United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 99

SEQ ID NO: 3520328 - RNA, 19 nt, Pseudomonas aeruginosa PA01
caggucggcgucuuccggc

SEQ ID NO: 3520329 - RNA, 14 nt, Pseudomonas aeruginosa PA01
caggucgggcaacg

SEQ ID NO: 3520330 - RNA, 19 nt, Pseudomonas aeruginosa PA01
caggucgggcaacggcugg

SEQ ID NO: 3520331 - RNA, 15 nt, Pseudomonas aeruginosa PA01
caggucgguccgccg

SEQ ID NO: 3520332 - RNA, 16 nt, Pseudomonas aeruginosa PA01
caggucgguccgccga

SEQ ID NO: 3520333 - RNA, 14 nt, Pseudomonas aeruginosa PA01
caggucggucggcg

SEQ ID NO: 3520334 - RNA, 19 nt, Pseudomonas aeruginosa PA01
caggucggucggcggcggu

SEQ ID NO: 3520335 - RNA, 17 nt, Pseudomonas aeruginosa PA01
caggucgguguugcgcu

SEQ ID NO: 3520336 - RNA, 12 nt, Pseudomonas aeruginosa PA01
caggucgucgcg

SEQ ID NO: 3520337 - RNA, 17 nt, Pseudomonas aeruginosa PA01
caggucgucgcgcuuga

SEQ ID NO: 3520338 - RNA, 14 nt, Pseudomonas aeruginosa PA01
caggucgucggcga

SEQ ID NO: 3520339 - RNA, 21 nt, Pseudomonas aeruginosa PA01
caggucgugcagcccggucac

SEQ ID NO: 3520340 - RNA, 19 nt, Pseudomonas aeruginosa PA01
caggucguugacgaucugc

SEQ ID NO: 3520341 - RNA, 18 nt, Pseudomonas aeruginosa PA01
caggucguugcgccggcc

SEQ ID NO: 3520342 - RNA, 22 nt, Pseudomonas aeruginosa PA01
caggucguugcgccggcccagc

SEQ ID NO: 3520343 - RNA, 15 nt, Pseudomonas aeruginosa PA01
caggucucaccgccc

SEQ ID NO: 3520344 - RNA, 13 nt, Pseudomonas aeruginosa PA01
caggucucgacgc

SEQ ID NO: 3520345 - RNA, 20 nt, Pseudomonas aeruginosa PA01
caggucuguggaggcgcaaa

SEQ ID NO: 3520346 - RNA, 16 nt, Pseudomonas aeruginosa PA01
caggucuucuggaaau

SEQ ID NO: 3520347 - RNA, 18 nt, Pseudomonas aeruginosa PA01
caggucuugucgcggguc

SEQ ID NO: 3520348 - RNA, 16 nt, Pseudomonas aeruginosa PA01
caggugacgcagggcg

SEQ ID NO: 3520349 - RNA, 21 nt, Pseudomonas aeruginosa PA01
caggugagggcgacccagcgc

SEQ ID NO: 3520350 - RNA, 13 nt, Pseudomonas aeruginosa PA01
caggugcaccgcg

SEQ ID NO: 3520351 - RNA, 18 nt, Pseudomonas aeruginosa PA01
caggugcacggccaggcc

SEQ ID NO: 3520352 - RNA, 14 nt, Pseudomonas aeruginosa PA01
caggugcagcgagg

SEQ ID NO: 3520353 - RNA, 15 nt, Pseudomonas aeruginosa PA01
caggugcaggaacag

SEQ ID NO: 3520354 - RNA, 19 nt, Pseudomonas aeruginosa PA01
caggugcaggaacagccag

SEQ ID NO: 3520355 - RNA, 17 nt, Pseudomonas aeruginosa PA01
caggugcauguagcgcu

SEQ ID NO: 3520356 - RNA, 23 nt, Pseudomonas aeruginosa PA01
caggugcccuggcagacgcugcu

SEQ ID NO: 3520357 - RNA, 14 nt, Pseudomonas aeruginosa PA01
caggugccgcucgu

SEQ ID NO: 3520358 - RNA, 20 nt, Pseudomonas aeruginosa PA01
caggugcgagucaccccgac

SEQ ID NO: 3520359 - RNA, 12 nt, Pseudomonas aeruginosa PA01
caggugcgcagg

SEQ ID NO: 3520360 - RNA, 15 nt, Pseudomonas aeruginosa PA01
caggugcgccgagcg

SEQ ID NO: 3520361 - RNA, 17 nt, Pseudomonas aeruginosa PA01
caggugcgccgagcgcu

SEQ ID NO: 3520362 - RNA, 12 nt, Pseudomonas aeruginosa PA01
caggugcgcugg

SEQ ID NO: 3520363 - RNA, 19 nt, Pseudomonas aeruginosa PA01
caggugcgcugguuggcga

SEQ ID NO: 3520364 - RNA, 22 nt, Pseudomonas aeruginosa PA01
caggugcgcugguuggcgaggu

SEQ ID NO: 3520365 - RNA, 12 nt, Pseudomonas aeruginosa PA01
caggugcggcug

SEQ ID NO: 3520366 - RNA, 17 nt, Pseudomonas aeruginosa PA01
caggugcggcugggugu

SEQ ID NO: 3520367 - RNA, 21 nt, Pseudomonas aeruginosa PA01
caggugcguacuuggcccggc

SEQ ID NO: 3520368 - RNA, 20 nt, Pseudomonas aeruginosa PA01
caggugcuggucguggucca

SEQ ID NO: 3520369 - RNA, 21 nt, Pseudomonas aeruginosa PA01
caggugcugguggcccugggc

SEQ ID NO: 3520370 - RNA, 23 nt, Pseudomonas aeruginosa PA01
caggugcuucacgaauacccggu

SEQ ID NO: 3520371 - RNA, 16 nt, Pseudomonas aeruginosa PA01
caggugcuuggcaccg

SEQ ID NO: 3520372 - RNA, 18 nt, Pseudomonas aeruginosa PA01
caggugcuuggcaccgcg

SEQ ID NO: 3520373 - RNA, 22 nt, Pseudomonas aeruginosa PA01
caggugcuuggcuucgagcugc

SEQ ID NO: 3520374 - RNA, 14 nt, Pseudomonas aeruginosa PA01
caggugcuugucac

SEQ ID NO: 3520375 - RNA, 22 nt, Pseudomonas aeruginosa PA01
caggugcuugucacgcucggca

SEQ ID NO: 3520376 - RNA, 13 nt, Pseudomonas aeruginosa PA01
cagguggaagcgc

SEQ ID NO: 3520377 - RNA, 16 nt, Pseudomonas aeruginosa PA01
cagguggaagcgcgcg

SEQ ID NO: 3520378 - RNA, 17 nt, Pseudomonas aeruginosa PA01
cagguggaagcgcgcgu

SEQ ID NO: 3520379 - RNA, 23 nt, Pseudomonas aeruginosa PA01
cagguggaagcgcgcgucggcgg

SEQ ID NO: 3520380 - RNA, 17 nt, Pseudomonas aeruginosa PA01
cagguggaucgcggcgu

SEQ ID NO: 3520381 - RNA, 23 nt, Pseudomonas aeruginosa PA01
cagguggaucgcggcguaggcgc

SEQ ID NO: 3520382 - RNA, 15 nt, Pseudomonas aeruginosa PA01
cagguggcaggccug

SEQ ID NO: 3520383 - RNA, 16 nt, Pseudomonas aeruginosa PA01
cagguggcaggccugg

SEQ ID NO: 3520384 - RNA, 17 nt, Pseudomonas aeruginosa PA01
cagguggcgggucggcg

SEQ ID NO: 3520385 - RNA, 18 nt, Pseudomonas aeruginosa PA01
cagguggcgggucggcgg

SEQ ID NO: 3520386 - RNA, 20 nt, Pseudomonas aeruginosa PA01
cagguggcgggucggcggau

SEQ ID NO: 3520387 - RNA, 16 nt, Pseudomonas aeruginosa PA01
cagguggcuggccaug

SEQ ID NO: 3520388 - RNA, 15 nt, Pseudomonas aeruginosa PA01
cagguggcuggucag

SEQ ID NO: 3520389 - RNA, 13 nt, Pseudomonas aeruginosa PA01
cagguggcuuucc

SEQ ID NO: 3520390 - RNA, 17 nt, Pseudomonas aeruginosa PA01
cagguggcuuuccagca

SEQ ID NO: 3520391 - RNA, 19 nt, Pseudomonas aeruginosa PA01
caggugggucacgucggcg

SEQ ID NO: 3520392 - RNA, 18 nt, Pseudomonas aeruginosa PA01
cagguggucgaucuccuc

SEQ ID NO: 3520393 - RNA, 21 nt, Pseudomonas aeruginosa PA01
cagguggucgaucuccuccuc

SEQ ID NO: 3520394 - RNA, 17 nt, Pseudomonas aeruginosa PA01
caggugguggcggaucu

SEQ ID NO: 3520395 - RNA, 22 nt, Pseudomonas aeruginosa PA01
cagguggugguagagcggcacc

SEQ ID NO: 3520396 - RNA, 15 nt, Pseudomonas aeruginosa PA01
cagguguacaucggg

SEQ ID NO: 3520397 - RNA, 18 nt, Pseudomonas aeruginosa PA01
cagguguucggccccggc

SEQ ID NO: 3520398 - RNA, 20 nt, Pseudomonas aeruginosa PA01
cagguguucggccccggcca

SEQ ID NO: 3520399 - RNA, 22 nt, Pseudomonas aeruginosa PA01
cagguguucggccccggccagg

SEQ ID NO: 3520400 - RNA, 23 nt, Pseudomonas aeruginosa PA01
cagguguucggccccggccaggu

SEQ ID NO: 3520401 - RNA, 16 nt, Pseudomonas aeruginosa PA01
cagguguucggcggcg

SEQ ID NO: 3520402 - RNA, 19 nt, Pseudomonas aeruginosa PA01
cagguguucggcggcgugc

SEQ ID NO: 3520403 - RNA, 20 nt, Pseudomonas aeruginosa PA01
cagguguucguccagaugcu

SEQ ID NO: 3520404 - RNA, 17 nt, Pseudomonas aeruginosa PA01
cagguucagcaggucgc

SEQ ID NO: 3520405 - RNA, 20 nt, Pseudomonas aeruginosa PA01
cagguucagcaggucgcggc

SEQ ID NO: 3520406 - RNA, 21 nt, Pseudomonas aeruginosa PA01
cagguucaggguggcgaucac

SEQ ID NO: 3520407 - RNA, 17 nt, Pseudomonas aeruginosa PA01
cagguucaucgccgcca

SEQ ID NO: 3520408 - RNA, 13 nt, Pseudomonas aeruginosa PA01
cagguuccuccug

SEQ ID NO: 3520409 - RNA, 15 nt, Pseudomonas aeruginosa PA01
cagguuccuccuggg

SEQ ID NO: 3520410 - RNA, 16 nt, Pseudomonas aeruginosa PA01
cagguuccuccugggc

SEQ ID NO: 3520411 - RNA, 21 nt, Pseudomonas aeruginosa PA01
cagguuccuccugggccgacg

SEQ ID NO: 3520412 - RNA, 21 nt, Pseudomonas aeruginosa PA01
cagguucgaaugcugcccgga

SEQ ID NO: 3520413 - RNA, 16 nt, Pseudomonas aeruginosa PA01
cagguucggcagcgcc

SEQ ID NO: 3520414 - RNA, 17 nt, Pseudomonas aeruginosa PA01
cagguucggcagcgccu

SEQ ID NO: 3520415 - RNA, 17 nt, Pseudomonas aeruginosa PA01
cagguucggcgccagcu

SEQ ID NO: 3520416 - RNA, 21 nt, Pseudomonas aeruginosa PA01
cagguucggcgguagcgcgaa

SEQ ID NO: 3520417 - RNA, 21 nt, Pseudomonas aeruginosa PA01
cagguucugccagagcgcugc

SEQ ID NO: 3520418 - RNA, 18 nt, Pseudomonas aeruginosa PA01
cagguugaagaacggccc

SEQ ID NO: 3520419 - RNA, 19 nt, Pseudomonas aeruginosa PA01
cagguugaagaacggcccg

SEQ ID NO: 3520420 - RNA, 21 nt, Pseudomonas aeruginosa PA01
cagguugaagaacggcccgcu

SEQ ID NO: 3520421 - RNA, 19 nt, Pseudomonas aeruginosa PA01
cagguugaccccgcggccg

SEQ ID NO: 3520422 - RNA, 21 nt, Pseudomonas aeruginosa PA01
cagguugaccccgcggccgag

SEQ ID NO: 3520423 - RNA, 17 nt, Pseudomonas aeruginosa PA01
cagguugaccuucuguc

SEQ ID NO: 3520424 - RNA, 18 nt, Pseudomonas aeruginosa PA01
cagguugaccuucugucc

SEQ ID NO: 3520425 - RNA, 18 nt, Pseudomonas aeruginosa PA01
cagguugacgaugcggcc

SEQ ID NO: 3520426 - RNA, 15 nt, Pseudomonas aeruginosa PA01
cagguugagggccgc

SEQ ID NO: 3520427 - RNA, 16 nt, Pseudomonas aeruginosa PA01
cagguugagggccgcg

SEQ ID NO: 3520428 - RNA, 24 nt, Pseudomonas aeruginosa PA01
cagguugauccugggcgccagccg

SEQ ID NO: 3520429 - RNA, 16 nt, Pseudomonas aeruginosa PA01
cagguugcacggccgg

SEQ ID NO: 3520430 - RNA, 16 nt, Pseudomonas aeruginosa PA01
cagguugccggcgugc

SEQ ID NO: 3520431 - RNA, 14 nt, Pseudomonas aeruginosa PA01
cagguugcgcaacc

SEQ ID NO: 3520432 - RNA, 19 nt, Pseudomonas aeruginosa PA01
cagguugcgcaaccagcgc

SEQ ID NO: 3520433 - RNA, 12 nt, Pseudomonas aeruginosa PA01
cagguugcgcug

SEQ ID NO: 3520434 - RNA, 14 nt, Pseudomonas aeruginosa PA01
cagguugcuggcga

SEQ ID NO: 3520435 - RNA, 17 nt, Pseudomonas aeruginosa PA01
cagguuggccccgccga

SEQ ID NO: 3520436 - RNA, 21 nt, Pseudomonas aeruginosa PA01
cagguuggccccgccgaggaa

SEQ ID NO: 3520437 - RNA, 20 nt, Pseudomonas aeruginosa PA01
cagguuggccuggcccggcg

SEQ ID NO: 3520438 - RNA, 16 nt, Pseudomonas aeruginosa PA01
cagguuggcgccgggc

SEQ ID NO: 3520439 - RNA, 17 nt, Pseudomonas aeruginosa PA01
cagguuggcgccgggcg

SEQ ID NO: 3520440 - RNA, 14 nt, Pseudomonas aeruginosa PA01
cagguuggucugcu

SEQ ID NO: 3520441 - RNA, 19 nt, Pseudomonas aeruginosa PA01
cagguuuccggcagcacgu

SEQ ID NO: 3520442 - RNA, 19 nt, Pseudomonas aeruginosa PA01
caguaacgccugucgcucc

SEQ ID NO: 3520443 - RNA, 16 nt, Pseudomonas aeruginosa PA01
caguacagcucggcgc

SEQ ID NO: 3520444 - RNA, 17 nt, Pseudomonas aeruginosa PA01
caguacagcucggcgcc

SEQ ID NO: 3520445 - RNA, 18 nt, Pseudomonas aeruginosa PA01
caguacagcucggcgccc

SEQ ID NO: 3520446 - RNA, 16 nt, Pseudomonas aeruginosa PA01
caguacagcugcaccg

SEQ ID NO: 3520447 - RNA, 19 nt, Pseudomonas aeruginosa PA01
caguaccagcaaugcccag

SEQ ID NO: 3520448 - RNA, 13 nt, Pseudomonas aeruginosa PA01
caguacccggccg

SEQ ID NO: 3520449 - RNA, 14 nt, Pseudomonas aeruginosa PA01
caguacccggccgc

SEQ ID NO: 3520450 - RNA, 14 nt, Pseudomonas aeruginosa PA01
caguaccggcagcg

SEQ ID NO: 3520451 - RNA, 17 nt, Pseudomonas aeruginosa PA01
caguaccggcagcgccg

SEQ ID NO: 3520452 - RNA, 19 nt, Pseudomonas aeruginosa PA01
caguaccuggcgguacagc

SEQ ID NO: 3520453 - RNA, 22 nt, Pseudomonas aeruginosa PA01
caguaccuggcgguacagcccc

SEQ ID NO: 3520454 - RNA, 23 nt, Pseudomonas aeruginosa PA01
caguaccuggcgguacagccccc

SEQ ID NO: 3520455 - RNA, 23 nt, Pseudomonas aeruginosa PA01
caguaccuuccauuucgaagcug

SEQ ID NO: 3520456 - RNA, 17 nt, Pseudomonas aeruginosa PA01
caguacgaucagccagg

SEQ ID NO: 3520457 - RNA, 14 nt, Pseudomonas aeruginosa PA01
caguacgcucuggg

SEQ ID NO: 3520458 - RNA, 17 nt, Pseudomonas aeruginosa PA01
caguacgucgagaccga

SEQ ID NO: 3520459 - RNA, 23 nt, Pseudomonas aeruginosa PA01
caguacguggcgcuugagcagcc

SEQ ID NO: 3520460 - RNA, 16 nt, Pseudomonas aeruginosa PA01
caguacuccgagggcc

SEQ ID NO: 3520461 - RNA, 17 nt, Pseudomonas aeruginosa PA01
caguacuugaacagcag

SEQ ID NO: 3520462 - RNA, 16 nt, Pseudomonas aeruginosa PA01
caguacuuggccagca

SEQ ID NO: 3520463 - RNA, 18 nt, Pseudomonas aeruginosa PA01
caguacuuggccagcagc

SEQ ID NO: 3520464 - RNA, 16 nt, Pseudomonas aeruginosa PA01
caguagagauguacag

SEQ ID NO: 3520465 - RNA, 17 nt, Pseudomonas aeruginosa PA01
caguagaugccgcgucg

SEQ ID NO: 3520466 - RNA, 13 nt, Pseudomonas aeruginosa PA01
caguagcgccugg

SEQ ID NO: 3520467 - RNA, 14 nt, Pseudomonas aeruginosa PA01
caguagcggcaggg

SEQ ID NO: 3520468 - RNA, 21 nt, Pseudomonas aeruginosa PA01
caguagcgggcauccagcgga

SEQ ID NO: 3520469 - RNA, 19 nt, Pseudomonas aeruginosa PA01
caguagcuguugugucccg

SEQ ID NO: 3520470 - RNA, 15 nt, Pseudomonas aeruginosa PA01
caguaggcgcugccg

SEQ ID NO: 3520471 - RNA, 22 nt, Pseudomonas aeruginosa PA01
caguagguagagaugcagcagg

SEQ ID NO: 3520472 - RNA, 23 nt, Pseudomonas aeruginosa PA01
caguagguagagaugcagcaggu

SEQ ID NO: 3520473 - RNA, 16 nt, Pseudomonas aeruginosa PA01
caguaguucuccaccg

SEQ ID NO: 3520474 - RNA, 19 nt, Pseudomonas aeruginosa PA01
caguaguucuccaccgcca

SEQ ID NO: 3520475 - RNA, 14 nt, Pseudomonas aeruginosa PA01
cagucaccaggucg

SEQ ID NO: 3520476 - RNA, 21 nt, Pseudomonas aeruginosa PA01
cagucagaacacacgaauggc

SEQ ID NO: 3520477 - RNA, 15 nt, Pseudomonas aeruginosa PA01
cagucaggaucggcg

SEQ ID NO: 3520478 - RNA, 16 nt, Pseudomonas aeruginosa PA01
cagucaggaucggcgc

SEQ ID NO: 3520479 - RNA, 20 nt, Pseudomonas aeruginosa PA01
caguccaucguucaguugcc

SEQ ID NO: 3520480 - RNA, 13 nt, Pseudomonas aeruginosa PA01
cagucccaggcca

SEQ ID NO: 3520481 - RNA, 23 nt, Pseudomonas aeruginosa PA01
cagucccaggccaaccaccccga

SEQ ID NO: 3520482 - RNA, 18 nt, Pseudomonas aeruginosa PA01
cagucccgcaaagcccgc

SEQ ID NO: 3520483 - RNA, 19 nt, Pseudomonas aeruginosa PA01
cagucccgcaaagcccgcu

SEQ ID NO: 3520484 - RNA, 14 nt, Pseudomonas aeruginosa PA01
cagucccgccaggc

SEQ ID NO: 3520485 - RNA, 16 nt, Pseudomonas aeruginosa PA01
cagucccgccaggcgc

SEQ ID NO: 3520486 - RNA, 19 nt, Pseudomonas aeruginosa PA01
cagucccgccaggcgccga

SEQ ID NO: 3520487 - RNA, 16 nt, Pseudomonas aeruginosa PA01
cagucccgcgcggccc

SEQ ID NO: 3520488 - RNA, 16 nt, Pseudomonas aeruginosa PA01
cagucccgcggcgcgu

SEQ ID NO: 3520489 - RNA, 19 nt, Pseudomonas aeruginosa PA01
cagucccggcuugccggca

SEQ ID NO: 3520490 - RNA, 15 nt, Pseudomonas aeruginosa PA01
cagucccugccaggg

SEQ ID NO: 3520491 - RNA, 16 nt, Pseudomonas aeruginosa PA01
cagucccugccagggg

SEQ ID NO: 3520492 - RNA, 13 nt, Pseudomonas aeruginosa PA01
cagucccuggccg

SEQ ID NO: 3520493 - RNA, 15 nt, Pseudomonas aeruginosa PA01
cagucccuggccggc

SEQ ID NO: 3520494 - RNA, 16 nt, Pseudomonas aeruginosa PA01
cagucccuggccggcg

SEQ ID NO: 3520495 - RNA, 22 nt, Pseudomonas aeruginosa PA01
cagucccuggccggcgauggcc

SEQ ID NO: 3520496 - RNA, 23 nt, Pseudomonas aeruginosa PA01
cagucccuggccggcgauggccg

SEQ ID NO: 3520497 - RNA, 23 nt, Pseudomonas aeruginosa PA01
cagucccuucagcgcaccgcccu

SEQ ID NO: 3520498 - RNA, 16 nt, Pseudomonas aeruginosa PA01
caguccggcagcacgg

SEQ ID NO: 3520499 - RNA, 18 nt, Pseudomonas aeruginosa PA01
caguccggguugacccag

SEQ ID NO: 3520500 - RNA, 21 nt, Pseudomonas aeruginosa PA01
caguccgguagcgcgccugcu

SEQ ID NO: 3520501 - RNA, 23 nt, Pseudomonas aeruginosa PA01
caguccgguagcgcgccugcuuu

SEQ ID NO: 3520502 - RNA, 21 nt, Pseudomonas aeruginosa PA01
caguccucguacaugcgcgag

SEQ ID NO: 3520503 - RNA, 13 nt, Pseudomonas aeruginosa PA01
caguccuggaccc

SEQ ID NO: 3520504 - RNA, 20 nt, Pseudomonas aeruginosa PA01
caguccuggcgguagcccgg

SEQ ID NO: 3520505 - RNA, 19 nt, Pseudomonas aeruginosa PA01
caguccuugagcgccagca

SEQ ID NO: 3520506 - RNA, 21 nt, Pseudomonas aeruginosa PA01
caguccuugagcgccagcagg

SEQ ID NO: 3520507 - RNA, 17 nt, Pseudomonas aeruginosa PA01
cagucgaaaaccggcgg

SEQ ID NO: 3520508 - RNA, 18 nt, Pseudomonas aeruginosa PA01
cagucgaaaaccggcggg

SEQ ID NO: 3520509 - RNA, 19 nt, Pseudomonas aeruginosa PA01
cagucgaaaaccggcgggc

SEQ ID NO: 3520510 - RNA, 19 nt, Pseudomonas aeruginosa PA01
cagucgaccgucgccacgc

SEQ ID NO: 3520511 - RNA, 18 nt, Pseudomonas aeruginosa PA01
cagucgagacgccagccg

SEQ ID NO: 3520512 - RNA, 17 nt, Pseudomonas aeruginosa PA01
cagucgagcaugucgcu

SEQ ID NO: 3520513 - RNA, 20 nt, Pseudomonas aeruginosa PA01
cagucgaugacgaggcccgc

SEQ ID NO: 3520514 - RNA, 14 nt, Pseudomonas aeruginosa PA01
cagucgcacagcca

SEQ ID NO: 3520515 - RNA, 15 nt, Pseudomonas aeruginosa PA01
cagucgcacagccag

SEQ ID NO: 3520516 - RNA, 16 nt, Pseudomonas aeruginosa PA01
cagucgcacagccagg

SEQ ID NO: 3520517 - RNA, 18 nt, Pseudomonas aeruginosa PA01
cagucgcacagccagggg

SEQ ID NO: 3520518 - RNA, 19 nt, Pseudomonas aeruginosa PA01
cagucgcacagccaggggc

SEQ ID NO: 3520519 - RNA, 23 nt, Pseudomonas aeruginosa PA01
cagucgcauaaaaaagccccgcu

SEQ ID NO: 3520520 - RNA, 16 nt, Pseudomonas aeruginosa PA01
cagucgcccccaccgc

SEQ ID NO: 3520521 - RNA, 18 nt, Pseudomonas aeruginosa PA01
cagucgcccgcuucgcca

SEQ ID NO: 3520522 - RNA, 17 nt, Pseudomonas aeruginosa PA01
cagucgccgcaccggcg

SEQ ID NO: 3520523 - RNA, 12 nt, Pseudomonas aeruginosa PA01
cagucgccuggc

SEQ ID NO: 3520524 - RNA, 18 nt, Pseudomonas aeruginosa PA01
cagucgcggaagcggcaa

SEQ ID NO: 3520525 - RNA, 18 nt, Pseudomonas aeruginosa PA01
cagucgcuuccgcgcggc

SEQ ID NO: 3520526 - RNA, 18 nt, Pseudomonas aeruginosa PA01
cagucggcaccgaucgcc

SEQ ID NO: 3520527 - RNA, 19 nt, Pseudomonas aeruginosa PA01
cagucggcaccgaucgccc

SEQ ID NO: 3520528 - RNA, 21 nt, Pseudomonas aeruginosa PA01
cagucggcaccgaucgcccgc

SEQ ID NO: 3520529 - RNA, 15 nt, Pseudomonas aeruginosa PA01
cagucggccaggcgc

SEQ ID NO: 3520530 - RNA, 16 nt, Pseudomonas aeruginosa PA01
cagucggccaggcgcc

SEQ ID NO: 3520531 - RNA, 18 nt, Pseudomonas aeruginosa PA01
cagucggccaggcgccag

SEQ ID NO: 3520532 - RNA, 19 nt, Pseudomonas aeruginosa PA01
cagucggccaggcgccagg

SEQ ID NO: 3520533 - RNA, 16 nt, Pseudomonas aeruginosa PA01
cagucggcggucuuga

SEQ ID NO: 3520534 - RNA, 19 nt, Pseudomonas aeruginosa PA01
cagucggcguccgccucgc

SEQ ID NO: 3520535 - RNA, 14 nt, Pseudomonas aeruginosa PA01
cagucggggcaggc

SEQ ID NO: 3520536 - RNA, 15 nt, Pseudomonas aeruginosa PA01
cagucggggcaggcg

SEQ ID NO: 3520537 - RNA, 16 nt, Pseudomonas aeruginosa PA01
cagucggggcaggcgc

SEQ ID NO: 3520538 - RNA, 17 nt, Pseudomonas aeruginosa PA01
cagucggggcaggcgca

SEQ ID NO: 3520539 - RNA, 22 nt, Pseudomonas aeruginosa PA01
cagucggggcaggcgcaggcga

SEQ ID NO: 3520540 - RNA, 22 nt, Pseudomonas aeruginosa PA01
cagucgguagaaauccuccgga

SEQ ID NO: 3520541 - RNA, 16 nt, Pseudomonas aeruginosa PA01
cagucgguagagcagu

SEQ ID NO: 3520542 - RNA, 19 nt, Pseudomonas aeruginosa PA01
cagucgguuagaauaccgg

SEQ ID NO: 3520543 - RNA, 19 nt, Pseudomonas aeruginosa PA01
cagucguagcgcaguugcc

SEQ ID NO: 3520544 - RNA, 19 nt, Pseudomonas aeruginosa PA01
cagucguaggucugcccga

SEQ ID NO: 3520545 - RNA, 16 nt, Pseudomonas aeruginosa PA01
cagucgucgcagccga

SEQ ID NO: 3520546 - RNA, 20 nt, Pseudomonas aeruginosa PA01
cagucgucgcgcagcuccuc

SEQ ID NO: 3520547 - RNA, 21 nt, Pseudomonas aeruginosa PA01
cagucgucguccagcgggccc

SEQ ID NO: 3520548 - RNA, 14 nt, Pseudomonas aeruginosa PA01
cagucuucgccggc

SEQ ID NO: 3520549 - RNA, 15 nt, Pseudomonas aeruginosa PA01
cagucuucgccggcc

SEQ ID NO: 3520550 - RNA, 22 nt, Pseudomonas aeruginosa PA01
cagucuucgccggccugcgcgc

SEQ ID NO: 3520551 - RNA, 20 nt, Pseudomonas aeruginosa PA01
cagugagaagauccuguagu

SEQ ID NO: 3520552 - RNA, 14 nt, Pseudomonas aeruginosa PA01
cagugcaccgccgg

SEQ ID NO: 3520553 - RNA, 20 nt, Pseudomonas aeruginosa PA01
cagugcacguuccagcucgg

SEQ ID NO: 3520554 - RNA, 16 nt, Pseudomonas aeruginosa PA01
cagugcaucggccgcc

SEQ ID NO: 3520555 - RNA, 17 nt, Pseudomonas aeruginosa PA01
cagugcaucggccgcca

SEQ ID NO: 3520556 - RNA, 19 nt, Pseudomonas aeruginosa PA01
cagugcaucggccgccagg

SEQ ID NO: 3520557 - RNA, 20 nt, Pseudomonas aeruginosa PA01
cagugccaggcucgccgcca

SEQ ID NO: 3520558 - RNA, 14 nt, Pseudomonas aeruginosa PA01
cagugccucccggc

SEQ ID NO: 3520559 - RNA, 15 nt, Pseudomonas aeruginosa PA01
cagugccucccggcc

SEQ ID NO: 3520560 - RNA, 23 nt, Pseudomonas aeruginosa PA01
cagugccugcaccacgcaggcgc

SEQ ID NO: 3520561 - RNA, 16 nt, Pseudomonas aeruginosa PA01
cagugcgagucggcga

SEQ ID NO: 3520562 - RNA, 19 nt, Pseudomonas aeruginosa PA01
cagugcgagucggcgacga

SEQ ID NO: 3520563 - RNA, 11 nt, Pseudomonas aeruginosa PA01
cagugcgcccu

SEQ ID NO: 3520564 - RNA, 14 nt, Pseudomonas aeruginosa PA01
cagugcgcccucga

SEQ ID NO: 3520565 - RNA, 15 nt, Pseudomonas aeruginosa PA01
cagugcgccgcagcg

SEQ ID NO: 3520566 - RNA, 19 nt, Pseudomonas aeruginosa PA01
cagugcgccggcaucgcca

SEQ ID NO: 3520567 - RNA, 12 nt, Pseudomonas aeruginosa PA01
cagugcgccggg

SEQ ID NO: 3520568 - RNA, 13 nt, Pseudomonas aeruginosa PA01
cagugcgccgggu

SEQ ID NO: 3520569 - RNA, 20 nt, Pseudomonas aeruginosa PA01
cagugcgcgguccgcguggu

SEQ ID NO: 3520570 - RNA, 15 nt, Pseudomonas aeruginosa PA01
cagugcggcagucgg

SEQ ID NO: 3520571 - RNA, 20 nt, Pseudomonas aeruginosa PA01
cagugcggggcgcucgcccu

SEQ ID NO: 3520572 - RNA, 15 nt, Pseudomonas aeruginosa PA01
cagugcguaguccuu

SEQ ID NO: 3520573 - RNA, 24 nt, Pseudomonas aeruginosa PA01
cagugcucccgcaaccugccagaa

SEQ ID NO: 3520574 - RNA, 18 nt, Pseudomonas aeruginosa PA01
cagugcuugagcggaucg

SEQ ID NO: 3520575 - RNA, 23 nt, Pseudomonas aeruginosa PA01
caguggaucguugaacuggaugu

SEQ ID NO: 3520576 - RNA, 13 nt, Pseudomonas aeruginosa PA01
caguggcgccagc

SEQ ID NO: 3520577 - RNA, 15 nt, Pseudomonas aeruginosa PA01
caguggcgccgccau

SEQ ID NO: 3520578 - RNA, 17 nt, Pseudomonas aeruginosa PA01
caguggcgccgccaugg

SEQ ID NO: 3520579 - RNA, 23 nt, Pseudomonas aeruginosa PA01
caguggcuccgcgcguucagcca

SEQ ID NO: 3520580 - RNA, 16 nt, Pseudomonas aeruginosa PA01
cagugggccaccggcu

SEQ ID NO: 3520581 - RNA, 17 nt, Pseudomonas aeruginosa PA01
caguggguaggccaggc

SEQ ID NO: 3520582 - RNA, 19 nt, Pseudomonas aeruginosa PA01
caguggguaggccaggcaa

SEQ ID NO: 3520583 - RNA, 22 nt, Pseudomonas aeruginosa PA01
cagugggucgaugcccucgcgg

SEQ ID NO: 3520584 - RNA, 21 nt, Pseudomonas aeruginosa PA01
caguggucgcagcuccagcgg

SEQ ID NO: 3520585 - RNA, 20 nt, Pseudomonas aeruginosa PA01
caguggugauccgcacccgc

SEQ ID NO: 3520586 - RNA, 16 nt, Pseudomonas aeruginosa PA01
cagugguuccaggagg

SEQ ID NO: 3520587 - RNA, 17 nt, Pseudomonas aeruginosa PA01
cagugguuccaggaggg

SEQ ID NO: 3520588 - RNA, 19 nt, Pseudomonas aeruginosa PA01
cagugguuccaggagggcu

SEQ ID NO: 3520589 - RNA, 16 nt, Pseudomonas aeruginosa PA01
cagugguuuuccugca

SEQ ID NO: 3520590 - RNA, 19 nt, Pseudomonas aeruginosa PA01
cagugucgcgaacucggcg

SEQ ID NO: 3520591 - RNA, 20 nt, Pseudomonas aeruginosa PA01
cagugucgcgaacucggcgc

SEQ ID NO: 3520592 - RNA, 12 nt, Pseudomonas aeruginosa PA01
caguucagccgg

SEQ ID NO: 3520593 - RNA, 13 nt, Pseudomonas aeruginosa PA01
caguucagcgcgc

SEQ ID NO: 3520594 - RNA, 14 nt, Pseudomonas aeruginosa PA01
caguucagcgcgcu

SEQ ID NO: 3520595 - RNA, 15 nt, Pseudomonas aeruginosa PA01
caguucagcgcgcuc

SEQ ID NO: 3520596 - RNA, 16 nt, Pseudomonas aeruginosa PA01
caguucaggcugggcc

SEQ ID NO: 3520597 - RNA, 21 nt, Pseudomonas aeruginosa PA01
caguucagggcgagcagggca

SEQ ID NO: 3520598 - RNA, 21 nt, Pseudomonas aeruginosa PA01
caguucagggcguagcggaag

SEQ ID NO: 3520599 - RNA, 15 nt, Pseudomonas aeruginosa PA01
caguucaucgagcag

SEQ ID NO: 3520600 - RNA, 20 nt, Pseudomonas aeruginosa PA01
caguuccacgaagaacgcca

SEQ ID NO: 3520601 - RNA, 21 nt, Pseudomonas aeruginosa PA01
caguuccagggucagcuggcg

SEQ ID NO: 3520602 - RNA, 17 nt, Pseudomonas aeruginosa PA01
caguucccccagcaccu

SEQ ID NO: 3520603 - RNA, 17 nt, Pseudomonas aeruginosa PA01
caguuccgcaucggcca

SEQ ID NO: 3520604 - RNA, 14 nt, Pseudomonas aeruginosa PA01
caguuccucgccgc

SEQ ID NO: 3520605 - RNA, 20 nt, Pseudomonas aeruginosa PA01
caguuccucgccgcugcugg

SEQ ID NO: 3520606 - RNA, 14 nt, Pseudomonas aeruginosa PA01
caguuccugcacca

SEQ ID NO: 3520607 - RNA, 16 nt, Pseudomonas aeruginosa PA01
caguuccugcaccacg

SEQ ID NO: 3520608 - RNA, 15 nt, Pseudomonas aeruginosa PA01
caguuccugcuccuc

SEQ ID NO: 3520609 - RNA, 22 nt, Pseudomonas aeruginosa PA01
caguuccugcuccuccgacgcc

SEQ ID NO: 3520610 - RNA, 18 nt, Pseudomonas aeruginosa PA01
caguuccuucaccggacg

SEQ ID NO: 3520611 - RNA, 13 nt, Pseudomonas aeruginosa PA01
caguuccuucacg

SEQ ID NO: 3520612 - RNA, 20 nt, Pseudomonas aeruginosa PA01
caguucgaccuccaggccga

SEQ ID NO: 3520613 - RNA, 23 nt, Pseudomonas aeruginosa PA01
caguucgaccuccaggccgaagc

SEQ ID NO: 3520614 - RNA, 16 nt, Pseudomonas aeruginosa PA01
caguucgccccgccgc

SEQ ID NO: 3520615 - RNA, 20 nt, Pseudomonas aeruginosa PA01
caguucgccccgccgccagg

SEQ ID NO: 3520616 - RNA, 22 nt, Pseudomonas aeruginosa PA01
caguucgccccgccgccaggcg

SEQ ID NO: 3520617 - RNA, 19 nt, Pseudomonas aeruginosa PA01
caguucgccgcccgaggcg

SEQ ID NO: 3520618 - RNA, 23 nt, Pseudomonas aeruginosa PA01
caguucgccgcccgaggcgaccu

SEQ ID NO: 3520619 - RNA, 14 nt, Pseudomonas aeruginosa PA01
caguucgcgcagga

SEQ ID NO: 3520620 - RNA, 21 nt, Pseudomonas aeruginosa PA01
caguucgcgcaggaccuggcu

SEQ ID NO: 3520621 - RNA, 13 nt, Pseudomonas aeruginosa PA01
caguucgcgggcc

SEQ ID NO: 3520622 - RNA, 15 nt, Pseudomonas aeruginosa PA01
caguucgcgggccgc

SEQ ID NO: 3520623 - RNA, 20 nt, Pseudomonas aeruginosa PA01
caguucgcgggccgcggcga

SEQ ID NO: 3520624 - RNA, 16 nt, Pseudomonas aeruginosa PA01
caguucggccagcggc

SEQ ID NO: 3520625 - RNA, 17 nt, Pseudomonas aeruginosa PA01
caguucggccagcggca

SEQ ID NO: 3520626 - RNA, 20 nt, Pseudomonas aeruginosa PA01
caguucggccaucagcacgu

SEQ ID NO: 3520627 - RNA, 18 nt, Pseudomonas aeruginosa PA01
caguucggcccagcagcg

SEQ ID NO: 3520628 - RNA, 20 nt, Pseudomonas aeruginosa PA01
caguucggcccagcagcgcu

SEQ ID NO: 3520629 - RNA, 19 nt, Pseudomonas aeruginosa PA01
caguucggcgaugaccagc

SEQ ID NO: 3520630 - RNA, 24 nt, Pseudomonas aeruginosa PA01
caguucggcgaugaccagcucggc

SEQ ID NO: 3520631 - RNA, 16 nt, Pseudomonas aeruginosa PA01
caguucggugccgccg

SEQ ID NO: 3520632 - RNA, 19 nt, Pseudomonas aeruginosa PA01
caguucggugccgccggcg

SEQ ID NO: 3520633 - RNA, 19 nt, Pseudomonas aeruginosa PA01
caguucguccaucgccagg

SEQ ID NO: 3520634 - RNA, 20 nt, Pseudomonas aeruginosa PA01
caguucgucgagggucugcu

SEQ ID NO: 3520635 - RNA, 22 nt, Pseudomonas aeruginosa PA01
caguucgucgaugaugccgucu

SEQ ID NO: 3520636 - RNA, 18 nt, Pseudomonas aeruginosa PA01
caguucgucgccacgccc

SEQ ID NO: 3520637 - RNA, 23 nt, Pseudomonas aeruginosa PA01
caguucgucgccacgcccgccgu

SEQ ID NO: 3520638 - RNA, 23 nt, Pseudomonas aeruginosa PA01
caguucgucgcccaucucggugu

SEQ ID NO: 3520639 - RNA, 19 nt, Pseudomonas aeruginosa PA01
caguucgucuuccagcggc

SEQ ID NO: 3520640 - RNA, 14 nt, Pseudomonas aeruginosa PA01
caguucgugccagg

SEQ ID NO: 3520641 - RNA, 23 nt, Pseudomonas aeruginosa PA01
caguucguucugggucgcgcagg

SEQ ID NO: 3520642 - RNA, 20 nt, Pseudomonas aeruginosa PA01
caguucguugaccacgcuca

SEQ ID NO: 3520643 - RNA, 15 nt, Pseudomonas aeruginosa PA01
caguucguugagcag

SEQ ID NO: 3520644 - RNA, 17 nt, Pseudomonas aeruginosa PA01
caguucucgcagcaggc

SEQ ID NO: 3520645 - RNA, 19 nt, Pseudomonas aeruginosa PA01
caguucucgcagcaggcgu

SEQ ID NO: 3520646 - RNA, 17 nt, Pseudomonas aeruginosa PA01
caguucugggcggccag

SEQ ID NO: 3520647 - RNA, 18 nt, Pseudomonas aeruginosa PA01
caguucugggcggccagg

SEQ ID NO: 3520648 - RNA, 16 nt, Pseudomonas aeruginosa PA01
caguucuucgccgccc

SEQ ID NO: 3520649 - RNA, 14 nt, Pseudomonas aeruginosa PA01
caguugagcugugg

SEQ ID NO: 3520650 - RNA, 13 nt, Pseudomonas aeruginosa PA01
caguugcaccgca

SEQ ID NO: 3520651 - RNA, 13 nt, Pseudomonas aeruginosa PA01
caguugcagggau

SEQ ID NO: 3520652 - RNA, 17 nt, Pseudomonas aeruginosa PA01
caguugcaguaccugcu

SEQ ID NO: 3520653 - RNA, 23 nt, Pseudomonas aeruginosa PA01
caguugcaguaccugcucacggc

SEQ ID NO: 3520654 - RNA, 14 nt, Pseudomonas aeruginosa PA01
caguugccaggagg

SEQ ID NO: 3520655 - RNA, 16 nt, Pseudomonas aeruginosa PA01
caguugccucugugcg

SEQ ID NO: 3520656 - RNA, 16 nt, Pseudomonas aeruginosa PA01
caguugcgccgccugc

SEQ ID NO: 3520657 - RNA, 19 nt, Pseudomonas aeruginosa PA01
caguugcgccgccugcggc

SEQ ID NO: 3520658 - RNA, 23 nt, Pseudomonas aeruginosa PA01
caguugcgccgccugcggcuugc

SEQ ID NO: 3520659 - RNA, 14 nt, Pseudomonas aeruginosa PA01
caguugcgcggcga

SEQ ID NO: 3520660 - RNA, 21 nt, Pseudomonas aeruginosa PA01
caguugcgcuccgguggcgga

SEQ ID NO: 3520661 - RNA, 14 nt, Pseudomonas aeruginosa PA01
caguugcgggcgca

SEQ ID NO: 3520662 - RNA, 17 nt, Pseudomonas aeruginosa PA01
caguugcucgcuccgag

SEQ ID NO: 3520663 - RNA, 23 nt, Pseudomonas aeruginosa PA01
caguugcucgcuccgagcaggcc

SEQ ID NO: 3520664 - RNA, 19 nt, Pseudomonas aeruginosa PA01
caguugcugaucaggccga

SEQ ID NO: 3520665 - RNA, 17 nt, Pseudomonas aeruginosa PA01
caguuggacgcggccug

SEQ ID NO: 3520666 - RNA, 18 nt, Pseudomonas aeruginosa PA01
caguuggacgcggccugg

SEQ ID NO: 3520667 - RNA, 23 nt, Pseudomonas aeruginosa PA01
caguuggacgcggccugggccga

SEQ ID NO: 3520668 - RNA, 16 nt, Pseudomonas aeruginosa PA01
caguuggacugcgagg

SEQ ID NO: 3520669 - RNA, 17 nt, Pseudomonas aeruginosa PA01
caguuggacugcgaggc

SEQ ID NO: 3520670 - RNA, 13 nt, Pseudomonas aeruginosa PA01
caguugggccagg

SEQ ID NO: 3520671 - RNA, 18 nt, Pseudomonas aeruginosa PA01
caguuggugcacgcgccg

SEQ ID NO: 3520672 - RNA, 20 nt, Pseudomonas aeruginosa PA01
caguuggugcacgcgccggg

SEQ ID NO: 3520673 - RNA, 14 nt, Pseudomonas aeruginosa PA01
caguuguuccgggu

SEQ ID NO: 3520674 - RNA, 18 nt, Pseudomonas aeruginosa PA01
caguuuucuaaccggcgu

SEQ ID NO: 3520675 - RNA, 21 nt, Pseudomonas aeruginosa PA01
cauaaccccuuugccgagcgg

SEQ ID NO: 3520676 - RNA, 13 nt, Pseudomonas aeruginosa PA01
cauaaccgcucgc

SEQ ID NO: 3520677 - RNA, 15 nt, Pseudomonas aeruginosa PA01
cauaaccggaagcga

SEQ ID NO: 3520678 - RNA, 21 nt, Pseudomonas aeruginosa PA01
cauacacaugcaggcucgaca

SEQ ID NO: 3520679 - RNA, 17 nt, Pseudomonas aeruginosa PA01
cauacaccaggccggcg

SEQ ID NO: 3520680 - RNA, 20 nt, Pseudomonas aeruginosa PA01
cauaccgacaugccccgccg

SEQ ID NO: 3520681 - RNA, 16 nt, Pseudomonas aeruginosa PA01
cauaccgccucggugg

SEQ ID NO: 3520682 - RNA, 13 nt, Pseudomonas aeruginosa PA01
cauaccuccagcc

SEQ ID NO: 3520683 - RNA, 16 nt, Pseudomonas aeruginosa PA01
cauacgaaaaaaaggc

SEQ ID NO: 3520684 - RNA, 19 nt, Pseudomonas aeruginosa PA01
cauacgaaaaaaaggcgcu

SEQ ID NO: 3520685 - RNA, 19 nt, Pseudomonas aeruginosa PA01
cauacgaaaacggcccuca

SEQ ID NO: 3520686 - RNA, 19 nt, Pseudomonas aeruginosa PA01
cauacguccuacgaaggca

SEQ ID NO: 3520687 - RNA, 22 nt, Pseudomonas aeruginosa PA01
cauagaaacgcagggccucuuc

SEQ ID NO: 3520688 - RNA, 13 nt, Pseudomonas aeruginosa PA01
cauagaccagcag

SEQ ID NO: 3520689 - RNA, 21 nt, Pseudomonas aeruginosa PA01
cauagaccagcagcgagcagg

SEQ ID NO: 3520690 - RNA, 20 nt, Pseudomonas aeruginosa PA01
cauagagugcccaggcgcug

SEQ ID NO: 3520691 - RNA, 23 nt, Pseudomonas aeruginosa PA01
cauagaguugcuuggcgcgcugg

SEQ ID NO: 3520692 - RNA, 15 nt, Pseudomonas aeruginosa PA01
cauagaugaaggcuu

SEQ ID NO: 3520693 - RNA, 12 nt, Pseudomonas aeruginosa PA01
cauagcagcgcc

SEQ ID NO: 3520694 - RNA, 24 nt, Pseudomonas aeruginosa PA01
cauagcaggccuggagcgccucga

SEQ ID NO: 3520695 - RNA, 13 nt, Pseudomonas aeruginosa PA01
cauagccaccgcc

SEQ ID NO: 3520696 - RNA, 20 nt, Pseudomonas aeruginosa PA01
cauagccgaacuccgccagc

SEQ ID NO: 3520697 - RNA, 14 nt, Pseudomonas aeruginosa PA01
cauagccggcgaac

SEQ ID NO: 3520698 - RNA, 13 nt, Pseudomonas aeruginosa PA01
cauagccggcgcg

SEQ ID NO: 3520699 - RNA, 19 nt, Pseudomonas aeruginosa PA01
cauagccggcgcgcccggc

SEQ ID NO: 3520700 - RNA, 19 nt, Pseudomonas aeruginosa PA01
cauagccguugucggugau

SEQ ID NO: 3520701 - RNA, 13 nt, Pseudomonas aeruginosa PA01
cauagcgcagcac

SEQ ID NO: 3520702 - RNA, 15 nt, Pseudomonas aeruginosa PA01
cauagcgcagcaccg

SEQ ID NO: 3520703 - RNA, 13 nt, Pseudomonas aeruginosa PA01
cauagcgcagccg

SEQ ID NO: 3520704 - RNA, 14 nt, Pseudomonas aeruginosa PA01
cauagcgcagccgc

SEQ ID NO: 3520705 - RNA, 13 nt, Pseudomonas aeruginosa PA01
cauagcucagcug

SEQ ID NO: 3520706 - RNA, 14 nt, Pseudomonas aeruginosa PA01
cauagcucagcugg

SEQ ID NO: 3520707 - RNA, 19 nt, Pseudomonas aeruginosa PA01
cauaggacugccaacuggc

SEQ ID NO: 3520708 - RNA, 23 nt, Pseudomonas aeruginosa PA01
cauaggccugggcguacaggccc

SEQ ID NO: 3520709 - RNA, 15 nt, Pseudomonas aeruginosa PA01
cauaggcggcgcaga

SEQ ID NO: 3520710 - RNA, 18 nt, Pseudomonas aeruginosa PA01
cauaggucaugcccaggc

SEQ ID NO: 3520711 - RNA, 21 nt, Pseudomonas aeruginosa PA01
cauaggucaugcccaggccga

SEQ ID NO: 3520712 - RNA, 15 nt, Pseudomonas aeruginosa PA01
cauagucggugaccu

SEQ ID NO: 3520713 - RNA, 21 nt, Pseudomonas aeruginosa PA01
cauagugcugggcgaccuuca

SEQ ID NO: 3520714 - RNA, 13 nt, Pseudomonas aeruginosa PA01
cauauagcgcugu

SEQ ID NO: 3520715 - RNA, 14 nt, Pseudomonas aeruginosa PA01
cauauccccucuca

SEQ ID NO: 3520716 - RNA, 20 nt, Pseudomonas aeruginosa PA01
caucaacccaccgaccacca

SEQ ID NO: 3520717 - RNA, 15 nt, Pseudomonas aeruginosa PA01
caucaccacgaucag

SEQ ID NO: 3520718 - RNA, 22 nt, Pseudomonas aeruginosa PA01
caucaccacgcgauauccgcca

SEQ ID NO: 3520719 - RNA, 14 nt, Pseudomonas aeruginosa PA01
caucaccagcgccg

SEQ ID NO: 3520720 - RNA, 15 nt, Pseudomonas aeruginosa PA01
caucaccagcgccgu

SEQ ID NO: 3520721 - RNA, 12 nt, Pseudomonas aeruginosa PA01
caucaccaggcu

SEQ ID NO: 3520722 - RNA, 15 nt, Pseudomonas aeruginosa PA01
caucaccaggucgcu

SEQ ID NO: 3520723 - RNA, 18 nt, Pseudomonas aeruginosa PA01
caucaccccgcaaccgca

SEQ ID NO: 3520724 - RNA, 20 nt, Pseudomonas aeruginosa PA01
caucacccgguucucgcccc

SEQ ID NO: 3520725 - RNA, 15 nt, Pseudomonas aeruginosa PA01
caucaccgccaucag

SEQ ID NO: 3520726 - RNA, 23 nt, Pseudomonas aeruginosa PA01
caucaccgcgguuggcgccucgc

SEQ ID NO: 3520727 - RNA, 14 nt, Pseudomonas aeruginosa PA01
caucaccggcggga

SEQ ID NO: 3520728 - RNA, 16 nt, Pseudomonas aeruginosa PA01
caucaccuucgccagc

SEQ ID NO: 3520729 - RNA, 17 nt, Pseudomonas aeruginosa PA01
caucaccuucgccagca

SEQ ID NO: 3520730 - RNA, 20 nt, Pseudomonas aeruginosa PA01
caucaccuucgccagcaggc

SEQ ID NO: 3520731 - RNA, 21 nt, Pseudomonas aeruginosa PA01
caucaccuugucgcaccagcc

SEQ ID NO: 3520732 - RNA, 19 nt, Pseudomonas aeruginosa PA01
caucacggccccgagaaaa

SEQ ID NO: 3520733 - RNA, 20 nt, Pseudomonas aeruginosa PA01
caucacgucgcgcaccuggc

SEQ ID NO: 3520734 - RNA, 16 nt, Pseudomonas aeruginosa PA01
caucagaggcaacacc

SEQ ID NO: 3520735 - RNA, 15 nt, Pseudomonas aeruginosa PA01
caucagaucgcguuu

SEQ ID NO: 3520736 - RNA, 22 nt, Pseudomonas aeruginosa PA01
caucagcaccaggaagccccag

SEQ ID NO: 3520737 - RNA, 22 nt, Pseudomonas aeruginosa PA01
caucagcacgucguccagcgcc

SEQ ID NO: 3520738 - RNA, 16 nt, Pseudomonas aeruginosa PA01
caucagcagcgccagc

SEQ ID NO: 3520739 - RNA, 13 nt, Pseudomonas aeruginosa PA01
caucagcaggaag

SEQ ID NO: 3520740 - RNA, 14 nt, Pseudomonas aeruginosa PA01
caucagcaggguca

SEQ ID NO: 3520741 - RNA, 16 nt, Pseudomonas aeruginosa PA01
caucagcaguccgcca

SEQ ID NO: 3520742 - RNA, 19 nt, Pseudomonas aeruginosa PA01
caucagccccucggccagg

SEQ ID NO: 3520743 - RNA, 18 nt, Pseudomonas aeruginosa PA01
caucagccgcgcgcugga

SEQ ID NO: 3520744 - RNA, 18 nt, Pseudomonas aeruginosa PA01
caucagccuggccagcgu

SEQ ID NO: 3520745 - RNA, 23 nt, Pseudomonas aeruginosa PA01
caucagcgaccaguugcucgcuc

SEQ ID NO: 3520746 - RNA, 15 nt, Pseudomonas aeruginosa PA01
caucagcgccgccuc

SEQ ID NO: 3520747 - RNA, 17 nt, Pseudomonas aeruginosa PA01
caucagcgccgccucgc

SEQ ID NO: 3520748 - RNA, 22 nt, Pseudomonas aeruginosa PA01
caucagcuccacgucggcccgg

SEQ ID NO: 3520749 - RNA, 20 nt, Pseudomonas aeruginosa PA01
caucagcuggaucuggugga

SEQ ID NO: 3520750 - RNA, 22 nt, Pseudomonas aeruginosa PA01
caucagcuggaucugguggaac

SEQ ID NO: 3520751 - RNA, 14 nt, Pseudomonas aeruginosa PA01
caucaggcccuuga

SEQ ID NO: 3520752 - RNA, 19 nt, Pseudomonas aeruginosa PA01
caucaggccgcggcccugc

SEQ ID NO: 3520753 - RNA, 18 nt, Pseudomonas aeruginosa PA01
caucaggcgcuguccugu

SEQ ID NO: 3520754 - RNA, 21 nt, Pseudomonas aeruginosa PA01
caucaggcgcuugcucuccac

SEQ ID NO: 3520755 - RNA, 13 nt, Pseudomonas aeruginosa PA01
caucaggcucagg

SEQ ID NO: 3520756 - RNA, 15 nt, Pseudomonas aeruginosa PA01
caucaggcucaggcg

SEQ ID NO: 3520757 - RNA, 15 nt, Pseudomonas aeruginosa PA01
caucaggcugccgag

SEQ ID NO: 3520758 - RNA, 17 nt, Pseudomonas aeruginosa PA01
caucaggcugccgagca

SEQ ID NO: 3520759 - RNA, 21 nt, Pseudomonas aeruginosa PA01
caucaggcugccgagcagggu

SEQ ID NO: 3520760 - RNA, 20 nt, Pseudomonas aeruginosa PA01
caucagggucggcccggaga

SEQ ID NO: 3520761 - RNA, 18 nt, Pseudomonas aeruginosa PA01
caucagguagaugaacug

SEQ ID NO: 3520762 - RNA, 22 nt, Pseudomonas aeruginosa PA01
caucaggucggcgcgcaccugu

SEQ ID NO: 3520763 - RNA, 18 nt, Pseudomonas aeruginosa PA01
caucaggucggucuggcg

SEQ ID NO: 3520764 - RNA, 22 nt, Pseudomonas aeruginosa PA01
caucaggucggucuggcggccc

SEQ ID NO: 3520765 - RNA, 14 nt, Pseudomonas aeruginosa PA01
caucaguuccucgc

SEQ ID NO: 3520766 - RNA, 14 nt, Pseudomonas aeruginosa PA01
caucaguugcgcgc

SEQ ID NO: 3520767 - RNA, 16 nt, Pseudomonas aeruginosa PA01
caucauccacagcgug

SEQ ID NO: 3520768 - RNA, 18 nt, Pseudomonas aeruginosa PA01
caucaugccgagcaucag

SEQ ID NO: 3520769 - RNA, 16 nt, Pseudomonas aeruginosa PA01
cauccacagcgugcag

SEQ ID NO: 3520770 - RNA, 18 nt, Pseudomonas aeruginosa PA01
cauccacagcgugcagac

SEQ ID NO: 3520771 - RNA, 14 nt, Pseudomonas aeruginosa PA01
cauccacaggcggc

SEQ ID NO: 3520772 - RNA, 20 nt, Pseudomonas aeruginosa PA01
cauccacagggucggcagga

SEQ ID NO: 3520773 - RNA, 13 nt, Pseudomonas aeruginosa PA01
cauccaccagcgg

SEQ ID NO: 3520774 - RNA, 12 nt, Pseudomonas aeruginosa PA01
cauccagccccc

SEQ ID NO: 3520775 - RNA, 16 nt, Pseudomonas aeruginosa PA01
cauccagccugcgcug

SEQ ID NO: 3520776 - RNA, 15 nt, Pseudomonas aeruginosa PA01
cauccagcgccugga

SEQ ID NO: 3520777 - RNA, 22 nt, Pseudomonas aeruginosa PA01
cauccagcggacgcuuguccuu

SEQ ID NO: 3520778 - RNA, 16 nt, Pseudomonas aeruginosa PA01
cauccaggacaccccg

SEQ ID NO: 3520779 - RNA, 20 nt, Pseudomonas aeruginosa PA01
cauccaggcuuuccaccgcc

SEQ ID NO: 3520780 - RNA, 21 nt, Pseudomonas aeruginosa PA01
cauccaggcuuuccaccgcca

SEQ ID NO: 3520781 - RNA, 14 nt, Pseudomonas aeruginosa PA01
cauccagucggcgc

SEQ ID NO: 3520782 - RNA, 18 nt, Pseudomonas aeruginosa PA01
cauccagucuucgccggc

SEQ ID NO: 3520783 - RNA, 18 nt, Pseudomonas aeruginosa PA01
cauccaguguggcggcgu

SEQ ID NO: 3520784 - RNA, 14 nt, Pseudomonas aeruginosa PA01
cauccaguuccugc

SEQ ID NO: 3520785 - RNA, 13 nt, Pseudomonas aeruginosa PA01
caucccaguagcc

SEQ ID NO: 3520786 - RNA, 22 nt, Pseudomonas aeruginosa PA01
cauccccccgcgaagcgacggc

SEQ ID NO: 3520787 - RNA, 13 nt, Pseudomonas aeruginosa PA01
cauccccgaggcg

SEQ ID NO: 3520788 - RNA, 20 nt, Pseudomonas aeruginosa PA01
cauccccgaggcgacgcccu

SEQ ID NO: 3520789 - RNA, 23 nt, Pseudomonas aeruginosa PA01
cauccccgccucgaccagcgccg

SEQ ID NO: 3520790 - RNA, 20 nt, Pseudomonas aeruginosa PA01
cauccccuuuuuucagccug

SEQ ID NO: 3520791 - RNA, 21 nt, Pseudomonas aeruginosa PA01
caucccgcccggucucagccg

SEQ ID NO: 3520792 - RNA, 19 nt, Pseudomonas aeruginosa PA01
caucccgggguugcccagc

SEQ ID NO: 3520793 - RNA, 22 nt, Pseudomonas aeruginosa PA01
caucccguuggggaugcgccgu

SEQ ID NO: 3520794 - RNA, 12 nt, Pseudomonas aeruginosa PA01
caucccuucuuu

SEQ ID NO: 3520795 - RNA, 22 nt, Pseudomonas aeruginosa PA01
caucccuuuuucauucuccagc

SEQ ID NO: 3520796 - RNA, 23 nt, Pseudomonas aeruginosa PA01
caucccuuuuucauucuccagcc

SEQ ID NO: 3520797 - RNA, 14 nt, Pseudomonas aeruginosa PA01
cauccgacgccggc

SEQ ID NO: 3520798 - RNA, 20 nt, Pseudomonas aeruginosa PA01
cauccgcaccauccgccgca

SEQ ID NO: 3520799 - RNA, 21 nt, Pseudomonas aeruginosa PA01
cauccgcaccauccgccgcag

SEQ ID NO: 3520800 - RNA, 15 nt, Pseudomonas aeruginosa PA01
cauccgcccugcguc

SEQ ID NO: 3520801 - RNA, 17 nt, Pseudomonas aeruginosa PA01
cauccgcccugcgucgc

SEQ ID NO: 3520802 - RNA, 15 nt, Pseudomonas aeruginosa PA01
cauccgccgcagacc

SEQ ID NO: 3520803 - RNA, 14 nt, Pseudomonas aeruginosa PA01
cauccgccgcagga

SEQ ID NO: 3520804 - RNA, 15 nt, Pseudomonas aeruginosa PA01
cauccgccgcugggg

SEQ ID NO: 3520805 - RNA, 13 nt, Pseudomonas aeruginosa PA01
cauccgccggcgc

SEQ ID NO: 3520806 - RNA, 14 nt, Pseudomonas aeruginosa PA01
cauccgccggcgcg

SEQ ID NO: 3520807 - RNA, 23 nt, Pseudomonas aeruginosa PA01
cauccgccuuuuuugugcccggc

SEQ ID NO: 3520808 - RNA, 14 nt, Pseudomonas aeruginosa PA01
cauccgcgccgacc

SEQ ID NO: 3520809 - RNA, 15 nt, Pseudomonas aeruginosa PA01
cauccgcgccgacca

SEQ ID NO: 3520810 - RNA, 20 nt, Pseudomonas aeruginosa PA01
cauccgcgccgaccagccgc

SEQ ID NO: 3520811 - RNA, 14 nt, Pseudomonas aeruginosa PA01
cauccgcggccccg

SEQ ID NO: 3520812 - RNA, 15 nt, Pseudomonas aeruginosa PA01
cauccgcggccccgg

SEQ ID NO: 3520813 - RNA, 19 nt, Pseudomonas aeruginosa PA01
cauccgcggccccggcguc

SEQ ID NO: 3520814 - RNA, 14 nt, Pseudomonas aeruginosa PA01
cauccgcguggcga

SEQ ID NO: 3520815 - RNA, 21 nt, Pseudomonas aeruginosa PA01
cauccgcguggcgaugcccug

SEQ ID NO: 3520816 - RNA, 20 nt, Pseudomonas aeruginosa PA01
cauccgcugguagcccaggc

SEQ ID NO: 3520817 - RNA, 22 nt, Pseudomonas aeruginosa PA01
cauccgcugguagcccaggccg

SEQ ID NO: 3520818 - RNA, 17 nt, Pseudomonas aeruginosa PA01
cauccggaguucgcccg

SEQ ID NO: 3520819 - RNA, 20 nt, Pseudomonas aeruginosa PA01
cauccggaguucgcccgccc

SEQ ID NO: 3520820 - RNA, 23 nt, Pseudomonas aeruginosa PA01
cauccggaguucgcccgccccau

SEQ ID NO: 3520821 - RNA, 15 nt, Pseudomonas aeruginosa PA01
cauccgggcggcggg

SEQ ID NO: 3520822 - RNA, 19 nt, Pseudomonas aeruginosa PA01
cauccgggcggcgggcgca

SEQ ID NO: 3520823 - RNA, 20 nt, Pseudomonas aeruginosa PA01
cauccggguccagcggccgc

SEQ ID NO: 3520824 - RNA, 21 nt, Pseudomonas aeruginosa PA01
cauccggguccagcggccgcg

SEQ ID NO: 3520825 - RNA, 23 nt, Pseudomonas aeruginosa PA01
cauccguaaaauggcgcgccucu

SEQ ID NO: 3520826 - RNA, 22 nt, Pseudomonas aeruginosa PA01
cauccgugcgaacacaccgacc

SEQ ID NO: 3520827 - RNA, 24 nt, Pseudomonas aeruginosa PA01
cauccgugcgaacacaccgaccgc

SEQ ID NO: 3520828 - RNA, 21 nt, Pseudomonas aeruginosa PA01
cauccuccaccguuccgaccc

SEQ ID NO: 3520829 - RNA, 12 nt, Pseudomonas aeruginosa PA01
cauccuccagca

SEQ ID NO: 3520830 - RNA, 14 nt, Pseudomonas aeruginosa PA01
cauccucccugccc

SEQ ID NO: 3520831 - RNA, 12 nt, Pseudomonas aeruginosa PA01
cauccucgccgc

SEQ ID NO: 3520832 - RNA, 19 nt, Pseudomonas aeruginosa PA01
cauccucgccgcuggcgcu

SEQ ID NO: 3520833 - RNA, 16 nt, Pseudomonas aeruginosa PA01
cauccucggcauccag

SEQ ID NO: 3520834 - RNA, 17 nt, Pseudomonas aeruginosa PA01
cauccucguuccacggg

SEQ ID NO: 3520835 - RNA, 16 nt, Pseudomonas aeruginosa PA01
cauccugaaaagcgcu

SEQ ID NO: 3520836 - RNA, 22 nt, Pseudomonas aeruginosa PA01
cauccugaugaaucgccucccu

SEQ ID NO: 3520837 - RNA, 23 nt, Pseudomonas aeruginosa PA01
cauccugaugaaucgccucccug

SEQ ID NO: 3520838 - RNA, 20 nt, Pseudomonas aeruginosa PA01
cauccugcgcgccucuuccu

SEQ ID NO: 3520839 - RNA, 21 nt, Pseudomonas aeruginosa PA01
cauccugcgcgccucuuccug

SEQ ID NO: 3520840 - RNA, 18 nt, Pseudomonas aeruginosa PA01
cauccuggcccuggauau

SEQ ID NO: 3520841 - RNA, 14 nt, Pseudomonas aeruginosa PA01
cauccuggccgguc

SEQ ID NO: 3520842 - RNA, 20 nt, Pseudomonas aeruginosa PA01
cauccuggccggucguucgc

SEQ ID NO: 3520843 - RNA, 15 nt, Pseudomonas aeruginosa PA01
cauccuguggcugca

SEQ ID NO: 3520844 - RNA, 15 nt, Pseudomonas aeruginosa PA01
caucgaagcgcacca

SEQ ID NO: 3520845 - RNA, 23 nt, Pseudomonas aeruginosa PA01
caucgacagggucgucuggguca

SEQ ID NO: 3520846 - RNA, 17 nt, Pseudomonas aeruginosa PA01
caucgaccagacgcagc

SEQ ID NO: 3520847 - RNA, 18 nt, Pseudomonas aeruginosa PA01
caucgaccagacgcagca

SEQ ID NO: 3520848 - RNA, 14 nt, Pseudomonas aeruginosa PA01
caucgaccagcagc

SEQ ID NO: 3520849 - RNA, 15 nt, Pseudomonas aeruginosa PA01
caucgaccagcagcg

SEQ ID NO: 3520850 - RNA, 17 nt, Pseudomonas aeruginosa PA01
caucgaccagcagcggc

SEQ ID NO: 3520851 - RNA, 18 nt, Pseudomonas aeruginosa PA01
caucgaccagggccgggu

SEQ ID NO: 3520852 - RNA, 16 nt, Pseudomonas aeruginosa PA01
caucgaccaggucgcc

SEQ ID NO: 3520853 - RNA, 23 nt, Pseudomonas aeruginosa PA01
caucgaccaggucgccaugcccg

SEQ ID NO: 3520854 - RNA, 21 nt, Pseudomonas aeruginosa PA01
caucgaccuugcccucggcgc

SEQ ID NO: 3520855 - RNA, 22 nt, Pseudomonas aeruginosa PA01
caucgaccuugcccucggcgcc

SEQ ID NO: 3520856 - RNA, 23 nt, Pseudomonas aeruginosa PA01
caucgaccuugcccucggcgccc

SEQ ID NO: 3520857 - RNA, 13 nt, Pseudomonas aeruginosa PA01
caucgacgccagc

SEQ ID NO: 3520858 - RNA, 16 nt, Pseudomonas aeruginosa PA01
caucgacgccagcggc

SEQ ID NO: 3520859 - RNA, 17 nt, Pseudomonas aeruginosa PA01
caucgacgccagcggcg

SEQ ID NO: 3520860 - RNA, 21 nt, Pseudomonas aeruginosa PA01
caucgacgcccucggcgacga

SEQ ID NO: 3520861 - RNA, 16 nt, Pseudomonas aeruginosa PA01
caucgacugcaacaga

SEQ ID NO: 3520862 - RNA, 14 nt, Pseudomonas aeruginosa PA01
caucgagcggcggc

SEQ ID NO: 3520863 - RNA, 18 nt, Pseudomonas aeruginosa PA01
caucgagcggcggccguc

SEQ ID NO: 3520864 - RNA, 19 nt, Pseudomonas aeruginosa PA01
caucgaggccaggccgagc

SEQ ID NO: 3520865 - RNA, 22 nt, Pseudomonas aeruginosa PA01
caucgaggccaggccgagcgcc

SEQ ID NO: 3520866 - RNA, 23 nt, Pseudomonas aeruginosa PA01
caucgaggccaggccgagcgcca

SEQ ID NO: 3520867 - RNA, 18 nt, Pseudomonas aeruginosa PA01
caucgaggccauccccga

SEQ ID NO: 3520868 - RNA, 14 nt, Pseudomonas aeruginosa PA01
caucgaggccgccc

SEQ ID NO: 3520869 - RNA, 19 nt, Pseudomonas aeruginosa PA01
caucgaggccgcccagcgc

SEQ ID NO: 3520870 - RNA, 21 nt, Pseudomonas aeruginosa PA01
caucgaggccgcccagcgcag

SEQ ID NO: 3520871 - RNA, 14 nt, Pseudomonas aeruginosa PA01
caucgaggccggca

SEQ ID NO: 3520872 - RNA, 15 nt, Pseudomonas aeruginosa PA01
caucgaggugcuuga

SEQ ID NO: 3520873 - RNA, 18 nt, Pseudomonas aeruginosa PA01
caucgauaacaccaggag

SEQ ID NO: 3520874 - RNA, 23 nt, Pseudomonas aeruginosa PA01
caucgauaacaccaggagcgcca

SEQ ID NO: 3520875 - RNA, 15 nt, Pseudomonas aeruginosa PA01
caucgaucagcagcg

SEQ ID NO: 3520876 - RNA, 16 nt, Pseudomonas aeruginosa PA01
caucgaucagcagcgc

SEQ ID NO: 3520877 - RNA, 18 nt, Pseudomonas aeruginosa PA01
caucgaucagcagcgcca

SEQ ID NO: 3520878 - RNA, 12 nt, Pseudomonas aeruginosa PA01
caucgauccgca

SEQ ID NO: 3520879 - RNA, 18 nt, Pseudomonas aeruginosa PA01
caucgauccgcacccggg

SEQ ID NO: 3520880 - RNA, 21 nt, Pseudomonas aeruginosa PA01
caucgauccgcacccgggcaa

SEQ ID NO: 3520881 - RNA, 15 nt, Pseudomonas aeruginosa PA01
caucgaugaccuucg

SEQ ID NO: 3520882 - RNA, 20 nt, Pseudomonas aeruginosa PA01
caucgaugccuugcggcccc

SEQ ID NO: 3520883 - RNA, 19 nt, Pseudomonas aeruginosa PA01
caucgauggucacuggcga

SEQ ID NO: 3520884 - RNA, 20 nt, Pseudomonas aeruginosa PA01
caucgauggucacuggcgag

SEQ ID NO: 3520885 - RNA, 16 nt, Pseudomonas aeruginosa PA01
caucgaugugagcccc

SEQ ID NO: 3520886 - RNA, 14 nt, Pseudomonas aeruginosa PA01
caucgcaggcagcg

SEQ ID NO: 3520887 - RNA, 17 nt, Pseudomonas aeruginosa PA01
caucgcaggcagcgcgc

SEQ ID NO: 3520888 - RNA, 20 nt, Pseudomonas aeruginosa PA01
caucgcauagccggcgcgcc

SEQ ID NO: 3520889 - RNA, 13 nt, Pseudomonas aeruginosa PA01
caucgccaccagc

SEQ ID NO: 3520890 - RNA, 14 nt, Pseudomonas aeruginosa PA01
caucgccaccagca

SEQ ID NO: 3520891 - RNA, 16 nt, Pseudomonas aeruginosa PA01
caucgccaccagcagg

SEQ ID NO: 3520892 - RNA, 13 nt, Pseudomonas aeruginosa PA01
caucgccaccgcg

SEQ ID NO: 3520893 - RNA, 12 nt, Pseudomonas aeruginosa PA01
caucgccagcgc

SEQ ID NO: 3520894 - RNA, 14 nt, Pseudomonas aeruginosa PA01
caucgccagcgcca

SEQ ID NO: 3520895 - RNA, 17 nt, Pseudomonas aeruginosa PA01
caucgccaguugcaggg

SEQ ID NO: 3520896 - RNA, 12 nt, Pseudomonas aeruginosa PA01
caucgcccauga

SEQ ID NO: 3520897 - RNA, 17 nt, Pseudomonas aeruginosa PA01
caucgcccgcagccaca

SEQ ID NO: 3520898 - RNA, 23 nt, Pseudomonas aeruginosa PA01
caucgcccgcagccacaggcgcc

SEQ ID NO: 3520899 - RNA, 13 nt, Pseudomonas aeruginosa PA01
caucgcccggcgc

SEQ ID NO: 3520900 - RNA, 15 nt, Pseudomonas aeruginosa PA01
caucgcccggcgcuu

SEQ ID NO: 3520901 - RNA, 13 nt, Pseudomonas aeruginosa PA01
caucgcccugcac

SEQ ID NO: 3520902 - RNA, 17 nt, Pseudomonas aeruginosa PA01
caucgccgaccacuucc

SEQ ID NO: 3520903 - RNA, 13 nt, Pseudomonas aeruginosa PA01
caucgccgagggc

SEQ ID NO: 3520904 - RNA, 15 nt, Pseudomonas aeruginosa PA01
caucgccgccaggca

SEQ ID NO: 3520905 - RNA, 16 nt, Pseudomonas aeruginosa PA01
caucgccgccaggcag

SEQ ID NO: 3520906 - RNA, 13 nt, Pseudomonas aeruginosa PA01
caucgccgcccag

SEQ ID NO: 3520907 - RNA, 14 nt, Pseudomonas aeruginosa PA01
caucgccggcagcg

SEQ ID NO: 3520908 - RNA, 16 nt, Pseudomonas aeruginosa PA01
caucgccggcagcgcc

SEQ ID NO: 3520909 - RNA, 15 nt, Pseudomonas aeruginosa PA01
caucgccggcccgcg

SEQ ID NO: 3520910 - RNA, 21 nt, Pseudomonas aeruginosa PA01
caucgccggcgagccgcuggc

SEQ ID NO: 3520911 - RNA, 13 nt, Pseudomonas aeruginosa PA01
caucgccggcgcc

SEQ ID NO: 3520912 - RNA, 15 nt, Pseudomonas aeruginosa PA01
caucgccuccacggc

SEQ ID NO: 3520913 - RNA, 19 nt, Pseudomonas aeruginosa PA01
caucgccuccacggcggcc

SEQ ID NO: 3520914 - RNA, 15 nt, Pseudomonas aeruginosa PA01
caucgccucgccggc

SEQ ID NO: 3520915 - RNA, 16 nt, Pseudomonas aeruginosa PA01
caucgccucgccggcc

SEQ ID NO: 3520916 - RNA, 16 nt, Pseudomonas aeruginosa PA01
caucgccucgcggacc

SEQ ID NO: 3520917 - RNA, 21 nt, Pseudomonas aeruginosa PA01
caucgccucgcggaccucggg

SEQ ID NO: 3520918 - RNA, 16 nt, Pseudomonas aeruginosa PA01
caucgccugcuggugg

SEQ ID NO: 3520919 - RNA, 18 nt, Pseudomonas aeruginosa PA01
caucgccugggccggcgu

SEQ ID NO: 3520920 - RNA, 21 nt, Pseudomonas aeruginosa PA01
caucgccugggccggcguaug

SEQ ID NO: 3520921 - RNA, 21 nt, Pseudomonas aeruginosa PA01
caucgcgaaaacucccggccu

SEQ ID NO: 3520922 - RNA, 17 nt, Pseudomonas aeruginosa PA01
caucgcgaucuaccugc

SEQ ID NO: 3520923 - RNA, 22 nt, Pseudomonas aeruginosa PA01
caucgcgaucuaccugcgugcg

SEQ ID NO: 3520924 - RNA, 14 nt, Pseudomonas aeruginosa PA01
caucgcgcacaugc

SEQ ID NO: 3520925 - RNA, 20 nt, Pseudomonas aeruginosa PA01
caucgcgccaaugccgucga

SEQ ID NO: 3520926 - RNA, 12 nt, Pseudomonas aeruginosa PA01
caucgcgccgcc

SEQ ID NO: 3520927 - RNA, 13 nt, Pseudomonas aeruginosa PA01
caucgcgccgccg

SEQ ID NO: 3520928 - RNA, 17 nt, Pseudomonas aeruginosa PA01
caucgcgccgccgaagc

SEQ ID NO: 3520929 - RNA, 24 nt, Pseudomonas aeruginosa PA01
caucgcggaaacccuuccagccgc

SEQ ID NO: 3520930 - RNA, 16 nt, Pseudomonas aeruginosa PA01
caucgcggcgauggcc

SEQ ID NO: 3520931 - RNA, 20 nt, Pseudomonas aeruginosa PA01
caucgcggcgauggccgcca

SEQ ID NO: 3520932 - RNA, 21 nt, Pseudomonas aeruginosa PA01
caucgcggcgauggccgccag

SEQ ID NO: 3520933 - RNA, 20 nt, Pseudomonas aeruginosa PA01
caucgcgggcgugcuccagc

SEQ ID NO: 3520934 - RNA, 23 nt, Pseudomonas aeruginosa PA01
caucgcgggcgugcuccagcacc

SEQ ID NO: 3520935 - RNA, 19 nt, Pseudomonas aeruginosa PA01
caucgcgguuauccgccgg

SEQ ID NO: 3520936 - RNA, 13 nt, Pseudomonas aeruginosa PA01
caucgcguagggc

SEQ ID NO: 3520937 - RNA, 21 nt, Pseudomonas aeruginosa PA01
caucgcguagggcgacggcgc

SEQ ID NO: 3520938 - RNA, 16 nt, Pseudomonas aeruginosa PA01
caucgcguagggcgca

SEQ ID NO: 3520939 - RNA, 23 nt, Pseudomonas aeruginosa PA01
caucgcguagggcgcauaaccgc

SEQ ID NO: 3520940 - RNA, 23 nt, Pseudomonas aeruginosa PA01
caucgcguagggcguauaaccgc

SEQ ID NO: 3520941 - RNA, 21 nt, Pseudomonas aeruginosa PA01
caucgcguagguggcgccgcc

SEQ ID NO: 3520942 - RNA, 22 nt, Pseudomonas aeruginosa PA01
caucgcguagguggcgccgccg

SEQ ID NO: 3520943 - RNA, 23 nt, Pseudomonas aeruginosa PA01
caucgcguagguggcgccgccgg

SEQ ID NO: 3520944 - RNA, 14 nt, Pseudomonas aeruginosa PA01
caucgcgucgccga

SEQ ID NO: 3520945 - RNA, 16 nt, Pseudomonas aeruginosa PA01
caucgcgucgccgaac

SEQ ID NO: 3520946 - RNA, 19 nt, Pseudomonas aeruginosa PA01
caucgcucaccggaccgug

SEQ ID NO: 3520947 - RNA, 14 nt, Pseudomonas aeruginosa PA01
caucgcucugcuga

SEQ ID NO: 3520948 - RNA, 13 nt, Pseudomonas aeruginosa PA01
caucgcugaccug

SEQ ID NO: 3520949 - RNA, 15 nt, Pseudomonas aeruginosa PA01
caucgcugaccugga

SEQ ID NO: 3520950 - RNA, 17 nt, Pseudomonas aeruginosa PA01
caucgcuuuccuggccg

SEQ ID NO: 3520951 - RNA, 18 nt, Pseudomonas aeruginosa PA01
caucgcuuuccuggccga

SEQ ID NO: 3520952 - RNA, 17 nt, Pseudomonas aeruginosa PA01
caucggacgccguagcg

SEQ ID NO: 3520953 - RNA, 15 nt, Pseudomonas aeruginosa PA01
caucggagugcaugc

SEQ ID NO: 3520954 - RNA, 17 nt, Pseudomonas aeruginosa PA01
caucggagugcaugccg

SEQ ID NO: 3520955 - RNA, 15 nt, Pseudomonas aeruginosa PA01
caucggccaccuucg

SEQ ID NO: 3520956 - RNA, 20 nt, Pseudomonas aeruginosa PA01
caucggccacuaucgccaac

SEQ ID NO: 3520957 - RNA, 23 nt, Pseudomonas aeruginosa PA01
caucggccacuaucgccaacgcc

SEQ ID NO: 3520958 - RNA, 19 nt, Pseudomonas aeruginosa PA01
caucggccauucggccugg

SEQ ID NO: 3520959 - RNA, 16 nt, Pseudomonas aeruginosa PA01
caucggccccaccgca

SEQ ID NO: 3520960 - RNA, 16 nt, Pseudomonas aeruginosa PA01
caucggcccgacgccg

SEQ ID NO: 3520961 - RNA, 20 nt, Pseudomonas aeruginosa PA01
caucggcccgacgccgcccg

SEQ ID NO: 3520962 - RNA, 21 nt, Pseudomonas aeruginosa PA01
caucggcccgacgccgcccgg

SEQ ID NO: 3520963 - RNA, 23 nt, Pseudomonas aeruginosa PA01
caucggcccgacgccgcccggca

SEQ ID NO: 3520964 - RNA, 15 nt, Pseudomonas aeruginosa PA01
caucggcccggcuuc

SEQ ID NO: 3520965 - RNA, 23 nt, Pseudomonas aeruginosa PA01
caucggcccggcuucgcggguga

SEQ ID NO: 3520966 - RNA, 23 nt, Pseudomonas aeruginosa PA01
caucggccgacagagcggccggc

SEQ ID NO: 3520967 - RNA, 15 nt, Pseudomonas aeruginosa PA01
caucggccgccaggc

SEQ ID NO: 3520968 - RNA, 22 nt, Pseudomonas aeruginosa PA01
caucggccuggggcucggcuuc

SEQ ID NO: 3520969 - RNA, 13 nt, Pseudomonas aeruginosa PA01
caucggcgccgcg

SEQ ID NO: 3520970 - RNA, 14 nt, Pseudomonas aeruginosa PA01
caucggcgccgcgc

SEQ ID NO: 3520971 - RNA, 23 nt, Pseudomonas aeruginosa PA01
caucggcgccgcgcaccugggcg

SEQ ID NO: 3520972 - RNA, 13 nt, Pseudomonas aeruginosa PA01
caucggcgcgccg

SEQ ID NO: 3520973 - RNA, 14 nt, Pseudomonas aeruginosa PA01
caucggcgcgccga

SEQ ID NO: 3520974 - RNA, 13 nt, Pseudomonas aeruginosa PA01
caucggcgcggcc

SEQ ID NO: 3520975 - RNA, 15 nt, Pseudomonas aeruginosa PA01
caucggcgcuccgcc

SEQ ID NO: 3520976 - RNA, 20 nt, Pseudomonas aeruginosa PA01
caucggcggauaacgccgcu

SEQ ID NO: 3520977 - RNA, 22 nt, Pseudomonas aeruginosa PA01
caucggcggauaacgccgcugg

SEQ ID NO: 3520978 - RNA, 13 nt, Pseudomonas aeruginosa PA01
caucggcggcagg

SEQ ID NO: 3520979 - RNA, 17 nt, Pseudomonas aeruginosa PA01
caucggcggcaggcgca

SEQ ID NO: 3520980 - RNA, 20 nt, Pseudomonas aeruginosa PA01
caucggcggcggcccgcaca

SEQ ID NO: 3520981 - RNA, 17 nt, Pseudomonas aeruginosa PA01
caucggcgucggcuggu

SEQ ID NO: 3520982 - RNA, 13 nt, Pseudomonas aeruginosa PA01
caucggcucggca

SEQ ID NO: 3520983 - RNA, 14 nt, Pseudomonas aeruginosa PA01
caucggcuggccga

SEQ ID NO: 3520984 - RNA, 16 nt, Pseudomonas aeruginosa PA01
caucggcuggccgagg

SEQ ID NO: 3520985 - RNA, 20 nt, Pseudomonas aeruginosa PA01
caucggcuggccgagggcgc

SEQ ID NO: 3520986 - RNA, 21 nt, Pseudomonas aeruginosa PA01
caucggcuggucgucgcggua

SEQ ID NO: 3520987 - RNA, 14 nt, Pseudomonas aeruginosa PA01
caucggggcugcuc

SEQ ID NO: 3520988 - RNA, 22 nt, Pseudomonas aeruginosa PA01
caucggguugaucgacgccagc

SEQ ID NO: 3520989 - RNA, 21 nt, Pseudomonas aeruginosa PA01
caucgguauucaucggcggca

SEQ ID NO: 3520990 - RNA, 13 nt, Pseudomonas aeruginosa PA01
caucggucgcgcc

SEQ ID NO: 3520991 - RNA, 23 nt, Pseudomonas aeruginosa PA01
caucggugaccugguagucgcgg

SEQ ID NO: 3520992 - RNA, 14 nt, Pseudomonas aeruginosa PA01
caucggugccggca

SEQ ID NO: 3520993 - RNA, 18 nt, Pseudomonas aeruginosa PA01
caucgguggugugauccu

SEQ ID NO: 3520994 - RNA, 23 nt, Pseudomonas aeruginosa PA01
caucgguggugugauccugcugg

SEQ ID NO: 3520995 - RNA, 16 nt, Pseudomonas aeruginosa PA01
caucguccagcucggc

SEQ ID NO: 3520996 - RNA, 18 nt, Pseudomonas aeruginosa PA01
caucguccagcucggcca

SEQ ID NO: 3520997 - RNA, 20 nt, Pseudomonas aeruginosa PA01
caucgucgaaacgcuggcgg

SEQ ID NO: 3520998 - RNA, 14 nt, Pseudomonas aeruginosa PA01
caucgucgaagggc

SEQ ID NO: 3520999 - RNA, 23 nt, Pseudomonas aeruginosa PA01
caucgucgaugcguccgcgcagg

SEQ ID NO: 3521000 - RNA, 19 nt, Pseudomonas aeruginosa PA01
caucgucgcuuccggcgcc

SEQ ID NO: 3521001 - RNA, 15 nt, Pseudomonas aeruginosa PA01
caucgucucgcgaca

SEQ ID NO: 3521002 - RNA, 20 nt, Pseudomonas aeruginosa PA01
caucgucucgcgacacgugc

SEQ ID NO: 3521003 - RNA, 14 nt, Pseudomonas aeruginosa PA01
caucgucugcgcgg

SEQ ID NO: 3521004 - RNA, 16 nt, Pseudomonas aeruginosa PA01
caucgucugcgcggcg

SEQ ID NO: 3521005 - RNA, 16 nt, Pseudomonas aeruginosa PA01
caucguggggcggcgc

SEQ ID NO: 3521006 - RNA, 13 nt, Pseudomonas aeruginosa PA01
caucguucuuucc

SEQ ID NO: 3521007 - RNA, 15 nt, Pseudomonas aeruginosa PA01
caucguuggcgccgu

SEQ ID NO: 3521008 - RNA, 20 nt, Pseudomonas aeruginosa PA01
caucucagcaacccgcuccg

SEQ ID NO: 3521009 - RNA, 15 nt, Pseudomonas aeruginosa PA01
caucuccaggccgcu

SEQ ID NO: 3521010 - RNA, 23 nt, Pseudomonas aeruginosa PA01
caucuccaggccgcucaccgcca

SEQ ID NO: 3521011 - RNA, 14 nt, Pseudomonas aeruginosa PA01
caucuccucgcuga

SEQ ID NO: 3521012 - RNA, 15 nt, Pseudomonas aeruginosa PA01
caucuccucgcugau

SEQ ID NO: 3521013 - RNA, 23 nt, Pseudomonas aeruginosa PA01
caucucgauggugaacgccaggc

SEQ ID NO: 3521014 - RNA, 20 nt, Pseudomonas aeruginosa PA01
caucucgccgcgcacgucga

SEQ ID NO: 3521015 - RNA, 14 nt, Pseudomonas aeruginosa PA01
caucucgccgucgg

SEQ ID NO: 3521016 - RNA, 13 nt, Pseudomonas aeruginosa PA01
caucucgcggcgg

SEQ ID NO: 3521017 - RNA, 16 nt, Pseudomonas aeruginosa PA01
caucucggccaggccc

SEQ ID NO: 3521018 - RNA, 16 nt, Pseudomonas aeruginosa PA01
caucucggcgcaggca

SEQ ID NO: 3521019 - RNA, 16 nt, Pseudomonas aeruginosa PA01
caucucggugcgcccc

SEQ ID NO: 3521020 - RNA, 22 nt, Pseudomonas aeruginosa PA01
caucucgguguccaccaccagc

SEQ ID NO: 3521021 - RNA, 22 nt, Pseudomonas aeruginosa PA01
caucucguccucggggaagcgc

SEQ ID NO: 3521022 - RNA, 22 nt, Pseudomonas aeruginosa PA01
caucucgugguugaggcgcucg

SEQ ID NO: 3521023 - RNA, 13 nt, Pseudomonas aeruginosa PA01
caucugccgggcg

SEQ ID NO: 3521024 - RNA, 14 nt, Pseudomonas aeruginosa PA01
caucugccgggcgc

SEQ ID NO: 3521025 - RNA, 16 nt, Pseudomonas aeruginosa PA01
caucugccgggcgcgc

SEQ ID NO: 3521026 - RNA, 13 nt, Pseudomonas aeruginosa PA01
caucugcgccggg

SEQ ID NO: 3521027 - RNA, 19 nt, Pseudomonas aeruginosa PA01
caucugcggguugccgcag

SEQ ID NO: 3521028 - RNA, 19 nt, Pseudomonas aeruginosa PA01
caucugcucgaggauggca

SEQ ID NO: 3521029 - RNA, 15 nt, Pseudomonas aeruginosa PA01
caucuggcugccgag

SEQ ID NO: 3521030 - RNA, 14 nt, Pseudomonas aeruginosa PA01
caucugggccaucg

SEQ ID NO: 3521031 - RNA, 23 nt, Pseudomonas aeruginosa PA01
caucuguaccaccgccaugcugu

SEQ ID NO: 3521032 - RNA, 20 nt, Pseudomonas aeruginosa PA01
caucuucucgaagcgcgccu

SEQ ID NO: 3521033 - RNA, 24 nt, Pseudomonas aeruginosa PA01
caucuucucgaagcgcgccugcuc

SEQ ID NO: 3521034 - RNA, 22 nt, Pseudomonas aeruginosa PA01
caucuucuggacaccgaugccg

SEQ ID NO: 3521035 - RNA, 15 nt, Pseudomonas aeruginosa PA01
caucuugcccagccg

SEQ ID NO: 3521036 - RNA, 18 nt, Pseudomonas aeruginosa PA01
caucuugcggcaauucuu

SEQ ID NO: 3521037 - RNA, 16 nt, Pseudomonas aeruginosa PA01
caugaaaaagccccgc

SEQ ID NO: 3521038 - RNA, 15 nt, Pseudomonas aeruginosa PA01
caugaaaaagccccu

SEQ ID NO: 3521039 - RNA, 20 nt, Pseudomonas aeruginosa PA01
caugaaaaagcccggccgcu

SEQ ID NO: 3521040 - RNA, 16 nt, Pseudomonas aeruginosa PA01
caugaaaaaggccggu

SEQ ID NO: 3521041 - RNA, 17 nt, Pseudomonas aeruginosa PA01
caugaaaaaggcgcccg

SEQ ID NO: 3521042 - RNA, 20 nt, Pseudomonas aeruginosa PA01
caugaaaaauggccgcuuca

SEQ ID NO: 3521043 - RNA, 22 nt, Pseudomonas aeruginosa PA01
caugaacacauagaccagcagc

SEQ ID NO: 3521044 - RNA, 20 nt, Pseudomonas aeruginosa PA01
caugaagacguacagcgggu

SEQ ID NO: 3521045 - RNA, 20 nt, Pseudomonas aeruginosa PA01
caugaagccgcgcgccgagu

SEQ ID NO: 3521046 - RNA, 21 nt, Pseudomonas aeruginosa PA01
caugaagcuuuuccagcgcac

SEQ ID NO: 3521047 - RNA, 23 nt, Pseudomonas aeruginosa PA01
caugaagcuuuuccagcgcaccg

SEQ ID NO: 3521048 - RNA, 20 nt, Pseudomonas aeruginosa PA01
caugaaggaaaccggccagc

SEQ ID NO: 3521049 - RNA, 18 nt, Pseudomonas aeruginosa PA01
caugaaggcgcugagcgc

SEQ ID NO: 3521050 - RNA, 19 nt, Pseudomonas aeruginosa PA01
caugaaugccuugaggccu

SEQ ID NO: 3521051 - RNA, 16 nt, Pseudomonas aeruginosa PA01
caugaauguggugucg

SEQ ID NO: 3521052 - RNA, 16 nt, Pseudomonas aeruginosa PA01
caugaccagagccgcc

SEQ ID NO: 3521053 - RNA, 15 nt, Pseudomonas aeruginosa PA01
caugacccgcggcag

SEQ ID NO: 3521054 - RNA, 16 nt, Pseudomonas aeruginosa PA01
caugacccgcggcagg

SEQ ID NO: 3521055 - RNA, 19 nt, Pseudomonas aeruginosa PA01
caugacccgcggcaggucc

SEQ ID NO: 3521056 - RNA, 21 nt, Pseudomonas aeruginosa PA01
caugaccgauggcgccgcgau

SEQ ID NO: 3521057 - RNA, 14 nt, Pseudomonas aeruginosa PA01
caugaccgccgcuc

SEQ ID NO: 3521058 - RNA, 20 nt, Pseudomonas aeruginosa PA01
caugaccgccgcucaucugc

SEQ ID NO: 3521059 - RNA, 17 nt, Pseudomonas aeruginosa PA01
caugaccgucagccagg

SEQ ID NO: 3521060 - RNA, 18 nt, Pseudomonas aeruginosa PA01
caugaccgucagccaggc

SEQ ID NO: 3521061 - RNA, 20 nt, Pseudomonas aeruginosa PA01
caugaccucggccagccagg

SEQ ID NO: 3521062 - RNA, 15 nt, Pseudomonas aeruginosa PA01
caugaccuucagcac

SEQ ID NO: 3521063 - RNA, 20 nt, Pseudomonas aeruginosa PA01
caugaccuucagcaccugcg

SEQ ID NO: 3521064 - RNA, 21 nt, Pseudomonas aeruginosa PA01
caugaccuucagguagauguc

SEQ ID NO: 3521065 - RNA, 22 nt, Pseudomonas aeruginosa PA01
caugacgauaucggcgccggcc

SEQ ID NO: 3521066 - RNA, 18 nt, Pseudomonas aeruginosa PA01
caugacgggcgguaugcc

SEQ ID NO: 3521067 - RNA, 14 nt, Pseudomonas aeruginosa PA01
caugagauccgcca

SEQ ID NO: 3521068 - RNA, 16 nt, Pseudomonas aeruginosa PA01
caugagauccgccagc

SEQ ID NO: 3521069 - RNA, 17 nt, Pseudomonas aeruginosa PA01
caugagauccgccagca

SEQ ID NO: 3521070 - RNA, 15 nt, Pseudomonas aeruginosa PA01
caugagcagggcgga

SEQ ID NO: 3521071 - RNA, 17 nt, Pseudomonas aeruginosa PA01
caugagcgaucccaggu

SEQ ID NO: 3521072 - RNA, 16 nt, Pseudomonas aeruginosa PA01
caugaggcuggccagc

SEQ ID NO: 3521073 - RNA, 19 nt, Pseudomonas aeruginosa PA01
caugaggcuggccagcaau

SEQ ID NO: 3521074 - RNA, 15 nt, Pseudomonas aeruginosa PA01
caugagguucaggcc

SEQ ID NO: 3521075 - RNA, 17 nt, Pseudomonas aeruginosa PA01
caugagguucaggccgg

SEQ ID NO: 3521076 - RNA, 15 nt, Pseudomonas aeruginosa PA01
caugauaaggcaaag

SEQ ID NO: 3521077 - RNA, 16 nt, Pseudomonas aeruginosa PA01
caugaucaucggcugg

SEQ ID NO: 3521078 - RNA, 20 nt, Pseudomonas aeruginosa PA01
caugauccggugcaggccga

SEQ ID NO: 3521079 - RNA, 14 nt, Pseudomonas aeruginosa PA01
caugaucgccaccg

SEQ ID NO: 3521080 - RNA, 16 nt, Pseudomonas aeruginosa PA01
caugaucgccucggcg

SEQ ID NO: 3521081 - RNA, 17 nt, Pseudomonas aeruginosa PA01
caugaucgccucggcgc

SEQ ID NO: 3521082 - RNA, 19 nt, Pseudomonas aeruginosa PA01
caugaugccgaggcggccg

SEQ ID NO: 3521083 - RNA, 20 nt, Pseudomonas aeruginosa PA01
caugaugccgugcagcuugg

SEQ ID NO: 3521084 - RNA, 17 nt, Pseudomonas aeruginosa PA01
caugauggugccgccgg

SEQ ID NO: 3521085 - RNA, 22 nt, Pseudomonas aeruginosa PA01
caugaugugcgcaggcuggccg

SEQ ID NO: 3521086 - RNA, 19 nt, Pseudomonas aeruginosa PA01
caugauuucguuggcccag

SEQ ID NO: 3521087 - RNA, 22 nt, Pseudomonas aeruginosa PA01
caugauuucguuggcccagacc

SEQ ID NO: 3521088 - RNA, 23 nt, Pseudomonas aeruginosa PA01
caugauuucguuggcccagaccu

SEQ ID NO: 3521089 - RNA, 17 nt, Pseudomonas aeruginosa PA01
caugcaagaacgccgac

SEQ ID NO: 3521090 - RNA, 16 nt, Pseudomonas aeruginosa PA01
caugcaccaccugcuu

SEQ ID NO: 3521091 - RNA, 14 nt, Pseudomonas aeruginosa PA01
caugcaccaggccg

SEQ ID NO: 3521092 - RNA, 18 nt, Pseudomonas aeruginosa PA01
caugcaccaggccgccau

SEQ ID NO: 3521093 - RNA, 15 nt, Pseudomonas aeruginosa PA01
caugcacgcccugga

SEQ ID NO: 3521094 - RNA, 18 nt, Pseudomonas aeruginosa PA01
caugcacuucgaccagua

SEQ ID NO: 3521095 - RNA, 23 nt, Pseudomonas aeruginosa PA01
caugcagcggcauggucagccca

SEQ ID NO: 3521096 - RNA, 14 nt, Pseudomonas aeruginosa PA01
caugcaggccggcc

SEQ ID NO: 3521097 - RNA, 18 nt, Pseudomonas aeruginosa PA01
caugcaggcucgacaggu

SEQ ID NO: 3521098 - RNA, 17 nt, Pseudomonas aeruginosa PA01
caugcagguggcgcuca

SEQ ID NO: 3521099 - RNA, 17 nt, Pseudomonas aeruginosa PA01
caugccacgcaccacca

SEQ ID NO: 3521100 - RNA, 20 nt, Pseudomonas aeruginosa PA01
caugccacgcaccaccaggu

SEQ ID NO: 3521101 - RNA, 21 nt, Pseudomonas aeruginosa PA01
caugccaggagaaccuggcca

SEQ ID NO: 3521102 - RNA, 21 nt, Pseudomonas aeruginosa PA01
caugcccagcguggccagcga

SEQ ID NO: 3521103 - RNA, 23 nt, Pseudomonas aeruginosa PA01
caugcccagcguggccagcgaac

SEQ ID NO: 3521104 - RNA, 16 nt, Pseudomonas aeruginosa PA01
caugcccagcuucacc

SEQ ID NO: 3521105 - RNA, 21 nt, Pseudomonas aeruginosa PA01
caugcccagcuucaccggugc

SEQ ID NO: 3521106 - RNA, 22 nt, Pseudomonas aeruginosa PA01
caugcccagcuucaccggugcc

SEQ ID NO: 3521107 - RNA, 14 nt, Pseudomonas aeruginosa PA01
caugcccaggcucg

SEQ ID NO: 3521108 - RNA, 13 nt, Pseudomonas aeruginosa PA01
caugcccgccccg

SEQ ID NO: 3521109 - RNA, 16 nt, Pseudomonas aeruginosa PA01
caugcccgccccgcac

SEQ ID NO: 3521110 - RNA, 14 nt, Pseudomonas aeruginosa PA01
caugcccgcugggc

SEQ ID NO: 3521111 - RNA, 15 nt, Pseudomonas aeruginosa PA01
caugcccgcugggca

SEQ ID NO: 3521112 - RNA, 16 nt, Pseudomonas aeruginosa PA01
caugcccgcugggcag

SEQ ID NO: 3521113 - RNA, 15 nt, Pseudomonas aeruginosa PA01
caugcccggccuggc

SEQ ID NO: 3521114 - RNA, 17 nt, Pseudomonas aeruginosa PA01
caugcccggcuggcgua

SEQ ID NO: 3521115 - RNA, 14 nt, Pseudomonas aeruginosa PA01
caugcccugccggc

SEQ ID NO: 3521116 - RNA, 16 nt, Pseudomonas aeruginosa PA01
caugcccugccggcgc

SEQ ID NO: 3521117 - RNA, 17 nt, Pseudomonas aeruginosa PA01
caugcccugccggcgca

SEQ ID NO: 3521118 - RNA, 14 nt, Pseudomonas aeruginosa PA01
caugcccuggccga

SEQ ID NO: 3521119 - RNA, 13 nt, Pseudomonas aeruginosa PA01
caugcccuugucg

SEQ ID NO: 3521120 - RNA, 20 nt, Pseudomonas aeruginosa PA01
caugcccuugucgcccuucu

SEQ ID NO: 3521121 - RNA, 23 nt, Pseudomonas aeruginosa PA01
caugcccuugucgcccuucuucc

SEQ ID NO: 3521122 - RNA, 19 nt, Pseudomonas aeruginosa PA01
caugccgaacuucuccgcc

SEQ ID NO: 3521123 - RNA, 24 nt, Pseudomonas aeruginosa PA01
caugccgacgagcagcucgccggc

SEQ ID NO: 3521124 - RNA, 20 nt, Pseudomonas aeruginosa PA01
caugccgagcaucagcgacu

SEQ ID NO: 3521125 - RNA, 15 nt, Pseudomonas aeruginosa PA01
caugccgagcgaaau

SEQ ID NO: 3521126 - RNA, 19 nt, Pseudomonas aeruginosa PA01
caugccgcaagcuccccgc

SEQ ID NO: 3521127 - RNA, 21 nt, Pseudomonas aeruginosa PA01
caugccgcaagcuccccgccg

SEQ ID NO: 3521128 - RNA, 23 nt, Pseudomonas aeruginosa PA01
caugccgcaagcuccccgccgcc

SEQ ID NO: 3521129 - RNA, 15 nt, Pseudomonas aeruginosa PA01
caugccgcaggaacc

SEQ ID NO: 3521130 - RNA, 17 nt, Pseudomonas aeruginosa PA01
caugccgcaggaaccga

SEQ ID NO: 3521131 - RNA, 22 nt, Pseudomonas aeruginosa PA01
caugccgcaggaaccgacgcgc

SEQ ID NO: 3521132 - RNA, 11 nt, Pseudomonas aeruginosa PA01
caugccgcccg

SEQ ID NO: 3521133 - RNA, 12 nt, Pseudomonas aeruginosa PA01
caugccgcccgg

SEQ ID NO: 3521134 - RNA, 15 nt, Pseudomonas aeruginosa PA01
caugccgcccggccg

SEQ ID NO: 3521135 - RNA, 17 nt, Pseudomonas aeruginosa PA01
caugccgccgacgccgg

SEQ ID NO: 3521136 - RNA, 21 nt, Pseudomonas aeruginosa PA01
caugccgccgucgcggccauc

SEQ ID NO: 3521137 - RNA, 14 nt, Pseudomonas aeruginosa PA01
caugccgcuagccc

SEQ ID NO: 3521138 - RNA, 17 nt, Pseudomonas aeruginosa PA01
caugccgcuagcccugc

SEQ ID NO: 3521139 - RNA, 20 nt, Pseudomonas aeruginosa PA01
caugccgcuagcccugcugc

SEQ ID NO: 3521140 - RNA, 21 nt, Pseudomonas aeruginosa PA01
caugccgcuagcccugcugcu

SEQ ID NO: 3521141 - RNA, 17 nt, Pseudomonas aeruginosa PA01
caugccgcucugccaga

SEQ ID NO: 3521142 - RNA, 16 nt, Pseudomonas aeruginosa PA01
caugccggccaggaag

SEQ ID NO: 3521143 - RNA, 19 nt, Pseudomonas aeruginosa PA01
caugccggggaaccacacc

SEQ ID NO: 3521144 - RNA, 20 nt, Pseudomonas aeruginosa PA01
caugccggggaaccacaccu

SEQ ID NO: 3521145 - RNA, 17 nt, Pseudomonas aeruginosa PA01
caugccgggguccgccg

SEQ ID NO: 3521146 - RNA, 18 nt, Pseudomonas aeruginosa PA01
caugccgggguccgccgg

SEQ ID NO: 3521147 - RNA, 19 nt, Pseudomonas aeruginosa PA01
caugccgggguccgccggu

SEQ ID NO: 3521148 - RNA, 21 nt, Pseudomonas aeruginosa PA01
caugccgggguccgccgguca

SEQ ID NO: 3521149 - RNA, 22 nt, Pseudomonas aeruginosa PA01
caugccgggguggaguaccagg

SEQ ID NO: 3521150 - RNA, 19 nt, Pseudomonas aeruginosa PA01
caugccguacaggucggcg

SEQ ID NO: 3521151 - RNA, 20 nt, Pseudomonas aeruginosa PA01
caugccguacaggucggcgc

SEQ ID NO: 3521152 - RNA, 21 nt, Pseudomonas aeruginosa PA01
caugccguacaggucggcgcc

SEQ ID NO: 3521153 - RNA, 22 nt, Pseudomonas aeruginosa PA01
caugccguacaggucggcgccg

SEQ ID NO: 3521154 - RNA, 19 nt, Pseudomonas aeruginosa PA01
caugccgugggcgccgccg

SEQ ID NO: 3521155 - RNA, 20 nt, Pseudomonas aeruginosa PA01
caugccgugggcgccgccgg

SEQ ID NO: 3521156 - RNA, 17 nt, Pseudomonas aeruginosa PA01
caugccguucaggccgg

SEQ ID NO: 3521157 - RNA, 17 nt, Pseudomonas aeruginosa PA01
caugccguugcccucgc

SEQ ID NO: 3521158 - RNA, 19 nt, Pseudomonas aeruginosa PA01
caugccguugcccucgcgc

SEQ ID NO: 3521159 - RNA, 19 nt, Pseudomonas aeruginosa PA01
caugccguuggccgagcgc

SEQ ID NO: 3521160 - RNA, 17 nt, Pseudomonas aeruginosa PA01
caugccguugggccagg

SEQ ID NO: 3521161 - RNA, 20 nt, Pseudomonas aeruginosa PA01
caugccguugggccagggcc

SEQ ID NO: 3521162 - RNA, 16 nt, Pseudomonas aeruginosa PA01
caugccuagcacccgg

SEQ ID NO: 3521163 - RNA, 22 nt, Pseudomonas aeruginosa PA01
caugccugcuuucccugcugcg

SEQ ID NO: 3521164 - RNA, 16 nt, Pseudomonas aeruginosa PA01
caugccuugcagcgcc

SEQ ID NO: 3521165 - RNA, 19 nt, Pseudomonas aeruginosa PA01
caugcgaaaacggcgaccc

SEQ ID NO: 3521166 - RNA, 21 nt, Pseudomonas aeruginosa PA01
caugcgaaaacggcgacccug

SEQ ID NO: 3521167 - RNA, 13 nt, Pseudomonas aeruginosa PA01
caugcgcagcgcg

SEQ ID NO: 3521168 - RNA, 17 nt, Pseudomonas aeruginosa PA01
caugcgcagcgcguuga

SEQ ID NO: 3521169 - RNA, 12 nt, Pseudomonas aeruginosa PA01
caugcgccggcu

SEQ ID NO: 3521170 - RNA, 14 nt, Pseudomonas aeruginosa PA01
caugcgcggcagga

SEQ ID NO: 3521171 - RNA, 22 nt, Pseudomonas aeruginosa PA01
caugcgcggcaggaaauccgcc

SEQ ID NO: 3521172 - RNA, 18 nt, Pseudomonas aeruginosa PA01
caugcgcggcaggaucag

SEQ ID NO: 3521173 - RNA, 20 nt, Pseudomonas aeruginosa PA01
caugcgcggcaggaucaggc

SEQ ID NO: 3521174 - RNA, 19 nt, Pseudomonas aeruginosa PA01
caugcgcguguugcgccgc

SEQ ID NO: 3521175 - RNA, 20 nt, Pseudomonas aeruginosa PA01
caugcgcugguagcgcucca

SEQ ID NO: 3521176 - RNA, 22 nt, Pseudomonas aeruginosa PA01
caugcgcugguagcgcuccagc

SEQ ID NO: 3521177 - RNA, 23 nt, Pseudomonas aeruginosa PA01
caugcgcugguagcgcuccagcu

SEQ ID NO: 3521178 - RNA, 19 nt, Pseudomonas aeruginosa PA01
caugcggaaggcuuccugg

SEQ ID NO: 3521179 - RNA, 20 nt, Pseudomonas aeruginosa PA01
caugcggaaggcuuccuggu

SEQ ID NO: 3521180 - RNA, 22 nt, Pseudomonas aeruginosa PA01
caugcggaaggcuuccuggugg

SEQ ID NO: 3521181 - RNA, 20 nt, Pseudomonas aeruginosa PA01
caugcggaucgccuccggca

SEQ ID NO: 3521182 - RNA, 19 nt, Pseudomonas aeruginosa PA01
caugcggcaggccuuccac

SEQ ID NO: 3521183 - RNA, 12 nt, Pseudomonas aeruginosa PA01
caugcggccgau

SEQ ID NO: 3521184 - RNA, 13 nt, Pseudomonas aeruginosa PA01
caugcggcuacuc

SEQ ID NO: 3521185 - RNA, 17 nt, Pseudomonas aeruginosa PA01
caugcggcuacucgccc

SEQ ID NO: 3521186 - RNA, 20 nt, Pseudomonas aeruginosa PA01
caugcgugcauccuuuuucc

SEQ ID NO: 3521187 - RNA, 13 nt, Pseudomonas aeruginosa PA01
caugcucagccgc

SEQ ID NO: 3521188 - RNA, 14 nt, Pseudomonas aeruginosa PA01
caugcucagccgcg

SEQ ID NO: 3521189 - RNA, 16 nt, Pseudomonas aeruginosa PA01
caugcucagccgcgcc

SEQ ID NO: 3521190 - RNA, 22 nt, Pseudomonas aeruginosa PA01
caugcucaggucgaacugcacc

SEQ ID NO: 3521191 - RNA, 14 nt, Pseudomonas aeruginosa PA01
caugcuccgccugg

SEQ ID NO: 3521192 - RNA, 20 nt, Pseudomonas aeruginosa PA01
caugcuccgccuggcggaua

SEQ ID NO: 3521193 - RNA, 14 nt, Pseudomonas aeruginosa PA01
caugcucgccaccu

SEQ ID NO: 3521194 - RNA, 15 nt, Pseudomonas aeruginosa PA01
caugcucgccaccug

SEQ ID NO: 3521195 - RNA, 14 nt, Pseudomonas aeruginosa PA01
caugcucggccagc

SEQ ID NO: 3521196 - RNA, 15 nt, Pseudomonas aeruginosa PA01
caugcucggccagcu

SEQ ID NO: 3521197 - RNA, 18 nt, Pseudomonas aeruginosa PA01
caugcucgggcugccgca

SEQ ID NO: 3521198 - RNA, 19 nt, Pseudomonas aeruginosa PA01
caugcucuucaggcugucg

SEQ ID NO: 3521199 - RNA, 21 nt, Pseudomonas aeruginosa PA01
caugcugcucaguugcaccug

SEQ ID NO: 3521200 - RNA, 12 nt, Pseudomonas aeruginosa PA01
caugcugcucgg

SEQ ID NO: 3521201 - RNA, 16 nt, Pseudomonas aeruginosa PA01
caugcugcucggcauu

SEQ ID NO: 3521202 - RNA, 17 nt, Pseudomonas aeruginosa PA01
caugcuggcgcucucga

SEQ ID NO: 3521203 - RNA, 21 nt, Pseudomonas aeruginosa PA01
caugcuguugccguggcggcg

SEQ ID NO: 3521204 - RNA, 22 nt, Pseudomonas aeruginosa PA01
cauggaaaccccggccuggcgc

SEQ ID NO: 3521205 - RNA, 18 nt, Pseudomonas aeruginosa PA01
cauggaacagcagccagg

SEQ ID NO: 3521206 - RNA, 20 nt, Pseudomonas aeruginosa PA01
cauggaacagcagccaggcg

SEQ ID NO: 3521207 - RNA, 16 nt, Pseudomonas aeruginosa PA01
cauggagaccuggcug

SEQ ID NO: 3521208 - RNA, 21 nt, Pseudomonas aeruginosa PA01
cauggagacggcccgccccgc

SEQ ID NO: 3521209 - RNA, 13 nt, Pseudomonas aeruginosa PA01
cauggagcaacag

SEQ ID NO: 3521210 - RNA, 15 nt, Pseudomonas aeruginosa PA01
cauggaucaccaggg

SEQ ID NO: 3521211 - RNA, 21 nt, Pseudomonas aeruginosa PA01
cauggaucaccagggucggca

SEQ ID NO: 3521212 - RNA, 17 nt, Pseudomonas aeruginosa PA01
cauggaucaccgccaag

SEQ ID NO: 3521213 - RNA, 12 nt, Pseudomonas aeruginosa PA01
cauggcaucccc

SEQ ID NO: 3521214 - RNA, 22 nt, Pseudomonas aeruginosa PA01
cauggcaugaggggaaucgccg

SEQ ID NO: 3521215 - RNA, 14 nt, Pseudomonas aeruginosa PA01
cauggcauggccau

SEQ ID NO: 3521216 - RNA, 21 nt, Pseudomonas aeruginosa PA01
cauggccaccgaaucggacag

SEQ ID NO: 3521217 - RNA, 16 nt, Pseudomonas aeruginosa PA01
cauggccagcucgacc

SEQ ID NO: 3521218 - RNA, 16 nt, Pseudomonas aeruginosa PA01
cauggccgaccgccag

SEQ ID NO: 3521219 - RNA, 17 nt, Pseudomonas aeruginosa PA01
cauggccgaccgccagg

SEQ ID NO: 3521220 - RNA, 18 nt, Pseudomonas aeruginosa PA01
cauggccgaccgccaggc

SEQ ID NO: 3521221 - RNA, 19 nt, Pseudomonas aeruginosa PA01
cauggccgaccgccaggcc

SEQ ID NO: 3521222 - RNA, 21 nt, Pseudomonas aeruginosa PA01
cauggccgaccgccaggccga

SEQ ID NO: 3521223 - RNA, 22 nt, Pseudomonas aeruginosa PA01
cauggccgaccgccaggccgac

SEQ ID NO: 3521224 - RNA, 23 nt, Pseudomonas aeruginosa PA01
cauggccgaccgccaggccgacc

SEQ ID NO: 3521225 - RNA, 13 nt, Pseudomonas aeruginosa PA01
cauggccgcagcg

SEQ ID NO: 3521226 - RNA, 14 nt, Pseudomonas aeruginosa PA01
cauggccgcuccca

SEQ ID NO: 3521227 - RNA, 23 nt, Pseudomonas aeruginosa PA01
cauggccgcucccaccgcuuuca

SEQ ID NO: 3521228 - RNA, 14 nt, Pseudomonas aeruginosa PA01
cauggccggcgugc

SEQ ID NO: 3521229 - RNA, 12 nt, Pseudomonas aeruginosa PA01
cauggccgggcc

SEQ ID NO: 3521230 - RNA, 12 nt, Pseudomonas aeruginosa PA01
cauggccuggaa

SEQ ID NO: 3521231 - RNA, 16 nt, Pseudomonas aeruginosa PA01
cauggccuggcgcuca

SEQ ID NO: 3521232 - RNA, 21 nt, Pseudomonas aeruginosa PA01
cauggccuggcgcucagcgcc

SEQ ID NO: 3521233 - RNA, 23 nt, Pseudomonas aeruginosa PA01
cauggccuggcgcucagcgccgc

SEQ ID NO: 3521234 - RNA, 19 nt, Pseudomonas aeruginosa PA01
cauggcgaagcucggccgc

SEQ ID NO: 3521235 - RNA, 22 nt, Pseudomonas aeruginosa PA01
cauggcgaccugguggcgccgg

SEQ ID NO: 3521236 - RNA, 19 nt, Pseudomonas aeruginosa PA01
cauggcgaucuccgggagc

SEQ ID NO: 3521237 - RNA, 22 nt, Pseudomonas aeruginosa PA01
cauggcgcacgccgcggaaggc

SEQ ID NO: 3521238 - RNA, 21 nt, Pseudomonas aeruginosa PA01
cauggcgccacgcaaacccau

SEQ ID NO: 3521239 - RNA, 13 nt, Pseudomonas aeruginosa PA01
cauggcgccacuc

SEQ ID NO: 3521240 - RNA, 13 nt, Pseudomonas aeruginosa PA01
cauggcgccgcca

SEQ ID NO: 3521241 - RNA, 19 nt, Pseudomonas aeruginosa PA01
cauggcgcgaugcucccga

SEQ ID NO: 3521242 - RNA, 23 nt, Pseudomonas aeruginosa PA01
cauggcgcgaugcucccgagcaa

SEQ ID NO: 3521243 - RNA, 20 nt, Pseudomonas aeruginosa PA01
cauggcgcucuucaccgucg

SEQ ID NO: 3521244 - RNA, 16 nt, Pseudomonas aeruginosa PA01
cauggcgcugaggaag

SEQ ID NO: 3521245 - RNA, 23 nt, Pseudomonas aeruginosa PA01
cauggcgcugaggaagagcagcg

SEQ ID NO: 3521246 - RNA, 15 nt, Pseudomonas aeruginosa PA01
cauggcgcuugcgca

SEQ ID NO: 3521247 - RNA, 21 nt, Pseudomonas aeruginosa PA01
cauggcggacauguugcaggg

SEQ ID NO: 3521248 - RNA, 17 nt, Pseudomonas aeruginosa PA01
cauggcgggcguuuucg

SEQ ID NO: 3521249 - RNA, 21 nt, Pseudomonas aeruginosa PA01
cauggcggucagaucagcggg

SEQ ID NO: 3521250 - RNA, 14 nt, Pseudomonas aeruginosa PA01
cauggcgucggcga

SEQ ID NO: 3521251 - RNA, 16 nt, Pseudomonas aeruginosa PA01
cauggcgucggcgauc

SEQ ID NO: 3521252 - RNA, 13 nt, Pseudomonas aeruginosa PA01
cauggcuggcgcu

SEQ ID NO: 3521253 - RNA, 13 nt, Pseudomonas aeruginosa PA01
cauggcuggugcg

SEQ ID NO: 3521254 - RNA, 20 nt, Pseudomonas aeruginosa PA01
cauggcuguagcucugcugg

SEQ ID NO: 3521255 - RNA, 12 nt, Pseudomonas aeruginosa PA01
cauggcuucggg

SEQ ID NO: 3521256 - RNA, 19 nt, Pseudomonas aeruginosa PA01
cauggcuuuccaggcgccg

SEQ ID NO: 3521257 - RNA, 22 nt, Pseudomonas aeruginosa PA01
cauggcuuuccaggcgccgcuu

SEQ ID NO: 3521258 - RNA, 16 nt, Pseudomonas aeruginosa PA01
caugggaaccucggca

SEQ ID NO: 3521259 - RNA, 17 nt, Pseudomonas aeruginosa PA01
caugggcauccugccgc

SEQ ID NO: 3521260 - RNA, 18 nt, Pseudomonas aeruginosa PA01
caugggcauccugccgcc

SEQ ID NO: 3521261 - RNA, 19 nt, Pseudomonas aeruginosa PA01
caugggcauccugccgccu

SEQ ID NO: 3521262 - RNA, 17 nt, Pseudomonas aeruginosa PA01
caugggccaguuccggc

SEQ ID NO: 3521263 - RNA, 12 nt, Pseudomonas aeruginosa PA01
caugggccgcgc

SEQ ID NO: 3521264 - RNA, 19 nt, Pseudomonas aeruginosa PA01
caugggccgcgcagaucgc

SEQ ID NO: 3521265 - RNA, 15 nt, Pseudomonas aeruginosa PA01
caugggcgcgcgccg

SEQ ID NO: 3521266 - RNA, 16 nt, Pseudomonas aeruginosa PA01
caugggcgcgcgccgg

SEQ ID NO: 3521267 - RNA, 18 nt, Pseudomonas aeruginosa PA01
caugggcgcgcgccgggc

SEQ ID NO: 3521268 - RNA, 18 nt, Pseudomonas aeruginosa PA01
caugggcgcguucucccu

SEQ ID NO: 3521269 - RNA, 18 nt, Pseudomonas aeruginosa PA01
caugggcucgcgcggggc

SEQ ID NO: 3521270 - RNA, 23 nt, Pseudomonas aeruginosa PA01
caugggcucgcgcggggcgcgcu

SEQ ID NO: 3521271 - RNA, 16 nt, Pseudomonas aeruginosa PA01
caugggggccagcagg

SEQ ID NO: 3521272 - RNA, 22 nt, Pseudomonas aeruginosa PA01
caugggggccagcagggccgcc

SEQ ID NO: 3521273 - RNA, 14 nt, Pseudomonas aeruginosa PA01
caugggguucgaca

SEQ ID NO: 3521274 - RNA, 20 nt, Pseudomonas aeruginosa PA01
caugggucagcgccagcaac

SEQ ID NO: 3521275 - RNA, 18 nt, Pseudomonas aeruginosa PA01
caugggugcuguucagcg

SEQ ID NO: 3521276 - RNA, 20 nt, Pseudomonas aeruginosa PA01
caugggugcuguucagcggg

SEQ ID NO: 3521277 - RNA, 19 nt, Pseudomonas aeruginosa PA01
caugguccguucggcgccc

SEQ ID NO: 3521278 - RNA, 18 nt, Pseudomonas aeruginosa PA01
cauggucucgcugaccca

SEQ ID NO: 3521279 - RNA, 16 nt, Pseudomonas aeruginosa PA01
cauggugcccagcagg

SEQ ID NO: 3521280 - RNA, 17 nt, Pseudomonas aeruginosa PA01
cauggugcccagcaggc

SEQ ID NO: 3521281 - RNA, 14 nt, Pseudomonas aeruginosa PA01
cauggugccgagca

SEQ ID NO: 3521282 - RNA, 16 nt, Pseudomonas aeruginosa PA01
cauggugggcgccgcu

SEQ ID NO: 3521283 - RNA, 17 nt, Pseudomonas aeruginosa PA01
caugguguccggcggcg

SEQ ID NO: 3521284 - RNA, 18 nt, Pseudomonas aeruginosa PA01
caugguguuggcggccug

SEQ ID NO: 3521285 - RNA, 19 nt, Pseudomonas aeruginosa PA01
caugguguuggcggccugg

SEQ ID NO: 3521286 - RNA, 21 nt, Pseudomonas aeruginosa PA01
caugguguugggcaggguguc

SEQ ID NO: 3521287 - RNA, 16 nt, Pseudomonas aeruginosa PA01
cauguagaccaccagc

SEQ ID NO: 3521288 - RNA, 15 nt, Pseudomonas aeruginosa PA01
cauguagcgcuccuc

SEQ ID NO: 3521289 - RNA, 15 nt, Pseudomonas aeruginosa PA01
cauguaggcgcacca

SEQ ID NO: 3521290 - RNA, 17 nt, Pseudomonas aeruginosa PA01
cauguccaccgccgcca

SEQ ID NO: 3521291 - RNA, 22 nt, Pseudomonas aeruginosa PA01
cauguccaccgccgccagcaac

SEQ ID NO: 3521292 - RNA, 14 nt, Pseudomonas aeruginosa PA01
cauguccagccagu

SEQ ID NO: 3521293 - RNA, 20 nt, Pseudomonas aeruginosa PA01
cauguccagccaguggcugg

SEQ ID NO: 3521294 - RNA, 20 nt, Pseudomonas aeruginosa PA01
cauguccgaacgcgaggucu

SEQ ID NO: 3521295 - RNA, 17 nt, Pseudomonas aeruginosa PA01
cauguccgccaguuccg

SEQ ID NO: 3521296 - RNA, 15 nt, Pseudomonas aeruginosa PA01
cauguccucggcgcc

SEQ ID NO: 3521297 - RNA, 13 nt, Pseudomonas aeruginosa PA01
cauguccugcagg

SEQ ID NO: 3521298 - RNA, 17 nt, Pseudomonas aeruginosa PA01
cauguccugcaggcuca

SEQ ID NO: 3521299 - RNA, 18 nt, Pseudomonas aeruginosa PA01
caugucgagguugcgcuc

SEQ ID NO: 3521300 - RNA, 16 nt, Pseudomonas aeruginosa PA01
caugucgccggggaag

SEQ ID NO: 3521301 - RNA, 21 nt, Pseudomonas aeruginosa PA01
caugucgcuccagaccuccag

SEQ ID NO: 3521302 - RNA, 16 nt, Pseudomonas aeruginosa PA01
caugucgcugagcggc

SEQ ID NO: 3521303 - RNA, 15 nt, Pseudomonas aeruginosa PA01
caugucgcuggccug

SEQ ID NO: 3521304 - RNA, 22 nt, Pseudomonas aeruginosa PA01
caugucgguauccaccggaccc

SEQ ID NO: 3521305 - RNA, 23 nt, Pseudomonas aeruginosa PA01
caugucguggacauacaggcgcg

SEQ ID NO: 3521306 - RNA, 13 nt, Pseudomonas aeruginosa PA01
caugucugcaacc

SEQ ID NO: 3521307 - RNA, 13 nt, Pseudomonas aeruginosa PA01
caugugcuggcgg

SEQ ID NO: 3521308 - RNA, 22 nt, Pseudomonas aeruginosa PA01
caugugcuugaccgccgccugg

SEQ ID NO: 3521309 - RNA, 13 nt, Pseudomonas aeruginosa PA01
cauguggcgcagc

SEQ ID NO: 3521310 - RNA, 18 nt, Pseudomonas aeruginosa PA01
cauguuccacaugcgcuc

SEQ ID NO: 3521311 - RNA, 18 nt, Pseudomonas aeruginosa PA01
cauguuccuccagagugc

SEQ ID NO: 3521312 - RNA, 23 nt, Pseudomonas aeruginosa PA01
cauguuccuccagagugcgcagc

SEQ ID NO: 3521313 - RNA, 19 nt, Pseudomonas aeruginosa PA01
cauguugcagggucgccgg

SEQ ID NO: 3521314 - RNA, 15 nt, Pseudomonas aeruginosa PA01
cauguugcggcccag

SEQ ID NO: 3521315 - RNA, 19 nt, Pseudomonas aeruginosa PA01
cauguuguuauggccgacc

SEQ ID NO: 3521316 - RNA, 16 nt, Pseudomonas aeruginosa PA01
cauuacuauuuaccug

SEQ ID NO: 3521317 - RNA, 19 nt, Pseudomonas aeruginosa PA01
cauuacuugcccacgcaga

SEQ ID NO: 3521318 - RNA, 19 nt, Pseudomonas aeruginosa PA01
cauuagcgucgcgcggcca

SEQ ID NO: 3521319 - RNA, 12 nt, Pseudomonas aeruginosa PA01
cauucagcgcgc

SEQ ID NO: 3521320 - RNA, 13 nt, Pseudomonas aeruginosa PA01
cauucaggcggau

SEQ ID NO: 3521321 - RNA, 19 nt, Pseudomonas aeruginosa PA01
cauucaucucgccgucggc

SEQ ID NO: 3521322 - RNA, 15 nt, Pseudomonas aeruginosa PA01
cauucauggcgccac

SEQ ID NO: 3521323 - RNA, 23 nt, Pseudomonas aeruginosa PA01
cauuccagaaacggcugccggua

SEQ ID NO: 3521324 - RNA, 19 nt, Pseudomonas aeruginosa PA01
cauuccgacaaggagcgcg

SEQ ID NO: 3521325 - RNA, 19 nt, Pseudomonas aeruginosa PA01
cauuccgcggcacuccggc

SEQ ID NO: 3521326 - RNA, 21 nt, Pseudomonas aeruginosa PA01
cauuccgggcgaaagcgguac

SEQ ID NO: 3521327 - RNA, 11 nt, Pseudomonas aeruginosa PA01
cauuccuccag

SEQ ID NO: 3521328 - RNA, 22 nt, Pseudomonas aeruginosa PA01
cauuccuugauuugcccggcga

SEQ ID NO: 3521329 - RNA, 18 nt, Pseudomonas aeruginosa PA01
cauucgaauggcgccggc

SEQ ID NO: 3521330 - RNA, 19 nt, Pseudomonas aeruginosa PA01
cauucgaauggcgccggcc

SEQ ID NO: 3521331 - RNA, 19 nt, Pseudomonas aeruginosa PA01
cauucgacccgccgaccag

SEQ ID NO: 3521332 - RNA, 17 nt, Pseudomonas aeruginosa PA01
cauucgaugccgcgcgc

SEQ ID NO: 3521333 - RNA, 19 nt, Pseudomonas aeruginosa PA01
cauucgaugccgcgcgccu

SEQ ID NO: 3521334 - RNA, 16 nt, Pseudomonas aeruginosa PA01
cauucgccgcgacgcu

SEQ ID NO: 3521335 - RNA, 12 nt, Pseudomonas aeruginosa PA01
cauucgccgggc

SEQ ID NO: 3521336 - RNA, 16 nt, Pseudomonas aeruginosa PA01
cauucgcucugcgcca

SEQ ID NO: 3521337 - RNA, 21 nt, Pseudomonas aeruginosa PA01
cauucgcucugcgccaggcgg

SEQ ID NO: 3521338 - RNA, 15 nt, Pseudomonas aeruginosa PA01
cauucggccagcgcg

SEQ ID NO: 3521339 - RNA, 18 nt, Pseudomonas aeruginosa PA01
cauucggccagcgcggcg

SEQ ID NO: 3521340 - RNA, 21 nt, Pseudomonas aeruginosa PA01
cauucggccagcgcggcgcgc

SEQ ID NO: 3521341 - RNA, 13 nt, Pseudomonas aeruginosa PA01
cauucggccuggc

SEQ ID NO: 3521342 - RNA, 20 nt, Pseudomonas aeruginosa PA01
cauucggccuggcaguugca

SEQ ID NO: 3521343 - RNA, 18 nt, Pseudomonas aeruginosa PA01
cauucggugcgcuccugu

SEQ ID NO: 3521344 - RNA, 15 nt, Pseudomonas aeruginosa PA01
cauucguccagccgc

SEQ ID NO: 3521345 - RNA, 14 nt, Pseudomonas aeruginosa PA01
cauucgucgccgcu

SEQ ID NO: 3521346 - RNA, 16 nt, Pseudomonas aeruginosa PA01
cauucgucgccgcugg

SEQ ID NO: 3521347 - RNA, 12 nt, Pseudomonas aeruginosa PA01
cauucgucgcug

SEQ ID NO: 3521348 - RNA, 14 nt, Pseudomonas aeruginosa PA01
cauucuccagccgc

SEQ ID NO: 3521349 - RNA, 15 nt, Pseudomonas aeruginosa PA01
cauucuccagccgca

SEQ ID NO: 3521350 - RNA, 12 nt, Pseudomonas aeruginosa PA01
cauucucccucg

SEQ ID NO: 3521351 - RNA, 16 nt, Pseudomonas aeruginosa PA01
cauucucccucgccga

SEQ ID NO: 3521352 - RNA, 16 nt, Pseudomonas aeruginosa PA01
cauucucgcgacccug

SEQ ID NO: 3521353 - RNA, 18 nt, Pseudomonas aeruginosa PA01
cauucucgcgacccuggc

SEQ ID NO: 3521354 - RNA, 16 nt, Pseudomonas aeruginosa PA01
cauucucucuucagca

SEQ ID NO: 3521355 - RNA, 21 nt, Pseudomonas aeruginosa PA01
cauucuugggacuagagguac

SEQ ID NO: 3521356 - RNA, 17 nt, Pseudomonas aeruginosa PA01
cauugaaaaacccaugc

SEQ ID NO: 3521357 - RNA, 16 nt, Pseudomonas aeruginosa PA01
cauugaaaacggcgcc

SEQ ID NO: 3521358 - RNA, 13 nt, Pseudomonas aeruginosa PA01
cauugaaggccga

SEQ ID NO: 3521359 - RNA, 14 nt, Pseudomonas aeruginosa PA01
cauugagcgccagc

SEQ ID NO: 3521360 - RNA, 21 nt, Pseudomonas aeruginosa PA01
cauugagcgcgcccaggcagg

SEQ ID NO: 3521361 - RNA, 19 nt, Pseudomonas aeruginosa PA01
cauugcacaacgggugcug

SEQ ID NO: 3521362 - RNA, 20 nt, Pseudomonas aeruginosa PA01
cauugcacuuccacuccagg

SEQ ID NO: 3521363 - RNA, 14 nt, Pseudomonas aeruginosa PA01
cauugccaccacca

SEQ ID NO: 3521364 - RNA, 15 nt, Pseudomonas aeruginosa PA01
cauugccaccaccau

SEQ ID NO: 3521365 - RNA, 17 nt, Pseudomonas aeruginosa PA01
cauugccaccaccaugc

SEQ ID NO: 3521366 - RNA, 15 nt, Pseudomonas aeruginosa PA01
cauugcccggccagg

SEQ ID NO: 3521367 - RNA, 16 nt, Pseudomonas aeruginosa PA01
cauugcccggccaggc

SEQ ID NO: 3521368 - RNA, 18 nt, Pseudomonas aeruginosa PA01
cauugcccggccaggcgc

SEQ ID NO: 3521369 - RNA, 12 nt, Pseudomonas aeruginosa PA01
cauugccgaugu

SEQ ID NO: 3521370 - RNA, 13 nt, Pseudomonas aeruginosa PA01
cauugccgccagg

SEQ ID NO: 3521371 - RNA, 20 nt, Pseudomonas aeruginosa PA01
cauugccgggcuuccuggcc

SEQ ID NO: 3521372 - RNA, 18 nt, Pseudomonas aeruginosa PA01
cauugccguccgucggca

SEQ ID NO: 3521373 - RNA, 13 nt, Pseudomonas aeruginosa PA01
cauugcgcacggu

SEQ ID NO: 3521374 - RNA, 13 nt, Pseudomonas aeruginosa PA01
cauugcgccgccg

SEQ ID NO: 3521375 - RNA, 20 nt, Pseudomonas aeruginosa PA01
cauugcgcuccgacuccugc

SEQ ID NO: 3521376 - RNA, 14 nt, Pseudomonas aeruginosa PA01
cauugcggcccgcc

SEQ ID NO: 3521377 - RNA, 16 nt, Pseudomonas aeruginosa PA01
cauugcggcccgccac

SEQ ID NO: 3521378 - RNA, 22 nt, Pseudomonas aeruginosa PA01
cauuggccaggccccaggccgc

SEQ ID NO: 3521379 - RNA, 17 nt, Pseudomonas aeruginosa PA01
cauuggccaucagcgcc

SEQ ID NO: 3521380 - RNA, 18 nt, Pseudomonas aeruginosa PA01
cauuggccaucagcgccg

SEQ ID NO: 3521381 - RNA, 14 nt, Pseudomonas aeruginosa PA01
cauuggccgacgcc

SEQ ID NO: 3521382 - RNA, 21 nt, Pseudomonas aeruginosa PA01
cauuggcgaaguugccgccgc

SEQ ID NO: 3521383 - RNA, 17 nt, Pseudomonas aeruginosa PA01
cauugggucccugguuc

SEQ ID NO: 3521384 - RNA, 16 nt, Pseudomonas aeruginosa PA01
cauuguuggcgcucgg

SEQ ID NO: 3521385 - RNA, 18 nt, Pseudomonas aeruginosa PA01
cauuguuggcgcucggcc

SEQ ID NO: 3521386 - RNA, 12 nt, Pseudomonas aeruginosa PA01
cauuucaaggcg

SEQ ID NO: 3521387 - RNA, 22 nt, Pseudomonas aeruginosa PA01
cauuucccgcgagcagccgacg

SEQ ID NO: 3521388 - RNA, 13 nt, Pseudomonas aeruginosa PA01
cauuuccgccgga

SEQ ID NO: 3521389 - RNA, 14 nt, Pseudomonas aeruginosa PA01
cauuuccgccggau

SEQ ID NO: 3521390 - RNA, 22 nt, Pseudomonas aeruginosa PA01
cauuucgaguguccgcaguuga

SEQ ID NO: 3521391 - RNA, 13 nt, Pseudomonas aeruginosa PA01
cauuucguagccc

SEQ ID NO: 3521392 - RNA, 19 nt, Pseudomonas aeruginosa PA01
cauuucguagcccaggcgg

SEQ ID NO: 3521393 - RNA, 12 nt, Pseudomonas aeruginosa PA01
cauuucguugcg

SEQ ID NO: 3521394 - RNA, 23 nt, Pseudomonas aeruginosa PA01
cauuuguuuuaaaguucgacgau

SEQ ID NO: 3521395 - RNA, 14 nt, Pseudomonas aeruginosa PA01
ccaaagaaaaggcc

SEQ ID NO: 3521396 - RNA, 14 nt, Pseudomonas aeruginosa PA01
ccaaaugauuccug

SEQ ID NO: 3521397 - RNA, 24 nt, Pseudomonas aeruginosa PA01
ccaacagcagguagaccacgcagg

SEQ ID NO: 3521398 - RNA, 15 nt, Pseudomonas aeruginosa PA01
ccaacagccggcggg

SEQ ID NO: 3521399 - RNA, 13 nt, Pseudomonas aeruginosa PA01
ccaacagggcguc

SEQ ID NO: 3521400 - RNA, 20 nt, Pseudomonas aeruginosa PA01
ccaacagggcgucgucgagg

SEQ ID NO: 3521401 - RNA, 16 nt, Pseudomonas aeruginosa PA01
ccaacagucgucgcgc

SEQ ID NO: 3521402 - RNA, 14 nt, Pseudomonas aeruginosa PA01
ccaaccaccggcgc

SEQ ID NO: 3521403 - RNA, 22 nt, Pseudomonas aeruginosa PA01
ccaaccaggaaggcguagaccu

SEQ ID NO: 3521404 - RNA, 20 nt, Pseudomonas aeruginosa PA01
ccaaccaugguuuccgccgg

SEQ ID NO: 3521405 - RNA, 19 nt, Pseudomonas aeruginosa PA01
ccaacccgcuucgucccau

SEQ ID NO: 3521406 - RNA, 13 nt, Pseudomonas aeruginosa PA01
ccaacccggccag

SEQ ID NO: 3521407 - RNA, 14 nt, Pseudomonas aeruginosa PA01
ccaacccggccagc

SEQ ID NO: 3521408 - RNA, 16 nt, Pseudomonas aeruginosa PA01
ccaacccggccagccc

SEQ ID NO: 3521409 - RNA, 14 nt, Pseudomonas aeruginosa PA01
ccaaccgcgcucgg

SEQ ID NO: 3521410 - RNA, 15 nt, Pseudomonas aeruginosa PA01
ccaaccgcgcucggc

SEQ ID NO: 3521411 - RNA, 20 nt, Pseudomonas aeruginosa PA01
ccaaccgggcagcagccgga

SEQ ID NO: 3521412 - RNA, 13 nt, Pseudomonas aeruginosa PA01
ccaaccgucgccc

SEQ ID NO: 3521413 - RNA, 16 nt, Pseudomonas aeruginosa PA01
ccaaccgucgcccugg

SEQ ID NO: 3521414 - RNA, 20 nt, Pseudomonas aeruginosa PA01
ccaaccguucugccgcagcg

SEQ ID NO: 3521415 - RNA, 23 nt, Pseudomonas aeruginosa PA01
ccaaccguucugccgcagcgccu

SEQ ID NO: 3521416 - RNA, 13 nt, Pseudomonas aeruginosa PA01
ccaaccucucccc

SEQ ID NO: 3521417 - RNA, 12 nt, Pseudomonas aeruginosa PA01
ccaacgcaggcg

SEQ ID NO: 3521418 - RNA, 13 nt, Pseudomonas aeruginosa PA01
ccaacgcaggcgc

SEQ ID NO: 3521419 - RNA, 15 nt, Pseudomonas aeruginosa PA01
ccaacgccaccgcgc

SEQ ID NO: 3521420 - RNA, 12 nt, Pseudomonas aeruginosa PA01
ccaacgcgccgu

SEQ ID NO: 3521421 - RNA, 18 nt, Pseudomonas aeruginosa PA01
ccaacggaaaaaggcgcc

SEQ ID NO: 3521422 - RNA, 12 nt, Pseudomonas aeruginosa PA01
ccaacggccgcu

SEQ ID NO: 3521423 - RNA, 16 nt, Pseudomonas aeruginosa PA01
ccaacggcguguccag

SEQ ID NO: 3521424 - RNA, 19 nt, Pseudomonas aeruginosa PA01
ccaacggcguuauccgccg

SEQ ID NO: 3521425 - RNA, 23 nt, Pseudomonas aeruginosa PA01
ccaacggcguuauccgccgcuca

SEQ ID NO: 3521426 - RNA, 23 nt, Pseudomonas aeruginosa PA01
ccaacgguagcggaucagccggc

SEQ ID NO: 3521427 - RNA, 16 nt, Pseudomonas aeruginosa PA01
ccaacguccucgaugc

SEQ ID NO: 3521428 - RNA, 19 nt, Pseudomonas aeruginosa PA01
ccaacucagucgagguaga

SEQ ID NO: 3521429 - RNA, 14 nt, Pseudomonas aeruginosa PA01
ccaacugagcggcg

SEQ ID NO: 3521430 - RNA, 20 nt, Pseudomonas aeruginosa PA01
ccaacugcgcccccagcgcc

SEQ ID NO: 3521431 - RNA, 21 nt, Pseudomonas aeruginosa PA01
ccaacugcuugccgagcuggg

SEQ ID NO: 3521432 - RNA, 22 nt, Pseudomonas aeruginosa PA01
ccaacuggauuuccuucggcac

SEQ ID NO: 3521433 - RNA, 16 nt, Pseudomonas aeruginosa PA01
ccaacuggcggaugcg

SEQ ID NO: 3521434 - RNA, 14 nt, Pseudomonas aeruginosa PA01
ccaacuggcggcug

SEQ ID NO: 3521435 - RNA, 17 nt, Pseudomonas aeruginosa PA01
ccaacuggcguccccau

SEQ ID NO: 3521436 - RNA, 17 nt, Pseudomonas aeruginosa PA01
ccaagagagcgccagcg

SEQ ID NO: 3521437 - RNA, 19 nt, Pseudomonas aeruginosa PA01
ccaagagagcgccagcgag

SEQ ID NO: 3521438 - RNA, 16 nt, Pseudomonas aeruginosa PA01
ccaagccaccagcgac

SEQ ID NO: 3521439 - RNA, 18 nt, Pseudomonas aeruginosa PA01
ccaagcccggcgagagcg

SEQ ID NO: 3521440 - RNA, 17 nt, Pseudomonas aeruginosa PA01
ccaagcgagacgccgcc

SEQ ID NO: 3521441 - RNA, 16 nt, Pseudomonas aeruginosa PA01
ccaagcuguugcucca

SEQ ID NO: 3521442 - RNA, 19 nt, Pseudomonas aeruginosa PA01
ccaagcuuguugcgcaggc

SEQ ID NO: 3521443 - RNA, 13 nt, Pseudomonas aeruginosa PA01
ccaaggaugcgcc

SEQ ID NO: 3521444 - RNA, 18 nt, Pseudomonas aeruginosa PA01
ccaaggaugcgccagcgg

SEQ ID NO: 3521445 - RNA, 20 nt, Pseudomonas aeruginosa PA01
ccaaggaugcgccagcggcc

SEQ ID NO: 3521446 - RNA, 12 nt, Pseudomonas aeruginosa PA01
ccaaggccgcca

SEQ ID NO: 3521447 - RNA, 13 nt, Pseudomonas aeruginosa PA01
ccaaggccgccag

SEQ ID NO: 3521448 - RNA, 14 nt, Pseudomonas aeruginosa PA01
ccaaggccgccagg

SEQ ID NO: 3521449 - RNA, 15 nt, Pseudomonas aeruginosa PA01
ccaagggccugggcg

SEQ ID NO: 3521450 - RNA, 16 nt, Pseudomonas aeruginosa PA01
ccaagggccugggcgc

SEQ ID NO: 3521451 - RNA, 21 nt, Pseudomonas aeruginosa PA01
ccaagggccugggcgccgcca

SEQ ID NO: 3521452 - RNA, 15 nt, Pseudomonas aeruginosa PA01
ccaagggcgccgccg

SEQ ID NO: 3521453 - RNA, 16 nt, Pseudomonas aeruginosa PA01
ccaagggcgccgccga

SEQ ID NO: 3521454 - RNA, 14 nt, Pseudomonas aeruginosa PA01
ccaaggggccgcgc

SEQ ID NO: 3521455 - RNA, 15 nt, Pseudomonas aeruginosa PA01
ccaaggggccgcgcu

SEQ ID NO: 3521456 - RNA, 21 nt, Pseudomonas aeruginosa PA01
ccaagguacggggcugcggcc

SEQ ID NO: 3521457 - RNA, 22 nt, Pseudomonas aeruginosa PA01
ccaagguuccagccccgccgga

SEQ ID NO: 3521458 - RNA, 14 nt, Pseudomonas aeruginosa PA01
ccaagucggccgcc

SEQ ID NO: 3521459 - RNA, 15 nt, Pseudomonas aeruginosa PA01
ccaagucggccgccc

SEQ ID NO: 3521460 - RNA, 18 nt, Pseudomonas aeruginosa PA01
ccaagucggccgcccagc

SEQ ID NO: 3521461 - RNA, 20 nt, Pseudomonas aeruginosa PA01
ccaagucggccgcccagcgg

SEQ ID NO: 3521462 - RNA, 17 nt, Pseudomonas aeruginosa PA01
ccaaguugccuggcagg

SEQ ID NO: 3521463 - RNA, 18 nt, Pseudomonas aeruginosa PA01
ccaaguugccuggcaggu

SEQ ID NO: 3521464 - RNA, 14 nt, Pseudomonas aeruginosa PA01
ccaauacccacagg

SEQ ID NO: 3521465 - RNA, 15 nt, Pseudomonas aeruginosa PA01
ccaauacccacaggg

SEQ ID NO: 3521466 - RNA, 22 nt, Pseudomonas aeruginosa PA01
ccaauccgauuccgcgcaggac

SEQ ID NO: 3521467 - RNA, 14 nt, Pseudomonas aeruginosa PA01
ccaauccgcgccgg

SEQ ID NO: 3521468 - RNA, 15 nt, Pseudomonas aeruginosa PA01
ccaaugcaccugcgc

SEQ ID NO: 3521469 - RNA, 16 nt, Pseudomonas aeruginosa PA01
ccaaugccagugccuc

SEQ ID NO: 3521470 - RNA, 22 nt, Pseudomonas aeruginosa PA01
ccaaugccuuccgacgccgcgu

SEQ ID NO: 3521471 - RNA, 16 nt, Pseudomonas aeruginosa PA01
ccaauucgacgccgaa

SEQ ID NO: 3521472 - RNA, 20 nt, Pseudomonas aeruginosa PA01
ccaauugcccguagggcgaa

SEQ ID NO: 3521473 - RNA, 18 nt, Pseudomonas aeruginosa PA01
ccaauugccguagggcga

SEQ ID NO: 3521474 - RNA, 19 nt, Pseudomonas aeruginosa PA01
ccaauugccguagggcgaa

SEQ ID NO: 3521475 - RNA, 20 nt, Pseudomonas aeruginosa PA01
ccacaaggugggcagcagcg

SEQ ID NO: 3521476 - RNA, 24 nt, Pseudomonas aeruginosa PA01
ccacaaggugggcagcagcgaacg

SEQ ID NO: 3521477 - RNA, 11 nt, Pseudomonas aeruginosa PA01
ccacaccaggu

SEQ ID NO: 3521478 - RNA, 15 nt, Pseudomonas aeruginosa PA01
ccacaccaggucgcc

SEQ ID NO: 3521479 - RNA, 22 nt, Pseudomonas aeruginosa PA01
ccacaccugcaacacgucggac

SEQ ID NO: 3521480 - RNA, 21 nt, Pseudomonas aeruginosa PA01
ccacagaucgccagcucgccg

SEQ ID NO: 3521481 - RNA, 16 nt, Pseudomonas aeruginosa PA01
ccacagcugccagccc

SEQ ID NO: 3521482 - RNA, 18 nt, Pseudomonas aeruginosa PA01
ccacagcugccagccccg

SEQ ID NO: 3521483 - RNA, 14 nt, Pseudomonas aeruginosa PA01
ccacaggcccugca

SEQ ID NO: 3521484 - RNA, 13 nt, Pseudomonas aeruginosa PA01
ccacaggcccugg

SEQ ID NO: 3521485 - RNA, 19 nt, Pseudomonas aeruginosa PA01
ccacaggcccuggaucacc

SEQ ID NO: 3521486 - RNA, 13 nt, Pseudomonas aeruginosa PA01
ccacaggccggcu

SEQ ID NO: 3521487 - RNA, 21 nt, Pseudomonas aeruginosa PA01
ccacaggccggcuaaccgcga

SEQ ID NO: 3521488 - RNA, 21 nt, Pseudomonas aeruginosa PA01
ccacaggcguuauccgccgau

SEQ ID NO: 3521489 - RNA, 23 nt, Pseudomonas aeruginosa PA01
ccacaggcguuauccgccgccga

SEQ ID NO: 3521490 - RNA, 20 nt, Pseudomonas aeruginosa PA01
ccacaggguggcgggcggcc

SEQ ID NO: 3521491 - RNA, 18 nt, Pseudomonas aeruginosa PA01
ccacagguggaucgcggc

SEQ ID NO: 3521492 - RNA, 16 nt, Pseudomonas aeruginosa PA01
ccacagugccaggcuc

SEQ ID NO: 3521493 - RNA, 16 nt, Pseudomonas aeruginosa PA01
ccacaguuucauggug

SEQ ID NO: 3521494 - RNA, 15 nt, Pseudomonas aeruginosa PA01
ccacauccuugccgu

SEQ ID NO: 3521495 - RNA, 15 nt, Pseudomonas aeruginosa PA01
ccacaucggccaguc

SEQ ID NO: 3521496 - RNA, 13 nt, Pseudomonas aeruginosa PA01
ccacaugggcgac

SEQ ID NO: 3521497 - RNA, 19 nt, Pseudomonas aeruginosa PA01
ccacaugggcgaccgguuc

SEQ ID NO: 3521498 - RNA, 14 nt, Pseudomonas aeruginosa PA01
ccaccaccacgacg

SEQ ID NO: 3521499 - RNA, 13 nt, Pseudomonas aeruginosa PA01
ccaccaccaggac

SEQ ID NO: 3521500 - RNA, 19 nt, Pseudomonas aeruginosa PA01
ccaccaccaucgccgcgga

SEQ ID NO: 3521501 - RNA, 14 nt, Pseudomonas aeruginosa PA01
ccaccaccaugccu

SEQ ID NO: 3521502 - RNA, 14 nt, Pseudomonas aeruginosa PA01
ccaccaccgacagg

SEQ ID NO: 3521503 - RNA, 15 nt, Pseudomonas aeruginosa PA01
ccaccacgacguugc

SEQ ID NO: 3521504 - RNA, 21 nt, Pseudomonas aeruginosa PA01
ccaccacgaucugcuugcgcg

SEQ ID NO: 3521505 - RNA, 19 nt, Pseudomonas aeruginosa PA01
ccaccacgccgucgccgcu

SEQ ID NO: 3521506 - RNA, 18 nt, Pseudomonas aeruginosa PA01
ccaccacucgcgagcugg

SEQ ID NO: 3521507 - RNA, 20 nt, Pseudomonas aeruginosa PA01
ccaccacucgcgagcuggcg

SEQ ID NO: 3521508 - RNA, 22 nt, Pseudomonas aeruginosa PA01
ccaccacucgcgagcuggcgcc

SEQ ID NO: 3521509 - RNA, 23 nt, Pseudomonas aeruginosa PA01
ccaccacucgcgagcuggcgccg

SEQ ID NO: 3521510 - RNA, 12 nt, Pseudomonas aeruginosa PA01
ccaccagagcca

SEQ ID NO: 3521511 - RNA, 20 nt, Pseudomonas aeruginosa PA01
ccaccagagccagccgcgag

SEQ ID NO: 3521512 - RNA, 15 nt, Pseudomonas aeruginosa PA01
ccaccagcagcagcg

SEQ ID NO: 3521513 - RNA, 16 nt, Pseudomonas aeruginosa PA01
ccaccagcagcagcgg

SEQ ID NO: 3521514 - RNA, 21 nt, Pseudomonas aeruginosa PA01
ccaccagcaggaucgagcccu

SEQ ID NO: 3521515 - RNA, 18 nt, Pseudomonas aeruginosa PA01
ccaccagcagggccaggc

SEQ ID NO: 3521516 - RNA, 21 nt, Pseudomonas aeruginosa PA01
ccaccagcagggccaggccga

SEQ ID NO: 3521517 - RNA, 20 nt, Pseudomonas aeruginosa PA01
ccaccagcaucaccaccggg

SEQ ID NO: 3521518 - RNA, 11 nt, Pseudomonas aeruginosa PA01
ccaccagccag

SEQ ID NO: 3521519 - RNA, 14 nt, Pseudomonas aeruginosa PA01
ccaccagccagcuc

SEQ ID NO: 3521520 - RNA, 21 nt, Pseudomonas aeruginosa PA01
ccaccagccaguagucuuccu

SEQ ID NO: 3521521 - RNA, 16 nt, Pseudomonas aeruginosa PA01
ccaccagccagucgag

SEQ ID NO: 3521522 - RNA, 15 nt, Pseudomonas aeruginosa PA01
ccaccagcccgcagg

SEQ ID NO: 3521523 - RNA, 16 nt, Pseudomonas aeruginosa PA01
ccaccagcccgcaggg

SEQ ID NO: 3521524 - RNA, 20 nt, Pseudomonas aeruginosa PA01
ccaccagcgaaagcgucagc

SEQ ID NO: 3521525 - RNA, 12 nt, Pseudomonas aeruginosa PA01
ccaccagcgagu

SEQ ID NO: 3521526 - RNA, 21 nt, Pseudomonas aeruginosa PA01
ccaccagcgagucgacccagg

SEQ ID NO: 3521527 - RNA, 12 nt, Pseudomonas aeruginosa PA01
ccaccagcgccc

SEQ ID NO: 3521528 - RNA, 15 nt, Pseudomonas aeruginosa PA01
ccaccagcgccgcca

SEQ ID NO: 3521529 - RNA, 13 nt, Pseudomonas aeruginosa PA01
ccaccagcgccgg

SEQ ID NO: 3521530 - RNA, 17 nt, Pseudomonas aeruginosa PA01
ccaccagcgccggcggc

SEQ ID NO: 3521531 - RNA, 20 nt, Pseudomonas aeruginosa PA01
ccaccagcgccggcggcgcg

SEQ ID NO: 3521532 - RNA, 14 nt, Pseudomonas aeruginosa PA01
ccaccagcgcgcgc

SEQ ID NO: 3521533 - RNA, 21 nt, Pseudomonas aeruginosa PA01
ccaccagcgcgcgcuggcgca

SEQ ID NO: 3521534 - RNA, 13 nt, Pseudomonas aeruginosa PA01
ccaccagcgucgc

SEQ ID NO: 3521535 - RNA, 14 nt, Pseudomonas aeruginosa PA01
ccaccagcgucgcc

SEQ ID NO: 3521536 - RNA, 15 nt, Pseudomonas aeruginosa PA01
ccaccagcgucgcca

SEQ ID NO: 3521537 - RNA, 17 nt, Pseudomonas aeruginosa PA01
ccaccagcgucgccagg

SEQ ID NO: 3521538 - RNA, 20 nt, Pseudomonas aeruginosa PA01
ccaccagcgucgccaggccg

SEQ ID NO: 3521539 - RNA, 15 nt, Pseudomonas aeruginosa PA01
ccaccagcguggcgc

SEQ ID NO: 3521540 - RNA, 21 nt, Pseudomonas aeruginosa PA01
ccaccaggaaggcgucgccgu

SEQ ID NO: 3521541 - RNA, 19 nt, Pseudomonas aeruginosa PA01
ccaccaggccauagcgcgc

SEQ ID NO: 3521542 - RNA, 23 nt, Pseudomonas aeruginosa PA01
ccaccaggccauagcgcgccggg

SEQ ID NO: 3521543 - RNA, 15 nt, Pseudomonas aeruginosa PA01
ccaccaggccgcugc

SEQ ID NO: 3521544 - RNA, 16 nt, Pseudomonas aeruginosa PA01
ccaccaggccgcugcc

SEQ ID NO: 3521545 - RNA, 22 nt, Pseudomonas aeruginosa PA01
ccaccaggccgcugccgccgcg

SEQ ID NO: 3521546 - RNA, 11 nt, Pseudomonas aeruginosa PA01
ccaccaggcgc

SEQ ID NO: 3521547 - RNA, 12 nt, Pseudomonas aeruginosa PA01
ccaccaggcgcc

SEQ ID NO: 3521548 - RNA, 17 nt, Pseudomonas aeruginosa PA01
ccaccaggcggucgcgg

SEQ ID NO: 3521549 - RNA, 19 nt, Pseudomonas aeruginosa PA01
ccaccaggcuuacccgcga

SEQ ID NO: 3521550 - RNA, 14 nt, Pseudomonas aeruginosa PA01
ccaccagggccucg

SEQ ID NO: 3521551 - RNA, 21 nt, Pseudomonas aeruginosa PA01
ccaccaggguaccgaaacagg

SEQ ID NO: 3521552 - RNA, 21 nt, Pseudomonas aeruginosa PA01
ccaccagggucgguucgcggc

SEQ ID NO: 3521553 - RNA, 23 nt, Pseudomonas aeruginosa PA01
ccaccagggucgguucgcggcgc

SEQ ID NO: 3521554 - RNA, 12 nt, Pseudomonas aeruginosa PA01
ccaccaggucgc

SEQ ID NO: 3521555 - RNA, 14 nt, Pseudomonas aeruginosa PA01
ccaccaggucgccg

SEQ ID NO: 3521556 - RNA, 17 nt, Pseudomonas aeruginosa PA01
ccaccauaaagcccaca

SEQ ID NO: 3521557 - RNA, 19 nt, Pseudomonas aeruginosa PA01
ccaccaucacgucgcgcac

SEQ ID NO: 3521558 - RNA, 13 nt, Pseudomonas aeruginosa PA01
ccaccaucgccgc

SEQ ID NO: 3521559 - RNA, 16 nt, Pseudomonas aeruginosa PA01
ccaccaucgccgcgga

SEQ ID NO: 3521560 - RNA, 17 nt, Pseudomonas aeruginosa PA01
ccaccaugugcuggcgg

SEQ ID NO: 3521561 - RNA, 12 nt, Pseudomonas aeruginosa PA01
ccacccagcagc

SEQ ID NO: 3521562 - RNA, 13 nt, Pseudomonas aeruginosa PA01
ccacccagcagca

SEQ ID NO: 3521563 - RNA, 16 nt, Pseudomonas aeruginosa PA01
ccacccagccgcggcc

SEQ ID NO: 3521564 - RNA, 13 nt, Pseudomonas aeruginosa PA01
ccacccaggcgcc

SEQ ID NO: 3521565 - RNA, 15 nt, Pseudomonas aeruginosa PA01
ccacccaggcgccga

SEQ ID NO: 3521566 - RNA, 18 nt, Pseudomonas aeruginosa PA01
ccacccaucugccggcca

SEQ ID NO: 3521567 - RNA, 19 nt, Pseudomonas aeruginosa PA01
ccaccccaggguuggcggc

SEQ ID NO: 3521568 - RNA, 20 nt, Pseudomonas aeruginosa PA01
ccaccccaggguuggcggca

SEQ ID NO: 3521569 - RNA, 23 nt, Pseudomonas aeruginosa PA01
ccaccccaggguuggcggcaucg

SEQ ID NO: 3521570 - RNA, 23 nt, Pseudomonas aeruginosa PA01
ccacccccgcaaccgcugccgcc

SEQ ID NO: 3521571 - RNA, 20 nt, Pseudomonas aeruginosa PA01
ccaccccgccgcuggcggca

SEQ ID NO: 3521572 - RNA, 15 nt, Pseudomonas aeruginosa PA01
ccacccgcagccccg

SEQ ID NO: 3521573 - RNA, 14 nt, Pseudomonas aeruginosa PA01
ccacccgcagccgc

SEQ ID NO: 3521574 - RNA, 21 nt, Pseudomonas aeruginosa PA01
ccacccgcagccgcgugcgcg

SEQ ID NO: 3521575 - RNA, 15 nt, Pseudomonas aeruginosa PA01
ccacccgcgggcagc

SEQ ID NO: 3521576 - RNA, 16 nt, Pseudomonas aeruginosa PA01
ccacccggccauggcg

SEQ ID NO: 3521577 - RNA, 12 nt, Pseudomonas aeruginosa PA01
ccacccggccgc

SEQ ID NO: 3521578 - RNA, 13 nt, Pseudomonas aeruginosa PA01
ccacccggccgcg

SEQ ID NO: 3521579 - RNA, 15 nt, Pseudomonas aeruginosa PA01
ccacccggccgcgcu

SEQ ID NO: 3521580 - RNA, 20 nt, Pseudomonas aeruginosa PA01
ccacccggcgcacgccggcc

SEQ ID NO: 3521581 - RNA, 18 nt, Pseudomonas aeruginosa PA01
ccacccggcugcaugccg

SEQ ID NO: 3521582 - RNA, 13 nt, Pseudomonas aeruginosa PA01
ccacccgucccgc

SEQ ID NO: 3521583 - RNA, 16 nt, Pseudomonas aeruginosa PA01
ccacccgucccgcgcg

SEQ ID NO: 3521584 - RNA, 17 nt, Pseudomonas aeruginosa PA01
ccacccgucccgcgcgc

SEQ ID NO: 3521585 - RNA, 20 nt, Pseudomonas aeruginosa PA01
ccacccgucccgcgcgccga

SEQ ID NO: 3521586 - RNA, 13 nt, Pseudomonas aeruginosa PA01
ccacccguuccuu

SEQ ID NO: 3521587 - RNA, 20 nt, Pseudomonas aeruginosa PA01
ccacccguuccuugcgcggc

SEQ ID NO: 3521588 - RNA, 16 nt, Pseudomonas aeruginosa PA01
ccacccguucgccggc

SEQ ID NO: 3521589 - RNA, 20 nt, Pseudomonas aeruginosa PA01
ccacccguucgccggccucc

SEQ ID NO: 3521590 - RNA, 18 nt, Pseudomonas aeruginosa PA01
ccacccucggcuucgucc

SEQ ID NO: 3521591 - RNA, 21 nt, Pseudomonas aeruginosa PA01
ccacccuugcguccugccucg

SEQ ID NO: 3521592 - RNA, 20 nt, Pseudomonas aeruginosa PA01
ccacccuuggagccgcccuc

SEQ ID NO: 3521593 - RNA, 21 nt, Pseudomonas aeruginosa PA01
ccacccuugggucaucgaaca

SEQ ID NO: 3521594 - RNA, 17 nt, Pseudomonas aeruginosa PA01
ccaccgaaucggacagg

SEQ ID NO: 3521595 - RNA, 20 nt, Pseudomonas aeruginosa PA01
ccaccgacaggccgaccagc

SEQ ID NO: 3521596 - RNA, 24 nt, Pseudomonas aeruginosa PA01
ccaccgacaggccgaccagcaggg

SEQ ID NO: 3521597 - RNA, 16 nt, Pseudomonas aeruginosa PA01
ccaccgacgccggacg

SEQ ID NO: 3521598 - RNA, 22 nt, Pseudomonas aeruginosa PA01
ccaccgacggcuccggauggcu

SEQ ID NO: 3521599 - RNA, 20 nt, Pseudomonas aeruginosa PA01
ccaccgagagcggcgccagg

SEQ ID NO: 3521600 - RNA, 22 nt, Pseudomonas aeruginosa PA01
ccaccgagagcggcgccaggcg

SEQ ID NO: 3521601 - RNA, 23 nt, Pseudomonas aeruginosa PA01
ccaccgagagcggcgccaggcgu

SEQ ID NO: 3521602 - RNA, 15 nt, Pseudomonas aeruginosa PA01
ccaccgaguggcgca

SEQ ID NO: 3521603 - RNA, 18 nt, Pseudomonas aeruginosa PA01
ccaccgaguggcgcagcg

SEQ ID NO: 3521604 - RNA, 19 nt, Pseudomonas aeruginosa PA01
ccaccgauggcgcgcuuuc

SEQ ID NO: 3521605 - RNA, 15 nt, Pseudomonas aeruginosa PA01
ccaccgauucgccgg

SEQ ID NO: 3521606 - RNA, 18 nt, Pseudomonas aeruginosa PA01
ccaccgauucgccggcca

SEQ ID NO: 3521607 - RNA, 23 nt, Pseudomonas aeruginosa PA01
ccaccgccaccugccccgggcgc

SEQ ID NO: 3521608 - RNA, 12 nt, Pseudomonas aeruginosa PA01
ccaccgccagca

SEQ ID NO: 3521609 - RNA, 14 nt, Pseudomonas aeruginosa PA01
ccaccgccagcacc

SEQ ID NO: 3521610 - RNA, 16 nt, Pseudomonas aeruginosa PA01
ccaccgccagcaccca

SEQ ID NO: 3521611 - RNA, 12 nt, Pseudomonas aeruginosa PA01
ccaccgccaggc

SEQ ID NO: 3521612 - RNA, 13 nt, Pseudomonas aeruginosa PA01
ccaccgccagggc

SEQ ID NO: 3521613 - RNA, 16 nt, Pseudomonas aeruginosa PA01
ccaccgccagggcgcu

SEQ ID NO: 3521614 - RNA, 14 nt, Pseudomonas aeruginosa PA01
ccaccgccaugcug

SEQ ID NO: 3521615 - RNA, 12 nt, Pseudomonas aeruginosa PA01
ccaccgccgcca

SEQ ID NO: 3521616 - RNA, 13 nt, Pseudomonas aeruginosa PA01
ccaccgccgccag

SEQ ID NO: 3521617 - RNA, 14 nt, Pseudomonas aeruginosa PA01
ccaccgccgccagc

SEQ ID NO: 3521618 - RNA, 15 nt, Pseudomonas aeruginosa PA01
ccaccgccgccagca

SEQ ID NO: 3521619 - RNA, 18 nt, Pseudomonas aeruginosa PA01
ccaccgccgccagcaacg

SEQ ID NO: 3521620 - RNA, 12 nt, Pseudomonas aeruginosa PA01
ccaccgccugcc

SEQ ID NO: 3521621 - RNA, 18 nt, Pseudomonas aeruginosa PA01
ccaccgccuggaccaggu

SEQ ID NO: 3521622 - RNA, 22 nt, Pseudomonas aeruginosa PA01
ccaccgccuggucgccgggauu

SEQ ID NO: 3521623 - RNA, 11 nt, Pseudomonas aeruginosa PA01
ccaccgcgacg

SEQ ID NO: 3521624 - RNA, 14 nt, Pseudomonas aeruginosa PA01
ccaccgcgacgcgc

SEQ ID NO: 3521625 - RNA, 12 nt, Pseudomonas aeruginosa PA01
ccaccgcgccga

SEQ ID NO: 3521626 - RNA, 13 nt, Pseudomonas aeruginosa PA01
ccaccgcgcgccc

SEQ ID NO: 3521627 - RNA, 21 nt, Pseudomonas aeruginosa PA01
ccaccgcgcggcacaggcggc

SEQ ID NO: 3521628 - RNA, 22 nt, Pseudomonas aeruginosa PA01
ccaccgcgcggcacaggcggcu

SEQ ID NO: 3521629 - RNA, 18 nt, Pseudomonas aeruginosa PA01
ccaccgcggccucgcugg

SEQ ID NO: 3521630 - RNA, 16 nt, Pseudomonas aeruginosa PA01
ccaccgcggcguccgc

SEQ ID NO: 3521631 - RNA, 24 nt, Pseudomonas aeruginosa PA01
ccaccgcgggggucggaugcagcg

SEQ ID NO: 3521632 - RNA, 20 nt, Pseudomonas aeruginosa PA01
ccaccgcuccggcgccgagg

SEQ ID NO: 3521633 - RNA, 20 nt, Pseudomonas aeruginosa PA01
ccaccgcucgaguucgcgcg

SEQ ID NO: 3521634 - RNA, 21 nt, Pseudomonas aeruginosa PA01
ccaccgcucgaguucgcgcgg

SEQ ID NO: 3521635 - RNA, 13 nt, Pseudomonas aeruginosa PA01
ccaccgcuucgcg

SEQ ID NO: 3521636 - RNA, 22 nt, Pseudomonas aeruginosa PA01
ccaccgcuucgcggaucaacgc

SEQ ID NO: 3521637 - RNA, 18 nt, Pseudomonas aeruginosa PA01
ccaccgcuuucagcgccg

SEQ ID NO: 3521638 - RNA, 21 nt, Pseudomonas aeruginosa PA01
ccaccgcuuucagcgccgcuc

SEQ ID NO: 3521639 - RNA, 22 nt, Pseudomonas aeruginosa PA01
ccaccgcuuucagcgccgcucg

SEQ ID NO: 3521640 - RNA, 13 nt, Pseudomonas aeruginosa PA01
ccaccggacccgg

SEQ ID NO: 3521641 - RNA, 20 nt, Pseudomonas aeruginosa PA01
ccaccggacccggcugcacg

SEQ ID NO: 3521642 - RNA, 17 nt, Pseudomonas aeruginosa PA01
ccaccggaucgcccugg

SEQ ID NO: 3521643 - RNA, 20 nt, Pseudomonas aeruginosa PA01
ccaccggaucgcccuggcgc

SEQ ID NO: 3521644 - RNA, 21 nt, Pseudomonas aeruginosa PA01
ccaccggaucgcccuggcgcc

SEQ ID NO: 3521645 - RNA, 23 nt, Pseudomonas aeruginosa PA01
ccaccggauugucgauguauccg

SEQ ID NO: 3521646 - RNA, 14 nt, Pseudomonas aeruginosa PA01
ccaccggcacgcca

SEQ ID NO: 3521647 - RNA, 16 nt, Pseudomonas aeruginosa PA01
ccaccggcacgccauc

SEQ ID NO: 3521648 - RNA, 21 nt, Pseudomonas aeruginosa PA01
ccaccggcacgccauccuccg

SEQ ID NO: 3521649 - RNA, 22 nt, Pseudomonas aeruginosa PA01
ccaccggcccggagaucgccgc

SEQ ID NO: 3521650 - RNA, 12 nt, Pseudomonas aeruginosa PA01
ccaccggccgcg

SEQ ID NO: 3521651 - RNA, 12 nt, Pseudomonas aeruginosa PA01
ccaccggcgucc

SEQ ID NO: 3521652 - RNA, 20 nt, Pseudomonas aeruginosa PA01
ccaccggcguccacuccggc

SEQ ID NO: 3521653 - RNA, 12 nt, Pseudomonas aeruginosa PA01
ccaccggcuggc

SEQ ID NO: 3521654 - RNA, 14 nt, Pseudomonas aeruginosa PA01
ccaccggcuggccg

SEQ ID NO: 3521655 - RNA, 15 nt, Pseudomonas aeruginosa PA01
ccaccggcuggccgc

SEQ ID NO: 3521656 - RNA, 13 nt, Pseudomonas aeruginosa PA01
ccaccggcuggcg

SEQ ID NO: 3521657 - RNA, 19 nt, Pseudomonas aeruginosa PA01
ccaccggcuugccgggugc

SEQ ID NO: 3521658 - RNA, 17 nt, Pseudomonas aeruginosa PA01
ccaccgggaucagcggc

SEQ ID NO: 3521659 - RNA, 18 nt, Pseudomonas aeruginosa PA01
ccaccgggaucagcggcg

SEQ ID NO: 3521660 - RNA, 23 nt, Pseudomonas aeruginosa PA01
ccaccgggaucgcuaccgacagg

SEQ ID NO: 3521661 - RNA, 15 nt, Pseudomonas aeruginosa PA01
ccaccgggccgucgg

SEQ ID NO: 3521662 - RNA, 16 nt, Pseudomonas aeruginosa PA01
ccaccgggccgucggg

SEQ ID NO: 3521663 - RNA, 22 nt, Pseudomonas aeruginosa PA01
ccaccgggugcagguucaccgc

SEQ ID NO: 3521664 - RNA, 22 nt, Pseudomonas aeruginosa PA01
ccaccgguacgcucaccaccac

SEQ ID NO: 3521665 - RNA, 16 nt, Pseudomonas aeruginosa PA01
ccaccggucuuggcgc

SEQ ID NO: 3521666 - RNA, 17 nt, Pseudomonas aeruginosa PA01
ccaccgguggcgacgcg

SEQ ID NO: 3521667 - RNA, 23 nt, Pseudomonas aeruginosa PA01
ccaccgguggcgacgcgcaggcc

SEQ ID NO: 3521668 - RNA, 16 nt, Pseudomonas aeruginosa PA01
ccaccgguuucgccag

SEQ ID NO: 3521669 - RNA, 21 nt, Pseudomonas aeruginosa PA01
ccaccgucgcggucaucgccg

SEQ ID NO: 3521670 - RNA, 23 nt, Pseudomonas aeruginosa PA01
ccaccgucgcggucaucgccggc

SEQ ID NO: 3521671 - RNA, 15 nt, Pseudomonas aeruginosa PA01
ccaccgucuggcgca

SEQ ID NO: 3521672 - RNA, 20 nt, Pseudomonas aeruginosa PA01
ccaccgugaccagcauggcg

SEQ ID NO: 3521673 - RNA, 16 nt, Pseudomonas aeruginosa PA01
ccaccgugcccgccgg

SEQ ID NO: 3521674 - RNA, 19 nt, Pseudomonas aeruginosa PA01
ccaccgugcccgccggcgc

SEQ ID NO: 3521675 - RNA, 14 nt, Pseudomonas aeruginosa PA01
ccaccgugcgcacc

SEQ ID NO: 3521676 - RNA, 16 nt, Pseudomonas aeruginosa PA01
ccaccgugcgcaccuc

SEQ ID NO: 3521677 - RNA, 14 nt, Pseudomonas aeruginosa PA01
ccaccguggcgacg

SEQ ID NO: 3521678 - RNA, 12 nt, Pseudomonas aeruginosa PA01
ccaccguggcgc

SEQ ID NO: 3521679 - RNA, 14 nt, Pseudomonas aeruginosa PA01
ccaccguggcgccg

SEQ ID NO: 3521680 - RNA, 15 nt, Pseudomonas aeruginosa PA01
ccaccguggcgccgg

SEQ ID NO: 3521681 - RNA, 21 nt, Pseudomonas aeruginosa PA01
ccaccguggcgccggcgcgcu

SEQ ID NO: 3521682 - RNA, 22 nt, Pseudomonas aeruginosa PA01
ccaccguggcgccggcgcgcuu

SEQ ID NO: 3521683 - RNA, 17 nt, Pseudomonas aeruginosa PA01
ccaccguuccgacccgg

SEQ ID NO: 3521684 - RNA, 18 nt, Pseudomonas aeruginosa PA01
ccaccguuccgacccggc

SEQ ID NO: 3521685 - RNA, 18 nt, Pseudomonas aeruginosa PA01
ccaccuccggaugcagau

SEQ ID NO: 3521686 - RNA, 17 nt, Pseudomonas aeruginosa PA01
ccaccucgacccuggcg

SEQ ID NO: 3521687 - RNA, 18 nt, Pseudomonas aeruginosa PA01
ccaccucgacccuggcgc

SEQ ID NO: 3521688 - RNA, 19 nt, Pseudomonas aeruginosa PA01
ccaccucgacccuggcgcc

SEQ ID NO: 3521689 - RNA, 13 nt, Pseudomonas aeruginosa PA01
ccaccucgacggc

SEQ ID NO: 3521690 - RNA, 13 nt, Pseudomonas aeruginosa PA01
ccaccucgccaag

SEQ ID NO: 3521691 - RNA, 19 nt, Pseudomonas aeruginosa PA01
ccaccucgccaagcuggcg

SEQ ID NO: 3521692 - RNA, 23 nt, Pseudomonas aeruginosa PA01
ccaccucgccaagcuggcgaucg

SEQ ID NO: 3521693 - RNA, 14 nt, Pseudomonas aeruginosa PA01
ccaccucgcccucg

SEQ ID NO: 3521694 - RNA, 15 nt, Pseudomonas aeruginosa PA01
ccaccucgcccucgc

SEQ ID NO: 3521695 - RNA, 16 nt, Pseudomonas aeruginosa PA01
ccaccucggcgucggc

SEQ ID NO: 3521696 - RNA, 18 nt, Pseudomonas aeruginosa PA01
ccaccucggcgucggcau

SEQ ID NO: 3521697 - RNA, 21 nt, Pseudomonas aeruginosa PA01
ccaccugaacgcgcccggcca

SEQ ID NO: 3521698 - RNA, 23 nt, Pseudomonas aeruginosa PA01
ccaccugaacgcgcccggccagg

SEQ ID NO: 3521699 - RNA, 19 nt, Pseudomonas aeruginosa PA01
ccaccugcaugcuuuugaa

SEQ ID NO: 3521700 - RNA, 21 nt, Pseudomonas aeruginosa PA01
ccaccugcaugcuuuugaaca

SEQ ID NO: 3521701 - RNA, 21 nt, Pseudomonas aeruginosa PA01
ccaccugcucgcugaaccgcg

SEQ ID NO: 3521702 - RNA, 12 nt, Pseudomonas aeruginosa PA01
ccaccuggcggc

SEQ ID NO: 3521703 - RNA, 20 nt, Pseudomonas aeruginosa PA01
ccaccuggcucuguuccucg

SEQ ID NO: 3521704 - RNA, 15 nt, Pseudomonas aeruginosa PA01
ccaccugguagguca

SEQ ID NO: 3521705 - RNA, 21 nt, Pseudomonas aeruginosa PA01
ccaccugguaggucacuuccg

SEQ ID NO: 3521706 - RNA, 22 nt, Pseudomonas aeruginosa PA01
ccaccugguaggucacuuccgu

SEQ ID NO: 3521707 - RNA, 16 nt, Pseudomonas aeruginosa PA01
ccaccuguagcagggu

SEQ ID NO: 3521708 - RNA, 19 nt, Pseudomonas aeruginosa PA01
ccaccuguagcagggugcg

SEQ ID NO: 3521709 - RNA, 12 nt, Pseudomonas aeruginosa PA01
ccaccuguucca

SEQ ID NO: 3521710 - RNA, 12 nt, Pseudomonas aeruginosa PA01
ccaccuguuccg

SEQ ID NO: 3521711 - RNA, 22 nt, Pseudomonas aeruginosa PA01
ccaccuucaggcugcucaugcc

SEQ ID NO: 3521712 - RNA, 13 nt, Pseudomonas aeruginosa PA01
ccaccuucgauca

SEQ ID NO: 3521713 - RNA, 13 nt, Pseudomonas aeruginosa PA01
ccaccuucgcccg

SEQ ID NO: 3521714 - RNA, 14 nt, Pseudomonas aeruginosa PA01
ccaccuucgcccgc

SEQ ID NO: 3521715 - RNA, 12 nt, Pseudomonas aeruginosa PA01
ccaccuucuaca

SEQ ID NO: 3521716 - RNA, 12 nt, Pseudomonas aeruginosa PA01
ccaccuugccgc

SEQ ID NO: 3521717 - RNA, 15 nt, Pseudomonas aeruginosa PA01
ccaccuugccgcgcc

SEQ ID NO: 3521718 - RNA, 20 nt, Pseudomonas aeruginosa PA01
ccaccuugccgcgcccggcc

SEQ ID NO: 3521719 - RNA, 18 nt, Pseudomonas aeruginosa PA01
ccaccuugcgucccuggg

SEQ ID NO: 3521720 - RNA, 18 nt, Pseudomonas aeruginosa PA01
ccacgaaaaagcccggca

SEQ ID NO: 3521721 - RNA, 18 nt, Pseudomonas aeruginosa PA01
ccacgaacugcauggccu

SEQ ID NO: 3521722 - RNA, 19 nt, Pseudomonas aeruginosa PA01
ccacgaagaacgccagccc

SEQ ID NO: 3521723 - RNA, 18 nt, Pseudomonas aeruginosa PA01
ccacgacccgcucuuccu

SEQ ID NO: 3521724 - RNA, 13 nt, Pseudomonas aeruginosa PA01
ccacgacccugcu

SEQ ID NO: 3521725 - RNA, 15 nt, Pseudomonas aeruginosa PA01
ccacgacccugcugg

SEQ ID NO: 3521726 - RNA, 22 nt, Pseudomonas aeruginosa PA01
ccacgacccugcuggccggugc

SEQ ID NO: 3521727 - RNA, 19 nt, Pseudomonas aeruginosa PA01
ccacgacgaacggcgcuuc

SEQ ID NO: 3521728 - RNA, 20 nt, Pseudomonas aeruginosa PA01
ccacgacgaacggcgcuuca

SEQ ID NO: 3521729 - RNA, 17 nt, Pseudomonas aeruginosa PA01
ccacgacgaagcgccgg

SEQ ID NO: 3521730 - RNA, 18 nt, Pseudomonas aeruginosa PA01
ccacgacgaagcgccggc

SEQ ID NO: 3521731 - RNA, 20 nt, Pseudomonas aeruginosa PA01
ccacgacgaagcgccggcgg

SEQ ID NO: 3521732 - RNA, 16 nt, Pseudomonas aeruginosa PA01
ccacgacgcacucaua

SEQ ID NO: 3521733 - RNA, 23 nt, Pseudomonas aeruginosa PA01
ccacgacgcacucauagcucagc

SEQ ID NO: 3521734 - RNA, 14 nt, Pseudomonas aeruginosa PA01
ccacgacgucggcg

SEQ ID NO: 3521735 - RNA, 15 nt, Pseudomonas aeruginosa PA01
ccacgacgucggcgg

SEQ ID NO: 3521736 - RNA, 18 nt, Pseudomonas aeruginosa PA01
ccacgacucacccgcugc

SEQ ID NO: 3521737 - RNA, 19 nt, Pseudomonas aeruginosa PA01
ccacgacucacccgcugcg

SEQ ID NO: 3521738 - RNA, 12 nt, Pseudomonas aeruginosa PA01
ccacgaucagcu

SEQ ID NO: 3521739 - RNA, 16 nt, Pseudomonas aeruginosa PA01
ccacgaucaggcccuu

SEQ ID NO: 3521740 - RNA, 22 nt, Pseudomonas aeruginosa PA01
ccacgaucucggugguguagcg

SEQ ID NO: 3521741 - RNA, 12 nt, Pseudomonas aeruginosa PA01
ccacgcaccacc

SEQ ID NO: 3521742 - RNA, 17 nt, Pseudomonas aeruginosa PA01
ccacgcaccaccagguc

SEQ ID NO: 3521743 - RNA, 14 nt, Pseudomonas aeruginosa PA01
ccacgcaccagcuc

SEQ ID NO: 3521744 - RNA, 18 nt, Pseudomonas aeruginosa PA01
ccacgcaccagcucccgg

SEQ ID NO: 3521745 - RNA, 14 nt, Pseudomonas aeruginosa PA01
ccacgcagaaggcg

SEQ ID NO: 3521746 - RNA, 17 nt, Pseudomonas aeruginosa PA01
ccacgcagagcggcagg

SEQ ID NO: 3521747 - RNA, 20 nt, Pseudomonas aeruginosa PA01
ccacgcagagcggcaggccg

SEQ ID NO: 3521748 - RNA, 16 nt, Pseudomonas aeruginosa PA01
ccacgcagccacccgc

SEQ ID NO: 3521749 - RNA, 13 nt, Pseudomonas aeruginosa PA01
ccacgcaggccag

SEQ ID NO: 3521750 - RNA, 14 nt, Pseudomonas aeruginosa PA01
ccacgcaggccagc

SEQ ID NO: 3521751 - RNA, 16 nt, Pseudomonas aeruginosa PA01
ccacgcaggccagcgc

SEQ ID NO: 3521752 - RNA, 17 nt, Pseudomonas aeruginosa PA01
ccacgcaggccagcgcc

SEQ ID NO: 3521753 - RNA, 19 nt, Pseudomonas aeruginosa PA01
ccacgcaggccagcgccag

SEQ ID NO: 3521754 - RNA, 14 nt, Pseudomonas aeruginosa PA01
ccacgcaggcgcgu

SEQ ID NO: 3521755 - RNA, 19 nt, Pseudomonas aeruginosa PA01
ccacgccauucgaauggcg

SEQ ID NO: 3521756 - RNA, 23 nt, Pseudomonas aeruginosa PA01
ccacgccauucgaauggcgccgg

SEQ ID NO: 3521757 - RNA, 13 nt, Pseudomonas aeruginosa PA01
ccacgcccgcggu

SEQ ID NO: 3521758 - RNA, 13 nt, Pseudomonas aeruginosa PA01
ccacgcccugcgc

SEQ ID NO: 3521759 - RNA, 14 nt, Pseudomonas aeruginosa PA01
ccacgcccugcgcc

SEQ ID NO: 3521760 - RNA, 21 nt, Pseudomonas aeruginosa PA01
ccacgccgaagucggcgagcc

SEQ ID NO: 3521761 - RNA, 15 nt, Pseudomonas aeruginosa PA01
ccacgccgacgccga

SEQ ID NO: 3521762 - RNA, 17 nt, Pseudomonas aeruginosa PA01
ccacgccgcugucgucc

SEQ ID NO: 3521763 - RNA, 19 nt, Pseudomonas aeruginosa PA01
ccacgccgcugucguccag

SEQ ID NO: 3521764 - RNA, 22 nt, Pseudomonas aeruginosa PA01
ccacgccgcugucguccagcgg

SEQ ID NO: 3521765 - RNA, 23 nt, Pseudomonas aeruginosa PA01
ccacgccgcugucguccagcggg

SEQ ID NO: 3521766 - RNA, 12 nt, Pseudomonas aeruginosa PA01
ccacgccggccg

SEQ ID NO: 3521767 - RNA, 21 nt, Pseudomonas aeruginosa PA01
ccacgccggccggcucagcgc

SEQ ID NO: 3521768 - RNA, 12 nt, Pseudomonas aeruginosa PA01
ccacgccggcgc

SEQ ID NO: 3521769 - RNA, 13 nt, Pseudomonas aeruginosa PA01
ccacgccgucgca

SEQ ID NO: 3521770 - RNA, 13 nt, Pseudomonas aeruginosa PA01
ccacgccugccau

SEQ ID NO: 3521771 - RNA, 16 nt, Pseudomonas aeruginosa PA01
ccacgccugccaucga

SEQ ID NO: 3521772 - RNA, 18 nt, Pseudomonas aeruginosa PA01
ccacgccuucgcggccga

SEQ ID NO: 3521773 - RNA, 23 nt, Pseudomonas aeruginosa PA01
ccacgccuugcagcaccgccugg

SEQ ID NO: 3521774 - RNA, 12 nt, Pseudomonas aeruginosa PA01
ccacgcgaccag

SEQ ID NO: 3521775 - RNA, 13 nt, Pseudomonas aeruginosa PA01
ccacgcgaccagc

SEQ ID NO: 3521776 - RNA, 16 nt, Pseudomonas aeruginosa PA01
ccacgcgauauccgcc

SEQ ID NO: 3521777 - RNA, 17 nt, Pseudomonas aeruginosa PA01
ccacgcgauauccgcca

SEQ ID NO: 3521778 - RNA, 19 nt, Pseudomonas aeruginosa PA01
ccacgcgauauccgccagg

SEQ ID NO: 3521779 - RNA, 16 nt, Pseudomonas aeruginosa PA01
ccacgcgcaagccagc

SEQ ID NO: 3521780 - RNA, 14 nt, Pseudomonas aeruginosa PA01
ccacgcgccuggcc

SEQ ID NO: 3521781 - RNA, 21 nt, Pseudomonas aeruginosa PA01
ccacgcggauaucgcuggcgc

SEQ ID NO: 3521782 - RNA, 13 nt, Pseudomonas aeruginosa PA01
ccacgcucagccg

SEQ ID NO: 3521783 - RNA, 15 nt, Pseudomonas aeruginosa PA01
ccacgcucagccgug

SEQ ID NO: 3521784 - RNA, 22 nt, Pseudomonas aeruginosa PA01
ccacgcucagugcgccgggugc

SEQ ID NO: 3521785 - RNA, 22 nt, Pseudomonas aeruginosa PA01
ccacgcuccuggaagaacaggc

SEQ ID NO: 3521786 - RNA, 20 nt, Pseudomonas aeruginosa PA01
ccacgcucucgaacagcagc

SEQ ID NO: 3521787 - RNA, 21 nt, Pseudomonas aeruginosa PA01
ccacgcucucgaacagcagca

SEQ ID NO: 3521788 - RNA, 20 nt, Pseudomonas aeruginosa PA01
ccacgcugaggcucagcgcg

SEQ ID NO: 3521789 - RNA, 15 nt, Pseudomonas aeruginosa PA01
ccacgcugaucauca

SEQ ID NO: 3521790 - RNA, 20 nt, Pseudomonas aeruginosa PA01
ccacgcugaucaucagcagg

SEQ ID NO: 3521791 - RNA, 22 nt, Pseudomonas aeruginosa PA01
ccacgcugaucaucagcagggu

SEQ ID NO: 3521792 - RNA, 16 nt, Pseudomonas aeruginosa PA01
ccacgcugcugccggc

SEQ ID NO: 3521793 - RNA, 16 nt, Pseudomonas aeruginosa PA01
ccacgcugugcggcag

SEQ ID NO: 3521794 - RNA, 17 nt, Pseudomonas aeruginosa PA01
ccacgcugugcggcagc

SEQ ID NO: 3521795 - RNA, 15 nt, Pseudomonas aeruginosa PA01
ccacgcuucugcgcc

SEQ ID NO: 3521796 - RNA, 16 nt, Pseudomonas aeruginosa PA01
ccacggaaggccacgc

SEQ ID NO: 3521797 - RNA, 21 nt, Pseudomonas aeruginosa PA01
ccacggaaggccacgccgccg

SEQ ID NO: 3521798 - RNA, 22 nt, Pseudomonas aeruginosa PA01
ccacggaaggccacgccgccgu

SEQ ID NO: 3521799 - RNA, 17 nt, Pseudomonas aeruginosa PA01
ccacggacgcgcagggu

SEQ ID NO: 3521800 - RNA, 18 nt, Pseudomonas aeruginosa PA01
ccacggacgcgcaggguc

SEQ ID NO: 3521801 - RNA, 15 nt, Pseudomonas aeruginosa PA01
ccacggagaagcguc

SEQ ID NO: 3521802 - RNA, 16 nt, Pseudomonas aeruginosa PA01
ccacggagaagcgucc

SEQ ID NO: 3521803 - RNA, 17 nt, Pseudomonas aeruginosa PA01
ccacggagaagcguccg

SEQ ID NO: 3521804 - RNA, 18 nt, Pseudomonas aeruginosa PA01
ccacggauaugcgccgcc

SEQ ID NO: 3521805 - RNA, 19 nt, Pseudomonas aeruginosa PA01
ccacggauaugcgccgcca

SEQ ID NO: 3521806 - RNA, 22 nt, Pseudomonas aeruginosa PA01
ccacggaugcagucccgccagg

SEQ ID NO: 3521807 - RNA, 23 nt, Pseudomonas aeruginosa PA01
ccacggaugcagucccgccaggc

SEQ ID NO: 3521808 - RNA, 16 nt, Pseudomonas aeruginosa PA01
ccacggcacacgucgg

SEQ ID NO: 3521809 - RNA, 13 nt, Pseudomonas aeruginosa PA01
ccacggccaggcc

SEQ ID NO: 3521810 - RNA, 19 nt, Pseudomonas aeruginosa PA01
ccacggccgcugcgcaggc

SEQ ID NO: 3521811 - RNA, 12 nt, Pseudomonas aeruginosa PA01
ccacggccggcg

SEQ ID NO: 3521812 - RNA, 15 nt, Pseudomonas aeruginosa PA01
ccacggcgaagccgc

SEQ ID NO: 3521813 - RNA, 18 nt, Pseudomonas aeruginosa PA01
ccacggcgaagccgcgcc

SEQ ID NO: 3521814 - RNA, 21 nt, Pseudomonas aeruginosa PA01
ccacggcgagagcgccgacca

SEQ ID NO: 3521815 - RNA, 22 nt, Pseudomonas aeruginosa PA01
ccacggcgagagcgccgaccag

SEQ ID NO: 3521816 - RNA, 17 nt, Pseudomonas aeruginosa PA01
ccacggcgccuucccag

SEQ ID NO: 3521817 - RNA, 19 nt, Pseudomonas aeruginosa PA01
ccacggcgcgcuccggcgc

SEQ ID NO: 3521818 - RNA, 21 nt, Pseudomonas aeruginosa PA01
ccacggcgcgcuccggcgcgc

SEQ ID NO: 3521819 - RNA, 15 nt, Pseudomonas aeruginosa PA01
ccacggcggauugac

SEQ ID NO: 3521820 - RNA, 14 nt, Pseudomonas aeruginosa PA01
ccacggcggccucg

SEQ ID NO: 3521821 - RNA, 12 nt, Pseudomonas aeruginosa PA01
ccacgggaaugg

SEQ ID NO: 3521822 - RNA, 14 nt, Pseudomonas aeruginosa PA01
ccacgggaauggcg

SEQ ID NO: 3521823 - RNA, 23 nt, Pseudomonas aeruginosa PA01
ccacgggaauggcggauaaccgc

SEQ ID NO: 3521824 - RNA, 22 nt, Pseudomonas aeruginosa PA01
ccacgggcgacccaggccgaca

SEQ ID NO: 3521825 - RNA, 13 nt, Pseudomonas aeruginosa PA01
ccacgggcgccag

SEQ ID NO: 3521826 - RNA, 17 nt, Pseudomonas aeruginosa PA01
ccacgggucgcagccga

SEQ ID NO: 3521827 - RNA, 16 nt, Pseudomonas aeruginosa PA01
ccacgggucgucgccc

SEQ ID NO: 3521828 - RNA, 18 nt, Pseudomonas aeruginosa PA01
ccacgggucgucgcccug

SEQ ID NO: 3521829 - RNA, 18 nt, Pseudomonas aeruginosa PA01
ccacggugaucaggcgcu

SEQ ID NO: 3521830 - RNA, 24 nt, Pseudomonas aeruginosa PA01
ccacgguguugccguggucgcgca

SEQ ID NO: 3521831 - RNA, 17 nt, Pseudomonas aeruginosa PA01
ccacguacagcgcgaca

SEQ ID NO: 3521832 - RNA, 13 nt, Pseudomonas aeruginosa PA01
ccacguacuccag

SEQ ID NO: 3521833 - RNA, 15 nt, Pseudomonas aeruginosa PA01
ccacguacuccagca

SEQ ID NO: 3521834 - RNA, 22 nt, Pseudomonas aeruginosa PA01
ccacguacuccagcaacggcau

SEQ ID NO: 3521835 - RNA, 14 nt, Pseudomonas aeruginosa PA01
ccacguagccggcg

SEQ ID NO: 3521836 - RNA, 14 nt, Pseudomonas aeruginosa PA01
ccacguagggcgug

SEQ ID NO: 3521837 - RNA, 23 nt, Pseudomonas aeruginosa PA01
ccacguagggcgugguguagccg

SEQ ID NO: 3521838 - RNA, 17 nt, Pseudomonas aeruginosa PA01
ccacguccuccaggcuc

SEQ ID NO: 3521839 - RNA, 18 nt, Pseudomonas aeruginosa PA01
ccacguccuugguguagc

SEQ ID NO: 3521840 - RNA, 22 nt, Pseudomonas aeruginosa PA01
ccacgucgagcgggcggucguc

SEQ ID NO: 3521841 - RNA, 22 nt, Pseudomonas aeruginosa PA01
ccacgucgaugccuucggcggc

SEQ ID NO: 3521842 - RNA, 15 nt, Pseudomonas aeruginosa PA01
ccacgucgccccagg

SEQ ID NO: 3521843 - RNA, 11 nt, Pseudomonas aeruginosa PA01
ccacgucgccg

SEQ ID NO: 3521844 - RNA, 15 nt, Pseudomonas aeruginosa PA01
ccacgucgccgacca

SEQ ID NO: 3521845 - RNA, 18 nt, Pseudomonas aeruginosa PA01
ccacgucgccgaccaggc

SEQ ID NO: 3521846 - RNA, 19 nt, Pseudomonas aeruginosa PA01
ccacgucguuucucggcga

SEQ ID NO: 3521847 - RNA, 22 nt, Pseudomonas aeruginosa PA01
ccacgucguuucucggcgaugg

SEQ ID NO: 3521848 - RNA, 22 nt, Pseudomonas aeruginosa PA01
ccacgucugugccgaggccgcc

SEQ ID NO: 3521849 - RNA, 23 nt, Pseudomonas aeruginosa PA01
ccacgucugugccgaggccgccg

SEQ ID NO: 3521850 - RNA, 21 nt, Pseudomonas aeruginosa PA01
ccacgugcggggugcgcugga

SEQ ID NO: 3521851 - RNA, 14 nt, Pseudomonas aeruginosa PA01
ccacguggccggcg

SEQ ID NO: 3521852 - RNA, 15 nt, Pseudomonas aeruginosa PA01
ccacguggccggcgc

SEQ ID NO: 3521853 - RNA, 18 nt, Pseudomonas aeruginosa PA01
ccacguggccggcgcgga

SEQ ID NO: 3521854 - RNA, 14 nt, Pseudomonas aeruginosa PA01
ccacguucggcgcg

SEQ ID NO: 3521855 - RNA, 19 nt, Pseudomonas aeruginosa PA01
ccacguugagcaucaccgc

SEQ ID NO: 3521856 - RNA, 14 nt, Pseudomonas aeruginosa PA01
ccacguugcgccgc

SEQ ID NO: 3521857 - RNA, 15 nt, Pseudomonas aeruginosa PA01
ccacguugcgccgca

SEQ ID NO: 3521858 - RNA, 23 nt, Pseudomonas aeruginosa PA01
ccacuccagauagugcggccagg

SEQ ID NO: 3521859 - RNA, 13 nt, Pseudomonas aeruginosa PA01
ccacuccagcgcg

SEQ ID NO: 3521860 - RNA, 12 nt, Pseudomonas aeruginosa PA01
ccacuccagcgg

SEQ ID NO: 3521861 - RNA, 14 nt, Pseudomonas aeruginosa PA01
ccacucccaugcca

SEQ ID NO: 3521862 - RNA, 13 nt, Pseudomonas aeruginosa PA01
ccacucccggccc

SEQ ID NO: 3521863 - RNA, 13 nt, Pseudomonas aeruginosa PA01
ccacuccggcagg

SEQ ID NO: 3521864 - RNA, 16 nt, Pseudomonas aeruginosa PA01
ccacuccuccgccugc

SEQ ID NO: 3521865 - RNA, 14 nt, Pseudomonas aeruginosa PA01
ccacucgcagccgc

SEQ ID NO: 3521866 - RNA, 20 nt, Pseudomonas aeruginosa PA01
ccacucgcagccgcgcucgg

SEQ ID NO: 3521867 - RNA, 22 nt, Pseudomonas aeruginosa PA01
ccacucgcagccgcgcucggcc

SEQ ID NO: 3521868 - RNA, 21 nt, Pseudomonas aeruginosa PA01
ccacucgccagcgcgcgccga

SEQ ID NO: 3521869 - RNA, 16 nt, Pseudomonas aeruginosa PA01
ccacucgccgaccagc

SEQ ID NO: 3521870 - RNA, 22 nt, Pseudomonas aeruginosa PA01
ccacucgcgagcuggcgccguc

SEQ ID NO: 3521871 - RNA, 13 nt, Pseudomonas aeruginosa PA01
ccacucggccagg

SEQ ID NO: 3521872 - RNA, 16 nt, Pseudomonas aeruginosa PA01
ccacucggccaggcgc

SEQ ID NO: 3521873 - RNA, 18 nt, Pseudomonas aeruginosa PA01
ccacucggccaggcgcca

SEQ ID NO: 3521874 - RNA, 14 nt, Pseudomonas aeruginosa PA01
ccacucggcgugcc

SEQ ID NO: 3521875 - RNA, 19 nt, Pseudomonas aeruginosa PA01
ccacucggugcagaugacc

SEQ ID NO: 3521876 - RNA, 23 nt, Pseudomonas aeruginosa PA01
ccacucggugcagaugaccagcg

SEQ ID NO: 3521877 - RNA, 23 nt, Pseudomonas aeruginosa PA01
ccacugaacuggaucggccccac

SEQ ID NO: 3521878 - RNA, 20 nt, Pseudomonas aeruginosa PA01
ccacugacgcgcagcgccgc

SEQ ID NO: 3521879 - RNA, 22 nt, Pseudomonas aeruginosa PA01
ccacugacgcgcagcgccgccg

SEQ ID NO: 3521880 - RNA, 13 nt, Pseudomonas aeruginosa PA01
ccacugcgcgcca

SEQ ID NO: 3521881 - RNA, 14 nt, Pseudomonas aeruginosa PA01
ccacugcuuggcca

SEQ ID NO: 3521882 - RNA, 20 nt, Pseudomonas aeruginosa PA01
ccacugcuuggccaggcgcu

SEQ ID NO: 3521883 - RNA, 18 nt, Pseudomonas aeruginosa PA01
ccacugcuuggcgaacuc

SEQ ID NO: 3521884 - RNA, 20 nt, Pseudomonas aeruginosa PA01
ccacuggaagaaggcgauca

SEQ ID NO: 3521885 - RNA, 21 nt, Pseudomonas aeruginosa PA01
ccacuggauggucacgccgag

SEQ ID NO: 3521886 - RNA, 17 nt, Pseudomonas aeruginosa PA01
ccacuggcggaccgccu

SEQ ID NO: 3521887 - RNA, 18 nt, Pseudomonas aeruginosa PA01
ccacuggcggaccgccuc

SEQ ID NO: 3521888 - RNA, 20 nt, Pseudomonas aeruginosa PA01
ccacuggcggaucuucgccu

SEQ ID NO: 3521889 - RNA, 16 nt, Pseudomonas aeruginosa PA01
ccacugucucgccgau

SEQ ID NO: 3521890 - RNA, 17 nt, Pseudomonas aeruginosa PA01
ccacugucucgccgaug

SEQ ID NO: 3521891 - RNA, 13 nt, Pseudomonas aeruginosa PA01
ccacuuccagcuu

SEQ ID NO: 3521892 - RNA, 12 nt, Pseudomonas aeruginosa PA01
ccacuuccaggu

SEQ ID NO: 3521893 - RNA, 14 nt, Pseudomonas aeruginosa PA01
ccacuucccggcgc

SEQ ID NO: 3521894 - RNA, 18 nt, Pseudomonas aeruginosa PA01
ccacuucgaagccgagcu

SEQ ID NO: 3521895 - RNA, 23 nt, Pseudomonas aeruginosa PA01
ccacuucgcggaccacgucccag

SEQ ID NO: 3521896 - RNA, 18 nt, Pseudomonas aeruginosa PA01
ccacuucguccggccgcc

SEQ ID NO: 3521897 - RNA, 19 nt, Pseudomonas aeruginosa PA01
ccacuucguccggccgccc

SEQ ID NO: 3521898 - RNA, 20 nt, Pseudomonas aeruginosa PA01
ccacuucguccggccgcccg

SEQ ID NO: 3521899 - RNA, 17 nt, Pseudomonas aeruginosa PA01
ccacuugaacaccgugg

SEQ ID NO: 3521900 - RNA, 14 nt, Pseudomonas aeruginosa PA01
ccacuugccgccgc

SEQ ID NO: 3521901 - RNA, 15 nt, Pseudomonas aeruginosa PA01
ccacuugccgccgcc

SEQ ID NO: 3521902 - RNA, 19 nt, Pseudomonas aeruginosa PA01
ccacuugccgccgccggag

SEQ ID NO: 3521903 - RNA, 14 nt, Pseudomonas aeruginosa PA01
ccacuugcgccggc

SEQ ID NO: 3521904 - RNA, 13 nt, Pseudomonas aeruginosa PA01
ccagaaaaaagcc

SEQ ID NO: 3521905 - RNA, 13 nt, Pseudomonas aeruginosa PA01
ccagaacagcaaa

SEQ ID NO: 3521906 - RNA, 16 nt, Pseudomonas aeruginosa PA01
ccagaagaucagcgcg

SEQ ID NO: 3521907 - RNA, 12 nt, Pseudomonas aeruginosa PA01
ccagaagcccca

SEQ ID NO: 3521908 - RNA, 14 nt, Pseudomonas aeruginosa PA01
ccagaagccggccg

SEQ ID NO: 3521909 - RNA, 21 nt, Pseudomonas aeruginosa PA01
ccagaagcggccgaccaggcc

SEQ ID NO: 3521910 - RNA, 15 nt, Pseudomonas aeruginosa PA01
ccagaaggccagggc

SEQ ID NO: 3521911 - RNA, 17 nt, Pseudomonas aeruginosa PA01
ccagaaggccugcgcuu

SEQ ID NO: 3521912 - RNA, 14 nt, Pseudomonas aeruginosa PA01
ccagaaucucccgc

SEQ ID NO: 3521913 - RNA, 18 nt, Pseudomonas aeruginosa PA01
ccagaaucucccgcaggc

SEQ ID NO: 3521914 - RNA, 14 nt, Pseudomonas aeruginosa PA01
ccagaaugugccgg

SEQ ID NO: 3521915 - RNA, 16 nt, Pseudomonas aeruginosa PA01
ccagaaugugccggua

SEQ ID NO: 3521916 - RNA, 14 nt, Pseudomonas aeruginosa PA01
ccagacaggccagc

SEQ ID NO: 3521917 - RNA, 17 nt, Pseudomonas aeruginosa PA01
ccagacaggccagcucg

SEQ ID NO: 3521918 - RNA, 18 nt, Pseudomonas aeruginosa PA01
ccagacaggccagcucgc

SEQ ID NO: 3521919 - RNA, 21 nt, Pseudomonas aeruginosa PA01
ccagacaggccagcucgcccg

SEQ ID NO: 3521920 - RNA, 22 nt, Pseudomonas aeruginosa PA01
ccagacauccggguccagcggc

SEQ ID NO: 3521921 - RNA, 13 nt, Pseudomonas aeruginosa PA01
ccagaccagcagc

SEQ ID NO: 3521922 - RNA, 14 nt, Pseudomonas aeruginosa PA01
ccagaccagcagcg

SEQ ID NO: 3521923 - RNA, 20 nt, Pseudomonas aeruginosa PA01
ccagaccagcagcggcagcc

SEQ ID NO: 3521924 - RNA, 20 nt, Pseudomonas aeruginosa PA01
ccagaccagccccagucccu

SEQ ID NO: 3521925 - RNA, 16 nt, Pseudomonas aeruginosa PA01
ccagaccccauccgca

SEQ ID NO: 3521926 - RNA, 12 nt, Pseudomonas aeruginosa PA01
ccagaccccggc

SEQ ID NO: 3521927 - RNA, 13 nt, Pseudomonas aeruginosa PA01
ccagaccgcagcc

SEQ ID NO: 3521928 - RNA, 15 nt, Pseudomonas aeruginosa PA01
ccagaccgcagccgg

SEQ ID NO: 3521929 - RNA, 22 nt, Pseudomonas aeruginosa PA01
ccagaccguggauuucagcagg

SEQ ID NO: 3521930 - RNA, 15 nt, Pseudomonas aeruginosa PA01
ccagaccuccaggua

SEQ ID NO: 3521931 - RNA, 15 nt, Pseudomonas aeruginosa PA01
ccagaccugccgccc

SEQ ID NO: 3521932 - RNA, 16 nt, Pseudomonas aeruginosa PA01
ccagaccugccgcccg

SEQ ID NO: 3521933 - RNA, 17 nt, Pseudomonas aeruginosa PA01
ccagaccugccgcccgg

SEQ ID NO: 3521934 - RNA, 13 nt, Pseudomonas aeruginosa PA01
ccagaccuggccg

SEQ ID NO: 3521935 - RNA, 15 nt, Pseudomonas aeruginosa PA01
ccagaccuggccgcu

SEQ ID NO: 3521936 - RNA, 20 nt, Pseudomonas aeruginosa PA01
ccagaccuggccgcugugga

SEQ ID NO: 3521937 - RNA, 15 nt, Pseudomonas aeruginosa PA01
ccagaccuuccagcc

SEQ ID NO: 3521938 - RNA, 17 nt, Pseudomonas aeruginosa PA01
ccagaccuuccagccgc

SEQ ID NO: 3521939 - RNA, 18 nt, Pseudomonas aeruginosa PA01
ccagaccuuccagccgcg

SEQ ID NO: 3521940 - RNA, 20 nt, Pseudomonas aeruginosa PA01
ccagaccuuccagccgcgcg

SEQ ID NO: 3521941 - RNA, 21 nt, Pseudomonas aeruginosa PA01
ccagaccuuccagccgcgcgc

SEQ ID NO: 3521942 - RNA, 14 nt, Pseudomonas aeruginosa PA01
ccagacgaucagcg

SEQ ID NO: 3521943 - RNA, 12 nt, Pseudomonas aeruginosa PA01
ccagacgcagca

SEQ ID NO: 3521944 - RNA, 23 nt, Pseudomonas aeruginosa PA01
ccagacgcggauuggccgggccg

SEQ ID NO: 3521945 - RNA, 14 nt, Pseudomonas aeruginosa PA01
ccagacgcucggcc

SEQ ID NO: 3521946 - RNA, 17 nt, Pseudomonas aeruginosa PA01
ccagacgcucggccagc

SEQ ID NO: 3521947 - RNA, 15 nt, Pseudomonas aeruginosa PA01
ccagacguccggcag

SEQ ID NO: 3521948 - RNA, 16 nt, Pseudomonas aeruginosa PA01
ccagacucuccagguc

SEQ ID NO: 3521949 - RNA, 17 nt, Pseudomonas aeruginosa PA01
ccagacucuccaggucg

SEQ ID NO: 3521950 - RNA, 15 nt, Pseudomonas aeruginosa PA01
ccagacuuccgggcu

SEQ ID NO: 3521951 - RNA, 18 nt, Pseudomonas aeruginosa PA01
ccagacuuccgggcugcg

SEQ ID NO: 3521952 - RNA, 20 nt, Pseudomonas aeruginosa PA01
ccagagaucgcccagcggcu

SEQ ID NO: 3521953 - RNA, 13 nt, Pseudomonas aeruginosa PA01
ccagagcaccagg

SEQ ID NO: 3521954 - RNA, 16 nt, Pseudomonas aeruginosa PA01
ccagagcagcaccagc

SEQ ID NO: 3521955 - RNA, 14 nt, Pseudomonas aeruginosa PA01
ccagagcagcgucg

SEQ ID NO: 3521956 - RNA, 22 nt, Pseudomonas aeruginosa PA01
ccagagcaggcggaucgccgcc

SEQ ID NO: 3521957 - RNA, 14 nt, Pseudomonas aeruginosa PA01
ccagagccagccgc

SEQ ID NO: 3521958 - RNA, 16 nt, Pseudomonas aeruginosa PA01
ccagagccagccgcga

SEQ ID NO: 3521959 - RNA, 17 nt, Pseudomonas aeruginosa PA01
ccagagccagccgcgag

SEQ ID NO: 3521960 - RNA, 18 nt, Pseudomonas aeruginosa PA01
ccagagccaugggccggc

SEQ ID NO: 3521961 - RNA, 20 nt, Pseudomonas aeruginosa PA01
ccagagccaugggccggccg

SEQ ID NO: 3521962 - RNA, 20 nt, Pseudomonas aeruginosa PA01
ccagagcccgccgaacagca

SEQ ID NO: 3521963 - RNA, 21 nt, Pseudomonas aeruginosa PA01
ccagagcccgucgaagccagg

SEQ ID NO: 3521964 - RNA, 13 nt, Pseudomonas aeruginosa PA01
ccagagccgccga

SEQ ID NO: 3521965 - RNA, 15 nt, Pseudomonas aeruginosa PA01
ccagagccgccgaac

SEQ ID NO: 3521966 - RNA, 13 nt, Pseudomonas aeruginosa PA01
ccagagccgcucg

SEQ ID NO: 3521967 - RNA, 16 nt, Pseudomonas aeruginosa PA01
ccagagccgcucggcg

SEQ ID NO: 3521968 - RNA, 22 nt, Pseudomonas aeruginosa PA01
ccagagcgcgcccugcaggccg

SEQ ID NO: 3521969 - RNA, 14 nt, Pseudomonas aeruginosa PA01
ccagagcuugagga

SEQ ID NO: 3521970 - RNA, 21 nt, Pseudomonas aeruginosa PA01
ccagaggcauucaucaccagc

SEQ ID NO: 3521971 - RNA, 17 nt, Pseudomonas aeruginosa PA01
ccagaggcugcgcucca

SEQ ID NO: 3521972 - RNA, 17 nt, Pseudomonas aeruginosa PA01
ccagaggucgagcuggg

SEQ ID NO: 3521973 - RNA, 18 nt, Pseudomonas aeruginosa PA01
ccagaguccaugcucagg

SEQ ID NO: 3521974 - RNA, 19 nt, Pseudomonas aeruginosa PA01
ccagagugcgcagcagcgu

SEQ ID NO: 3521975 - RNA, 12 nt, Pseudomonas aeruginosa PA01
ccagaguucgcc

SEQ ID NO: 3521976 - RNA, 18 nt, Pseudomonas aeruginosa PA01
ccagaguucgcccagcuc

SEQ ID NO: 3521977 - RNA, 22 nt, Pseudomonas aeruginosa PA01
ccagaguucgcccagcucgccg

SEQ ID NO: 3521978 - RNA, 12 nt, Pseudomonas aeruginosa PA01
ccagaguugccu

SEQ ID NO: 3521979 - RNA, 20 nt, Pseudomonas aeruginosa PA01
ccagaguugccuguccagcu

SEQ ID NO: 3521980 - RNA, 21 nt, Pseudomonas aeruginosa PA01
ccagaguugccuguccagcuc

SEQ ID NO: 3521981 - RNA, 16 nt, Pseudomonas aeruginosa PA01
ccagauagugcggcca

SEQ ID NO: 3521982 - RNA, 20 nt, Pseudomonas aeruginosa PA01
ccagauagugcggccaggcg

SEQ ID NO: 3521983 - RNA, 21 nt, Pseudomonas aeruginosa PA01
ccagauagugcggccaggcgu

SEQ ID NO: 3521984 - RNA, 16 nt, Pseudomonas aeruginosa PA01
ccagauauccagggcc

SEQ ID NO: 3521985 - RNA, 13 nt, Pseudomonas aeruginosa PA01
ccagaucaccacc

SEQ ID NO: 3521986 - RNA, 19 nt, Pseudomonas aeruginosa PA01
ccagaucgccaccccgccg

SEQ ID NO: 3521987 - RNA, 17 nt, Pseudomonas aeruginosa PA01
ccagaucgccagcgcca

SEQ ID NO: 3521988 - RNA, 23 nt, Pseudomonas aeruginosa PA01
ccagaucggcauggccgaccgcc

SEQ ID NO: 3521989 - RNA, 22 nt, Pseudomonas aeruginosa PA01
ccagaucggcgcgcagggccag

SEQ ID NO: 3521990 - RNA, 15 nt, Pseudomonas aeruginosa PA01
ccagaugaaacugcc

SEQ ID NO: 3521991 - RNA, 20 nt, Pseudomonas aeruginosa PA01
ccagaugacgauggccgccg

SEQ ID NO: 3521992 - RNA, 21 nt, Pseudomonas aeruginosa PA01
ccagaugacgauggccgccgc

SEQ ID NO: 3521993 - RNA, 12 nt, Pseudomonas aeruginosa PA01
ccagaugaucag

SEQ ID NO: 3521994 - RNA, 14 nt, Pseudomonas aeruginosa PA01
ccagaugaucaggc

SEQ ID NO: 3521995 - RNA, 18 nt, Pseudomonas aeruginosa PA01
ccagaugaucaggccgag

SEQ ID NO: 3521996 - RNA, 23 nt, Pseudomonas aeruginosa PA01
ccagaugaucaggccgagcaccg

SEQ ID NO: 3521997 - RNA, 17 nt, Pseudomonas aeruginosa PA01
ccagaugaucuucaucc

SEQ ID NO: 3521998 - RNA, 20 nt, Pseudomonas aeruginosa PA01
ccagaugaucuucaucccgg

SEQ ID NO: 3521999 - RNA, 15 nt, Pseudomonas aeruginosa PA01
ccagaugcuggagcu

SEQ ID NO: 3522000 - RNA, 20 nt, Pseudomonas aeruginosa PA01
ccagauggcuggucaggcug

SEQ ID NO: 3522001 - RNA, 15 nt, Pseudomonas aeruginosa PA01
ccagcaaacccgggc

SEQ ID NO: 3522002 - RNA, 16 nt, Pseudomonas aeruginosa PA01
ccagcaaacccgggcc

SEQ ID NO: 3522003 - RNA, 18 nt, Pseudomonas aeruginosa PA01
ccagcaaacccgggccca

SEQ ID NO: 3522004 - RNA, 17 nt, Pseudomonas aeruginosa PA01
ccagcaaacgggacagg

SEQ ID NO: 3522005 - RNA, 17 nt, Pseudomonas aeruginosa PA01
ccagcaacaccggaagc

SEQ ID NO: 3522006 - RNA, 19 nt, Pseudomonas aeruginosa PA01
ccagcaacaccggaagcgu

SEQ ID NO: 3522007 - RNA, 20 nt, Pseudomonas aeruginosa PA01
ccagcaacaguugccgcagc

SEQ ID NO: 3522008 - RNA, 15 nt, Pseudomonas aeruginosa PA01
ccagcaacgccgccc

SEQ ID NO: 3522009 - RNA, 16 nt, Pseudomonas aeruginosa PA01
ccagcaacgccuucug

SEQ ID NO: 3522010 - RNA, 15 nt, Pseudomonas aeruginosa PA01
ccagcaacggcaucg

SEQ ID NO: 3522011 - RNA, 17 nt, Pseudomonas aeruginosa PA01
ccagcaacggcaucgcu

SEQ ID NO: 3522012 - RNA, 14 nt, Pseudomonas aeruginosa PA01
ccagcaacgggucg

SEQ ID NO: 3522013 - RNA, 17 nt, Pseudomonas aeruginosa PA01
ccagcaacgggucgggc

SEQ ID NO: 3522014 - RNA, 20 nt, Pseudomonas aeruginosa PA01
ccagcaacgugaagcccuuc

SEQ ID NO: 3522015 - RNA, 21 nt, Pseudomonas aeruginosa PA01
ccagcaacgugaagcccuucu

SEQ ID NO: 3522016 - RNA, 12 nt, Pseudomonas aeruginosa PA01
ccagcaagccgu

SEQ ID NO: 3522017 - RNA, 19 nt, Pseudomonas aeruginosa PA01
ccagcaagccguagaacgc

SEQ ID NO: 3522018 - RNA, 23 nt, Pseudomonas aeruginosa PA01
ccagcaagccguagaacgccagg

SEQ ID NO: 3522019 - RNA, 20 nt, Pseudomonas aeruginosa PA01
ccagcaaggcgucauagcag

SEQ ID NO: 3522020 - RNA, 17 nt, Pseudomonas aeruginosa PA01
ccagcaauacccgccgc

SEQ ID NO: 3522021 - RNA, 18 nt, Pseudomonas aeruginosa PA01
ccagcaauagccucagua

SEQ ID NO: 3522022 - RNA, 16 nt, Pseudomonas aeruginosa PA01
ccagcaaugccagcgc

SEQ ID NO: 3522023 - RNA, 17 nt, Pseudomonas aeruginosa PA01
ccagcaaugccagcgcc

SEQ ID NO: 3522024 - RNA, 22 nt, Pseudomonas aeruginosa PA01
ccagcaaugccagcgccacgcc

SEQ ID NO: 3522025 - RNA, 14 nt, Pseudomonas aeruginosa PA01
ccagcaaugcccag

SEQ ID NO: 3522026 - RNA, 15 nt, Pseudomonas aeruginosa PA01
ccagcaaugcccagc

SEQ ID NO: 3522027 - RNA, 17 nt, Pseudomonas aeruginosa PA01
ccagcaaugcccgcgcc

SEQ ID NO: 3522028 - RNA, 20 nt, Pseudomonas aeruginosa PA01
ccagcaaugcccgcgccugg

SEQ ID NO: 3522029 - RNA, 23 nt, Pseudomonas aeruginosa PA01
ccagcaaugcccgcgccugggcc

SEQ ID NO: 3522030 - RNA, 18 nt, Pseudomonas aeruginosa PA01
ccagcaauuccacgcgac

SEQ ID NO: 3522031 - RNA, 21 nt, Pseudomonas aeruginosa PA01
ccagcaauuccacgcgacagc

SEQ ID NO: 3522032 - RNA, 19 nt, Pseudomonas aeruginosa PA01
ccagcaauugccgcugcac

SEQ ID NO: 3522033 - RNA, 21 nt, Pseudomonas aeruginosa PA01
ccagcaauugccgcugcacgc

SEQ ID NO: 3522034 - RNA, 22 nt, Pseudomonas aeruginosa PA01
ccagcaauugccgcugcacgcc

SEQ ID NO: 3522035 - RNA, 13 nt, Pseudomonas aeruginosa PA01
ccagcaccacccg

SEQ ID NO: 3522036 - RNA, 14 nt, Pseudomonas aeruginosa PA01
ccagcaccacccgg

SEQ ID NO: 3522037 - RNA, 15 nt, Pseudomonas aeruginosa PA01
ccagcaccacccggc

SEQ ID NO: 3522038 - RNA, 16 nt, Pseudomonas aeruginosa PA01
ccagcaccacccggcc

SEQ ID NO: 3522039 - RNA, 21 nt, Pseudomonas aeruginosa PA01
ccagcaccacccggccgcgcu

SEQ ID NO: 3522040 - RNA, 18 nt, Pseudomonas aeruginosa PA01
ccagcaccacccggcgca

SEQ ID NO: 3522041 - RNA, 22 nt, Pseudomonas aeruginosa PA01
ccagcaccacccggcgcacgcc

SEQ ID NO: 3522042 - RNA, 18 nt, Pseudomonas aeruginosa PA01
ccagcaccagcaggagca

SEQ ID NO: 3522043 - RNA, 21 nt, Pseudomonas aeruginosa PA01
ccagcaccagucccuggccgg

SEQ ID NO: 3522044 - RNA, 19 nt, Pseudomonas aeruginosa PA01
ccagcaccaucggguugau

SEQ ID NO: 3522045 - RNA, 18 nt, Pseudomonas aeruginosa PA01
ccagcaccaugcgcggca

SEQ ID NO: 3522046 - RNA, 15 nt, Pseudomonas aeruginosa PA01
ccagcacccagucuu

SEQ ID NO: 3522047 - RNA, 22 nt, Pseudomonas aeruginosa PA01
ccagcaccgagcugaucgcgca

SEQ ID NO: 3522048 - RNA, 15 nt, Pseudomonas aeruginosa PA01
ccagcaccgccugca

SEQ ID NO: 3522049 - RNA, 17 nt, Pseudomonas aeruginosa PA01
ccagcaccgccugcaac

SEQ ID NO: 3522050 - RNA, 18 nt, Pseudomonas aeruginosa PA01
ccagcaccgccugcaacu

SEQ ID NO: 3522051 - RNA, 22 nt, Pseudomonas aeruginosa PA01
ccagcaccggcggcgccaggcc

SEQ ID NO: 3522052 - RNA, 15 nt, Pseudomonas aeruginosa PA01
ccagcaccguggcgc

SEQ ID NO: 3522053 - RNA, 17 nt, Pseudomonas aeruginosa PA01
ccagcaccguggcgcca

SEQ ID NO: 3522054 - RNA, 15 nt, Pseudomonas aeruginosa PA01
ccagcaccuccccca

SEQ ID NO: 3522055 - RNA, 17 nt, Pseudomonas aeruginosa PA01
ccagcaccucccccagc

SEQ ID NO: 3522056 - RNA, 19 nt, Pseudomonas aeruginosa PA01
ccagcaccucccccagcgg

SEQ ID NO: 3522057 - RNA, 15 nt, Pseudomonas aeruginosa PA01
ccagcaccucgacgc

SEQ ID NO: 3522058 - RNA, 17 nt, Pseudomonas aeruginosa PA01
ccagcaccucgacgccc

SEQ ID NO: 3522059 - RNA, 19 nt, Pseudomonas aeruginosa PA01
ccagcaccucgacgcccgc

SEQ ID NO: 3522060 - RNA, 15 nt, Pseudomonas aeruginosa PA01
ccagcaccucgccgu

SEQ ID NO: 3522061 - RNA, 13 nt, Pseudomonas aeruginosa PA01
ccagcaccucgcg

SEQ ID NO: 3522062 - RNA, 17 nt, Pseudomonas aeruginosa PA01
ccagcaccucgcgggaa

SEQ ID NO: 3522063 - RNA, 21 nt, Pseudomonas aeruginosa PA01
ccagcaccucguaggccgacu

SEQ ID NO: 3522064 - RNA, 23 nt, Pseudomonas aeruginosa PA01
ccagcaccucguaggccgacucg

SEQ ID NO: 3522065 - RNA, 20 nt, Pseudomonas aeruginosa PA01
ccagcaccugcgggcugcgu

SEQ ID NO: 3522066 - RNA, 19 nt, Pseudomonas aeruginosa PA01
ccagcaccuggacgaaugc

SEQ ID NO: 3522067 - RNA, 16 nt, Pseudomonas aeruginosa PA01
ccagcaccuggcagug

SEQ ID NO: 3522068 - RNA, 18 nt, Pseudomonas aeruginosa PA01
ccagcaccuggcagugcg

SEQ ID NO: 3522069 - RNA, 16 nt, Pseudomonas aeruginosa PA01
ccagcaccuucaucac

SEQ ID NO: 3522070 - RNA, 22 nt, Pseudomonas aeruginosa PA01
ccagcaccuucaucaccagguc

SEQ ID NO: 3522071 - RNA, 13 nt, Pseudomonas aeruginosa PA01
ccagcacgccgag

SEQ ID NO: 3522072 - RNA, 15 nt, Pseudomonas aeruginosa PA01
ccagcacgccgagca

SEQ ID NO: 3522073 - RNA, 17 nt, Pseudomonas aeruginosa PA01
ccagcacgccgaucccg

SEQ ID NO: 3522074 - RNA, 22 nt, Pseudomonas aeruginosa PA01
ccagcacgccgaucccgaucgg

SEQ ID NO: 3522075 - RNA, 17 nt, Pseudomonas aeruginosa PA01
ccagcacggaugcccag

SEQ ID NO: 3522076 - RNA, 19 nt, Pseudomonas aeruginosa PA01
ccagcacggaugcccagcc

SEQ ID NO: 3522077 - RNA, 24 nt, Pseudomonas aeruginosa PA01
ccagcacggcgaauucgucgccgc

SEQ ID NO: 3522078 - RNA, 15 nt, Pseudomonas aeruginosa PA01
ccagcacggcgcagg

SEQ ID NO: 3522079 - RNA, 18 nt, Pseudomonas aeruginosa PA01
ccagcacggcgcagggca

SEQ ID NO: 3522080 - RNA, 21 nt, Pseudomonas aeruginosa PA01
ccagcacggugaaccaggcgc

SEQ ID NO: 3522081 - RNA, 20 nt, Pseudomonas aeruginosa PA01
ccagcacggugcuggcgucg

SEQ ID NO: 3522082 - RNA, 17 nt, Pseudomonas aeruginosa PA01
ccagcacguagccgccc

SEQ ID NO: 3522083 - RNA, 19 nt, Pseudomonas aeruginosa PA01
ccagcacguugccauccag

SEQ ID NO: 3522084 - RNA, 22 nt, Pseudomonas aeruginosa PA01
ccagcacguugccauccagcgc

SEQ ID NO: 3522085 - RNA, 15 nt, Pseudomonas aeruginosa PA01
ccagcacuacgccca

SEQ ID NO: 3522086 - RNA, 16 nt, Pseudomonas aeruginosa PA01
ccagcacuacgcccau

SEQ ID NO: 3522087 - RNA, 21 nt, Pseudomonas aeruginosa PA01
ccagcacuacgcccauggcgg

SEQ ID NO: 3522088 - RNA, 14 nt, Pseudomonas aeruginosa PA01
ccagcacucgcucc

SEQ ID NO: 3522089 - RNA, 18 nt, Pseudomonas aeruginosa PA01
ccagcacucgcuccuccg

SEQ ID NO: 3522090 - RNA, 13 nt, Pseudomonas aeruginosa PA01
ccagcagacgcuc

SEQ ID NO: 3522091 - RNA, 17 nt, Pseudomonas aeruginosa PA01
ccagcagacgcuccuug

SEQ ID NO: 3522092 - RNA, 20 nt, Pseudomonas aeruginosa PA01
ccagcagacggcacgacgcc

SEQ ID NO: 3522093 - RNA, 12 nt, Pseudomonas aeruginosa PA01
ccagcagcaaca

SEQ ID NO: 3522094 - RNA, 19 nt, Pseudomonas aeruginosa PA01
ccagcagcaacagcgccgc

SEQ ID NO: 3522095 - RNA, 22 nt, Pseudomonas aeruginosa PA01
ccagcagcaacagcgccgcgcg

SEQ ID NO: 3522096 - RNA, 21 nt, Pseudomonas aeruginosa PA01
ccagcagcaccaucagccagc

SEQ ID NO: 3522097 - RNA, 22 nt, Pseudomonas aeruginosa PA01
ccagcagcaccaucagccagcc

SEQ ID NO: 3522098 - RNA, 23 nt, Pseudomonas aeruginosa PA01
ccagcagcacgcccugggacagg

SEQ ID NO: 3522099 - RNA, 17 nt, Pseudomonas aeruginosa PA01
ccagcagcacggcgacg

SEQ ID NO: 3522100 - RNA, 13 nt, Pseudomonas aeruginosa PA01
ccagcagcagcgg

SEQ ID NO: 3522101 - RNA, 12 nt, Pseudomonas aeruginosa PA01
ccagcagcaggc

SEQ ID NO: 3522102 - RNA, 13 nt, Pseudomonas aeruginosa PA01
ccagcagcaggcc

SEQ ID NO: 3522103 - RNA, 17 nt, Pseudomonas aeruginosa PA01
ccagcagcaggccggcg

SEQ ID NO: 3522104 - RNA, 18 nt, Pseudomonas aeruginosa PA01
ccagcagcaggccggcga

SEQ ID NO: 3522105 - RNA, 19 nt, Pseudomonas aeruginosa PA01
ccagcagcaggccggcgac

SEQ ID NO: 3522106 - RNA, 22 nt, Pseudomonas aeruginosa PA01
ccagcagcaggccggcgaccag

SEQ ID NO: 3522107 - RNA, 12 nt, Pseudomonas aeruginosa PA01
ccagcagcaggu

SEQ ID NO: 3522108 - RNA, 14 nt, Pseudomonas aeruginosa PA01
ccagcagccaggcc

SEQ ID NO: 3522109 - RNA, 17 nt, Pseudomonas aeruginosa PA01
ccagcagccccgaggcc

SEQ ID NO: 3522110 - RNA, 20 nt, Pseudomonas aeruginosa PA01
ccagcagccccgaggccagc

SEQ ID NO: 3522111 - RNA, 22 nt, Pseudomonas aeruginosa PA01
ccagcagccccgaggccagcag

SEQ ID NO: 3522112 - RNA, 15 nt, Pseudomonas aeruginosa PA01
ccagcagcccggccu

SEQ ID NO: 3522113 - RNA, 17 nt, Pseudomonas aeruginosa PA01
ccagcagcgagcaggcg

SEQ ID NO: 3522114 - RNA, 20 nt, Pseudomonas aeruginosa PA01
ccagcagcgcacgcuucucc

SEQ ID NO: 3522115 - RNA, 13 nt, Pseudomonas aeruginosa PA01
ccagcagcgccuc

SEQ ID NO: 3522116 - RNA, 14 nt, Pseudomonas aeruginosa PA01
ccagcagcgccucg

SEQ ID NO: 3522117 - RNA, 18 nt, Pseudomonas aeruginosa PA01
ccagcagcgcugaucacg

SEQ ID NO: 3522118 - RNA, 12 nt, Pseudomonas aeruginosa PA01
ccagcagcggca

SEQ ID NO: 3522119 - RNA, 15 nt, Pseudomonas aeruginosa PA01
ccagcagcggcagcc

SEQ ID NO: 3522120 - RNA, 16 nt, Pseudomonas aeruginosa PA01
ccagcagcggcagcca

SEQ ID NO: 3522121 - RNA, 21 nt, Pseudomonas aeruginosa PA01
ccagcagcggcagccacucgg

SEQ ID NO: 3522122 - RNA, 15 nt, Pseudomonas aeruginosa PA01
ccagcagcggcggcg

SEQ ID NO: 3522123 - RNA, 16 nt, Pseudomonas aeruginosa PA01
ccagcagcggcggcgc

SEQ ID NO: 3522124 - RNA, 18 nt, Pseudomonas aeruginosa PA01
ccagcagcggcggcgccg

SEQ ID NO: 3522125 - RNA, 19 nt, Pseudomonas aeruginosa PA01
ccagcagcggcggcgccgg

SEQ ID NO: 3522126 - RNA, 16 nt, Pseudomonas aeruginosa PA01
ccagcagcggcucacg

SEQ ID NO: 3522127 - RNA, 23 nt, Pseudomonas aeruginosa PA01
ccagcagcggcucacgccccagc

SEQ ID NO: 3522128 - RNA, 15 nt, Pseudomonas aeruginosa PA01
ccagcagcuccaugu

SEQ ID NO: 3522129 - RNA, 18 nt, Pseudomonas aeruginosa PA01
ccagcagcuccgggcugg

SEQ ID NO: 3522130 - RNA, 21 nt, Pseudomonas aeruginosa PA01
ccagcaggaaaacgcucaggc

SEQ ID NO: 3522131 - RNA, 23 nt, Pseudomonas aeruginosa PA01
ccagcaggaaaacgcucaggcca

SEQ ID NO: 3522132 - RNA, 14 nt, Pseudomonas aeruginosa PA01
ccagcaggaccugg

SEQ ID NO: 3522133 - RNA, 21 nt, Pseudomonas aeruginosa PA01
ccagcaggaccuggccguugg

SEQ ID NO: 3522134 - RNA, 22 nt, Pseudomonas aeruginosa PA01
ccagcaggaccuggccguuggc

SEQ ID NO: 3522135 - RNA, 14 nt, Pseudomonas aeruginosa PA01
ccagcaggacgucg

SEQ ID NO: 3522136 - RNA, 21 nt, Pseudomonas aeruginosa PA01
ccagcaggaucgacagcagcg

SEQ ID NO: 3522137 - RNA, 15 nt, Pseudomonas aeruginosa PA01
ccagcaggaucgagc

SEQ ID NO: 3522138 - RNA, 20 nt, Pseudomonas aeruginosa PA01
ccagcaggaucgagcccugg

SEQ ID NO: 3522139 - RNA, 15 nt, Pseudomonas aeruginosa PA01
ccagcaggcaggcau

SEQ ID NO: 3522140 - RNA, 15 nt, Pseudomonas aeruginosa PA01
ccagcaggcaggcgc

SEQ ID NO: 3522141 - RNA, 17 nt, Pseudomonas aeruginosa PA01
ccagcaggcaggcgcgg

SEQ ID NO: 3522142 - RNA, 21 nt, Pseudomonas aeruginosa PA01
ccagcaggcaggcgcggguca

SEQ ID NO: 3522143 - RNA, 13 nt, Pseudomonas aeruginosa PA01
ccagcaggccagc

SEQ ID NO: 3522144 - RNA, 13 nt, Pseudomonas aeruginosa PA01
ccagcaggcccag

SEQ ID NO: 3522145 - RNA, 16 nt, Pseudomonas aeruginosa PA01
ccagcaggcccagcca

SEQ ID NO: 3522146 - RNA, 14 nt, Pseudomonas aeruginosa PA01
ccagcaggcccagu

SEQ ID NO: 3522147 - RNA, 24 nt, Pseudomonas aeruginosa PA01
ccagcaggcccaguucgcugccgc

SEQ ID NO: 3522148 - RNA, 16 nt, Pseudomonas aeruginosa PA01
ccagcaggccgaaggc

SEQ ID NO: 3522149 - RNA, 20 nt, Pseudomonas aeruginosa PA01
ccagcaggccgaaggccagg

SEQ ID NO: 3522150 - RNA, 14 nt, Pseudomonas aeruginosa PA01
ccagcaggccgagc

SEQ ID NO: 3522151 - RNA, 20 nt, Pseudomonas aeruginosa PA01
ccagcaggccgagcccgagu

SEQ ID NO: 3522152 - RNA, 21 nt, Pseudomonas aeruginosa PA01
ccagcaggccgaucaccagcg

SEQ ID NO: 3522153 - RNA, 17 nt, Pseudomonas aeruginosa PA01
ccagcaggccgaucagc

SEQ ID NO: 3522154 - RNA, 18 nt, Pseudomonas aeruginosa PA01
ccagcaggccgaucagcg

SEQ ID NO: 3522155 - RNA, 21 nt, Pseudomonas aeruginosa PA01
ccagcaggccgaucagcggcg

SEQ ID NO: 3522156 - RNA, 14 nt, Pseudomonas aeruginosa PA01
ccagcaggccggcc

SEQ ID NO: 3522157 - RNA, 17 nt, Pseudomonas aeruginosa PA01
ccagcaggccggccagc

SEQ ID NO: 3522158 - RNA, 22 nt, Pseudomonas aeruginosa PA01
ccagcaggccgugggccggcgc

SEQ ID NO: 3522159 - RNA, 12 nt, Pseudomonas aeruginosa PA01
ccagcaggcgca

SEQ ID NO: 3522160 - RNA, 18 nt, Pseudomonas aeruginosa PA01
ccagcaggcgcagcagcg

SEQ ID NO: 3522161 - RNA, 21 nt, Pseudomonas aeruginosa PA01
ccagcaggcgcagcagcgacu

SEQ ID NO: 3522162 - RNA, 14 nt, Pseudomonas aeruginosa PA01
ccagcaggcgcagg

SEQ ID NO: 3522163 - RNA, 16 nt, Pseudomonas aeruginosa PA01
ccagcaggcgcagguc

SEQ ID NO: 3522164 - RNA, 21 nt, Pseudomonas aeruginosa PA01
ccagcaggcgcaggucggccu

SEQ ID NO: 3522165 - RNA, 13 nt, Pseudomonas aeruginosa PA01
ccagcaggcgccg

SEQ ID NO: 3522166 - RNA, 14 nt, Pseudomonas aeruginosa PA01
ccagcaggcgccgg

SEQ ID NO: 3522167 - RNA, 17 nt, Pseudomonas aeruginosa PA01
ccagcaggcgccggcgg

SEQ ID NO: 3522168 - RNA, 12 nt, Pseudomonas aeruginosa PA01
ccagcaggcgcg

SEQ ID NO: 3522169 - RNA, 15 nt, Pseudomonas aeruginosa PA01
ccagcaggcgcgccc

SEQ ID NO: 3522170 - RNA, 17 nt, Pseudomonas aeruginosa PA01
ccagcaggcgcgcccug

SEQ ID NO: 3522171 - RNA, 18 nt, Pseudomonas aeruginosa PA01
ccagcaggcgcgcccuga

SEQ ID NO: 3522172 - RNA, 18 nt, Pseudomonas aeruginosa PA01
ccagcaggcgcgggcugg

SEQ ID NO: 3522173 - RNA, 15 nt, Pseudomonas aeruginosa PA01
ccagcaggcgcucgg

SEQ ID NO: 3522174 - RNA, 16 nt, Pseudomonas aeruginosa PA01
ccagcaggcgcucggc

SEQ ID NO: 3522175 - RNA, 18 nt, Pseudomonas aeruginosa PA01
ccagcaggcgcucggcga

SEQ ID NO: 3522176 - RNA, 19 nt, Pseudomonas aeruginosa PA01
ccagcaggcgcucggcgac

SEQ ID NO: 3522177 - RNA, 20 nt, Pseudomonas aeruginosa PA01
ccagcaggcgcucggcgacg

SEQ ID NO: 3522178 - RNA, 20 nt, Pseudomonas aeruginosa PA01
ccagcaggcguugcagugcg

SEQ ID NO: 3522179 - RNA, 20 nt, Pseudomonas aeruginosa PA01
ccagcaggcucuuggucgcg

SEQ ID NO: 3522180 - RNA, 14 nt, Pseudomonas aeruginosa PA01
ccagcagggccagc

SEQ ID NO: 3522181 - RNA, 15 nt, Pseudomonas aeruginosa PA01
ccagcagggccagca

SEQ ID NO: 3522182 - RNA, 18 nt, Pseudomonas aeruginosa PA01
ccagcagggccagcagcg

SEQ ID NO: 3522183 - RNA, 20 nt, Pseudomonas aeruginosa PA01
ccagcagggccagccagagc

SEQ ID NO: 3522184 - RNA, 17 nt, Pseudomonas aeruginosa PA01
ccagcagggccagcgcc

SEQ ID NO: 3522185 - RNA, 20 nt, Pseudomonas aeruginosa PA01
ccagcagggccagcgccugg

SEQ ID NO: 3522186 - RNA, 15 nt, Pseudomonas aeruginosa PA01
ccagcagggccaggc

SEQ ID NO: 3522187 - RNA, 17 nt, Pseudomonas aeruginosa PA01
ccagcagggccaggccg

SEQ ID NO: 3522188 - RNA, 19 nt, Pseudomonas aeruginosa PA01
ccagcagggccaggccgag

SEQ ID NO: 3522189 - RNA, 14 nt, Pseudomonas aeruginosa PA01
ccagcagggccgcc

SEQ ID NO: 3522190 - RNA, 15 nt, Pseudomonas aeruginosa PA01
ccagcagggccgccg

SEQ ID NO: 3522191 - RNA, 16 nt, Pseudomonas aeruginosa PA01
ccagcagggccgccga

SEQ ID NO: 3522192 - RNA, 17 nt, Pseudomonas aeruginosa PA01
ccagcagggccgccgag

SEQ ID NO: 3522193 - RNA, 18 nt, Pseudomonas aeruginosa PA01
ccagcagggccgccgagg

SEQ ID NO: 3522194 - RNA, 16 nt, Pseudomonas aeruginosa PA01
ccagcagggucgccug

SEQ ID NO: 3522195 - RNA, 17 nt, Pseudomonas aeruginosa PA01
ccagcagggucgccugg

SEQ ID NO: 3522196 - RNA, 18 nt, Pseudomonas aeruginosa PA01
ccagcagggucgccuggg

SEQ ID NO: 3522197 - RNA, 19 nt, Pseudomonas aeruginosa PA01
ccagcagggucgccugggu

SEQ ID NO: 3522198 - RNA, 22 nt, Pseudomonas aeruginosa PA01
ccagcagggucgcuuccucggc

SEQ ID NO: 3522199 - RNA, 20 nt, Pseudomonas aeruginosa PA01
ccagcagggugcggauggcg

SEQ ID NO: 3522200 - RNA, 22 nt, Pseudomonas aeruginosa PA01
ccagcagggugcggauggcgau

SEQ ID NO: 3522201 - RNA, 15 nt, Pseudomonas aeruginosa PA01
ccagcaggguggcca

SEQ ID NO: 3522202 - RNA, 17 nt, Pseudomonas aeruginosa PA01
ccagcaggguggccagg

SEQ ID NO: 3522203 - RNA, 18 nt, Pseudomonas aeruginosa PA01
ccagcaggguggccaggg

SEQ ID NO: 3522204 - RNA, 18 nt, Pseudomonas aeruginosa PA01
ccagcagguacagcgacu

SEQ ID NO: 3522205 - RNA, 18 nt, Pseudomonas aeruginosa PA01
ccagcagguagccagggg

SEQ ID NO: 3522206 - RNA, 16 nt, Pseudomonas aeruginosa PA01
ccagcagguagccugc

SEQ ID NO: 3522207 - RNA, 12 nt, Pseudomonas aeruginosa PA01
ccagcaggucga

SEQ ID NO: 3522208 - RNA, 15 nt, Pseudomonas aeruginosa PA01
ccagcaggucgaggg

SEQ ID NO: 3522209 - RNA, 15 nt, Pseudomonas aeruginosa PA01
ccagcaggucgaggu

SEQ ID NO: 3522210 - RNA, 12 nt, Pseudomonas aeruginosa PA01
ccagcaggucgg

SEQ ID NO: 3522211 - RNA, 14 nt, Pseudomonas aeruginosa PA01
ccagcaggucggca

SEQ ID NO: 3522212 - RNA, 16 nt, Pseudomonas aeruginosa PA01
ccagcaggucggcagc

SEQ ID NO: 3522213 - RNA, 18 nt, Pseudomonas aeruginosa PA01
ccagcaggucggcagcgu

SEQ ID NO: 3522214 - RNA, 20 nt, Pseudomonas aeruginosa PA01
ccagcaggucggcagcgucg

SEQ ID NO: 3522215 - RNA, 17 nt, Pseudomonas aeruginosa PA01
ccagcaggucggccugc

SEQ ID NO: 3522216 - RNA, 14 nt, Pseudomonas aeruginosa PA01
ccagcagguggcgc

SEQ ID NO: 3522217 - RNA, 20 nt, Pseudomonas aeruginosa PA01
ccagcagguggucgaugggc

SEQ ID NO: 3522218 - RNA, 17 nt, Pseudomonas aeruginosa PA01
ccagcaguagugcgacg

SEQ ID NO: 3522219 - RNA, 21 nt, Pseudomonas aeruginosa PA01
ccagcaguagugcgacgcagc

SEQ ID NO: 3522220 - RNA, 16 nt, Pseudomonas aeruginosa PA01
ccagcagucgcacagc

SEQ ID NO: 3522221 - RNA, 17 nt, Pseudomonas aeruginosa PA01
ccagcagucgcacagcc

SEQ ID NO: 3522222 - RNA, 13 nt, Pseudomonas aeruginosa PA01
ccagcagucgcgg

SEQ ID NO: 3522223 - RNA, 16 nt, Pseudomonas aeruginosa PA01
ccagcagucgcggccc

SEQ ID NO: 3522224 - RNA, 17 nt, Pseudomonas aeruginosa PA01
ccagcagucgcggcccu

SEQ ID NO: 3522225 - RNA, 17 nt, Pseudomonas aeruginosa PA01
ccagcaguucgucgcca

SEQ ID NO: 3522226 - RNA, 19 nt, Pseudomonas aeruginosa PA01
ccagcaguucgucgccacg

SEQ ID NO: 3522227 - RNA, 22 nt, Pseudomonas aeruginosa PA01
ccagcaguucgucgccacgccc

SEQ ID NO: 3522228 - RNA, 15 nt, Pseudomonas aeruginosa PA01
ccagcaguugcaaca

SEQ ID NO: 3522229 - RNA, 17 nt, Pseudomonas aeruginosa PA01
ccagcaguugcaacagc

SEQ ID NO: 3522230 - RNA, 18 nt, Pseudomonas aeruginosa PA01
ccagcaguugcaacagcg

SEQ ID NO: 3522231 - RNA, 21 nt, Pseudomonas aeruginosa PA01
ccagcaguugcaacagcgcgg

SEQ ID NO: 3522232 - RNA, 23 nt, Pseudomonas aeruginosa PA01
ccagcaguugcaacagcgcggcg

SEQ ID NO: 3522233 - RNA, 22 nt, Pseudomonas aeruginosa PA01
ccagcaucaugaucugguagac

SEQ ID NO: 3522234 - RNA, 20 nt, Pseudomonas aeruginosa PA01
ccagcaucgcaucggcgacc

SEQ ID NO: 3522235 - RNA, 13 nt, Pseudomonas aeruginosa PA01
ccagcaucgccgg

SEQ ID NO: 3522236 - RNA, 15 nt, Pseudomonas aeruginosa PA01
ccagcaucguaggga

SEQ ID NO: 3522237 - RNA, 18 nt, Pseudomonas aeruginosa PA01
ccagcaugcccagcgugg

SEQ ID NO: 3522238 - RNA, 21 nt, Pseudomonas aeruginosa PA01
ccagcaugcccagcguggcca

SEQ ID NO: 3522239 - RNA, 17 nt, Pseudomonas aeruginosa PA01
ccagcaugcucgggcug

SEQ ID NO: 3522240 - RNA, 22 nt, Pseudomonas aeruginosa PA01
ccagcauggcgaagcucggccg

SEQ ID NO: 3522241 - RNA, 22 nt, Pseudomonas aeruginosa PA01
ccagcauguccugcaggcucag

SEQ ID NO: 3522242 - RNA, 21 nt, Pseudomonas aeruginosa PA01
ccagcauuaccccgaccaggu

SEQ ID NO: 3522243 - RNA, 22 nt, Pseudomonas aeruginosa PA01
ccagccaacugcuucaggcgcg

SEQ ID NO: 3522244 - RNA, 17 nt, Pseudomonas aeruginosa PA01
ccagccacucccggccc

SEQ ID NO: 3522245 - RNA, 18 nt, Pseudomonas aeruginosa PA01
ccagccacugcuuggcga

SEQ ID NO: 3522246 - RNA, 20 nt, Pseudomonas aeruginosa PA01
ccagccacugcuuggcgaac

SEQ ID NO: 3522247 - RNA, 23 nt, Pseudomonas aeruginosa PA01
ccagccacugcuuggcgaacucc

SEQ ID NO: 3522248 - RNA, 19 nt, Pseudomonas aeruginosa PA01
ccagccagacguccggcag

SEQ ID NO: 3522249 - RNA, 16 nt, Pseudomonas aeruginosa PA01
ccagccagagcagcgu

SEQ ID NO: 3522250 - RNA, 15 nt, Pseudomonas aeruginosa PA01
ccagccagcagcccg

SEQ ID NO: 3522251 - RNA, 19 nt, Pseudomonas aeruginosa PA01
ccagccagcagcccggccu

SEQ ID NO: 3522252 - RNA, 11 nt, Pseudomonas aeruginosa PA01
ccagccagccc

SEQ ID NO: 3522253 - RNA, 12 nt, Pseudomonas aeruginosa PA01
ccagccagcccg

SEQ ID NO: 3522254 - RNA, 14 nt, Pseudomonas aeruginosa PA01
ccagccagcccgca

SEQ ID NO: 3522255 - RNA, 15 nt, Pseudomonas aeruginosa PA01
ccagccagcccucgg

SEQ ID NO: 3522256 - RNA, 15 nt, Pseudomonas aeruginosa PA01
ccagccagccgcgcg

SEQ ID NO: 3522257 - RNA, 16 nt, Pseudomonas aeruginosa PA01
ccagccagccgcgcgc

SEQ ID NO: 3522258 - RNA, 14 nt, Pseudomonas aeruginosa PA01
ccagccagcgcggc

SEQ ID NO: 3522259 - RNA, 20 nt, Pseudomonas aeruginosa PA01
ccagccaggaagagcccgcc

SEQ ID NO: 3522260 - RNA, 21 nt, Pseudomonas aeruginosa PA01
ccagccaggaagagcccgcca

SEQ ID NO: 3522261 - RNA, 22 nt, Pseudomonas aeruginosa PA01
ccagccaggaagagcccgccac

SEQ ID NO: 3522262 - RNA, 23 nt, Pseudomonas aeruginosa PA01
ccagccaggaagagcccgccacg

SEQ ID NO: 3522263 - RNA, 14 nt, Pseudomonas aeruginosa PA01
ccagccaggcccgg

SEQ ID NO: 3522264 - RNA, 21 nt, Pseudomonas aeruginosa PA01
ccagccaggcgaugaacggcg

SEQ ID NO: 3522265 - RNA, 20 nt, Pseudomonas aeruginosa PA01
ccagccaggcgcucucgccg

SEQ ID NO: 3522266 - RNA, 14 nt, Pseudomonas aeruginosa PA01
ccagccagggcagc

SEQ ID NO: 3522267 - RNA, 18 nt, Pseudomonas aeruginosa PA01
ccagccagggcagcaggu

SEQ ID NO: 3522268 - RNA, 13 nt, Pseudomonas aeruginosa PA01
ccagccagggccg

SEQ ID NO: 3522269 - RNA, 15 nt, Pseudomonas aeruginosa PA01
ccagccagggccgcg

SEQ ID NO: 3522270 - RNA, 17 nt, Pseudomonas aeruginosa PA01
ccagccaguccggcagc

SEQ ID NO: 3522271 - RNA, 15 nt, Pseudomonas aeruginosa PA01
ccagccagugcaugc

SEQ ID NO: 3522272 - RNA, 16 nt, Pseudomonas aeruginosa PA01
ccagccaugcaggcug

SEQ ID NO: 3522273 - RNA, 19 nt, Pseudomonas aeruginosa PA01
ccagccauugagcgcgccc

SEQ ID NO: 3522274 - RNA, 13 nt, Pseudomonas aeruginosa PA01
ccagcccagcggc

SEQ ID NO: 3522275 - RNA, 21 nt, Pseudomonas aeruginosa PA01
ccagcccagcggcgcggcgua

SEQ ID NO: 3522276 - RNA, 17 nt, Pseudomonas aeruginosa PA01
ccagccccaccgccagg

SEQ ID NO: 3522277 - RNA, 13 nt, Pseudomonas aeruginosa PA01
ccagccccacugg

SEQ ID NO: 3522278 - RNA, 18 nt, Pseudomonas aeruginosa PA01
ccagccccaggccgcccu

SEQ ID NO: 3522279 - RNA, 14 nt, Pseudomonas aeruginosa PA01
ccagccccaggcgc

SEQ ID NO: 3522280 - RNA, 14 nt, Pseudomonas aeruginosa PA01
ccagccccaguccc

SEQ ID NO: 3522281 - RNA, 9 nt, Pseudomonas aeruginosa PA01
ccagccccc

SEQ ID NO: 3522282 - RNA, 16 nt, Pseudomonas aeruginosa PA01
ccagcccccucgcccu

SEQ ID NO: 3522283 - RNA, 13 nt, Pseudomonas aeruginosa PA01
ccagccccgccgg

SEQ ID NO: 3522284 - RNA, 14 nt, Pseudomonas aeruginosa PA01
ccagccccgccgga

SEQ ID NO: 3522285 - RNA, 16 nt, Pseudomonas aeruginosa PA01
ccagccccgccggaau

SEQ ID NO: 3522286 - RNA, 18 nt, Pseudomonas aeruginosa PA01
ccagccccugcggaccgc

SEQ ID NO: 3522287 - RNA, 22 nt, Pseudomonas aeruginosa PA01
ccagcccgcaauccgaccgggg

SEQ ID NO: 3522288 - RNA, 12 nt, Pseudomonas aeruginosa PA01
ccagcccgcagg

SEQ ID NO: 3522289 - RNA, 12 nt, Pseudomonas aeruginosa PA01
ccagcccgccuu

SEQ ID NO: 3522290 - RNA, 14 nt, Pseudomonas aeruginosa PA01
ccagcccgccuucc

SEQ ID NO: 3522291 - RNA, 12 nt, Pseudomonas aeruginosa PA01
ccagcccggcca

SEQ ID NO: 3522292 - RNA, 12 nt, Pseudomonas aeruginosa PA01
ccagcccggccu

SEQ ID NO: 3522293 - RNA, 18 nt, Pseudomonas aeruginosa PA01
ccagcccggccucgccgg

SEQ ID NO: 3522294 - RNA, 13 nt, Pseudomonas aeruginosa PA01
ccagcccggcggc

SEQ ID NO: 3522295 - RNA, 14 nt, Pseudomonas aeruginosa PA01
ccagcccggcgugg

SEQ ID NO: 3522296 - RNA, 21 nt, Pseudomonas aeruginosa PA01
ccagcccggcgugggcggucg

SEQ ID NO: 3522297 - RNA, 13 nt, Pseudomonas aeruginosa PA01
ccagcccggcucg

SEQ ID NO: 3522298 - RNA, 17 nt, Pseudomonas aeruginosa PA01
ccagcccgguucagcgg

SEQ ID NO: 3522299 - RNA, 14 nt, Pseudomonas aeruginosa PA01
ccagcccguagucg

SEQ ID NO: 3522300 - RNA, 20 nt, Pseudomonas aeruginosa PA01
ccagcccuggaaaggccucg

SEQ ID NO: 3522301 - RNA, 17 nt, Pseudomonas aeruginosa PA01
ccagcccuggcgcggca

SEQ ID NO: 3522302 - RNA, 16 nt, Pseudomonas aeruginosa PA01
ccagcccuucgacguc

SEQ ID NO: 3522303 - RNA, 20 nt, Pseudomonas aeruginosa PA01
ccagccgaacaguucggcgg

SEQ ID NO: 3522304 - RNA, 16 nt, Pseudomonas aeruginosa PA01
ccagccgacguagggc

SEQ ID NO: 3522305 - RNA, 15 nt, Pseudomonas aeruginosa PA01
ccagccgaggcagcc

SEQ ID NO: 3522306 - RNA, 16 nt, Pseudomonas aeruginosa PA01
ccagccgaggcagccg

SEQ ID NO: 3522307 - RNA, 20 nt, Pseudomonas aeruginosa PA01
ccagccgaggcagccgucgg

SEQ ID NO: 3522308 - RNA, 13 nt, Pseudomonas aeruginosa PA01
ccagccgccagga

SEQ ID NO: 3522309 - RNA, 18 nt, Pseudomonas aeruginosa PA01
ccagccgccaggacggca

SEQ ID NO: 3522310 - RNA, 21 nt, Pseudomonas aeruginosa PA01
ccagccgccaggacggcaggg

SEQ ID NO: 3522311 - RNA, 20 nt, Pseudomonas aeruginosa PA01
ccagccgcccuggcucuggg

SEQ ID NO: 3522312 - RNA, 16 nt, Pseudomonas aeruginosa PA01
ccagccgccgaagggc

SEQ ID NO: 3522313 - RNA, 11 nt, Pseudomonas aeruginosa PA01
ccagccgccgc

SEQ ID NO: 3522314 - RNA, 18 nt, Pseudomonas aeruginosa PA01
ccagccgcgccagugccu

SEQ ID NO: 3522315 - RNA, 12 nt, Pseudomonas aeruginosa PA01
ccagccgcgcgc

SEQ ID NO: 3522316 - RNA, 14 nt, Pseudomonas aeruginosa PA01
ccagccgcgcgccg

SEQ ID NO: 3522317 - RNA, 16 nt, Pseudomonas aeruginosa PA01
ccagccgcgcgccgca

SEQ ID NO: 3522318 - RNA, 22 nt, Pseudomonas aeruginosa PA01
ccagccgcgcgccgcaucgcug

SEQ ID NO: 3522319 - RNA, 19 nt, Pseudomonas aeruginosa PA01
ccagccgcgcgcgucgagc

SEQ ID NO: 3522320 - RNA, 15 nt, Pseudomonas aeruginosa PA01
ccagccgcgcggcau

SEQ ID NO: 3522321 - RNA, 20 nt, Pseudomonas aeruginosa PA01
ccagccgcggaucaccuggc

SEQ ID NO: 3522322 - RNA, 15 nt, Pseudomonas aeruginosa PA01
ccagccgcggccguu

SEQ ID NO: 3522323 - RNA, 18 nt, Pseudomonas aeruginosa PA01
ccagccgcuagcgguagc

SEQ ID NO: 3522324 - RNA, 14 nt, Pseudomonas aeruginosa PA01
ccagccgcucgcgu

SEQ ID NO: 3522325 - RNA, 21 nt, Pseudomonas aeruginosa PA01
ccagccgcucgcguccgcagu

SEQ ID NO: 3522326 - RNA, 22 nt, Pseudomonas aeruginosa PA01
ccagccgcugcagggcggcgcu

SEQ ID NO: 3522327 - RNA, 14 nt, Pseudomonas aeruginosa PA01
ccagccggcaagcg

SEQ ID NO: 3522328 - RNA, 16 nt, Pseudomonas aeruginosa PA01
ccagccggccauccag

SEQ ID NO: 3522329 - RNA, 21 nt, Pseudomonas aeruginosa PA01
ccagccggccgcgucgcccag

SEQ ID NO: 3522330 - RNA, 23 nt, Pseudomonas aeruginosa PA01
ccagccggccgcgucgcccaggc

SEQ ID NO: 3522331 - RNA, 24 nt, Pseudomonas aeruginosa PA01
ccagccggccgcgucgcccaggcc

SEQ ID NO: 3522332 - RNA, 23 nt, Pseudomonas aeruginosa PA01
ccagccggccuugcuuugcgccu

SEQ ID NO: 3522333 - RNA, 22 nt, Pseudomonas aeruginosa PA01
ccagccggcgaagggcaggccg

SEQ ID NO: 3522334 - RNA, 14 nt, Pseudomonas aeruginosa PA01
ccagccggcgacgc

SEQ ID NO: 3522335 - RNA, 12 nt, Pseudomonas aeruginosa PA01
ccagccggcgcc

SEQ ID NO: 3522336 - RNA, 15 nt, Pseudomonas aeruginosa PA01
ccagccggcgccgca

SEQ ID NO: 3522337 - RNA, 17 nt, Pseudomonas aeruginosa PA01
ccagccggcgccgcagg

SEQ ID NO: 3522338 - RNA, 18 nt, Pseudomonas aeruginosa PA01
ccagccggcgcucggcca

SEQ ID NO: 3522339 - RNA, 19 nt, Pseudomonas aeruginosa PA01
ccagccggcgcucggccag

SEQ ID NO: 3522340 - RNA, 21 nt, Pseudomonas aeruginosa PA01
ccagccggcgcuucugcgagc

SEQ ID NO: 3522341 - RNA, 20 nt, Pseudomonas aeruginosa PA01
ccagccggcugugaccgaga

SEQ ID NO: 3522342 - RNA, 19 nt, Pseudomonas aeruginosa PA01
ccagccgggcuccgccgcg

SEQ ID NO: 3522343 - RNA, 17 nt, Pseudomonas aeruginosa PA01
ccagccggggcugagcg

SEQ ID NO: 3522344 - RNA, 14 nt, Pseudomonas aeruginosa PA01
ccagccggucccgg

SEQ ID NO: 3522345 - RNA, 17 nt, Pseudomonas aeruginosa PA01
ccagccggucccgggcu

SEQ ID NO: 3522346 - RNA, 18 nt, Pseudomonas aeruginosa PA01
ccagccggucccgggcuc

SEQ ID NO: 3522347 - RNA, 22 nt, Pseudomonas aeruginosa PA01
ccagccggugaaacggaucacg

SEQ ID NO: 3522348 - RNA, 12 nt, Pseudomonas aeruginosa PA01
ccagccguccgc

SEQ ID NO: 3522349 - RNA, 14 nt, Pseudomonas aeruginosa PA01
ccagccguccgcgg

SEQ ID NO: 3522350 - RNA, 15 nt, Pseudomonas aeruginosa PA01
ccagccgucgucguc

SEQ ID NO: 3522351 - RNA, 22 nt, Pseudomonas aeruginosa PA01
ccagccguucgcuggacaggcg

SEQ ID NO: 3522352 - RNA, 16 nt, Pseudomonas aeruginosa PA01
ccagccuacugggcgu

SEQ ID NO: 3522353 - RNA, 12 nt, Pseudomonas aeruginosa PA01
ccagccucagcc

SEQ ID NO: 3522354 - RNA, 13 nt, Pseudomonas aeruginosa PA01
ccagccucagcca

SEQ ID NO: 3522355 - RNA, 19 nt, Pseudomonas aeruginosa PA01
ccagccucauucgcucugc

SEQ ID NO: 3522356 - RNA, 23 nt, Pseudomonas aeruginosa PA01
ccagccucauucgcucugcgcca

SEQ ID NO: 3522357 - RNA, 15 nt, Pseudomonas aeruginosa PA01
ccagccuccacccgg

SEQ ID NO: 3522358 - RNA, 13 nt, Pseudomonas aeruginosa PA01
ccagccucggcag

SEQ ID NO: 3522359 - RNA, 18 nt, Pseudomonas aeruginosa PA01
ccagccucggcagggcgc

SEQ ID NO: 3522360 - RNA, 22 nt, Pseudomonas aeruginosa PA01
ccagccucggcagggcgcccgc

SEQ ID NO: 3522361 - RNA, 24 nt, Pseudomonas aeruginosa PA01
ccagccucggcagggcgcccgccc

SEQ ID NO: 3522362 - RNA, 14 nt, Pseudomonas aeruginosa PA01
ccagccuucccggc

SEQ ID NO: 3522363 - RNA, 15 nt, Pseudomonas aeruginosa PA01
ccagccuucccggcg

SEQ ID NO: 3522364 - RNA, 16 nt, Pseudomonas aeruginosa PA01
ccagccuucccggcgc

SEQ ID NO: 3522365 - RNA, 17 nt, Pseudomonas aeruginosa PA01
ccagccuucccggcgcu

SEQ ID NO: 3522366 - RNA, 20 nt, Pseudomonas aeruginosa PA01
ccagccuuccggcaccacca

SEQ ID NO: 3522367 - RNA, 13 nt, Pseudomonas aeruginosa PA01
ccagccuuccucg

SEQ ID NO: 3522368 - RNA, 14 nt, Pseudomonas aeruginosa PA01
ccagccuugagccu

SEQ ID NO: 3522369 - RNA, 23 nt, Pseudomonas aeruginosa PA01
ccagccuugagccuugccccguu

SEQ ID NO: 3522370 - RNA, 15 nt, Pseudomonas aeruginosa PA01
ccagcgaaagcguca

SEQ ID NO: 3522371 - RNA, 18 nt, Pseudomonas aeruginosa PA01
ccagcgaaagcgucagcg

SEQ ID NO: 3522372 - RNA, 19 nt, Pseudomonas aeruginosa PA01
ccagcgaaagcgucagcgc

SEQ ID NO: 3522373 - RNA, 20 nt, Pseudomonas aeruginosa PA01
ccagcgaaagcgucagcgcg

SEQ ID NO: 3522374 - RNA, 21 nt, Pseudomonas aeruginosa PA01
ccagcgaaagcgucagcgcgc

SEQ ID NO: 3522375 - RNA, 17 nt, Pseudomonas aeruginosa PA01
ccagcgaacccaggccg

SEQ ID NO: 3522376 - RNA, 18 nt, Pseudomonas aeruginosa PA01
ccagcgaacccaggccgc

SEQ ID NO: 3522377 - RNA, 15 nt, Pseudomonas aeruginosa PA01
ccagcgaaccgccgg

SEQ ID NO: 3522378 - RNA, 18 nt, Pseudomonas aeruginosa PA01
ccagcgaaccgccggccu

SEQ ID NO: 3522379 - RNA, 20 nt, Pseudomonas aeruginosa PA01
ccagcgaaccgccggccucg

SEQ ID NO: 3522380 - RNA, 17 nt, Pseudomonas aeruginosa PA01
ccagcgaauggacaggc

SEQ ID NO: 3522381 - RNA, 21 nt, Pseudomonas aeruginosa PA01
ccagcgaauggacaggcgccc

SEQ ID NO: 3522382 - RNA, 16 nt, Pseudomonas aeruginosa PA01
ccagcgaccgucgaac

SEQ ID NO: 3522383 - RNA, 18 nt, Pseudomonas aeruginosa PA01
ccagcgaccgucgaacca

SEQ ID NO: 3522384 - RNA, 23 nt, Pseudomonas aeruginosa PA01
ccagcgaccgucgaaccagggac

SEQ ID NO: 3522385 - RNA, 12 nt, Pseudomonas aeruginosa PA01
ccagcgacgacu

SEQ ID NO: 3522386 - RNA, 17 nt, Pseudomonas aeruginosa PA01
ccagcgacgcgacaucc

SEQ ID NO: 3522387 - RNA, 17 nt, Pseudomonas aeruginosa PA01
ccagcgacuccgccagu

SEQ ID NO: 3522388 - RNA, 13 nt, Pseudomonas aeruginosa PA01
ccagcgacucgcu

SEQ ID NO: 3522389 - RNA, 16 nt, Pseudomonas aeruginosa PA01
ccagcgacucgcucgc

SEQ ID NO: 3522390 - RNA, 17 nt, Pseudomonas aeruginosa PA01
ccagcgacucgcucgcu

SEQ ID NO: 3522391 - RNA, 23 nt, Pseudomonas aeruginosa PA01
ccagcgacucgcucgcuucagcg

SEQ ID NO: 3522392 - RNA, 15 nt, Pseudomonas aeruginosa PA01
ccagcgagaacuugc

SEQ ID NO: 3522393 - RNA, 20 nt, Pseudomonas aeruginosa PA01
ccagcgagaacuugccggcg

SEQ ID NO: 3522394 - RNA, 21 nt, Pseudomonas aeruginosa PA01
ccagcgagaacuugccggcgc

SEQ ID NO: 3522395 - RNA, 22 nt, Pseudomonas aeruginosa PA01
ccagcgagaacuugccggcgcc

SEQ ID NO: 3522396 - RNA, 23 nt, Pseudomonas aeruginosa PA01
ccagcgagaacuugccggcgcca

SEQ ID NO: 3522397 - RNA, 20 nt, Pseudomonas aeruginosa PA01
ccagcgagacgggcgaggcu

SEQ ID NO: 3522398 - RNA, 15 nt, Pseudomonas aeruginosa PA01
ccagcgagccgagca

SEQ ID NO: 3522399 - RNA, 19 nt, Pseudomonas aeruginosa PA01
ccagcgagccgaucaccag

SEQ ID NO: 3522400 - RNA, 15 nt, Pseudomonas aeruginosa PA01
ccagcgagcgggcga

SEQ ID NO: 3522401 - RNA, 19 nt, Pseudomonas aeruginosa PA01
ccagcgagcgggcgagggc

SEQ ID NO: 3522402 - RNA, 13 nt, Pseudomonas aeruginosa PA01
ccagcgaggcgug

SEQ ID NO: 3522403 - RNA, 21 nt, Pseudomonas aeruginosa PA01
ccagcgaguagucgcggggcg

SEQ ID NO: 3522404 - RNA, 15 nt, Pseudomonas aeruginosa PA01
ccagcgagucgaccc

SEQ ID NO: 3522405 - RNA, 20 nt, Pseudomonas aeruginosa PA01
ccagcgagucgacccaggcc

SEQ ID NO: 3522406 - RNA, 16 nt, Pseudomonas aeruginosa PA01
ccagcgcaagcggcgg

SEQ ID NO: 3522407 - RNA, 20 nt, Pseudomonas aeruginosa PA01
ccagcgcaccagggucgggc

SEQ ID NO: 3522408 - RNA, 22 nt, Pseudomonas aeruginosa PA01
ccagcgcaccgccaaggauggg

SEQ ID NO: 3522409 - RNA, 22 nt, Pseudomonas aeruginosa PA01
ccagcgcaccuacuaccgcugg

SEQ ID NO: 3522410 - RNA, 23 nt, Pseudomonas aeruginosa PA01
ccagcgcaccuacuaccgcuggg

SEQ ID NO: 3522411 - RNA, 15 nt, Pseudomonas aeruginosa PA01
ccagcgcacgccgug

SEQ ID NO: 3522412 - RNA, 23 nt, Pseudomonas aeruginosa PA01
ccagcgcacgccguggaccagga

SEQ ID NO: 3522413 - RNA, 17 nt, Pseudomonas aeruginosa PA01
ccagcgcagccugcugg

SEQ ID NO: 3522414 - RNA, 13 nt, Pseudomonas aeruginosa PA01
ccagcgcaggccg

SEQ ID NO: 3522415 - RNA, 14 nt, Pseudomonas aeruginosa PA01
ccagcgcaucgagg

SEQ ID NO: 3522416 - RNA, 16 nt, Pseudomonas aeruginosa PA01
ccagcgcaucgaggcc

SEQ ID NO: 3522417 - RNA, 14 nt, Pseudomonas aeruginosa PA01
ccagcgcaucggcg

SEQ ID NO: 3522418 - RNA, 13 nt, Pseudomonas aeruginosa PA01
ccagcgccaccag

SEQ ID NO: 3522419 - RNA, 19 nt, Pseudomonas aeruginosa PA01
ccagcgccaccagcagggc

SEQ ID NO: 3522420 - RNA, 23 nt, Pseudomonas aeruginosa PA01
ccagcgccaccagcagggccagg

SEQ ID NO: 3522421 - RNA, 14 nt, Pseudomonas aeruginosa PA01
ccagcgccacgccg

SEQ ID NO: 3522422 - RNA, 20 nt, Pseudomonas aeruginosa PA01
ccagcgccacggcgaucgcc

SEQ ID NO: 3522423 - RNA, 22 nt, Pseudomonas aeruginosa PA01
ccagcgccacggcgaucgccgg

SEQ ID NO: 3522424 - RNA, 17 nt, Pseudomonas aeruginosa PA01
ccagcgccacuuccagg

SEQ ID NO: 3522425 - RNA, 14 nt, Pseudomonas aeruginosa PA01
ccagcgccagcagg

SEQ ID NO: 3522426 - RNA, 14 nt, Pseudomonas aeruginosa PA01
ccagcgccaggagc

SEQ ID NO: 3522427 - RNA, 16 nt, Pseudomonas aeruginosa PA01
ccagcgccaggagcag

SEQ ID NO: 3522428 - RNA, 18 nt, Pseudomonas aeruginosa PA01
ccagcgccaggagcaggg

SEQ ID NO: 3522429 - RNA, 21 nt, Pseudomonas aeruginosa PA01
ccagcgccaggagcagggcgc

SEQ ID NO: 3522430 - RNA, 13 nt, Pseudomonas aeruginosa PA01
ccagcgccaggcc

SEQ ID NO: 3522431 - RNA, 14 nt, Pseudomonas aeruginosa PA01
ccagcgccaggccg

SEQ ID NO: 3522432 - RNA, 16 nt, Pseudomonas aeruginosa PA01
ccagcgccaggccgcc

SEQ ID NO: 3522433 - RNA, 15 nt, Pseudomonas aeruginosa PA01
ccagcgccaggcgcg

SEQ ID NO: 3522434 - RNA, 14 nt, Pseudomonas aeruginosa PA01
ccagcgccagguug

SEQ ID NO: 3522435 - RNA, 23 nt, Pseudomonas aeruginosa PA01
ccagcgccagguuggccuggccc

SEQ ID NO: 3522436 - RNA, 14 nt, Pseudomonas aeruginosa PA01
ccagcgcccaggcc

SEQ ID NO: 3522437 - RNA, 16 nt, Pseudomonas aeruginosa PA01
ccagcgcccaggccgg

SEQ ID NO: 3522438 - RNA, 17 nt, Pseudomonas aeruginosa PA01
ccagcgcccaggccggg

SEQ ID NO: 3522439 - RNA, 18 nt, Pseudomonas aeruginosa PA01
ccagcgcccaggccgggu

SEQ ID NO: 3522440 - RNA, 20 nt, Pseudomonas aeruginosa PA01
ccagcgcccgcaccacccgc

SEQ ID NO: 3522441 - RNA, 22 nt, Pseudomonas aeruginosa PA01
ccagcgcccgcaccacccgcug

SEQ ID NO: 3522442 - RNA, 16 nt, Pseudomonas aeruginosa PA01
ccagcgcccguagcac

SEQ ID NO: 3522443 - RNA, 23 nt, Pseudomonas aeruginosa PA01
ccagcgccgacuugcucaucgcg

SEQ ID NO: 3522444 - RNA, 21 nt, Pseudomonas aeruginosa PA01
ccagcgccgagacgaucagca

SEQ ID NO: 3522445 - RNA, 22 nt, Pseudomonas aeruginosa PA01
ccagcgccgagacgaucagcag

SEQ ID NO: 3522446 - RNA, 21 nt, Pseudomonas aeruginosa PA01
ccagcgccgcauuggccaggc

SEQ ID NO: 3522447 - RNA, 22 nt, Pseudomonas aeruginosa PA01
ccagcgccgcauuggccaggcc

SEQ ID NO: 3522448 - RNA, 14 nt, Pseudomonas aeruginosa PA01
ccagcgccgccaac

SEQ ID NO: 3522449 - RNA, 13 nt, Pseudomonas aeruginosa PA01
ccagcgccgccac

SEQ ID NO: 3522450 - RNA, 14 nt, Pseudomonas aeruginosa PA01
ccagcgccgccagg

SEQ ID NO: 3522451 - RNA, 19 nt, Pseudomonas aeruginosa PA01
ccagcgccgccaggcagac

SEQ ID NO: 3522452 - RNA, 17 nt, Pseudomonas aeruginosa PA01
ccagcgccgccaggcgc

SEQ ID NO: 3522453 - RNA, 14 nt, Pseudomonas aeruginosa PA01
ccagcgccgccagu

SEQ ID NO: 3522454 - RNA, 13 nt, Pseudomonas aeruginosa PA01
ccagcgccgccgc

SEQ ID NO: 3522455 - RNA, 14 nt, Pseudomonas aeruginosa PA01
ccagcgccgccgcg

SEQ ID NO: 3522456 - RNA, 18 nt, Pseudomonas aeruginosa PA01
ccagcgccgccgcugcgu

SEQ ID NO: 3522457 - RNA, 20 nt, Pseudomonas aeruginosa PA01
ccagcgccgccgcugcgucg

SEQ ID NO: 3522458 - RNA, 12 nt, Pseudomonas aeruginosa PA01
ccagcgccgccu

SEQ ID NO: 3522459 - RNA, 19 nt, Pseudomonas aeruginosa PA01
ccagcgccgccucgaaggc

SEQ ID NO: 3522460 - RNA, 14 nt, Pseudomonas aeruginosa PA01
ccagcgccgccugc

SEQ ID NO: 3522461 - RNA, 17 nt, Pseudomonas aeruginosa PA01
ccagcgccgccugcugg

SEQ ID NO: 3522462 - RNA, 11 nt, Pseudomonas aeruginosa PA01
ccagcgccgcg

SEQ ID NO: 3522463 - RNA, 13 nt, Pseudomonas aeruginosa PA01
ccagcgccgcgcu

SEQ ID NO: 3522464 - RNA, 15 nt, Pseudomonas aeruginosa PA01
ccagcgccgcgcugc

SEQ ID NO: 3522465 - RNA, 12 nt, Pseudomonas aeruginosa PA01
ccagcgccgcgg

SEQ ID NO: 3522466 - RNA, 16 nt, Pseudomonas aeruginosa PA01
ccagcgccgcggcgac

SEQ ID NO: 3522467 - RNA, 12 nt, Pseudomonas aeruginosa PA01
ccagcgccggcg

SEQ ID NO: 3522468 - RNA, 23 nt, Pseudomonas aeruginosa PA01
ccagcgccggcggcgcguccacc

SEQ ID NO: 3522469 - RNA, 14 nt, Pseudomonas aeruginosa PA01
ccagcgccucgacc

SEQ ID NO: 3522470 - RNA, 22 nt, Pseudomonas aeruginosa PA01
ccagcgccucgaccagaucggc

SEQ ID NO: 3522471 - RNA, 23 nt, Pseudomonas aeruginosa PA01
ccagcgccucgaccagaucggca

SEQ ID NO: 3522472 - RNA, 17 nt, Pseudomonas aeruginosa PA01
ccagcgccucgggccgg

SEQ ID NO: 3522473 - RNA, 20 nt, Pseudomonas aeruginosa PA01
ccagcgccuggaugaucgcg

SEQ ID NO: 3522474 - RNA, 14 nt, Pseudomonas aeruginosa PA01
ccagcgccuggcgc

SEQ ID NO: 3522475 - RNA, 16 nt, Pseudomonas aeruginosa PA01
ccagcgccugggccgc

SEQ ID NO: 3522476 - RNA, 17 nt, Pseudomonas aeruginosa PA01
ccagcgcgagcguucca

SEQ ID NO: 3522477 - RNA, 22 nt, Pseudomonas aeruginosa PA01
ccagcgcgauacccuggccggc

SEQ ID NO: 3522478 - RNA, 12 nt, Pseudomonas aeruginosa PA01
ccagcgcgcagc

SEQ ID NO: 3522479 - RNA, 16 nt, Pseudomonas aeruginosa PA01
ccagcgcgcccggcgc

SEQ ID NO: 3522480 - RNA, 23 nt, Pseudomonas aeruginosa PA01
ccagcgcgcccggcgccaccccg

SEQ ID NO: 3522481 - RNA, 14 nt, Pseudomonas aeruginosa PA01
ccagcgcgccgccg

SEQ ID NO: 3522482 - RNA, 15 nt, Pseudomonas aeruginosa PA01
ccagcgcgccgccga

SEQ ID NO: 3522483 - RNA, 14 nt, Pseudomonas aeruginosa PA01
ccagcgcgccgcgc

SEQ ID NO: 3522484 - RNA, 14 nt, Pseudomonas aeruginosa PA01
ccagcgcgcgccga

SEQ ID NO: 3522485 - RNA, 23 nt, Pseudomonas aeruginosa PA01
ccagcgcgcgccgacaggcaucg

SEQ ID NO: 3522486 - RNA, 14 nt, Pseudomonas aeruginosa PA01
ccagcgcgcgcugg

SEQ ID NO: 3522487 - RNA, 18 nt, Pseudomonas aeruginosa PA01
ccagcgcgcgcuggcgca

SEQ ID NO: 3522488 - RNA, 20 nt, Pseudomonas aeruginosa PA01
ccagcgcgcgcuggcgcagc

SEQ ID NO: 3522489 - RNA, 16 nt, Pseudomonas aeruginosa PA01
ccagcgcgcucuucgc

SEQ ID NO: 3522490 - RNA, 22 nt, Pseudomonas aeruginosa PA01
ccagcgcgcucuucgccgcggc

SEQ ID NO: 3522491 - RNA, 14 nt, Pseudomonas aeruginosa PA01
ccagcgcggccgcc

SEQ ID NO: 3522492 - RNA, 16 nt, Pseudomonas aeruginosa PA01
ccagcgcggccgccgc

SEQ ID NO: 3522493 - RNA, 18 nt, Pseudomonas aeruginosa PA01
ccagcgcggccgccgccg

SEQ ID NO: 3522494 - RNA, 14 nt, Pseudomonas aeruginosa PA01
ccagcgcggcgccc

SEQ ID NO: 3522495 - RNA, 19 nt, Pseudomonas aeruginosa PA01
ccagcgcggcgccccaggc

SEQ ID NO: 3522496 - RNA, 14 nt, Pseudomonas aeruginosa PA01
ccagcgcggcgcgc

SEQ ID NO: 3522497 - RNA, 13 nt, Pseudomonas aeruginosa PA01
ccagcgcggcgcu

SEQ ID NO: 3522498 - RNA, 17 nt, Pseudomonas aeruginosa PA01
ccagcgcggcggacagg

SEQ ID NO: 3522499 - RNA, 14 nt, Pseudomonas aeruginosa PA01
ccagcgcggcucgg

SEQ ID NO: 3522500 - RNA, 19 nt, Pseudomonas aeruginosa PA01
ccagcgcggcucgggcggc

SEQ ID NO: 3522501 - RNA, 21 nt, Pseudomonas aeruginosa PA01
ccagcgcggcucgggcggcaa

SEQ ID NO: 3522502 - RNA, 22 nt, Pseudomonas aeruginosa PA01
ccagcgcggcucgggcggcaag

SEQ ID NO: 3522503 - RNA, 23 nt, Pseudomonas aeruginosa PA01
ccagcgcggcucgggcggcaagg

SEQ ID NO: 3522504 - RNA, 12 nt, Pseudomonas aeruginosa PA01
ccagcgcgggca

SEQ ID NO: 3522505 - RNA, 23 nt, Pseudomonas aeruginosa PA01
ccagcgcggucucuucgucgguc

SEQ ID NO: 3522506 - RNA, 18 nt, Pseudomonas aeruginosa PA01
ccagcgcgguguuguagu

SEQ ID NO: 3522507 - RNA, 19 nt, Pseudomonas aeruginosa PA01
ccagcgcgucgaccaccgc

SEQ ID NO: 3522508 - RNA, 24 nt, Pseudomonas aeruginosa PA01
ccagcgcgucgaccaccgcguggu

SEQ ID NO: 3522509 - RNA, 15 nt, Pseudomonas aeruginosa PA01
ccagcgcgucggcac

SEQ ID NO: 3522510 - RNA, 21 nt, Pseudomonas aeruginosa PA01
ccagcgcgucggcacgccgaa

SEQ ID NO: 3522511 - RNA, 12 nt, Pseudomonas aeruginosa PA01
ccagcgcgugca

SEQ ID NO: 3522512 - RNA, 19 nt, Pseudomonas aeruginosa PA01
ccagcgcgugcaggcgccc

SEQ ID NO: 3522513 - RNA, 12 nt, Pseudomonas aeruginosa PA01
ccagcgcuccuu

SEQ ID NO: 3522514 - RNA, 15 nt, Pseudomonas aeruginosa PA01
ccagcgcuccuugcg

SEQ ID NO: 3522515 - RNA, 18 nt, Pseudomonas aeruginosa PA01
ccagcgcuccuugcgcca

SEQ ID NO: 3522516 - RNA, 22 nt, Pseudomonas aeruginosa PA01
ccagcgcuccuugcgccaggcc

SEQ ID NO: 3522517 - RNA, 18 nt, Pseudomonas aeruginosa PA01
ccagcgcucgaacgccgc

SEQ ID NO: 3522518 - RNA, 21 nt, Pseudomonas aeruginosa PA01
ccagcgcucgaacgccgcccg

SEQ ID NO: 3522519 - RNA, 21 nt, Pseudomonas aeruginosa PA01
ccagcgcucguagccggcgcg

SEQ ID NO: 3522520 - RNA, 16 nt, Pseudomonas aeruginosa PA01
ccagcgcugccucggu

SEQ ID NO: 3522521 - RNA, 23 nt, Pseudomonas aeruginosa PA01
ccagcgcuuccaccgccugcccc

SEQ ID NO: 3522522 - RNA, 20 nt, Pseudomonas aeruginosa PA01
ccagcgcuuccucgggcagc

SEQ ID NO: 3522523 - RNA, 14 nt, Pseudomonas aeruginosa PA01
ccagcgcuucgcga

SEQ ID NO: 3522524 - RNA, 15 nt, Pseudomonas aeruginosa PA01
ccagcgcuucggcgg

SEQ ID NO: 3522525 - RNA, 20 nt, Pseudomonas aeruginosa PA01
ccagcggaacgaaggacagg

SEQ ID NO: 3522526 - RNA, 14 nt, Pseudomonas aeruginosa PA01
ccagcggaccgucg

SEQ ID NO: 3522527 - RNA, 17 nt, Pseudomonas aeruginosa PA01
ccagcggaccgucgggc

SEQ ID NO: 3522528 - RNA, 14 nt, Pseudomonas aeruginosa PA01
ccagcggacgcuug

SEQ ID NO: 3522529 - RNA, 14 nt, Pseudomonas aeruginosa PA01
ccagcggagcgucg

SEQ ID NO: 3522530 - RNA, 17 nt, Pseudomonas aeruginosa PA01
ccagcggagcgucgggc

SEQ ID NO: 3522531 - RNA, 16 nt, Pseudomonas aeruginosa PA01
ccagcggcacuucccg

SEQ ID NO: 3522532 - RNA, 12 nt, Pseudomonas aeruginosa PA01
ccagcggcagcc

SEQ ID NO: 3522533 - RNA, 21 nt, Pseudomonas aeruginosa PA01
ccagcggcagcgguucgcccg

SEQ ID NO: 3522534 - RNA, 18 nt, Pseudomonas aeruginosa PA01
ccagcggcagcucggcga

SEQ ID NO: 3522535 - RNA, 21 nt, Pseudomonas aeruginosa PA01
ccagcggcaggcacgcugcca

SEQ ID NO: 3522536 - RNA, 19 nt, Pseudomonas aeruginosa PA01
ccagcggcagggcggcgau

SEQ ID NO: 3522537 - RNA, 21 nt, Pseudomonas aeruginosa PA01
ccagcggcagggcggcgauga

SEQ ID NO: 3522538 - RNA, 21 nt, Pseudomonas aeruginosa PA01
ccagcggcauccgccgcuggg

SEQ ID NO: 3522539 - RNA, 19 nt, Pseudomonas aeruginosa PA01
ccagcggcauucgaacggc

SEQ ID NO: 3522540 - RNA, 19 nt, Pseudomonas aeruginosa PA01
ccagcggccagggcgaggc

SEQ ID NO: 3522541 - RNA, 16 nt, Pseudomonas aeruginosa PA01
ccagcggcccggcagg

SEQ ID NO: 3522542 - RNA, 13 nt, Pseudomonas aeruginosa PA01
ccagcggccgcga

SEQ ID NO: 3522543 - RNA, 14 nt, Pseudomonas aeruginosa PA01
ccagcggccgcgag

SEQ ID NO: 3522544 - RNA, 15 nt, Pseudomonas aeruginosa PA01
ccagcggccgcgagc

SEQ ID NO: 3522545 - RNA, 17 nt, Pseudomonas aeruginosa PA01
ccagcggccgcgagcgc

SEQ ID NO: 3522546 - RNA, 13 nt, Pseudomonas aeruginosa PA01
ccagcggccgcgc

SEQ ID NO: 3522547 - RNA, 14 nt, Pseudomonas aeruginosa PA01
ccagcggccgcgcc

SEQ ID NO: 3522548 - RNA, 23 nt, Pseudomonas aeruginosa PA01
ccagcggccgcgccuugcucagg

SEQ ID NO: 3522549 - RNA, 13 nt, Pseudomonas aeruginosa PA01
ccagcggcgagca

SEQ ID NO: 3522550 - RNA, 13 nt, Pseudomonas aeruginosa PA01
ccagcggcgccag

SEQ ID NO: 3522551 - RNA, 14 nt, Pseudomonas aeruginosa PA01
ccagcggcgccagc

SEQ ID NO: 3522552 - RNA, 16 nt, Pseudomonas aeruginosa PA01
ccagcggcgccagcuc

SEQ ID NO: 3522553 - RNA, 22 nt, Pseudomonas aeruginosa PA01
ccagcggcgccagcuccagcgc

SEQ ID NO: 3522554 - RNA, 14 nt, Pseudomonas aeruginosa PA01
ccagcggcgccucg

SEQ ID NO: 3522555 - RNA, 22 nt, Pseudomonas aeruginosa PA01
ccagcggcgccucgaagcggau

SEQ ID NO: 3522556 - RNA, 14 nt, Pseudomonas aeruginosa PA01
ccagcggcgcggcg

SEQ ID NO: 3522557 - RNA, 24 nt, Pseudomonas aeruginosa PA01
ccagcggcgcggcguaccagccgc

SEQ ID NO: 3522558 - RNA, 20 nt, Pseudomonas aeruginosa PA01
ccagcggcgcuugcgggcgc

SEQ ID NO: 3522559 - RNA, 21 nt, Pseudomonas aeruginosa PA01
ccagcggcgggaaacgcagcg

SEQ ID NO: 3522560 - RNA, 14 nt, Pseudomonas aeruginosa PA01
ccagcggcugcggg

SEQ ID NO: 3522561 - RNA, 21 nt, Pseudomonas aeruginosa PA01
ccagcggcuggcgggcgaccg

SEQ ID NO: 3522562 - RNA, 19 nt, Pseudomonas aeruginosa PA01
ccagcggcuuguccuggcg

SEQ ID NO: 3522563 - RNA, 21 nt, Pseudomonas aeruginosa PA01
ccagcggcuuguccuggcgca

SEQ ID NO: 3522564 - RNA, 16 nt, Pseudomonas aeruginosa PA01
ccagcgggcgccgccg

SEQ ID NO: 3522565 - RNA, 20 nt, Pseudomonas aeruginosa PA01
ccagcgggcugucguccugg

SEQ ID NO: 3522566 - RNA, 15 nt, Pseudomonas aeruginosa PA01
ccagcgggguggcgc

SEQ ID NO: 3522567 - RNA, 18 nt, Pseudomonas aeruginosa PA01
ccagcggguagaugccac

SEQ ID NO: 3522568 - RNA, 18 nt, Pseudomonas aeruginosa PA01
ccagcggguaggaauuga

SEQ ID NO: 3522569 - RNA, 20 nt, Pseudomonas aeruginosa PA01
ccagcggguaguagaucagc

SEQ ID NO: 3522570 - RNA, 21 nt, Pseudomonas aeruginosa PA01
ccagcggguaguagaucagcu

SEQ ID NO: 3522571 - RNA, 20 nt, Pseudomonas aeruginosa PA01
ccagcgggucgucgaagcgc

SEQ ID NO: 3522572 - RNA, 16 nt, Pseudomonas aeruginosa PA01
ccagcgguaccagcag

SEQ ID NO: 3522573 - RNA, 18 nt, Pseudomonas aeruginosa PA01
ccagcgguaccagcagcg

SEQ ID NO: 3522574 - RNA, 17 nt, Pseudomonas aeruginosa PA01
ccagcgguacccgccgg

SEQ ID NO: 3522575 - RNA, 18 nt, Pseudomonas aeruginosa PA01
ccagcgguacccgccggc

SEQ ID NO: 3522576 - RNA, 16 nt, Pseudomonas aeruginosa PA01
ccagcgguacguagcg

SEQ ID NO: 3522577 - RNA, 17 nt, Pseudomonas aeruginosa PA01
ccagcgguacguagcgc

SEQ ID NO: 3522578 - RNA, 23 nt, Pseudomonas aeruginosa PA01
ccagcgguacguagcgcgguucg

SEQ ID NO: 3522579 - RNA, 14 nt, Pseudomonas aeruginosa PA01
ccagcgucgccagg

SEQ ID NO: 3522580 - RNA, 16 nt, Pseudomonas aeruginosa PA01
ccagcgucgccaggcc

SEQ ID NO: 3522581 - RNA, 17 nt, Pseudomonas aeruginosa PA01
ccagcgucgccaggccg

SEQ ID NO: 3522582 - RNA, 15 nt, Pseudomonas aeruginosa PA01
ccagcgucgccgccg

SEQ ID NO: 3522583 - RNA, 18 nt, Pseudomonas aeruginosa PA01
ccagcgucgccgccgcgg

SEQ ID NO: 3522584 - RNA, 20 nt, Pseudomonas aeruginosa PA01
ccagcgucgcgcgugccccg

SEQ ID NO: 3522585 - RNA, 23 nt, Pseudomonas aeruginosa PA01
ccagcgucugccgcuggcggccu

SEQ ID NO: 3522586 - RNA, 21 nt, Pseudomonas aeruginosa PA01
ccagcgugaagaccuggucca

SEQ ID NO: 3522587 - RNA, 14 nt, Pseudomonas aeruginosa PA01
ccagcgugcccgcu

SEQ ID NO: 3522588 - RNA, 16 nt, Pseudomonas aeruginosa PA01
ccagcgugcccgcugc

SEQ ID NO: 3522589 - RNA, 17 nt, Pseudomonas aeruginosa PA01
ccagcgugcccgcugca

SEQ ID NO: 3522590 - RNA, 14 nt, Pseudomonas aeruginosa PA01
ccagcguggccagc

SEQ ID NO: 3522591 - RNA, 15 nt, Pseudomonas aeruginosa PA01
ccagcguggccagcg

SEQ ID NO: 3522592 - RNA, 16 nt, Pseudomonas aeruginosa PA01
ccagcguggccagcga

SEQ ID NO: 3522593 - RNA, 13 nt, Pseudomonas aeruginosa PA01
ccagcguggcgcg

SEQ ID NO: 3522594 - RNA, 17 nt, Pseudomonas aeruginosa PA01
ccagcguggcgcgcauc

SEQ ID NO: 3522595 - RNA, 16 nt, Pseudomonas aeruginosa PA01
ccagcgugggcaacag

SEQ ID NO: 3522596 - RNA, 17 nt, Pseudomonas aeruginosa PA01
ccagcgugggcaacagg

SEQ ID NO: 3522597 - RNA, 18 nt, Pseudomonas aeruginosa PA01
ccagcgugggcaacaggc

SEQ ID NO: 3522598 - RNA, 20 nt, Pseudomonas aeruginosa PA01
ccagcgugggcaacaggccg

SEQ ID NO: 3522599 - RNA, 18 nt, Pseudomonas aeruginosa PA01
ccagcgugguaccgcugc

SEQ ID NO: 3522600 - RNA, 17 nt, Pseudomonas aeruginosa PA01
ccagcguucggcgcugg

SEQ ID NO: 3522601 - RNA, 20 nt, Pseudomonas aeruginosa PA01
ccagcguucggcgcuggcgc

SEQ ID NO: 3522602 - RNA, 16 nt, Pseudomonas aeruginosa PA01
ccagcguuguccucgg

SEQ ID NO: 3522603 - RNA, 19 nt, Pseudomonas aeruginosa PA01
ccagcguuguccucggcgg

SEQ ID NO: 3522604 - RNA, 19 nt, Pseudomonas aeruginosa PA01
ccagcguuucgaagccgcc

SEQ ID NO: 3522605 - RNA, 13 nt, Pseudomonas aeruginosa PA01
ccagcucagcagg

SEQ ID NO: 3522606 - RNA, 19 nt, Pseudomonas aeruginosa PA01
ccagcucagcuccaggccg

SEQ ID NO: 3522607 - RNA, 19 nt, Pseudomonas aeruginosa PA01
ccagcucauggagcaacag

SEQ ID NO: 3522608 - RNA, 21 nt, Pseudomonas aeruginosa PA01
ccagcucauggagcaacagcg

SEQ ID NO: 3522609 - RNA, 14 nt, Pseudomonas aeruginosa PA01
ccagcuccaccagg

SEQ ID NO: 3522610 - RNA, 15 nt, Pseudomonas aeruginosa PA01
ccagcuccagcaccg

SEQ ID NO: 3522611 - RNA, 14 nt, Pseudomonas aeruginosa PA01
ccagcuccagcgcc

SEQ ID NO: 3522612 - RNA, 15 nt, Pseudomonas aeruginosa PA01
ccagcuccagcgccc

SEQ ID NO: 3522613 - RNA, 16 nt, Pseudomonas aeruginosa PA01
ccagcuccagcgccca

SEQ ID NO: 3522614 - RNA, 22 nt, Pseudomonas aeruginosa PA01
ccagcucccccacguacuccag

SEQ ID NO: 3522615 - RNA, 15 nt, Pseudomonas aeruginosa PA01
ccagcuccccguccc

SEQ ID NO: 3522616 - RNA, 13 nt, Pseudomonas aeruginosa PA01
ccagcucccggcu

SEQ ID NO: 3522617 - RNA, 14 nt, Pseudomonas aeruginosa PA01
ccagcucccggcuc

SEQ ID NO: 3522618 - RNA, 15 nt, Pseudomonas aeruginosa PA01
ccagcuccgaaggga

SEQ ID NO: 3522619 - RNA, 21 nt, Pseudomonas aeruginosa PA01
ccagcuccgaagggaacccgc

SEQ ID NO: 3522620 - RNA, 23 nt, Pseudomonas aeruginosa PA01
ccagcuccgucuguucggccagg

SEQ ID NO: 3522621 - RNA, 13 nt, Pseudomonas aeruginosa PA01
ccagcuccuccag

SEQ ID NO: 3522622 - RNA, 18 nt, Pseudomonas aeruginosa PA01
ccagcucgaacagcaccg

SEQ ID NO: 3522623 - RNA, 16 nt, Pseudomonas aeruginosa PA01
ccagcucgaagccgcc

SEQ ID NO: 3522624 - RNA, 17 nt, Pseudomonas aeruginosa PA01
ccagcucgaagccgccg

SEQ ID NO: 3522625 - RNA, 19 nt, Pseudomonas aeruginosa PA01
ccagcucgacccgcccgcc

SEQ ID NO: 3522626 - RNA, 19 nt, Pseudomonas aeruginosa PA01
ccagcucgaccuugcccuu

SEQ ID NO: 3522627 - RNA, 15 nt, Pseudomonas aeruginosa PA01
ccagcucgcccgccu

SEQ ID NO: 3522628 - RNA, 11 nt, Pseudomonas aeruginosa PA01
ccagcucgccg

SEQ ID NO: 3522629 - RNA, 16 nt, Pseudomonas aeruginosa PA01
ccagcucgccgaacag

SEQ ID NO: 3522630 - RNA, 13 nt, Pseudomonas aeruginosa PA01
ccagcucgccgcg

SEQ ID NO: 3522631 - RNA, 18 nt, Pseudomonas aeruginosa PA01
ccagcucgccgcgcucca

SEQ ID NO: 3522632 - RNA, 23 nt, Pseudomonas aeruginosa PA01
ccagcucggccaucagcgccagg

SEQ ID NO: 3522633 - RNA, 13 nt, Pseudomonas aeruginosa PA01
ccagcucggccgg

SEQ ID NO: 3522634 - RNA, 19 nt, Pseudomonas aeruginosa PA01
ccagcucggccggcaggcu

SEQ ID NO: 3522635 - RNA, 14 nt, Pseudomonas aeruginosa PA01
ccagcucggccugu

SEQ ID NO: 3522636 - RNA, 14 nt, Pseudomonas aeruginosa PA01
ccagcucggcgagu

SEQ ID NO: 3522637 - RNA, 15 nt, Pseudomonas aeruginosa PA01
ccagcucggcgaucc

SEQ ID NO: 3522638 - RNA, 16 nt, Pseudomonas aeruginosa PA01
ccagcucggcgauccg

SEQ ID NO: 3522639 - RNA, 22 nt, Pseudomonas aeruginosa PA01
ccagcucggcgauccgcgcuuc

SEQ ID NO: 3522640 - RNA, 18 nt, Pseudomonas aeruginosa PA01
ccagcucggucagcggcg

SEQ ID NO: 3522641 - RNA, 20 nt, Pseudomonas aeruginosa PA01
ccagcucggucagcggcgca

SEQ ID NO: 3522642 - RNA, 18 nt, Pseudomonas aeruginosa PA01
ccagcucggugccgucau

SEQ ID NO: 3522643 - RNA, 18 nt, Pseudomonas aeruginosa PA01
ccagcucguccaggcaag

SEQ ID NO: 3522644 - RNA, 19 nt, Pseudomonas aeruginosa PA01
ccagcucguccaggcaagc

SEQ ID NO: 3522645 - RNA, 14 nt, Pseudomonas aeruginosa PA01
ccagcucgucgccc

SEQ ID NO: 3522646 - RNA, 16 nt, Pseudomonas aeruginosa PA01
ccagcucucgcuggug

SEQ ID NO: 3522647 - RNA, 18 nt, Pseudomonas aeruginosa PA01
ccagcucuugcccugcca

SEQ ID NO: 3522648 - RNA, 20 nt, Pseudomonas aeruginosa PA01
ccagcucuugcccugccagc

SEQ ID NO: 3522649 - RNA, 22 nt, Pseudomonas aeruginosa PA01
ccagcucuugcccugccagcgg

SEQ ID NO: 3522650 - RNA, 16 nt, Pseudomonas aeruginosa PA01
ccagcugccagugcuc

SEQ ID NO: 3522651 - RNA, 13 nt, Pseudomonas aeruginosa PA01
ccagcugcgccug

SEQ ID NO: 3522652 - RNA, 15 nt, Pseudomonas aeruginosa PA01
ccagcugcgccugca

SEQ ID NO: 3522653 - RNA, 21 nt, Pseudomonas aeruginosa PA01
ccagcugcgccugcagcucgg

SEQ ID NO: 3522654 - RNA, 21 nt, Pseudomonas aeruginosa PA01
ccagcuggcgacggcucugga

SEQ ID NO: 3522655 - RNA, 15 nt, Pseudomonas aeruginosa PA01
ccagcuggcgcagcc

SEQ ID NO: 3522656 - RNA, 12 nt, Pseudomonas aeruginosa PA01
ccagcuggcgcg

SEQ ID NO: 3522657 - RNA, 13 nt, Pseudomonas aeruginosa PA01
ccagcuguacgcg

SEQ ID NO: 3522658 - RNA, 15 nt, Pseudomonas aeruginosa PA01
ccagcuucagccgac

SEQ ID NO: 3522659 - RNA, 17 nt, Pseudomonas aeruginosa PA01
ccagcuucagccgaccg

SEQ ID NO: 3522660 - RNA, 18 nt, Pseudomonas aeruginosa PA01
ccagcuucagccgaccgu

SEQ ID NO: 3522661 - RNA, 16 nt, Pseudomonas aeruginosa PA01
ccagcuuccaggcgcg

SEQ ID NO: 3522662 - RNA, 23 nt, Pseudomonas aeruginosa PA01
ccagcuucuucugcagcucggcc

SEQ ID NO: 3522663 - RNA, 15 nt, Pseudomonas aeruginosa PA01
ccagcuucuugccuu

SEQ ID NO: 3522664 - RNA, 19 nt, Pseudomonas aeruginosa PA01
ccagcuucuuggcccggug

SEQ ID NO: 3522665 - RNA, 21 nt, Pseudomonas aeruginosa PA01
ccagcuugagguaggccagcc

SEQ ID NO: 3522666 - RNA, 13 nt, Pseudomonas aeruginosa PA01
ccagcuugcgcuc

SEQ ID NO: 3522667 - RNA, 17 nt, Pseudomonas aeruginosa PA01
ccagcuuggcacggccg

SEQ ID NO: 3522668 - RNA, 23 nt, Pseudomonas aeruginosa PA01
ccagcuuggcacggccggcggug

SEQ ID NO: 3522669 - RNA, 17 nt, Pseudomonas aeruginosa PA01
ccagcuugggcacgcgg

SEQ ID NO: 3522670 - RNA, 23 nt, Pseudomonas aeruginosa PA01
ccagcuugggcacgcggaucugg

SEQ ID NO: 3522671 - RNA, 21 nt, Pseudomonas aeruginosa PA01
ccagcuuggucgggauggcga

SEQ ID NO: 3522672 - RNA, 21 nt, Pseudomonas aeruginosa PA01
ccagcuuguaguagcgcccga

SEQ ID NO: 3522673 - RNA, 17 nt, Pseudomonas aeruginosa PA01
ccagcuugucgccuucc

SEQ ID NO: 3522674 - RNA, 18 nt, Pseudomonas aeruginosa PA01
ccagcuugucgccuuccu

SEQ ID NO: 3522675 - RNA, 21 nt, Pseudomonas aeruginosa PA01
ccagcuugucgccuuccucgg

SEQ ID NO: 3522676 - RNA, 14 nt, Pseudomonas aeruginosa PA01
ccagcuugucggcc

SEQ ID NO: 3522677 - RNA, 17 nt, Pseudomonas aeruginosa PA01
ccagcuugucggccuug

SEQ ID NO: 3522678 - RNA, 15 nt, Pseudomonas aeruginosa PA01
ccagcuugucgucgg

SEQ ID NO: 3522679 - RNA, 16 nt, Pseudomonas aeruginosa PA01
ccagcuugucgucggc

SEQ ID NO: 3522680 - RNA, 15 nt, Pseudomonas aeruginosa PA01
ccagcuuguggccgg

SEQ ID NO: 3522681 - RNA, 14 nt, Pseudomonas aeruginosa PA01
ccaggaaccggcca

SEQ ID NO: 3522682 - RNA, 17 nt, Pseudomonas aeruginosa PA01
ccaggaacgccucugcg

SEQ ID NO: 3522683 - RNA, 13 nt, Pseudomonas aeruginosa PA01
ccaggaagagccc

SEQ ID NO: 3522684 - RNA, 20 nt, Pseudomonas aeruginosa PA01
ccaggaagagcccgccacgc

SEQ ID NO: 3522685 - RNA, 21 nt, Pseudomonas aeruginosa PA01
ccaggaagagcccgccacgcu

SEQ ID NO: 3522686 - RNA, 23 nt, Pseudomonas aeruginosa PA01
ccaggaagccccagaagaucgcc

SEQ ID NO: 3522687 - RNA, 15 nt, Pseudomonas aeruginosa PA01
ccaggaagccgcgcc

SEQ ID NO: 3522688 - RNA, 18 nt, Pseudomonas aeruginosa PA01
ccaggaagccgcgcccca

SEQ ID NO: 3522689 - RNA, 20 nt, Pseudomonas aeruginosa PA01
ccaggaagccgcgccccagc

SEQ ID NO: 3522690 - RNA, 21 nt, Pseudomonas aeruginosa PA01
ccaggaagccgcgccccagcg

SEQ ID NO: 3522691 - RNA, 22 nt, Pseudomonas aeruginosa PA01
ccaggaagccgcgccccagcgg

SEQ ID NO: 3522692 - RNA, 23 nt, Pseudomonas aeruginosa PA01
ccaggaagccgcgccccagcggc

SEQ ID NO: 3522693 - RNA, 14 nt, Pseudomonas aeruginosa PA01
ccaggaagcgucgu

SEQ ID NO: 3522694 - RNA, 21 nt, Pseudomonas aeruginosa PA01
ccaggaagcgucgugcgccgg

SEQ ID NO: 3522695 - RNA, 22 nt, Pseudomonas aeruginosa PA01
ccaggaagcgucgugcgccggc

SEQ ID NO: 3522696 - RNA, 19 nt, Pseudomonas aeruginosa PA01
ccaggaagcucggcagcac

SEQ ID NO: 3522697 - RNA, 20 nt, Pseudomonas aeruginosa PA01
ccaggaagcucggcagcacg

SEQ ID NO: 3522698 - RNA, 21 nt, Pseudomonas aeruginosa PA01
ccaggaaggaaugcugccacc

SEQ ID NO: 3522699 - RNA, 14 nt, Pseudomonas aeruginosa PA01
ccaggaaggccgcu

SEQ ID NO: 3522700 - RNA, 22 nt, Pseudomonas aeruginosa PA01
ccaggaaggccgcuucgccgcc

SEQ ID NO: 3522701 - RNA, 14 nt, Pseudomonas aeruginosa PA01
ccaggaaggccggg

SEQ ID NO: 3522702 - RNA, 19 nt, Pseudomonas aeruginosa PA01
ccaggaaggcguagaccuc

SEQ ID NO: 3522703 - RNA, 14 nt, Pseudomonas aeruginosa PA01
ccaggaaggcgucg

SEQ ID NO: 3522704 - RNA, 20 nt, Pseudomonas aeruginosa PA01
ccaggaaggcgucgccgucg

SEQ ID NO: 3522705 - RNA, 16 nt, Pseudomonas aeruginosa PA01
ccaggaauuccuggcc

SEQ ID NO: 3522706 - RNA, 17 nt, Pseudomonas aeruginosa PA01
ccaggacaacgacagcc

SEQ ID NO: 3522707 - RNA, 18 nt, Pseudomonas aeruginosa PA01
ccaggacaacgacagccc

SEQ ID NO: 3522708 - RNA, 20 nt, Pseudomonas aeruginosa PA01
ccaggacaauggacaagcgu

SEQ ID NO: 3522709 - RNA, 11 nt, Pseudomonas aeruginosa PA01
ccaggacaccc

SEQ ID NO: 3522710 - RNA, 13 nt, Pseudomonas aeruginosa PA01
ccaggacagcacg

SEQ ID NO: 3522711 - RNA, 15 nt, Pseudomonas aeruginosa PA01
ccaggacagcacgcu

SEQ ID NO: 3522712 - RNA, 17 nt, Pseudomonas aeruginosa PA01
ccaggacagcacgcuca

SEQ ID NO: 3522713 - RNA, 14 nt, Pseudomonas aeruginosa PA01
ccaggaccagcccg

SEQ ID NO: 3522714 - RNA, 13 nt, Pseudomonas aeruginosa PA01
ccaggaccagcgc

SEQ ID NO: 3522715 - RNA, 16 nt, Pseudomonas aeruginosa PA01
ccaggaccagcgccug

SEQ ID NO: 3522716 - RNA, 17 nt, Pseudomonas aeruginosa PA01
ccaggaccaggaucgac

SEQ ID NO: 3522717 - RNA, 13 nt, Pseudomonas aeruginosa PA01
ccaggaccagggc

SEQ ID NO: 3522718 - RNA, 15 nt, Pseudomonas aeruginosa PA01
ccaggaccaguucgc

SEQ ID NO: 3522719 - RNA, 18 nt, Pseudomonas aeruginosa PA01
ccaggaccaucggcacca

SEQ ID NO: 3522720 - RNA, 18 nt, Pseudomonas aeruginosa PA01
ccaggaccauuugcgccu

SEQ ID NO: 3522721 - RNA, 20 nt, Pseudomonas aeruginosa PA01
ccaggaccauuugcgccucg

SEQ ID NO: 3522722 - RNA, 14 nt, Pseudomonas aeruginosa PA01
ccaggaccgcgaug

SEQ ID NO: 3522723 - RNA, 22 nt, Pseudomonas aeruginosa PA01
ccaggaccucgaagcuggccag

SEQ ID NO: 3522724 - RNA, 16 nt, Pseudomonas aeruginosa PA01
ccaggaccuugucgcg

SEQ ID NO: 3522725 - RNA, 19 nt, Pseudomonas aeruginosa PA01
ccaggaccuugucgcgcac

SEQ ID NO: 3522726 - RNA, 18 nt, Pseudomonas aeruginosa PA01
ccaggacgccaccaggcc

SEQ ID NO: 3522727 - RNA, 19 nt, Pseudomonas aeruginosa PA01
ccaggacgccaccaggccg

SEQ ID NO: 3522728 - RNA, 21 nt, Pseudomonas aeruginosa PA01
ccaggacgccaccaggccgcu

SEQ ID NO: 3522729 - RNA, 15 nt, Pseudomonas aeruginosa PA01
ccaggacgcuggcga

SEQ ID NO: 3522730 - RNA, 19 nt, Pseudomonas aeruginosa PA01
ccaggacguuauccguccu

SEQ ID NO: 3522731 - RNA, 24 nt, Pseudomonas aeruginosa PA01
ccaggacguuauccguccuacgcg

SEQ ID NO: 3522732 - RNA, 15 nt, Pseudomonas aeruginosa PA01
ccaggacucgccauc

SEQ ID NO: 3522733 - RNA, 22 nt, Pseudomonas aeruginosa PA01
ccaggacucgccaucggccugg

SEQ ID NO: 3522734 - RNA, 23 nt, Pseudomonas aeruginosa PA01
ccaggacucgccaucggccuggg

SEQ ID NO: 3522735 - RNA, 21 nt, Pseudomonas aeruginosa PA01
ccaggagcacgccgugcaggg

SEQ ID NO: 3522736 - RNA, 22 nt, Pseudomonas aeruginosa PA01
ccaggagcacgccgugcagggu

SEQ ID NO: 3522737 - RNA, 16 nt, Pseudomonas aeruginosa PA01
ccaggagcagggcgcc

SEQ ID NO: 3522738 - RNA, 18 nt, Pseudomonas aeruginosa PA01
ccaggagcgccagcacca

SEQ ID NO: 3522739 - RNA, 19 nt, Pseudomonas aeruginosa PA01
ccaggaggauucgccagcc

SEQ ID NO: 3522740 - RNA, 14 nt, Pseudomonas aeruginosa PA01
ccaggagggcugcu

SEQ ID NO: 3522741 - RNA, 21 nt, Pseudomonas aeruginosa PA01
ccaggagggcugcuguccagc

SEQ ID NO: 3522742 - RNA, 19 nt, Pseudomonas aeruginosa PA01
ccaggaguggugaagcgcu

SEQ ID NO: 3522743 - RNA, 23 nt, Pseudomonas aeruginosa PA01
ccaggaucauccgcaccauccgc

SEQ ID NO: 3522744 - RNA, 18 nt, Pseudomonas aeruginosa PA01
ccaggaucgaacuggcca

SEQ ID NO: 3522745 - RNA, 20 nt, Pseudomonas aeruginosa PA01
ccaggaucgaacuggccagc

SEQ ID NO: 3522746 - RNA, 22 nt, Pseudomonas aeruginosa PA01
ccaggaucgaccccgccggggc

SEQ ID NO: 3522747 - RNA, 12 nt, Pseudomonas aeruginosa PA01
ccaggaucgccg

SEQ ID NO: 3522748 - RNA, 15 nt, Pseudomonas aeruginosa PA01
ccaggaucgccgggc

SEQ ID NO: 3522749 - RNA, 16 nt, Pseudomonas aeruginosa PA01
ccaggaucgccgggcu

SEQ ID NO: 3522750 - RNA, 13 nt, Pseudomonas aeruginosa PA01
ccaggaucgccuc

SEQ ID NO: 3522751 - RNA, 23 nt, Pseudomonas aeruginosa PA01
ccaggaucgccuccaccagcgcc

SEQ ID NO: 3522752 - RNA, 12 nt, Pseudomonas aeruginosa PA01
ccaggaucggca

SEQ ID NO: 3522753 - RNA, 18 nt, Pseudomonas aeruginosa PA01
ccaggaugaccaggcuga

SEQ ID NO: 3522754 - RNA, 23 nt, Pseudomonas aeruginosa PA01
ccaggaugaccaggcugaucagc

SEQ ID NO: 3522755 - RNA, 21 nt, Pseudomonas aeruginosa PA01
ccaggaugcaaccgcccuggu

SEQ ID NO: 3522756 - RNA, 19 nt, Pseudomonas aeruginosa PA01
ccaggaugcccugcucuuc

SEQ ID NO: 3522757 - RNA, 18 nt, Pseudomonas aeruginosa PA01
ccaggauguucgccgagg

SEQ ID NO: 3522758 - RNA, 15 nt, Pseudomonas aeruginosa PA01
ccaggcaagcgcaug

SEQ ID NO: 3522759 - RNA, 20 nt, Pseudomonas aeruginosa PA01
ccaggcaagcgcaugaggcu

SEQ ID NO: 3522760 - RNA, 22 nt, Pseudomonas aeruginosa PA01
ccaggcaagcgcaugaggcugg

SEQ ID NO: 3522761 - RNA, 17 nt, Pseudomonas aeruginosa PA01
ccaggcaauggccggcg

SEQ ID NO: 3522762 - RNA, 18 nt, Pseudomonas aeruginosa PA01
ccaggcaauggccggcgg

SEQ ID NO: 3522763 - RNA, 19 nt, Pseudomonas aeruginosa PA01
ccaggcaaugucguugaug

SEQ ID NO: 3522764 - RNA, 16 nt, Pseudomonas aeruginosa PA01
ccaggcacggcuucag

SEQ ID NO: 3522765 - RNA, 15 nt, Pseudomonas aeruginosa PA01
ccaggcagaccagcg

SEQ ID NO: 3522766 - RNA, 16 nt, Pseudomonas aeruginosa PA01
ccaggcagaccagcgc

SEQ ID NO: 3522767 - RNA, 17 nt, Pseudomonas aeruginosa PA01
ccaggcagaccagcgca

SEQ ID NO: 3522768 - RNA, 17 nt, Pseudomonas aeruginosa PA01
ccaggcagaccaggccg

SEQ ID NO: 3522769 - RNA, 17 nt, Pseudomonas aeruginosa PA01
ccaggcagaccugcagc

SEQ ID NO: 3522770 - RNA, 20 nt, Pseudomonas aeruginosa PA01
ccaggcagaccugcagcagg

SEQ ID NO: 3522771 - RNA, 21 nt, Pseudomonas aeruginosa PA01
ccaggcagaccugcagcagga

SEQ ID NO: 3522772 - RNA, 15 nt, Pseudomonas aeruginosa PA01
ccaggcagaucgcgc

SEQ ID NO: 3522773 - RNA, 20 nt, Pseudomonas aeruginosa PA01
ccaggcagaucgcgccgagc

SEQ ID NO: 3522774 - RNA, 18 nt, Pseudomonas aeruginosa PA01
ccaggcaggccgggcugg

SEQ ID NO: 3522775 - RNA, 20 nt, Pseudomonas aeruginosa PA01
ccaggcaggcgaugaccgcc

SEQ ID NO: 3522776 - RNA, 12 nt, Pseudomonas aeruginosa PA01
ccaggcaggcgg

SEQ ID NO: 3522777 - RNA, 17 nt, Pseudomonas aeruginosa PA01
ccaggcaggcggucagc

SEQ ID NO: 3522778 - RNA, 20 nt, Pseudomonas aeruginosa PA01
ccaggcaggcggucagcgcg

SEQ ID NO: 3522779 - RNA, 21 nt, Pseudomonas aeruginosa PA01
ccaggcaggcggucagcgcgu

SEQ ID NO: 3522780 - RNA, 18 nt, Pseudomonas aeruginosa PA01
ccaggcauccagcaccgc

SEQ ID NO: 3522781 - RNA, 19 nt, Pseudomonas aeruginosa PA01
ccaggcauccagcaccgcu

SEQ ID NO: 3522782 - RNA, 16 nt, Pseudomonas aeruginosa PA01
ccaggcauuccuccag

SEQ ID NO: 3522783 - RNA, 17 nt, Pseudomonas aeruginosa PA01
ccaggcauuccuccagg

SEQ ID NO: 3522784 - RNA, 12 nt, Pseudomonas aeruginosa PA01
ccaggccaacca

SEQ ID NO: 3522785 - RNA, 14 nt, Pseudomonas aeruginosa PA01
ccaggccaaccacc

SEQ ID NO: 3522786 - RNA, 14 nt, Pseudomonas aeruginosa PA01
ccaggccacgccca

SEQ ID NO: 3522787 - RNA, 18 nt, Pseudomonas aeruginosa PA01
ccaggccacggccggcga

SEQ ID NO: 3522788 - RNA, 19 nt, Pseudomonas aeruginosa PA01
ccaggccacggccggcgag

SEQ ID NO: 3522789 - RNA, 12 nt, Pseudomonas aeruginosa PA01
ccaggccaggug

SEQ ID NO: 3522790 - RNA, 13 nt, Pseudomonas aeruginosa PA01
ccaggccaggugg

SEQ ID NO: 3522791 - RNA, 13 nt, Pseudomonas aeruginosa PA01
ccaggcccacgcc

SEQ ID NO: 3522792 - RNA, 15 nt, Pseudomonas aeruginosa PA01
ccaggcccacgccga

SEQ ID NO: 3522793 - RNA, 14 nt, Pseudomonas aeruginosa PA01
ccaggcccagccgg

SEQ ID NO: 3522794 - RNA, 17 nt, Pseudomonas aeruginosa PA01
ccaggcccagccgguga

SEQ ID NO: 3522795 - RNA, 13 nt, Pseudomonas aeruginosa PA01
ccaggcccagcgc

SEQ ID NO: 3522796 - RNA, 14 nt, Pseudomonas aeruginosa PA01
ccaggcccagcgcg

SEQ ID NO: 3522797 - RNA, 18 nt, Pseudomonas aeruginosa PA01
ccaggcccauccuggcga

SEQ ID NO: 3522798 - RNA, 20 nt, Pseudomonas aeruginosa PA01
ccaggcccauccuggcgauc

SEQ ID NO: 3522799 - RNA, 17 nt, Pseudomonas aeruginosa PA01
ccaggccccaggccgcc

SEQ ID NO: 3522800 - RNA, 19 nt, Pseudomonas aeruginosa PA01
ccaggccccaggccgccgc

SEQ ID NO: 3522801 - RNA, 11 nt, Pseudomonas aeruginosa PA01
ccaggcccgcc

SEQ ID NO: 3522802 - RNA, 14 nt, Pseudomonas aeruginosa PA01
ccaggcccgccgcg

SEQ ID NO: 3522803 - RNA, 15 nt, Pseudomonas aeruginosa PA01
ccaggcccgccgcgg

SEQ ID NO: 3522804 - RNA, 20 nt, Pseudomonas aeruginosa PA01
ccaggcccgccgcggcgagc

SEQ ID NO: 3522805 - RNA, 15 nt, Pseudomonas aeruginosa PA01
ccaggcccgccgguc

SEQ ID NO: 3522806 - RNA, 12 nt, Pseudomonas aeruginosa PA01
ccaggcccggca

SEQ ID NO: 3522807 - RNA, 13 nt, Pseudomonas aeruginosa PA01
ccaggcccggcag

SEQ ID NO: 3522808 - RNA, 14 nt, Pseudomonas aeruginosa PA01
ccaggcccggcagg

SEQ ID NO: 3522809 - RNA, 12 nt, Pseudomonas aeruginosa PA01
ccaggcccggcg

SEQ ID NO: 3522810 - RNA, 16 nt, Pseudomonas aeruginosa PA01
ccaggcccucagcggc

SEQ ID NO: 3522811 - RNA, 17 nt, Pseudomonas aeruginosa PA01
ccaggcccucagcggcg

SEQ ID NO: 3522812 - RNA, 23 nt, Pseudomonas aeruginosa PA01
ccaggcccucagcggcggugcgc

SEQ ID NO: 3522813 - RNA, 16 nt, Pseudomonas aeruginosa PA01
ccaggcccucggcgac

SEQ ID NO: 3522814 - RNA, 17 nt, Pseudomonas aeruginosa PA01
ccaggcccugcuccucc

SEQ ID NO: 3522815 - RNA, 23 nt, Pseudomonas aeruginosa PA01
ccaggcccugggcggcgggcccg

SEQ ID NO: 3522816 - RNA, 18 nt, Pseudomonas aeruginosa PA01
ccaggccgaagccgccgg

SEQ ID NO: 3522817 - RNA, 20 nt, Pseudomonas aeruginosa PA01
ccaggccgaaggccuggccg

SEQ ID NO: 3522818 - RNA, 21 nt, Pseudomonas aeruginosa PA01
ccaggccgaaguagccggcgu

SEQ ID NO: 3522819 - RNA, 15 nt, Pseudomonas aeruginosa PA01
ccaggccgacagcgg

SEQ ID NO: 3522820 - RNA, 16 nt, Pseudomonas aeruginosa PA01
ccaggccgacagcggc

SEQ ID NO: 3522821 - RNA, 18 nt, Pseudomonas aeruginosa PA01
ccaggccgacagcggcug

SEQ ID NO: 3522822 - RNA, 19 nt, Pseudomonas aeruginosa PA01
ccaggccgacagcggcugg

SEQ ID NO: 3522823 - RNA, 19 nt, Pseudomonas aeruginosa PA01
ccaggccgacccgcaggcc

SEQ ID NO: 3522824 - RNA, 20 nt, Pseudomonas aeruginosa PA01
ccaggccgacccgcaggccg

SEQ ID NO: 3522825 - RNA, 11 nt, Pseudomonas aeruginosa PA01
ccaggccgagc

SEQ ID NO: 3522826 - RNA, 14 nt, Pseudomonas aeruginosa PA01
ccaggccgagcagg

SEQ ID NO: 3522827 - RNA, 15 nt, Pseudomonas aeruginosa PA01
ccaggccgagcagga

SEQ ID NO: 3522828 - RNA, 17 nt, Pseudomonas aeruginosa PA01
ccaggccgagcgcgccg

SEQ ID NO: 3522829 - RNA, 17 nt, Pseudomonas aeruginosa PA01
ccaggccgaucgccucg

SEQ ID NO: 3522830 - RNA, 20 nt, Pseudomonas aeruginosa PA01
ccaggccgaugaacgccgcg

SEQ ID NO: 3522831 - RNA, 21 nt, Pseudomonas aeruginosa PA01
ccaggccgauguucaggccgg

SEQ ID NO: 3522832 - RNA, 21 nt, Pseudomonas aeruginosa PA01
ccaggccgcaaguaccgccgg

SEQ ID NO: 3522833 - RNA, 19 nt, Pseudomonas aeruginosa PA01
ccaggccgcaggugaagcu

SEQ ID NO: 3522834 - RNA, 15 nt, Pseudomonas aeruginosa PA01
ccaggccgccaugcu

SEQ ID NO: 3522835 - RNA, 16 nt, Pseudomonas aeruginosa PA01
ccaggccgccaugcuc

SEQ ID NO: 3522836 - RNA, 21 nt, Pseudomonas aeruginosa PA01
ccaggccgccaugcucggcca

SEQ ID NO: 3522837 - RNA, 15 nt, Pseudomonas aeruginosa PA01
ccaggccgcccagga

SEQ ID NO: 3522838 - RNA, 16 nt, Pseudomonas aeruginosa PA01
ccaggccgccgaagaa

SEQ ID NO: 3522839 - RNA, 18 nt, Pseudomonas aeruginosa PA01
ccaggccgccgaagaacu

SEQ ID NO: 3522840 - RNA, 19 nt, Pseudomonas aeruginosa PA01
ccaggccgccgaagaacuc

SEQ ID NO: 3522841 - RNA, 17 nt, Pseudomonas aeruginosa PA01
ccaggccgccgauccag

SEQ ID NO: 3522842 - RNA, 13 nt, Pseudomonas aeruginosa PA01
ccaggccgccgcc

SEQ ID NO: 3522843 - RNA, 20 nt, Pseudomonas aeruginosa PA01
ccaggccgccgccugcucgc

SEQ ID NO: 3522844 - RNA, 16 nt, Pseudomonas aeruginosa PA01
ccaggccgccggcgac

SEQ ID NO: 3522845 - RNA, 14 nt, Pseudomonas aeruginosa PA01
ccaggccgcgcagc

SEQ ID NO: 3522846 - RNA, 16 nt, Pseudomonas aeruginosa PA01
ccaggccgcgcagcaa

SEQ ID NO: 3522847 - RNA, 18 nt, Pseudomonas aeruginosa PA01
ccaggccgcgcagcaacg

SEQ ID NO: 3522848 - RNA, 16 nt, Pseudomonas aeruginosa PA01
ccaggccgcgcagucc

SEQ ID NO: 3522849 - RNA, 22 nt, Pseudomonas aeruginosa PA01
ccaggccgcgucguaguugccu

SEQ ID NO: 3522850 - RNA, 19 nt, Pseudomonas aeruginosa PA01
ccaggccgcugccgccgcg

SEQ ID NO: 3522851 - RNA, 21 nt, Pseudomonas aeruginosa PA01
ccaggccgcugccgccgcgca

SEQ ID NO: 3522852 - RNA, 17 nt, Pseudomonas aeruginosa PA01
ccaggccgcuggcggcg

SEQ ID NO: 3522853 - RNA, 18 nt, Pseudomonas aeruginosa PA01
ccaggccgcuggcggcga

SEQ ID NO: 3522854 - RNA, 16 nt, Pseudomonas aeruginosa PA01
ccaggccggagccgcg

SEQ ID NO: 3522855 - RNA, 14 nt, Pseudomonas aeruginosa PA01
ccaggccggcgagg

SEQ ID NO: 3522856 - RNA, 13 nt, Pseudomonas aeruginosa PA01
ccaggccggcgcc

SEQ ID NO: 3522857 - RNA, 14 nt, Pseudomonas aeruginosa PA01
ccaggccggcggcc

SEQ ID NO: 3522858 - RNA, 20 nt, Pseudomonas aeruginosa PA01
ccaggccgggucgcagccgg

SEQ ID NO: 3522859 - RNA, 18 nt, Pseudomonas aeruginosa PA01
ccaggccggugcagaaga

SEQ ID NO: 3522860 - RNA, 17 nt, Pseudomonas aeruginosa PA01
ccaggccguagaccacc

SEQ ID NO: 3522861 - RNA, 20 nt, Pseudomonas aeruginosa PA01
ccaggccguagaccaccagc

SEQ ID NO: 3522862 - RNA, 22 nt, Pseudomonas aeruginosa PA01
ccaggccguagaccaccagcag

SEQ ID NO: 3522863 - RNA, 17 nt, Pseudomonas aeruginosa PA01
ccaggccguagcugcgc

SEQ ID NO: 3522864 - RNA, 15 nt, Pseudomonas aeruginosa PA01
ccaggccguaggcga

SEQ ID NO: 3522865 - RNA, 17 nt, Pseudomonas aeruginosa PA01
ccaggccgucgagggca

SEQ ID NO: 3522866 - RNA, 23 nt, Pseudomonas aeruginosa PA01
ccaggccguucucgaagagcugg

SEQ ID NO: 3522867 - RNA, 16 nt, Pseudomonas aeruginosa PA01
ccaggccucagaacug

SEQ ID NO: 3522868 - RNA, 13 nt, Pseudomonas aeruginosa PA01
ccaggccucccag

SEQ ID NO: 3522869 - RNA, 14 nt, Pseudomonas aeruginosa PA01
ccaggccucccagc

SEQ ID NO: 3522870 - RNA, 15 nt, Pseudomonas aeruginosa PA01
ccaggccucccagcc

SEQ ID NO: 3522871 - RNA, 16 nt, Pseudomonas aeruginosa PA01
ccaggccucccagccg

SEQ ID NO: 3522872 - RNA, 22 nt, Pseudomonas aeruginosa PA01
ccaggccucggcgcgggccuuc

SEQ ID NO: 3522873 - RNA, 14 nt, Pseudomonas aeruginosa PA01
ccaggccuuccaga

SEQ ID NO: 3522874 - RNA, 16 nt, Pseudomonas aeruginosa PA01
ccaggccuuccagaac

SEQ ID NO: 3522875 - RNA, 21 nt, Pseudomonas aeruginosa PA01
ccaggccuuccagaacgccgc

SEQ ID NO: 3522876 - RNA, 23 nt, Pseudomonas aeruginosa PA01
ccaggccuuccagaacgccgcgc

SEQ ID NO: 3522877 - RNA, 24 nt, Pseudomonas aeruginosa PA01
ccaggccuugcagcaacucgccgc

SEQ ID NO: 3522878 - RNA, 18 nt, Pseudomonas aeruginosa PA01
ccaggcgaaagucggcgc

SEQ ID NO: 3522879 - RNA, 19 nt, Pseudomonas aeruginosa PA01
ccaggcgaaagucggcgcg

SEQ ID NO: 3522880 - RNA, 20 nt, Pseudomonas aeruginosa PA01
ccaggcgaaagucggcgcga

SEQ ID NO: 3522881 - RNA, 16 nt, Pseudomonas aeruginosa PA01
ccaggcgaagcggcug

SEQ ID NO: 3522882 - RNA, 20 nt, Pseudomonas aeruginosa PA01
ccaggcgaauggagggaucg

SEQ ID NO: 3522883 - RNA, 22 nt, Pseudomonas aeruginosa PA01
ccaggcgaauggagggaucgcg

SEQ ID NO: 3522884 - RNA, 23 nt, Pseudomonas aeruginosa PA01
ccaggcgaauggagggaucgcgc

SEQ ID NO: 3522885 - RNA, 17 nt, Pseudomonas aeruginosa PA01
ccaggcgaggaacagcg

SEQ ID NO: 3522886 - RNA, 19 nt, Pseudomonas aeruginosa PA01
ccaggcgauaucccgccgc

SEQ ID NO: 3522887 - RNA, 18 nt, Pseudomonas aeruginosa PA01
ccaggcgauccacagcag

SEQ ID NO: 3522888 - RNA, 19 nt, Pseudomonas aeruginosa PA01
ccaggcgauccacagcagg

SEQ ID NO: 3522889 - RNA, 20 nt, Pseudomonas aeruginosa PA01
ccaggcgauccacagcaggu

SEQ ID NO: 3522890 - RNA, 14 nt, Pseudomonas aeruginosa PA01
ccaggcgauccagc

SEQ ID NO: 3522891 - RNA, 16 nt, Pseudomonas aeruginosa PA01
ccaggcgauccagcgg

SEQ ID NO: 3522892 - RNA, 11 nt, Pseudomonas aeruginosa PA01
ccaggcgaugc

SEQ ID NO: 3522893 - RNA, 22 nt, Pseudomonas aeruginosa PA01
ccaggcgaugcgccggaucggc

SEQ ID NO: 3522894 - RNA, 23 nt, Pseudomonas aeruginosa PA01
ccaggcgaugcgccggaucggcu

SEQ ID NO: 3522895 - RNA, 17 nt, Pseudomonas aeruginosa PA01
ccaggcgauggugcgcu

SEQ ID NO: 3522896 - RNA, 16 nt, Pseudomonas aeruginosa PA01
ccaggcgcaccagcag

SEQ ID NO: 3522897 - RNA, 18 nt, Pseudomonas aeruginosa PA01
ccaggcgcaccagcaggc

SEQ ID NO: 3522898 - RNA, 21 nt, Pseudomonas aeruginosa PA01
ccaggcgcaccagcaggcgca

SEQ ID NO: 3522899 - RNA, 22 nt, Pseudomonas aeruginosa PA01
ccaggcgcaccagcaggcgcaa

SEQ ID NO: 3522900 - RNA, 12 nt, Pseudomonas aeruginosa PA01
ccaggcgcagcc

SEQ ID NO: 3522901 - RNA, 19 nt, Pseudomonas aeruginosa PA01
ccaggcgcaguaggccugg

SEQ ID NO: 3522902 - RNA, 19 nt, Pseudomonas aeruginosa PA01
ccaggcgccaauccgggcg

SEQ ID NO: 3522903 - RNA, 22 nt, Pseudomonas aeruginosa PA01
ccaggcgccagggacgcgcagc

SEQ ID NO: 3522904 - RNA, 15 nt, Pseudomonas aeruginosa PA01
ccaggcgcccaggca

SEQ ID NO: 3522905 - RNA, 18 nt, Pseudomonas aeruginosa PA01
ccaggcgcccaggcagca

SEQ ID NO: 3522906 - RNA, 20 nt, Pseudomonas aeruginosa PA01
ccaggcgccgaugcccaggc

SEQ ID NO: 3522907 - RNA, 21 nt, Pseudomonas aeruginosa PA01
ccaggcgccgaugcccaggcc

SEQ ID NO: 3522908 - RNA, 16 nt, Pseudomonas aeruginosa PA01
ccaggcgccgcccccg

SEQ ID NO: 3522909 - RNA, 18 nt, Pseudomonas aeruginosa PA01
ccaggcgccgcccccggc

SEQ ID NO: 3522910 - RNA, 15 nt, Pseudomonas aeruginosa PA01
ccaggcgccgcucga

SEQ ID NO: 3522911 - RNA, 16 nt, Pseudomonas aeruginosa PA01
ccaggcgccgggucga

SEQ ID NO: 3522912 - RNA, 17 nt, Pseudomonas aeruginosa PA01
ccaggcgccgggucgau

SEQ ID NO: 3522913 - RNA, 20 nt, Pseudomonas aeruginosa PA01
ccaggcgcgaacgcucccag

SEQ ID NO: 3522914 - RNA, 21 nt, Pseudomonas aeruginosa PA01
ccaggcgcgaacgcucccagc

SEQ ID NO: 3522915 - RNA, 12 nt, Pseudomonas aeruginosa PA01
ccaggcgcgccu

SEQ ID NO: 3522916 - RNA, 21 nt, Pseudomonas aeruginosa PA01
ccaggcgcgccuggaucagcg

SEQ ID NO: 3522917 - RNA, 23 nt, Pseudomonas aeruginosa PA01
ccaggcgcgcuggaugcccuccu

SEQ ID NO: 3522918 - RNA, 21 nt, Pseudomonas aeruginosa PA01
ccaggcgcggcgucgggcgaa

SEQ ID NO: 3522919 - RNA, 22 nt, Pseudomonas aeruginosa PA01
ccaggcgcgggucuucaggccg

SEQ ID NO: 3522920 - RNA, 19 nt, Pseudomonas aeruginosa PA01
ccaggcgcgucuccagcuc

SEQ ID NO: 3522921 - RNA, 21 nt, Pseudomonas aeruginosa PA01
ccaggcgcgucuccagcucgg

SEQ ID NO: 3522922 - RNA, 13 nt, Pseudomonas aeruginosa PA01
ccaggcgcuccag

SEQ ID NO: 3522923 - RNA, 17 nt, Pseudomonas aeruginosa PA01
ccaggcgcuccuccagc

SEQ ID NO: 3522924 - RNA, 19 nt, Pseudomonas aeruginosa PA01
ccaggcgcuccuccagcgc

SEQ ID NO: 3522925 - RNA, 21 nt, Pseudomonas aeruginosa PA01
ccaggcgcuccuccagcgccg

SEQ ID NO: 3522926 - RNA, 16 nt, Pseudomonas aeruginosa PA01
ccaggcgcucgcgcug

SEQ ID NO: 3522927 - RNA, 19 nt, Pseudomonas aeruginosa PA01
ccaggcgcucgcgcugcaa

SEQ ID NO: 3522928 - RNA, 15 nt, Pseudomonas aeruginosa PA01
ccaggcgcucggcga

SEQ ID NO: 3522929 - RNA, 16 nt, Pseudomonas aeruginosa PA01
ccaggcgcucggcgac

SEQ ID NO: 3522930 - RNA, 23 nt, Pseudomonas aeruginosa PA01
ccaggcgcucggcggcgcgcagc

SEQ ID NO: 3522931 - RNA, 16 nt, Pseudomonas aeruginosa PA01
ccaggcgcucucgccg

SEQ ID NO: 3522932 - RNA, 20 nt, Pseudomonas aeruginosa PA01
ccaggcgcucucgccgccuu

SEQ ID NO: 3522933 - RNA, 22 nt, Pseudomonas aeruginosa PA01
ccaggcgcugcguuccuguucg

SEQ ID NO: 3522934 - RNA, 15 nt, Pseudomonas aeruginosa PA01
ccaggcgcugcucga

SEQ ID NO: 3522935 - RNA, 16 nt, Pseudomonas aeruginosa PA01
ccaggcgcuggcgccg

SEQ ID NO: 3522936 - RNA, 17 nt, Pseudomonas aeruginosa PA01
ccaggcgcuggcgccga

SEQ ID NO: 3522937 - RNA, 19 nt, Pseudomonas aeruginosa PA01
ccaggcgcuggcgccgaug

SEQ ID NO: 3522938 - RNA, 20 nt, Pseudomonas aeruginosa PA01
ccaggcgcugguccagcacg

SEQ ID NO: 3522939 - RNA, 20 nt, Pseudomonas aeruginosa PA01
ccaggcggagcauggugucg

SEQ ID NO: 3522940 - RNA, 21 nt, Pseudomonas aeruginosa PA01
ccaggcggcaagggcgucugg

SEQ ID NO: 3522941 - RNA, 15 nt, Pseudomonas aeruginosa PA01
ccaggcggcagccgc

SEQ ID NO: 3522942 - RNA, 16 nt, Pseudomonas aeruginosa PA01
ccaggcggcagccgcg

SEQ ID NO: 3522943 - RNA, 13 nt, Pseudomonas aeruginosa PA01
ccaggcggccgaa

SEQ ID NO: 3522944 - RNA, 20 nt, Pseudomonas aeruginosa PA01
ccaggcggccgcuggcgauc

SEQ ID NO: 3522945 - RNA, 22 nt, Pseudomonas aeruginosa PA01
ccaggcggccgucggccuggcg

SEQ ID NO: 3522946 - RNA, 14 nt, Pseudomonas aeruginosa PA01
ccaggcggcggacg

SEQ ID NO: 3522947 - RNA, 17 nt, Pseudomonas aeruginosa PA01
ccaggcggcgguagccg

SEQ ID NO: 3522948 - RNA, 13 nt, Pseudomonas aeruginosa PA01
ccaggcgggcacg

SEQ ID NO: 3522949 - RNA, 14 nt, Pseudomonas aeruginosa PA01
ccaggcgggccagc

SEQ ID NO: 3522950 - RNA, 18 nt, Pseudomonas aeruginosa PA01
ccaggcggggucagaggg

SEQ ID NO: 3522951 - RNA, 16 nt, Pseudomonas aeruginosa PA01
ccaggcgguccagcca

SEQ ID NO: 3522952 - RNA, 15 nt, Pseudomonas aeruginosa PA01
ccaggcggugucgcg

SEQ ID NO: 3522953 - RNA, 18 nt, Pseudomonas aeruginosa PA01
ccaggcgguugcggaacu

SEQ ID NO: 3522954 - RNA, 15 nt, Pseudomonas aeruginosa PA01
ccaggcgguuggccc

SEQ ID NO: 3522955 - RNA, 16 nt, Pseudomonas aeruginosa PA01
ccaggcgguuggcccg

SEQ ID NO: 3522956 - RNA, 22 nt, Pseudomonas aeruginosa PA01
ccaggcgguuggcccgcgccgu

SEQ ID NO: 3522957 - RNA, 20 nt, Pseudomonas aeruginosa PA01
ccaggcgguuguucagcggg

SEQ ID NO: 3522958 - RNA, 23 nt, Pseudomonas aeruginosa PA01
ccaggcgguuguucagcgggcgc

SEQ ID NO: 3522959 - RNA, 18 nt, Pseudomonas aeruginosa PA01
ccaggcguauucggcgac

SEQ ID NO: 3522960 - RNA, 21 nt, Pseudomonas aeruginosa PA01
ccaggcguauucggcgaccag

SEQ ID NO: 3522961 - RNA, 23 nt, Pseudomonas aeruginosa PA01
ccaggcguauucggcgaccagcc

SEQ ID NO: 3522962 - RNA, 13 nt, Pseudomonas aeruginosa PA01
ccaggcguccgcu

SEQ ID NO: 3522963 - RNA, 15 nt, Pseudomonas aeruginosa PA01
ccaggcgucgcgcca

SEQ ID NO: 3522964 - RNA, 20 nt, Pseudomonas aeruginosa PA01
ccaggcgugcagaccgucga

SEQ ID NO: 3522965 - RNA, 22 nt, Pseudomonas aeruginosa PA01
ccaggcgugcagaccgucgauc

SEQ ID NO: 3522966 - RNA, 18 nt, Pseudomonas aeruginosa PA01
ccaggcgugccuguuccu

SEQ ID NO: 3522967 - RNA, 16 nt, Pseudomonas aeruginosa PA01
ccaggcguggggcgaa

SEQ ID NO: 3522968 - RNA, 13 nt, Pseudomonas aeruginosa PA01
ccaggcguuccag

SEQ ID NO: 3522969 - RNA, 16 nt, Pseudomonas aeruginosa PA01
ccaggcguuccagcuc

SEQ ID NO: 3522970 - RNA, 18 nt, Pseudomonas aeruginosa PA01
ccaggcguuccagcucgg

SEQ ID NO: 3522971 - RNA, 19 nt, Pseudomonas aeruginosa PA01
ccaggcguuccagcucggc

SEQ ID NO: 3522972 - RNA, 21 nt, Pseudomonas aeruginosa PA01
ccaggcguuccagcucggcga

SEQ ID NO: 3522973 - RNA, 17 nt, Pseudomonas aeruginosa PA01
ccaggcucagcucuccc

SEQ ID NO: 3522974 - RNA, 14 nt, Pseudomonas aeruginosa PA01
ccaggcucgccccg

SEQ ID NO: 3522975 - RNA, 16 nt, Pseudomonas aeruginosa PA01
ccaggcucgccccggc

SEQ ID NO: 3522976 - RNA, 20 nt, Pseudomonas aeruginosa PA01
ccaggcucgccccggcggcg

SEQ ID NO: 3522977 - RNA, 21 nt, Pseudomonas aeruginosa PA01
ccaggcucgccccggcggcga

SEQ ID NO: 3522978 - RNA, 14 nt, Pseudomonas aeruginosa PA01
ccaggcucgccgcc

SEQ ID NO: 3522979 - RNA, 17 nt, Pseudomonas aeruginosa PA01
ccaggcucgccgccagc

SEQ ID NO: 3522980 - RNA, 20 nt, Pseudomonas aeruginosa PA01
ccaggcucgccgccagcagg

SEQ ID NO: 3522981 - RNA, 21 nt, Pseudomonas aeruginosa PA01
ccaggcucgccgccagcagga

SEQ ID NO: 3522982 - RNA, 20 nt, Pseudomonas aeruginosa PA01
ccaggcucgguucugcgcac

SEQ ID NO: 3522983 - RNA, 17 nt, Pseudomonas aeruginosa PA01
ccaggcucuucagcacg

SEQ ID NO: 3522984 - RNA, 19 nt, Pseudomonas aeruginosa PA01
ccaggcucuucagcacgcg

SEQ ID NO: 3522985 - RNA, 15 nt, Pseudomonas aeruginosa PA01
ccaggcugaccgcgu

SEQ ID NO: 3522986 - RNA, 18 nt, Pseudomonas aeruginosa PA01
ccaggcugaguucgucga

SEQ ID NO: 3522987 - RNA, 17 nt, Pseudomonas aeruginosa PA01
ccaggcugaucagcccg

SEQ ID NO: 3522988 - RNA, 14 nt, Pseudomonas aeruginosa PA01
ccaggcugccgccg

SEQ ID NO: 3522989 - RNA, 18 nt, Pseudomonas aeruginosa PA01
ccaggcugccgccgccgu

SEQ ID NO: 3522990 - RNA, 16 nt, Pseudomonas aeruginosa PA01
ccaggcugccgccuuc

SEQ ID NO: 3522991 - RNA, 23 nt, Pseudomonas aeruginosa PA01
ccaggcugccgccuucgcgggcc

SEQ ID NO: 3522992 - RNA, 14 nt, Pseudomonas aeruginosa PA01
ccaggcugccggcc

SEQ ID NO: 3522993 - RNA, 17 nt, Pseudomonas aeruginosa PA01
ccaggcugccggccagg

SEQ ID NO: 3522994 - RNA, 21 nt, Pseudomonas aeruginosa PA01
ccaggcuggccaguugcgcuc

SEQ ID NO: 3522995 - RNA, 15 nt, Pseudomonas aeruginosa PA01
ccaggcuggcggcca

SEQ ID NO: 3522996 - RNA, 22 nt, Pseudomonas aeruginosa PA01
ccaggcuggcggccagggcaug

SEQ ID NO: 3522997 - RNA, 18 nt, Pseudomonas aeruginosa PA01
ccaggcuguagccggcga

SEQ ID NO: 3522998 - RNA, 20 nt, Pseudomonas aeruginosa PA01
ccaggcuguagccggcgaug

SEQ ID NO: 3522999 - RNA, 20 nt, Pseudomonas aeruginosa PA01
ccaggcuguggcgcggcugg

SEQ ID NO: 3523000 - RNA, 21 nt, Pseudomonas aeruginosa PA01
ccaggcugugggcgacuuccu

SEQ ID NO: 3523001 - RNA, 15 nt, Pseudomonas aeruginosa PA01
ccaggcuuacccgcg

SEQ ID NO: 3523002 - RNA, 17 nt, Pseudomonas aeruginosa PA01
ccaggcuuacccgcgac

SEQ ID NO: 3523003 - RNA, 16 nt, Pseudomonas aeruginosa PA01
ccaggcuucggcgcgc

SEQ ID NO: 3523004 - RNA, 17 nt, Pseudomonas aeruginosa PA01
ccaggcuucggcgcgcu

SEQ ID NO: 3523005 - RNA, 19 nt, Pseudomonas aeruginosa PA01
ccaggcuucggcgcgcugg

SEQ ID NO: 3523006 - RNA, 17 nt, Pseudomonas aeruginosa PA01
ccaggcuuuccaccgcc

SEQ ID NO: 3523007 - RNA, 20 nt, Pseudomonas aeruginosa PA01
ccaggcuuuccaccgccagc

SEQ ID NO: 3523008 - RNA, 22 nt, Pseudomonas aeruginosa PA01
ccaggcuuuccaccgccagcac

SEQ ID NO: 3523009 - RNA, 17 nt, Pseudomonas aeruginosa PA01
ccaggcuuugcggcaag

SEQ ID NO: 3523010 - RNA, 13 nt, Pseudomonas aeruginosa PA01
ccagggaaaucag

SEQ ID NO: 3523011 - RNA, 16 nt, Pseudomonas aeruginosa PA01
ccagggaagcgcgcgc

SEQ ID NO: 3523012 - RNA, 19 nt, Pseudomonas aeruginosa PA01
ccagggaaucgucacggcg

SEQ ID NO: 3523013 - RNA, 19 nt, Pseudomonas aeruginosa PA01
ccagggacgcccggagcgc

SEQ ID NO: 3523014 - RNA, 20 nt, Pseudomonas aeruginosa PA01
ccagggacgcccggagcgcg

SEQ ID NO: 3523015 - RNA, 16 nt, Pseudomonas aeruginosa PA01
ccagggacgcgcagcg

SEQ ID NO: 3523016 - RNA, 19 nt, Pseudomonas aeruginosa PA01
ccagggacgcgcagcggcg

SEQ ID NO: 3523017 - RNA, 23 nt, Pseudomonas aeruginosa PA01
ccagggacgcgcagcggcgccga

SEQ ID NO: 3523018 - RNA, 15 nt, Pseudomonas aeruginosa PA01
ccagggacgcgccgg

SEQ ID NO: 3523019 - RNA, 17 nt, Pseudomonas aeruginosa PA01
ccagggacgcgccggcg

SEQ ID NO: 3523020 - RNA, 18 nt, Pseudomonas aeruginosa PA01
ccagggacgcgccggcgg

SEQ ID NO: 3523021 - RNA, 16 nt, Pseudomonas aeruginosa PA01
ccagggagaacagcag

SEQ ID NO: 3523022 - RNA, 21 nt, Pseudomonas aeruginosa PA01
ccagggagaacagcaggguca

SEQ ID NO: 3523023 - RNA, 12 nt, Pseudomonas aeruginosa PA01
ccagggagcagg

SEQ ID NO: 3523024 - RNA, 17 nt, Pseudomonas aeruginosa PA01
ccagggagcgcucgcgc

SEQ ID NO: 3523025 - RNA, 18 nt, Pseudomonas aeruginosa PA01
ccagggagcgcucgcgca

SEQ ID NO: 3523026 - RNA, 21 nt, Pseudomonas aeruginosa PA01
ccagggagcgcucgcgcagcc

SEQ ID NO: 3523027 - RNA, 21 nt, Pseudomonas aeruginosa PA01
ccagggagucgcuggccaucu

SEQ ID NO: 3523028 - RNA, 16 nt, Pseudomonas aeruginosa PA01
ccagggcaaacagcuc

SEQ ID NO: 3523029 - RNA, 17 nt, Pseudomonas aeruginosa PA01
ccagggcaaacagcucc

SEQ ID NO: 3523030 - RNA, 17 nt, Pseudomonas aeruginosa PA01
ccagggcaacgccaggc

SEQ ID NO: 3523031 - RNA, 18 nt, Pseudomonas aeruginosa PA01
ccagggcaacgccaggcu

SEQ ID NO: 3523032 - RNA, 19 nt, Pseudomonas aeruginosa PA01
ccagggcaacgccaggcug

SEQ ID NO: 3523033 - RNA, 13 nt, Pseudomonas aeruginosa PA01
ccagggcagcagg

SEQ ID NO: 3523034 - RNA, 21 nt, Pseudomonas aeruginosa PA01
ccagggcagcaggucgcgcag

SEQ ID NO: 3523035 - RNA, 21 nt, Pseudomonas aeruginosa PA01
ccagggcagggaguccgccag

SEQ ID NO: 3523036 - RNA, 24 nt, Pseudomonas aeruginosa PA01
ccagggcagggaguccgccagccg

SEQ ID NO: 3523037 - RNA, 20 nt, Pseudomonas aeruginosa PA01
ccagggcaguacguggcgcu

SEQ ID NO: 3523038 - RNA, 21 nt, Pseudomonas aeruginosa PA01
ccagggcaguacguggcgcuu

SEQ ID NO: 3523039 - RNA, 22 nt, Pseudomonas aeruginosa PA01
ccagggcaugggucagcgccag

SEQ ID NO: 3523040 - RNA, 15 nt, Pseudomonas aeruginosa PA01
ccagggccagcagcg

SEQ ID NO: 3523041 - RNA, 13 nt, Pseudomonas aeruginosa PA01
ccagggccagcgg

SEQ ID NO: 3523042 - RNA, 14 nt, Pseudomonas aeruginosa PA01
ccagggccagcggg

SEQ ID NO: 3523043 - RNA, 19 nt, Pseudomonas aeruginosa PA01
ccagggccagcuuggucgg

SEQ ID NO: 3523044 - RNA, 21 nt, Pseudomonas aeruginosa PA01
ccagggccagcuuggucggga

SEQ ID NO: 3523045 - RNA, 21 nt, Pseudomonas aeruginosa PA01
ccagggccaggagcaucggcg

SEQ ID NO: 3523046 - RNA, 23 nt, Pseudomonas aeruginosa PA01
ccagggccaggaugaccaggcug

SEQ ID NO: 3523047 - RNA, 15 nt, Pseudomonas aeruginosa PA01
ccagggcccagagca

SEQ ID NO: 3523048 - RNA, 18 nt, Pseudomonas aeruginosa PA01
ccagggcccagagcagca

SEQ ID NO: 3523049 - RNA, 19 nt, Pseudomonas aeruginosa PA01
ccagggcccagagcagcac

SEQ ID NO: 3523050 - RNA, 23 nt, Pseudomonas aeruginosa PA01
ccagggcccagagcagcaccagc

SEQ ID NO: 3523051 - RNA, 18 nt, Pseudomonas aeruginosa PA01
ccagggccgagcacaggg

SEQ ID NO: 3523052 - RNA, 14 nt, Pseudomonas aeruginosa PA01
ccagggccgcucga

SEQ ID NO: 3523053 - RNA, 18 nt, Pseudomonas aeruginosa PA01
ccagggccgcucgagggc

SEQ ID NO: 3523054 - RNA, 13 nt, Pseudomonas aeruginosa PA01
ccagggccggcgc

SEQ ID NO: 3523055 - RNA, 15 nt, Pseudomonas aeruginosa PA01
ccagggccggcgccc

SEQ ID NO: 3523056 - RNA, 19 nt, Pseudomonas aeruginosa PA01
ccagggccggcgcccuucg

SEQ ID NO: 3523057 - RNA, 23 nt, Pseudomonas aeruginosa PA01
ccagggccgggucaucaccggca

SEQ ID NO: 3523058 - RNA, 18 nt, Pseudomonas aeruginosa PA01
ccagggccugcuccagcg

SEQ ID NO: 3523059 - RNA, 21 nt, Pseudomonas aeruginosa PA01
ccaggucgagguucuccaggc

SEQ ID NO: 3523060 - RNA, 13 nt, Pseudomonas aeruginosa PA01
ccaggucgaucag

SEQ ID NO: 3523061 - RNA, 15 nt, Pseudomonas aeruginosa PA01
ccaggucgaucagca

SEQ ID NO: 3523062 - RNA, 22 nt, Pseudomonas aeruginosa PA01
ccaggucgaucagcagcagcgc

SEQ ID NO: 3523063 - RNA, 23 nt, Pseudomonas aeruginosa PA01
ccaggucgaucagcagcagcgcc

SEQ ID NO: 3523064 - RNA, 23 nt, Pseudomonas aeruginosa PA01
ccaggucgauccccaacccggcc

SEQ ID NO: 3523065 - RNA, 15 nt, Pseudomonas aeruginosa PA01
ccaggucgccaugcc

SEQ ID NO: 3523066 - RNA, 19 nt, Pseudomonas aeruginosa PA01
ccaggucgcccaccuugcg

SEQ ID NO: 3523067 - RNA, 13 nt, Pseudomonas aeruginosa PA01
ccaggucgccgca

SEQ ID NO: 3523068 - RNA, 14 nt, Pseudomonas aeruginosa PA01
ccaggucgccgcac

SEQ ID NO: 3523069 - RNA, 23 nt, Pseudomonas aeruginosa PA01
ccaggucgccguagaacagcacg

SEQ ID NO: 3523070 - RNA, 22 nt, Pseudomonas aeruginosa PA01
ccaggucgcgacugaccacgca

SEQ ID NO: 3523071 - RNA, 15 nt, Pseudomonas aeruginosa PA01
ccaggucgcgcaggg

SEQ ID NO: 3523072 - RNA, 16 nt, Pseudomonas aeruginosa PA01
ccaggucgcgcagggc

SEQ ID NO: 3523073 - RNA, 17 nt, Pseudomonas aeruginosa PA01
ccaggucgcgcagggcc

SEQ ID NO: 3523074 - RNA, 14 nt, Pseudomonas aeruginosa PA01
ccaggucgcgcuug

SEQ ID NO: 3523075 - RNA, 15 nt, Pseudomonas aeruginosa PA01
ccaggucgcggauca

SEQ ID NO: 3523076 - RNA, 21 nt, Pseudomonas aeruginosa PA01
ccaggucgcggaucaggcugg

SEQ ID NO: 3523077 - RNA, 15 nt, Pseudomonas aeruginosa PA01
ccaggucgcggguga

SEQ ID NO: 3523078 - RNA, 12 nt, Pseudomonas aeruginosa PA01
ccaggucgcugc

SEQ ID NO: 3523079 - RNA, 12 nt, Pseudomonas aeruginosa PA01
ccaggucgcugg

SEQ ID NO: 3523080 - RNA, 19 nt, Pseudomonas aeruginosa PA01
ccaggucgcuggcaccggc

SEQ ID NO: 3523081 - RNA, 23 nt, Pseudomonas aeruginosa PA01
ccaggucgcuguccuccagcggc

SEQ ID NO: 3523082 - RNA, 12 nt, Pseudomonas aeruginosa PA01
ccaggucggcgc

SEQ ID NO: 3523083 - RNA, 13 nt, Pseudomonas aeruginosa PA01
ccaggucggcgcg

SEQ ID NO: 3523084 - RNA, 14 nt, Pseudomonas aeruginosa PA01
ccaggucggcggca

SEQ ID NO: 3523085 - RNA, 18 nt, Pseudomonas aeruginosa PA01
ccaggucggcggcacgcu

SEQ ID NO: 3523086 - RNA, 22 nt, Pseudomonas aeruginosa PA01
ccaggucggcgggcaccgccag

SEQ ID NO: 3523087 - RNA, 23 nt, Pseudomonas aeruginosa PA01
ccaggucggcgggcaccgccagc

SEQ ID NO: 3523088 - RNA, 16 nt, Pseudomonas aeruginosa PA01
ccaggucgguccgccg

SEQ ID NO: 3523089 - RNA, 18 nt, Pseudomonas aeruginosa PA01
ccaggucggucggcggcg

SEQ ID NO: 3523090 - RNA, 15 nt, Pseudomonas aeruginosa PA01
ccaggucgucgcgcu

SEQ ID NO: 3523091 - RNA, 22 nt, Pseudomonas aeruginosa PA01
ccaggucgucgucacgcaggcu

SEQ ID NO: 3523092 - RNA, 17 nt, Pseudomonas aeruginosa PA01
ccaggucguugcgccgg

SEQ ID NO: 3523093 - RNA, 18 nt, Pseudomonas aeruginosa PA01
ccaggucguugcgccggc

SEQ ID NO: 3523094 - RNA, 19 nt, Pseudomonas aeruginosa PA01
ccaggucguugcgccggcc

SEQ ID NO: 3523095 - RNA, 20 nt, Pseudomonas aeruginosa PA01
ccaggucguugcgccggccc

SEQ ID NO: 3523096 - RNA, 22 nt, Pseudomonas aeruginosa PA01
ccaggucuucuggaaaucggcg

SEQ ID NO: 3523097 - RNA, 18 nt, Pseudomonas aeruginosa PA01
ccaggugcacggccaggc

SEQ ID NO: 3523098 - RNA, 20 nt, Pseudomonas aeruginosa PA01
ccaggugcacggccaggcca

SEQ ID NO: 3523099 - RNA, 16 nt, Pseudomonas aeruginosa PA01
ccaggugcagcgaggg

SEQ ID NO: 3523100 - RNA, 19 nt, Pseudomonas aeruginosa PA01
ccaggugcaggaagcgccg

SEQ ID NO: 3523101 - RNA, 23 nt, Pseudomonas aeruginosa PA01
ccaggugcaggaagcgccgggcc

SEQ ID NO: 3523102 - RNA, 14 nt, Pseudomonas aeruginosa PA01
ccaggugcccugga

SEQ ID NO: 3523103 - RNA, 21 nt, Pseudomonas aeruginosa PA01
ccaggugcccuggaagccggc

SEQ ID NO: 3523104 - RNA, 22 nt, Pseudomonas aeruginosa PA01
ccaggugcgagucaccccgacc

SEQ ID NO: 3523105 - RNA, 17 nt, Pseudomonas aeruginosa PA01
ccaggugcgcaggcgcu

SEQ ID NO: 3523106 - RNA, 19 nt, Pseudomonas aeruginosa PA01
ccaggugcgcaggcgcucg

SEQ ID NO: 3523107 - RNA, 12 nt, Pseudomonas aeruginosa PA01
ccaggugcgccg

SEQ ID NO: 3523108 - RNA, 14 nt, Pseudomonas aeruginosa PA01
ccaggugcgcggca

SEQ ID NO: 3523109 - RNA, 23 nt, Pseudomonas aeruginosa PA01
ccaggugcuggucgugguccagc

SEQ ID NO: 3523110 - RNA, 16 nt, Pseudomonas aeruginosa PA01
ccaggugcuuggcuuc

SEQ ID NO: 3523111 - RNA, 20 nt, Pseudomonas aeruginosa PA01
ccaggugcuuggcuucgagc

SEQ ID NO: 3523112 - RNA, 16 nt, Pseudomonas aeruginosa PA01
ccagguggcaggccug

SEQ ID NO: 3523113 - RNA, 22 nt, Pseudomonas aeruginosa PA01
ccagguggcaggccuggaauac

SEQ ID NO: 3523114 - RNA, 18 nt, Pseudomonas aeruginosa PA01
ccagguggucgaccaggc

SEQ ID NO: 3523115 - RNA, 22 nt, Pseudomonas aeruginosa PA01
ccagguggucgaccaggcguuc

SEQ ID NO: 3523116 - RNA, 16 nt, Pseudomonas aeruginosa PA01
ccagguguacaucggg

SEQ ID NO: 3523117 - RNA, 23 nt, Pseudomonas aeruginosa PA01
ccagguguucggccccggccagg

SEQ ID NO: 3523118 - RNA, 16 nt, Pseudomonas aeruginosa PA01
ccagguguucguccag

SEQ ID NO: 3523119 - RNA, 15 nt, Pseudomonas aeruginosa PA01
ccagguucacccagu

SEQ ID NO: 3523120 - RNA, 22 nt, Pseudomonas aeruginosa PA01
ccagguucgcguggcccggcgc

SEQ ID NO: 3523121 - RNA, 14 nt, Pseudomonas aeruginosa PA01
ccagguucggcgcc

SEQ ID NO: 3523122 - RNA, 19 nt, Pseudomonas aeruginosa PA01
ccagguucggcgccagcuc

SEQ ID NO: 3523123 - RNA, 18 nt, Pseudomonas aeruginosa PA01
ccagguucugccagagcg

SEQ ID NO: 3523124 - RNA, 17 nt, Pseudomonas aeruginosa PA01
ccagguucuggucgccg

SEQ ID NO: 3523125 - RNA, 20 nt, Pseudomonas aeruginosa PA01
ccagguucuggucgccgaca

SEQ ID NO: 3523126 - RNA, 20 nt, Pseudomonas aeruginosa PA01
ccagguuggccuggcccggc

SEQ ID NO: 3523127 - RNA, 22 nt, Pseudomonas aeruginosa PA01
ccagguuggccuggcccggcgc

SEQ ID NO: 3523128 - RNA, 15 nt, Pseudomonas aeruginosa PA01
ccagguugugaucga

SEQ ID NO: 3523129 - RNA, 22 nt, Pseudomonas aeruginosa PA01
ccagguugugaucgaccucgcg

SEQ ID NO: 3523130 - RNA, 18 nt, Pseudomonas aeruginosa PA01
ccaguaauggggaucgcg

SEQ ID NO: 3523131 - RNA, 19 nt, Pseudomonas aeruginosa PA01
ccaguacacccagggcagu

SEQ ID NO: 3523132 - RNA, 15 nt, Pseudomonas aeruginosa PA01
ccaguaccacgcagc

SEQ ID NO: 3523133 - RNA, 16 nt, Pseudomonas aeruginosa PA01
ccaguaccacgcagcc

SEQ ID NO: 3523134 - RNA, 22 nt, Pseudomonas aeruginosa PA01
ccaguaccacgcagccacccgc

SEQ ID NO: 3523135 - RNA, 14 nt, Pseudomonas aeruginosa PA01
ccaguaccagcaau

SEQ ID NO: 3523136 - RNA, 18 nt, Pseudomonas aeruginosa PA01
ccaguaccagcaaugccc

SEQ ID NO: 3523137 - RNA, 23 nt, Pseudomonas aeruginosa PA01
ccaguacuccgagggccgcgccg

SEQ ID NO: 3523138 - RNA, 16 nt, Pseudomonas aeruginosa PA01
ccaguacuugaacagc

SEQ ID NO: 3523139 - RNA, 19 nt, Pseudomonas aeruginosa PA01
ccaguagccggucaggcgc

SEQ ID NO: 3523140 - RNA, 18 nt, Pseudomonas aeruginosa PA01
ccaguagcgacagcaucu

SEQ ID NO: 3523141 - RNA, 19 nt, Pseudomonas aeruginosa PA01
ccaguagcgcuucgcgcag

SEQ ID NO: 3523142 - RNA, 21 nt, Pseudomonas aeruginosa PA01
ccaguagcggaagcacggcuc

SEQ ID NO: 3523143 - RNA, 16 nt, Pseudomonas aeruginosa PA01
ccaguaguccuccgcg

SEQ ID NO: 3523144 - RNA, 17 nt, Pseudomonas aeruginosa PA01
ccaguaguccuccgcgc

SEQ ID NO: 3523145 - RNA, 20 nt, Pseudomonas aeruginosa PA01
ccaguaguccuccgcgccca

SEQ ID NO: 3523146 - RNA, 23 nt, Pseudomonas aeruginosa PA01
ccaguaguccuccgcgcccaggc

SEQ ID NO: 3523147 - RNA, 13 nt, Pseudomonas aeruginosa PA01
ccagucaccaggu

SEQ ID NO: 3523148 - RNA, 14 nt, Pseudomonas aeruginosa PA01
ccagucaccagguc

SEQ ID NO: 3523149 - RNA, 15 nt, Pseudomonas aeruginosa PA01
ccagucauugcgcuc

SEQ ID NO: 3523150 - RNA, 17 nt, Pseudomonas aeruginosa PA01
ccagucauugcgcuccg

SEQ ID NO: 3523151 - RNA, 20 nt, Pseudomonas aeruginosa PA01
ccagucccgcaaagcccgcu

SEQ ID NO: 3523152 - RNA, 21 nt, Pseudomonas aeruginosa PA01
ccagucccggcuugccggcag

SEQ ID NO: 3523153 - RNA, 17 nt, Pseudomonas aeruginosa PA01
ccagucccuggccggcg

SEQ ID NO: 3523154 - RNA, 17 nt, Pseudomonas aeruginosa PA01
ccagucccuucagcgca

SEQ ID NO: 3523155 - RNA, 21 nt, Pseudomonas aeruginosa PA01
ccagucccuucagcgcaccgc

SEQ ID NO: 3523156 - RNA, 21 nt, Pseudomonas aeruginosa PA01
ccaguccggcaccgcucugca

SEQ ID NO: 3523157 - RNA, 16 nt, Pseudomonas aeruginosa PA01
ccaguccggcagcacg

SEQ ID NO: 3523158 - RNA, 20 nt, Pseudomonas aeruginosa PA01
ccaguccggucagcagcagg

SEQ ID NO: 3523159 - RNA, 11 nt, Pseudomonas aeruginosa PA01
ccaguccugga

SEQ ID NO: 3523160 - RNA, 21 nt, Pseudomonas aeruginosa PA01
ccagucgagacgccagccgcc

SEQ ID NO: 3523161 - RNA, 16 nt, Pseudomonas aeruginosa PA01
ccauccgacgccggcu

SEQ ID NO: 3523162 - RNA, 17 nt, Pseudomonas aeruginosa PA01
ccauccgacgccggcuu

SEQ ID NO: 3523163 - RNA, 14 nt, Pseudomonas aeruginosa PA01
ccauccgccgcagg

SEQ ID NO: 3523164 - RNA, 16 nt, Pseudomonas aeruginosa PA01
ccauccgccgcaggaa

SEQ ID NO: 3523165 - RNA, 14 nt, Pseudomonas aeruginosa PA01
ccauccgccuucuu

SEQ ID NO: 3523166 - RNA, 16 nt, Pseudomonas aeruginosa PA01
ccauccgcgccgacca

SEQ ID NO: 3523167 - RNA, 18 nt, Pseudomonas aeruginosa PA01
ccauccgcgccgaccagc

SEQ ID NO: 3523168 - RNA, 16 nt, Pseudomonas aeruginosa PA01
ccauccggaguucgcc

SEQ ID NO: 3523169 - RNA, 17 nt, Pseudomonas aeruginosa PA01
ccauccggaguucgccc

SEQ ID NO: 3523170 - RNA, 19 nt, Pseudomonas aeruginosa PA01
ccauccggaguucgcccgc

SEQ ID NO: 3523171 - RNA, 11 nt, Pseudomonas aeruginosa PA01
ccauccuccag

SEQ ID NO: 3523172 - RNA, 21 nt, Pseudomonas aeruginosa PA01
ccauccuccagcacuacgccc

SEQ ID NO: 3523173 - RNA, 16 nt, Pseudomonas aeruginosa PA01
ccauccuccagcgccg

SEQ ID NO: 3523174 - RNA, 17 nt, Pseudomonas aeruginosa PA01
ccauccuccagcgccgc

SEQ ID NO: 3523175 - RNA, 13 nt, Pseudomonas aeruginosa PA01
ccauccucgccgg

SEQ ID NO: 3523176 - RNA, 15 nt, Pseudomonas aeruginosa PA01
ccauccuggccgguc

SEQ ID NO: 3523177 - RNA, 16 nt, Pseudomonas aeruginosa PA01
ccauccuggccggucg

SEQ ID NO: 3523178 - RNA, 18 nt, Pseudomonas aeruginosa PA01
ccauccuggucgcguucc

SEQ ID NO: 3523179 - RNA, 20 nt, Pseudomonas aeruginosa PA01
ccauccuggucgcguuccag

SEQ ID NO: 3523180 - RNA, 23 nt, Pseudomonas aeruginosa PA01
ccauccuggucgcguuccagcuc

SEQ ID NO: 3523181 - RNA, 14 nt, Pseudomonas aeruginosa PA01
ccauccuucggcgu

SEQ ID NO: 3523182 - RNA, 20 nt, Pseudomonas aeruginosa PA01
ccaucgaaaucgcccaccag

SEQ ID NO: 3523183 - RNA, 22 nt, Pseudomonas aeruginosa PA01
ccaucgaaaucgcccaccaggu

SEQ ID NO: 3523184 - RNA, 17 nt, Pseudomonas aeruginosa PA01
ccaucgaggccaggccg

SEQ ID NO: 3523185 - RNA, 18 nt, Pseudomonas aeruginosa PA01
ccaucgaggccaggccga

SEQ ID NO: 3523186 - RNA, 16 nt, Pseudomonas aeruginosa PA01
ccaucgaucagcagcg

SEQ ID NO: 3523187 - RNA, 17 nt, Pseudomonas aeruginosa PA01
ccaucgaucagcagcgc

SEQ ID NO: 3523188 - RNA, 18 nt, Pseudomonas aeruginosa PA01
ccaucgaucagcagcgcc

SEQ ID NO: 3523189 - RNA, 15 nt, Pseudomonas aeruginosa PA01
ccaucgauggucagg

SEQ ID NO: 3523190 - RNA, 17 nt, Pseudomonas aeruginosa PA01
ccaucgcaggcagcgcg

SEQ ID NO: 3523191 - RNA, 18 nt, Pseudomonas aeruginosa PA01
ccaucgcaggcagcgcgc

SEQ ID NO: 3523192 - RNA, 22 nt, Pseudomonas aeruginosa PA01
ccaucgcaggcagcgcgcgucg

SEQ ID NO: 3523193 - RNA, 16 nt, Pseudomonas aeruginosa PA01
ccaucgcauagccggc

SEQ ID NO: 3523194 - RNA, 17 nt, Pseudomonas aeruginosa PA01
ccaucgcauagccggcg

SEQ ID NO: 3523195 - RNA, 20 nt, Pseudomonas aeruginosa PA01
ccaucgcauagccggcgcgc

SEQ ID NO: 3523196 - RNA, 16 nt, Pseudomonas aeruginosa PA01
ccaucgccaccagcag

SEQ ID NO: 3523197 - RNA, 17 nt, Pseudomonas aeruginosa PA01
ccaucgccaccagcagg

SEQ ID NO: 3523198 - RNA, 18 nt, Pseudomonas aeruginosa PA01
ccaucgccaccagcagga

SEQ ID NO: 3523199 - RNA, 17 nt, Pseudomonas aeruginosa PA01
ccaucgcccugcacgga

SEQ ID NO: 3523200 - RNA, 13 nt, Pseudomonas aeruginosa PA01
ccaucgccgcgga

SEQ ID NO: 3523201 - RNA, 15 nt, Pseudomonas aeruginosa PA01
ccaucgccgcggcga

SEQ ID NO: 3523202 - RNA, 13 nt, Pseudomonas aeruginosa PA01
ccaucgccggccc

SEQ ID NO: 3523203 - RNA, 16 nt, Pseudomonas aeruginosa PA01
ccaucgccggcccgcg

SEQ ID NO: 3523204 - RNA, 13 nt, Pseudomonas aeruginosa PA01
ccaucgccggcga

SEQ ID NO: 3523205 - RNA, 16 nt, Pseudomonas aeruginosa PA01
ccaucgccggcgagcc

SEQ ID NO: 3523206 - RNA, 19 nt, Pseudomonas aeruginosa PA01
ccaucgccggcgagccgcu

SEQ ID NO: 3523207 - RNA, 21 nt, Pseudomonas aeruginosa PA01
ccaucgccggcgagccgcugg

SEQ ID NO: 3523208 - RNA, 15 nt, Pseudomonas aeruginosa PA01
ccaucgccuccacgg

SEQ ID NO: 3523209 - RNA, 16 nt, Pseudomonas aeruginosa PA01
ccaucgccuccacggc

SEQ ID NO: 3523210 - RNA, 16 nt, Pseudomonas aeruginosa PA01
ccaucgccucgccggc

SEQ ID NO: 3523211 - RNA, 17 nt, Pseudomonas aeruginosa PA01
ccaucgccucgccggcc

SEQ ID NO: 3523212 - RNA, 18 nt, Pseudomonas aeruginosa PA01
ccaucgccucgccggcca

SEQ ID NO: 3523213 - RNA, 21 nt, Pseudomonas aeruginosa PA01
ccaucgccucgcggaccucgg

SEQ ID NO: 3523214 - RNA, 15 nt, Pseudomonas aeruginosa PA01
ccaucgcggcgaugg

SEQ ID NO: 3523215 - RNA, 15 nt, Pseudomonas aeruginosa PA01
ccaucgcuccagcga

SEQ ID NO: 3523216 - RNA, 17 nt, Pseudomonas aeruginosa PA01
ccaucgcuccagcgaau

SEQ ID NO: 3523217 - RNA, 17 nt, Pseudomonas aeruginosa PA01
ccaucgcuuuccuggcc

SEQ ID NO: 3523218 - RNA, 15 nt, Pseudomonas aeruginosa PA01
ccaucggccuggggc

SEQ ID NO: 3523219 - RNA, 16 nt, Pseudomonas aeruginosa PA01
ccaucggcgucggcug

SEQ ID NO: 3523220 - RNA, 20 nt, Pseudomonas aeruginosa PA01
ccaucgucgcuuccggcgcc

SEQ ID NO: 3523221 - RNA, 19 nt, Pseudomonas aeruginosa PA01
ccaucguucaguugccucu

SEQ ID NO: 3523222 - RNA, 13 nt, Pseudomonas aeruginosa PA01
ccaucucgccgcg

SEQ ID NO: 3523223 - RNA, 15 nt, Pseudomonas aeruginosa PA01
ccaucucgccgcgca

SEQ ID NO: 3523224 - RNA, 17 nt, Pseudomonas aeruginosa PA01
ccaucucgccgcgcacg

SEQ ID NO: 3523225 - RNA, 15 nt, Pseudomonas aeruginosa PA01
ccaucuguaccaccg

SEQ ID NO: 3523226 - RNA, 15 nt, Pseudomonas aeruginosa PA01
ccaucuucagcauca

SEQ ID NO: 3523227 - RNA, 13 nt, Pseudomonas aeruginosa PA01
ccaucuuuuccug

SEQ ID NO: 3523228 - RNA, 19 nt, Pseudomonas aeruginosa PA01
ccaucuuuuccugcuggcg

SEQ ID NO: 3523229 - RNA, 17 nt, Pseudomonas aeruginosa PA01
ccaugaaaaaggccggu

SEQ ID NO: 3523230 - RNA, 19 nt, Pseudomonas aeruginosa PA01
ccaugaaaaaggcgcccgc

SEQ ID NO: 3523231 - RNA, 15 nt, Pseudomonas aeruginosa PA01
ccaugaacucuuccc

SEQ ID NO: 3523232 - RNA, 16 nt, Pseudomonas aeruginosa PA01
ccaugaacucuucccc

SEQ ID NO: 3523233 - RNA, 17 nt, Pseudomonas aeruginosa PA01
ccaugaaugccuugagg

SEQ ID NO: 3523234 - RNA, 18 nt, Pseudomonas aeruginosa PA01
ccaugaccucggccagcc

SEQ ID NO: 3523235 - RNA, 19 nt, Pseudomonas aeruginosa PA01
ccaugaccucggccagcca

SEQ ID NO: 3523236 - RNA, 13 nt, Pseudomonas aeruginosa PA01
ccaugagccgggg

SEQ ID NO: 3523237 - RNA, 22 nt, Pseudomonas aeruginosa PA01
ccaugagcgacccaacggggcc

SEQ ID NO: 3523238 - RNA, 22 nt, Pseudomonas aeruginosa PA01
ccaugagguuggccacguaggg

SEQ ID NO: 3523239 - RNA, 12 nt, Pseudomonas aeruginosa PA01
ccaugaucaucg

SEQ ID NO: 3523240 - RNA, 19 nt, Pseudomonas aeruginosa PA01
ccaugaucaucgccugcug

SEQ ID NO: 3523241 - RNA, 20 nt, Pseudomonas aeruginosa PA01
ccaugaucaucgccugcugg

SEQ ID NO: 3523242 - RNA, 14 nt, Pseudomonas aeruginosa PA01
ccaugaucaucggc

SEQ ID NO: 3523243 - RNA, 16 nt, Pseudomonas aeruginosa PA01
ccaugaucaucggcug

SEQ ID NO: 3523244 - RNA, 14 nt, Pseudomonas aeruginosa PA01
ccaugaucgccacc

SEQ ID NO: 3523245 - RNA, 18 nt, Pseudomonas aeruginosa PA01
ccaugaugugcgcaggcu

SEQ ID NO: 3523246 - RNA, 19 nt, Pseudomonas aeruginosa PA01
ccaugaugugcgcaggcug

SEQ ID NO: 3523247 - RNA, 19 nt, Pseudomonas aeruginosa PA01
ccaugcaagaacgccgacc

SEQ ID NO: 3523248 - RNA, 22 nt, Pseudomonas aeruginosa PA01
ccaugcaagaacgccgacccua

SEQ ID NO: 3523249 - RNA, 14 nt, Pseudomonas aeruginosa PA01
ccaugcacacgcuc

SEQ ID NO: 3523250 - RNA, 17 nt, Pseudomonas aeruginosa PA01
ccaugcacacgcuccca

SEQ ID NO: 3523251 - RNA, 19 nt, Pseudomonas aeruginosa PA01
ccaugcagcggcaugguca

SEQ ID NO: 3523252 - RNA, 21 nt, Pseudomonas aeruginosa PA01
ccaugcagcggcauggucagc

SEQ ID NO: 3523253 - RNA, 14 nt, Pseudomonas aeruginosa PA01
ccaugcaggccagg

SEQ ID NO: 3523254 - RNA, 23 nt, Pseudomonas aeruginosa PA01
ccaugcaugauuucguuggccca

SEQ ID NO: 3523255 - RNA, 18 nt, Pseudomonas aeruginosa PA01
ccaugccaggagaaccug

SEQ ID NO: 3523256 - RNA, 18 nt, Pseudomonas aeruginosa PA01
ccaugcccauuacguugu

SEQ ID NO: 3523257 - RNA, 23 nt, Pseudomonas aeruginosa PA01
ccaugcccgccccgcaccagcca

SEQ ID NO: 3523258 - RNA, 13 nt, Pseudomonas aeruginosa PA01
ccaugcccgcugg

SEQ ID NO: 3523259 - RNA, 16 nt, Pseudomonas aeruginosa PA01
ccaugcccgcugggca

SEQ ID NO: 3523260 - RNA, 16 nt, Pseudomonas aeruginosa PA01
ccaugcccggcuggcg

SEQ ID NO: 3523261 - RNA, 20 nt, Pseudomonas aeruginosa PA01
ccaugcccgucgaccaucac

SEQ ID NO: 3523262 - RNA, 20 nt, Pseudomonas aeruginosa PA01
ccaugcccuuguccggcccg

SEQ ID NO: 3523263 - RNA, 16 nt, Pseudomonas aeruginosa PA01
ccaugccgcccggccg

SEQ ID NO: 3523264 - RNA, 18 nt, Pseudomonas aeruginosa PA01
cccacgcccaucggcguc

SEQ ID NO: 3523265 - RNA, 19 nt, Pseudomonas aeruginosa PA01
cccacgcgacccaucgccg

SEQ ID NO: 3523266 - RNA, 18 nt, Pseudomonas aeruginosa PA01
cccacgcgccuggccguc

SEQ ID NO: 3523267 - RNA, 19 nt, Pseudomonas aeruginosa PA01
cccacgcgccuggccgucu

SEQ ID NO: 3523268 - RNA, 22 nt, Pseudomonas aeruginosa PA01
cccacggaggccuucgccgacc

SEQ ID NO: 3523269 - RNA, 13 nt, Pseudomonas aeruginosa PA01
cccacggccaggc

SEQ ID NO: 3523270 - RNA, 15 nt, Pseudomonas aeruginosa PA01
cccacggccaggccc

SEQ ID NO: 3523271 - RNA, 19 nt, Pseudomonas aeruginosa PA01
cccacggccaggcccacgc

SEQ ID NO: 3523272 - RNA, 20 nt, Pseudomonas aeruginosa PA01
cccacggccaggcccacgcc

SEQ ID NO: 3523273 - RNA, 15 nt, Pseudomonas aeruginosa PA01
cccacggcgcggccg

SEQ ID NO: 3523274 - RNA, 20 nt, Pseudomonas aeruginosa PA01
cccacgggcgacccaggccg

SEQ ID NO: 3523275 - RNA, 21 nt, Pseudomonas aeruginosa PA01
cccacgggcgacccaggccga

SEQ ID NO: 3523276 - RNA, 13 nt, Pseudomonas aeruginosa PA01
cccacgggcggcc

SEQ ID NO: 3523277 - RNA, 13 nt, Pseudomonas aeruginosa PA01
cccacgggcggcu

SEQ ID NO: 3523278 - RNA, 13 nt, Pseudomonas aeruginosa PA01
cccacuccggcag

SEQ ID NO: 3523279 - RNA, 15 nt, Pseudomonas aeruginosa PA01
cccacuccggcaggc

SEQ ID NO: 3523280 - RNA, 18 nt, Pseudomonas aeruginosa PA01
cccacuccggcaggcgcu

SEQ ID NO: 3523281 - RNA, 15 nt, Pseudomonas aeruginosa PA01
cccacucgauggugg

SEQ ID NO: 3523282 - RNA, 14 nt, Pseudomonas aeruginosa PA01
cccacucgcguagc

SEQ ID NO: 3523283 - RNA, 15 nt, Pseudomonas aeruginosa PA01
cccacucggccagca

SEQ ID NO: 3523284 - RNA, 19 nt, Pseudomonas aeruginosa PA01
cccacucuucagucccucg

SEQ ID NO: 3523285 - RNA, 20 nt, Pseudomonas aeruginosa PA01
cccacuuccggcccggccag

SEQ ID NO: 3523286 - RNA, 22 nt, Pseudomonas aeruginosa PA01
cccacuuccggcccggccaggc

SEQ ID NO: 3523287 - RNA, 12 nt, Pseudomonas aeruginosa PA01
cccacuuccucg

SEQ ID NO: 3523288 - RNA, 17 nt, Pseudomonas aeruginosa PA01
cccagaaaaaagccccg

SEQ ID NO: 3523289 - RNA, 16 nt, Pseudomonas aeruginosa PA01
cccagaaaaucggcag

SEQ ID NO: 3523290 - RNA, 20 nt, Pseudomonas aeruginosa PA01
cccagaagaucgccugcugg

SEQ ID NO: 3523291 - RNA, 15 nt, Pseudomonas aeruginosa PA01
cccagaagccgaccu

SEQ ID NO: 3523292 - RNA, 15 nt, Pseudomonas aeruginosa PA01
cccagaaggccaggg

SEQ ID NO: 3523293 - RNA, 13 nt, Pseudomonas aeruginosa PA01
cccagacacgccu

SEQ ID NO: 3523294 - RNA, 16 nt, Pseudomonas aeruginosa PA01
cccagacacgccucaa

SEQ ID NO: 3523295 - RNA, 20 nt, Pseudomonas aeruginosa PA01
cccagacacgccucaaggca

SEQ ID NO: 3523296 - RNA, 10 nt, Pseudomonas aeruginosa PA01
cccagacagc

SEQ ID NO: 3523297 - RNA, 12 nt, Pseudomonas aeruginosa PA01
cccagaccaccc

SEQ ID NO: 3523298 - RNA, 16 nt, Pseudomonas aeruginosa PA01
cccagaccacccggcu

SEQ ID NO: 3523299 - RNA, 18 nt, Pseudomonas aeruginosa PA01
cccagaccagcagcggca

SEQ ID NO: 3523300 - RNA, 14 nt, Pseudomonas aeruginosa PA01
cccagacccucucc

SEQ ID NO: 3523301 - RNA, 20 nt, Pseudomonas aeruginosa PA01
cccagaccguggauuucagc

SEQ ID NO: 3523302 - RNA, 17 nt, Pseudomonas aeruginosa PA01
cccagaccugccgcccg

SEQ ID NO: 3523303 - RNA, 16 nt, Pseudomonas aeruginosa PA01
cccagaccuuccagcc

SEQ ID NO: 3523304 - RNA, 17 nt, Pseudomonas aeruginosa PA01
cccagaccuuccagccg

SEQ ID NO: 3523305 - RNA, 17 nt, Pseudomonas aeruginosa PA01
cccagacguccagcgcc

SEQ ID NO: 3523306 - RNA, 12 nt, Pseudomonas aeruginosa PA01
cccagagcagca

SEQ ID NO: 3523307 - RNA, 20 nt, Pseudomonas aeruginosa PA01
cccagagcagcaccagcacc

SEQ ID NO: 3523308 - RNA, 14 nt, Pseudomonas aeruginosa PA01
cccagagcccgccg

SEQ ID NO: 3523309 - RNA, 19 nt, Pseudomonas aeruginosa PA01
cccagagccgcucggcggg

SEQ ID NO: 3523310 - RNA, 17 nt, Pseudomonas aeruginosa PA01
cccagaguucgcccagc

SEQ ID NO: 3523311 - RNA, 21 nt, Pseudomonas aeruginosa PA01
cccagaguucgcccagcucgc

SEQ ID NO: 3523312 - RNA, 14 nt, Pseudomonas aeruginosa PA01
cccagauauccagg

SEQ ID NO: 3523313 - RNA, 20 nt, Pseudomonas aeruginosa PA01
cccagaucauguagagcagg

SEQ ID NO: 3523314 - RNA, 17 nt, Pseudomonas aeruginosa PA01
cccagauccccugcagg

SEQ ID NO: 3523315 - RNA, 18 nt, Pseudomonas aeruginosa PA01
cccagaucgccagcgcca

SEQ ID NO: 3523316 - RNA, 19 nt, Pseudomonas aeruginosa PA01
cccagcaacugaccuggcc

SEQ ID NO: 3523317 - RNA, 17 nt, Pseudomonas aeruginosa PA01
cccagcaccacagcacc

SEQ ID NO: 3523318 - RNA, 14 nt, Pseudomonas aeruginosa PA01
cccagcaccucgcc

SEQ ID NO: 3523319 - RNA, 15 nt, Pseudomonas aeruginosa PA01
cccagcaccucgccg

SEQ ID NO: 3523320 - RNA, 12 nt, Pseudomonas aeruginosa PA01
cccagcaccugg

SEQ ID NO: 3523321 - RNA, 19 nt, Pseudomonas aeruginosa PA01
cccagcacgccgagcaacg

SEQ ID NO: 3523322 - RNA, 19 nt, Pseudomonas aeruginosa PA01
cccagcacggaugcccagc

SEQ ID NO: 3523323 - RNA, 15 nt, Pseudomonas aeruginosa PA01
cccagcagcaacagc

SEQ ID NO: 3523324 - RNA, 19 nt, Pseudomonas aeruginosa PA01
cccagcagcaacagcgccg

SEQ ID NO: 3523325 - RNA, 21 nt, Pseudomonas aeruginosa PA01
cccagcagcaacagcgccgcg

SEQ ID NO: 3523326 - RNA, 13 nt, Pseudomonas aeruginosa PA01
cccagcagcacca

SEQ ID NO: 3523327 - RNA, 21 nt, Pseudomonas aeruginosa PA01
cccagcagcaccaucagccag

SEQ ID NO: 3523328 - RNA, 14 nt, Pseudomonas aeruginosa PA01
cccagcagcaggcc

SEQ ID NO: 3523329 - RNA, 22 nt, Pseudomonas aeruginosa PA01
cccagcagcaggccggcgacca

SEQ ID NO: 3523330 - RNA, 13 nt, Pseudomonas aeruginosa PA01
cccagcagcgccu

SEQ ID NO: 3523331 - RNA, 18 nt, Pseudomonas aeruginosa PA01
cccagcagcgccucggca

SEQ ID NO: 3523332 - RNA, 13 nt, Pseudomonas aeruginosa PA01
cccagcagcggca

SEQ ID NO: 3523333 - RNA, 11 nt, Pseudomonas aeruginosa PA01
cccagcaggcc

SEQ ID NO: 3523334 - RNA, 19 nt, Pseudomonas aeruginosa PA01
cccagcaggccagccaacu

SEQ ID NO: 3523335 - RNA, 15 nt, Pseudomonas aeruginosa PA01
cccagcaggccggcc

SEQ ID NO: 3523336 - RNA, 16 nt, Pseudomonas aeruginosa PA01
cccagcaggcgcgccc

SEQ ID NO: 3523337 - RNA, 18 nt, Pseudomonas aeruginosa PA01
cccagcagggccagccag

SEQ ID NO: 3523338 - RNA, 18 nt, Pseudomonas aeruginosa PA01
cccagcaucgccggcagc

SEQ ID NO: 3523339 - RNA, 19 nt, Pseudomonas aeruginosa PA01
cccagcaucgccggcagcg

SEQ ID NO: 3523340 - RNA, 23 nt, Pseudomonas aeruginosa PA01
cccagcaucgccggcagcgccgc

SEQ ID NO: 3523341 - RNA, 16 nt, Pseudomonas aeruginosa PA01
cccagccacagagguc

SEQ ID NO: 3523342 - RNA, 15 nt, Pseudomonas aeruginosa PA01
cccagccagggccgc

SEQ ID NO: 3523343 - RNA, 16 nt, Pseudomonas aeruginosa PA01
cccagccagggccgcg

SEQ ID NO: 3523344 - RNA, 20 nt, Pseudomonas aeruginosa PA01
cccagccauugagcgcgccc

SEQ ID NO: 3523345 - RNA, 12 nt, Pseudomonas aeruginosa PA01
cccagcccaggg

SEQ ID NO: 3523346 - RNA, 15 nt, Pseudomonas aeruginosa PA01
cccagcccagggcga

SEQ ID NO: 3523347 - RNA, 17 nt, Pseudomonas aeruginosa PA01
cccagccccaccgccag

SEQ ID NO: 3523348 - RNA, 12 nt, Pseudomonas aeruginosa PA01
cccagcccgccu

SEQ ID NO: 3523349 - RNA, 12 nt, Pseudomonas aeruginosa PA01
cccagcccggcc

SEQ ID NO: 3523350 - RNA, 18 nt, Pseudomonas aeruginosa PA01
cccagccgacgcgcagcg

SEQ ID NO: 3523351 - RNA, 18 nt, Pseudomonas aeruginosa PA01
cccagccgaggcagccgu

SEQ ID NO: 3523352 - RNA, 14 nt, Pseudomonas aeruginosa PA01
cccagccgaggugg

SEQ ID NO: 3523353 - RNA, 14 nt, Pseudomonas aeruginosa PA01
cccagccgcacgcc

SEQ ID NO: 3523354 - RNA, 14 nt, Pseudomonas aeruginosa PA01
cccagccgcggccg

SEQ ID NO: 3523355 - RNA, 16 nt, Pseudomonas aeruginosa PA01
cccagccgcggcgcca

SEQ ID NO: 3523356 - RNA, 18 nt, Pseudomonas aeruginosa PA01
cccagccgcggcgccacg

SEQ ID NO: 3523357 - RNA, 19 nt, Pseudomonas aeruginosa PA01
cccagccgcucgcguccgc

SEQ ID NO: 3523358 - RNA, 15 nt, Pseudomonas aeruginosa PA01
cccagccucggcagg

SEQ ID NO: 3523359 - RNA, 21 nt, Pseudomonas aeruginosa PA01
cccagccuugcuggacuuccc

SEQ ID NO: 3523360 - RNA, 18 nt, Pseudomonas aeruginosa PA01
cccagcgaagcuucuucg

SEQ ID NO: 3523361 - RNA, 17 nt, Pseudomonas aeruginosa PA01
cccagcgacuccgccag

SEQ ID NO: 3523362 - RNA, 12 nt, Pseudomonas aeruginosa PA01
cccagcgagccg

SEQ ID NO: 3523363 - RNA, 17 nt, Pseudomonas aeruginosa PA01
cccagcgcagccugcug

SEQ ID NO: 3523364 - RNA, 18 nt, Pseudomonas aeruginosa PA01
cccagcgcagccugcugg

SEQ ID NO: 3523365 - RNA, 13 nt, Pseudomonas aeruginosa PA01
cccagcgcaucgc

SEQ ID NO: 3523366 - RNA, 15 nt, Pseudomonas aeruginosa PA01
cccagcgcaucgcgc

SEQ ID NO: 3523367 - RNA, 16 nt, Pseudomonas aeruginosa PA01
cccagcgcccgcacca

SEQ ID NO: 3523368 - RNA, 18 nt, Pseudomonas aeruginosa PA01
cccagguggcaggccugg

SEQ ID NO: 3523369 - RNA, 16 nt, Pseudomonas aeruginosa PA01
cccagguggucgacca

SEQ ID NO: 3523370 - RNA, 18 nt, Pseudomonas aeruginosa PA01
cccagguggucgaccagg

SEQ ID NO: 3523371 - RNA, 19 nt, Pseudomonas aeruginosa PA01
cccagguggucgaccaggc

SEQ ID NO: 3523372 - RNA, 20 nt, Pseudomonas aeruginosa PA01
cccagguucuggucgccgac

SEQ ID NO: 3523373 - RNA, 21 nt, Pseudomonas aeruginosa PA01
cccagguucuggucgccgaca

SEQ ID NO: 3523374 - RNA, 16 nt, Pseudomonas aeruginosa PA01
cccagguuggcgaaca

SEQ ID NO: 3523375 - RNA, 18 nt, Pseudomonas aeruginosa PA01
cccaguacccgcugguaa

SEQ ID NO: 3523376 - RNA, 14 nt, Pseudomonas aeruginosa PA01
cccaguaccgccac

SEQ ID NO: 3523377 - RNA, 15 nt, Pseudomonas aeruginosa PA01
cccaguagccgguca

SEQ ID NO: 3523378 - RNA, 21 nt, Pseudomonas aeruginosa PA01
cccagucccuucagcgcaccg

SEQ ID NO: 3523379 - RNA, 20 nt, Pseudomonas aeruginosa PA01
cccaguccucguacaugcgc

SEQ ID NO: 3523380 - RNA, 16 nt, Pseudomonas aeruginosa PA01
cccagucggcguccgc

SEQ ID NO: 3523381 - RNA, 17 nt, Pseudomonas aeruginosa PA01
cccagucggcguccgcc

SEQ ID NO: 3523382 - RNA, 18 nt, Pseudomonas aeruginosa PA01
cccagugcgagucggcga

SEQ ID NO: 3523383 - RNA, 20 nt, Pseudomonas aeruginosa PA01
cccagugcgagucggcgacg

SEQ ID NO: 3523384 - RNA, 15 nt, Pseudomonas aeruginosa PA01
cccagugcucccgca

SEQ ID NO: 3523385 - RNA, 18 nt, Pseudomonas aeruginosa PA01
cccaguucgccggccagc

SEQ ID NO: 3523386 - RNA, 21 nt, Pseudomonas aeruginosa PA01
cccaguucgcgcggagugcug

SEQ ID NO: 3523387 - RNA, 18 nt, Pseudomonas aeruginosa PA01
cccaguucuucgccgccc

SEQ ID NO: 3523388 - RNA, 19 nt, Pseudomonas aeruginosa PA01
cccaguucuucgccgcccg

SEQ ID NO: 3523389 - RNA, 20 nt, Pseudomonas aeruginosa PA01
cccaguucuucgccgcccgc

SEQ ID NO: 3523390 - RNA, 21 nt, Pseudomonas aeruginosa PA01
cccaguucuucgccgcccgcg

SEQ ID NO: 3523391 - RNA, 14 nt, Pseudomonas aeruginosa PA01
cccaguugcccggc

SEQ ID NO: 3523392 - RNA, 15 nt, Pseudomonas aeruginosa PA01
cccaguugcgccgcc

SEQ ID NO: 3523393 - RNA, 16 nt, Pseudomonas aeruginosa PA01
cccaguugcgccgccu

SEQ ID NO: 3523394 - RNA, 16 nt, Pseudomonas aeruginosa PA01
cccaguugcgcggcga

SEQ ID NO: 3523395 - RNA, 13 nt, Pseudomonas aeruginosa PA01
cccaguugggcca

SEQ ID NO: 3523396 - RNA, 16 nt, Pseudomonas aeruginosa PA01
cccaguugggccagga

SEQ ID NO: 3523397 - RNA, 15 nt, Pseudomonas aeruginosa PA01
cccauaccgccucgg

SEQ ID NO: 3523398 - RNA, 17 nt, Pseudomonas aeruginosa PA01
cccaucaacgagccgag

SEQ ID NO: 3523399 - RNA, 19 nt, Pseudomonas aeruginosa PA01
cccaucacggccccgagaa

SEQ ID NO: 3523400 - RNA, 16 nt, Pseudomonas aeruginosa PA01
cccauccgacgccggc

SEQ ID NO: 3523401 - RNA, 21 nt, Pseudomonas aeruginosa PA01
cccauccgacgccggcuucca

SEQ ID NO: 3523402 - RNA, 15 nt, Pseudomonas aeruginosa PA01
cccauccgcucggcg

SEQ ID NO: 3523403 - RNA, 14 nt, Pseudomonas aeruginosa PA01
cccauccgggcggc

SEQ ID NO: 3523404 - RNA, 18 nt, Pseudomonas aeruginosa PA01
cccaucgacugcaacaga

SEQ ID NO: 3523405 - RNA, 16 nt, Pseudomonas aeruginosa PA01
cccaucgccaccagca

SEQ ID NO: 3523406 - RNA, 17 nt, Pseudomonas aeruginosa PA01
cccaucgccaccagcag

SEQ ID NO: 3523407 - RNA, 16 nt, Pseudomonas aeruginosa PA01
cccaucgccagggucu

SEQ ID NO: 3523408 - RNA, 15 nt, Pseudomonas aeruginosa PA01
cccaucgcccgcagc

SEQ ID NO: 3523409 - RNA, 23 nt, Pseudomonas aeruginosa PA01
cccaucgcccgcagccacaggcg

SEQ ID NO: 3523410 - RNA, 24 nt, Pseudomonas aeruginosa PA01
cccaucgccgaagacgccugucgg

SEQ ID NO: 3523411 - RNA, 14 nt, Pseudomonas aeruginosa PA01
cccaucgccuccac

SEQ ID NO: 3523412 - RNA, 20 nt, Pseudomonas aeruginosa PA01
cccaucucgguguccaccac

SEQ ID NO: 3523413 - RNA, 16 nt, Pseudomonas aeruginosa PA01
cccaucugccggccac

SEQ ID NO: 3523414 - RNA, 20 nt, Pseudomonas aeruginosa PA01
cccaucugccggccaccauc

SEQ ID NO: 3523415 - RNA, 12 nt, Pseudomonas aeruginosa PA01
cccaugaucgcc

SEQ ID NO: 3523416 - RNA, 16 nt, Pseudomonas aeruginosa PA01
cccaugauggucggca

SEQ ID NO: 3523417 - RNA, 13 nt, Pseudomonas aeruginosa PA01
cccaugcccgccc

SEQ ID NO: 3523418 - RNA, 18 nt, Pseudomonas aeruginosa PA01
cccaugcccggccuggcg

SEQ ID NO: 3523419 - RNA, 22 nt, Pseudomonas aeruginosa PA01
cccaugccgcaagcuccccgcc

SEQ ID NO: 3523420 - RNA, 18 nt, Pseudomonas aeruginosa PA01
cccaugccgcuagcccug

SEQ ID NO: 3523421 - RNA, 19 nt, Pseudomonas aeruginosa PA01
cccaugccgcuagcccugc

SEQ ID NO: 3523422 - RNA, 20 nt, Pseudomonas aeruginosa PA01
cccaugccgcuagcccugcu

SEQ ID NO: 3523423 - RNA, 18 nt, Pseudomonas aeruginosa PA01
cccaugccuugcagcgcc

SEQ ID NO: 3523424 - RNA, 19 nt, Pseudomonas aeruginosa PA01
cccaugccuugcagcgcca

SEQ ID NO: 3523425 - RNA, 13 nt, Pseudomonas aeruginosa PA01
cccaugcgcggcg

SEQ ID NO: 3523426 - RNA, 15 nt, Pseudomonas aeruginosa PA01
cccauggcgccacgc

SEQ ID NO: 3523427 - RNA, 22 nt, Pseudomonas aeruginosa PA01
cccauguagaccaccagcgugg

SEQ ID NO: 3523428 - RNA, 21 nt, Pseudomonas aeruginosa PA01
cccaugugcuugaccgccgcc

SEQ ID NO: 3523429 - RNA, 15 nt, Pseudomonas aeruginosa PA01
cccauguggcgcagc

SEQ ID NO: 3523430 - RNA, 23 nt, Pseudomonas aeruginosa PA01
cccauuacguuguaguucggcau

SEQ ID NO: 3523431 - RNA, 14 nt, Pseudomonas aeruginosa PA01
cccauucgaugccg

SEQ ID NO: 3523432 - RNA, 15 nt, Pseudomonas aeruginosa PA01
cccauucgaugccgc

SEQ ID NO: 3523433 - RNA, 19 nt, Pseudomonas aeruginosa PA01
cccauucgaugccgcgcgc

SEQ ID NO: 3523434 - RNA, 22 nt, Pseudomonas aeruginosa PA01
cccauucgaugccgcgcgccug

SEQ ID NO: 3523435 - RNA, 21 nt, Pseudomonas aeruginosa PA01
cccauugcaucugcgccggga

SEQ ID NO: 3523436 - RNA, 23 nt, Pseudomonas aeruginosa PA01
cccauugcaucugcgccgggaug

SEQ ID NO: 3523437 - RNA, 18 nt, Pseudomonas aeruginosa PA01
cccauugcccggccaggc

SEQ ID NO: 3523438 - RNA, 13 nt, Pseudomonas aeruginosa PA01
ccccaacccggcc

SEQ ID NO: 3523439 - RNA, 20 nt, Pseudomonas aeruginosa PA01
ccccaauugccguagggcga

SEQ ID NO: 3523440 - RNA, 21 nt, Pseudomonas aeruginosa PA01
ccccaauugccguagggcgaa

SEQ ID NO: 3523441 - RNA, 14 nt, Pseudomonas aeruginosa PA01
ccccacaggcccug

SEQ ID NO: 3523442 - RNA, 15 nt, Pseudomonas aeruginosa PA01
ccccacaggcccugc

SEQ ID NO: 3523443 - RNA, 12 nt, Pseudomonas aeruginosa PA01
ccccaccaggcu

SEQ ID NO: 3523444 - RNA, 14 nt, Pseudomonas aeruginosa PA01
ccccacccgucccg

SEQ ID NO: 3523445 - RNA, 19 nt, Pseudomonas aeruginosa PA01
ccccacggaggccuucgcc

SEQ ID NO: 3523446 - RNA, 13 nt, Pseudomonas aeruginosa PA01
ccccacggcgcgg

SEQ ID NO: 3523447 - RNA, 17 nt, Pseudomonas aeruginosa PA01
ccccacgggcgacccag

SEQ ID NO: 3523448 - RNA, 21 nt, Pseudomonas aeruginosa PA01
ccccacgggcgacccaggccg

SEQ ID NO: 3523449 - RNA, 22 nt, Pseudomonas aeruginosa PA01
ccccacgggcgacccaggccga

SEQ ID NO: 3523450 - RNA, 22 nt, Pseudomonas aeruginosa PA01
ccccacgguagagacggcggcg

SEQ ID NO: 3523451 - RNA, 23 nt, Pseudomonas aeruginosa PA01
ccccacgguagagacggcggcga

SEQ ID NO: 3523452 - RNA, 15 nt, Pseudomonas aeruginosa PA01
ccccacucggccagc

SEQ ID NO: 3523453 - RNA, 13 nt, Pseudomonas aeruginosa PA01
ccccacuggaaga

SEQ ID NO: 3523454 - RNA, 20 nt, Pseudomonas aeruginosa PA01
ccccacuggaagaaggcgau

SEQ ID NO: 3523455 - RNA, 17 nt, Pseudomonas aeruginosa PA01
ccccacuuccggcccgg

SEQ ID NO: 3523456 - RNA, 20 nt, Pseudomonas aeruginosa PA01
ccccagaagccccagagccc

SEQ ID NO: 3523457 - RNA, 14 nt, Pseudomonas aeruginosa PA01
ccccagacccaggu

SEQ ID NO: 3523458 - RNA, 23 nt, Pseudomonas aeruginosa PA01
ccccagacccaggugcgcaggcg

SEQ ID NO: 3523459 - RNA, 18 nt, Pseudomonas aeruginosa PA01
ccccagacccucucccug

SEQ ID NO: 3523460 - RNA, 23 nt, Pseudomonas aeruginosa PA01
ccccagaccguggauuucagcag

SEQ ID NO: 3523461 - RNA, 14 nt, Pseudomonas aeruginosa PA01
ccccagagcccgcc

SEQ ID NO: 3523462 - RNA, 18 nt, Pseudomonas aeruginosa PA01
ccccagagcccgccgaac

SEQ ID NO: 3523463 - RNA, 19 nt, Pseudomonas aeruginosa PA01
ccccagaucgccagcgcca

SEQ ID NO: 3523464 - RNA, 16 nt, Pseudomonas aeruginosa PA01
ccccagcaccucgccg

SEQ ID NO: 3523465 - RNA, 12 nt, Pseudomonas aeruginosa PA01
ccccagcaccug

SEQ ID NO: 3523466 - RNA, 12 nt, Pseudomonas aeruginosa PA01
ccccagcacgcc

SEQ ID NO: 3523467 - RNA, 20 nt, Pseudomonas aeruginosa PA01
ccccagcacgccgagcaacg

SEQ ID NO: 3523468 - RNA, 15 nt, Pseudomonas aeruginosa PA01
ccccagcaggcaggc

SEQ ID NO: 3523469 - RNA, 15 nt, Pseudomonas aeruginosa PA01
ccccagcaggccagc

SEQ ID NO: 3523470 - RNA, 22 nt, Pseudomonas aeruginosa PA01
ccccuccuggaaagaccggcgc

SEQ ID NO: 3523471 - RNA, 23 nt, Pseudomonas aeruginosa PA01
ccccucgcgcaucuggcugcgcg

SEQ ID NO: 3523472 - RNA, 18 nt, Pseudomonas aeruginosa PA01
ccccucggcuaaccgccu

SEQ ID NO: 3523473 - RNA, 16 nt, Pseudomonas aeruginosa PA01
ccccucuucggagcga

SEQ ID NO: 3523474 - RNA, 19 nt, Pseudomonas aeruginosa PA01
ccccucuucggagcgaggc

SEQ ID NO: 3523475 - RNA, 18 nt, Pseudomonas aeruginosa PA01
ccccugccgaaccgccuc

SEQ ID NO: 3523476 - RNA, 12 nt, Pseudomonas aeruginosa PA01
ccccugccgccc

SEQ ID NO: 3523477 - RNA, 11 nt, Pseudomonas aeruginosa PA01
ccccugccgcg

SEQ ID NO: 3523478 - RNA, 23 nt, Pseudomonas aeruginosa PA01
ccccugcgaccgugaggcgcagg

SEQ ID NO: 3523479 - RNA, 14 nt, Pseudomonas aeruginosa PA01
ccccugcggcccga

SEQ ID NO: 3523480 - RNA, 11 nt, Pseudomonas aeruginosa PA01
ccccugcuccu

SEQ ID NO: 3523481 - RNA, 21 nt, Pseudomonas aeruginosa PA01
ccccugcuccucgccguacag

SEQ ID NO: 3523482 - RNA, 17 nt, Pseudomonas aeruginosa PA01
ccccuggaaugccggcc

SEQ ID NO: 3523483 - RNA, 19 nt, Pseudomonas aeruginosa PA01
ccccuggaaugccggccgg

SEQ ID NO: 3523484 - RNA, 22 nt, Pseudomonas aeruginosa PA01
ccccuggccguugaccagcgcg

SEQ ID NO: 3523485 - RNA, 13 nt, Pseudomonas aeruginosa PA01
ccccuggcgcucg

SEQ ID NO: 3523486 - RNA, 14 nt, Pseudomonas aeruginosa PA01
ccccuggcgcucga

SEQ ID NO: 3523487 - RNA, 14 nt, Pseudomonas aeruginosa PA01
ccccugggccggcu

SEQ ID NO: 3523488 - RNA, 21 nt, Pseudomonas aeruginosa PA01
ccccuguggucaggcgccagg

SEQ ID NO: 3523489 - RNA, 20 nt, Pseudomonas aeruginosa PA01
ccccuuccuccucgccgcuc

SEQ ID NO: 3523490 - RNA, 23 nt, Pseudomonas aeruginosa PA01
ccccuucggcugcaacuuccacu

SEQ ID NO: 3523491 - RNA, 13 nt, Pseudomonas aeruginosa PA01
ccccuucggucgc

SEQ ID NO: 3523492 - RNA, 17 nt, Pseudomonas aeruginosa PA01
ccccuucggucgcgccc

SEQ ID NO: 3523493 - RNA, 18 nt, Pseudomonas aeruginosa PA01
ccccuucggucgcgcccc

SEQ ID NO: 3523494 - RNA, 19 nt, Pseudomonas aeruginosa PA01
ccccuucggucgcgccccg

SEQ ID NO: 3523495 - RNA, 20 nt, Pseudomonas aeruginosa PA01
ccccuuuuuucagccuguca

SEQ ID NO: 3523496 - RNA, 18 nt, Pseudomonas aeruginosa PA01
ccccuuuuuuugcgcgcc

SEQ ID NO: 3523497 - RNA, 19 nt, Pseudomonas aeruginosa PA01
cccgaaaaaaaaggccgca

SEQ ID NO: 3523498 - RNA, 14 nt, Pseudomonas aeruginosa PA01
cccgaacgccgacc

SEQ ID NO: 3523499 - RNA, 14 nt, Pseudomonas aeruginosa PA01
cccgaacgggcccu

SEQ ID NO: 3523500 - RNA, 17 nt, Pseudomonas aeruginosa PA01
cccgaagguguccgccc

SEQ ID NO: 3523501 - RNA, 15 nt, Pseudomonas aeruginosa PA01
cccgaaguagcgacg

SEQ ID NO: 3523502 - RNA, 16 nt, Pseudomonas aeruginosa PA01
cccgacaggcagcgcc

SEQ ID NO: 3523503 - RNA, 17 nt, Pseudomonas aeruginosa PA01
cccgacaggcagcgccg

SEQ ID NO: 3523504 - RNA, 19 nt, Pseudomonas aeruginosa PA01
cccgacaggcagcgccgcc

SEQ ID NO: 3523505 - RNA, 20 nt, Pseudomonas aeruginosa PA01
cccgacaggcagcgccgccc

SEQ ID NO: 3523506 - RNA, 14 nt, Pseudomonas aeruginosa PA01
cccgaccagcgcgc

SEQ ID NO: 3523507 - RNA, 18 nt, Pseudomonas aeruginosa PA01
cccgaccaggucgcuggc

SEQ ID NO: 3523508 - RNA, 19 nt, Pseudomonas aeruginosa PA01
cccgaccaggucgcuggca

SEQ ID NO: 3523509 - RNA, 16 nt, Pseudomonas aeruginosa PA01
cccgaccccacgccgg

SEQ ID NO: 3523510 - RNA, 18 nt, Pseudomonas aeruginosa PA01
cccgaccccacgccggcc

SEQ ID NO: 3523511 - RNA, 23 nt, Pseudomonas aeruginosa PA01
cccgaccccacgccggccggcuc

SEQ ID NO: 3523512 - RNA, 15 nt, Pseudomonas aeruginosa PA01
cccgaccgguuccag

SEQ ID NO: 3523513 - RNA, 19 nt, Pseudomonas aeruginosa PA01
cccgaccgguuccagcggc

SEQ ID NO: 3523514 - RNA, 12 nt, Pseudomonas aeruginosa PA01
cccgaccuucuc

SEQ ID NO: 3523515 - RNA, 18 nt, Pseudomonas aeruginosa PA01
cccgacgcccuccagcac

SEQ ID NO: 3523516 - RNA, 15 nt, Pseudomonas aeruginosa PA01
cccgacgccgcccgg

SEQ ID NO: 3523517 - RNA, 21 nt, Pseudomonas aeruginosa PA01
cccgacgccgcccggcaccgg

SEQ ID NO: 3523518 - RNA, 20 nt, Pseudomonas aeruginosa PA01
cccgacggcuugaucacgcc

SEQ ID NO: 3523519 - RNA, 22 nt, Pseudomonas aeruginosa PA01
cccgacggguuugugccguucc

SEQ ID NO: 3523520 - RNA, 14 nt, Pseudomonas aeruginosa PA01
cccgacugcagcgg

SEQ ID NO: 3523521 - RNA, 18 nt, Pseudomonas aeruginosa PA01
cccgacugucgugccucc

SEQ ID NO: 3523522 - RNA, 20 nt, Pseudomonas aeruginosa PA01
cccgacugucgugccuccag

SEQ ID NO: 3523523 - RNA, 22 nt, Pseudomonas aeruginosa PA01
cccgacugucgugccuccagcc

SEQ ID NO: 3523524 - RNA, 22 nt, Pseudomonas aeruginosa PA01
cccgagaaaacccugggaaugg

SEQ ID NO: 3523525 - RNA, 16 nt, Pseudomonas aeruginosa PA01
cccgagcaacugcucg

SEQ ID NO: 3523526 - RNA, 18 nt, Pseudomonas aeruginosa PA01
cccgagcaacugcucggg

SEQ ID NO: 3523527 - RNA, 12 nt, Pseudomonas aeruginosa PA01
cccgagccgcug

SEQ ID NO: 3523528 - RNA, 19 nt, Pseudomonas aeruginosa PA01
cccgagcggcgcgaagucg

SEQ ID NO: 3523529 - RNA, 16 nt, Pseudomonas aeruginosa PA01
cccgagcuuugcgcag

SEQ ID NO: 3523530 - RNA, 20 nt, Pseudomonas aeruginosa PA01
cccgagcuuugcgcagccac

SEQ ID NO: 3523531 - RNA, 13 nt, Pseudomonas aeruginosa PA01
cccgaggcgacgc

SEQ ID NO: 3523532 - RNA, 13 nt, Pseudomonas aeruginosa PA01
cccgagggcggca

SEQ ID NO: 3523533 - RNA, 15 nt, Pseudomonas aeruginosa PA01
cccgagggcggcagg

SEQ ID NO: 3523534 - RNA, 14 nt, Pseudomonas aeruginosa PA01
cccgaggugucgcc

SEQ ID NO: 3523535 - RNA, 16 nt, Pseudomonas aeruginosa PA01
cccgaggugucgccgc

SEQ ID NO: 3523536 - RNA, 16 nt, Pseudomonas aeruginosa PA01
cccgaguaggcgcugc

SEQ ID NO: 3523537 - RNA, 22 nt, Pseudomonas aeruginosa PA01
cccgagucccuugcggcagacg

SEQ ID NO: 3523538 - RNA, 18 nt, Pseudomonas aeruginosa PA01
cccgagugccggcgcguc

SEQ ID NO: 3523539 - RNA, 14 nt, Pseudomonas aeruginosa PA01
cccgagugcgccca

SEQ ID NO: 3523540 - RNA, 15 nt, Pseudomonas aeruginosa PA01
cccgagugcgcccag

SEQ ID NO: 3523541 - RNA, 20 nt, Pseudomonas aeruginosa PA01
cccgagugcgcccagcagca

SEQ ID NO: 3523542 - RNA, 21 nt, Pseudomonas aeruginosa PA01
cccgagugcgcccagcagcag

SEQ ID NO: 3523543 - RNA, 22 nt, Pseudomonas aeruginosa PA01
cccgagugcgcccagcagcagg

SEQ ID NO: 3523544 - RNA, 12 nt, Pseudomonas aeruginosa PA01
cccgauaggcgc

SEQ ID NO: 3523545 - RNA, 17 nt, Pseudomonas aeruginosa PA01
cccgauaggcgccggcg

SEQ ID NO: 3523546 - RNA, 13 nt, Pseudomonas aeruginosa PA01
cccgaucaccgga

SEQ ID NO: 3523547 - RNA, 14 nt, Pseudomonas aeruginosa PA01
cccgauuccgcgca

SEQ ID NO: 3523548 - RNA, 13 nt, Pseudomonas aeruginosa PA01
cccgcaaccgcag

SEQ ID NO: 3523549 - RNA, 14 nt, Pseudomonas aeruginosa PA01
cccgcaaccgcaga

SEQ ID NO: 3523550 - RNA, 21 nt, Pseudomonas aeruginosa PA01
cccgcaaccgcagacuccggc

SEQ ID NO: 3523551 - RNA, 15 nt, Pseudomonas aeruginosa PA01
cccgcaaccgcugcc

SEQ ID NO: 3523552 - RNA, 17 nt, Pseudomonas aeruginosa PA01
cccgcaaccgcugccgc

SEQ ID NO: 3523553 - RNA, 20 nt, Pseudomonas aeruginosa PA01
cccgcaaccgcugccgccgu

SEQ ID NO: 3523554 - RNA, 21 nt, Pseudomonas aeruginosa PA01
cccgcaaccgcugccgccguc

SEQ ID NO: 3523555 - RNA, 23 nt, Pseudomonas aeruginosa PA01
cccgcaaggugcgggccgucguu

SEQ ID NO: 3523556 - RNA, 16 nt, Pseudomonas aeruginosa PA01
cccgcaauccgaccgg

SEQ ID NO: 3523557 - RNA, 19 nt, Pseudomonas aeruginosa PA01
cccgcaccacccgcugcaa

SEQ ID NO: 3523558 - RNA, 14 nt, Pseudomonas aeruginosa PA01
cccgcaccacuauc

SEQ ID NO: 3523559 - RNA, 14 nt, Pseudomonas aeruginosa PA01
cccgcaccagccgg

SEQ ID NO: 3523560 - RNA, 16 nt, Pseudomonas aeruginosa PA01
cccgcaccagccggcg

SEQ ID NO: 3523561 - RNA, 18 nt, Pseudomonas aeruginosa PA01
cccgcaccagccggcgcu

SEQ ID NO: 3523562 - RNA, 18 nt, Pseudomonas aeruginosa PA01
cccgcaccggcgcgccgg

SEQ ID NO: 3523563 - RNA, 16 nt, Pseudomonas aeruginosa PA01
cccgcaccuugcccug

SEQ ID NO: 3523564 - RNA, 14 nt, Pseudomonas aeruginosa PA01
cccgcacgaggcgg

SEQ ID NO: 3523565 - RNA, 17 nt, Pseudomonas aeruginosa PA01
cccgcagaucuuccccg

SEQ ID NO: 3523566 - RNA, 23 nt, Pseudomonas aeruginosa PA01
cccgcagaucuuccccguugccg

SEQ ID NO: 3523567 - RNA, 19 nt, Pseudomonas aeruginosa PA01
cccgcagccacggcacacg

SEQ ID NO: 3523568 - RNA, 14 nt, Pseudomonas aeruginosa PA01
cccgcagccccgcc

SEQ ID NO: 3523569 - RNA, 23 nt, Pseudomonas aeruginosa PA01
cccgcagccgcgugcgcgccgcc

SEQ ID NO: 3523570 - RNA, 19 nt, Pseudomonas aeruginosa PA01
cccgcagcgaucagcacca

SEQ ID NO: 3523571 - RNA, 12 nt, Pseudomonas aeruginosa PA01
cccgcagcggca

SEQ ID NO: 3523572 - RNA, 13 nt, Pseudomonas aeruginosa PA01
cccgcagcggcag

SEQ ID NO: 3523573 - RNA, 18 nt, Pseudomonas aeruginosa PA01
cccgcgccuucaguucgu

SEQ ID NO: 3523574 - RNA, 16 nt, Pseudomonas aeruginosa PA01
cccgcgcgacagcucu

SEQ ID NO: 3523575 - RNA, 17 nt, Pseudomonas aeruginosa PA01
cccgcgcgacagcucug

SEQ ID NO: 3523576 - RNA, 13 nt, Pseudomonas aeruginosa PA01
cccgcgcgccgag

SEQ ID NO: 3523577 - RNA, 14 nt, Pseudomonas aeruginosa PA01
cccgcgcgccgagc

SEQ ID NO: 3523578 - RNA, 13 nt, Pseudomonas aeruginosa PA01
cccgcgcggcaac

SEQ ID NO: 3523579 - RNA, 12 nt, Pseudomonas aeruginosa PA01
cccgcgcucggc

SEQ ID NO: 3523580 - RNA, 13 nt, Pseudomonas aeruginosa PA01
cccgcgcucggcc

SEQ ID NO: 3523581 - RNA, 17 nt, Pseudomonas aeruginosa PA01
cccgcgcucggccgccu

SEQ ID NO: 3523582 - RNA, 17 nt, Pseudomonas aeruginosa PA01
cccgcggaucgcgccgu

SEQ ID NO: 3523583 - RNA, 18 nt, Pseudomonas aeruginosa PA01
cccgcggcaucggccugg

SEQ ID NO: 3523584 - RNA, 15 nt, Pseudomonas aeruginosa PA01
cccgcggcgagcagc

SEQ ID NO: 3523585 - RNA, 21 nt, Pseudomonas aeruginosa PA01
cccgcgguauucuccagcagg

SEQ ID NO: 3523586 - RNA, 16 nt, Pseudomonas aeruginosa PA01
cccgcggucacucggc

SEQ ID NO: 3523587 - RNA, 21 nt, Pseudomonas aeruginosa PA01
cccgcgucccuugcggguacg

SEQ ID NO: 3523588 - RNA, 12 nt, Pseudomonas aeruginosa PA01
cccgcguccucc

SEQ ID NO: 3523589 - RNA, 14 nt, Pseudomonas aeruginosa PA01
cccgcgucgcgcgc

SEQ ID NO: 3523590 - RNA, 18 nt, Pseudomonas aeruginosa PA01
cccgcgucgcgcgcggca

SEQ ID NO: 3523591 - RNA, 18 nt, Pseudomonas aeruginosa PA01
cccgcguguucgaccggg

SEQ ID NO: 3523592 - RNA, 20 nt, Pseudomonas aeruginosa PA01
cccgcguguucgaccggguu

SEQ ID NO: 3523593 - RNA, 19 nt, Pseudomonas aeruginosa PA01
cccgcuacccugccccagc

SEQ ID NO: 3523594 - RNA, 21 nt, Pseudomonas aeruginosa PA01
cccgcucaugagauccgccag

SEQ ID NO: 3523595 - RNA, 13 nt, Pseudomonas aeruginosa PA01
cccgcuccagccg

SEQ ID NO: 3523596 - RNA, 15 nt, Pseudomonas aeruginosa PA01
cccgcuccagccggc

SEQ ID NO: 3523597 - RNA, 17 nt, Pseudomonas aeruginosa PA01
cccgcuccagccggcaa

SEQ ID NO: 3523598 - RNA, 16 nt, Pseudomonas aeruginosa PA01
cccgcucccgcggccc

SEQ ID NO: 3523599 - RNA, 17 nt, Pseudomonas aeruginosa PA01
cccgcuccgcggccggc

SEQ ID NO: 3523600 - RNA, 15 nt, Pseudomonas aeruginosa PA01
cccgcuccgucgcuu

SEQ ID NO: 3523601 - RNA, 24 nt, Pseudomonas aeruginosa PA01
cccgcuccgucgcuucgcccgccg

SEQ ID NO: 3523602 - RNA, 16 nt, Pseudomonas aeruginosa PA01
cccgcucgaggguguc

SEQ ID NO: 3523603 - RNA, 15 nt, Pseudomonas aeruginosa PA01
cccgcugcaccagcu

SEQ ID NO: 3523604 - RNA, 21 nt, Pseudomonas aeruginosa PA01
cccgcugcgcugccagcgccg

SEQ ID NO: 3523605 - RNA, 13 nt, Pseudomonas aeruginosa PA01
cccgcuggcccaa

SEQ ID NO: 3523606 - RNA, 13 nt, Pseudomonas aeruginosa PA01
cccgcuguccgcc

SEQ ID NO: 3523607 - RNA, 17 nt, Pseudomonas aeruginosa PA01
cccgcuguccgccggcc

SEQ ID NO: 3523608 - RNA, 15 nt, Pseudomonas aeruginosa PA01
cccgcuucgagcggg

SEQ ID NO: 3523609 - RNA, 16 nt, Pseudomonas aeruginosa PA01
cccgcuucggcccgcu

SEQ ID NO: 3523610 - RNA, 21 nt, Pseudomonas aeruginosa PA01
cccgcuucgucggucgcgacg

SEQ ID NO: 3523611 - RNA, 19 nt, Pseudomonas aeruginosa PA01
cccgcuugccgucgaccug

SEQ ID NO: 3523612 - RNA, 13 nt, Pseudomonas aeruginosa PA01
cccgcuugcgccg

SEQ ID NO: 3523613 - RNA, 15 nt, Pseudomonas aeruginosa PA01
cccgcuugcgccgcc

SEQ ID NO: 3523614 - RNA, 16 nt, Pseudomonas aeruginosa PA01
cccgcuugcgccgccu

SEQ ID NO: 3523615 - RNA, 23 nt, Pseudomonas aeruginosa PA01
cccgcuugcgccgccucgcgcaa

SEQ ID NO: 3523616 - RNA, 15 nt, Pseudomonas aeruginosa PA01
cccgcuuuccccggc

SEQ ID NO: 3523617 - RNA, 13 nt, Pseudomonas aeruginosa PA01
cccggaaugcaaa

SEQ ID NO: 3523618 - RNA, 22 nt, Pseudomonas aeruginosa PA01
cccggaaugcaaaaagcccacu

SEQ ID NO: 3523619 - RNA, 14 nt, Pseudomonas aeruginosa PA01
cccggacagccuuc

SEQ ID NO: 3523620 - RNA, 14 nt, Pseudomonas aeruginosa PA01
cccggaccagggcg

SEQ ID NO: 3523621 - RNA, 20 nt, Pseudomonas aeruginosa PA01
cccggaccagggcgccgggc

SEQ ID NO: 3523622 - RNA, 22 nt, Pseudomonas aeruginosa PA01
cccggaccggcucucuucggcc

SEQ ID NO: 3523623 - RNA, 15 nt, Pseudomonas aeruginosa PA01
cccggaccugggcac

SEQ ID NO: 3523624 - RNA, 19 nt, Pseudomonas aeruginosa PA01
cccggaccugggcaccagu

SEQ ID NO: 3523625 - RNA, 18 nt, Pseudomonas aeruginosa PA01
cccggaccuuguccaggg

SEQ ID NO: 3523626 - RNA, 17 nt, Pseudomonas aeruginosa PA01
cccggacgacgaaagaa

SEQ ID NO: 3523627 - RNA, 22 nt, Pseudomonas aeruginosa PA01
cccggacgggugcgcgccaccu

SEQ ID NO: 3523628 - RNA, 17 nt, Pseudomonas aeruginosa PA01
cccggacugcccgacga

SEQ ID NO: 3523629 - RNA, 17 nt, Pseudomonas aeruginosa PA01
cccggagaccgugccgc

SEQ ID NO: 3523630 - RNA, 19 nt, Pseudomonas aeruginosa PA01
cccggagaccgugccgccg

SEQ ID NO: 3523631 - RNA, 20 nt, Pseudomonas aeruginosa PA01
cccggagaccgugccgccgg

SEQ ID NO: 3523632 - RNA, 19 nt, Pseudomonas aeruginosa PA01
cccggagaucgccgcgccg

SEQ ID NO: 3523633 - RNA, 21 nt, Pseudomonas aeruginosa PA01
cccggagaucggcugcaacgc

SEQ ID NO: 3523634 - RNA, 12 nt, Pseudomonas aeruginosa PA01
cccggagccaac

SEQ ID NO: 3523635 - RNA, 14 nt, Pseudomonas aeruginosa PA01
cccggagccaacgc

SEQ ID NO: 3523636 - RNA, 20 nt, Pseudomonas aeruginosa PA01
cccggagccaacgcccgggc

SEQ ID NO: 3523637 - RNA, 12 nt, Pseudomonas aeruginosa PA01
cccggagccguu

SEQ ID NO: 3523638 - RNA, 20 nt, Pseudomonas aeruginosa PA01
cccggagcgcgaaagcgccc

SEQ ID NO: 3523639 - RNA, 22 nt, Pseudomonas aeruginosa PA01
cccggagcgcgaaagcgccccg

SEQ ID NO: 3523640 - RNA, 14 nt, Pseudomonas aeruginosa PA01
cccggagcggcugc

SEQ ID NO: 3523641 - RNA, 18 nt, Pseudomonas aeruginosa PA01
cccggagcggcugccgag

SEQ ID NO: 3523642 - RNA, 12 nt, Pseudomonas aeruginosa PA01
cccggaggcggc

SEQ ID NO: 3523643 - RNA, 14 nt, Pseudomonas aeruginosa PA01
cccggaggcggcga

SEQ ID NO: 3523644 - RNA, 15 nt, Pseudomonas aeruginosa PA01
cccggaggcggcgag

SEQ ID NO: 3523645 - RNA, 20 nt, Pseudomonas aeruginosa PA01
cccggagugugucggggccg

SEQ ID NO: 3523646 - RNA, 16 nt, Pseudomonas aeruginosa PA01
cccggaguuccagcgg

SEQ ID NO: 3523647 - RNA, 17 nt, Pseudomonas aeruginosa PA01
cccggauaccccgguug

SEQ ID NO: 3523648 - RNA, 19 nt, Pseudomonas aeruginosa PA01
cccggaucagcucgcguag

SEQ ID NO: 3523649 - RNA, 14 nt, Pseudomonas aeruginosa PA01
cccggauucgccga

SEQ ID NO: 3523650 - RNA, 19 nt, Pseudomonas aeruginosa PA01
cccggcaagcgccggcaac

SEQ ID NO: 3523651 - RNA, 16 nt, Pseudomonas aeruginosa PA01
cccggcaagggccugc

SEQ ID NO: 3523652 - RNA, 21 nt, Pseudomonas aeruginosa PA01
cccggcaagggccugcucagc

SEQ ID NO: 3523653 - RNA, 15 nt, Pseudomonas aeruginosa PA01
cccggcaauagccgg

SEQ ID NO: 3523654 - RNA, 16 nt, Pseudomonas aeruginosa PA01
cccggcaauagccggg

SEQ ID NO: 3523655 - RNA, 22 nt, Pseudomonas aeruginosa PA01
cccggcaauagccgggcuuuuu

SEQ ID NO: 3523656 - RNA, 19 nt, Pseudomonas aeruginosa PA01
cccggcaaucaggcgcgau

SEQ ID NO: 3523657 - RNA, 13 nt, Pseudomonas aeruginosa PA01
cccggcaccaggc

SEQ ID NO: 3523658 - RNA, 15 nt, Pseudomonas aeruginosa PA01
cccggcacucgccgg

SEQ ID NO: 3523659 - RNA, 16 nt, Pseudomonas aeruginosa PA01
cccggcacucgccggg

SEQ ID NO: 3523660 - RNA, 16 nt, Pseudomonas aeruginosa PA01
cccggcagcaggccgc

SEQ ID NO: 3523661 - RNA, 20 nt, Pseudomonas aeruginosa PA01
cccggcagcucccuugccgc

SEQ ID NO: 3523662 - RNA, 18 nt, Pseudomonas aeruginosa PA01
cccggcaggcaggccugg

SEQ ID NO: 3523663 - RNA, 21 nt, Pseudomonas aeruginosa PA01
cccggcaggcaggccugggca

SEQ ID NO: 3523664 - RNA, 19 nt, Pseudomonas aeruginosa PA01
cccggcaggcagugccggg

SEQ ID NO: 3523665 - RNA, 14 nt, Pseudomonas aeruginosa PA01
cccggcaggcgcac

SEQ ID NO: 3523666 - RNA, 17 nt, Pseudomonas aeruginosa PA01
cccggcaggcgcacgcg

SEQ ID NO: 3523667 - RNA, 21 nt, Pseudomonas aeruginosa PA01
cccggcaggcgcacgcgcagu

SEQ ID NO: 3523668 - RNA, 15 nt, Pseudomonas aeruginosa PA01
cccggcauaggcgcc

SEQ ID NO: 3523669 - RNA, 16 nt, Pseudomonas aeruginosa PA01
cccggcauaggcgcca

SEQ ID NO: 3523670 - RNA, 18 nt, Pseudomonas aeruginosa PA01
cccggcaucgugccgcgg

SEQ ID NO: 3523671 - RNA, 15 nt, Pseudomonas aeruginosa PA01
cccggcaucugccgg

SEQ ID NO: 3523672 - RNA, 17 nt, Pseudomonas aeruginosa PA01
cccggcaucugccgggc

SEQ ID NO: 3523673 - RNA, 13 nt, Pseudomonas aeruginosa PA01
cccggcauucgcc

SEQ ID NO: 3523674 - RNA, 13 nt, Pseudomonas aeruginosa PA01
cccggccagcagc

SEQ ID NO: 3523675 - RNA, 17 nt, Pseudomonas aeruginosa PA01
cccggccagcagcgccu

SEQ ID NO: 3523676 - RNA, 16 nt, Pseudomonas aeruginosa PA01
cccggcguuucgccgg

SEQ ID NO: 3523677 - RNA, 18 nt, Pseudomonas aeruginosa PA01
cccggcguuucgccgggc

SEQ ID NO: 3523678 - RNA, 20 nt, Pseudomonas aeruginosa PA01
cccggcguuucgccgggccu

SEQ ID NO: 3523679 - RNA, 15 nt, Pseudomonas aeruginosa PA01
cccggcuccagccgg

SEQ ID NO: 3523680 - RNA, 23 nt, Pseudomonas aeruginosa PA01
cccggcuccagccgggcuccgcc

SEQ ID NO: 3523681 - RNA, 20 nt, Pseudomonas aeruginosa PA01
cccggcucgcccaugcgcgg

SEQ ID NO: 3523682 - RNA, 12 nt, Pseudomonas aeruginosa PA01
cccggcucgccg

SEQ ID NO: 3523683 - RNA, 16 nt, Pseudomonas aeruginosa PA01
cccggcucgccgccgg

SEQ ID NO: 3523684 - RNA, 18 nt, Pseudomonas aeruginosa PA01
cccggcucgccgccgggc

SEQ ID NO: 3523685 - RNA, 20 nt, Pseudomonas aeruginosa PA01
cccggcucgccgccgggcgc

SEQ ID NO: 3523686 - RNA, 13 nt, Pseudomonas aeruginosa PA01
cccggcuggccau

SEQ ID NO: 3523687 - RNA, 17 nt, Pseudomonas aeruginosa PA01
cccggcuggcguaccuc

SEQ ID NO: 3523688 - RNA, 20 nt, Pseudomonas aeruginosa PA01
cccggcuggcguaccucgcc

SEQ ID NO: 3523689 - RNA, 22 nt, Pseudomonas aeruginosa PA01
cccggcuggcguaccucgccag

SEQ ID NO: 3523690 - RNA, 20 nt, Pseudomonas aeruginosa PA01
cccggcugguugccagcagc

SEQ ID NO: 3523691 - RNA, 20 nt, Pseudomonas aeruginosa PA01
cccggcugugcucgacgggc

SEQ ID NO: 3523692 - RNA, 22 nt, Pseudomonas aeruginosa PA01
cccggcugugcucgacgggcgc

SEQ ID NO: 3523693 - RNA, 22 nt, Pseudomonas aeruginosa PA01
cccggcuucgcgggugaccugg

SEQ ID NO: 3523694 - RNA, 14 nt, Pseudomonas aeruginosa PA01
cccggcuucgcugg

SEQ ID NO: 3523695 - RNA, 17 nt, Pseudomonas aeruginosa PA01
cccggcuucgcuggugc

SEQ ID NO: 3523696 - RNA, 14 nt, Pseudomonas aeruginosa PA01
cccggcuugccggc

SEQ ID NO: 3523697 - RNA, 18 nt, Pseudomonas aeruginosa PA01
cccggcuugccggcagcg

SEQ ID NO: 3523698 - RNA, 20 nt, Pseudomonas aeruginosa PA01
cccggcuugccggcagcgac

SEQ ID NO: 3523699 - RNA, 13 nt, Pseudomonas aeruginosa PA01
cccggcuugcuga

SEQ ID NO: 3523700 - RNA, 18 nt, Pseudomonas aeruginosa PA01
cccggcuugcugacgaug

SEQ ID NO: 3523701 - RNA, 18 nt, Pseudomonas aeruginosa PA01
cccggcuuggcgggcucg

SEQ ID NO: 3523702 - RNA, 20 nt, Pseudomonas aeruginosa PA01
cccggcuuggcgggcucgcc

SEQ ID NO: 3523703 - RNA, 16 nt, Pseudomonas aeruginosa PA01
cccggcuuuccucggc

SEQ ID NO: 3523704 - RNA, 18 nt, Pseudomonas aeruginosa PA01
cccggcuuuccucggcca

SEQ ID NO: 3523705 - RNA, 20 nt, Pseudomonas aeruginosa PA01
cccggcuuuccucggccaug

SEQ ID NO: 3523706 - RNA, 23 nt, Pseudomonas aeruginosa PA01
cccggcuuuuuucgcccgugccg

SEQ ID NO: 3523707 - RNA, 24 nt, Pseudomonas aeruginosa PA01
cccggcuuuuuucgcccgugccga

SEQ ID NO: 3523708 - RNA, 16 nt, Pseudomonas aeruginosa PA01
cccgggaaaccaccag

SEQ ID NO: 3523709 - RNA, 20 nt, Pseudomonas aeruginosa PA01
cccgggaaaccaccaggaag

SEQ ID NO: 3523710 - RNA, 22 nt, Pseudomonas aeruginosa PA01
cccgggaucgaugcgcgcccug

SEQ ID NO: 3523711 - RNA, 15 nt, Pseudomonas aeruginosa PA01
cccgggaugcccggc

SEQ ID NO: 3523712 - RNA, 19 nt, Pseudomonas aeruginosa PA01
cccgggaugcccggccgca

SEQ ID NO: 3523713 - RNA, 17 nt, Pseudomonas aeruginosa PA01
cccgggcccaagccgag

SEQ ID NO: 3523714 - RNA, 14 nt, Pseudomonas aeruginosa PA01
cccgggccgcgcac

SEQ ID NO: 3523715 - RNA, 17 nt, Pseudomonas aeruginosa PA01
cccgggccuccuggcgg

SEQ ID NO: 3523716 - RNA, 21 nt, Pseudomonas aeruginosa PA01
cccgggccuccuggcggcgug

SEQ ID NO: 3523717 - RNA, 14 nt, Pseudomonas aeruginosa PA01
cccgggcgaccugc

SEQ ID NO: 3523718 - RNA, 15 nt, Pseudomonas aeruginosa PA01
cccgggcgaccugcu

SEQ ID NO: 3523719 - RNA, 21 nt, Pseudomonas aeruginosa PA01
cccgggcgaccugcucgcgca

SEQ ID NO: 3523720 - RNA, 22 nt, Pseudomonas aeruginosa PA01
cccgggcgaccugcucgcgcac

SEQ ID NO: 3523721 - RNA, 12 nt, Pseudomonas aeruginosa PA01
cccgggcgccac

SEQ ID NO: 3523722 - RNA, 14 nt, Pseudomonas aeruginosa PA01
cccgggcgccaccg

SEQ ID NO: 3523723 - RNA, 15 nt, Pseudomonas aeruginosa PA01
cccgggcgccaccgc

SEQ ID NO: 3523724 - RNA, 17 nt, Pseudomonas aeruginosa PA01
cccgggcgccaccgcgu

SEQ ID NO: 3523725 - RNA, 16 nt, Pseudomonas aeruginosa PA01
cccggggagggugccg

SEQ ID NO: 3523726 - RNA, 13 nt, Pseudomonas aeruginosa PA01
cccggggcucugc

SEQ ID NO: 3523727 - RNA, 18 nt, Pseudomonas aeruginosa PA01
cccgggguugcccagcag

SEQ ID NO: 3523728 - RNA, 19 nt, Pseudomonas aeruginosa PA01
cccgggguugcccagcagg

SEQ ID NO: 3523729 - RNA, 21 nt, Pseudomonas aeruginosa PA01
cccgggguuggcgcugaccag

SEQ ID NO: 3523730 - RNA, 17 nt, Pseudomonas aeruginosa PA01
cccgggucaggccgaga

SEQ ID NO: 3523731 - RNA, 15 nt, Pseudomonas aeruginosa PA01
cccgggucgcgcagc

SEQ ID NO: 3523732 - RNA, 19 nt, Pseudomonas aeruginosa PA01
cccgggucgcgcagcggcu

SEQ ID NO: 3523733 - RNA, 22 nt, Pseudomonas aeruginosa PA01
cccgggucgcugcucagggccg

SEQ ID NO: 3523734 - RNA, 21 nt, Pseudomonas aeruginosa PA01
cccggguggauaucgucggga

SEQ ID NO: 3523735 - RNA, 22 nt, Pseudomonas aeruginosa PA01
cccggguguccuuugccugaug

SEQ ID NO: 3523736 - RNA, 16 nt, Pseudomonas aeruginosa PA01
cccggguucugcucga

SEQ ID NO: 3523737 - RNA, 20 nt, Pseudomonas aeruginosa PA01
cccggguucugcucgaacau

SEQ ID NO: 3523738 - RNA, 22 nt, Pseudomonas aeruginosa PA01
cccggguugagguagagcacgc

SEQ ID NO: 3523739 - RNA, 24 nt, Pseudomonas aeruginosa PA01
cccggguugagguagagcacgccg

SEQ ID NO: 3523740 - RNA, 21 nt, Pseudomonas aeruginosa PA01
cccggguugccguagcgaugc

SEQ ID NO: 3523741 - RNA, 16 nt, Pseudomonas aeruginosa PA01
cccggguuuccugccc

SEQ ID NO: 3523742 - RNA, 15 nt, Pseudomonas aeruginosa PA01
cccgguacagcgccu

SEQ ID NO: 3523743 - RNA, 16 nt, Pseudomonas aeruginosa PA01
cccgguacagcgccug

SEQ ID NO: 3523744 - RNA, 19 nt, Pseudomonas aeruginosa PA01
cccgguacagcgccugguc

SEQ ID NO: 3523745 - RNA, 18 nt, Pseudomonas aeruginosa PA01
cccgguacuccuccagca

SEQ ID NO: 3523746 - RNA, 18 nt, Pseudomonas aeruginosa PA01
cccgguagacgccuccca

SEQ ID NO: 3523747 - RNA, 16 nt, Pseudomonas aeruginosa PA01
cccgguauucagccag

SEQ ID NO: 3523748 - RNA, 15 nt, Pseudomonas aeruginosa PA01
cccggucaccaccca

SEQ ID NO: 3523749 - RNA, 16 nt, Pseudomonas aeruginosa PA01
cccggucaccacccag

SEQ ID NO: 3523750 - RNA, 19 nt, Pseudomonas aeruginosa PA01
cccggucagcuucgccgcc

SEQ ID NO: 3523751 - RNA, 21 nt, Pseudomonas aeruginosa PA01
cccggucagcuucgccgcccu

SEQ ID NO: 3523752 - RNA, 23 nt, Pseudomonas aeruginosa PA01
cccggucagcuucgccgcccugg

SEQ ID NO: 3523753 - RNA, 16 nt, Pseudomonas aeruginosa PA01
cccggucauggugccg

SEQ ID NO: 3523754 - RNA, 17 nt, Pseudomonas aeruginosa PA01
cccgguccguccagcgc

SEQ ID NO: 3523755 - RNA, 18 nt, Pseudomonas aeruginosa PA01
cccgguccguccagcgcg

SEQ ID NO: 3523756 - RNA, 19 nt, Pseudomonas aeruginosa PA01
cccgguccguccagcgcgc

SEQ ID NO: 3523757 - RNA, 21 nt, Pseudomonas aeruginosa PA01
cccgguccguccagcgcgccc

SEQ ID NO: 3523758 - RNA, 15 nt, Pseudomonas aeruginosa PA01
cccgguccugcaacu

SEQ ID NO: 3523759 - RNA, 16 nt, Pseudomonas aeruginosa PA01
cccggucgagguugcg

SEQ ID NO: 3523760 - RNA, 19 nt, Pseudomonas aeruginosa PA01
cccggucgagguugcgcgg

SEQ ID NO: 3523761 - RNA, 21 nt, Pseudomonas aeruginosa PA01
cccggucgagguugcgcggca

SEQ ID NO: 3523762 - RNA, 13 nt, Pseudomonas aeruginosa PA01
cccggucgcgcug

SEQ ID NO: 3523763 - RNA, 16 nt, Pseudomonas aeruginosa PA01
cccggucuagcgcccc

SEQ ID NO: 3523764 - RNA, 17 nt, Pseudomonas aeruginosa PA01
cccggucuagcgccccg

SEQ ID NO: 3523765 - RNA, 22 nt, Pseudomonas aeruginosa PA01
cccggucuagcgccccggccgc

SEQ ID NO: 3523766 - RNA, 14 nt, Pseudomonas aeruginosa PA01
cccggucucagccg

SEQ ID NO: 3523767 - RNA, 17 nt, Pseudomonas aeruginosa PA01
cccggucucagccggcg

SEQ ID NO: 3523768 - RNA, 20 nt, Pseudomonas aeruginosa PA01
cccgguggaauaccgcugcg

SEQ ID NO: 3523769 - RNA, 22 nt, Pseudomonas aeruginosa PA01
cccgguggaauaccgcugcgcg

SEQ ID NO: 3523770 - RNA, 14 nt, Pseudomonas aeruginosa PA01
cccggugucgacga

SEQ ID NO: 3523771 - RNA, 17 nt, Pseudomonas aeruginosa PA01
cccggugucgacgacga

SEQ ID NO: 3523772 - RNA, 16 nt, Pseudomonas aeruginosa PA01
cccgguuaccggcgac

SEQ ID NO: 3523773 - RNA, 21 nt, Pseudomonas aeruginosa PA01
cccgguuaccggcgaccaccg

SEQ ID NO: 3523774 - RNA, 17 nt, Pseudomonas aeruginosa PA01
cccgguuacucgccggc

SEQ ID NO: 3523775 - RNA, 18 nt, Pseudomonas aeruginosa PA01
cccgguucucgccccagc

SEQ ID NO: 3523776 - RNA, 14 nt, Pseudomonas aeruginosa PA01
cccgguugaccccg

SEQ ID NO: 3523777 - RNA, 15 nt, Pseudomonas aeruginosa PA01
cccgguugaccccgc

SEQ ID NO: 3523778 - RNA, 15 nt, Pseudomonas aeruginosa PA01
cccucgcagccggcg

SEQ ID NO: 3523779 - RNA, 16 nt, Pseudomonas aeruginosa PA01
cccucgcagccggcgg

SEQ ID NO: 3523780 - RNA, 23 nt, Pseudomonas aeruginosa PA01
cccucgcaguacagcucggcgcc

SEQ ID NO: 3523781 - RNA, 14 nt, Pseudomonas aeruginosa PA01
cccucgcggcggca

SEQ ID NO: 3523782 - RNA, 22 nt, Pseudomonas aeruginosa PA01
cccucgcggcggcaggccagcu

SEQ ID NO: 3523783 - RNA, 16 nt, Pseudomonas aeruginosa PA01
cccucgcuccaacgca

SEQ ID NO: 3523784 - RNA, 21 nt, Pseudomonas aeruginosa PA01
cccucgcuccaacgcaggcgc

SEQ ID NO: 3523785 - RNA, 19 nt, Pseudomonas aeruginosa PA01
cccucggaugccgcacagg

SEQ ID NO: 3523786 - RNA, 17 nt, Pseudomonas aeruginosa PA01
cccucggccaggaccag

SEQ ID NO: 3523787 - RNA, 15 nt, Pseudomonas aeruginosa PA01
cccucggccaggcau

SEQ ID NO: 3523788 - RNA, 22 nt, Pseudomonas aeruginosa PA01
cccucggcccggagccaacgcc

SEQ ID NO: 3523789 - RNA, 12 nt, Pseudomonas aeruginosa PA01
cccucggcgacg

SEQ ID NO: 3523790 - RNA, 18 nt, Pseudomonas aeruginosa PA01
cccucggcgcccgccugc

SEQ ID NO: 3523791 - RNA, 17 nt, Pseudomonas aeruginosa PA01
cccucggcgccgagcau

SEQ ID NO: 3523792 - RNA, 12 nt, Pseudomonas aeruginosa PA01
cccucggcggcg

SEQ ID NO: 3523793 - RNA, 13 nt, Pseudomonas aeruginosa PA01
cccucggcggcga

SEQ ID NO: 3523794 - RNA, 14 nt, Pseudomonas aeruginosa PA01
cccucggcggcgag

SEQ ID NO: 3523795 - RNA, 13 nt, Pseudomonas aeruginosa PA01
cccucggcguuca

SEQ ID NO: 3523796 - RNA, 15 nt, Pseudomonas aeruginosa PA01
cccucgggccgcagg

SEQ ID NO: 3523797 - RNA, 19 nt, Pseudomonas aeruginosa PA01
cccucggugauaccgccgg

SEQ ID NO: 3523798 - RNA, 20 nt, Pseudomonas aeruginosa PA01
cccucggugauaccgccggc

SEQ ID NO: 3523799 - RNA, 18 nt, Pseudomonas aeruginosa PA01
cccucggugcggccgagg

SEQ ID NO: 3523800 - RNA, 19 nt, Pseudomonas aeruginosa PA01
cccucggugcggccgagga

SEQ ID NO: 3523801 - RNA, 19 nt, Pseudomonas aeruginosa PA01
cccucguugauuccgccgg

SEQ ID NO: 3523802 - RNA, 20 nt, Pseudomonas aeruginosa PA01
cccucguugauuccgccgga

SEQ ID NO: 3523803 - RNA, 20 nt, Pseudomonas aeruginosa PA01
cccucuaucacacuguccag

SEQ ID NO: 3523804 - RNA, 18 nt, Pseudomonas aeruginosa PA01
cccucucaggagcgccgc

SEQ ID NO: 3523805 - RNA, 11 nt, Pseudomonas aeruginosa PA01
cccucucccca

SEQ ID NO: 3523806 - RNA, 14 nt, Pseudomonas aeruginosa PA01
cccucucucgccuc

SEQ ID NO: 3523807 - RNA, 20 nt, Pseudomonas aeruginosa PA01
cccucucucgccucggcggg

SEQ ID NO: 3523808 - RNA, 14 nt, Pseudomonas aeruginosa PA01
cccugacccgcacc

SEQ ID NO: 3523809 - RNA, 19 nt, Pseudomonas aeruginosa PA01
cccugacccgcaccggcau

SEQ ID NO: 3523810 - RNA, 15 nt, Pseudomonas aeruginosa PA01
cccugcaaagcggcg

SEQ ID NO: 3523811 - RNA, 18 nt, Pseudomonas aeruginosa PA01
cccugcaaagcggcgacg

SEQ ID NO: 3523812 - RNA, 20 nt, Pseudomonas aeruginosa PA01
cccugcaaagcggcgacgcc

SEQ ID NO: 3523813 - RNA, 13 nt, Pseudomonas aeruginosa PA01
cccugcaacacgu

SEQ ID NO: 3523814 - RNA, 18 nt, Pseudomonas aeruginosa PA01
cccugcaacacguagcgc

SEQ ID NO: 3523815 - RNA, 15 nt, Pseudomonas aeruginosa PA01
cccugcaacaggacc

SEQ ID NO: 3523816 - RNA, 16 nt, Pseudomonas aeruginosa PA01
cccugcacagggacgc

SEQ ID NO: 3523817 - RNA, 20 nt, Pseudomonas aeruginosa PA01
cccugcacagggacgcggcg

SEQ ID NO: 3523818 - RNA, 21 nt, Pseudomonas aeruginosa PA01
cccugcacaucaccuucgccc

SEQ ID NO: 3523819 - RNA, 18 nt, Pseudomonas aeruginosa PA01
cccugcacccuuggcgca

SEQ ID NO: 3523820 - RNA, 12 nt, Pseudomonas aeruginosa PA01
cccugcagcgcg

SEQ ID NO: 3523821 - RNA, 13 nt, Pseudomonas aeruginosa PA01
cccugcagcgcgc

SEQ ID NO: 3523822 - RNA, 16 nt, Pseudomonas aeruginosa PA01
cccugcagcgcgcgcu

SEQ ID NO: 3523823 - RNA, 12 nt, Pseudomonas aeruginosa PA01
cccugcaucgcg

SEQ ID NO: 3523824 - RNA, 16 nt, Pseudomonas aeruginosa PA01
cccugcaugccggccg

SEQ ID NO: 3523825 - RNA, 17 nt, Pseudomonas aeruginosa PA01
cccugcaugccggccgu

SEQ ID NO: 3523826 - RNA, 21 nt, Pseudomonas aeruginosa PA01
cccugccacuugcgggugcgc

SEQ ID NO: 3523827 - RNA, 18 nt, Pseudomonas aeruginosa PA01
cccugccagaggaucggc

SEQ ID NO: 3523828 - RNA, 12 nt, Pseudomonas aeruginosa PA01
cccugccagcgg

SEQ ID NO: 3523829 - RNA, 13 nt, Pseudomonas aeruginosa PA01
cccugccagcggg

SEQ ID NO: 3523830 - RNA, 15 nt, Pseudomonas aeruginosa PA01
cccugccagcgggcg

SEQ ID NO: 3523831 - RNA, 19 nt, Pseudomonas aeruginosa PA01
cccugccagcgggcgccgc

SEQ ID NO: 3523832 - RNA, 13 nt, Pseudomonas aeruginosa PA01
cccugcccagugg

SEQ ID NO: 3523833 - RNA, 19 nt, Pseudomonas aeruginosa PA01
cccugccccagcaucgccg

SEQ ID NO: 3523834 - RNA, 21 nt, Pseudomonas aeruginosa PA01
cccugccccagcaucgccggc

SEQ ID NO: 3523835 - RNA, 23 nt, Pseudomonas aeruginosa PA01
cccugccccagcaucgccggcag

SEQ ID NO: 3523836 - RNA, 13 nt, Pseudomonas aeruginosa PA01
cccugccccuucg

SEQ ID NO: 3523837 - RNA, 19 nt, Pseudomonas aeruginosa PA01
cccugccccuucggcugca

SEQ ID NO: 3523838 - RNA, 16 nt, Pseudomonas aeruginosa PA01
cccugcccgcgccucg

SEQ ID NO: 3523839 - RNA, 13 nt, Pseudomonas aeruginosa PA01
cccugccgcccuu

SEQ ID NO: 3523840 - RNA, 13 nt, Pseudomonas aeruginosa PA01
cccugccggcgca

SEQ ID NO: 3523841 - RNA, 17 nt, Pseudomonas aeruginosa PA01
cccugccggcgcagauc

SEQ ID NO: 3523842 - RNA, 12 nt, Pseudomonas aeruginosa PA01
cccugccggcgg

SEQ ID NO: 3523843 - RNA, 13 nt, Pseudomonas aeruginosa PA01
cccugccggcggu

SEQ ID NO: 3523844 - RNA, 14 nt, Pseudomonas aeruginosa PA01
cccugccggcggug

SEQ ID NO: 3523845 - RNA, 20 nt, Pseudomonas aeruginosa PA01
cccugccguauccgcggcag

SEQ ID NO: 3523846 - RNA, 21 nt, Pseudomonas aeruginosa PA01
cccugccguucgucaccggcg

SEQ ID NO: 3523847 - RNA, 22 nt, Pseudomonas aeruginosa PA01
cccugcgaccgugaggcgcagg

SEQ ID NO: 3523848 - RNA, 18 nt, Pseudomonas aeruginosa PA01
cccugcgcccagggacgc

SEQ ID NO: 3523849 - RNA, 13 nt, Pseudomonas aeruginosa PA01
cccugcgccgcag

SEQ ID NO: 3523850 - RNA, 15 nt, Pseudomonas aeruginosa PA01
cccugcgccgcagcg

SEQ ID NO: 3523851 - RNA, 19 nt, Pseudomonas aeruginosa PA01
cccugcgccucgaccuggc

SEQ ID NO: 3523852 - RNA, 20 nt, Pseudomonas aeruginosa PA01
cccugcgcgaucccccgccc

SEQ ID NO: 3523853 - RNA, 21 nt, Pseudomonas aeruginosa PA01
cccugcgcgcgcguuucagcg

SEQ ID NO: 3523854 - RNA, 17 nt, Pseudomonas aeruginosa PA01
cccugcggauggcgcgg

SEQ ID NO: 3523855 - RNA, 14 nt, Pseudomonas aeruginosa PA01
cccugcggcaggcg

SEQ ID NO: 3523856 - RNA, 12 nt, Pseudomonas aeruginosa PA01
cccugcggcgcc

SEQ ID NO: 3523857 - RNA, 16 nt, Pseudomonas aeruginosa PA01
cccugcggcgccgguu

SEQ ID NO: 3523858 - RNA, 24 nt, Pseudomonas aeruginosa PA01
cccugcgggacccagacaggccug

SEQ ID NO: 3523859 - RNA, 17 nt, Pseudomonas aeruginosa PA01
cccugcguggaaccgcg

SEQ ID NO: 3523860 - RNA, 22 nt, Pseudomonas aeruginosa PA01
cccugcguggaaccgcggcgcc

SEQ ID NO: 3523861 - RNA, 15 nt, Pseudomonas aeruginosa PA01
cccugcuccucgccg

SEQ ID NO: 3523862 - RNA, 14 nt, Pseudomonas aeruginosa PA01
cccugcucgcgcag

SEQ ID NO: 3523863 - RNA, 19 nt, Pseudomonas aeruginosa PA01
cccugcucgcgcagggucg

SEQ ID NO: 3523864 - RNA, 16 nt, Pseudomonas aeruginosa PA01
cccugcugcagggccu

SEQ ID NO: 3523865 - RNA, 16 nt, Pseudomonas aeruginosa PA01
cccugcugcggcaacg

SEQ ID NO: 3523866 - RNA, 15 nt, Pseudomonas aeruginosa PA01
cccugcugcucgcca

SEQ ID NO: 3523867 - RNA, 15 nt, Pseudomonas aeruginosa PA01
cccugcugcugcuca

SEQ ID NO: 3523868 - RNA, 21 nt, Pseudomonas aeruginosa PA01
cccugcugcugcucagcgcgc

SEQ ID NO: 3523869 - RNA, 14 nt, Pseudomonas aeruginosa PA01
cccugcuggccggu

SEQ ID NO: 3523870 - RNA, 20 nt, Pseudomonas aeruginosa PA01
cccugcuggccggugccgcc

SEQ ID NO: 3523871 - RNA, 13 nt, Pseudomonas aeruginosa PA01
cccugcuggcgca

SEQ ID NO: 3523872 - RNA, 20 nt, Pseudomonas aeruginosa PA01
cccugcuggcgcagccaggc

SEQ ID NO: 3523873 - RNA, 21 nt, Pseudomonas aeruginosa PA01
cccugcuggcgcagccaggcg

SEQ ID NO: 3523874 - RNA, 22 nt, Pseudomonas aeruginosa PA01
cccugcuggcgcagccaggcga

SEQ ID NO: 3523875 - RNA, 21 nt, Pseudomonas aeruginosa PA01
cccugcuucgaacgugcgcgc

SEQ ID NO: 3523876 - RNA, 22 nt, Pseudomonas aeruginosa PA01
cccugcuucgaacgugcgcgca

SEQ ID NO: 3523877 - RNA, 20 nt, Pseudomonas aeruginosa PA01
cccuggaaaggccucggcga

SEQ ID NO: 3523878 - RNA, 14 nt, Pseudomonas aeruginosa PA01
cccuggaagccggc

SEQ ID NO: 3523879 - RNA, 16 nt, Pseudomonas aeruginosa PA01
cccuggaagccggcag

SEQ ID NO: 3523880 - RNA, 14 nt, Pseudomonas aeruginosa PA01
cccuggacccgggc

SEQ ID NO: 3523881 - RNA, 18 nt, Pseudomonas aeruginosa PA01
cccuugcucccgccgcuc

SEQ ID NO: 3523882 - RNA, 16 nt, Pseudomonas aeruginosa PA01
cccuugcucgcggcgu

SEQ ID NO: 3523883 - RNA, 23 nt, Pseudomonas aeruginosa PA01
cccuugcucgcggcguaggccuc

SEQ ID NO: 3523884 - RNA, 14 nt, Pseudomonas aeruginosa PA01
cccuuggagccgcc

SEQ ID NO: 3523885 - RNA, 22 nt, Pseudomonas aeruginosa PA01
cccuuggccagcaccaugcgcg

SEQ ID NO: 3523886 - RNA, 14 nt, Pseudomonas aeruginosa PA01
cccuuggcggcgcc

SEQ ID NO: 3523887 - RNA, 17 nt, Pseudomonas aeruginosa PA01
cccuuggcgucgcggcu

SEQ ID NO: 3523888 - RNA, 23 nt, Pseudomonas aeruginosa PA01
cccuuggucaggccgaccagcgc

SEQ ID NO: 3523889 - RNA, 18 nt, Pseudomonas aeruginosa PA01
cccuuguacagcuucagg

SEQ ID NO: 3523890 - RNA, 15 nt, Pseudomonas aeruginosa PA01
cccuuguagaucgac

SEQ ID NO: 3523891 - RNA, 15 nt, Pseudomonas aeruginosa PA01
cccuugucgccgcug

SEQ ID NO: 3523892 - RNA, 19 nt, Pseudomonas aeruginosa PA01
cccuugugaaagggcggca

SEQ ID NO: 3523893 - RNA, 22 nt, Pseudomonas aeruginosa PA01
cccuuguggccgaucuccuggu

SEQ ID NO: 3523894 - RNA, 18 nt, Pseudomonas aeruginosa PA01
cccuuucacaugcuugcu

SEQ ID NO: 3523895 - RNA, 20 nt, Pseudomonas aeruginosa PA01
cccuuucgaacugcaugucg

SEQ ID NO: 3523896 - RNA, 14 nt, Pseudomonas aeruginosa PA01
cccuuugccgagcg

SEQ ID NO: 3523897 - RNA, 17 nt, Pseudomonas aeruginosa PA01
cccuuuuccaccggccg

SEQ ID NO: 3523898 - RNA, 23 nt, Pseudomonas aeruginosa PA01
cccuuuuccaccggccgcgccuu

SEQ ID NO: 3523899 - RNA, 18 nt, Pseudomonas aeruginosa PA01
cccuuuuucaugcgcggg

SEQ ID NO: 3523900 - RNA, 22 nt, Pseudomonas aeruginosa PA01
cccuuuuucauucuccagccgc

SEQ ID NO: 3523901 - RNA, 19 nt, Pseudomonas aeruginosa PA01
cccuuuuucgucgccagcc

SEQ ID NO: 3523902 - RNA, 13 nt, Pseudomonas aeruginosa PA01
ccgaaacagggcg

SEQ ID NO: 3523903 - RNA, 18 nt, Pseudomonas aeruginosa PA01
ccgaaacagggcgaccag

SEQ ID NO: 3523904 - RNA, 13 nt, Pseudomonas aeruginosa PA01
ccgaaaccaggau

SEQ ID NO: 3523905 - RNA, 17 nt, Pseudomonas aeruginosa PA01
ccgaaaccaggaucgaa

SEQ ID NO: 3523906 - RNA, 16 nt, Pseudomonas aeruginosa PA01
ccgaaaccggcgaugc

SEQ ID NO: 3523907 - RNA, 18 nt, Pseudomonas aeruginosa PA01
ccgaaacgguccaccagg

SEQ ID NO: 3523908 - RNA, 19 nt, Pseudomonas aeruginosa PA01
ccgaaagaaacaacgaagu

SEQ ID NO: 3523909 - RNA, 18 nt, Pseudomonas aeruginosa PA01
ccgaaagccgaagcgcga

SEQ ID NO: 3523910 - RNA, 16 nt, Pseudomonas aeruginosa PA01
ccgaaauagcgcgccc

SEQ ID NO: 3523911 - RNA, 20 nt, Pseudomonas aeruginosa PA01
ccgaaauagcgcgcccagug

SEQ ID NO: 3523912 - RNA, 19 nt, Pseudomonas aeruginosa PA01
ccgaaaugcugcaggccga

SEQ ID NO: 3523913 - RNA, 21 nt, Pseudomonas aeruginosa PA01
ccgaaauggcgguggccgugg

SEQ ID NO: 3523914 - RNA, 19 nt, Pseudomonas aeruginosa PA01
ccgaaauugaccagguacg

SEQ ID NO: 3523915 - RNA, 21 nt, Pseudomonas aeruginosa PA01
ccgaaauugaccagguacgga

SEQ ID NO: 3523916 - RNA, 23 nt, Pseudomonas aeruginosa PA01
ccgaacacaggacgagacgccga

SEQ ID NO: 3523917 - RNA, 21 nt, Pseudomonas aeruginosa PA01
ccgaacaccugcaucaccagg

SEQ ID NO: 3523918 - RNA, 22 nt, Pseudomonas aeruginosa PA01
ccgaacaccugcaucaccaggc

SEQ ID NO: 3523919 - RNA, 16 nt, Pseudomonas aeruginosa PA01
ccgaacagaggaaggc

SEQ ID NO: 3523920 - RNA, 14 nt, Pseudomonas aeruginosa PA01
ccgaacagcaggga

SEQ ID NO: 3523921 - RNA, 19 nt, Pseudomonas aeruginosa PA01
ccgaacagcagggaggcgc

SEQ ID NO: 3523922 - RNA, 16 nt, Pseudomonas aeruginosa PA01
ccgaacagccgcccca

SEQ ID NO: 3523923 - RNA, 15 nt, Pseudomonas aeruginosa PA01
ccgaacagcgcgcca

SEQ ID NO: 3523924 - RNA, 14 nt, Pseudomonas aeruginosa PA01
ccgaacagggcgaa

SEQ ID NO: 3523925 - RNA, 16 nt, Pseudomonas aeruginosa PA01
ccgaacagggcgaagg

SEQ ID NO: 3523926 - RNA, 19 nt, Pseudomonas aeruginosa PA01
ccgaacagggcgaaggcca

SEQ ID NO: 3523927 - RNA, 16 nt, Pseudomonas aeruginosa PA01
ccgaacagggcgagca

SEQ ID NO: 3523928 - RNA, 18 nt, Pseudomonas aeruginosa PA01
ccgaacagggcgagcagg

SEQ ID NO: 3523929 - RNA, 19 nt, Pseudomonas aeruginosa PA01
ccgaacaucagcagcagga

SEQ ID NO: 3523930 - RNA, 13 nt, Pseudomonas aeruginosa PA01
ccgaacaugccga

SEQ ID NO: 3523931 - RNA, 15 nt, Pseudomonas aeruginosa PA01
ccgaacgccaccagg

SEQ ID NO: 3523932 - RNA, 18 nt, Pseudomonas aeruginosa PA01
ccgaacgccaccagggcc

SEQ ID NO: 3523933 - RNA, 14 nt, Pseudomonas aeruginosa PA01
ccgaacgccccagu

SEQ ID NO: 3523934 - RNA, 22 nt, Pseudomonas aeruginosa PA01
ccgaacggaucgcgucgcaggc

SEQ ID NO: 3523935 - RNA, 21 nt, Pseudomonas aeruginosa PA01
ccgaacgggaaguaggccugg

SEQ ID NO: 3523936 - RNA, 20 nt, Pseudomonas aeruginosa PA01
ccgaacggguagagcgggcc

SEQ ID NO: 3523937 - RNA, 23 nt, Pseudomonas aeruginosa PA01
ccgaacucaugcccagcuuggcc

SEQ ID NO: 3523938 - RNA, 21 nt, Pseudomonas aeruginosa PA01
ccgaacuccgccagcaccacc

SEQ ID NO: 3523939 - RNA, 22 nt, Pseudomonas aeruginosa PA01
ccgaacuccggugucaggccga

SEQ ID NO: 3523940 - RNA, 12 nt, Pseudomonas aeruginosa PA01
ccgaacucgccg

SEQ ID NO: 3523941 - RNA, 16 nt, Pseudomonas aeruginosa PA01
ccgaacugcagggcgu

SEQ ID NO: 3523942 - RNA, 22 nt, Pseudomonas aeruginosa PA01
ccgaacugcagggcgucgccgg

SEQ ID NO: 3523943 - RNA, 14 nt, Pseudomonas aeruginosa PA01
ccgaacuucccccu

SEQ ID NO: 3523944 - RNA, 17 nt, Pseudomonas aeruginosa PA01
ccgaacuucccccuccc

SEQ ID NO: 3523945 - RNA, 17 nt, Pseudomonas aeruginosa PA01
ccgaacuuccgccgaau

SEQ ID NO: 3523946 - RNA, 22 nt, Pseudomonas aeruginosa PA01
ccgaacuuccgccgaauauuuc

SEQ ID NO: 3523947 - RNA, 19 nt, Pseudomonas aeruginosa PA01
ccgaacuucuccgccaccc

SEQ ID NO: 3523948 - RNA, 16 nt, Pseudomonas aeruginosa PA01
ccgaagaacucggcgc

SEQ ID NO: 3523949 - RNA, 21 nt, Pseudomonas aeruginosa PA01
ccgaagaacucggcgcugccg

SEQ ID NO: 3523950 - RNA, 19 nt, Pseudomonas aeruginosa PA01
ccgaagaggcccucggcgc

SEQ ID NO: 3523951 - RNA, 21 nt, Pseudomonas aeruginosa PA01
ccgaagaggcccucggcgccg

SEQ ID NO: 3523952 - RNA, 23 nt, Pseudomonas aeruginosa PA01
ccgaagaggcccucggcgccgag

SEQ ID NO: 3523953 - RNA, 20 nt, Pseudomonas aeruginosa PA01
ccgaagaucgacaggccgcc

SEQ ID NO: 3523954 - RNA, 21 nt, Pseudomonas aeruginosa PA01
ccgaagaucgacaggccgccg

SEQ ID NO: 3523955 - RNA, 13 nt, Pseudomonas aeruginosa PA01
ccgaagccgacgc

SEQ ID NO: 3523956 - RNA, 16 nt, Pseudomonas aeruginosa PA01
ccgaagccgacgccga

SEQ ID NO: 3523957 - RNA, 13 nt, Pseudomonas aeruginosa PA01
ccgaagccgcgca

SEQ ID NO: 3523958 - RNA, 15 nt, Pseudomonas aeruginosa PA01
ccgaagccuucgucg

SEQ ID NO: 3523959 - RNA, 17 nt, Pseudomonas aeruginosa PA01
ccgaagccuucgucgau

SEQ ID NO: 3523960 - RNA, 22 nt, Pseudomonas aeruginosa PA01
ccgaagcgcucggucagcuccc

SEQ ID NO: 3523961 - RNA, 19 nt, Pseudomonas aeruginosa PA01
ccgaagcgugggcggccgg

SEQ ID NO: 3523962 - RNA, 16 nt, Pseudomonas aeruginosa PA01
ccgaagcugaggccgg

SEQ ID NO: 3523963 - RNA, 16 nt, Pseudomonas aeruginosa PA01
ccgaagcugucgagca

SEQ ID NO: 3523964 - RNA, 16 nt, Pseudomonas aeruginosa PA01
ccgaaggacaggccgu

SEQ ID NO: 3523965 - RNA, 15 nt, Pseudomonas aeruginosa PA01
ccgaaggcaacagcc

SEQ ID NO: 3523966 - RNA, 20 nt, Pseudomonas aeruginosa PA01
ccgaaggcaacagcccgcgc

SEQ ID NO: 3523967 - RNA, 22 nt, Pseudomonas aeruginosa PA01
ccgaaggcaacagcccgcgccg

SEQ ID NO: 3523968 - RNA, 13 nt, Pseudomonas aeruginosa PA01
ccgaaggccaggc

SEQ ID NO: 3523969 - RNA, 16 nt, Pseudomonas aeruginosa PA01
ccgaaggccaggccgg

SEQ ID NO: 3523970 - RNA, 24 nt, Pseudomonas aeruginosa PA01
ccgaaggccaggccggcgccuugc

SEQ ID NO: 3523971 - RNA, 15 nt, Pseudomonas aeruginosa PA01
ccgaaggccuggccg

SEQ ID NO: 3523972 - RNA, 18 nt, Pseudomonas aeruginosa PA01
ccgaaggcgucauccgcc

SEQ ID NO: 3523973 - RNA, 17 nt, Pseudomonas aeruginosa PA01
ccgaaggcgugggcgcc

SEQ ID NO: 3523974 - RNA, 23 nt, Pseudomonas aeruginosa PA01
ccgaaggcgugggcgccggcgcg

SEQ ID NO: 3523975 - RNA, 18 nt, Pseudomonas aeruginosa PA01
ccgaagggaaacaccagg

SEQ ID NO: 3523976 - RNA, 22 nt, Pseudomonas aeruginosa PA01
ccgaagggaaacaccaggccga

SEQ ID NO: 3523977 - RNA, 17 nt, Pseudomonas aeruginosa PA01
ccgaagggaacccgcgg

SEQ ID NO: 3523978 - RNA, 18 nt, Pseudomonas aeruginosa PA01
ccgaagggaacccgcggc

SEQ ID NO: 3523979 - RNA, 20 nt, Pseudomonas aeruginosa PA01
ccgaagggaacccgcggcgc

SEQ ID NO: 3523980 - RNA, 13 nt, Pseudomonas aeruginosa PA01
ccgaagggccgca

SEQ ID NO: 3523981 - RNA, 12 nt, Pseudomonas aeruginosa PA01
ccgaaggugcag

SEQ ID NO: 3523982 - RNA, 18 nt, Pseudomonas aeruginosa PA01
ccgaaguagucgccccgg

SEQ ID NO: 3523983 - RNA, 16 nt, Pseudomonas aeruginosa PA01
ccgacgccgagcagca

SEQ ID NO: 3523984 - RNA, 20 nt, Pseudomonas aeruginosa PA01
ccgacgccgagcagcaccag

SEQ ID NO: 3523985 - RNA, 21 nt, Pseudomonas aeruginosa PA01
ccgacgccgagcagcaccagg

SEQ ID NO: 3523986 - RNA, 13 nt, Pseudomonas aeruginosa PA01
ccgacgccgcccg

SEQ ID NO: 3523987 - RNA, 15 nt, Pseudomonas aeruginosa PA01
ccgacgccgccugcg

SEQ ID NO: 3523988 - RNA, 16 nt, Pseudomonas aeruginosa PA01
ccgacgccgccugcgc

SEQ ID NO: 3523989 - RNA, 12 nt, Pseudomonas aeruginosa PA01
ccgacgccgcgu

SEQ ID NO: 3523990 - RNA, 13 nt, Pseudomonas aeruginosa PA01
ccgacgccgcugg

SEQ ID NO: 3523991 - RNA, 13 nt, Pseudomonas aeruginosa PA01
ccgacgccggacg

SEQ ID NO: 3523992 - RNA, 21 nt, Pseudomonas aeruginosa PA01
ccgacgcgcgcugccugcgau

SEQ ID NO: 3523993 - RNA, 22 nt, Pseudomonas aeruginosa PA01
ccgacgcucgcggcaucccgcc

SEQ ID NO: 3523994 - RNA, 16 nt, Pseudomonas aeruginosa PA01
ccgacgcugaggauca

SEQ ID NO: 3523995 - RNA, 18 nt, Pseudomonas aeruginosa PA01
ccgacggcccuccggcgc

SEQ ID NO: 3523996 - RNA, 17 nt, Pseudomonas aeruginosa PA01
ccgacggcggcggcgga

SEQ ID NO: 3523997 - RNA, 12 nt, Pseudomonas aeruginosa PA01
ccgacggcgugc

SEQ ID NO: 3523998 - RNA, 16 nt, Pseudomonas aeruginosa PA01
ccgacggcuucgacca

SEQ ID NO: 3523999 - RNA, 18 nt, Pseudomonas aeruginosa PA01
ccgacggcuucgaccacg

SEQ ID NO: 3524000 - RNA, 16 nt, Pseudomonas aeruginosa PA01
ccgacggcuugaucac

SEQ ID NO: 3524001 - RNA, 21 nt, Pseudomonas aeruginosa PA01
ccgacggcuugaucacgccga

SEQ ID NO: 3524002 - RNA, 22 nt, Pseudomonas aeruginosa PA01
ccgacggcuugaucacgccgaa

SEQ ID NO: 3524003 - RNA, 23 nt, Pseudomonas aeruginosa PA01
ccgacggcuugaucacgccgaag

SEQ ID NO: 3524004 - RNA, 14 nt, Pseudomonas aeruginosa PA01
ccgacgggucgcca

SEQ ID NO: 3524005 - RNA, 18 nt, Pseudomonas aeruginosa PA01
ccgacgggucgccauggu

SEQ ID NO: 3524006 - RNA, 20 nt, Pseudomonas aeruginosa PA01
ccgacgggucgccauggucg

SEQ ID NO: 3524007 - RNA, 14 nt, Pseudomonas aeruginosa PA01
ccgacggguucuuc

SEQ ID NO: 3524008 - RNA, 22 nt, Pseudomonas aeruginosa PA01
ccgacggguucuucucgucgaa

SEQ ID NO: 3524009 - RNA, 22 nt, Pseudomonas aeruginosa PA01
ccgacgguaguaccucgaagcc

SEQ ID NO: 3524010 - RNA, 13 nt, Pseudomonas aeruginosa PA01
ccgacggucggca

SEQ ID NO: 3524011 - RNA, 15 nt, Pseudomonas aeruginosa PA01
ccgacggucggcagg

SEQ ID NO: 3524012 - RNA, 15 nt, Pseudomonas aeruginosa PA01
ccgacguagccgcgu

SEQ ID NO: 3524013 - RNA, 18 nt, Pseudomonas aeruginosa PA01
ccgacguagccgcguacg

SEQ ID NO: 3524014 - RNA, 22 nt, Pseudomonas aeruginosa PA01
ccgacguagggcaucgccgaca

SEQ ID NO: 3524015 - RNA, 18 nt, Pseudomonas aeruginosa PA01
ccgacguccaucagcguc

SEQ ID NO: 3524016 - RNA, 15 nt, Pseudomonas aeruginosa PA01
ccgacguccuccagg

SEQ ID NO: 3524017 - RNA, 21 nt, Pseudomonas aeruginosa PA01
ccgacguccuccaggaccagg

SEQ ID NO: 3524018 - RNA, 22 nt, Pseudomonas aeruginosa PA01
ccgacgucguggauaggcggcg

SEQ ID NO: 3524019 - RNA, 23 nt, Pseudomonas aeruginosa PA01
ccgacgucguggauaggcggcgg

SEQ ID NO: 3524020 - RNA, 13 nt, Pseudomonas aeruginosa PA01
ccgacgugcaccc

SEQ ID NO: 3524021 - RNA, 17 nt, Pseudomonas aeruginosa PA01
ccgacgugcacccgcug

SEQ ID NO: 3524022 - RNA, 19 nt, Pseudomonas aeruginosa PA01
ccgacguugagaaggcgcc

SEQ ID NO: 3524023 - RNA, 22 nt, Pseudomonas aeruginosa PA01
ccgacguugagaaggcgccuga

SEQ ID NO: 3524024 - RNA, 19 nt, Pseudomonas aeruginosa PA01
ccgacucuccgcgccgcgg

SEQ ID NO: 3524025 - RNA, 21 nt, Pseudomonas aeruginosa PA01
ccgacucuccgcgccgcggcg

SEQ ID NO: 3524026 - RNA, 22 nt, Pseudomonas aeruginosa PA01
ccgacugcgaaaaagaacgccc

SEQ ID NO: 3524027 - RNA, 15 nt, Pseudomonas aeruginosa PA01
ccgacugcgagccga

SEQ ID NO: 3524028 - RNA, 21 nt, Pseudomonas aeruginosa PA01
ccgacuggccguuggcgaacu

SEQ ID NO: 3524029 - RNA, 18 nt, Pseudomonas aeruginosa PA01
ccgacugguccugcggcg

SEQ ID NO: 3524030 - RNA, 16 nt, Pseudomonas aeruginosa PA01
ccgacuggugggcacg

SEQ ID NO: 3524031 - RNA, 19 nt, Pseudomonas aeruginosa PA01
ccgacugucgugccuccag

SEQ ID NO: 3524032 - RNA, 20 nt, Pseudomonas aeruginosa PA01
ccgacugucgugccuccagc

SEQ ID NO: 3524033 - RNA, 21 nt, Pseudomonas aeruginosa PA01
ccgacugucgugccuccagcc

SEQ ID NO: 3524034 - RNA, 15 nt, Pseudomonas aeruginosa PA01
ccgacuuccaggcgc

SEQ ID NO: 3524035 - RNA, 16 nt, Pseudomonas aeruginosa PA01
ccgacuuccaggcgca

SEQ ID NO: 3524036 - RNA, 22 nt, Pseudomonas aeruginosa PA01
ccgacuuccaggcgcaggcgag

SEQ ID NO: 3524037 - RNA, 23 nt, Pseudomonas aeruginosa PA01
ccgacuuccaggcgcaggcgagg

SEQ ID NO: 3524038 - RNA, 15 nt, Pseudomonas aeruginosa PA01
ccgacuucggcaagc

SEQ ID NO: 3524039 - RNA, 18 nt, Pseudomonas aeruginosa PA01
ccgacuugcucaucgcgu

SEQ ID NO: 3524040 - RNA, 20 nt, Pseudomonas aeruginosa PA01
ccgacuuggcagucgccgcc

SEQ ID NO: 3524041 - RNA, 12 nt, Pseudomonas aeruginosa PA01
ccgagaaaaccc

SEQ ID NO: 3524042 - RNA, 22 nt, Pseudomonas aeruginosa PA01
ccgagaaaguucccgcauggcu

SEQ ID NO: 3524043 - RNA, 14 nt, Pseudomonas aeruginosa PA01
ccgagaaccaguac

SEQ ID NO: 3524044 - RNA, 14 nt, Pseudomonas aeruginosa PA01
ccgagaacccggcc

SEQ ID NO: 3524045 - RNA, 15 nt, Pseudomonas aeruginosa PA01
ccgagaacgcggcga

SEQ ID NO: 3524046 - RNA, 16 nt, Pseudomonas aeruginosa PA01
ccgagaacgcggcgaa

SEQ ID NO: 3524047 - RNA, 20 nt, Pseudomonas aeruginosa PA01
ccgagaagccggggcaggca

SEQ ID NO: 3524048 - RNA, 17 nt, Pseudomonas aeruginosa PA01
ccgagacccuggcgcug

SEQ ID NO: 3524049 - RNA, 12 nt, Pseudomonas aeruginosa PA01
ccgagaccggca

SEQ ID NO: 3524050 - RNA, 14 nt, Pseudomonas aeruginosa PA01
ccgagaccggcagc

SEQ ID NO: 3524051 - RNA, 17 nt, Pseudomonas aeruginosa PA01
ccgagaccggcagccgg

SEQ ID NO: 3524052 - RNA, 15 nt, Pseudomonas aeruginosa PA01
ccgagacgaucagca

SEQ ID NO: 3524053 - RNA, 17 nt, Pseudomonas aeruginosa PA01
ccgagacgcccuggaug

SEQ ID NO: 3524054 - RNA, 22 nt, Pseudomonas aeruginosa PA01
ccgagacgcugcaccgcggcgc

SEQ ID NO: 3524055 - RNA, 16 nt, Pseudomonas aeruginosa PA01
ccgagacuugaucgca

SEQ ID NO: 3524056 - RNA, 17 nt, Pseudomonas aeruginosa PA01
ccgagagcagggccugg

SEQ ID NO: 3524057 - RNA, 17 nt, Pseudomonas aeruginosa PA01
ccgagagcggcgccagg

SEQ ID NO: 3524058 - RNA, 16 nt, Pseudomonas aeruginosa PA01
ccgagagcugcaaggc

SEQ ID NO: 3524059 - RNA, 18 nt, Pseudomonas aeruginosa PA01
ccgagaggguggucgcgc

SEQ ID NO: 3524060 - RNA, 19 nt, Pseudomonas aeruginosa PA01
ccgagauagcggcaacgcg

SEQ ID NO: 3524061 - RNA, 15 nt, Pseudomonas aeruginosa PA01
ccgagaucaccuugu

SEQ ID NO: 3524062 - RNA, 16 nt, Pseudomonas aeruginosa PA01
ccgagauccugcagca

SEQ ID NO: 3524063 - RNA, 20 nt, Pseudomonas aeruginosa PA01
ccgagaucggucaccguggu

SEQ ID NO: 3524064 - RNA, 22 nt, Pseudomonas aeruginosa PA01
ccgagaugcucgcgcagcgacu

SEQ ID NO: 3524065 - RNA, 18 nt, Pseudomonas aeruginosa PA01
ccgagauucugcaggcgc

SEQ ID NO: 3524066 - RNA, 14 nt, Pseudomonas aeruginosa PA01
ccgagauuggccgc

SEQ ID NO: 3524067 - RNA, 18 nt, Pseudomonas aeruginosa PA01
ccgagauuggccgccugc

SEQ ID NO: 3524068 - RNA, 23 nt, Pseudomonas aeruginosa PA01
ccgagauuggccgccugcucggc

SEQ ID NO: 3524069 - RNA, 16 nt, Pseudomonas aeruginosa PA01
ccgagcaacggcagca

SEQ ID NO: 3524070 - RNA, 16 nt, Pseudomonas aeruginosa PA01
ccgagcaacucggcgg

SEQ ID NO: 3524071 - RNA, 18 nt, Pseudomonas aeruginosa PA01
ccgagcaacucggcggcg

SEQ ID NO: 3524072 - RNA, 22 nt, Pseudomonas aeruginosa PA01
ccgagcaacucggcggcgagcg

SEQ ID NO: 3524073 - RNA, 22 nt, Pseudomonas aeruginosa PA01
ccgagcaacugcauguugccgu

SEQ ID NO: 3524074 - RNA, 14 nt, Pseudomonas aeruginosa PA01
ccgagcaacugcuc

SEQ ID NO: 3524075 - RNA, 20 nt, Pseudomonas aeruginosa PA01
ccgagcaacugcucgggcgu

SEQ ID NO: 3524076 - RNA, 20 nt, Pseudomonas aeruginosa PA01
ccgagcaagccuuccaggua

SEQ ID NO: 3524077 - RNA, 17 nt, Pseudomonas aeruginosa PA01
ccgagcaauccggcgcu

SEQ ID NO: 3524078 - RNA, 19 nt, Pseudomonas aeruginosa PA01
ccgagcaccacgcgcaagc

SEQ ID NO: 3524079 - RNA, 14 nt, Pseudomonas aeruginosa PA01
ccgagcaccggcag

SEQ ID NO: 3524080 - RNA, 13 nt, Pseudomonas aeruginosa PA01
ccgagcaccggcc

SEQ ID NO: 3524081 - RNA, 19 nt, Pseudomonas aeruginosa PA01
ccgagcagcaccaggcugg

SEQ ID NO: 3524082 - RNA, 13 nt, Pseudomonas aeruginosa PA01
ccgagcagcgcca

SEQ ID NO: 3524083 - RNA, 14 nt, Pseudomonas aeruginosa PA01
ccgagcagcgccag

SEQ ID NO: 3524084 - RNA, 15 nt, Pseudomonas aeruginosa PA01
ccgagcagcgccagc

SEQ ID NO: 3524085 - RNA, 18 nt, Pseudomonas aeruginosa PA01
ccgaggcgaucgccgcgg

SEQ ID NO: 3524086 - RNA, 12 nt, Pseudomonas aeruginosa PA01
ccgaggcgcgcc

SEQ ID NO: 3524087 - RNA, 16 nt, Pseudomonas aeruginosa PA01
ccgaggcgcgccgaca

SEQ ID NO: 3524088 - RNA, 13 nt, Pseudomonas aeruginosa PA01
ccgaggcgcuucu

SEQ ID NO: 3524089 - RNA, 15 nt, Pseudomonas aeruginosa PA01
ccgaggcgcuucugc

SEQ ID NO: 3524090 - RNA, 20 nt, Pseudomonas aeruginosa PA01
ccgaggcggauuugccgccg

SEQ ID NO: 3524091 - RNA, 22 nt, Pseudomonas aeruginosa PA01
ccgaggcggauuugccgccgag

SEQ ID NO: 3524092 - RNA, 23 nt, Pseudomonas aeruginosa PA01
ccgaggcggauuugccgccgagg

SEQ ID NO: 3524093 - RNA, 12 nt, Pseudomonas aeruginosa PA01
ccgaggcggccg

SEQ ID NO: 3524094 - RNA, 22 nt, Pseudomonas aeruginosa PA01
ccgaggcgucgaaacgggcgcu

SEQ ID NO: 3524095 - RNA, 19 nt, Pseudomonas aeruginosa PA01
ccgaggcguuauccgccga

SEQ ID NO: 3524096 - RNA, 20 nt, Pseudomonas aeruginosa PA01
ccgaggcguuauccgccgau

SEQ ID NO: 3524097 - RNA, 13 nt, Pseudomonas aeruginosa PA01
ccgaggcuuucca

SEQ ID NO: 3524098 - RNA, 18 nt, Pseudomonas aeruginosa PA01
ccgaggcuuuccagcagg

SEQ ID NO: 3524099 - RNA, 23 nt, Pseudomonas aeruginosa PA01
ccgaggcuuuccagcaggcgcuc

SEQ ID NO: 3524100 - RNA, 18 nt, Pseudomonas aeruginosa PA01
ccgagggaggaggcgccg

SEQ ID NO: 3524101 - RNA, 21 nt, Pseudomonas aeruginosa PA01
ccgagggcagccucagcgaca

SEQ ID NO: 3524102 - RNA, 19 nt, Pseudomonas aeruginosa PA01
ccgagggcaggaaccagac

SEQ ID NO: 3524103 - RNA, 12 nt, Pseudomonas aeruginosa PA01
ccgagggccgcg

SEQ ID NO: 3524104 - RNA, 13 nt, Pseudomonas aeruginosa PA01
ccgagggccgcgc

SEQ ID NO: 3524105 - RNA, 14 nt, Pseudomonas aeruginosa PA01
ccgagggccgcgcc

SEQ ID NO: 3524106 - RNA, 15 nt, Pseudomonas aeruginosa PA01
ccgagggccgcgccg

SEQ ID NO: 3524107 - RNA, 16 nt, Pseudomonas aeruginosa PA01
ccgagggccgcgccga

SEQ ID NO: 3524108 - RNA, 19 nt, Pseudomonas aeruginosa PA01
ccgagggccgcgccgaccc

SEQ ID NO: 3524109 - RNA, 14 nt, Pseudomonas aeruginosa PA01
ccgagggcgaagau

SEQ ID NO: 3524110 - RNA, 22 nt, Pseudomonas aeruginosa PA01
ccgagggcgaagaucucgccau

SEQ ID NO: 3524111 - RNA, 22 nt, Pseudomonas aeruginosa PA01
ccgagggcgaguucggcgagca

SEQ ID NO: 3524112 - RNA, 20 nt, Pseudomonas aeruginosa PA01
ccgagggcgccaggugcagg

SEQ ID NO: 3524113 - RNA, 13 nt, Pseudomonas aeruginosa PA01
ccgagggcgcgca

SEQ ID NO: 3524114 - RNA, 14 nt, Pseudomonas aeruginosa PA01
ccgagggcgcgcag

SEQ ID NO: 3524115 - RNA, 15 nt, Pseudomonas aeruginosa PA01
ccgagggcgcgcagu

SEQ ID NO: 3524116 - RNA, 14 nt, Pseudomonas aeruginosa PA01
ccgagggcgcggcg

SEQ ID NO: 3524117 - RNA, 17 nt, Pseudomonas aeruginosa PA01
ccgagggcgcggcgcca

SEQ ID NO: 3524118 - RNA, 21 nt, Pseudomonas aeruginosa PA01
ccgagggcugagacgcugccg

SEQ ID NO: 3524119 - RNA, 19 nt, Pseudomonas aeruginosa PA01
ccgagggcugccgcccggu

SEQ ID NO: 3524120 - RNA, 22 nt, Pseudomonas aeruginosa PA01
ccgagggcuguaaucgccgcuu

SEQ ID NO: 3524121 - RNA, 13 nt, Pseudomonas aeruginosa PA01
ccgaggggcggcu

SEQ ID NO: 3524122 - RNA, 19 nt, Pseudomonas aeruginosa PA01
ccgaggguacguuccauga

SEQ ID NO: 3524123 - RNA, 18 nt, Pseudomonas aeruginosa PA01
ccgagggugaucagccga

SEQ ID NO: 3524124 - RNA, 20 nt, Pseudomonas aeruginosa PA01
ccgagggugcagagcagagu

SEQ ID NO: 3524125 - RNA, 13 nt, Pseudomonas aeruginosa PA01
ccgaggguggcgc

SEQ ID NO: 3524126 - RNA, 15 nt, Pseudomonas aeruginosa PA01
ccgaggguggcgcug

SEQ ID NO: 3524127 - RNA, 18 nt, Pseudomonas aeruginosa PA01
ccgaggguggcgcuggcc

SEQ ID NO: 3524128 - RNA, 23 nt, Pseudomonas aeruginosa PA01
ccgaggguguagaggaucuccga

SEQ ID NO: 3524129 - RNA, 22 nt, Pseudomonas aeruginosa PA01
ccgaggucaguucggugccgcc

SEQ ID NO: 3524130 - RNA, 22 nt, Pseudomonas aeruginosa PA01
ccgagguccaucuugaugccga

SEQ ID NO: 3524131 - RNA, 12 nt, Pseudomonas aeruginosa PA01
ccgaggucgccg

SEQ ID NO: 3524132 - RNA, 13 nt, Pseudomonas aeruginosa PA01
ccgaggucgccgc

SEQ ID NO: 3524133 - RNA, 18 nt, Pseudomonas aeruginosa PA01
ccgaggucgcgggccagg

SEQ ID NO: 3524134 - RNA, 19 nt, Pseudomonas aeruginosa PA01
ccgaggucgcgggccaggc

SEQ ID NO: 3524135 - RNA, 21 nt, Pseudomonas aeruginosa PA01
ccgaggucgcgggccaggccc

SEQ ID NO: 3524136 - RNA, 14 nt, Pseudomonas aeruginosa PA01
ccgaggucggcgaa

SEQ ID NO: 3524137 - RNA, 19 nt, Pseudomonas aeruginosa PA01
ccgaggucggcgaacaggg

SEQ ID NO: 3524138 - RNA, 21 nt, Pseudomonas aeruginosa PA01
ccgaggucggcgaacagggug

SEQ ID NO: 3524139 - RNA, 14 nt, Pseudomonas aeruginosa PA01
ccgaggucggcggc

SEQ ID NO: 3524140 - RNA, 19 nt, Pseudomonas aeruginosa PA01
ccgaggucuuggccagccg

SEQ ID NO: 3524141 - RNA, 23 nt, Pseudomonas aeruginosa PA01
ccgaggucuuggccagccgcgcg

SEQ ID NO: 3524142 - RNA, 14 nt, Pseudomonas aeruginosa PA01
ccgaggugcggcuu

SEQ ID NO: 3524143 - RNA, 16 nt, Pseudomonas aeruginosa PA01
ccgaggugcggcuugc

SEQ ID NO: 3524144 - RNA, 16 nt, Pseudomonas aeruginosa PA01
ccgaggugcugcaccg

SEQ ID NO: 3524145 - RNA, 18 nt, Pseudomonas aeruginosa PA01
ccgaggugcugcaccggg

SEQ ID NO: 3524146 - RNA, 19 nt, Pseudomonas aeruginosa PA01
ccgagguggagaucagcgg

SEQ ID NO: 3524147 - RNA, 15 nt, Pseudomonas aeruginosa PA01
ccgaggugucgccgc

SEQ ID NO: 3524148 - RNA, 16 nt, Pseudomonas aeruginosa PA01
ccgagguugacgaacg

SEQ ID NO: 3524149 - RNA, 19 nt, Pseudomonas aeruginosa PA01
ccgagucccuugcggcaga

SEQ ID NO: 3524150 - RNA, 12 nt, Pseudomonas aeruginosa PA01
ccgaguccgcgc

SEQ ID NO: 3524151 - RNA, 15 nt, Pseudomonas aeruginosa PA01
ccgaguccgcgcgcg

SEQ ID NO: 3524152 - RNA, 14 nt, Pseudomonas aeruginosa PA01
ccgagucggcaacg

SEQ ID NO: 3524153 - RNA, 22 nt, Pseudomonas aeruginosa PA01
ccgagucggcaacgauaccgcc

SEQ ID NO: 3524154 - RNA, 14 nt, Pseudomonas aeruginosa PA01
ccgagugccggcgc

SEQ ID NO: 3524155 - RNA, 15 nt, Pseudomonas aeruginosa PA01
ccgagugccggcgcg

SEQ ID NO: 3524156 - RNA, 13 nt, Pseudomonas aeruginosa PA01
ccgagugcgccca

SEQ ID NO: 3524157 - RNA, 18 nt, Pseudomonas aeruginosa PA01
ccgagugcgcccagcagc

SEQ ID NO: 3524158 - RNA, 19 nt, Pseudomonas aeruginosa PA01
ccgagugcgcccagcagca

SEQ ID NO: 3524159 - RNA, 14 nt, Pseudomonas aeruginosa PA01
ccgaguggcgcagc

SEQ ID NO: 3524160 - RNA, 16 nt, Pseudomonas aeruginosa PA01
ccgaguggcgcagcgc

SEQ ID NO: 3524161 - RNA, 18 nt, Pseudomonas aeruginosa PA01
ccgaguggcgcagcgccc

SEQ ID NO: 3524162 - RNA, 21 nt, Pseudomonas aeruginosa PA01
ccgaguucgccgcgagcacca

SEQ ID NO: 3524163 - RNA, 17 nt, Pseudomonas aeruginosa PA01
ccgaguucgcgcaggcg

SEQ ID NO: 3524164 - RNA, 12 nt, Pseudomonas aeruginosa PA01
ccgaguuggccc

SEQ ID NO: 3524165 - RNA, 21 nt, Pseudomonas aeruginosa PA01
ccgaguuucccggcgcggccg

SEQ ID NO: 3524166 - RNA, 16 nt, Pseudomonas aeruginosa PA01
ccgauacagcgcgcga

SEQ ID NO: 3524167 - RNA, 22 nt, Pseudomonas aeruginosa PA01
ccgauacagcgcgcgauaccga

SEQ ID NO: 3524168 - RNA, 20 nt, Pseudomonas aeruginosa PA01
ccgauacccugggagccgcc

SEQ ID NO: 3524169 - RNA, 21 nt, Pseudomonas aeruginosa PA01
ccgauacccugggagccgccg

SEQ ID NO: 3524170 - RNA, 24 nt, Pseudomonas aeruginosa PA01
ccgauacgagaucgagcgcgccca

SEQ ID NO: 3524171 - RNA, 15 nt, Pseudomonas aeruginosa PA01
ccgauagcggcgcga

SEQ ID NO: 3524172 - RNA, 17 nt, Pseudomonas aeruginosa PA01
ccgauaggcgccggcgc

SEQ ID NO: 3524173 - RNA, 23 nt, Pseudomonas aeruginosa PA01
ccgauaggcgccggcgcgcggcg

SEQ ID NO: 3524174 - RNA, 16 nt, Pseudomonas aeruginosa PA01
ccgauauaggcgacga

SEQ ID NO: 3524175 - RNA, 21 nt, Pseudomonas aeruginosa PA01
ccgauauaggcgacgaucagc

SEQ ID NO: 3524176 - RNA, 18 nt, Pseudomonas aeruginosa PA01
ccgauaucucccaacugg

SEQ ID NO: 3524177 - RNA, 16 nt, Pseudomonas aeruginosa PA01
ccgauauggcuggcgc

SEQ ID NO: 3524178 - RNA, 19 nt, Pseudomonas aeruginosa PA01
ccgaucaacgcggccagca

SEQ ID NO: 3524179 - RNA, 22 nt, Pseudomonas aeruginosa PA01
ccgaucaacgcggccagcagca

SEQ ID NO: 3524180 - RNA, 16 nt, Pseudomonas aeruginosa PA01
ccgaucaccaccagca

SEQ ID NO: 3524181 - RNA, 16 nt, Pseudomonas aeruginosa PA01
ccgaucaccaccagcg

SEQ ID NO: 3524182 - RNA, 17 nt, Pseudomonas aeruginosa PA01
ccgaucaccaccagcgc

SEQ ID NO: 3524183 - RNA, 19 nt, Pseudomonas aeruginosa PA01
ccgaucaccaccagcgccg

SEQ ID NO: 3524184 - RNA, 21 nt, Pseudomonas aeruginosa PA01
ccgaucaccaccagcgccgcc

SEQ ID NO: 3524185 - RNA, 22 nt, Pseudomonas aeruginosa PA01
ccgaucaccaccagcgccgcca

SEQ ID NO: 3524186 - RNA, 14 nt, Pseudomonas aeruginosa PA01
ccgaucaccaccug

SEQ ID NO: 3524187 - RNA, 18 nt, Pseudomonas aeruginosa PA01
ccgauucuuggcucggca

SEQ ID NO: 3524188 - RNA, 22 nt, Pseudomonas aeruginosa PA01
ccgauugccagaguugccuguc

SEQ ID NO: 3524189 - RNA, 16 nt, Pseudomonas aeruginosa PA01
ccgauuuccccaaggc

SEQ ID NO: 3524190 - RNA, 22 nt, Pseudomonas aeruginosa PA01
ccgauuucgaugacgccauccu

SEQ ID NO: 3524191 - RNA, 15 nt, Pseudomonas aeruginosa PA01
ccgcaaacccccugc

SEQ ID NO: 3524192 - RNA, 16 nt, Pseudomonas aeruginosa PA01
ccgcaaacccccugcg

SEQ ID NO: 3524193 - RNA, 18 nt, Pseudomonas aeruginosa PA01
ccgcaaacccccugcgcg

SEQ ID NO: 3524194 - RNA, 14 nt, Pseudomonas aeruginosa PA01
ccgcaaccagcccu

SEQ ID NO: 3524195 - RNA, 21 nt, Pseudomonas aeruginosa PA01
ccgcaaccagcccuggcgcag

SEQ ID NO: 3524196 - RNA, 14 nt, Pseudomonas aeruginosa PA01
ccgcaaccgcugcc

SEQ ID NO: 3524197 - RNA, 19 nt, Pseudomonas aeruginosa PA01
ccgcaaccgcugccgccgu

SEQ ID NO: 3524198 - RNA, 16 nt, Pseudomonas aeruginosa PA01
ccgcaaccgguccucg

SEQ ID NO: 3524199 - RNA, 21 nt, Pseudomonas aeruginosa PA01
ccgcaaccugccagaaaaccc

SEQ ID NO: 3524200 - RNA, 20 nt, Pseudomonas aeruginosa PA01
ccgcaacgaaaaagggcggc

SEQ ID NO: 3524201 - RNA, 22 nt, Pseudomonas aeruginosa PA01
ccgcaacgaaaaagggcggcca

SEQ ID NO: 3524202 - RNA, 23 nt, Pseudomonas aeruginosa PA01
ccgcaacgaaaaagggcggccac

SEQ ID NO: 3524203 - RNA, 17 nt, Pseudomonas aeruginosa PA01
ccgcaagcuccccgccg

SEQ ID NO: 3524204 - RNA, 20 nt, Pseudomonas aeruginosa PA01
ccgcaagcuccccgccgcca

SEQ ID NO: 3524205 - RNA, 22 nt, Pseudomonas aeruginosa PA01
ccgcaagcuccccgccgccagg

SEQ ID NO: 3524206 - RNA, 23 nt, Pseudomonas aeruginosa PA01
ccgcaagcuuuuccgaauacugc

SEQ ID NO: 3524207 - RNA, 13 nt, Pseudomonas aeruginosa PA01
ccgcaaggccagg

SEQ ID NO: 3524208 - RNA, 14 nt, Pseudomonas aeruginosa PA01
ccgcaaggccaggg

SEQ ID NO: 3524209 - RNA, 20 nt, Pseudomonas aeruginosa PA01
ccgcaaggccagggcggcgc

SEQ ID NO: 3524210 - RNA, 22 nt, Pseudomonas aeruginosa PA01
ccgcaaggccagggcggcgccg

SEQ ID NO: 3524211 - RNA, 23 nt, Pseudomonas aeruginosa PA01
ccgcaaggccagggcggcgccga

SEQ ID NO: 3524212 - RNA, 17 nt, Pseudomonas aeruginosa PA01
ccgcaaggugcgggccg

SEQ ID NO: 3524213 - RNA, 19 nt, Pseudomonas aeruginosa PA01
ccgcaaggugcgggccguc

SEQ ID NO: 3524214 - RNA, 20 nt, Pseudomonas aeruginosa PA01
ccgcaaggugcgggccgucg

SEQ ID NO: 3524215 - RNA, 17 nt, Pseudomonas aeruginosa PA01
ccgcaaguaccgccggc

SEQ ID NO: 3524216 - RNA, 16 nt, Pseudomonas aeruginosa PA01
ccgcaaguggcggcug

SEQ ID NO: 3524217 - RNA, 15 nt, Pseudomonas aeruginosa PA01
ccgcaaucagcgggc

SEQ ID NO: 3524218 - RNA, 14 nt, Pseudomonas aeruginosa PA01
ccgcaauccgaccg

SEQ ID NO: 3524219 - RNA, 19 nt, Pseudomonas aeruginosa PA01
ccgcaauccgccgcucccg

SEQ ID NO: 3524220 - RNA, 12 nt, Pseudomonas aeruginosa PA01
ccgcaaugacgg

SEQ ID NO: 3524221 - RNA, 19 nt, Pseudomonas aeruginosa PA01
ccgcaaugcggggcguucu

SEQ ID NO: 3524222 - RNA, 23 nt, Pseudomonas aeruginosa PA01
ccgcaaugcggggcguucugcuu

SEQ ID NO: 3524223 - RNA, 19 nt, Pseudomonas aeruginosa PA01
ccgcacaccgcgcgcgccu

SEQ ID NO: 3524224 - RNA, 15 nt, Pseudomonas aeruginosa PA01
ccgcacaggcuggcc

SEQ ID NO: 3524225 - RNA, 17 nt, Pseudomonas aeruginosa PA01
ccgcaccacguagccgg

SEQ ID NO: 3524226 - RNA, 21 nt, Pseudomonas aeruginosa PA01
ccgcaccacguagccggcguc

SEQ ID NO: 3524227 - RNA, 14 nt, Pseudomonas aeruginosa PA01
ccgcaccagccagc

SEQ ID NO: 3524228 - RNA, 16 nt, Pseudomonas aeruginosa PA01
ccgcaccagccagccc

SEQ ID NO: 3524229 - RNA, 14 nt, Pseudomonas aeruginosa PA01
ccgcaccagccggc

SEQ ID NO: 3524230 - RNA, 15 nt, Pseudomonas aeruginosa PA01
ccgcaccagccggcg

SEQ ID NO: 3524231 - RNA, 16 nt, Pseudomonas aeruginosa PA01
ccgcaccauccgccgc

SEQ ID NO: 3524232 - RNA, 20 nt, Pseudomonas aeruginosa PA01
ccgcaccccauccucgccgg

SEQ ID NO: 3524233 - RNA, 23 nt, Pseudomonas aeruginosa PA01
ccgcacccgggcaacugaucagc

SEQ ID NO: 3524234 - RNA, 13 nt, Pseudomonas aeruginosa PA01
ccgcaccgccagc

SEQ ID NO: 3524235 - RNA, 14 nt, Pseudomonas aeruginosa PA01
ccgcaccgccagcg

SEQ ID NO: 3524236 - RNA, 16 nt, Pseudomonas aeruginosa PA01
ccgcaccgccagcguc

SEQ ID NO: 3524237 - RNA, 21 nt, Pseudomonas aeruginosa PA01
ccgcaccgccagcgucgccgc

SEQ ID NO: 3524238 - RNA, 14 nt, Pseudomonas aeruginosa PA01
ccgcaccggcaugu

SEQ ID NO: 3524239 - RNA, 14 nt, Pseudomonas aeruginosa PA01
ccgcaccggcgcgc

SEQ ID NO: 3524240 - RNA, 17 nt, Pseudomonas aeruginosa PA01
ccgcaccggcgcgccgg

SEQ ID NO: 3524241 - RNA, 15 nt, Pseudomonas aeruginosa PA01
ccgcaccuacccgag

SEQ ID NO: 3524242 - RNA, 13 nt, Pseudomonas aeruginosa PA01
ccgcaccuggacc

SEQ ID NO: 3524243 - RNA, 12 nt, Pseudomonas aeruginosa PA01
ccgcaccuggug

SEQ ID NO: 3524244 - RNA, 14 nt, Pseudomonas aeruginosa PA01
ccgcaccuggugga

SEQ ID NO: 3524245 - RNA, 16 nt, Pseudomonas aeruginosa PA01
ccgcacgaggcgggcu

SEQ ID NO: 3524246 - RNA, 17 nt, Pseudomonas aeruginosa PA01
ccgcacgaggcgggcug

SEQ ID NO: 3524247 - RNA, 18 nt, Pseudomonas aeruginosa PA01
ccgcacgaggcgggcugg

SEQ ID NO: 3524248 - RNA, 21 nt, Pseudomonas aeruginosa PA01
ccgcacgaggcgggcuggaaa

SEQ ID NO: 3524249 - RNA, 21 nt, Pseudomonas aeruginosa PA01
ccgcacugguggcgaacagca

SEQ ID NO: 3524250 - RNA, 13 nt, Pseudomonas aeruginosa PA01
ccgcacuuccagg

SEQ ID NO: 3524251 - RNA, 12 nt, Pseudomonas aeruginosa PA01
ccgcagaaccag

SEQ ID NO: 3524252 - RNA, 16 nt, Pseudomonas aeruginosa PA01
ccgcagaaccagacgc

SEQ ID NO: 3524253 - RNA, 17 nt, Pseudomonas aeruginosa PA01
ccgcagacaucgccgag

SEQ ID NO: 3524254 - RNA, 20 nt, Pseudomonas aeruginosa PA01
ccgcagacaucgccgagggc

SEQ ID NO: 3524255 - RNA, 14 nt, Pseudomonas aeruginosa PA01
ccgcagaccagcga

SEQ ID NO: 3524256 - RNA, 14 nt, Pseudomonas aeruginosa PA01
ccgcagacguggca

SEQ ID NO: 3524257 - RNA, 23 nt, Pseudomonas aeruginosa PA01
ccgcagacguggcauucgucgcc

SEQ ID NO: 3524258 - RNA, 19 nt, Pseudomonas aeruginosa PA01
ccgcagacuccggcgcagc

SEQ ID NO: 3524259 - RNA, 22 nt, Pseudomonas aeruginosa PA01
ccgcagacuccggcgcagccca

SEQ ID NO: 3524260 - RNA, 23 nt, Pseudomonas aeruginosa PA01
ccgcagacuccggcgcagcccag

SEQ ID NO: 3524261 - RNA, 13 nt, Pseudomonas aeruginosa PA01
ccgcagagccagc

SEQ ID NO: 3524262 - RNA, 16 nt, Pseudomonas aeruginosa PA01
ccgcagagccagccgc

SEQ ID NO: 3524263 - RNA, 23 nt, Pseudomonas aeruginosa PA01
ccgcagagccagccgcagcccgg

SEQ ID NO: 3524264 - RNA, 21 nt, Pseudomonas aeruginosa PA01
ccgcagaugcuccagggagcg

SEQ ID NO: 3524265 - RNA, 23 nt, Pseudomonas aeruginosa PA01
ccgcagaugcuccagggagcgcu

SEQ ID NO: 3524266 - RNA, 18 nt, Pseudomonas aeruginosa PA01
ccgcagcacagccccagc

SEQ ID NO: 3524267 - RNA, 11 nt, Pseudomonas aeruginosa PA01
ccgcagcagcg

SEQ ID NO: 3524268 - RNA, 13 nt, Pseudomonas aeruginosa PA01
ccgcagcagcggc

SEQ ID NO: 3524269 - RNA, 14 nt, Pseudomonas aeruginosa PA01
ccgcagcagcggca

SEQ ID NO: 3524270 - RNA, 14 nt, Pseudomonas aeruginosa PA01
ccgcagcagcggcg

SEQ ID NO: 3524271 - RNA, 17 nt, Pseudomonas aeruginosa PA01
ccgcagcagcggcgaca

SEQ ID NO: 3524272 - RNA, 12 nt, Pseudomonas aeruginosa PA01
ccgcagccacag

SEQ ID NO: 3524273 - RNA, 17 nt, Pseudomonas aeruginosa PA01
ccgcagccacaggcgcc

SEQ ID NO: 3524274 - RNA, 18 nt, Pseudomonas aeruginosa PA01
ccgcagccacaggcgcca

SEQ ID NO: 3524275 - RNA, 14 nt, Pseudomonas aeruginosa PA01
ccgcagccagccuc

SEQ ID NO: 3524276 - RNA, 13 nt, Pseudomonas aeruginosa PA01
ccgcagcccgguc

SEQ ID NO: 3524277 - RNA, 12 nt, Pseudomonas aeruginosa PA01
ccgcagccgugg

SEQ ID NO: 3524278 - RNA, 16 nt, Pseudomonas aeruginosa PA01
ccgcagccguggcgcg

SEQ ID NO: 3524279 - RNA, 17 nt, Pseudomonas aeruginosa PA01
ccgcagccguggcgcga

SEQ ID NO: 3524280 - RNA, 14 nt, Pseudomonas aeruginosa PA01
ccgcagccuuggca

SEQ ID NO: 3524281 - RNA, 20 nt, Pseudomonas aeruginosa PA01
ccgcagcgaucagcaccagc

SEQ ID NO: 3524282 - RNA, 23 nt, Pseudomonas aeruginosa PA01
ccgcagcgaucagcaccagcgga

SEQ ID NO: 3524283 - RNA, 19 nt, Pseudomonas aeruginosa PA01
ccgcagcgcaagucggccu

SEQ ID NO: 3524284 - RNA, 21 nt, Pseudomonas aeruginosa PA01
ccgcagcgccccucccagcca

SEQ ID NO: 3524285 - RNA, 19 nt, Pseudomonas aeruginosa PA01
ccgcagcgccucccgggcc

SEQ ID NO: 3524286 - RNA, 21 nt, Pseudomonas aeruginosa PA01
ccgcagcgcuuuucaggaugu

SEQ ID NO: 3524287 - RNA, 14 nt, Pseudomonas aeruginosa PA01
ccgcagcggcagcg

SEQ ID NO: 3524288 - RNA, 18 nt, Pseudomonas aeruginosa PA01
ccgcagcggcaugcccug

SEQ ID NO: 3524289 - RNA, 14 nt, Pseudomonas aeruginosa PA01
ccgcagcggccagg

SEQ ID NO: 3524290 - RNA, 23 nt, Pseudomonas aeruginosa PA01
ccgccagcaagacgguccccagu

SEQ ID NO: 3524291 - RNA, 21 nt, Pseudomonas aeruginosa PA01
ccgccagcaccacccggccgc

SEQ ID NO: 3524292 - RNA, 19 nt, Pseudomonas aeruginosa PA01
ccgccagcaccuggcagug

SEQ ID NO: 3524293 - RNA, 23 nt, Pseudomonas aeruginosa PA01
ccgccagcaccuggcagugcgcc

SEQ ID NO: 3524294 - RNA, 15 nt, Pseudomonas aeruginosa PA01
ccgccagcagacggc

SEQ ID NO: 3524295 - RNA, 18 nt, Pseudomonas aeruginosa PA01
ccgccagcagacggcacg

SEQ ID NO: 3524296 - RNA, 13 nt, Pseudomonas aeruginosa PA01
ccgccagcaggcc

SEQ ID NO: 3524297 - RNA, 14 nt, Pseudomonas aeruginosa PA01
ccgccagcaggccg

SEQ ID NO: 3524298 - RNA, 15 nt, Pseudomonas aeruginosa PA01
ccgccagcaggccga

SEQ ID NO: 3524299 - RNA, 19 nt, Pseudomonas aeruginosa PA01
ccgccagcaggccgaaggc

SEQ ID NO: 3524300 - RNA, 22 nt, Pseudomonas aeruginosa PA01
ccgccagcaggccgaaggccag

SEQ ID NO: 3524301 - RNA, 15 nt, Pseudomonas aeruginosa PA01
ccgccagcaggcgcc

SEQ ID NO: 3524302 - RNA, 17 nt, Pseudomonas aeruginosa PA01
ccgccagcaggcgccgg

SEQ ID NO: 3524303 - RNA, 18 nt, Pseudomonas aeruginosa PA01
ccgccagcaggcgccggc

SEQ ID NO: 3524304 - RNA, 19 nt, Pseudomonas aeruginosa PA01
ccgccagcaggcgccggcg

SEQ ID NO: 3524305 - RNA, 20 nt, Pseudomonas aeruginosa PA01
ccgccagcaggcgccggcgg

SEQ ID NO: 3524306 - RNA, 19 nt, Pseudomonas aeruginosa PA01
ccgccagcaggcgcgggcu

SEQ ID NO: 3524307 - RNA, 20 nt, Pseudomonas aeruginosa PA01
ccgccagcaggcgcgggcug

SEQ ID NO: 3524308 - RNA, 14 nt, Pseudomonas aeruginosa PA01
ccgccagcaggcgu

SEQ ID NO: 3524309 - RNA, 19 nt, Pseudomonas aeruginosa PA01
ccgccagcaggucggccug

SEQ ID NO: 3524310 - RNA, 21 nt, Pseudomonas aeruginosa PA01
ccgccagcaguggcuccgcgc

SEQ ID NO: 3524311 - RNA, 22 nt, Pseudomonas aeruginosa PA01
ccgccagcaguggcuccgcgcg

SEQ ID NO: 3524312 - RNA, 20 nt, Pseudomonas aeruginosa PA01
ccgccagcaguugcaacagc

SEQ ID NO: 3524313 - RNA, 17 nt, Pseudomonas aeruginosa PA01
ccgccagcauggcgaag

SEQ ID NO: 3524314 - RNA, 11 nt, Pseudomonas aeruginosa PA01
ccgccagccag

SEQ ID NO: 3524315 - RNA, 12 nt, Pseudomonas aeruginosa PA01
ccgccagccaga

SEQ ID NO: 3524316 - RNA, 20 nt, Pseudomonas aeruginosa PA01
ccgccagccagagcagcguc

SEQ ID NO: 3524317 - RNA, 12 nt, Pseudomonas aeruginosa PA01
ccgccagccagc

SEQ ID NO: 3524318 - RNA, 13 nt, Pseudomonas aeruginosa PA01
ccgccagccagcc

SEQ ID NO: 3524319 - RNA, 14 nt, Pseudomonas aeruginosa PA01
ccgccagccagccg

SEQ ID NO: 3524320 - RNA, 16 nt, Pseudomonas aeruginosa PA01
ccgccagccagccgcg

SEQ ID NO: 3524321 - RNA, 19 nt, Pseudomonas aeruginosa PA01
ccgccagccagccgcgcgc

SEQ ID NO: 3524322 - RNA, 21 nt, Pseudomonas aeruginosa PA01
ccgccagccagccgcgcgccg

SEQ ID NO: 3524323 - RNA, 13 nt, Pseudomonas aeruginosa PA01
ccgccagcccgcc

SEQ ID NO: 3524324 - RNA, 15 nt, Pseudomonas aeruginosa PA01
ccgccagccgccagg

SEQ ID NO: 3524325 - RNA, 19 nt, Pseudomonas aeruginosa PA01
ccgccagccgccaggacgg

SEQ ID NO: 3524326 - RNA, 13 nt, Pseudomonas aeruginosa PA01
ccgccagcgccgg

SEQ ID NO: 3524327 - RNA, 17 nt, Pseudomonas aeruginosa PA01
ccgccagcgccggccau

SEQ ID NO: 3524328 - RNA, 11 nt, Pseudomonas aeruginosa PA01
ccgccagcgcg

SEQ ID NO: 3524329 - RNA, 14 nt, Pseudomonas aeruginosa PA01
ccgccagcgcggcg

SEQ ID NO: 3524330 - RNA, 22 nt, Pseudomonas aeruginosa PA01
ccgccagcgcggcgcuuggcga

SEQ ID NO: 3524331 - RNA, 12 nt, Pseudomonas aeruginosa PA01
ccgccagcggca

SEQ ID NO: 3524332 - RNA, 13 nt, Pseudomonas aeruginosa PA01
ccgccagcggcau

SEQ ID NO: 3524333 - RNA, 23 nt, Pseudomonas aeruginosa PA01
ccgccagcggcauucgaacggcu

SEQ ID NO: 3524334 - RNA, 13 nt, Pseudomonas aeruginosa PA01
ccgccagcgggac

SEQ ID NO: 3524335 - RNA, 17 nt, Pseudomonas aeruginosa PA01
ccgccagcgggacgaug

SEQ ID NO: 3524336 - RNA, 17 nt, Pseudomonas aeruginosa PA01
ccgccagcgucgccgcc

SEQ ID NO: 3524337 - RNA, 13 nt, Pseudomonas aeruginosa PA01
ccgccagcuaccg

SEQ ID NO: 3524338 - RNA, 20 nt, Pseudomonas aeruginosa PA01
ccgccagcuaccggcagggu

SEQ ID NO: 3524339 - RNA, 22 nt, Pseudomonas aeruginosa PA01
ccgccagcucauggagcaacag

SEQ ID NO: 3524340 - RNA, 12 nt, Pseudomonas aeruginosa PA01
ccgccagcucgc

SEQ ID NO: 3524341 - RNA, 20 nt, Pseudomonas aeruginosa PA01
ccgccagcucgcuguccagc

SEQ ID NO: 3524342 - RNA, 19 nt, Pseudomonas aeruginosa PA01
ccgccagcuuguccgccgg

SEQ ID NO: 3524343 - RNA, 13 nt, Pseudomonas aeruginosa PA01
ccgccaggaccuc

SEQ ID NO: 3524344 - RNA, 16 nt, Pseudomonas aeruginosa PA01
ccgccaggacggcagg

SEQ ID NO: 3524345 - RNA, 18 nt, Pseudomonas aeruginosa PA01
ccgccaggacggcagggu

SEQ ID NO: 3524346 - RNA, 12 nt, Pseudomonas aeruginosa PA01
ccgccaggcaga

SEQ ID NO: 3524347 - RNA, 20 nt, Pseudomonas aeruginosa PA01
ccgccaggcagaccaggccg

SEQ ID NO: 3524348 - RNA, 21 nt, Pseudomonas aeruginosa PA01
ccgccaggcagaccaggccga

SEQ ID NO: 3524349 - RNA, 15 nt, Pseudomonas aeruginosa PA01
ccgccaggcaggccg

SEQ ID NO: 3524350 - RNA, 13 nt, Pseudomonas aeruginosa PA01
ccgccaggcccug

SEQ ID NO: 3524351 - RNA, 20 nt, Pseudomonas aeruginosa PA01
ccgccaggcccugggcggcg

SEQ ID NO: 3524352 - RNA, 14 nt, Pseudomonas aeruginosa PA01
ccgccaggccgacc

SEQ ID NO: 3524353 - RNA, 16 nt, Pseudomonas aeruginosa PA01
ccgccaggccgacccg

SEQ ID NO: 3524354 - RNA, 17 nt, Pseudomonas aeruginosa PA01
ccgccaggccgacccgc

SEQ ID NO: 3524355 - RNA, 12 nt, Pseudomonas aeruginosa PA01
ccgccaggccgc

SEQ ID NO: 3524356 - RNA, 14 nt, Pseudomonas aeruginosa PA01
ccgccaggccgcgc

SEQ ID NO: 3524357 - RNA, 17 nt, Pseudomonas aeruginosa PA01
ccgccaggccgcgcagu

SEQ ID NO: 3524358 - RNA, 13 nt, Pseudomonas aeruginosa PA01
ccgccaggccucg

SEQ ID NO: 3524359 - RNA, 18 nt, Pseudomonas aeruginosa PA01
ccgccaggccucggcgcg

SEQ ID NO: 3524360 - RNA, 14 nt, Pseudomonas aeruginosa PA01
ccgccaggccuucc

SEQ ID NO: 3524361 - RNA, 11 nt, Pseudomonas aeruginosa PA01
ccgccaggcgc

SEQ ID NO: 3524362 - RNA, 14 nt, Pseudomonas aeruginosa PA01
ccgccaggcgcagc

SEQ ID NO: 3524363 - RNA, 18 nt, Pseudomonas aeruginosa PA01
ccgccaggcgcagccagc

SEQ ID NO: 3524364 - RNA, 19 nt, Pseudomonas aeruginosa PA01
ccgccaggcgcagccagca

SEQ ID NO: 3524365 - RNA, 14 nt, Pseudomonas aeruginosa PA01
ccgccaggcgccga

SEQ ID NO: 3524366 - RNA, 12 nt, Pseudomonas aeruginosa PA01
ccgccaggcgcg

SEQ ID NO: 3524367 - RNA, 15 nt, Pseudomonas aeruginosa PA01
ccgccaggcgcgucg

SEQ ID NO: 3524368 - RNA, 19 nt, Pseudomonas aeruginosa PA01
ccgccaggcgcgucgcggc

SEQ ID NO: 3524369 - RNA, 19 nt, Pseudomonas aeruginosa PA01
ccgccaggcgcgucuccag

SEQ ID NO: 3524370 - RNA, 21 nt, Pseudomonas aeruginosa PA01
ccgccaggcgcgucuccagcu

SEQ ID NO: 3524371 - RNA, 12 nt, Pseudomonas aeruginosa PA01
ccgccaggcgcu

SEQ ID NO: 3524372 - RNA, 13 nt, Pseudomonas aeruginosa PA01
ccgccaggcgcuc

SEQ ID NO: 3524373 - RNA, 14 nt, Pseudomonas aeruginosa PA01
ccgccaggcggagc

SEQ ID NO: 3524374 - RNA, 21 nt, Pseudomonas aeruginosa PA01
ccgccaggcggagcauggugu

SEQ ID NO: 3524375 - RNA, 22 nt, Pseudomonas aeruginosa PA01
ccgccaggcggcaagggcgucu

SEQ ID NO: 3524376 - RNA, 14 nt, Pseudomonas aeruginosa PA01
ccgccaggcggccg

SEQ ID NO: 3524377 - RNA, 15 nt, Pseudomonas aeruginosa PA01
ccgccaggcggccgc

SEQ ID NO: 3524378 - RNA, 20 nt, Pseudomonas aeruginosa PA01
ccgccaggcggccgcuggcg

SEQ ID NO: 3524379 - RNA, 15 nt, Pseudomonas aeruginosa PA01
ccgccaggcuggcca

SEQ ID NO: 3524380 - RNA, 13 nt, Pseudomonas aeruginosa PA01
ccgccagggcgcu

SEQ ID NO: 3524381 - RNA, 17 nt, Pseudomonas aeruginosa PA01
ccgccagggcgucggag

SEQ ID NO: 3524382 - RNA, 18 nt, Pseudomonas aeruginosa PA01
ccgccagggcgucggaga

SEQ ID NO: 3524383 - RNA, 19 nt, Pseudomonas aeruginosa PA01
ccgccaggguguacuugac

SEQ ID NO: 3524384 - RNA, 22 nt, Pseudomonas aeruginosa PA01
ccgccagguccaggcucagcuc

SEQ ID NO: 3524385 - RNA, 17 nt, Pseudomonas aeruginosa PA01
ccgccagguccgccugg

SEQ ID NO: 3524386 - RNA, 13 nt, Pseudomonas aeruginosa PA01
ccgccaggucgau

SEQ ID NO: 3524387 - RNA, 21 nt, Pseudomonas aeruginosa PA01
ccgccaggucgauccccaacc

SEQ ID NO: 3524388 - RNA, 23 nt, Pseudomonas aeruginosa PA01
ccgccaggucgauccccaacccg

SEQ ID NO: 3524389 - RNA, 14 nt, Pseudomonas aeruginosa PA01
ccgccagguggcgg

SEQ ID NO: 3524390 - RNA, 16 nt, Pseudomonas aeruginosa PA01
ccgccagguggcgggc

SEQ ID NO: 3524391 - RNA, 13 nt, Pseudomonas aeruginosa PA01
ccgccagucggcc

SEQ ID NO: 3524392 - RNA, 18 nt, Pseudomonas aeruginosa PA01
ccgccagucggccuggcu

SEQ ID NO: 3524393 - RNA, 21 nt, Pseudomonas aeruginosa PA01
ccgccgaacagcaacaccgcg

SEQ ID NO: 3524394 - RNA, 22 nt, Pseudomonas aeruginosa PA01
ccgccgaacagcaacaccgcgc

SEQ ID NO: 3524395 - RNA, 15 nt, Pseudomonas aeruginosa PA01
ccgccgaacaugccg

SEQ ID NO: 3524396 - RNA, 16 nt, Pseudomonas aeruginosa PA01
ccgccgaacaugccga

SEQ ID NO: 3524397 - RNA, 18 nt, Pseudomonas aeruginosa PA01
ccgccgaacgccaccagg

SEQ ID NO: 3524398 - RNA, 21 nt, Pseudomonas aeruginosa PA01
ccgccgaacggaucgcgucgc

SEQ ID NO: 3524399 - RNA, 22 nt, Pseudomonas aeruginosa PA01
ccgccgaagccgacgccgagca

SEQ ID NO: 3524400 - RNA, 13 nt, Pseudomonas aeruginosa PA01
ccgccgaagcggg

SEQ ID NO: 3524401 - RNA, 14 nt, Pseudomonas aeruginosa PA01
ccgccgacacccgc

SEQ ID NO: 3524402 - RNA, 15 nt, Pseudomonas aeruginosa PA01
ccgccgacacccgcg

SEQ ID NO: 3524403 - RNA, 20 nt, Pseudomonas aeruginosa PA01
ccgccgacacccgcgccgcc

SEQ ID NO: 3524404 - RNA, 21 nt, Pseudomonas aeruginosa PA01
ccgccgacacccgcgccgccg

SEQ ID NO: 3524405 - RNA, 22 nt, Pseudomonas aeruginosa PA01
ccgccgacacccgcgccgccgc

SEQ ID NO: 3524406 - RNA, 17 nt, Pseudomonas aeruginosa PA01
ccgccgaccagcacggc

SEQ ID NO: 3524407 - RNA, 18 nt, Pseudomonas aeruginosa PA01
ccgccgaccagcacggcg

SEQ ID NO: 3524408 - RNA, 20 nt, Pseudomonas aeruginosa PA01
ccgccgaccggacuccgcgg

SEQ ID NO: 3524409 - RNA, 20 nt, Pseudomonas aeruginosa PA01
ccgccgaccgugagcuuguc

SEQ ID NO: 3524410 - RNA, 16 nt, Pseudomonas aeruginosa PA01
ccgccgaccucggccg

SEQ ID NO: 3524411 - RNA, 17 nt, Pseudomonas aeruginosa PA01
ccgccgaccucggccgc

SEQ ID NO: 3524412 - RNA, 14 nt, Pseudomonas aeruginosa PA01
ccgccgacgccgga

SEQ ID NO: 3524413 - RNA, 15 nt, Pseudomonas aeruginosa PA01
ccgccgacgccggac

SEQ ID NO: 3524414 - RNA, 17 nt, Pseudomonas aeruginosa PA01
ccgccgacugcaacugg

SEQ ID NO: 3524415 - RNA, 18 nt, Pseudomonas aeruginosa PA01
ccgccgacugcaacuggc

SEQ ID NO: 3524416 - RNA, 20 nt, Pseudomonas aeruginosa PA01
ccgccgacugcaacuggccg

SEQ ID NO: 3524417 - RNA, 13 nt, Pseudomonas aeruginosa PA01
ccgccgagacucc

SEQ ID NO: 3524418 - RNA, 23 nt, Pseudomonas aeruginosa PA01
ccgccgagacuccggagaaccgg

SEQ ID NO: 3524419 - RNA, 13 nt, Pseudomonas aeruginosa PA01
ccgccgagcaacu

SEQ ID NO: 3524420 - RNA, 15 nt, Pseudomonas aeruginosa PA01
ccgccgagcaacugc

SEQ ID NO: 3524421 - RNA, 14 nt, Pseudomonas aeruginosa PA01
ccgccgagcaggcc

SEQ ID NO: 3524422 - RNA, 22 nt, Pseudomonas aeruginosa PA01
ccgccgagcaugcgggcgaucu

SEQ ID NO: 3524423 - RNA, 14 nt, Pseudomonas aeruginosa PA01
ccgccgagcgccug

SEQ ID NO: 3524424 - RNA, 16 nt, Pseudomonas aeruginosa PA01
ccgccgagcgccuggc

SEQ ID NO: 3524425 - RNA, 22 nt, Pseudomonas aeruginosa PA01
ccgccgagcguugggccucgcu

SEQ ID NO: 3524426 - RNA, 16 nt, Pseudomonas aeruginosa PA01
ccgccgaggaagccga

SEQ ID NO: 3524427 - RNA, 19 nt, Pseudomonas aeruginosa PA01
ccgccgaggaagccgaccg

SEQ ID NO: 3524428 - RNA, 20 nt, Pseudomonas aeruginosa PA01
ccgccgaggaagccgaccgg

SEQ ID NO: 3524429 - RNA, 11 nt, Pseudomonas aeruginosa PA01
ccgccgagggc

SEQ ID NO: 3524430 - RNA, 20 nt, Pseudomonas aeruginosa PA01
ccgccgagggcaccgacgau

SEQ ID NO: 3524431 - RNA, 15 nt, Pseudomonas aeruginosa PA01
ccgccgagggcgcca

SEQ ID NO: 3524432 - RNA, 16 nt, Pseudomonas aeruginosa PA01
ccgccgaggugcugca

SEQ ID NO: 3524433 - RNA, 22 nt, Pseudomonas aeruginosa PA01
ccgccgauacaccaccauaccg

SEQ ID NO: 3524434 - RNA, 16 nt, Pseudomonas aeruginosa PA01
ccgccgauacagcgcg

SEQ ID NO: 3524435 - RNA, 16 nt, Pseudomonas aeruginosa PA01
ccgccgauaccucguu

SEQ ID NO: 3524436 - RNA, 12 nt, Pseudomonas aeruginosa PA01
ccgccgaucagc

SEQ ID NO: 3524437 - RNA, 14 nt, Pseudomonas aeruginosa PA01
ccgccgaucagcgc

SEQ ID NO: 3524438 - RNA, 17 nt, Pseudomonas aeruginosa PA01
ccgccgaucagcgcgcc

SEQ ID NO: 3524439 - RNA, 20 nt, Pseudomonas aeruginosa PA01
ccgccgauccaggaaccggc

SEQ ID NO: 3524440 - RNA, 22 nt, Pseudomonas aeruginosa PA01
ccgccgauccaggaaccggcca

SEQ ID NO: 3524441 - RNA, 14 nt, Pseudomonas aeruginosa PA01
ccgccgaucccgac

SEQ ID NO: 3524442 - RNA, 14 nt, Pseudomonas aeruginosa PA01
ccgccgaucugcug

SEQ ID NO: 3524443 - RNA, 15 nt, Pseudomonas aeruginosa PA01
ccgccgaucugcugg

SEQ ID NO: 3524444 - RNA, 23 nt, Pseudomonas aeruginosa PA01
ccgccgaucugcugggucaucga

SEQ ID NO: 3524445 - RNA, 14 nt, Pseudomonas aeruginosa PA01
ccgccgaugccgac

SEQ ID NO: 3524446 - RNA, 21 nt, Pseudomonas aeruginosa PA01
ccgccgaugccgacgucgacu

SEQ ID NO: 3524447 - RNA, 22 nt, Pseudomonas aeruginosa PA01
ccgccgaugcgcuacggcauca

SEQ ID NO: 3524448 - RNA, 21 nt, Pseudomonas aeruginosa PA01
ccgccgaugcuguucagcagg

SEQ ID NO: 3524449 - RNA, 13 nt, Pseudomonas aeruginosa PA01
ccgccgcagacca

SEQ ID NO: 3524450 - RNA, 17 nt, Pseudomonas aeruginosa PA01
ccgccgcagaccagcga

SEQ ID NO: 3524451 - RNA, 15 nt, Pseudomonas aeruginosa PA01
ccgccgcagagccag

SEQ ID NO: 3524452 - RNA, 17 nt, Pseudomonas aeruginosa PA01
ccgccgcagagccagcc

SEQ ID NO: 3524453 - RNA, 18 nt, Pseudomonas aeruginosa PA01
ccgccgcagagccagccg

SEQ ID NO: 3524454 - RNA, 19 nt, Pseudomonas aeruginosa PA01
ccgccgcagagccagccgc

SEQ ID NO: 3524455 - RNA, 13 nt, Pseudomonas aeruginosa PA01
ccgccgcagccgu

SEQ ID NO: 3524456 - RNA, 14 nt, Pseudomonas aeruginosa PA01
ccgccgcagccgug

SEQ ID NO: 3524457 - RNA, 16 nt, Pseudomonas aeruginosa PA01
ccgccgccagcaacag

SEQ ID NO: 3524458 - RNA, 16 nt, Pseudomonas aeruginosa PA01
ccgccgccagcaacgg

SEQ ID NO: 3524459 - RNA, 14 nt, Pseudomonas aeruginosa PA01
ccgccgccaggcgc

SEQ ID NO: 3524460 - RNA, 15 nt, Pseudomonas aeruginosa PA01
ccgccgccaggcggc

SEQ ID NO: 3524461 - RNA, 12 nt, Pseudomonas aeruginosa PA01
ccgccgccaggu

SEQ ID NO: 3524462 - RNA, 13 nt, Pseudomonas aeruginosa PA01
ccgccgccagguc

SEQ ID NO: 3524463 - RNA, 20 nt, Pseudomonas aeruginosa PA01
ccgccgccagguccgccugg

SEQ ID NO: 3524464 - RNA, 15 nt, Pseudomonas aeruginosa PA01
ccgccgcccagcagc

SEQ ID NO: 3524465 - RNA, 16 nt, Pseudomonas aeruginosa PA01
ccgccgcccagcagca

SEQ ID NO: 3524466 - RNA, 21 nt, Pseudomonas aeruginosa PA01
ccgccgcccagcagcaccauc

SEQ ID NO: 3524467 - RNA, 14 nt, Pseudomonas aeruginosa PA01
ccgccgccgacagg

SEQ ID NO: 3524468 - RNA, 12 nt, Pseudomonas aeruginosa PA01
ccgccgccgacg

SEQ ID NO: 3524469 - RNA, 20 nt, Pseudomonas aeruginosa PA01
ccgccgccgagaacccggcc

SEQ ID NO: 3524470 - RNA, 14 nt, Pseudomonas aeruginosa PA01
ccgccgccgcaacc

SEQ ID NO: 3524471 - RNA, 16 nt, Pseudomonas aeruginosa PA01
ccgccgccgcaaccgc

SEQ ID NO: 3524472 - RNA, 15 nt, Pseudomonas aeruginosa PA01
ccgccgccgccccag

SEQ ID NO: 3524473 - RNA, 17 nt, Pseudomonas aeruginosa PA01
ccgccgccgccgucgac

SEQ ID NO: 3524474 - RNA, 14 nt, Pseudomonas aeruginosa PA01
ccgccgccgcgccg

SEQ ID NO: 3524475 - RNA, 15 nt, Pseudomonas aeruginosa PA01
ccgccgccgcgccgg

SEQ ID NO: 3524476 - RNA, 15 nt, Pseudomonas aeruginosa PA01
ccgccgccgcggcgc

SEQ ID NO: 3524477 - RNA, 13 nt, Pseudomonas aeruginosa PA01
ccgccgccgcggu

SEQ ID NO: 3524478 - RNA, 13 nt, Pseudomonas aeruginosa PA01
ccgccgccggccu

SEQ ID NO: 3524479 - RNA, 12 nt, Pseudomonas aeruginosa PA01
ccgccgccggga

SEQ ID NO: 3524480 - RNA, 13 nt, Pseudomonas aeruginosa PA01
ccgccgccgucga

SEQ ID NO: 3524481 - RNA, 22 nt, Pseudomonas aeruginosa PA01
ccgccgccgucgacaccgauca

SEQ ID NO: 3524482 - RNA, 14 nt, Pseudomonas aeruginosa PA01
ccgccgccuaucca

SEQ ID NO: 3524483 - RNA, 14 nt, Pseudomonas aeruginosa PA01
ccgccgccuauccg

SEQ ID NO: 3524484 - RNA, 20 nt, Pseudomonas aeruginosa PA01
ccgccgccugcucgccgcug

SEQ ID NO: 3524485 - RNA, 16 nt, Pseudomonas aeruginosa PA01
ccgccgcgagcgccgc

SEQ ID NO: 3524486 - RNA, 16 nt, Pseudomonas aeruginosa PA01
ccgccgcgcagcacca

SEQ ID NO: 3524487 - RNA, 15 nt, Pseudomonas aeruginosa PA01
ccgccgcgcaggcgg

SEQ ID NO: 3524488 - RNA, 19 nt, Pseudomonas aeruginosa PA01
ccgccgcgcaucaccccgc

SEQ ID NO: 3524489 - RNA, 20 nt, Pseudomonas aeruginosa PA01
ccgccgcgcaucaccccgca

SEQ ID NO: 3524490 - RNA, 13 nt, Pseudomonas aeruginosa PA01
ccgccgcgcccgg

SEQ ID NO: 3524491 - RNA, 16 nt, Pseudomonas aeruginosa PA01
ccgccgcgcccggcgc

SEQ ID NO: 3524492 - RNA, 13 nt, Pseudomonas aeruginosa PA01
ccgccgcgccgcu

SEQ ID NO: 3524493 - RNA, 14 nt, Pseudomonas aeruginosa PA01
ccgccgcgccgcuc

SEQ ID NO: 3524494 - RNA, 17 nt, Pseudomonas aeruginosa PA01
ccgccgcgccgcucagg

SEQ ID NO: 3524495 - RNA, 20 nt, Pseudomonas aeruginosa PA01
ccgccgcgccgcucaggcgu

SEQ ID NO: 3524496 - RNA, 20 nt, Pseudomonas aeruginosa PA01
ccgccgggcggcgucgcgga

SEQ ID NO: 3524497 - RNA, 13 nt, Pseudomonas aeruginosa PA01
ccgccgggcuucg

SEQ ID NO: 3524498 - RNA, 22 nt, Pseudomonas aeruginosa PA01
ccgccggggaagcugccuucca

SEQ ID NO: 3524499 - RNA, 21 nt, Pseudomonas aeruginosa PA01
ccgccggggaucagcgagagc

SEQ ID NO: 3524500 - RNA, 12 nt, Pseudomonas aeruginosa PA01
ccgccggggcgc

SEQ ID NO: 3524501 - RNA, 15 nt, Pseudomonas aeruginosa PA01
ccgccggggcgcagg

SEQ ID NO: 3524502 - RNA, 18 nt, Pseudomonas aeruginosa PA01
ccgccggguacagcgcca

SEQ ID NO: 3524503 - RNA, 17 nt, Pseudomonas aeruginosa PA01
ccgccggguccaccgcg

SEQ ID NO: 3524504 - RNA, 21 nt, Pseudomonas aeruginosa PA01
ccgccgguagccguucgacgc

SEQ ID NO: 3524505 - RNA, 16 nt, Pseudomonas aeruginosa PA01
ccgccgguaucccggc

SEQ ID NO: 3524506 - RNA, 15 nt, Pseudomonas aeruginosa PA01
ccgccggucaaccgc

SEQ ID NO: 3524507 - RNA, 13 nt, Pseudomonas aeruginosa PA01
ccgccggucacca

SEQ ID NO: 3524508 - RNA, 18 nt, Pseudomonas aeruginosa PA01
ccgccggucaccacugga

SEQ ID NO: 3524509 - RNA, 16 nt, Pseudomonas aeruginosa PA01
ccgccggugaacaggu

SEQ ID NO: 3524510 - RNA, 23 nt, Pseudomonas aeruginosa PA01
ccgccggugaacagguagcugga

SEQ ID NO: 3524511 - RNA, 16 nt, Pseudomonas aeruginosa PA01
ccgccggugcaccagg

SEQ ID NO: 3524512 - RNA, 17 nt, Pseudomonas aeruginosa PA01
ccgccgguucgcaggcc

SEQ ID NO: 3524513 - RNA, 20 nt, Pseudomonas aeruginosa PA01
ccgccgguucgcaggccagg

SEQ ID NO: 3524514 - RNA, 23 nt, Pseudomonas aeruginosa PA01
ccgccgguucgcaggccaggcgc

SEQ ID NO: 3524515 - RNA, 12 nt, Pseudomonas aeruginosa PA01
ccgccguagagu

SEQ ID NO: 3524516 - RNA, 16 nt, Pseudomonas aeruginosa PA01
ccgccguccuccagca

SEQ ID NO: 3524517 - RNA, 23 nt, Pseudomonas aeruginosa PA01
ccgccguccuccagcaaggcguc

SEQ ID NO: 3524518 - RNA, 21 nt, Pseudomonas aeruginosa PA01
ccgccgucgacaccgaucacc

SEQ ID NO: 3524519 - RNA, 14 nt, Pseudomonas aeruginosa PA01
ccgccgucgcggcc

SEQ ID NO: 3524520 - RNA, 18 nt, Pseudomonas aeruginosa PA01
ccgccgucgcggccaucg

SEQ ID NO: 3524521 - RNA, 16 nt, Pseudomonas aeruginosa PA01
ccgccgucgggcuucg

SEQ ID NO: 3524522 - RNA, 16 nt, Pseudomonas aeruginosa PA01
ccgccgucuccgccgc

SEQ ID NO: 3524523 - RNA, 21 nt, Pseudomonas aeruginosa PA01
ccgccgucuugccgcugcgcg

SEQ ID NO: 3524524 - RNA, 16 nt, Pseudomonas aeruginosa PA01
ccgccgugaggcgcgc

SEQ ID NO: 3524525 - RNA, 20 nt, Pseudomonas aeruginosa PA01
ccgccgugaggcgcgcgccg

SEQ ID NO: 3524526 - RNA, 21 nt, Pseudomonas aeruginosa PA01
ccgccgugaggcgcgcgccga

SEQ ID NO: 3524527 - RNA, 21 nt, Pseudomonas aeruginosa PA01
ccgccgugcgcuccgccaggc

SEQ ID NO: 3524528 - RNA, 22 nt, Pseudomonas aeruginosa PA01
ccgccgugcgcuccgccaggcc

SEQ ID NO: 3524529 - RNA, 20 nt, Pseudomonas aeruginosa PA01
ccgccguggcugugcuggcc

SEQ ID NO: 3524530 - RNA, 17 nt, Pseudomonas aeruginosa PA01
ccgccgugggaacgcga

SEQ ID NO: 3524531 - RNA, 20 nt, Pseudomonas aeruginosa PA01
ccgccguuccuccucgccgc

SEQ ID NO: 3524532 - RNA, 22 nt, Pseudomonas aeruginosa PA01
ccgccguuccuccucgccgccg

SEQ ID NO: 3524533 - RNA, 17 nt, Pseudomonas aeruginosa PA01
ccgccguucgcccgcca

SEQ ID NO: 3524534 - RNA, 17 nt, Pseudomonas aeruginosa PA01
ccgccguucucauugcg

SEQ ID NO: 3524535 - RNA, 14 nt, Pseudomonas aeruginosa PA01
ccgccguugaggaa

SEQ ID NO: 3524536 - RNA, 16 nt, Pseudomonas aeruginosa PA01
ccgccguugccagcau

SEQ ID NO: 3524537 - RNA, 18 nt, Pseudomonas aeruginosa PA01
ccgccguuguagcggaug

SEQ ID NO: 3524538 - RNA, 20 nt, Pseudomonas aeruginosa PA01
ccgccuaccggggcgcgggc

SEQ ID NO: 3524539 - RNA, 20 nt, Pseudomonas aeruginosa PA01
ccgccuauccacgacgucgg

SEQ ID NO: 3524540 - RNA, 21 nt, Pseudomonas aeruginosa PA01
ccgccuauccacgacgucggc

SEQ ID NO: 3524541 - RNA, 22 nt, Pseudomonas aeruginosa PA01
ccgccuauccacgacgucggcg

SEQ ID NO: 3524542 - RNA, 23 nt, Pseudomonas aeruginosa PA01
ccgccuauccacgacgucggcgg

SEQ ID NO: 3524543 - RNA, 20 nt, Pseudomonas aeruginosa PA01
ccgccuauccgugacgucgg

SEQ ID NO: 3524544 - RNA, 22 nt, Pseudomonas aeruginosa PA01
ccgccuauccgugacgucggcg

SEQ ID NO: 3524545 - RNA, 23 nt, Pseudomonas aeruginosa PA01
ccgccuauccgugacgucggcgg

SEQ ID NO: 3524546 - RNA, 20 nt, Pseudomonas aeruginosa PA01
ccgccuauggcggauagagc

SEQ ID NO: 3524547 - RNA, 20 nt, Pseudomonas aeruginosa PA01
ccgccucaccccacgggcga

SEQ ID NO: 3524548 - RNA, 13 nt, Pseudomonas aeruginosa PA01
ccgccucaggccg

SEQ ID NO: 3524549 - RNA, 13 nt, Pseudomonas aeruginosa PA01
ccgccucgaaggc

SEQ ID NO: 3524550 - RNA, 19 nt, Pseudomonas aeruginosa PA01
ccgccucgaaggccggcaa

SEQ ID NO: 3524551 - RNA, 20 nt, Pseudomonas aeruginosa PA01
ccgccucgaaggccggcaaa

SEQ ID NO: 3524552 - RNA, 12 nt, Pseudomonas aeruginosa PA01
ccgccucgacca

SEQ ID NO: 3524553 - RNA, 18 nt, Pseudomonas aeruginosa PA01
ccgccucgaccagcgccg

SEQ ID NO: 3524554 - RNA, 18 nt, Pseudomonas aeruginosa PA01
ccgccucgaccaucggcg

SEQ ID NO: 3524555 - RNA, 21 nt, Pseudomonas aeruginosa PA01
ccgccucgaccaucggcggcg

SEQ ID NO: 3524556 - RNA, 13 nt, Pseudomonas aeruginosa PA01
ccgccucgcgcaa

SEQ ID NO: 3524557 - RNA, 18 nt, Pseudomonas aeruginosa PA01
ccgccucgcgcaacgccu

SEQ ID NO: 3524558 - RNA, 16 nt, Pseudomonas aeruginosa PA01
ccgccucgcgcaacug

SEQ ID NO: 3524559 - RNA, 21 nt, Pseudomonas aeruginosa PA01
ccgccucgcgcaacugcucga

SEQ ID NO: 3524560 - RNA, 13 nt, Pseudomonas aeruginosa PA01
ccgccucgcgccg

SEQ ID NO: 3524561 - RNA, 17 nt, Pseudomonas aeruginosa PA01
ccgccucgcgccgcgcc

SEQ ID NO: 3524562 - RNA, 21 nt, Pseudomonas aeruginosa PA01
ccgccucggagaacagcagcg

SEQ ID NO: 3524563 - RNA, 14 nt, Pseudomonas aeruginosa PA01
ccgccucggcggcu

SEQ ID NO: 3524564 - RNA, 16 nt, Pseudomonas aeruginosa PA01
ccgccucggcggcucu

SEQ ID NO: 3524565 - RNA, 14 nt, Pseudomonas aeruginosa PA01
ccgccucgggcagc

SEQ ID NO: 3524566 - RNA, 14 nt, Pseudomonas aeruginosa PA01
ccgccucgucgcca

SEQ ID NO: 3524567 - RNA, 15 nt, Pseudomonas aeruginosa PA01
ccgccucgucgccau

SEQ ID NO: 3524568 - RNA, 16 nt, Pseudomonas aeruginosa PA01
ccgccucuaugaaccg

SEQ ID NO: 3524569 - RNA, 17 nt, Pseudomonas aeruginosa PA01
ccgccugaaggcgggcu

SEQ ID NO: 3524570 - RNA, 16 nt, Pseudomonas aeruginosa PA01
ccgccugcaacucguc

SEQ ID NO: 3524571 - RNA, 21 nt, Pseudomonas aeruginosa PA01
ccgccugcagcaccaccucgc

SEQ ID NO: 3524572 - RNA, 23 nt, Pseudomonas aeruginosa PA01
ccgccugcagcaccaccucgcca

SEQ ID NO: 3524573 - RNA, 14 nt, Pseudomonas aeruginosa PA01
ccgccugcgccucg

SEQ ID NO: 3524574 - RNA, 16 nt, Pseudomonas aeruginosa PA01
ccgccugcgccucggc

SEQ ID NO: 3524575 - RNA, 20 nt, Pseudomonas aeruginosa PA01
ccgccugcgccucggcccug

SEQ ID NO: 3524576 - RNA, 19 nt, Pseudomonas aeruginosa PA01
ccgccugcggauagccaac

SEQ ID NO: 3524577 - RNA, 15 nt, Pseudomonas aeruginosa PA01
ccgccugcggcuugc

SEQ ID NO: 3524578 - RNA, 14 nt, Pseudomonas aeruginosa PA01
ccgccugcgucagc

SEQ ID NO: 3524579 - RNA, 22 nt, Pseudomonas aeruginosa PA01
ccgccugcgucagcgaggcggg

SEQ ID NO: 3524580 - RNA, 14 nt, Pseudomonas aeruginosa PA01
ccgccugcucgcgg

SEQ ID NO: 3524581 - RNA, 13 nt, Pseudomonas aeruginosa PA01
ccgccugcucggc

SEQ ID NO: 3524582 - RNA, 17 nt, Pseudomonas aeruginosa PA01
ccgccugcucggccugc

SEQ ID NO: 3524583 - RNA, 21 nt, Pseudomonas aeruginosa PA01
ccgccugcucggccugcugcg

SEQ ID NO: 3524584 - RNA, 18 nt, Pseudomonas aeruginosa PA01
ccgccugcuggcugccca

SEQ ID NO: 3524585 - RNA, 19 nt, Pseudomonas aeruginosa PA01
ccgccuggaaggcgcuggg

SEQ ID NO: 3524586 - RNA, 21 nt, Pseudomonas aeruginosa PA01
ccgccuggaaggcgcugggcg

SEQ ID NO: 3524587 - RNA, 22 nt, Pseudomonas aeruginosa PA01
ccgccuggaaggcgcugggcgg

SEQ ID NO: 3524588 - RNA, 17 nt, Pseudomonas aeruginosa PA01
ccgccuggagcaguuuc

SEQ ID NO: 3524589 - RNA, 13 nt, Pseudomonas aeruginosa PA01
ccgccuggccggc

SEQ ID NO: 3524590 - RNA, 18 nt, Pseudomonas aeruginosa PA01
ccgccuggccggccagcc

SEQ ID NO: 3524591 - RNA, 21 nt, Pseudomonas aeruginosa PA01
ccgccuggccggccagccagg

SEQ ID NO: 3524592 - RNA, 14 nt, Pseudomonas aeruginosa PA01
ccgccuggcgcaag

SEQ ID NO: 3524593 - RNA, 20 nt, Pseudomonas aeruginosa PA01
ccgccuggcgugccgccagg

SEQ ID NO: 3524594 - RNA, 22 nt, Pseudomonas aeruginosa PA01
ccgccuggcgugccgccaggcc

SEQ ID NO: 3524595 - RNA, 22 nt, Pseudomonas aeruginosa PA01
ccgccugggacggaacgucggc

SEQ ID NO: 3524596 - RNA, 20 nt, Pseudomonas aeruginosa PA01
ccgccuggguggcgacgaag

SEQ ID NO: 3524597 - RNA, 13 nt, Pseudomonas aeruginosa PA01
ccgccugguccag

SEQ ID NO: 3524598 - RNA, 20 nt, Pseudomonas aeruginosa PA01
ccgcgcaaccguuccagcgc

SEQ ID NO: 3524599 - RNA, 22 nt, Pseudomonas aeruginosa PA01
ccgcgcaagcucgucacccgcg

SEQ ID NO: 3524600 - RNA, 18 nt, Pseudomonas aeruginosa PA01
ccgcgcaaggcagcgucc

SEQ ID NO: 3524601 - RNA, 19 nt, Pseudomonas aeruginosa PA01
ccgcgcacaaaaaagcccg

SEQ ID NO: 3524602 - RNA, 21 nt, Pseudomonas aeruginosa PA01
ccgcgcacaaaaaagcccgcc

SEQ ID NO: 3524603 - RNA, 23 nt, Pseudomonas aeruginosa PA01
ccgcgcacaaaaaagcccgccag

SEQ ID NO: 3524604 - RNA, 14 nt, Pseudomonas aeruginosa PA01
ccgcgcaccagcac

SEQ ID NO: 3524605 - RNA, 15 nt, Pseudomonas aeruginosa PA01
ccgcgcaccucgacc

SEQ ID NO: 3524606 - RNA, 22 nt, Pseudomonas aeruginosa PA01
ccgcgcaccucgaccgcgccgg

SEQ ID NO: 3524607 - RNA, 22 nt, Pseudomonas aeruginosa PA01
ccgcgcaccugggcguuggcca

SEQ ID NO: 3524608 - RNA, 19 nt, Pseudomonas aeruginosa PA01
ccgcgcaccuugcuggaca

SEQ ID NO: 3524609 - RNA, 23 nt, Pseudomonas aeruginosa PA01
ccgcgcaccuugcuggacaaggu

SEQ ID NO: 3524610 - RNA, 23 nt, Pseudomonas aeruginosa PA01
ccgcgcacggaucgcgcugggcg

SEQ ID NO: 3524611 - RNA, 15 nt, Pseudomonas aeruginosa PA01
ccgcgcagaccauca

SEQ ID NO: 3524612 - RNA, 13 nt, Pseudomonas aeruginosa PA01
ccgcgcagaucgc

SEQ ID NO: 3524613 - RNA, 18 nt, Pseudomonas aeruginosa PA01
ccgcgcagaugaucgcca

SEQ ID NO: 3524614 - RNA, 20 nt, Pseudomonas aeruginosa PA01
ccgcgcagaugaucgccacc

SEQ ID NO: 3524615 - RNA, 21 nt, Pseudomonas aeruginosa PA01
ccgcgcagaugaucgccaccg

SEQ ID NO: 3524616 - RNA, 23 nt, Pseudomonas aeruginosa PA01
ccgcgcagaugaucgccaccggg

SEQ ID NO: 3524617 - RNA, 14 nt, Pseudomonas aeruginosa PA01
ccgcgcagcaacgg

SEQ ID NO: 3524618 - RNA, 22 nt, Pseudomonas aeruginosa PA01
ccgcgcagcaguaccuggcggu

SEQ ID NO: 3524619 - RNA, 13 nt, Pseudomonas aeruginosa PA01
ccgcgcagcgcgg

SEQ ID NO: 3524620 - RNA, 15 nt, Pseudomonas aeruginosa PA01
ccgcgcagcgcggcg

SEQ ID NO: 3524621 - RNA, 16 nt, Pseudomonas aeruginosa PA01
ccgcgcagcgcggcgc

SEQ ID NO: 3524622 - RNA, 23 nt, Pseudomonas aeruginosa PA01
ccgcgcagcgcggcgcuggguca

SEQ ID NO: 3524623 - RNA, 15 nt, Pseudomonas aeruginosa PA01
ccgcgcagcgucacc

SEQ ID NO: 3524624 - RNA, 19 nt, Pseudomonas aeruginosa PA01
ccgcgcagcuugccuucca

SEQ ID NO: 3524625 - RNA, 21 nt, Pseudomonas aeruginosa PA01
ccgcgcaggaagaaggcgucc

SEQ ID NO: 3524626 - RNA, 16 nt, Pseudomonas aeruginosa PA01
ccgcgcaggcggucgg

SEQ ID NO: 3524627 - RNA, 19 nt, Pseudomonas aeruginosa PA01
ccgcgcagguucaucgccg

SEQ ID NO: 3524628 - RNA, 20 nt, Pseudomonas aeruginosa PA01
ccgcgcagguucaucgccgc

SEQ ID NO: 3524629 - RNA, 16 nt, Pseudomonas aeruginosa PA01
ccgcgcagucccgcgc

SEQ ID NO: 3524630 - RNA, 17 nt, Pseudomonas aeruginosa PA01
ccgcgcagucccgcgcg

SEQ ID NO: 3524631 - RNA, 20 nt, Pseudomonas aeruginosa PA01
ccgcgcagucccgcgcggcc

SEQ ID NO: 3524632 - RNA, 20 nt, Pseudomonas aeruginosa PA01
ccgcgcaguuccuucaccgg

SEQ ID NO: 3524633 - RNA, 15 nt, Pseudomonas aeruginosa PA01
ccgcgcauaggaggc

SEQ ID NO: 3524634 - RNA, 22 nt, Pseudomonas aeruginosa PA01
ccgcgcaucaccccgcaaccgc

SEQ ID NO: 3524635 - RNA, 16 nt, Pseudomonas aeruginosa PA01
ccgcgcauccucggca

SEQ ID NO: 3524636 - RNA, 19 nt, Pseudomonas aeruginosa PA01
ccgcgcaugaaaaagccgc

SEQ ID NO: 3524637 - RNA, 20 nt, Pseudomonas aeruginosa PA01
ccgcgcaugaaaaagccgcc

SEQ ID NO: 3524638 - RNA, 21 nt, Pseudomonas aeruginosa PA01
ccgcgcaugaaaaagccgccc

SEQ ID NO: 3524639 - RNA, 23 nt, Pseudomonas aeruginosa PA01
ccgcgcaugaaaaagccgcccac

SEQ ID NO: 3524640 - RNA, 24 nt, Pseudomonas aeruginosa PA01
ccgcgcaugaaaaagccgcccacg

SEQ ID NO: 3524641 - RNA, 15 nt, Pseudomonas aeruginosa PA01
ccgcgcauggagacg

SEQ ID NO: 3524642 - RNA, 18 nt, Pseudomonas aeruginosa PA01
ccgcgcauggagacggcc

SEQ ID NO: 3524643 - RNA, 20 nt, Pseudomonas aeruginosa PA01
ccgcgcauggagacggcccg

SEQ ID NO: 3524644 - RNA, 23 nt, Pseudomonas aeruginosa PA01
ccgcgcauggagacggcccgccc

SEQ ID NO: 3524645 - RNA, 14 nt, Pseudomonas aeruginosa PA01
ccgcgcauggcggc

SEQ ID NO: 3524646 - RNA, 16 nt, Pseudomonas aeruginosa PA01
ccgcgcauggcggcga

SEQ ID NO: 3524647 - RNA, 18 nt, Pseudomonas aeruginosa PA01
ccgcgccaaaaagcagga

SEQ ID NO: 3524648 - RNA, 21 nt, Pseudomonas aeruginosa PA01
ccgcgccaacuggcgcaacug

SEQ ID NO: 3524649 - RNA, 21 nt, Pseudomonas aeruginosa PA01
ccgcgccacgcagugggaagc

SEQ ID NO: 3524650 - RNA, 15 nt, Pseudomonas aeruginosa PA01
ccgcgccacgcgcau

SEQ ID NO: 3524651 - RNA, 15 nt, Pseudomonas aeruginosa PA01
ccgcgccagcaggcg

SEQ ID NO: 3524652 - RNA, 12 nt, Pseudomonas aeruginosa PA01
ccgcgccagcca

SEQ ID NO: 3524653 - RNA, 13 nt, Pseudomonas aeruginosa PA01
ccgcgccagccac

SEQ ID NO: 3524654 - RNA, 20 nt, Pseudomonas aeruginosa PA01
ccgcgccagccacucccggc

SEQ ID NO: 3524655 - RNA, 12 nt, Pseudomonas aeruginosa PA01
ccgcgccagcgc

SEQ ID NO: 3524656 - RNA, 13 nt, Pseudomonas aeruginosa PA01
ccgcgccagcgcc

SEQ ID NO: 3524657 - RNA, 15 nt, Pseudomonas aeruginosa PA01
ccgcgccagcgccgc

SEQ ID NO: 3524658 - RNA, 18 nt, Pseudomonas aeruginosa PA01
ccgcgccagcgccgccag

SEQ ID NO: 3524659 - RNA, 14 nt, Pseudomonas aeruginosa PA01
ccgcgccagcucga

SEQ ID NO: 3524660 - RNA, 14 nt, Pseudomonas aeruginosa PA01
ccgcgccaggcgca

SEQ ID NO: 3524661 - RNA, 16 nt, Pseudomonas aeruginosa PA01
ccgcgccaggcgcagu

SEQ ID NO: 3524662 - RNA, 13 nt, Pseudomonas aeruginosa PA01
ccgcgccagugcc

SEQ ID NO: 3524663 - RNA, 21 nt, Pseudomonas aeruginosa PA01
ccgcgccagugccugcaccac

SEQ ID NO: 3524664 - RNA, 16 nt, Pseudomonas aeruginosa PA01
ccgcgccaugccggcg

SEQ ID NO: 3524665 - RNA, 17 nt, Pseudomonas aeruginosa PA01
ccgcgccaugccggcgc

SEQ ID NO: 3524666 - RNA, 19 nt, Pseudomonas aeruginosa PA01
ccgcgccaugccggcgccg

SEQ ID NO: 3524667 - RNA, 14 nt, Pseudomonas aeruginosa PA01
ccgcgcccaggcgc

SEQ ID NO: 3524668 - RNA, 15 nt, Pseudomonas aeruginosa PA01
ccgcgcccaggcgca

SEQ ID NO: 3524669 - RNA, 13 nt, Pseudomonas aeruginosa PA01
ccgcgcccaggcu

SEQ ID NO: 3524670 - RNA, 14 nt, Pseudomonas aeruginosa PA01
ccgcgcccaggcug

SEQ ID NO: 3524671 - RNA, 22 nt, Pseudomonas aeruginosa PA01
ccgcgcccaggcugccggccag

SEQ ID NO: 3524672 - RNA, 17 nt, Pseudomonas aeruginosa PA01
ccgcgccccagcggcag

SEQ ID NO: 3524673 - RNA, 13 nt, Pseudomonas aeruginosa PA01
ccgcgcccggcca

SEQ ID NO: 3524674 - RNA, 15 nt, Pseudomonas aeruginosa PA01
ccgcgcccggccagg

SEQ ID NO: 3524675 - RNA, 13 nt, Pseudomonas aeruginosa PA01
ccgcgcccggccu

SEQ ID NO: 3524676 - RNA, 15 nt, Pseudomonas aeruginosa PA01
ccgcgcccggccucc

SEQ ID NO: 3524677 - RNA, 12 nt, Pseudomonas aeruginosa PA01
ccgcgcccggcu

SEQ ID NO: 3524678 - RNA, 13 nt, Pseudomonas aeruginosa PA01
ccgcgcccggcug

SEQ ID NO: 3524679 - RNA, 14 nt, Pseudomonas aeruginosa PA01
ccgcgccgaagguc

SEQ ID NO: 3524680 - RNA, 16 nt, Pseudomonas aeruginosa PA01
ccgcgccgaccagccg

SEQ ID NO: 3524681 - RNA, 17 nt, Pseudomonas aeruginosa PA01
ccgcgccgaccagccgc

SEQ ID NO: 3524682 - RNA, 18 nt, Pseudomonas aeruginosa PA01
ccgcgccgaccagccgca

SEQ ID NO: 3524683 - RNA, 19 nt, Pseudomonas aeruginosa PA01
ccgcgccgaccagccgcag

SEQ ID NO: 3524684 - RNA, 14 nt, Pseudomonas aeruginosa PA01
ccgcgccgacccag

SEQ ID NO: 3524685 - RNA, 20 nt, Pseudomonas aeruginosa PA01
ccgcgccgacccagagcgcg

SEQ ID NO: 3524686 - RNA, 21 nt, Pseudomonas aeruginosa PA01
ccgcgccgacccagagcgcgc

SEQ ID NO: 3524687 - RNA, 22 nt, Pseudomonas aeruginosa PA01
ccgcgccgacccagagcgcgcc

SEQ ID NO: 3524688 - RNA, 21 nt, Pseudomonas aeruginosa PA01
ccgcgccgagauagcggcaac

SEQ ID NO: 3524689 - RNA, 16 nt, Pseudomonas aeruginosa PA01
ccgcgccgagccggcu

SEQ ID NO: 3524690 - RNA, 17 nt, Pseudomonas aeruginosa PA01
ccgcgccgagccggcug

SEQ ID NO: 3524691 - RNA, 13 nt, Pseudomonas aeruginosa PA01
ccgcgccgaugcc

SEQ ID NO: 3524692 - RNA, 12 nt, Pseudomonas aeruginosa PA01
ccgcgccgaugu

SEQ ID NO: 3524693 - RNA, 15 nt, Pseudomonas aeruginosa PA01
ccgcgccgcaagggc

SEQ ID NO: 3524694 - RNA, 19 nt, Pseudomonas aeruginosa PA01
ccgcgccgcaagggcgucg

SEQ ID NO: 3524695 - RNA, 12 nt, Pseudomonas aeruginosa PA01
ccgcgccgccga

SEQ ID NO: 3524696 - RNA, 14 nt, Pseudomonas aeruginosa PA01
ccgcgccgccgagg

SEQ ID NO: 3524697 - RNA, 13 nt, Pseudomonas aeruginosa PA01
ccgcgccgccucg

SEQ ID NO: 3524698 - RNA, 19 nt, Pseudomonas aeruginosa PA01
ccgcgccgccucgauggcg

SEQ ID NO: 3524699 - RNA, 17 nt, Pseudomonas aeruginosa PA01
ccgcgccgcgaggggaa

SEQ ID NO: 3524700 - RNA, 12 nt, Pseudomonas aeruginosa PA01
ccgcgccgcgcu

SEQ ID NO: 3524701 - RNA, 16 nt, Pseudomonas aeruginosa PA01
ccgcggaaaacgccgc

SEQ ID NO: 3524702 - RNA, 18 nt, Pseudomonas aeruginosa PA01
ccgcggaaaacgccgcga

SEQ ID NO: 3524703 - RNA, 15 nt, Pseudomonas aeruginosa PA01
ccgcggaaggcccgc

SEQ ID NO: 3524704 - RNA, 20 nt, Pseudomonas aeruginosa PA01
ccgcggaagugcgccgguug

SEQ ID NO: 3524705 - RNA, 13 nt, Pseudomonas aeruginosa PA01
ccgcggaauggcg

SEQ ID NO: 3524706 - RNA, 16 nt, Pseudomonas aeruginosa PA01
ccgcggaauggcgcgc

SEQ ID NO: 3524707 - RNA, 15 nt, Pseudomonas aeruginosa PA01
ccgcggaccgggcgg

SEQ ID NO: 3524708 - RNA, 19 nt, Pseudomonas aeruginosa PA01
ccgcggacggcacggggcg

SEQ ID NO: 3524709 - RNA, 12 nt, Pseudomonas aeruginosa PA01
ccgcggacggcc

SEQ ID NO: 3524710 - RNA, 15 nt, Pseudomonas aeruginosa PA01
ccgcggagcaccgcg

SEQ ID NO: 3524711 - RNA, 18 nt, Pseudomonas aeruginosa PA01
ccgcggagcaccgcgccu

SEQ ID NO: 3524712 - RNA, 22 nt, Pseudomonas aeruginosa PA01
ccgcggagcaccgcgccuucca

SEQ ID NO: 3524713 - RNA, 15 nt, Pseudomonas aeruginosa PA01
ccgcggagucgccgg

SEQ ID NO: 3524714 - RNA, 16 nt, Pseudomonas aeruginosa PA01
ccgcggaucaccuggc

SEQ ID NO: 3524715 - RNA, 18 nt, Pseudomonas aeruginosa PA01
ccgcggauccacgccugg

SEQ ID NO: 3524716 - RNA, 19 nt, Pseudomonas aeruginosa PA01
ccgcggauccacgccuggc

SEQ ID NO: 3524717 - RNA, 13 nt, Pseudomonas aeruginosa PA01
ccgcggaucgcgc

SEQ ID NO: 3524718 - RNA, 14 nt, Pseudomonas aeruginosa PA01
ccgcggaucgcgcc

SEQ ID NO: 3524719 - RNA, 22 nt, Pseudomonas aeruginosa PA01
ccgcggaucgcgccgucgcugg

SEQ ID NO: 3524720 - RNA, 19 nt, Pseudomonas aeruginosa PA01
ccgcggaucguccgggcgg

SEQ ID NO: 3524721 - RNA, 15 nt, Pseudomonas aeruginosa PA01
ccgcggaugacgggc

SEQ ID NO: 3524722 - RNA, 16 nt, Pseudomonas aeruginosa PA01
ccgcggaugacgggcg

SEQ ID NO: 3524723 - RNA, 18 nt, Pseudomonas aeruginosa PA01
ccgcggcaccggcgacga

SEQ ID NO: 3524724 - RNA, 16 nt, Pseudomonas aeruginosa PA01
ccgcggcacuccggca

SEQ ID NO: 3524725 - RNA, 21 nt, Pseudomonas aeruginosa PA01
ccgcggccagcccccucgccc

SEQ ID NO: 3524726 - RNA, 17 nt, Pseudomonas aeruginosa PA01
ccgcggccccggcgucu

SEQ ID NO: 3524727 - RNA, 17 nt, Pseudomonas aeruginosa PA01
ccgcggcccggcgcugc

SEQ ID NO: 3524728 - RNA, 18 nt, Pseudomonas aeruginosa PA01
ccgcggcccugcgccgca

SEQ ID NO: 3524729 - RNA, 21 nt, Pseudomonas aeruginosa PA01
ccgcggcccugcgccgcagcg

SEQ ID NO: 3524730 - RNA, 16 nt, Pseudomonas aeruginosa PA01
ccgcggcccugcucgc

SEQ ID NO: 3524731 - RNA, 17 nt, Pseudomonas aeruginosa PA01
ccgcggcccugcucgcc

SEQ ID NO: 3524732 - RNA, 19 nt, Pseudomonas aeruginosa PA01
ccgcggcccugcucgccgg

SEQ ID NO: 3524733 - RNA, 20 nt, Pseudomonas aeruginosa PA01
ccgcggcccugcucgccggc

SEQ ID NO: 3524734 - RNA, 22 nt, Pseudomonas aeruginosa PA01
ccgcggcccugcucgccggcgc

SEQ ID NO: 3524735 - RNA, 12 nt, Pseudomonas aeruginosa PA01
ccgcggccggca

SEQ ID NO: 3524736 - RNA, 14 nt, Pseudomonas aeruginosa PA01
ccgcggccggcagg

SEQ ID NO: 3524737 - RNA, 18 nt, Pseudomonas aeruginosa PA01
ccgcggccggcaggccga

SEQ ID NO: 3524738 - RNA, 12 nt, Pseudomonas aeruginosa PA01
ccgcggccggcg

SEQ ID NO: 3524739 - RNA, 18 nt, Pseudomonas aeruginosa PA01
ccgcggccggcuucagca

SEQ ID NO: 3524740 - RNA, 15 nt, Pseudomonas aeruginosa PA01
ccgcggccucgcugg

SEQ ID NO: 3524741 - RNA, 12 nt, Pseudomonas aeruginosa PA01
ccgcggccuugg

SEQ ID NO: 3524742 - RNA, 22 nt, Pseudomonas aeruginosa PA01
ccgcggcgaacaucauccacag

SEQ ID NO: 3524743 - RNA, 12 nt, Pseudomonas aeruginosa PA01
ccgcggcgaagc

SEQ ID NO: 3524744 - RNA, 18 nt, Pseudomonas aeruginosa PA01
ccgcggcgaagcgcucga

SEQ ID NO: 3524745 - RNA, 17 nt, Pseudomonas aeruginosa PA01
ccgcggcgaccagcgcg

SEQ ID NO: 3524746 - RNA, 22 nt, Pseudomonas aeruginosa PA01
ccgcggcgacggcucuuccccu

SEQ ID NO: 3524747 - RNA, 14 nt, Pseudomonas aeruginosa PA01
ccgcggcgagcagc

SEQ ID NO: 3524748 - RNA, 17 nt, Pseudomonas aeruginosa PA01
ccgcggcgagcagcggc

SEQ ID NO: 3524749 - RNA, 18 nt, Pseudomonas aeruginosa PA01
ccgcggcgagcagcggcg

SEQ ID NO: 3524750 - RNA, 21 nt, Pseudomonas aeruginosa PA01
ccgcggcgagcaucucggcca

SEQ ID NO: 3524751 - RNA, 23 nt, Pseudomonas aeruginosa PA01
ccgcggcgagguugcccacggcc

SEQ ID NO: 3524752 - RNA, 19 nt, Pseudomonas aeruginosa PA01
ccgcggcgcccucugccgg

SEQ ID NO: 3524753 - RNA, 22 nt, Pseudomonas aeruginosa PA01
ccgcggcgcgccuucagcgccu

SEQ ID NO: 3524754 - RNA, 12 nt, Pseudomonas aeruginosa PA01
ccgcggcgcgga

SEQ ID NO: 3524755 - RNA, 18 nt, Pseudomonas aeruginosa PA01
ccgcggcgcguaggcgaa

SEQ ID NO: 3524756 - RNA, 20 nt, Pseudomonas aeruginosa PA01
ccgcggcgcguaggcgaaca

SEQ ID NO: 3524757 - RNA, 19 nt, Pseudomonas aeruginosa PA01
ccgcggcgcucggcaucga

SEQ ID NO: 3524758 - RNA, 12 nt, Pseudomonas aeruginosa PA01
ccgcggcggccu

SEQ ID NO: 3524759 - RNA, 14 nt, Pseudomonas aeruginosa PA01
ccgcggcggccuca

SEQ ID NO: 3524760 - RNA, 14 nt, Pseudomonas aeruginosa PA01
ccgcggcggcgacg

SEQ ID NO: 3524761 - RNA, 23 nt, Pseudomonas aeruginosa PA01
ccgcggcguaaucgcgccaggcc

SEQ ID NO: 3524762 - RNA, 19 nt, Pseudomonas aeruginosa PA01
ccgcggcguuagccgccug

SEQ ID NO: 3524763 - RNA, 17 nt, Pseudomonas aeruginosa PA01
ccgcggcguuauccgcc

SEQ ID NO: 3524764 - RNA, 18 nt, Pseudomonas aeruginosa PA01
ccgcggcguugucggcca

SEQ ID NO: 3524765 - RNA, 23 nt, Pseudomonas aeruginosa PA01
ccgcggcguugucggccagcagc

SEQ ID NO: 3524766 - RNA, 21 nt, Pseudomonas aeruginosa PA01
ccgcggcuggccauccgcccu

SEQ ID NO: 3524767 - RNA, 20 nt, Pseudomonas aeruginosa PA01
ccgcgggcaaccgcggcggc

SEQ ID NO: 3524768 - RNA, 21 nt, Pseudomonas aeruginosa PA01
ccgcgggcaaccgcggcggcc

SEQ ID NO: 3524769 - RNA, 16 nt, Pseudomonas aeruginosa PA01
ccgcgggcagcagucg

SEQ ID NO: 3524770 - RNA, 15 nt, Pseudomonas aeruginosa PA01
ccgcgggcagcucga

SEQ ID NO: 3524771 - RNA, 17 nt, Pseudomonas aeruginosa PA01
ccgcgggccagccguuc

SEQ ID NO: 3524772 - RNA, 20 nt, Pseudomonas aeruginosa PA01
ccgcgggcgccuuuuucaug

SEQ ID NO: 3524773 - RNA, 20 nt, Pseudomonas aeruginosa PA01
ccgcgggcuauucccgccgc

SEQ ID NO: 3524774 - RNA, 22 nt, Pseudomonas aeruginosa PA01
ccgcgggcuauucccgccgcuc

SEQ ID NO: 3524775 - RNA, 20 nt, Pseudomonas aeruginosa PA01
ccgcggggaggaagcucccc

SEQ ID NO: 3524776 - RNA, 14 nt, Pseudomonas aeruginosa PA01
ccgcgggucaccag

SEQ ID NO: 3524777 - RNA, 15 nt, Pseudomonas aeruginosa PA01
ccgcgggucaccagc

SEQ ID NO: 3524778 - RNA, 17 nt, Pseudomonas aeruginosa PA01
ccgcgggucaccagcgc

SEQ ID NO: 3524779 - RNA, 18 nt, Pseudomonas aeruginosa PA01
ccgcgggucaccagcgcc

SEQ ID NO: 3524780 - RNA, 19 nt, Pseudomonas aeruginosa PA01
ccgcgggucaccagcgccg

SEQ ID NO: 3524781 - RNA, 23 nt, Pseudomonas aeruginosa PA01
ccgcgggucucgaucagcgccgg

SEQ ID NO: 3524782 - RNA, 17 nt, Pseudomonas aeruginosa PA01
ccgcgggucugcucggc

SEQ ID NO: 3524783 - RNA, 19 nt, Pseudomonas aeruginosa PA01
ccgcgggucugcucggcgc

SEQ ID NO: 3524784 - RNA, 20 nt, Pseudomonas aeruginosa PA01
ccgcgggucugcucggcgcc

SEQ ID NO: 3524785 - RNA, 16 nt, Pseudomonas aeruginosa PA01
ccgcggguuccucacg

SEQ ID NO: 3524786 - RNA, 20 nt, Pseudomonas aeruginosa PA01
ccgcgguacccggcagggcc

SEQ ID NO: 3524787 - RNA, 18 nt, Pseudomonas aeruginosa PA01
ccgcgguagcugcgcagg

SEQ ID NO: 3524788 - RNA, 20 nt, Pseudomonas aeruginosa PA01
ccgcgguagcugcgcagggc

SEQ ID NO: 3524789 - RNA, 22 nt, Pseudomonas aeruginosa PA01
ccgcgguagcugcgcagggcgc

SEQ ID NO: 3524790 - RNA, 23 nt, Pseudomonas aeruginosa PA01
ccgcgguagcugcgcagggcgcc

SEQ ID NO: 3524791 - RNA, 15 nt, Pseudomonas aeruginosa PA01
ccgcgguauucucca

SEQ ID NO: 3524792 - RNA, 18 nt, Pseudomonas aeruginosa PA01
ccgcgguauucuccagca

SEQ ID NO: 3524793 - RNA, 20 nt, Pseudomonas aeruginosa PA01
ccgcgguauucuccagcagg

SEQ ID NO: 3524794 - RNA, 19 nt, Pseudomonas aeruginosa PA01
ccgcggucacucggccucg

SEQ ID NO: 3524795 - RNA, 19 nt, Pseudomonas aeruginosa PA01
ccgcggucgaugucgcggc

SEQ ID NO: 3524796 - RNA, 12 nt, Pseudomonas aeruginosa PA01
ccgcggucgggc

SEQ ID NO: 3524797 - RNA, 13 nt, Pseudomonas aeruginosa PA01
ccgcggucgggca

SEQ ID NO: 3524798 - RNA, 16 nt, Pseudomonas aeruginosa PA01
ccgcggucgggcagau

SEQ ID NO: 3524799 - RNA, 17 nt, Pseudomonas aeruginosa PA01
ccgcggugcggauggca

SEQ ID NO: 3524800 - RNA, 14 nt, Pseudomonas aeruginosa PA01
ccgcgguggaggcg

SEQ ID NO: 3524801 - RNA, 22 nt, Pseudomonas aeruginosa PA01
ccgcgguggaggcggcggucau

SEQ ID NO: 3524802 - RNA, 13 nt, Pseudomonas aeruginosa PA01
ccgcggugggcuc

SEQ ID NO: 3524803 - RNA, 21 nt, Pseudomonas aeruginosa PA01
ccgcucgaucccggcgcggaa

SEQ ID NO: 3524804 - RNA, 18 nt, Pseudomonas aeruginosa PA01
ccgcucgaugcccgccag

SEQ ID NO: 3524805 - RNA, 22 nt, Pseudomonas aeruginosa PA01
ccgcucgaugcccgccagcagg

SEQ ID NO: 3524806 - RNA, 21 nt, Pseudomonas aeruginosa PA01
ccgcucgcgcacggcgaagaa

SEQ ID NO: 3524807 - RNA, 13 nt, Pseudomonas aeruginosa PA01
ccgcucgcgcggc

SEQ ID NO: 3524808 - RNA, 14 nt, Pseudomonas aeruginosa PA01
ccgcucgcgcggca

SEQ ID NO: 3524809 - RNA, 15 nt, Pseudomonas aeruginosa PA01
ccgcucgcgguuauc

SEQ ID NO: 3524810 - RNA, 19 nt, Pseudomonas aeruginosa PA01
ccgcucgcgguuauccgcc

SEQ ID NO: 3524811 - RNA, 23 nt, Pseudomonas aeruginosa PA01
ccgcucgcgguuauccgccgccu

SEQ ID NO: 3524812 - RNA, 21 nt, Pseudomonas aeruginosa PA01
ccgcucgcgguuauccgccgg

SEQ ID NO: 3524813 - RNA, 22 nt, Pseudomonas aeruginosa PA01
ccgcucgcgguuauccgccgga

SEQ ID NO: 3524814 - RNA, 13 nt, Pseudomonas aeruginosa PA01
ccgcucggccgcc

SEQ ID NO: 3524815 - RNA, 14 nt, Pseudomonas aeruginosa PA01
ccgcucggccgcca

SEQ ID NO: 3524816 - RNA, 12 nt, Pseudomonas aeruginosa PA01
ccgcucggccuu

SEQ ID NO: 3524817 - RNA, 15 nt, Pseudomonas aeruginosa PA01
ccgcucggcgagccg

SEQ ID NO: 3524818 - RNA, 18 nt, Pseudomonas aeruginosa PA01
ccgcucggcgagccgccg

SEQ ID NO: 3524819 - RNA, 20 nt, Pseudomonas aeruginosa PA01
ccgcucggcgaguucgcgca

SEQ ID NO: 3524820 - RNA, 23 nt, Pseudomonas aeruginosa PA01
ccgcucggcggguauccgccggg

SEQ ID NO: 3524821 - RNA, 18 nt, Pseudomonas aeruginosa PA01
ccgcucggcguagccggc

SEQ ID NO: 3524822 - RNA, 19 nt, Pseudomonas aeruginosa PA01
ccgcucggcguagccggcg

SEQ ID NO: 3524823 - RNA, 20 nt, Pseudomonas aeruginosa PA01
ccgcucggcguagccggcga

SEQ ID NO: 3524824 - RNA, 19 nt, Pseudomonas aeruginosa PA01
ccgcucggggcaucggcca

SEQ ID NO: 3524825 - RNA, 16 nt, Pseudomonas aeruginosa PA01
ccgcucgucaggcgcu

SEQ ID NO: 3524826 - RNA, 17 nt, Pseudomonas aeruginosa PA01
ccgcucgucauggcgca

SEQ ID NO: 3524827 - RNA, 21 nt, Pseudomonas aeruginosa PA01
ccgcucgucauggcgcacgcc

SEQ ID NO: 3524828 - RNA, 22 nt, Pseudomonas aeruginosa PA01
ccgcucgucauggcgcacgccg

SEQ ID NO: 3524829 - RNA, 15 nt, Pseudomonas aeruginosa PA01
ccgcucguggaaaaa

SEQ ID NO: 3524830 - RNA, 17 nt, Pseudomonas aeruginosa PA01
ccgcucguuggcggcca

SEQ ID NO: 3524831 - RNA, 18 nt, Pseudomonas aeruginosa PA01
ccgcucguuggcggccag

SEQ ID NO: 3524832 - RNA, 19 nt, Pseudomonas aeruginosa PA01
ccgcucguuggcggccagc

SEQ ID NO: 3524833 - RNA, 22 nt, Pseudomonas aeruginosa PA01
ccgcucucgaggacgugcacca

SEQ ID NO: 3524834 - RNA, 21 nt, Pseudomonas aeruginosa PA01
ccgcucucggugaccaccagg

SEQ ID NO: 3524835 - RNA, 15 nt, Pseudomonas aeruginosa PA01
ccgcucugcccgacc

SEQ ID NO: 3524836 - RNA, 14 nt, Pseudomonas aeruginosa PA01
ccgcucugcuggcc

SEQ ID NO: 3524837 - RNA, 16 nt, Pseudomonas aeruginosa PA01
ccgcucugcuggccac

SEQ ID NO: 3524838 - RNA, 19 nt, Pseudomonas aeruginosa PA01
ccgcucugcuggccacccu

SEQ ID NO: 3524839 - RNA, 17 nt, Pseudomonas aeruginosa PA01
ccgcucugcuggccgcc

SEQ ID NO: 3524840 - RNA, 18 nt, Pseudomonas aeruginosa PA01
ccgcucugcuggccgccc

SEQ ID NO: 3524841 - RNA, 19 nt, Pseudomonas aeruginosa PA01
ccgcucugcuggccgcccu

SEQ ID NO: 3524842 - RNA, 19 nt, Pseudomonas aeruginosa PA01
ccgcucuucugguaggcca

SEQ ID NO: 3524843 - RNA, 21 nt, Pseudomonas aeruginosa PA01
ccgcucuugauacccaccggc

SEQ ID NO: 3524844 - RNA, 15 nt, Pseudomonas aeruginosa PA01
ccgcucuuuccucau

SEQ ID NO: 3524845 - RNA, 16 nt, Pseudomonas aeruginosa PA01
ccgcucuuuccucauc

SEQ ID NO: 3524846 - RNA, 11 nt, Pseudomonas aeruginosa PA01
ccgcugaagga

SEQ ID NO: 3524847 - RNA, 17 nt, Pseudomonas aeruginosa PA01
ccgcugaaguccuggcc

SEQ ID NO: 3524848 - RNA, 15 nt, Pseudomonas aeruginosa PA01
ccgcugaccgggcgg

SEQ ID NO: 3524849 - RNA, 19 nt, Pseudomonas aeruginosa PA01
ccgcugacggucugccagc

SEQ ID NO: 3524850 - RNA, 23 nt, Pseudomonas aeruginosa PA01
ccgcugacggucugccagcucug

SEQ ID NO: 3524851 - RNA, 15 nt, Pseudomonas aeruginosa PA01
ccgcugagcagcagg

SEQ ID NO: 3524852 - RNA, 17 nt, Pseudomonas aeruginosa PA01
ccgcugaggauguagcc

SEQ ID NO: 3524853 - RNA, 20 nt, Pseudomonas aeruginosa PA01
ccgcugaggauguagccggc

SEQ ID NO: 3524854 - RNA, 22 nt, Pseudomonas aeruginosa PA01
ccgcugaucaguaccggcagcg

SEQ ID NO: 3524855 - RNA, 18 nt, Pseudomonas aeruginosa PA01
ccgcugaugaucgcgucg

SEQ ID NO: 3524856 - RNA, 17 nt, Pseudomonas aeruginosa PA01
ccgcugcacgccuuccg

SEQ ID NO: 3524857 - RNA, 15 nt, Pseudomonas aeruginosa PA01
ccgcugcagggcggc

SEQ ID NO: 3524858 - RNA, 17 nt, Pseudomonas aeruginosa PA01
ccgcugcagggcggcgc

SEQ ID NO: 3524859 - RNA, 22 nt, Pseudomonas aeruginosa PA01
ccgcugcaugaaaaagcccggc

SEQ ID NO: 3524860 - RNA, 21 nt, Pseudomonas aeruginosa PA01
ccgcugcaugugccaggccug

SEQ ID NO: 3524861 - RNA, 15 nt, Pseudomonas aeruginosa PA01
ccgcugccgccgcgc

SEQ ID NO: 3524862 - RNA, 16 nt, Pseudomonas aeruginosa PA01
ccgcugccgccgcgca

SEQ ID NO: 3524863 - RNA, 17 nt, Pseudomonas aeruginosa PA01
ccgcugccgccgcgcag

SEQ ID NO: 3524864 - RNA, 18 nt, Pseudomonas aeruginosa PA01
ccgcugccgcucuggcug

SEQ ID NO: 3524865 - RNA, 22 nt, Pseudomonas aeruginosa PA01
ccgcugccgcucuggcugcugg

SEQ ID NO: 3524866 - RNA, 21 nt, Pseudomonas aeruginosa PA01
ccgcugccguacagcccccgc

SEQ ID NO: 3524867 - RNA, 18 nt, Pseudomonas aeruginosa PA01
ccgcugccugucgcagcg

SEQ ID NO: 3524868 - RNA, 16 nt, Pseudomonas aeruginosa PA01
ccgcugcgcaggccga

SEQ ID NO: 3524869 - RNA, 17 nt, Pseudomonas aeruginosa PA01
ccgcugcgcaucagguc

SEQ ID NO: 3524870 - RNA, 13 nt, Pseudomonas aeruginosa PA01
ccgcugcgccgcc

SEQ ID NO: 3524871 - RNA, 16 nt, Pseudomonas aeruginosa PA01
ccgcugcgccgccguc

SEQ ID NO: 3524872 - RNA, 17 nt, Pseudomonas aeruginosa PA01
ccgcugcgccgccgucu

SEQ ID NO: 3524873 - RNA, 23 nt, Pseudomonas aeruginosa PA01
ccgcugcgcgaagccaggaagcg

SEQ ID NO: 3524874 - RNA, 14 nt, Pseudomonas aeruginosa PA01
ccgcugcgcgcagu

SEQ ID NO: 3524875 - RNA, 13 nt, Pseudomonas aeruginosa PA01
ccgcugcgcgggu

SEQ ID NO: 3524876 - RNA, 21 nt, Pseudomonas aeruginosa PA01
ccgcugcgcgggucuugccgg

SEQ ID NO: 3524877 - RNA, 20 nt, Pseudomonas aeruginosa PA01
ccgcugcgcgguuauccgcc

SEQ ID NO: 3524878 - RNA, 15 nt, Pseudomonas aeruginosa PA01
ccgcugcgcugccag

SEQ ID NO: 3524879 - RNA, 19 nt, Pseudomonas aeruginosa PA01
ccgcugcgcugccagcgcc

SEQ ID NO: 3524880 - RNA, 21 nt, Pseudomonas aeruginosa PA01
ccgcugcgcugccagcgccgc

SEQ ID NO: 3524881 - RNA, 23 nt, Pseudomonas aeruginosa PA01
ccgcugcgcugccagcgccgccg

SEQ ID NO: 3524882 - RNA, 19 nt, Pseudomonas aeruginosa PA01
ccgcugcggaagagguacg

SEQ ID NO: 3524883 - RNA, 15 nt, Pseudomonas aeruginosa PA01
ccgcugcggccggcg

SEQ ID NO: 3524884 - RNA, 17 nt, Pseudomonas aeruginosa PA01
ccgcugcggcgguccca

SEQ ID NO: 3524885 - RNA, 21 nt, Pseudomonas aeruginosa PA01
ccgcugcggcggucccagacc

SEQ ID NO: 3524886 - RNA, 12 nt, Pseudomonas aeruginosa PA01
ccgcugcggcuc

SEQ ID NO: 3524887 - RNA, 15 nt, Pseudomonas aeruginosa PA01
ccgcugcggcucgcc

SEQ ID NO: 3524888 - RNA, 16 nt, Pseudomonas aeruginosa PA01
ccgcugcggcucgccg

SEQ ID NO: 3524889 - RNA, 13 nt, Pseudomonas aeruginosa PA01
ccgcugcggcugc

SEQ ID NO: 3524890 - RNA, 15 nt, Pseudomonas aeruginosa PA01
ccgcugcgucgucgc

SEQ ID NO: 3524891 - RNA, 17 nt, Pseudomonas aeruginosa PA01
ccgcugcgucgucgcgg

SEQ ID NO: 3524892 - RNA, 19 nt, Pseudomonas aeruginosa PA01
ccgcugcgucgucgcggcg

SEQ ID NO: 3524893 - RNA, 13 nt, Pseudomonas aeruginosa PA01
ccgcugcgugcca

SEQ ID NO: 3524894 - RNA, 15 nt, Pseudomonas aeruginosa PA01
ccgcugcgugccagg

SEQ ID NO: 3524895 - RNA, 13 nt, Pseudomonas aeruginosa PA01
ccgcugcuggcau

SEQ ID NO: 3524896 - RNA, 16 nt, Pseudomonas aeruginosa PA01
ccgcuggaaccggccg

SEQ ID NO: 3524897 - RNA, 18 nt, Pseudomonas aeruginosa PA01
ccgcuggaaccggccggc

SEQ ID NO: 3524898 - RNA, 19 nt, Pseudomonas aeruginosa PA01
ccgcuggaaccggccggca

SEQ ID NO: 3524899 - RNA, 20 nt, Pseudomonas aeruginosa PA01
ccgcuggaaccggccggcag

SEQ ID NO: 3524900 - RNA, 12 nt, Pseudomonas aeruginosa PA01
ccgcuggccagg

SEQ ID NO: 3524901 - RNA, 14 nt, Pseudomonas aeruginosa PA01
ccgcuggccagguc

SEQ ID NO: 3524902 - RNA, 17 nt, Pseudomonas aeruginosa PA01
ccgcuggcccaacagcg

SEQ ID NO: 3524903 - RNA, 15 nt, Pseudomonas aeruginosa PA01
ccgcuggccgaccag

SEQ ID NO: 3524904 - RNA, 16 nt, Pseudomonas aeruginosa PA01
ccgcuggccuggccac

SEQ ID NO: 3524905 - RNA, 17 nt, Pseudomonas aeruginosa PA01
ccggaccagaucggcgc

SEQ ID NO: 3524906 - RNA, 13 nt, Pseudomonas aeruginosa PA01
ccggaccagccgg

SEQ ID NO: 3524907 - RNA, 17 nt, Pseudomonas aeruginosa PA01
ccggaccagccgguccc

SEQ ID NO: 3524908 - RNA, 21 nt, Pseudomonas aeruginosa PA01
ccggaccagccggucccgggc

SEQ ID NO: 3524909 - RNA, 13 nt, Pseudomonas aeruginosa PA01
ccggaccagccgu

SEQ ID NO: 3524910 - RNA, 16 nt, Pseudomonas aeruginosa PA01
ccggaccagccguccg

SEQ ID NO: 3524911 - RNA, 21 nt, Pseudomonas aeruginosa PA01
ccggaccagggcgccgggcug

SEQ ID NO: 3524912 - RNA, 12 nt, Pseudomonas aeruginosa PA01
ccggacccggcu

SEQ ID NO: 3524913 - RNA, 12 nt, Pseudomonas aeruginosa PA01
ccggaccgggcg

SEQ ID NO: 3524914 - RNA, 18 nt, Pseudomonas aeruginosa PA01
ccggaccgggcggcaggc

SEQ ID NO: 3524915 - RNA, 22 nt, Pseudomonas aeruginosa PA01
ccggaccgucgcgauagacgcc

SEQ ID NO: 3524916 - RNA, 19 nt, Pseudomonas aeruginosa PA01
ccggaccguggugacgguc

SEQ ID NO: 3524917 - RNA, 18 nt, Pseudomonas aeruginosa PA01
ccggaccuuguccagggu

SEQ ID NO: 3524918 - RNA, 15 nt, Pseudomonas aeruginosa PA01
ccggacgacgaaaga

SEQ ID NO: 3524919 - RNA, 17 nt, Pseudomonas aeruginosa PA01
ccggacgacgaaagaag

SEQ ID NO: 3524920 - RNA, 19 nt, Pseudomonas aeruginosa PA01
ccggacgacgaaagaagcc

SEQ ID NO: 3524921 - RNA, 16 nt, Pseudomonas aeruginosa PA01
ccggacgcaccagcag

SEQ ID NO: 3524922 - RNA, 17 nt, Pseudomonas aeruginosa PA01
ccggacgcaccagcagg

SEQ ID NO: 3524923 - RNA, 18 nt, Pseudomonas aeruginosa PA01
ccggacgcaccagcaggc

SEQ ID NO: 3524924 - RNA, 21 nt, Pseudomonas aeruginosa PA01
ccggacgcaccagcaggccga

SEQ ID NO: 3524925 - RNA, 15 nt, Pseudomonas aeruginosa PA01
ccggacgccgaacgc

SEQ ID NO: 3524926 - RNA, 16 nt, Pseudomonas aeruginosa PA01
ccggacgccgaacgcc

SEQ ID NO: 3524927 - RNA, 17 nt, Pseudomonas aeruginosa PA01
ccggacgccgaacgccc

SEQ ID NO: 3524928 - RNA, 20 nt, Pseudomonas aeruginosa PA01
ccggacgcgacugcugcugc

SEQ ID NO: 3524929 - RNA, 17 nt, Pseudomonas aeruginosa PA01
ccggacggccgcgccgg

SEQ ID NO: 3524930 - RNA, 13 nt, Pseudomonas aeruginosa PA01
ccggacggcggcg

SEQ ID NO: 3524931 - RNA, 24 nt, Pseudomonas aeruginosa PA01
ccggacggcggcgucaucccguag

SEQ ID NO: 3524932 - RNA, 16 nt, Pseudomonas aeruginosa PA01
ccggacggcugaggcu

SEQ ID NO: 3524933 - RNA, 18 nt, Pseudomonas aeruginosa PA01
ccggacgggugcgcgcca

SEQ ID NO: 3524934 - RNA, 17 nt, Pseudomonas aeruginosa PA01
ccggacguuuccagcgg

SEQ ID NO: 3524935 - RNA, 18 nt, Pseudomonas aeruginosa PA01
ccggacguuuccagcggc

SEQ ID NO: 3524936 - RNA, 20 nt, Pseudomonas aeruginosa PA01
ccggacugcccagcgccgcc

SEQ ID NO: 3524937 - RNA, 22 nt, Pseudomonas aeruginosa PA01
ccggacugcccagcgccgccag

SEQ ID NO: 3524938 - RNA, 19 nt, Pseudomonas aeruginosa PA01
ccggacugccgauggugau

SEQ ID NO: 3524939 - RNA, 17 nt, Pseudomonas aeruginosa PA01
ccggacuggauucggcc

SEQ ID NO: 3524940 - RNA, 21 nt, Pseudomonas aeruginosa PA01
ccggacuggauucggccugcc

SEQ ID NO: 3524941 - RNA, 15 nt, Pseudomonas aeruginosa PA01
ccggacuuccuugca

SEQ ID NO: 3524942 - RNA, 13 nt, Pseudomonas aeruginosa PA01
ccggagaacgccg

SEQ ID NO: 3524943 - RNA, 15 nt, Pseudomonas aeruginosa PA01
ccggagaacgccgcc

SEQ ID NO: 3524944 - RNA, 22 nt, Pseudomonas aeruginosa PA01
ccggagaccgugccgccggggc

SEQ ID NO: 3524945 - RNA, 18 nt, Pseudomonas aeruginosa PA01
ccggagacgauggcgacg

SEQ ID NO: 3524946 - RNA, 21 nt, Pseudomonas aeruginosa PA01
ccggagagcagcacggccucg

SEQ ID NO: 3524947 - RNA, 15 nt, Pseudomonas aeruginosa PA01
ccggagaucgccgcg

SEQ ID NO: 3524948 - RNA, 14 nt, Pseudomonas aeruginosa PA01
ccggagaucggcug

SEQ ID NO: 3524949 - RNA, 19 nt, Pseudomonas aeruginosa PA01
ccggagaugugcgcgguga

SEQ ID NO: 3524950 - RNA, 13 nt, Pseudomonas aeruginosa PA01
ccggagccaccgg

SEQ ID NO: 3524951 - RNA, 14 nt, Pseudomonas aeruginosa PA01
ccggagccaccggg

SEQ ID NO: 3524952 - RNA, 16 nt, Pseudomonas aeruginosa PA01
ccggagccgggcaacg

SEQ ID NO: 3524953 - RNA, 20 nt, Pseudomonas aeruginosa PA01
ccggagccuucuagcgaagg

SEQ ID NO: 3524954 - RNA, 17 nt, Pseudomonas aeruginosa PA01
ccggagcgaacgacagc

SEQ ID NO: 3524955 - RNA, 20 nt, Pseudomonas aeruginosa PA01
ccggagcgcgaaagcgcccc

SEQ ID NO: 3524956 - RNA, 21 nt, Pseudomonas aeruginosa PA01
ccggagcgcgaaagcgccccg

SEQ ID NO: 3524957 - RNA, 11 nt, Pseudomonas aeruginosa PA01
ccggagcuuug

SEQ ID NO: 3524958 - RNA, 20 nt, Pseudomonas aeruginosa PA01
ccggagcuuugcagggcgau

SEQ ID NO: 3524959 - RNA, 15 nt, Pseudomonas aeruginosa PA01
ccggaggcggcgagc

SEQ ID NO: 3524960 - RNA, 17 nt, Pseudomonas aeruginosa PA01
ccggaggcggcgagcgu

SEQ ID NO: 3524961 - RNA, 13 nt, Pseudomonas aeruginosa PA01
ccggagggcccgg

SEQ ID NO: 3524962 - RNA, 18 nt, Pseudomonas aeruginosa PA01
ccggaggggcggccgccg

SEQ ID NO: 3524963 - RNA, 13 nt, Pseudomonas aeruginosa PA01
ccggagucucggg

SEQ ID NO: 3524964 - RNA, 15 nt, Pseudomonas aeruginosa PA01
ccggagugaugccga

SEQ ID NO: 3524965 - RNA, 15 nt, Pseudomonas aeruginosa PA01
ccggaguuccagcgg

SEQ ID NO: 3524966 - RNA, 17 nt, Pseudomonas aeruginosa PA01
ccggaguucgcccgccc

SEQ ID NO: 3524967 - RNA, 20 nt, Pseudomonas aeruginosa PA01
ccggaguucgcccgccccau

SEQ ID NO: 3524968 - RNA, 13 nt, Pseudomonas aeruginosa PA01
ccggauacaccag

SEQ ID NO: 3524969 - RNA, 14 nt, Pseudomonas aeruginosa PA01
ccggauacaccagg

SEQ ID NO: 3524970 - RNA, 15 nt, Pseudomonas aeruginosa PA01
ccggauacaccaggu

SEQ ID NO: 3524971 - RNA, 19 nt, Pseudomonas aeruginosa PA01
ccggauacaccagguuggc

SEQ ID NO: 3524972 - RNA, 22 nt, Pseudomonas aeruginosa PA01
ccggauaccccgguugugcgcc

SEQ ID NO: 3524973 - RNA, 17 nt, Pseudomonas aeruginosa PA01
ccggauagacgccgucc

SEQ ID NO: 3524974 - RNA, 23 nt, Pseudomonas aeruginosa PA01
ccggauagacgccguccaccagc

SEQ ID NO: 3524975 - RNA, 14 nt, Pseudomonas aeruginosa PA01
ccggauagaucagg

SEQ ID NO: 3524976 - RNA, 18 nt, Pseudomonas aeruginosa PA01
ccggauagaucaggccgg

SEQ ID NO: 3524977 - RNA, 20 nt, Pseudomonas aeruginosa PA01
ccggauagaucaggccggcg

SEQ ID NO: 3524978 - RNA, 21 nt, Pseudomonas aeruginosa PA01
ccggauagaucaggccggcgu

SEQ ID NO: 3524979 - RNA, 23 nt, Pseudomonas aeruginosa PA01
ccggauagaucaggccggcgucg

SEQ ID NO: 3524980 - RNA, 15 nt, Pseudomonas aeruginosa PA01
ccggaucgcccuggc

SEQ ID NO: 3524981 - RNA, 13 nt, Pseudomonas aeruginosa PA01
ccggaucggccuu

SEQ ID NO: 3524982 - RNA, 12 nt, Pseudomonas aeruginosa PA01
ccggaucggcug

SEQ ID NO: 3524983 - RNA, 16 nt, Pseudomonas aeruginosa PA01
ccggaucggcugaccg

SEQ ID NO: 3524984 - RNA, 21 nt, Pseudomonas aeruginosa PA01
ccggaucggcugaccggcauc

SEQ ID NO: 3524985 - RNA, 13 nt, Pseudomonas aeruginosa PA01
ccggaugccaccg

SEQ ID NO: 3524986 - RNA, 14 nt, Pseudomonas aeruginosa PA01
ccggaugccaccgc

SEQ ID NO: 3524987 - RNA, 15 nt, Pseudomonas aeruginosa PA01
ccggaugccaccgcu

SEQ ID NO: 3524988 - RNA, 22 nt, Pseudomonas aeruginosa PA01
ccggaugcuccagguucggcgc

SEQ ID NO: 3524989 - RNA, 13 nt, Pseudomonas aeruginosa PA01
ccggauggccgcc

SEQ ID NO: 3524990 - RNA, 19 nt, Pseudomonas aeruginosa PA01
ccggauggcugacccgcug

SEQ ID NO: 3524991 - RNA, 14 nt, Pseudomonas aeruginosa PA01
ccggaugggcgagc

SEQ ID NO: 3524992 - RNA, 14 nt, Pseudomonas aeruginosa PA01
ccggauucgccgag

SEQ ID NO: 3524993 - RNA, 18 nt, Pseudomonas aeruginosa PA01
ccggauucgcgcagcagg

SEQ ID NO: 3524994 - RNA, 19 nt, Pseudomonas aeruginosa PA01
ccggauucgcgcagcaggc

SEQ ID NO: 3524995 - RNA, 14 nt, Pseudomonas aeruginosa PA01
ccggauugccgcgg

SEQ ID NO: 3524996 - RNA, 14 nt, Pseudomonas aeruginosa PA01
ccggcaaacgccgc

SEQ ID NO: 3524997 - RNA, 15 nt, Pseudomonas aeruginosa PA01
ccggcaaacgccgcc

SEQ ID NO: 3524998 - RNA, 16 nt, Pseudomonas aeruginosa PA01
ccggcaaacgccgcca

SEQ ID NO: 3524999 - RNA, 17 nt, Pseudomonas aeruginosa PA01
ccggcaaacgccgccac

SEQ ID NO: 3525000 - RNA, 13 nt, Pseudomonas aeruginosa PA01
ccggcaaaguauu

SEQ ID NO: 3525001 - RNA, 13 nt, Pseudomonas aeruginosa PA01
ccggcaaaugccg

SEQ ID NO: 3525002 - RNA, 14 nt, Pseudomonas aeruginosa PA01
ccggcaaaugccgg

SEQ ID NO: 3525003 - RNA, 17 nt, Pseudomonas aeruginosa PA01
ccggcaaaugccgggcu

SEQ ID NO: 3525004 - RNA, 21 nt, Pseudomonas aeruginosa PA01
ccggcaacgaacuucagggcu

SEQ ID NO: 3525005 - RNA, 14 nt, Pseudomonas aeruginosa PA01
ccggcaagcgccgg

SEQ ID NO: 3525006 - RNA, 16 nt, Pseudomonas aeruginosa PA01
ccggcaagcuccgcga

SEQ ID NO: 3525007 - RNA, 15 nt, Pseudomonas aeruginosa PA01
ccggcaaggcggccu

SEQ ID NO: 3525008 - RNA, 16 nt, Pseudomonas aeruginosa PA01
ccggcaugcucagccg

SEQ ID NO: 3525009 - RNA, 14 nt, Pseudomonas aeruginosa PA01
ccggcauucgccgg

SEQ ID NO: 3525010 - RNA, 15 nt, Pseudomonas aeruginosa PA01
ccggcauucgccggg

SEQ ID NO: 3525011 - RNA, 16 nt, Pseudomonas aeruginosa PA01
ccggcauucgccgggc

SEQ ID NO: 3525012 - RNA, 16 nt, Pseudomonas aeruginosa PA01
ccggccaaccaccggc

SEQ ID NO: 3525013 - RNA, 18 nt, Pseudomonas aeruginosa PA01
ccggccaauggccgggcu

SEQ ID NO: 3525014 - RNA, 13 nt, Pseudomonas aeruginosa PA01
ccggccaccagca

SEQ ID NO: 3525015 - RNA, 15 nt, Pseudomonas aeruginosa PA01
ccggccaccagcagc

SEQ ID NO: 3525016 - RNA, 22 nt, Pseudomonas aeruginosa PA01
ccggccaccaggcuuacccgcg

SEQ ID NO: 3525017 - RNA, 23 nt, Pseudomonas aeruginosa PA01
ccggccaccaucacgucgcgcac

SEQ ID NO: 3525018 - RNA, 14 nt, Pseudomonas aeruginosa PA01
ccggccacucgcag

SEQ ID NO: 3525019 - RNA, 16 nt, Pseudomonas aeruginosa PA01
ccggccacucgcagcc

SEQ ID NO: 3525020 - RNA, 18 nt, Pseudomonas aeruginosa PA01
ccggccacucgcagccgc

SEQ ID NO: 3525021 - RNA, 19 nt, Pseudomonas aeruginosa PA01
ccggccacucgcagccgcg

SEQ ID NO: 3525022 - RNA, 20 nt, Pseudomonas aeruginosa PA01
ccggccagagcuucugcugg

SEQ ID NO: 3525023 - RNA, 13 nt, Pseudomonas aeruginosa PA01
ccggccagcagcg

SEQ ID NO: 3525024 - RNA, 17 nt, Pseudomonas aeruginosa PA01
ccggccagcagcgccuc

SEQ ID NO: 3525025 - RNA, 14 nt, Pseudomonas aeruginosa PA01
ccggccagccaggc

SEQ ID NO: 3525026 - RNA, 12 nt, Pseudomonas aeruginosa PA01
ccggccagcccg

SEQ ID NO: 3525027 - RNA, 12 nt, Pseudomonas aeruginosa PA01
ccggccagccgc

SEQ ID NO: 3525028 - RNA, 15 nt, Pseudomonas aeruginosa PA01
ccggccagccgcgcc

SEQ ID NO: 3525029 - RNA, 18 nt, Pseudomonas aeruginosa PA01
ccggccagccgcgccagu

SEQ ID NO: 3525030 - RNA, 16 nt, Pseudomonas aeruginosa PA01
ccggccagccuggcca

SEQ ID NO: 3525031 - RNA, 18 nt, Pseudomonas aeruginosa PA01
ccggccagccuucccggc

SEQ ID NO: 3525032 - RNA, 13 nt, Pseudomonas aeruginosa PA01
ccggccagcgcgg

SEQ ID NO: 3525033 - RNA, 15 nt, Pseudomonas aeruginosa PA01
ccggccagcgcggcg

SEQ ID NO: 3525034 - RNA, 17 nt, Pseudomonas aeruginosa PA01
ccggccaggccacggcg

SEQ ID NO: 3525035 - RNA, 18 nt, Pseudomonas aeruginosa PA01
ccggccaggcccucagcg

SEQ ID NO: 3525036 - RNA, 13 nt, Pseudomonas aeruginosa PA01
ccggccaggccgc

SEQ ID NO: 3525037 - RNA, 17 nt, Pseudomonas aeruginosa PA01
ccggccaggccgcccag

SEQ ID NO: 3525038 - RNA, 13 nt, Pseudomonas aeruginosa PA01
ccggccaggcgcg

SEQ ID NO: 3525039 - RNA, 14 nt, Pseudomonas aeruginosa PA01
ccggccaggcgcgg

SEQ ID NO: 3525040 - RNA, 16 nt, Pseudomonas aeruginosa PA01
ccggccaggcgcggcg

SEQ ID NO: 3525041 - RNA, 17 nt, Pseudomonas aeruginosa PA01
ccggccaggcgcggcgc

SEQ ID NO: 3525042 - RNA, 13 nt, Pseudomonas aeruginosa PA01
ccggccaggcgcu

SEQ ID NO: 3525043 - RNA, 15 nt, Pseudomonas aeruginosa PA01
ccggccaggcgcugg

SEQ ID NO: 3525044 - RNA, 19 nt, Pseudomonas aeruginosa PA01
ccggccaggcgcuggucca

SEQ ID NO: 3525045 - RNA, 12 nt, Pseudomonas aeruginosa PA01
ccggccaggcgg

SEQ ID NO: 3525046 - RNA, 23 nt, Pseudomonas aeruginosa PA01
ccggccagggcgaacagcgccgc

SEQ ID NO: 3525047 - RNA, 16 nt, Pseudomonas aeruginosa PA01
ccggccagggucgcca

SEQ ID NO: 3525048 - RNA, 18 nt, Pseudomonas aeruginosa PA01
ccggccagggucgccagc

SEQ ID NO: 3525049 - RNA, 19 nt, Pseudomonas aeruginosa PA01
ccggccagggucgccagca

SEQ ID NO: 3525050 - RNA, 21 nt, Pseudomonas aeruginosa PA01
ccggccagggucgccagcagg

SEQ ID NO: 3525051 - RNA, 23 nt, Pseudomonas aeruginosa PA01
ccggccagggucgccagcaggua

SEQ ID NO: 3525052 - RNA, 10 nt, Pseudomonas aeruginosa PA01
ccggccaggu

SEQ ID NO: 3525053 - RNA, 18 nt, Pseudomonas aeruginosa PA01
ccggccagguaccggcca

SEQ ID NO: 3525054 - RNA, 23 nt, Pseudomonas aeruginosa PA01
ccggccagguaccggccaggcgg

SEQ ID NO: 3525055 - RNA, 17 nt, Pseudomonas aeruginosa PA01
ccggccagguacuggcg

SEQ ID NO: 3525056 - RNA, 19 nt, Pseudomonas aeruginosa PA01
ccggccagguacuggcgau

SEQ ID NO: 3525057 - RNA, 17 nt, Pseudomonas aeruginosa PA01
ccggccagguagcggcg

SEQ ID NO: 3525058 - RNA, 23 nt, Pseudomonas aeruginosa PA01
ccggccagguagcggcguucgcc

SEQ ID NO: 3525059 - RNA, 17 nt, Pseudomonas aeruginosa PA01
ccggccagguaggcgac

SEQ ID NO: 3525060 - RNA, 18 nt, Pseudomonas aeruginosa PA01
ccggccagguaggcgacg

SEQ ID NO: 3525061 - RNA, 21 nt, Pseudomonas aeruginosa PA01
ccggccagguaggcgacgaag

SEQ ID NO: 3525062 - RNA, 22 nt, Pseudomonas aeruginosa PA01
ccggccagguaggcgacgaagc

SEQ ID NO: 3525063 - RNA, 23 nt, Pseudomonas aeruginosa PA01
ccggccaguuggugcacgcgccg

SEQ ID NO: 3525064 - RNA, 12 nt, Pseudomonas aeruginosa PA01
ccggccaucagc

SEQ ID NO: 3525065 - RNA, 21 nt, Pseudomonas aeruginosa PA01
ccggccaucagcaccaggaag

SEQ ID NO: 3525066 - RNA, 22 nt, Pseudomonas aeruginosa PA01
ccggccauccagccaggcgcuc

SEQ ID NO: 3525067 - RNA, 11 nt, Pseudomonas aeruginosa PA01
ccggccauccu

SEQ ID NO: 3525068 - RNA, 16 nt, Pseudomonas aeruginosa PA01
ccggccauccuggccg

SEQ ID NO: 3525069 - RNA, 18 nt, Pseudomonas aeruginosa PA01
ccggccauccuggccggu

SEQ ID NO: 3525070 - RNA, 23 nt, Pseudomonas aeruginosa PA01
ccggccaugcaggccagggcggu

SEQ ID NO: 3525071 - RNA, 12 nt, Pseudomonas aeruginosa PA01
ccggccaugccg

SEQ ID NO: 3525072 - RNA, 17 nt, Pseudomonas aeruginosa PA01
ccggccaugcuggcgcu

SEQ ID NO: 3525073 - RNA, 17 nt, Pseudomonas aeruginosa PA01
ccggccauuacgccgag

SEQ ID NO: 3525074 - RNA, 20 nt, Pseudomonas aeruginosa PA01
ccggccauuacgccgagcau

SEQ ID NO: 3525075 - RNA, 15 nt, Pseudomonas aeruginosa PA01
ccggccauugccgcc

SEQ ID NO: 3525076 - RNA, 16 nt, Pseudomonas aeruginosa PA01
ccggcccacgcucagu

SEQ ID NO: 3525077 - RNA, 21 nt, Pseudomonas aeruginosa PA01
ccggcccacgcucagugcgcc

SEQ ID NO: 3525078 - RNA, 22 nt, Pseudomonas aeruginosa PA01
ccggcccacgcucagugcgccg

SEQ ID NO: 3525079 - RNA, 13 nt, Pseudomonas aeruginosa PA01
ccggcccagcagg

SEQ ID NO: 3525080 - RNA, 17 nt, Pseudomonas aeruginosa PA01
ccggcccagcaggccgg

SEQ ID NO: 3525081 - RNA, 20 nt, Pseudomonas aeruginosa PA01
ccggcccagcaggccggcca

SEQ ID NO: 3525082 - RNA, 14 nt, Pseudomonas aeruginosa PA01
ccggcccagccgcg

SEQ ID NO: 3525083 - RNA, 17 nt, Pseudomonas aeruginosa PA01
ccggcccagcguucggc

SEQ ID NO: 3525084 - RNA, 11 nt, Pseudomonas aeruginosa PA01
ccggcccaggc

SEQ ID NO: 3525085 - RNA, 12 nt, Pseudomonas aeruginosa PA01
ccggcccauccg

SEQ ID NO: 3525086 - RNA, 14 nt, Pseudomonas aeruginosa PA01
ccggcccauggcga

SEQ ID NO: 3525087 - RNA, 15 nt, Pseudomonas aeruginosa PA01
ccggcccauggcgac

SEQ ID NO: 3525088 - RNA, 14 nt, Pseudomonas aeruginosa PA01
ccggccccaccagc

SEQ ID NO: 3525089 - RNA, 13 nt, Pseudomonas aeruginosa PA01
ccggccccgcggu

SEQ ID NO: 3525090 - RNA, 14 nt, Pseudomonas aeruginosa PA01
ccggccccgcggua

SEQ ID NO: 3525091 - RNA, 23 nt, Pseudomonas aeruginosa PA01
ccggccccgcgguacccggcagg

SEQ ID NO: 3525092 - RNA, 14 nt, Pseudomonas aeruginosa PA01
ccggcccgcgccgc

SEQ ID NO: 3525093 - RNA, 18 nt, Pseudomonas aeruginosa PA01
ccggcccgcgccgccucg

SEQ ID NO: 3525094 - RNA, 22 nt, Pseudomonas aeruginosa PA01
ccggcccggagaucgccgcgcc

SEQ ID NO: 3525095 - RNA, 14 nt, Pseudomonas aeruginosa PA01
ccggcccggagcgc

SEQ ID NO: 3525096 - RNA, 17 nt, Pseudomonas aeruginosa PA01
ccggcccggagcgcgag

SEQ ID NO: 3525097 - RNA, 19 nt, Pseudomonas aeruginosa PA01
ccggcccggagcgcgaggc

SEQ ID NO: 3525098 - RNA, 14 nt, Pseudomonas aeruginosa PA01
ccggcccggccagg

SEQ ID NO: 3525099 - RNA, 15 nt, Pseudomonas aeruginosa PA01
ccggcccggccaggc

SEQ ID NO: 3525100 - RNA, 15 nt, Pseudomonas aeruginosa PA01
ccggcccggccaggu

SEQ ID NO: 3525101 - RNA, 15 nt, Pseudomonas aeruginosa PA01
ccggcccggccaucc

SEQ ID NO: 3525102 - RNA, 14 nt, Pseudomonas aeruginosa PA01
ccggcccggcguga

SEQ ID NO: 3525103 - RNA, 17 nt, Pseudomonas aeruginosa PA01
ccggcccgugcccgucc

SEQ ID NO: 3525104 - RNA, 18 nt, Pseudomonas aeruginosa PA01
ccggcccgugcccguccu

SEQ ID NO: 3525105 - RNA, 15 nt, Pseudomonas aeruginosa PA01
ccggcccucgcgagc

SEQ ID NO: 3525106 - RNA, 17 nt, Pseudomonas aeruginosa PA01
ccggcccucgcgagccc

SEQ ID NO: 3525107 - RNA, 14 nt, Pseudomonas aeruginosa PA01
ccggccgaccaggu

SEQ ID NO: 3525108 - RNA, 13 nt, Pseudomonas aeruginosa PA01
ccggccgacgaug

SEQ ID NO: 3525109 - RNA, 23 nt, Pseudomonas aeruginosa PA01
ccggccgacgauguucgaggcgc

SEQ ID NO: 3525110 - RNA, 23 nt, Pseudomonas aeruginosa PA01
ccggccgaucaccuucaccggca

SEQ ID NO: 3525111 - RNA, 21 nt, Pseudomonas aeruginosa PA01
ccggcgaugcccaggccgccg

SEQ ID NO: 3525112 - RNA, 22 nt, Pseudomonas aeruginosa PA01
ccggcgaugcccaggccgccga

SEQ ID NO: 3525113 - RNA, 16 nt, Pseudomonas aeruginosa PA01
ccggcgaugccgccca

SEQ ID NO: 3525114 - RNA, 17 nt, Pseudomonas aeruginosa PA01
ccggcgaugccgcccag

SEQ ID NO: 3525115 - RNA, 20 nt, Pseudomonas aeruginosa PA01
ccggcgaugccgcccagcac

SEQ ID NO: 3525116 - RNA, 21 nt, Pseudomonas aeruginosa PA01
ccggcgaugccgcccagcacc

SEQ ID NO: 3525117 - RNA, 19 nt, Pseudomonas aeruginosa PA01
ccggcgaugcgcaggccgg

SEQ ID NO: 3525118 - RNA, 19 nt, Pseudomonas aeruginosa PA01
ccggcgaugcucagcgccg

SEQ ID NO: 3525119 - RNA, 21 nt, Pseudomonas aeruginosa PA01
ccggcgaugcucagcgccggc

SEQ ID NO: 3525120 - RNA, 23 nt, Pseudomonas aeruginosa PA01
ccggcgaugcucagcgccggcca

SEQ ID NO: 3525121 - RNA, 14 nt, Pseudomonas aeruginosa PA01
ccggcgauggccca

SEQ ID NO: 3525122 - RNA, 14 nt, Pseudomonas aeruginosa PA01
ccggcgauggccgc

SEQ ID NO: 3525123 - RNA, 15 nt, Pseudomonas aeruginosa PA01
ccggcgauggccgcc

SEQ ID NO: 3525124 - RNA, 19 nt, Pseudomonas aeruginosa PA01
ccggcgaugugcggcgugg

SEQ ID NO: 3525125 - RNA, 23 nt, Pseudomonas aeruginosa PA01
ccggcgaugugcggcguggcgau

SEQ ID NO: 3525126 - RNA, 20 nt, Pseudomonas aeruginosa PA01
ccggcgauguucgcccccuu

SEQ ID NO: 3525127 - RNA, 14 nt, Pseudomonas aeruginosa PA01
ccggcgcacgccgg

SEQ ID NO: 3525128 - RNA, 19 nt, Pseudomonas aeruginosa PA01
ccggcgcacgccggccucg

SEQ ID NO: 3525129 - RNA, 22 nt, Pseudomonas aeruginosa PA01
ccggcgcacgccggccucgcgc

SEQ ID NO: 3525130 - RNA, 13 nt, Pseudomonas aeruginosa PA01
ccggcgcacugcg

SEQ ID NO: 3525131 - RNA, 17 nt, Pseudomonas aeruginosa PA01
ccggcgcagaacugccg

SEQ ID NO: 3525132 - RNA, 21 nt, Pseudomonas aeruginosa PA01
ccggcgcagaacugccgggcc

SEQ ID NO: 3525133 - RNA, 13 nt, Pseudomonas aeruginosa PA01
ccggcgcagagcg

SEQ ID NO: 3525134 - RNA, 19 nt, Pseudomonas aeruginosa PA01
ccggcgcagaucgcggcgc

SEQ ID NO: 3525135 - RNA, 15 nt, Pseudomonas aeruginosa PA01
ccggcgcagcggagg

SEQ ID NO: 3525136 - RNA, 17 nt, Pseudomonas aeruginosa PA01
ccggcgcaucagcgccg

SEQ ID NO: 3525137 - RNA, 19 nt, Pseudomonas aeruginosa PA01
ccggcgcaucgucgaaacg

SEQ ID NO: 3525138 - RNA, 12 nt, Pseudomonas aeruginosa PA01
ccggcgccaccc

SEQ ID NO: 3525139 - RNA, 13 nt, Pseudomonas aeruginosa PA01
ccggcgccacccc

SEQ ID NO: 3525140 - RNA, 14 nt, Pseudomonas aeruginosa PA01
ccggcgccacccuc

SEQ ID NO: 3525141 - RNA, 21 nt, Pseudomonas aeruginosa PA01
ccggcgccaccgauucgccgg

SEQ ID NO: 3525142 - RNA, 22 nt, Pseudomonas aeruginosa PA01
ccggcgccaccgauucgccggc

SEQ ID NO: 3525143 - RNA, 18 nt, Pseudomonas aeruginosa PA01
ccggcgccaccgcguuga

SEQ ID NO: 3525144 - RNA, 14 nt, Pseudomonas aeruginosa PA01
ccggcgccagcagg

SEQ ID NO: 3525145 - RNA, 15 nt, Pseudomonas aeruginosa PA01
ccggcgccagcaggc

SEQ ID NO: 3525146 - RNA, 13 nt, Pseudomonas aeruginosa PA01
ccggcgccaggcc

SEQ ID NO: 3525147 - RNA, 14 nt, Pseudomonas aeruginosa PA01
ccggcgccaggccc

SEQ ID NO: 3525148 - RNA, 19 nt, Pseudomonas aeruginosa PA01
ccggcgccaggccggagcc

SEQ ID NO: 3525149 - RNA, 18 nt, Pseudomonas aeruginosa PA01
ccggcgccaggcugaccg

SEQ ID NO: 3525150 - RNA, 21 nt, Pseudomonas aeruginosa PA01
ccggcgccaguucgccgguga

SEQ ID NO: 3525151 - RNA, 14 nt, Pseudomonas aeruginosa PA01
ccggcgccaucgau

SEQ ID NO: 3525152 - RNA, 22 nt, Pseudomonas aeruginosa PA01
ccggcgccaucgaucagcagcg

SEQ ID NO: 3525153 - RNA, 20 nt, Pseudomonas aeruginosa PA01
ccggcgcccacaaccugccg

SEQ ID NO: 3525154 - RNA, 19 nt, Pseudomonas aeruginosa PA01
ccggcgccccggcccagcc

SEQ ID NO: 3525155 - RNA, 15 nt, Pseudomonas aeruginosa PA01
ccggcgccccugcgg

SEQ ID NO: 3525156 - RNA, 17 nt, Pseudomonas aeruginosa PA01
ccggcgccccugcggcg

SEQ ID NO: 3525157 - RNA, 18 nt, Pseudomonas aeruginosa PA01
ccggcgccccugcggcgc

SEQ ID NO: 3525158 - RNA, 21 nt, Pseudomonas aeruginosa PA01
ccggcgccccugcggcgccgg

SEQ ID NO: 3525159 - RNA, 11 nt, Pseudomonas aeruginosa PA01
ccggcgcccgg

SEQ ID NO: 3525160 - RNA, 13 nt, Pseudomonas aeruginosa PA01
ccggcgcccggcg

SEQ ID NO: 3525161 - RNA, 15 nt, Pseudomonas aeruginosa PA01
ccggcgcccggcgca

SEQ ID NO: 3525162 - RNA, 13 nt, Pseudomonas aeruginosa PA01
ccggcgcccuggg

SEQ ID NO: 3525163 - RNA, 16 nt, Pseudomonas aeruginosa PA01
ccggcgcccugggcgc

SEQ ID NO: 3525164 - RNA, 14 nt, Pseudomonas aeruginosa PA01
ccggcgcccuucga

SEQ ID NO: 3525165 - RNA, 12 nt, Pseudomonas aeruginosa PA01
ccggcgccgagg

SEQ ID NO: 3525166 - RNA, 23 nt, Pseudomonas aeruginosa PA01
ccggcgccgagguaguaggucug

SEQ ID NO: 3525167 - RNA, 12 nt, Pseudomonas aeruginosa PA01
ccggcgccgccc

SEQ ID NO: 3525168 - RNA, 21 nt, Pseudomonas aeruginosa PA01
ccggcgccgccccguuggcgc

SEQ ID NO: 3525169 - RNA, 14 nt, Pseudomonas aeruginosa PA01
ccggcgccgcccuu

SEQ ID NO: 3525170 - RNA, 16 nt, Pseudomonas aeruginosa PA01
ccggcgccgccgaaca

SEQ ID NO: 3525171 - RNA, 22 nt, Pseudomonas aeruginosa PA01
ccggcgccgccgaacaugccga

SEQ ID NO: 3525172 - RNA, 17 nt, Pseudomonas aeruginosa PA01
ccggcgccgccggggau

SEQ ID NO: 3525173 - RNA, 12 nt, Pseudomonas aeruginosa PA01
ccggcgccgccu

SEQ ID NO: 3525174 - RNA, 18 nt, Pseudomonas aeruginosa PA01
ccggcgccgccucgggca

SEQ ID NO: 3525175 - RNA, 21 nt, Pseudomonas aeruginosa PA01
ccggcgccgccucgggcagcc

SEQ ID NO: 3525176 - RNA, 16 nt, Pseudomonas aeruginosa PA01
ccggcgccgccuggcc

SEQ ID NO: 3525177 - RNA, 19 nt, Pseudomonas aeruginosa PA01
ccggcgccgccuggccggu

SEQ ID NO: 3525178 - RNA, 12 nt, Pseudomonas aeruginosa PA01
ccggcgccgcgg

SEQ ID NO: 3525179 - RNA, 22 nt, Pseudomonas aeruginosa PA01
ccggcgccgcuagggcgcccuc

SEQ ID NO: 3525180 - RNA, 12 nt, Pseudomonas aeruginosa PA01
ccggcgccggca

SEQ ID NO: 3525181 - RNA, 14 nt, Pseudomonas aeruginosa PA01
ccggcgccggcagg

SEQ ID NO: 3525182 - RNA, 13 nt, Pseudomonas aeruginosa PA01
ccggcgccgggcu

SEQ ID NO: 3525183 - RNA, 19 nt, Pseudomonas aeruginosa PA01
ccggcgccuucaucgccac

SEQ ID NO: 3525184 - RNA, 14 nt, Pseudomonas aeruginosa PA01
ccggcgcgaccguc

SEQ ID NO: 3525185 - RNA, 15 nt, Pseudomonas aeruginosa PA01
ccggcgcgaccgucg

SEQ ID NO: 3525186 - RNA, 16 nt, Pseudomonas aeruginosa PA01
ccggcgcgaccgucgg

SEQ ID NO: 3525187 - RNA, 17 nt, Pseudomonas aeruginosa PA01
ccggcgcgaccgucggc

SEQ ID NO: 3525188 - RNA, 18 nt, Pseudomonas aeruginosa PA01
ccggcgcgaccgucggcc

SEQ ID NO: 3525189 - RNA, 20 nt, Pseudomonas aeruginosa PA01
ccggcgcgaccgucggccgg

SEQ ID NO: 3525190 - RNA, 20 nt, Pseudomonas aeruginosa PA01
ccggcgcgacgcuccaggug

SEQ ID NO: 3525191 - RNA, 14 nt, Pseudomonas aeruginosa PA01
ccggcgcgauccug

SEQ ID NO: 3525192 - RNA, 19 nt, Pseudomonas aeruginosa PA01
ccggcgcgauccuggcggc

SEQ ID NO: 3525193 - RNA, 18 nt, Pseudomonas aeruginosa PA01
ccggcgcgcacggaggcg

SEQ ID NO: 3525194 - RNA, 19 nt, Pseudomonas aeruginosa PA01
ccggcgcgcacggucuugg

SEQ ID NO: 3525195 - RNA, 17 nt, Pseudomonas aeruginosa PA01
ccggcgcgcagggugag

SEQ ID NO: 3525196 - RNA, 13 nt, Pseudomonas aeruginosa PA01
ccggcgcgcccag

SEQ ID NO: 3525197 - RNA, 18 nt, Pseudomonas aeruginosa PA01
ccggcgcgcccaggccca

SEQ ID NO: 3525198 - RNA, 21 nt, Pseudomonas aeruginosa PA01
ccggcgcgccccugcgcccag

SEQ ID NO: 3525199 - RNA, 22 nt, Pseudomonas aeruginosa PA01
ccggcgcgccccugcgcccagg

SEQ ID NO: 3525200 - RNA, 20 nt, Pseudomonas aeruginosa PA01
ccggcgcgccggacaggcca

SEQ ID NO: 3525201 - RNA, 12 nt, Pseudomonas aeruginosa PA01
ccggcgcgccgu

SEQ ID NO: 3525202 - RNA, 21 nt, Pseudomonas aeruginosa PA01
ccggcgcgccguucuuguuga

SEQ ID NO: 3525203 - RNA, 15 nt, Pseudomonas aeruginosa PA01
ccggcgcgcggcggg

SEQ ID NO: 3525204 - RNA, 16 nt, Pseudomonas aeruginosa PA01
ccggcgcgcuugccgc

SEQ ID NO: 3525205 - RNA, 18 nt, Pseudomonas aeruginosa PA01
ccggcgcggaagcgccug

SEQ ID NO: 3525206 - RNA, 18 nt, Pseudomonas aeruginosa PA01
ccggcgcggacgaugguc

SEQ ID NO: 3525207 - RNA, 15 nt, Pseudomonas aeruginosa PA01
ccggcgcggacggcc

SEQ ID NO: 3525208 - RNA, 18 nt, Pseudomonas aeruginosa PA01
ccggcgcggacggccugc

SEQ ID NO: 3525209 - RNA, 17 nt, Pseudomonas aeruginosa PA01
ccggcgcggccgaacuc

SEQ ID NO: 3525210 - RNA, 24 nt, Pseudomonas aeruginosa PA01
ccggcgcggccgaacucuggcggc

SEQ ID NO: 3525211 - RNA, 14 nt, Pseudomonas aeruginosa PA01
ccggcgcggccugc

SEQ ID NO: 3525212 - RNA, 17 nt, Pseudomonas aeruginosa PA01
ccggcgcggccugcagc

SEQ ID NO: 3525213 - RNA, 15 nt, Pseudomonas aeruginosa PA01
ccggcgcggcgcagc

SEQ ID NO: 3525214 - RNA, 20 nt, Pseudomonas aeruginosa PA01
ccggcgucggcgcgggcgcc

SEQ ID NO: 3525215 - RNA, 12 nt, Pseudomonas aeruginosa PA01
ccggcgucgucc

SEQ ID NO: 3525216 - RNA, 14 nt, Pseudomonas aeruginosa PA01
ccggcgucguccug

SEQ ID NO: 3525217 - RNA, 23 nt, Pseudomonas aeruginosa PA01
ccggcgucguccugcgcggcgac

SEQ ID NO: 3525218 - RNA, 22 nt, Pseudomonas aeruginosa PA01
ccggcgucucauggaacagcag

SEQ ID NO: 3525219 - RNA, 13 nt, Pseudomonas aeruginosa PA01
ccggcgugaacgc

SEQ ID NO: 3525220 - RNA, 14 nt, Pseudomonas aeruginosa PA01
ccggcgugaacgcg

SEQ ID NO: 3525221 - RNA, 17 nt, Pseudomonas aeruginosa PA01
ccggcgugaacgcggcg

SEQ ID NO: 3525222 - RNA, 20 nt, Pseudomonas aeruginosa PA01
ccggcgugaacgcggcgaga

SEQ ID NO: 3525223 - RNA, 20 nt, Pseudomonas aeruginosa PA01
ccggcgugagcagggccgag

SEQ ID NO: 3525224 - RNA, 19 nt, Pseudomonas aeruginosa PA01
ccggcgugggcggucggcg

SEQ ID NO: 3525225 - RNA, 13 nt, Pseudomonas aeruginosa PA01
ccggcgugguggc

SEQ ID NO: 3525226 - RNA, 23 nt, Pseudomonas aeruginosa PA01
ccggcgugguggcggggaacagc

SEQ ID NO: 3525227 - RNA, 16 nt, Pseudomonas aeruginosa PA01
ccggcguuauccgccg

SEQ ID NO: 3525228 - RNA, 17 nt, Pseudomonas aeruginosa PA01
ccggcguuauccgccga

SEQ ID NO: 3525229 - RNA, 17 nt, Pseudomonas aeruginosa PA01
ccggcguugaacugccc

SEQ ID NO: 3525230 - RNA, 19 nt, Pseudomonas aeruginosa PA01
ccggcguugaacugcccgc

SEQ ID NO: 3525231 - RNA, 15 nt, Pseudomonas aeruginosa PA01
ccggcguuucgccgg

SEQ ID NO: 3525232 - RNA, 19 nt, Pseudomonas aeruginosa PA01
ccggcuaucccccggccga

SEQ ID NO: 3525233 - RNA, 14 nt, Pseudomonas aeruginosa PA01
ccggcuccagggcg

SEQ ID NO: 3525234 - RNA, 16 nt, Pseudomonas aeruginosa PA01
ccggcuccagggcgaa

SEQ ID NO: 3525235 - RNA, 22 nt, Pseudomonas aeruginosa PA01
ccggcuccaguugcagcacccc

SEQ ID NO: 3525236 - RNA, 20 nt, Pseudomonas aeruginosa PA01
ccggcuccccuggaaugccg

SEQ ID NO: 3525237 - RNA, 22 nt, Pseudomonas aeruginosa PA01
ccggcuccccuggaaugccggc

SEQ ID NO: 3525238 - RNA, 16 nt, Pseudomonas aeruginosa PA01
ccggcuccgcgcacgg

SEQ ID NO: 3525239 - RNA, 17 nt, Pseudomonas aeruginosa PA01
ccggcuccgcgcacgga

SEQ ID NO: 3525240 - RNA, 14 nt, Pseudomonas aeruginosa PA01
ccggcuccggcugc

SEQ ID NO: 3525241 - RNA, 15 nt, Pseudomonas aeruginosa PA01
ccggcuccggcugcg

SEQ ID NO: 3525242 - RNA, 13 nt, Pseudomonas aeruginosa PA01
ccggcuccuugcg

SEQ ID NO: 3525243 - RNA, 16 nt, Pseudomonas aeruginosa PA01
ccggcuccuugcgccg

SEQ ID NO: 3525244 - RNA, 18 nt, Pseudomonas aeruginosa PA01
ccggcucgaccuugcugg

SEQ ID NO: 3525245 - RNA, 16 nt, Pseudomonas aeruginosa PA01
ccggcucgacgccgac

SEQ ID NO: 3525246 - RNA, 18 nt, Pseudomonas aeruginosa PA01
ccggcucgacgccgacau

SEQ ID NO: 3525247 - RNA, 16 nt, Pseudomonas aeruginosa PA01
ccggcucgcccagcag

SEQ ID NO: 3525248 - RNA, 19 nt, Pseudomonas aeruginosa PA01
ccggcucgcccaugcgcgg

SEQ ID NO: 3525249 - RNA, 20 nt, Pseudomonas aeruginosa PA01
ccggcucgcccaugcgcggc

SEQ ID NO: 3525250 - RNA, 11 nt, Pseudomonas aeruginosa PA01
ccggcucgccg

SEQ ID NO: 3525251 - RNA, 18 nt, Pseudomonas aeruginosa PA01
ccggcucgccgacuucca

SEQ ID NO: 3525252 - RNA, 20 nt, Pseudomonas aeruginosa PA01
ccggcucgccgacuuccagg

SEQ ID NO: 3525253 - RNA, 23 nt, Pseudomonas aeruginosa PA01
ccggcucgccgacuuccaggcgc

SEQ ID NO: 3525254 - RNA, 15 nt, Pseudomonas aeruginosa PA01
ccggcucgccgccgg

SEQ ID NO: 3525255 - RNA, 24 nt, Pseudomonas aeruginosa PA01
ccggcucgccgccgggcgcgcgcc

SEQ ID NO: 3525256 - RNA, 13 nt, Pseudomonas aeruginosa PA01
ccggcucgccgcg

SEQ ID NO: 3525257 - RNA, 15 nt, Pseudomonas aeruginosa PA01
ccggcucgccgcgcu

SEQ ID NO: 3525258 - RNA, 12 nt, Pseudomonas aeruginosa PA01
ccggcucggccg

SEQ ID NO: 3525259 - RNA, 17 nt, Pseudomonas aeruginosa PA01
ccggcucgguuuccacc

SEQ ID NO: 3525260 - RNA, 13 nt, Pseudomonas aeruginosa PA01
ccggcucgucggc

SEQ ID NO: 3525261 - RNA, 15 nt, Pseudomonas aeruginosa PA01
ccggcucgucggcgu

SEQ ID NO: 3525262 - RNA, 21 nt, Pseudomonas aeruginosa PA01
ccggcucguucaugucggcuc

SEQ ID NO: 3525263 - RNA, 23 nt, Pseudomonas aeruginosa PA01
ccggcucguucaugucggcuccu

SEQ ID NO: 3525264 - RNA, 17 nt, Pseudomonas aeruginosa PA01
ccggcucucuucggccg

SEQ ID NO: 3525265 - RNA, 19 nt, Pseudomonas aeruginosa PA01
ccggcugacgcuggcgaag

SEQ ID NO: 3525266 - RNA, 20 nt, Pseudomonas aeruginosa PA01
ccggcugacgcuggcgaagg

SEQ ID NO: 3525267 - RNA, 19 nt, Pseudomonas aeruginosa PA01
ccggcugagcgccaggcgc

SEQ ID NO: 3525268 - RNA, 20 nt, Pseudomonas aeruginosa PA01
ccggcugcacagguugacga

SEQ ID NO: 3525269 - RNA, 14 nt, Pseudomonas aeruginosa PA01
ccggcugcaugccg

SEQ ID NO: 3525270 - RNA, 15 nt, Pseudomonas aeruginosa PA01
ccggcugcaugccgg

SEQ ID NO: 3525271 - RNA, 16 nt, Pseudomonas aeruginosa PA01
ccggcugcaugccggg

SEQ ID NO: 3525272 - RNA, 18 nt, Pseudomonas aeruginosa PA01
ccggcugcauguccgcca

SEQ ID NO: 3525273 - RNA, 20 nt, Pseudomonas aeruginosa PA01
ccggcugcauguccgccagu

SEQ ID NO: 3525274 - RNA, 15 nt, Pseudomonas aeruginosa PA01
ccggcugccgcgcgu

SEQ ID NO: 3525275 - RNA, 17 nt, Pseudomonas aeruginosa PA01
ccggcugcuccgggcgg

SEQ ID NO: 3525276 - RNA, 19 nt, Pseudomonas aeruginosa PA01
ccggcugcuuggccagguc

SEQ ID NO: 3525277 - RNA, 24 nt, Pseudomonas aeruginosa PA01
ccggcugcuuggccaggucgcgca

SEQ ID NO: 3525278 - RNA, 14 nt, Pseudomonas aeruginosa PA01
ccggcuggccaucc

SEQ ID NO: 3525279 - RNA, 17 nt, Pseudomonas aeruginosa PA01
ccggcuggcccuccauc

SEQ ID NO: 3525280 - RNA, 14 nt, Pseudomonas aeruginosa PA01
ccggcuggccgcga

SEQ ID NO: 3525281 - RNA, 14 nt, Pseudomonas aeruginosa PA01
ccggcuggcgccgg

SEQ ID NO: 3525282 - RNA, 16 nt, Pseudomonas aeruginosa PA01
ccggcuggcggcucgg

SEQ ID NO: 3525283 - RNA, 19 nt, Pseudomonas aeruginosa PA01
ccggcuggcggcucggcug

SEQ ID NO: 3525284 - RNA, 19 nt, Pseudomonas aeruginosa PA01
ccggcuggguucggcgagg

SEQ ID NO: 3525285 - RNA, 17 nt, Pseudomonas aeruginosa PA01
ccggcuggucagaacca

SEQ ID NO: 3525286 - RNA, 19 nt, Pseudomonas aeruginosa PA01
ccggcugguugccagcagc

SEQ ID NO: 3525287 - RNA, 20 nt, Pseudomonas aeruginosa PA01
ccggcugguugccagcagcg

SEQ ID NO: 3525288 - RNA, 22 nt, Pseudomonas aeruginosa PA01
ccggcugguugccagcagcgcu

SEQ ID NO: 3525289 - RNA, 14 nt, Pseudomonas aeruginosa PA01
ccggcugucgacgc

SEQ ID NO: 3525290 - RNA, 17 nt, Pseudomonas aeruginosa PA01
ccggcugugcagggcag

SEQ ID NO: 3525291 - RNA, 13 nt, Pseudomonas aeruginosa PA01
ccggcuucagcaa

SEQ ID NO: 3525292 - RNA, 13 nt, Pseudomonas aeruginosa PA01
ccggcuucggcgg

SEQ ID NO: 3525293 - RNA, 14 nt, Pseudomonas aeruginosa PA01
ccggcuucggcggc

SEQ ID NO: 3525294 - RNA, 15 nt, Pseudomonas aeruginosa PA01
ccggcuucuacgccu

SEQ ID NO: 3525295 - RNA, 21 nt, Pseudomonas aeruginosa PA01
ccggcuucuacgccuugcggc

SEQ ID NO: 3525296 - RNA, 17 nt, Pseudomonas aeruginosa PA01
ccggcuugaucgagccc

SEQ ID NO: 3525297 - RNA, 15 nt, Pseudomonas aeruginosa PA01
ccggcuugccgaugu

SEQ ID NO: 3525298 - RNA, 16 nt, Pseudomonas aeruginosa PA01
ccggcuugccgauguc

SEQ ID NO: 3525299 - RNA, 21 nt, Pseudomonas aeruginosa PA01
ccggcuugccgaugucgccgg

SEQ ID NO: 3525300 - RNA, 19 nt, Pseudomonas aeruginosa PA01
ccggcuugccggcagcgac

SEQ ID NO: 3525301 - RNA, 15 nt, Pseudomonas aeruginosa PA01
ccggcuugccgucgg

SEQ ID NO: 3525302 - RNA, 17 nt, Pseudomonas aeruginosa PA01
ccggcuugccgucggug

SEQ ID NO: 3525303 - RNA, 22 nt, Pseudomonas aeruginosa PA01
ccggcuuggcgggcucgcccau

SEQ ID NO: 3525304 - RNA, 13 nt, Pseudomonas aeruginosa PA01
ccggcuuggucac

SEQ ID NO: 3525305 - RNA, 19 nt, Pseudomonas aeruginosa PA01
ccggcuugguucgcgcgcu

SEQ ID NO: 3525306 - RNA, 15 nt, Pseudomonas aeruginosa PA01
ccggcuuguugcgcu

SEQ ID NO: 3525307 - RNA, 20 nt, Pseudomonas aeruginosa PA01
ccggcuuuccucggccaugc

SEQ ID NO: 3525308 - RNA, 21 nt, Pseudomonas aeruginosa PA01
ccggcuuuuuucgcccgugcc

SEQ ID NO: 3525309 - RNA, 22 nt, Pseudomonas aeruginosa PA01
ccggcuuuuuucgcccgugccg

SEQ ID NO: 3525310 - RNA, 23 nt, Pseudomonas aeruginosa PA01
ccggcuuuuuucgcccgugccga

SEQ ID NO: 3525311 - RNA, 18 nt, Pseudomonas aeruginosa PA01
ccgggaaaauggaacagu

SEQ ID NO: 3525312 - RNA, 19 nt, Pseudomonas aeruginosa PA01
ccgggaaacagggcgacgc

SEQ ID NO: 3525313 - RNA, 21 nt, Pseudomonas aeruginosa PA01
ccgggaaacagggcgacgccg

SEQ ID NO: 3525314 - RNA, 20 nt, Pseudomonas aeruginosa PA01
ccgggaaaccaccaggaagg

SEQ ID NO: 3525315 - RNA, 20 nt, Pseudomonas aeruginosa PA01
ccgggaaagucugugaucag

SEQ ID NO: 3525316 - RNA, 12 nt, Pseudomonas aeruginosa PA01
ccgggcggcggg

SEQ ID NO: 3525317 - RNA, 15 nt, Pseudomonas aeruginosa PA01
ccgggcggcgggcgc

SEQ ID NO: 3525318 - RNA, 16 nt, Pseudomonas aeruginosa PA01
ccgggcggcgggcgca

SEQ ID NO: 3525319 - RNA, 16 nt, Pseudomonas aeruginosa PA01
ccgggcggcgucgcgg

SEQ ID NO: 3525320 - RNA, 19 nt, Pseudomonas aeruginosa PA01
ccgggcggcgucgcggaga

SEQ ID NO: 3525321 - RNA, 14 nt, Pseudomonas aeruginosa PA01
ccgggcgggucugg

SEQ ID NO: 3525322 - RNA, 20 nt, Pseudomonas aeruginosa PA01
ccgggcgggucuggcggaac

SEQ ID NO: 3525323 - RNA, 22 nt, Pseudomonas aeruginosa PA01
ccgggcgguacaggcgcaccug

SEQ ID NO: 3525324 - RNA, 13 nt, Pseudomonas aeruginosa PA01
ccgggcgugccag

SEQ ID NO: 3525325 - RNA, 15 nt, Pseudomonas aeruginosa PA01
ccgggcucacucccg

SEQ ID NO: 3525326 - RNA, 17 nt, Pseudomonas aeruginosa PA01
ccgggcucacucccguc

SEQ ID NO: 3525327 - RNA, 19 nt, Pseudomonas aeruginosa PA01
ccgggcucacucccgucca

SEQ ID NO: 3525328 - RNA, 15 nt, Pseudomonas aeruginosa PA01
ccgggcuccgccgcg

SEQ ID NO: 3525329 - RNA, 22 nt, Pseudomonas aeruginosa PA01
ccgggcuccggguugucgucgu

SEQ ID NO: 3525330 - RNA, 23 nt, Pseudomonas aeruginosa PA01
ccgggcugccgaacaggcguccc

SEQ ID NO: 3525331 - RNA, 18 nt, Pseudomonas aeruginosa PA01
ccgggcugcgcucggcgc

SEQ ID NO: 3525332 - RNA, 21 nt, Pseudomonas aeruginosa PA01
ccgggcugcgcucggcgcucg

SEQ ID NO: 3525333 - RNA, 21 nt, Pseudomonas aeruginosa PA01
ccgggcuggccaccgccagga

SEQ ID NO: 3525334 - RNA, 22 nt, Pseudomonas aeruginosa PA01
ccgggcuggucguagcagcgga

SEQ ID NO: 3525335 - RNA, 18 nt, Pseudomonas aeruginosa PA01
ccgggcugguucagcggg

SEQ ID NO: 3525336 - RNA, 19 nt, Pseudomonas aeruginosa PA01
ccgggcugguucagcgggu

SEQ ID NO: 3525337 - RNA, 17 nt, Pseudomonas aeruginosa PA01
ccgggcuguagugcucc

SEQ ID NO: 3525338 - RNA, 21 nt, Pseudomonas aeruginosa PA01
ccgggcuucgguguaucggcg

SEQ ID NO: 3525339 - RNA, 23 nt, Pseudomonas aeruginosa PA01
ccgggcuucgguguaucggcgga

SEQ ID NO: 3525340 - RNA, 17 nt, Pseudomonas aeruginosa PA01
ccgggcuugcaauccgu

SEQ ID NO: 3525341 - RNA, 23 nt, Pseudomonas aeruginosa PA01
ccgggcuuuuucauggcuggccc

SEQ ID NO: 3525342 - RNA, 20 nt, Pseudomonas aeruginosa PA01
ccgggcuuuuucaugggcgc

SEQ ID NO: 3525343 - RNA, 22 nt, Pseudomonas aeruginosa PA01
ccgggcuuuuucaugggcgcgc

SEQ ID NO: 3525344 - RNA, 21 nt, Pseudomonas aeruginosa PA01
ccgggcuuuuucucgucgcgc

SEQ ID NO: 3525345 - RNA, 13 nt, Pseudomonas aeruginosa PA01
ccggggaacaggu

SEQ ID NO: 3525346 - RNA, 19 nt, Pseudomonas aeruginosa PA01
ccggggagggugccgugga

SEQ ID NO: 3525347 - RNA, 19 nt, Pseudomonas aeruginosa PA01
ccggggaguucgacccaug

SEQ ID NO: 3525348 - RNA, 16 nt, Pseudomonas aeruginosa PA01
ccggggaucagcgaga

SEQ ID NO: 3525349 - RNA, 14 nt, Pseudomonas aeruginosa PA01
ccggggaucagguc

SEQ ID NO: 3525350 - RNA, 13 nt, Pseudomonas aeruginosa PA01
ccggggcagcagg

SEQ ID NO: 3525351 - RNA, 14 nt, Pseudomonas aeruginosa PA01
ccggggcagcaggg

SEQ ID NO: 3525352 - RNA, 13 nt, Pseudomonas aeruginosa PA01
ccggggcccggca

SEQ ID NO: 3525353 - RNA, 15 nt, Pseudomonas aeruginosa PA01
ccggggcccggcagg

SEQ ID NO: 3525354 - RNA, 17 nt, Pseudomonas aeruginosa PA01
ccggggcccggcaggca

SEQ ID NO: 3525355 - RNA, 12 nt, Pseudomonas aeruginosa PA01
ccggggccguuc

SEQ ID NO: 3525356 - RNA, 17 nt, Pseudomonas aeruginosa PA01
ccggggccuacugcugg

SEQ ID NO: 3525357 - RNA, 18 nt, Pseudomonas aeruginosa PA01
ccggggccuucaggcgcu

SEQ ID NO: 3525358 - RNA, 20 nt, Pseudomonas aeruginosa PA01
ccggggcgaucuugaucgcc

SEQ ID NO: 3525359 - RNA, 21 nt, Pseudomonas aeruginosa PA01
ccggggcgaucuugaucgcca

SEQ ID NO: 3525360 - RNA, 18 nt, Pseudomonas aeruginosa PA01
ccggggcgcaggucgcug

SEQ ID NO: 3525361 - RNA, 19 nt, Pseudomonas aeruginosa PA01
ccggggcgcaggucgcugg

SEQ ID NO: 3525362 - RNA, 12 nt, Pseudomonas aeruginosa PA01
ccggggcgcgcc

SEQ ID NO: 3525363 - RNA, 13 nt, Pseudomonas aeruginosa PA01
ccggggcgcgccc

SEQ ID NO: 3525364 - RNA, 19 nt, Pseudomonas aeruginosa PA01
ccggggcgcgcccgccagg

SEQ ID NO: 3525365 - RNA, 16 nt, Pseudomonas aeruginosa PA01
ccggggcgcgggcgaa

SEQ ID NO: 3525366 - RNA, 21 nt, Pseudomonas aeruginosa PA01
ccggggcggauucaggcgcgc

SEQ ID NO: 3525367 - RNA, 22 nt, Pseudomonas aeruginosa PA01
ccggggcggauucaggcgcgcu

SEQ ID NO: 3525368 - RNA, 24 nt, Pseudomonas aeruginosa PA01
ccggggcggauucaggcgcgcucg

SEQ ID NO: 3525369 - RNA, 22 nt, Pseudomonas aeruginosa PA01
ccggggcggccaaccucucccc

SEQ ID NO: 3525370 - RNA, 13 nt, Pseudomonas aeruginosa PA01
ccggggcgggccg

SEQ ID NO: 3525371 - RNA, 13 nt, Pseudomonas aeruginosa PA01
ccggggcguaggg

SEQ ID NO: 3525372 - RNA, 16 nt, Pseudomonas aeruginosa PA01
ccggggcgugcaggcc

SEQ ID NO: 3525373 - RNA, 18 nt, Pseudomonas aeruginosa PA01
ccggggcgugcaggccgc

SEQ ID NO: 3525374 - RNA, 19 nt, Pseudomonas aeruginosa PA01
ccggggcgugcaggccgcc

SEQ ID NO: 3525375 - RNA, 20 nt, Pseudomonas aeruginosa PA01
ccggggcugagcgcauugac

SEQ ID NO: 3525376 - RNA, 20 nt, Pseudomonas aeruginosa PA01
ccgggggaagaacccagaca

SEQ ID NO: 3525377 - RNA, 15 nt, Pseudomonas aeruginosa PA01
ccgggggcggcgaac

SEQ ID NO: 3525378 - RNA, 16 nt, Pseudomonas aeruginosa PA01
ccgggggcggcgaacg

SEQ ID NO: 3525379 - RNA, 13 nt, Pseudomonas aeruginosa PA01
ccgggggcggcgc

SEQ ID NO: 3525380 - RNA, 15 nt, Pseudomonas aeruginosa PA01
ccgggggcggcgccu

SEQ ID NO: 3525381 - RNA, 17 nt, Pseudomonas aeruginosa PA01
ccgggggcggcgccugg

SEQ ID NO: 3525382 - RNA, 15 nt, Pseudomonas aeruginosa PA01
ccgggggucgcggcg

SEQ ID NO: 3525383 - RNA, 16 nt, Pseudomonas aeruginosa PA01
ccgggggucgcggcga

SEQ ID NO: 3525384 - RNA, 15 nt, Pseudomonas aeruginosa PA01
ccggggucagcgccu

SEQ ID NO: 3525385 - RNA, 16 nt, Pseudomonas aeruginosa PA01
ccggggucaggccgag

SEQ ID NO: 3525386 - RNA, 14 nt, Pseudomonas aeruginosa PA01
ccgggguccgccgg

SEQ ID NO: 3525387 - RNA, 18 nt, Pseudomonas aeruginosa PA01
ccgggguugcccagcagg

SEQ ID NO: 3525388 - RNA, 13 nt, Pseudomonas aeruginosa PA01
ccgggguuggcgc

SEQ ID NO: 3525389 - RNA, 16 nt, Pseudomonas aeruginosa PA01
ccgggguuggcgcuga

SEQ ID NO: 3525390 - RNA, 22 nt, Pseudomonas aeruginosa PA01
ccgggguuuucuuuuugcgcca

SEQ ID NO: 3525391 - RNA, 14 nt, Pseudomonas aeruginosa PA01
ccggguacagcgcc

SEQ ID NO: 3525392 - RNA, 14 nt, Pseudomonas aeruginosa PA01
ccggguaccugcuc

SEQ ID NO: 3525393 - RNA, 15 nt, Pseudomonas aeruginosa PA01
ccggguaccugcucg

SEQ ID NO: 3525394 - RNA, 18 nt, Pseudomonas aeruginosa PA01
ccggguaccugcucgcgg

SEQ ID NO: 3525395 - RNA, 19 nt, Pseudomonas aeruginosa PA01
ccggguacuggcgcugcgc

SEQ ID NO: 3525396 - RNA, 16 nt, Pseudomonas aeruginosa PA01
ccggguauccagcacc

SEQ ID NO: 3525397 - RNA, 13 nt, Pseudomonas aeruginosa PA01
ccgggucacgguc

SEQ ID NO: 3525398 - RNA, 13 nt, Pseudomonas aeruginosa PA01
ccgggucaggccg

SEQ ID NO: 3525399 - RNA, 14 nt, Pseudomonas aeruginosa PA01
ccgggucaggccga

SEQ ID NO: 3525400 - RNA, 18 nt, Pseudomonas aeruginosa PA01
ccgggucaucaccggcag

SEQ ID NO: 3525401 - RNA, 15 nt, Pseudomonas aeruginosa PA01
ccgggucaugccgcc

SEQ ID NO: 3525402 - RNA, 14 nt, Pseudomonas aeruginosa PA01
ccgggucauuggcg

SEQ ID NO: 3525403 - RNA, 18 nt, Pseudomonas aeruginosa PA01
ccggguccagcggccgcg

SEQ ID NO: 3525404 - RNA, 19 nt, Pseudomonas aeruginosa PA01
ccggguccagcggccgcgc

SEQ ID NO: 3525405 - RNA, 15 nt, Pseudomonas aeruginosa PA01
ccggguccugcagau

SEQ ID NO: 3525406 - RNA, 21 nt, Pseudomonas aeruginosa PA01
ccggguccugcagauaaagcu

SEQ ID NO: 3525407 - RNA, 23 nt, Pseudomonas aeruginosa PA01
ccgggucgacaugcaggccggcc

SEQ ID NO: 3525408 - RNA, 21 nt, Pseudomonas aeruginosa PA01
ccgggucgacuucgcaccagc

SEQ ID NO: 3525409 - RNA, 22 nt, Pseudomonas aeruginosa PA01
ccgggucgacuucgcaccagcc

SEQ ID NO: 3525410 - RNA, 18 nt, Pseudomonas aeruginosa PA01
ccgggucgaggcugccga

SEQ ID NO: 3525411 - RNA, 13 nt, Pseudomonas aeruginosa PA01
ccgggucgagguc

SEQ ID NO: 3525412 - RNA, 16 nt, Pseudomonas aeruginosa PA01
ccgggucgaugggccg

SEQ ID NO: 3525413 - RNA, 16 nt, Pseudomonas aeruginosa PA01
ccgggucgccgcagcc

SEQ ID NO: 3525414 - RNA, 14 nt, Pseudomonas aeruginosa PA01
ccgggucgcgcagc

SEQ ID NO: 3525415 - RNA, 15 nt, Pseudomonas aeruginosa PA01
ccgggucgcgcagcg

SEQ ID NO: 3525416 - RNA, 20 nt, Pseudomonas aeruginosa PA01
ccgggucgcugcccaucgcc

SEQ ID NO: 3525417 - RNA, 17 nt, Pseudomonas aeruginosa PA01
ccgggucgcugcucagg

SEQ ID NO: 3525418 - RNA, 13 nt, Pseudomonas aeruginosa PA01
ccgggucggaugc

SEQ ID NO: 3525419 - RNA, 18 nt, Pseudomonas aeruginosa PA01
ccggucggacuccgccca

SEQ ID NO: 3525420 - RNA, 19 nt, Pseudomonas aeruginosa PA01
ccggucggacuccgcccag

SEQ ID NO: 3525421 - RNA, 21 nt, Pseudomonas aeruginosa PA01
ccggucggccuugaggcgggc

SEQ ID NO: 3525422 - RNA, 20 nt, Pseudomonas aeruginosa PA01
ccggucgggaugccgugccg

SEQ ID NO: 3525423 - RNA, 12 nt, Pseudomonas aeruginosa PA01
ccggucgggcac

SEQ ID NO: 3525424 - RNA, 15 nt, Pseudomonas aeruginosa PA01
ccggucuagccgggc

SEQ ID NO: 3525425 - RNA, 13 nt, Pseudomonas aeruginosa PA01
ccggucuagcgcc

SEQ ID NO: 3525426 - RNA, 22 nt, Pseudomonas aeruginosa PA01
ccggucuagcgccccggccgcg

SEQ ID NO: 3525427 - RNA, 14 nt, Pseudomonas aeruginosa PA01
ccggucucagccgg

SEQ ID NO: 3525428 - RNA, 19 nt, Pseudomonas aeruginosa PA01
ccggucucgcgcagcggcg

SEQ ID NO: 3525429 - RNA, 15 nt, Pseudomonas aeruginosa PA01
ccggucucggcgaug

SEQ ID NO: 3525430 - RNA, 14 nt, Pseudomonas aeruginosa PA01
ccggucugcugcgc

SEQ ID NO: 3525431 - RNA, 16 nt, Pseudomonas aeruginosa PA01
ccggucugcugcgcgc

SEQ ID NO: 3525432 - RNA, 19 nt, Pseudomonas aeruginosa PA01
ccggucugguagcgaaucu

SEQ ID NO: 3525433 - RNA, 10 nt, Pseudomonas aeruginosa PA01
ccggucuugc

SEQ ID NO: 3525434 - RNA, 13 nt, Pseudomonas aeruginosa PA01
ccggucuugccgg

SEQ ID NO: 3525435 - RNA, 22 nt, Pseudomonas aeruginosa PA01
ccggugaacagguagcuggaaa

SEQ ID NO: 3525436 - RNA, 16 nt, Pseudomonas aeruginosa PA01
ccggugaaccugacca

SEQ ID NO: 3525437 - RNA, 20 nt, Pseudomonas aeruginosa PA01
ccggugacauucgacagcag

SEQ ID NO: 3525438 - RNA, 21 nt, Pseudomonas aeruginosa PA01
ccggugacauucgacagcagg

SEQ ID NO: 3525439 - RNA, 20 nt, Pseudomonas aeruginosa PA01
ccggugacccacuccggcag

SEQ ID NO: 3525440 - RNA, 14 nt, Pseudomonas aeruginosa PA01
ccggugacgaaacc

SEQ ID NO: 3525441 - RNA, 19 nt, Pseudomonas aeruginosa PA01
ccggugacgaaaccggcgu

SEQ ID NO: 3525442 - RNA, 21 nt, Pseudomonas aeruginosa PA01
ccggugacgaaaccggcgucc

SEQ ID NO: 3525443 - RNA, 22 nt, Pseudomonas aeruginosa PA01
ccggugacgcugcucaccaggu

SEQ ID NO: 3525444 - RNA, 15 nt, Pseudomonas aeruginosa PA01
ccggugacgucgagg

SEQ ID NO: 3525445 - RNA, 19 nt, Pseudomonas aeruginosa PA01
ccggugaggcgcagcagcg

SEQ ID NO: 3525446 - RNA, 17 nt, Pseudomonas aeruginosa PA01
ccggugaucgagccgcc

SEQ ID NO: 3525447 - RNA, 20 nt, Pseudomonas aeruginosa PA01
ccggugaucucgcggcgcgg

SEQ ID NO: 3525448 - RNA, 19 nt, Pseudomonas aeruginosa PA01
ccggugaugucggcgcugu

SEQ ID NO: 3525449 - RNA, 16 nt, Pseudomonas aeruginosa PA01
ccggugcaccaggcga

SEQ ID NO: 3525450 - RNA, 21 nt, Pseudomonas aeruginosa PA01
ccggugcagaagacgcccagc

SEQ ID NO: 3525451 - RNA, 22 nt, Pseudomonas aeruginosa PA01
ccggugcagaagacgcccagca

SEQ ID NO: 3525452 - RNA, 20 nt, Pseudomonas aeruginosa PA01
ccggugcaugaaggcgcuga

SEQ ID NO: 3525453 - RNA, 23 nt, Pseudomonas aeruginosa PA01
ccggugcaugaaggcgcugagcg

SEQ ID NO: 3525454 - RNA, 20 nt, Pseudomonas aeruginosa PA01
ccggugccaggaccagcccg

SEQ ID NO: 3525455 - RNA, 14 nt, Pseudomonas aeruginosa PA01
ccggugccagggcg

SEQ ID NO: 3525456 - RNA, 15 nt, Pseudomonas aeruginosa PA01
ccggugccagggcgg

SEQ ID NO: 3525457 - RNA, 21 nt, Pseudomonas aeruginosa PA01
ccggugccagggcggucggcc

SEQ ID NO: 3525458 - RNA, 18 nt, Pseudomonas aeruginosa PA01
ccggugccauacagcgcc

SEQ ID NO: 3525459 - RNA, 15 nt, Pseudomonas aeruginosa PA01
ccggugccccgcugg

SEQ ID NO: 3525460 - RNA, 18 nt, Pseudomonas aeruginosa PA01
ccggugccccgcuggccc

SEQ ID NO: 3525461 - RNA, 12 nt, Pseudomonas aeruginosa PA01
ccggugccgccg

SEQ ID NO: 3525462 - RNA, 13 nt, Pseudomonas aeruginosa PA01
ccggugccgccgg

SEQ ID NO: 3525463 - RNA, 17 nt, Pseudomonas aeruginosa PA01
ccggugccgccggccac

SEQ ID NO: 3525464 - RNA, 20 nt, Pseudomonas aeruginosa PA01
ccggugccgccggccaccag

SEQ ID NO: 3525465 - RNA, 15 nt, Pseudomonas aeruginosa PA01
ccggugccggcggcg

SEQ ID NO: 3525466 - RNA, 19 nt, Pseudomonas aeruginosa PA01
ccggugccgggaagcgcag

SEQ ID NO: 3525467 - RNA, 17 nt, Pseudomonas aeruginosa PA01
ccggugccuucggcggc

SEQ ID NO: 3525468 - RNA, 18 nt, Pseudomonas aeruginosa PA01
ccggugccuucggcggcg

SEQ ID NO: 3525469 - RNA, 13 nt, Pseudomonas aeruginosa PA01
ccggugcgaaccg

SEQ ID NO: 3525470 - RNA, 16 nt, Pseudomonas aeruginosa PA01
ccggugcgaaccggcc

SEQ ID NO: 3525471 - RNA, 20 nt, Pseudomonas aeruginosa PA01
ccggugcggguggucgccgc

SEQ ID NO: 3525472 - RNA, 20 nt, Pseudomonas aeruginosa PA01
ccggugcggucguugaucac

SEQ ID NO: 3525473 - RNA, 15 nt, Pseudomonas aeruginosa PA01
ccggugcuggcgagc

SEQ ID NO: 3525474 - RNA, 18 nt, Pseudomonas aeruginosa PA01
ccggugcuggugcggccg

SEQ ID NO: 3525475 - RNA, 21 nt, Pseudomonas aeruginosa PA01
ccgguggacugguugaccugc

SEQ ID NO: 3525476 - RNA, 13 nt, Pseudomonas aeruginosa PA01
ccgguggccagga

SEQ ID NO: 3525477 - RNA, 23 nt, Pseudomonas aeruginosa PA01
ccgguggccaggacgcuggcgau

SEQ ID NO: 3525478 - RNA, 22 nt, Pseudomonas aeruginosa PA01
ccgguggccuccugcaacgccu

SEQ ID NO: 3525479 - RNA, 23 nt, Pseudomonas aeruginosa PA01
ccgguggccuccugcaacgccug

SEQ ID NO: 3525480 - RNA, 13 nt, Pseudomonas aeruginosa PA01
ccgguggcgacgc

SEQ ID NO: 3525481 - RNA, 17 nt, Pseudomonas aeruginosa PA01
ccgguggcgacgcgcag

SEQ ID NO: 3525482 - RNA, 13 nt, Pseudomonas aeruginosa PA01
ccgguggcgccca

SEQ ID NO: 3525483 - RNA, 17 nt, Pseudomonas aeruginosa PA01
ccgguggcgcccagcca

SEQ ID NO: 3525484 - RNA, 18 nt, Pseudomonas aeruginosa PA01
ccgguggcgcccagccag

SEQ ID NO: 3525485 - RNA, 12 nt, Pseudomonas aeruginosa PA01
ccgguggcguac

SEQ ID NO: 3525486 - RNA, 18 nt, Pseudomonas aeruginosa PA01
ccgguggcguuauccgcc

SEQ ID NO: 3525487 - RNA, 21 nt, Pseudomonas aeruginosa PA01
ccgguggcguuauccgcccca

SEQ ID NO: 3525488 - RNA, 17 nt, Pseudomonas aeruginosa PA01
ccggugggacugagccg

SEQ ID NO: 3525489 - RNA, 18 nt, Pseudomonas aeruginosa PA01
ccggugggacugagccgc

SEQ ID NO: 3525490 - RNA, 21 nt, Pseudomonas aeruginosa PA01
ccggugggacugagccgcugg

SEQ ID NO: 3525491 - RNA, 17 nt, Pseudomonas aeruginosa PA01
ccggugggcuuucccug

SEQ ID NO: 3525492 - RNA, 16 nt, Pseudomonas aeruginosa PA01
ccgguggucuucagca

SEQ ID NO: 3525493 - RNA, 17 nt, Pseudomonas aeruginosa PA01
ccggugucaggccgagg

SEQ ID NO: 3525494 - RNA, 16 nt, Pseudomonas aeruginosa PA01
ccggugucgacgacga

SEQ ID NO: 3525495 - RNA, 14 nt, Pseudomonas aeruginosa PA01
ccggugugacggcc

SEQ ID NO: 3525496 - RNA, 14 nt, Pseudomonas aeruginosa PA01
ccggugugcgcugc

SEQ ID NO: 3525497 - RNA, 22 nt, Pseudomonas aeruginosa PA01
ccggugugcgcugcaucggcgc

SEQ ID NO: 3525498 - RNA, 23 nt, Pseudomonas aeruginosa PA01
ccgguuaccggcgaccaccgccg

SEQ ID NO: 3525499 - RNA, 16 nt, Pseudomonas aeruginosa PA01
ccgguuacucgccggc

SEQ ID NO: 3525500 - RNA, 17 nt, Pseudomonas aeruginosa PA01
ccgguuacucgccggca

SEQ ID NO: 3525501 - RNA, 21 nt, Pseudomonas aeruginosa PA01
ccgguuaucgaggcgucggcg

SEQ ID NO: 3525502 - RNA, 13 nt, Pseudomonas aeruginosa PA01
ccgguuccagcgg

SEQ ID NO: 3525503 - RNA, 16 nt, Pseudomonas aeruginosa PA01
ccgguuccagcggccg

SEQ ID NO: 3525504 - RNA, 18 nt, Pseudomonas aeruginosa PA01
ccgguuccagcggccgcg

SEQ ID NO: 3525505 - RNA, 15 nt, Pseudomonas aeruginosa PA01
ccgguucccgcagcg

SEQ ID NO: 3525506 - RNA, 16 nt, Pseudomonas aeruginosa PA01
ccgguuccgcgucgcc

SEQ ID NO: 3525507 - RNA, 17 nt, Pseudomonas aeruginosa PA01
ccgguuccgcgucgccu

SEQ ID NO: 3525508 - RNA, 20 nt, Pseudomonas aeruginosa PA01
ccgguuccgcgucgccuucg

SEQ ID NO: 3525509 - RNA, 23 nt, Pseudomonas aeruginosa PA01
ccgguucgacacgcucagccccg

SEQ ID NO: 3525510 - RNA, 18 nt, Pseudomonas aeruginosa PA01
ccgguucgcaggccaggc

SEQ ID NO: 3525511 - RNA, 15 nt, Pseudomonas aeruginosa PA01
ccgguucguugaccg

SEQ ID NO: 3525512 - RNA, 16 nt, Pseudomonas aeruginosa PA01
ccgguucucgccccag

SEQ ID NO: 3525513 - RNA, 17 nt, Pseudomonas aeruginosa PA01
ccgguucucgccccagc

SEQ ID NO: 3525514 - RNA, 15 nt, Pseudomonas aeruginosa PA01
ccgguugaccccgcg

SEQ ID NO: 3525515 - RNA, 19 nt, Pseudomonas aeruginosa PA01
ccgguugagauccuggccg

SEQ ID NO: 3525516 - RNA, 21 nt, Pseudomonas aeruginosa PA01
ccgguugagauccuggccggc

SEQ ID NO: 3525517 - RNA, 22 nt, Pseudomonas aeruginosa PA01
ccgguugagauccuggccggcg

SEQ ID NO: 3525518 - RNA, 20 nt, Pseudomonas aeruginosa PA01
ccgguugauuuccgcaccga

SEQ ID NO: 3525519 - RNA, 21 nt, Pseudomonas aeruginosa PA01
ccgguugauuuccgcaccgag

SEQ ID NO: 3525520 - RNA, 12 nt, Pseudomonas aeruginosa PA01
ccgguugcagcc

SEQ ID NO: 3525521 - RNA, 15 nt, Pseudomonas aeruginosa PA01
ccguccgccaggucc

SEQ ID NO: 3525522 - RNA, 18 nt, Pseudomonas aeruginosa PA01
ccguccgccagguccagg

SEQ ID NO: 3525523 - RNA, 16 nt, Pseudomonas aeruginosa PA01
ccguccgcccaguucg

SEQ ID NO: 3525524 - RNA, 21 nt, Pseudomonas aeruginosa PA01
ccguccgcgaugcguuccagg

SEQ ID NO: 3525525 - RNA, 12 nt, Pseudomonas aeruginosa PA01
ccguccgcugcg

SEQ ID NO: 3525526 - RNA, 14 nt, Pseudomonas aeruginosa PA01
ccguccgcugcgcc

SEQ ID NO: 3525527 - RNA, 15 nt, Pseudomonas aeruginosa PA01
ccguccgggcacgca

SEQ ID NO: 3525528 - RNA, 23 nt, Pseudomonas aeruginosa PA01
ccguccgggcacgcauagcgcgc

SEQ ID NO: 3525529 - RNA, 22 nt, Pseudomonas aeruginosa PA01
ccguccgucccacaggccggcu

SEQ ID NO: 3525530 - RNA, 23 nt, Pseudomonas aeruginosa PA01
ccguccgucggcaguggugaucc

SEQ ID NO: 3525531 - RNA, 17 nt, Pseudomonas aeruginosa PA01
ccguccuacgcgaccgg

SEQ ID NO: 3525532 - RNA, 19 nt, Pseudomonas aeruginosa PA01
ccguccuacgcgaccgguc

SEQ ID NO: 3525533 - RNA, 19 nt, Pseudomonas aeruginosa PA01
ccguccucgucgaggucga

SEQ ID NO: 3525534 - RNA, 21 nt, Pseudomonas aeruginosa PA01
ccguccucgucgaggucgagg

SEQ ID NO: 3525535 - RNA, 15 nt, Pseudomonas aeruginosa PA01
ccguccugcggccgc

SEQ ID NO: 3525536 - RNA, 16 nt, Pseudomonas aeruginosa PA01
ccguccugcggccgca

SEQ ID NO: 3525537 - RNA, 14 nt, Pseudomonas aeruginosa PA01
ccguccuggcgggg

SEQ ID NO: 3525538 - RNA, 15 nt, Pseudomonas aeruginosa PA01
ccguccuucggccgc

SEQ ID NO: 3525539 - RNA, 21 nt, Pseudomonas aeruginosa PA01
ccguccuucggccgcaccagg

SEQ ID NO: 3525540 - RNA, 16 nt, Pseudomonas aeruginosa PA01
ccgucgaacagcagcu

SEQ ID NO: 3525541 - RNA, 22 nt, Pseudomonas aeruginosa PA01
ccgucgaacagcagcucgccgc

SEQ ID NO: 3525542 - RNA, 18 nt, Pseudomonas aeruginosa PA01
ccgucgaaccagccgcgu

SEQ ID NO: 3525543 - RNA, 17 nt, Pseudomonas aeruginosa PA01
ccgucgaaccagggacg

SEQ ID NO: 3525544 - RNA, 22 nt, Pseudomonas aeruginosa PA01
ccgucgaaccagggacgcccgg

SEQ ID NO: 3525545 - RNA, 19 nt, Pseudomonas aeruginosa PA01
ccgucgaagaucaccgggg

SEQ ID NO: 3525546 - RNA, 20 nt, Pseudomonas aeruginosa PA01
ccgucgaagccaggcaccgg

SEQ ID NO: 3525547 - RNA, 17 nt, Pseudomonas aeruginosa PA01
ccgucgaaguggacgaa

SEQ ID NO: 3525548 - RNA, 19 nt, Pseudomonas aeruginosa PA01
ccgucgaauuggacagcag

SEQ ID NO: 3525549 - RNA, 21 nt, Pseudomonas aeruginosa PA01
ccgucgaauuggacagcaggc

SEQ ID NO: 3525550 - RNA, 22 nt, Pseudomonas aeruginosa PA01
ccgucgaauuggacagcaggcu

SEQ ID NO: 3525551 - RNA, 21 nt, Pseudomonas aeruginosa PA01
ccgucgaccaucaccagcgcc

SEQ ID NO: 3525552 - RNA, 23 nt, Pseudomonas aeruginosa PA01
ccgucgaccaucaccagcgccgu

SEQ ID NO: 3525553 - RNA, 13 nt, Pseudomonas aeruginosa PA01
ccgucgacccgcc

SEQ ID NO: 3525554 - RNA, 18 nt, Pseudomonas aeruginosa PA01
ccgucgaccugcggggcg

SEQ ID NO: 3525555 - RNA, 15 nt, Pseudomonas aeruginosa PA01
ccgucgacgcccugg

SEQ ID NO: 3525556 - RNA, 11 nt, Pseudomonas aeruginosa PA01
ccgucgagcac

SEQ ID NO: 3525557 - RNA, 14 nt, Pseudomonas aeruginosa PA01
ccgucgagcaccag

SEQ ID NO: 3525558 - RNA, 15 nt, Pseudomonas aeruginosa PA01
ccgucgagcaccagc

SEQ ID NO: 3525559 - RNA, 16 nt, Pseudomonas aeruginosa PA01
ccgucgagccagccca

SEQ ID NO: 3525560 - RNA, 23 nt, Pseudomonas aeruginosa PA01
ccgucgagggcaaaggcgcgcag

SEQ ID NO: 3525561 - RNA, 16 nt, Pseudomonas aeruginosa PA01
ccgucgaggucggcga

SEQ ID NO: 3525562 - RNA, 23 nt, Pseudomonas aeruginosa PA01
ccgucgaucagguaggccggcgu

SEQ ID NO: 3525563 - RNA, 17 nt, Pseudomonas aeruginosa PA01
ccgucgaucuugcaauc

SEQ ID NO: 3525564 - RNA, 19 nt, Pseudomonas aeruginosa PA01
ccgucgcacucuuccuggg

SEQ ID NO: 3525565 - RNA, 22 nt, Pseudomonas aeruginosa PA01
ccgucgccauucggcgacgggc

SEQ ID NO: 3525566 - RNA, 12 nt, Pseudomonas aeruginosa PA01
ccgucgcccugg

SEQ ID NO: 3525567 - RNA, 19 nt, Pseudomonas aeruginosa PA01
ccgucgcccuggugcacgg

SEQ ID NO: 3525568 - RNA, 22 nt, Pseudomonas aeruginosa PA01
ccgucgccgcugaugcgcuggu

SEQ ID NO: 3525569 - RNA, 21 nt, Pseudomonas aeruginosa PA01
ccgucgcgaagaccggccggc

SEQ ID NO: 3525570 - RNA, 23 nt, Pseudomonas aeruginosa PA01
ccgucgcgaagaccggccggcuc

SEQ ID NO: 3525571 - RNA, 20 nt, Pseudomonas aeruginosa PA01
ccgucgcgauagacgccggc

SEQ ID NO: 3525572 - RNA, 22 nt, Pseudomonas aeruginosa PA01
ccgucgcgauagacgccggcga

SEQ ID NO: 3525573 - RNA, 12 nt, Pseudomonas aeruginosa PA01
ccgucgcgcacc

SEQ ID NO: 3525574 - RNA, 13 nt, Pseudomonas aeruginosa PA01
ccgucgcgcacca

SEQ ID NO: 3525575 - RNA, 12 nt, Pseudomonas aeruginosa PA01
ccgucgcgccgg

SEQ ID NO: 3525576 - RNA, 13 nt, Pseudomonas aeruginosa PA01
ccgucgcgccggc

SEQ ID NO: 3525577 - RNA, 15 nt, Pseudomonas aeruginosa PA01
ccgucgcgccggcca

SEQ ID NO: 3525578 - RNA, 16 nt, Pseudomonas aeruginosa PA01
ccgucgcgccggccau

SEQ ID NO: 3525579 - RNA, 13 nt, Pseudomonas aeruginosa PA01
ccgucgcgcgccc

SEQ ID NO: 3525580 - RNA, 18 nt, Pseudomonas aeruginosa PA01
ccgucgcgcgccggagcc

SEQ ID NO: 3525581 - RNA, 21 nt, Pseudomonas aeruginosa PA01
ccgucgcggccaucggcgaag

SEQ ID NO: 3525582 - RNA, 19 nt, Pseudomonas aeruginosa PA01
ccgucgcuucgcccgccgc

SEQ ID NO: 3525583 - RNA, 22 nt, Pseudomonas aeruginosa PA01
ccgucgcuucgcccgccgccug

SEQ ID NO: 3525584 - RNA, 23 nt, Pseudomonas aeruginosa PA01
ccgucgcuucgcccgccgccugg

SEQ ID NO: 3525585 - RNA, 12 nt, Pseudomonas aeruginosa PA01
ccgucggauggc

SEQ ID NO: 3525586 - RNA, 18 nt, Pseudomonas aeruginosa PA01
ccgucggcaagcaggccg

SEQ ID NO: 3525587 - RNA, 14 nt, Pseudomonas aeruginosa PA01
ccgucggccggggu

SEQ ID NO: 3525588 - RNA, 21 nt, Pseudomonas aeruginosa PA01
ccgucggccggggucaggccg

SEQ ID NO: 3525589 - RNA, 22 nt, Pseudomonas aeruginosa PA01
ccgucggccggggucaggccga

SEQ ID NO: 3525590 - RNA, 23 nt, Pseudomonas aeruginosa PA01
ccgucggccggggucaggccgag

SEQ ID NO: 3525591 - RNA, 17 nt, Pseudomonas aeruginosa PA01
ccgucggccucgccgau

SEQ ID NO: 3525592 - RNA, 12 nt, Pseudomonas aeruginosa PA01
ccgucggccugc

SEQ ID NO: 3525593 - RNA, 13 nt, Pseudomonas aeruginosa PA01
ccgucggcgcggg

SEQ ID NO: 3525594 - RNA, 11 nt, Pseudomonas aeruginosa PA01
ccgucggcggu

SEQ ID NO: 3525595 - RNA, 18 nt, Pseudomonas aeruginosa PA01
ccgucggcggucagcuug

SEQ ID NO: 3525596 - RNA, 14 nt, Pseudomonas aeruginosa PA01
ccgucggcuccgcu

SEQ ID NO: 3525597 - RNA, 16 nt, Pseudomonas aeruginosa PA01
ccgucgggcaguuccg

SEQ ID NO: 3525598 - RNA, 16 nt, Pseudomonas aeruginosa PA01
ccgucgggcauggcga

SEQ ID NO: 3525599 - RNA, 16 nt, Pseudomonas aeruginosa PA01
ccgucgggcuucggug

SEQ ID NO: 3525600 - RNA, 13 nt, Pseudomonas aeruginosa PA01
ccgucggugaucg

SEQ ID NO: 3525601 - RNA, 16 nt, Pseudomonas aeruginosa PA01
ccgucguagcgcagcg

SEQ ID NO: 3525602 - RNA, 19 nt, Pseudomonas aeruginosa PA01
ccgucguagcgcagcggca

SEQ ID NO: 3525603 - RNA, 21 nt, Pseudomonas aeruginosa PA01
ccgucguagcgcagcggcagg

SEQ ID NO: 3525604 - RNA, 22 nt, Pseudomonas aeruginosa PA01
ccgucguagcgcagcggcaggc

SEQ ID NO: 3525605 - RNA, 17 nt, Pseudomonas aeruginosa PA01
ccgucgucaccucggcg

SEQ ID NO: 3525606 - RNA, 18 nt, Pseudomonas aeruginosa PA01
ccgucgucaccucggcgc

SEQ ID NO: 3525607 - RNA, 19 nt, Pseudomonas aeruginosa PA01
ccgucgucaccucggcgcc

SEQ ID NO: 3525608 - RNA, 20 nt, Pseudomonas aeruginosa PA01
ccgucgucaccucggcgcca

SEQ ID NO: 3525609 - RNA, 18 nt, Pseudomonas aeruginosa PA01
ccgucgucacggaacuga

SEQ ID NO: 3525610 - RNA, 20 nt, Pseudomonas aeruginosa PA01
ccgucguuuuguccggcggc

SEQ ID NO: 3525611 - RNA, 17 nt, Pseudomonas aeruginosa PA01
ccgucucaggcgccagg

SEQ ID NO: 3525612 - RNA, 19 nt, Pseudomonas aeruginosa PA01
ccgucucaggcgccaggcc

SEQ ID NO: 3525613 - RNA, 21 nt, Pseudomonas aeruginosa PA01
ccgucucaggcgccaggccuc

SEQ ID NO: 3525614 - RNA, 14 nt, Pseudomonas aeruginosa PA01
ccgucuccaggcgc

SEQ ID NO: 3525615 - RNA, 16 nt, Pseudomonas aeruginosa PA01
ccgucuccaggcgcgc

SEQ ID NO: 3525616 - RNA, 23 nt, Pseudomonas aeruginosa PA01
ccgucuccaggcgcgccgugcgg

SEQ ID NO: 3525617 - RNA, 16 nt, Pseudomonas aeruginosa PA01
ccgucucgucgagcga

SEQ ID NO: 3525618 - RNA, 23 nt, Pseudomonas aeruginosa PA01
ccgucucgucgagcgagggcguc

SEQ ID NO: 3525619 - RNA, 15 nt, Pseudomonas aeruginosa PA01
ccgucuguucggcca

SEQ ID NO: 3525620 - RNA, 17 nt, Pseudomonas aeruginosa PA01
ccgucuguucggccagg

SEQ ID NO: 3525621 - RNA, 17 nt, Pseudomonas aeruginosa PA01
ccgucuuauucgacgcu

SEQ ID NO: 3525622 - RNA, 16 nt, Pseudomonas aeruginosa PA01
ccgucuuccaccagaa

SEQ ID NO: 3525623 - RNA, 17 nt, Pseudomonas aeruginosa PA01
ccguggucagcaccagg

SEQ ID NO: 3525624 - RNA, 18 nt, Pseudomonas aeruginosa PA01
ccguggucauggcgcaga

SEQ ID NO: 3525625 - RNA, 18 nt, Pseudomonas aeruginosa PA01
ccgugguccgccagcagg

SEQ ID NO: 3525626 - RNA, 20 nt, Pseudomonas aeruginosa PA01
ccgugguccgccagcaggcg

SEQ ID NO: 3525627 - RNA, 15 nt, Pseudomonas aeruginosa PA01
ccguggucgccgcuc

SEQ ID NO: 3525628 - RNA, 16 nt, Pseudomonas aeruginosa PA01
ccguggugcccgggug

SEQ ID NO: 3525629 - RNA, 19 nt, Pseudomonas aeruginosa PA01
ccgugguggccguggcgcc

SEQ ID NO: 3525630 - RNA, 18 nt, Pseudomonas aeruginosa PA01
ccguguaaugacuccggu

SEQ ID NO: 3525631 - RNA, 19 nt, Pseudomonas aeruginosa PA01
ccguguaaugacuccgguc

SEQ ID NO: 3525632 - RNA, 19 nt, Pseudomonas aeruginosa PA01
ccguguaccacgcccgcgg

SEQ ID NO: 3525633 - RNA, 14 nt, Pseudomonas aeruginosa PA01
ccgugucgaagccu

SEQ ID NO: 3525634 - RNA, 13 nt, Pseudomonas aeruginosa PA01
ccgugucgagggc

SEQ ID NO: 3525635 - RNA, 15 nt, Pseudomonas aeruginosa PA01
ccgugucgagggcga

SEQ ID NO: 3525636 - RNA, 16 nt, Pseudomonas aeruginosa PA01
ccgugucgagggcgaa

SEQ ID NO: 3525637 - RNA, 19 nt, Pseudomonas aeruginosa PA01
ccgugucgagggcgaacag

SEQ ID NO: 3525638 - RNA, 12 nt, Pseudomonas aeruginosa PA01
ccgugucggcgg

SEQ ID NO: 3525639 - RNA, 13 nt, Pseudomonas aeruginosa PA01
ccgugucggcggc

SEQ ID NO: 3525640 - RNA, 13 nt, Pseudomonas aeruginosa PA01
ccgugugcagcag

SEQ ID NO: 3525641 - RNA, 18 nt, Pseudomonas aeruginosa PA01
ccguguucggccagccgg

SEQ ID NO: 3525642 - RNA, 20 nt, Pseudomonas aeruginosa PA01
ccguguucggccagccggcg

SEQ ID NO: 3525643 - RNA, 20 nt, Pseudomonas aeruginosa PA01
ccguguugaucgccgcgccg

SEQ ID NO: 3525644 - RNA, 23 nt, Pseudomonas aeruginosa PA01
ccguguugaucgccgcgccgccg

SEQ ID NO: 3525645 - RNA, 19 nt, Pseudomonas aeruginosa PA01
ccguuaccgcgggcucagg

SEQ ID NO: 3525646 - RNA, 16 nt, Pseudomonas aeruginosa PA01
ccguuaccuuggccac

SEQ ID NO: 3525647 - RNA, 16 nt, Pseudomonas aeruginosa PA01
ccguucaaagcccgcc

SEQ ID NO: 3525648 - RNA, 15 nt, Pseudomonas aeruginosa PA01
ccguucacgccuggc

SEQ ID NO: 3525649 - RNA, 17 nt, Pseudomonas aeruginosa PA01
ccguucacgccuggcgg

SEQ ID NO: 3525650 - RNA, 18 nt, Pseudomonas aeruginosa PA01
ccguucagcucccaggcg

SEQ ID NO: 3525651 - RNA, 24 nt, Pseudomonas aeruginosa PA01
ccguucagcucccaggcgucgccg

SEQ ID NO: 3525652 - RNA, 13 nt, Pseudomonas aeruginosa PA01
ccguucaggccgg

SEQ ID NO: 3525653 - RNA, 15 nt, Pseudomonas aeruginosa PA01
ccguucaggccggcg

SEQ ID NO: 3525654 - RNA, 16 nt, Pseudomonas aeruginosa PA01
ccguucaggccggcgc

SEQ ID NO: 3525655 - RNA, 20 nt, Pseudomonas aeruginosa PA01
ccguucaggccggcgccgcc

SEQ ID NO: 3525656 - RNA, 13 nt, Pseudomonas aeruginosa PA01
ccguucaggcgcg

SEQ ID NO: 3525657 - RNA, 14 nt, Pseudomonas aeruginosa PA01
ccguucaggcgcgg

SEQ ID NO: 3525658 - RNA, 18 nt, Pseudomonas aeruginosa PA01
ccguuccaccgccuggac

SEQ ID NO: 3525659 - RNA, 22 nt, Pseudomonas aeruginosa PA01
ccguuccaccgccuggaccagg

SEQ ID NO: 3525660 - RNA, 15 nt, Pseudomonas aeruginosa PA01
ccguuccagcggcac

SEQ ID NO: 3525661 - RNA, 15 nt, Pseudomonas aeruginosa PA01
ccguuccaggcgggg

SEQ ID NO: 3525662 - RNA, 14 nt, Pseudomonas aeruginosa PA01
ccguucccagcagc

SEQ ID NO: 3525663 - RNA, 23 nt, Pseudomonas aeruginosa PA01
ccguuccgacccggccgaccagg

SEQ ID NO: 3525664 - RNA, 15 nt, Pseudomonas aeruginosa PA01
ccguuccggcgcagc

SEQ ID NO: 3525665 - RNA, 22 nt, Pseudomonas aeruginosa PA01
ccguuccguucaaagcccgccu

SEQ ID NO: 3525666 - RNA, 14 nt, Pseudomonas aeruginosa PA01
ccguuccuccucgc

SEQ ID NO: 3525667 - RNA, 19 nt, Pseudomonas aeruginosa PA01
ccguuccuccucgccgccg

SEQ ID NO: 3525668 - RNA, 21 nt, Pseudomonas aeruginosa PA01
ccguucgaucaauugccggua

SEQ ID NO: 3525669 - RNA, 16 nt, Pseudomonas aeruginosa PA01
ccguucgcccgcggcg

SEQ ID NO: 3525670 - RNA, 11 nt, Pseudomonas aeruginosa PA01
ccguucgccgg

SEQ ID NO: 3525671 - RNA, 14 nt, Pseudomonas aeruginosa PA01
ccguucgccggccu

SEQ ID NO: 3525672 - RNA, 16 nt, Pseudomonas aeruginosa PA01
ccguucgccggccucc

SEQ ID NO: 3525673 - RNA, 16 nt, Pseudomonas aeruginosa PA01
ccguucggcgcccagg

SEQ ID NO: 3525674 - RNA, 17 nt, Pseudomonas aeruginosa PA01
ccguucggcgcccaggu

SEQ ID NO: 3525675 - RNA, 19 nt, Pseudomonas aeruginosa PA01
ccguucgucaccggcgcca

SEQ ID NO: 3525676 - RNA, 22 nt, Pseudomonas aeruginosa PA01
ccguucucauugcgccgccggc

SEQ ID NO: 3525677 - RNA, 14 nt, Pseudomonas aeruginosa PA01
ccguucuccagguc

SEQ ID NO: 3525678 - RNA, 14 nt, Pseudomonas aeruginosa PA01
ccguucucgaucaa

SEQ ID NO: 3525679 - RNA, 19 nt, Pseudomonas aeruginosa PA01
ccguucugcacaugcacca

SEQ ID NO: 3525680 - RNA, 23 nt, Pseudomonas aeruginosa PA01
ccguucugccgcagcgccucccg

SEQ ID NO: 3525681 - RNA, 21 nt, Pseudomonas aeruginosa PA01
ccguucugugcggcgaugucg

SEQ ID NO: 3525682 - RNA, 14 nt, Pseudomonas aeruginosa PA01
ccguucuugaucac

SEQ ID NO: 3525683 - RNA, 23 nt, Pseudomonas aeruginosa PA01
ccguucuugaucaccgcggugcg

SEQ ID NO: 3525684 - RNA, 20 nt, Pseudomonas aeruginosa PA01
ccguucuuguugagcuggcc

SEQ ID NO: 3525685 - RNA, 21 nt, Pseudomonas aeruginosa PA01
ccguucuuguugagcuggccg

SEQ ID NO: 3525686 - RNA, 21 nt, Pseudomonas aeruginosa PA01
ccguugaaacgcucggcgucg

SEQ ID NO: 3525687 - RNA, 17 nt, Pseudomonas aeruginosa PA01
ccguugaacucggcgcc

SEQ ID NO: 3525688 - RNA, 19 nt, Pseudomonas aeruginosa PA01
ccguugaacucggcgccca

SEQ ID NO: 3525689 - RNA, 20 nt, Pseudomonas aeruginosa PA01
ccguugaacucggcgcccag

SEQ ID NO: 3525690 - RNA, 23 nt, Pseudomonas aeruginosa PA01
ccguugaagcagacguagggcug

SEQ ID NO: 3525691 - RNA, 18 nt, Pseudomonas aeruginosa PA01
ccguugaccagcgcgucg

SEQ ID NO: 3525692 - RNA, 16 nt, Pseudomonas aeruginosa PA01
ccguugaccugguugc

SEQ ID NO: 3525693 - RNA, 21 nt, Pseudomonas aeruginosa PA01
ccguugagcaccucgaccugg

SEQ ID NO: 3525694 - RNA, 20 nt, Pseudomonas aeruginosa PA01
ccguugaggcguucgaucuc

SEQ ID NO: 3525695 - RNA, 15 nt, Pseudomonas aeruginosa PA01
ccguugcacgaaaac

SEQ ID NO: 3525696 - RNA, 18 nt, Pseudomonas aeruginosa PA01
ccguugcccucgcgcugg

SEQ ID NO: 3525697 - RNA, 19 nt, Pseudomonas aeruginosa PA01
ccguugcccucgcgcugga

SEQ ID NO: 3525698 - RNA, 24 nt, Pseudomonas aeruginosa PA01
ccguugccgaccgagcagcggacg

SEQ ID NO: 3525699 - RNA, 19 nt, Pseudomonas aeruginosa PA01
ccguugccuucgccgucga

SEQ ID NO: 3525700 - RNA, 13 nt, Pseudomonas aeruginosa PA01
ccguugcggcagc

SEQ ID NO: 3525701 - RNA, 14 nt, Pseudomonas aeruginosa PA01
ccguugcggcccuu

SEQ ID NO: 3525702 - RNA, 13 nt, Pseudomonas aeruginosa PA01
ccguuggccagca

SEQ ID NO: 3525703 - RNA, 18 nt, Pseudomonas aeruginosa PA01
ccguuggcgaacaaucgg

SEQ ID NO: 3525704 - RNA, 23 nt, Pseudomonas aeruginosa PA01
ccguuggcgaacuucaggccggc

SEQ ID NO: 3525705 - RNA, 19 nt, Pseudomonas aeruginosa PA01
ccguuggcgcgggcgaagg

SEQ ID NO: 3525706 - RNA, 16 nt, Pseudomonas aeruginosa PA01
ccguuggcgucgcgca

SEQ ID NO: 3525707 - RNA, 13 nt, Pseudomonas aeruginosa PA01
ccguugggccagg

SEQ ID NO: 3525708 - RNA, 15 nt, Pseudomonas aeruginosa PA01
ccguuggucaacggc

SEQ ID NO: 3525709 - RNA, 18 nt, Pseudomonas aeruginosa PA01
ccguuguagaucggcagc

SEQ ID NO: 3525710 - RNA, 15 nt, Pseudomonas aeruginosa PA01
ccguuuccggcaugc

SEQ ID NO: 3525711 - RNA, 14 nt, Pseudomonas aeruginosa PA01
ccguuucgccgccg

SEQ ID NO: 3525712 - RNA, 15 nt, Pseudomonas aeruginosa PA01
ccguuucgccgccgg

SEQ ID NO: 3525713 - RNA, 23 nt, Pseudomonas aeruginosa PA01
ccguuugcucucaucccugugcg

SEQ ID NO: 3525714 - RNA, 23 nt, Pseudomonas aeruginosa PA01
ccguuuuucaugguccgucgcgc

SEQ ID NO: 3525715 - RNA, 21 nt, Pseudomonas aeruginosa PA01
ccguuuuuccuuguggcgguu

SEQ ID NO: 3525716 - RNA, 14 nt, Pseudomonas aeruginosa PA01
ccuacaucuuggca

SEQ ID NO: 3525717 - RNA, 14 nt, Pseudomonas aeruginosa PA01
ccuaccagaccgca

SEQ ID NO: 3525718 - RNA, 17 nt, Pseudomonas aeruginosa PA01
ccuaccauuagaggaac

SEQ ID NO: 3525719 - RNA, 11 nt, Pseudomonas aeruginosa PA01
ccuaccccagg

SEQ ID NO: 3525720 - RNA, 13 nt, Pseudomonas aeruginosa PA01
ccuacccgacagg

SEQ ID NO: 3525721 - RNA, 21 nt, Pseudomonas aeruginosa PA01
ccuacccgacaggcagcgccg

SEQ ID NO: 3525722 - RNA, 20 nt, Pseudomonas aeruginosa PA01
ccuacccgagcaacugcucg

SEQ ID NO: 3525723 - RNA, 12 nt, Pseudomonas aeruginosa PA01
ccuacccgcgcu

SEQ ID NO: 3525724 - RNA, 15 nt, Pseudomonas aeruginosa PA01
ccuaccggcgccgcc

SEQ ID NO: 3525725 - RNA, 14 nt, Pseudomonas aeruginosa PA01
ccuacgaaagcgcc

SEQ ID NO: 3525726 - RNA, 18 nt, Pseudomonas aeruginosa PA01
ccuccaggcgcgccugga

SEQ ID NO: 3525727 - RNA, 13 nt, Pseudomonas aeruginosa PA01
ccuccaggcucag

SEQ ID NO: 3525728 - RNA, 23 nt, Pseudomonas aeruginosa PA01
ccuccaggcucuucagcacgcgu

SEQ ID NO: 3525729 - RNA, 14 nt, Pseudomonas aeruginosa PA01
ccuccaggcuggcc

SEQ ID NO: 3525730 - RNA, 20 nt, Pseudomonas aeruginosa PA01
ccuccaggcuggccuuggcc

SEQ ID NO: 3525731 - RNA, 14 nt, Pseudomonas aeruginosa PA01
ccuccagggccagc

SEQ ID NO: 3525732 - RNA, 21 nt, Pseudomonas aeruginosa PA01
ccuccagggucgcccgugccu

SEQ ID NO: 3525733 - RNA, 23 nt, Pseudomonas aeruginosa PA01
ccuccagguaggcgcccuugacg

SEQ ID NO: 3525734 - RNA, 12 nt, Pseudomonas aeruginosa PA01
ccuccaguuccu

SEQ ID NO: 3525735 - RNA, 14 nt, Pseudomonas aeruginosa PA01
ccuccaguuccucg

SEQ ID NO: 3525736 - RNA, 21 nt, Pseudomonas aeruginosa PA01
ccuccauuagcgucgcgcggc

SEQ ID NO: 3525737 - RNA, 13 nt, Pseudomonas aeruginosa PA01
ccucccagccgug

SEQ ID NO: 3525738 - RNA, 14 nt, Pseudomonas aeruginosa PA01
ccucccagccgugg

SEQ ID NO: 3525739 - RNA, 14 nt, Pseudomonas aeruginosa PA01
ccucccccagcggg

SEQ ID NO: 3525740 - RNA, 12 nt, Pseudomonas aeruginosa PA01
ccuccccggccc

SEQ ID NO: 3525741 - RNA, 13 nt, Pseudomonas aeruginosa PA01
ccuccccggcccg

SEQ ID NO: 3525742 - RNA, 13 nt, Pseudomonas aeruginosa PA01
ccuccccguccug

SEQ ID NO: 3525743 - RNA, 22 nt, Pseudomonas aeruginosa PA01
ccucccgaguucaccaccccga

SEQ ID NO: 3525744 - RNA, 12 nt, Pseudomonas aeruginosa PA01
ccucccgccgcg

SEQ ID NO: 3525745 - RNA, 13 nt, Pseudomonas aeruginosa PA01
ccucccgcgccag

SEQ ID NO: 3525746 - RNA, 20 nt, Pseudomonas aeruginosa PA01
ccucccgcgccagcgccgcc

SEQ ID NO: 3525747 - RNA, 16 nt, Pseudomonas aeruginosa PA01
ccucccgcgccagcuc

SEQ ID NO: 3525748 - RNA, 14 nt, Pseudomonas aeruginosa PA01
ccucccggcucgcc

SEQ ID NO: 3525749 - RNA, 15 nt, Pseudomonas aeruginosa PA01
ccucccggcucgccg

SEQ ID NO: 3525750 - RNA, 21 nt, Pseudomonas aeruginosa PA01
ccucccgggccagcuccgccu

SEQ ID NO: 3525751 - RNA, 22 nt, Pseudomonas aeruginosa PA01
ccucccgggccagcuccgccug

SEQ ID NO: 3525752 - RNA, 13 nt, Pseudomonas aeruginosa PA01
ccuccgccagccc

SEQ ID NO: 3525753 - RNA, 11 nt, Pseudomonas aeruginosa PA01
ccuccgccagg

SEQ ID NO: 3525754 - RNA, 12 nt, Pseudomonas aeruginosa PA01
ccuccgccagga

SEQ ID NO: 3525755 - RNA, 21 nt, Pseudomonas aeruginosa PA01
ccuccgccaggaccuccugca

SEQ ID NO: 3525756 - RNA, 13 nt, Pseudomonas aeruginosa PA01
ccuccgccagguc

SEQ ID NO: 3525757 - RNA, 21 nt, Pseudomonas aeruginosa PA01
ccuccgccgcuuccgccaggc

SEQ ID NO: 3525758 - RNA, 14 nt, Pseudomonas aeruginosa PA01
ccuccgccugcacg

SEQ ID NO: 3525759 - RNA, 15 nt, Pseudomonas aeruginosa PA01
ccuccgcgcccaggc

SEQ ID NO: 3525760 - RNA, 14 nt, Pseudomonas aeruginosa PA01
ccuccgcucugcug

SEQ ID NO: 3525761 - RNA, 17 nt, Pseudomonas aeruginosa PA01
ccuccgcucugcuggcc

SEQ ID NO: 3525762 - RNA, 13 nt, Pseudomonas aeruginosa PA01
ccuccggacgccg

SEQ ID NO: 3525763 - RNA, 15 nt, Pseudomonas aeruginosa PA01
ccuccggacgccgaa

SEQ ID NO: 3525764 - RNA, 23 nt, Pseudomonas aeruginosa PA01
ccuccggaugcagauccagcggc

SEQ ID NO: 3525765 - RNA, 16 nt, Pseudomonas aeruginosa PA01
ccuccggcacgcugcc

SEQ ID NO: 3525766 - RNA, 18 nt, Pseudomonas aeruginosa PA01
ccuccggcacgcugccgc

SEQ ID NO: 3525767 - RNA, 13 nt, Pseudomonas aeruginosa PA01
ccuccggcagcgu

SEQ ID NO: 3525768 - RNA, 15 nt, Pseudomonas aeruginosa PA01
ccuccgggcguaacg

SEQ ID NO: 3525769 - RNA, 14 nt, Pseudomonas aeruginosa PA01
ccuccgggcgugcc

SEQ ID NO: 3525770 - RNA, 13 nt, Pseudomonas aeruginosa PA01
ccuccuccagcag

SEQ ID NO: 3525771 - RNA, 13 nt, Pseudomonas aeruginosa PA01
ccuccuccaguuc

SEQ ID NO: 3525772 - RNA, 23 nt, Pseudomonas aeruginosa PA01
ccuccucgaucacccgcgaggcc

SEQ ID NO: 3525773 - RNA, 17 nt, Pseudomonas aeruginosa PA01
ccuccucgccgccgacc

SEQ ID NO: 3525774 - RNA, 18 nt, Pseudomonas aeruginosa PA01
ccuccucgccgcuccgcg

SEQ ID NO: 3525775 - RNA, 20 nt, Pseudomonas aeruginosa PA01
ccuccucgccgcuccgcgcc

SEQ ID NO: 3525776 - RNA, 20 nt, Pseudomonas aeruginosa PA01
ccuccucgcucugcgccgcg

SEQ ID NO: 3525777 - RNA, 13 nt, Pseudomonas aeruginosa PA01
ccuccucggcggc

SEQ ID NO: 3525778 - RNA, 14 nt, Pseudomonas aeruginosa PA01
ccuccucggcggcc

SEQ ID NO: 3525779 - RNA, 18 nt, Pseudomonas aeruginosa PA01
ccuccucggcggccuuuu

SEQ ID NO: 3525780 - RNA, 22 nt, Pseudomonas aeruginosa PA01
ccuccucguaggcguccuggcg

SEQ ID NO: 3525781 - RNA, 18 nt, Pseudomonas aeruginosa PA01
ccuccuggaaagaccggc

SEQ ID NO: 3525782 - RNA, 17 nt, Pseudomonas aeruginosa PA01
ccuccuggauacgcucg

SEQ ID NO: 3525783 - RNA, 21 nt, Pseudomonas aeruginosa PA01
ccuccuggauacgcucggcca

SEQ ID NO: 3525784 - RNA, 22 nt, Pseudomonas aeruginosa PA01
ccuccuggauacgcucggccaa

SEQ ID NO: 3525785 - RNA, 20 nt, Pseudomonas aeruginosa PA01
ccuccuggcgcgucggccgc

SEQ ID NO: 3525786 - RNA, 12 nt, Pseudomonas aeruginosa PA01
ccuccuggcggc

SEQ ID NO: 3525787 - RNA, 18 nt, Pseudomonas aeruginosa PA01
ccuccuggcggcguggca

SEQ ID NO: 3525788 - RNA, 21 nt, Pseudomonas aeruginosa PA01
ccuccugggccugucgggggc

SEQ ID NO: 3525789 - RNA, 21 nt, Pseudomonas aeruginosa PA01
ccuccuggggaaucugcgcca

SEQ ID NO: 3525790 - RNA, 16 nt, Pseudomonas aeruginosa PA01
ccuccuguucgcgcgc

SEQ ID NO: 3525791 - RNA, 17 nt, Pseudomonas aeruginosa PA01
ccuccuugggaucggcg

SEQ ID NO: 3525792 - RNA, 22 nt, Pseudomonas aeruginosa PA01
ccucgaacagcuugaaccgcga

SEQ ID NO: 3525793 - RNA, 17 nt, Pseudomonas aeruginosa PA01
ccucgaaccccuggcgc

SEQ ID NO: 3525794 - RNA, 17 nt, Pseudomonas aeruginosa PA01
ccucgaacgcuucuugu

SEQ ID NO: 3525795 - RNA, 15 nt, Pseudomonas aeruginosa PA01
ccucgaacggcguga

SEQ ID NO: 3525796 - RNA, 17 nt, Pseudomonas aeruginosa PA01
ccucgaacggcgugagg

SEQ ID NO: 3525797 - RNA, 18 nt, Pseudomonas aeruginosa PA01
ccucgaagaaaaggcccg

SEQ ID NO: 3525798 - RNA, 21 nt, Pseudomonas aeruginosa PA01
ccucgaagaaaaggcccggcg

SEQ ID NO: 3525799 - RNA, 16 nt, Pseudomonas aeruginosa PA01
ccucgaagcccagcgc

SEQ ID NO: 3525800 - RNA, 17 nt, Pseudomonas aeruginosa PA01
ccucgaagcccagcgcc

SEQ ID NO: 3525801 - RNA, 14 nt, Pseudomonas aeruginosa PA01
ccucgaagcccugc

SEQ ID NO: 3525802 - RNA, 20 nt, Pseudomonas aeruginosa PA01
ccucgaagcggaucucgucg

SEQ ID NO: 3525803 - RNA, 17 nt, Pseudomonas aeruginosa PA01
ccucgaagcuggccagu

SEQ ID NO: 3525804 - RNA, 18 nt, Pseudomonas aeruginosa PA01
ccucgaaggucagcccgu

SEQ ID NO: 3525805 - RNA, 16 nt, Pseudomonas aeruginosa PA01
ccucgacauggaucac

SEQ ID NO: 3525806 - RNA, 17 nt, Pseudomonas aeruginosa PA01
ccucgaccagcgccgcg

SEQ ID NO: 3525807 - RNA, 22 nt, Pseudomonas aeruginosa PA01
ccucgaccagguccggcagcgc

SEQ ID NO: 3525808 - RNA, 20 nt, Pseudomonas aeruginosa PA01
ccucgaccaucggcggcggc

SEQ ID NO: 3525809 - RNA, 15 nt, Pseudomonas aeruginosa PA01
ccucgacccuggcgc

SEQ ID NO: 3525810 - RNA, 16 nt, Pseudomonas aeruginosa PA01
ccucgacccuggcgcc

SEQ ID NO: 3525811 - RNA, 18 nt, Pseudomonas aeruginosa PA01
ccucgacccuggcgccga

SEQ ID NO: 3525812 - RNA, 19 nt, Pseudomonas aeruginosa PA01
ccucgacccuggcgccgac

SEQ ID NO: 3525813 - RNA, 16 nt, Pseudomonas aeruginosa PA01
ccucgaccgcgccggc

SEQ ID NO: 3525814 - RNA, 12 nt, Pseudomonas aeruginosa PA01
ccucgaccuggc

SEQ ID NO: 3525815 - RNA, 14 nt, Pseudomonas aeruginosa PA01
ccucgaccuggcuc

SEQ ID NO: 3525816 - RNA, 15 nt, Pseudomonas aeruginosa PA01
ccucgaccugguagc

SEQ ID NO: 3525817 - RNA, 22 nt, Pseudomonas aeruginosa PA01
ccucgacgaaauaaugcggcgc

SEQ ID NO: 3525818 - RNA, 12 nt, Pseudomonas aeruginosa PA01
ccucgacgcccg

SEQ ID NO: 3525819 - RNA, 23 nt, Pseudomonas aeruginosa PA01
ccucgacgcccgcuugcgccgcc

SEQ ID NO: 3525820 - RNA, 13 nt, Pseudomonas aeruginosa PA01
ccucgacgccgag

SEQ ID NO: 3525821 - RNA, 17 nt, Pseudomonas aeruginosa PA01
ccucgacgccgagccag

SEQ ID NO: 3525822 - RNA, 15 nt, Pseudomonas aeruginosa PA01
ccucgacgcucuccg

SEQ ID NO: 3525823 - RNA, 22 nt, Pseudomonas aeruginosa PA01
ccucgacggcgaucucagccau

SEQ ID NO: 3525824 - RNA, 16 nt, Pseudomonas aeruginosa PA01
ccucgacggcgggagc

SEQ ID NO: 3525825 - RNA, 13 nt, Pseudomonas aeruginosa PA01
ccucgagcaggcc

SEQ ID NO: 3525826 - RNA, 22 nt, Pseudomonas aeruginosa PA01
ccucgaggaacaggucgacggc

SEQ ID NO: 3525827 - RNA, 20 nt, Pseudomonas aeruginosa PA01
ccucgaggaucuugcgcccg

SEQ ID NO: 3525828 - RNA, 23 nt, Pseudomonas aeruginosa PA01
ccucgaggaucuugcgcccggcg

SEQ ID NO: 3525829 - RNA, 14 nt, Pseudomonas aeruginosa PA01
ccucgcugccgccg

SEQ ID NO: 3525830 - RNA, 18 nt, Pseudomonas aeruginosa PA01
ccucgcugccgccgcaga

SEQ ID NO: 3525831 - RNA, 20 nt, Pseudomonas aeruginosa PA01
ccucgcugccuaccgucacg

SEQ ID NO: 3525832 - RNA, 21 nt, Pseudomonas aeruginosa PA01
ccucgcugccuaccgucacgc

SEQ ID NO: 3525833 - RNA, 22 nt, Pseudomonas aeruginosa PA01
ccucgcugccuaccgucacgcg

SEQ ID NO: 3525834 - RNA, 21 nt, Pseudomonas aeruginosa PA01
ccucgcugccuggggacggca

SEQ ID NO: 3525835 - RNA, 23 nt, Pseudomonas aeruginosa PA01
ccucgcugcgggcguagcgcggc

SEQ ID NO: 3525836 - RNA, 14 nt, Pseudomonas aeruginosa PA01
ccucgcuggcgaag

SEQ ID NO: 3525837 - RNA, 14 nt, Pseudomonas aeruginosa PA01
ccucggaaucggcg

SEQ ID NO: 3525838 - RNA, 14 nt, Pseudomonas aeruginosa PA01
ccucggagaacagc

SEQ ID NO: 3525839 - RNA, 15 nt, Pseudomonas aeruginosa PA01
ccucggagaacagca

SEQ ID NO: 3525840 - RNA, 18 nt, Pseudomonas aeruginosa PA01
ccucggagaacagcagcg

SEQ ID NO: 3525841 - RNA, 19 nt, Pseudomonas aeruginosa PA01
ccucggauaugccgcucag

SEQ ID NO: 3525842 - RNA, 14 nt, Pseudomonas aeruginosa PA01
ccucggaugccgca

SEQ ID NO: 3525843 - RNA, 17 nt, Pseudomonas aeruginosa PA01
ccucggaugccgcacag

SEQ ID NO: 3525844 - RNA, 19 nt, Pseudomonas aeruginosa PA01
ccucggaugccgcacaggc

SEQ ID NO: 3525845 - RNA, 15 nt, Pseudomonas aeruginosa PA01
ccucggcagcgcugg

SEQ ID NO: 3525846 - RNA, 18 nt, Pseudomonas aeruginosa PA01
ccucggcagcgcuggcga

SEQ ID NO: 3525847 - RNA, 14 nt, Pseudomonas aeruginosa PA01
ccucggcagggcgc

SEQ ID NO: 3525848 - RNA, 20 nt, Pseudomonas aeruginosa PA01
ccucggcagggcgcccgccc

SEQ ID NO: 3525849 - RNA, 22 nt, Pseudomonas aeruginosa PA01
ccucggcagggcgcccgcccgg

SEQ ID NO: 3525850 - RNA, 23 nt, Pseudomonas aeruginosa PA01
ccucggcauccaguucguucugg

SEQ ID NO: 3525851 - RNA, 16 nt, Pseudomonas aeruginosa PA01
ccucggcauccucgcc

SEQ ID NO: 3525852 - RNA, 17 nt, Pseudomonas aeruginosa PA01
ccucggcauccucgccc

SEQ ID NO: 3525853 - RNA, 18 nt, Pseudomonas aeruginosa PA01
ccucggccaacggccgcu

SEQ ID NO: 3525854 - RNA, 14 nt, Pseudomonas aeruginosa PA01
ccucggccagccag

SEQ ID NO: 3525855 - RNA, 20 nt, Pseudomonas aeruginosa PA01
ccucggccagccagggcagc

SEQ ID NO: 3525856 - RNA, 13 nt, Pseudomonas aeruginosa PA01
ccucggccagcgc

SEQ ID NO: 3525857 - RNA, 14 nt, Pseudomonas aeruginosa PA01
ccucggccagcgcc

SEQ ID NO: 3525858 - RNA, 17 nt, Pseudomonas aeruginosa PA01
ccucggccagcgccgcc

SEQ ID NO: 3525859 - RNA, 18 nt, Pseudomonas aeruginosa PA01
ccucggccagcgccgccg

SEQ ID NO: 3525860 - RNA, 21 nt, Pseudomonas aeruginosa PA01
ccucggccagcgccgccgcug

SEQ ID NO: 3525861 - RNA, 18 nt, Pseudomonas aeruginosa PA01
ccucggccaggaccaggg

SEQ ID NO: 3525862 - RNA, 14 nt, Pseudomonas aeruginosa PA01
ccucggccaggcau

SEQ ID NO: 3525863 - RNA, 19 nt, Pseudomonas aeruginosa PA01
ccucggccauaccuccagc

SEQ ID NO: 3525864 - RNA, 23 nt, Pseudomonas aeruginosa PA01
ccucggccauaccuccagccagc

SEQ ID NO: 3525865 - RNA, 21 nt, Pseudomonas aeruginosa PA01
ccucggccaucgagcgcucca

SEQ ID NO: 3525866 - RNA, 19 nt, Pseudomonas aeruginosa PA01
ccucggccgccaggcgcgu

SEQ ID NO: 3525867 - RNA, 18 nt, Pseudomonas aeruginosa PA01
ccucggccgccagggcgu

SEQ ID NO: 3525868 - RNA, 16 nt, Pseudomonas aeruginosa PA01
ccucggccucgucgag

SEQ ID NO: 3525869 - RNA, 13 nt, Pseudomonas aeruginosa PA01
ccucggccugggc

SEQ ID NO: 3525870 - RNA, 15 nt, Pseudomonas aeruginosa PA01
ccucggccuugcugg

SEQ ID NO: 3525871 - RNA, 17 nt, Pseudomonas aeruginosa PA01
ccucggccuugcuggcg

SEQ ID NO: 3525872 - RNA, 19 nt, Pseudomonas aeruginosa PA01
ccucggcgaacuccgccag

SEQ ID NO: 3525873 - RNA, 20 nt, Pseudomonas aeruginosa PA01
ccucggcgaacuccgccagc

SEQ ID NO: 3525874 - RNA, 15 nt, Pseudomonas aeruginosa PA01
ccucggcgaccaaca

SEQ ID NO: 3525875 - RNA, 21 nt, Pseudomonas aeruginosa PA01
ccucggcgaccaacagggcgu

SEQ ID NO: 3525876 - RNA, 15 nt, Pseudomonas aeruginosa PA01
ccucggcgacgagga

SEQ ID NO: 3525877 - RNA, 22 nt, Pseudomonas aeruginosa PA01
ccucggcgaggaucagucgcug

SEQ ID NO: 3525878 - RNA, 18 nt, Pseudomonas aeruginosa PA01
ccucggcgaucacccggc

SEQ ID NO: 3525879 - RNA, 17 nt, Pseudomonas aeruginosa PA01
ccucggcgaugccggag

SEQ ID NO: 3525880 - RNA, 20 nt, Pseudomonas aeruginosa PA01
ccucggcgccauaggccagc

SEQ ID NO: 3525881 - RNA, 23 nt, Pseudomonas aeruginosa PA01
ccucggcgccauaggccagcacc

SEQ ID NO: 3525882 - RNA, 13 nt, Pseudomonas aeruginosa PA01
ccucggcgcccgc

SEQ ID NO: 3525883 - RNA, 15 nt, Pseudomonas aeruginosa PA01
ccucggcgcccgccu

SEQ ID NO: 3525884 - RNA, 17 nt, Pseudomonas aeruginosa PA01
ccucggcgccgucgauc

SEQ ID NO: 3525885 - RNA, 18 nt, Pseudomonas aeruginosa PA01
ccucggcgcgauccuccg

SEQ ID NO: 3525886 - RNA, 20 nt, Pseudomonas aeruginosa PA01
ccucggcgcgauccuccgcc

SEQ ID NO: 3525887 - RNA, 15 nt, Pseudomonas aeruginosa PA01
ccucggcgcgcgccc

SEQ ID NO: 3525888 - RNA, 12 nt, Pseudomonas aeruginosa PA01
ccucggcgcggg

SEQ ID NO: 3525889 - RNA, 14 nt, Pseudomonas aeruginosa PA01
ccucggcgcuggcc

SEQ ID NO: 3525890 - RNA, 16 nt, Pseudomonas aeruginosa PA01
ccucggcgcuggccag

SEQ ID NO: 3525891 - RNA, 17 nt, Pseudomonas aeruginosa PA01
ccucggcgcuggccagg

SEQ ID NO: 3525892 - RNA, 13 nt, Pseudomonas aeruginosa PA01
ccucggcggccuu

SEQ ID NO: 3525893 - RNA, 13 nt, Pseudomonas aeruginosa PA01
ccucggcggcgag

SEQ ID NO: 3525894 - RNA, 16 nt, Pseudomonas aeruginosa PA01
ccucggcggcgagcgg

SEQ ID NO: 3525895 - RNA, 18 nt, Pseudomonas aeruginosa PA01
ccucggcggcggccugcu

SEQ ID NO: 3525896 - RNA, 19 nt, Pseudomonas aeruginosa PA01
ccucggcggcggccugcuc

SEQ ID NO: 3525897 - RNA, 22 nt, Pseudomonas aeruginosa PA01
ccucggcggcggccugcucgcg

SEQ ID NO: 3525898 - RNA, 23 nt, Pseudomonas aeruginosa PA01
ccucggcggcggccugcucgcgc

SEQ ID NO: 3525899 - RNA, 15 nt, Pseudomonas aeruginosa PA01
ccucggcggcggucg

SEQ ID NO: 3525900 - RNA, 20 nt, Pseudomonas aeruginosa PA01
ccucggcgggagagggcggc

SEQ ID NO: 3525901 - RNA, 22 nt, Pseudomonas aeruginosa PA01
ccucggcgggagagggcggcga

SEQ ID NO: 3525902 - RNA, 15 nt, Pseudomonas aeruginosa PA01
ccucggcguagccgg

SEQ ID NO: 3525903 - RNA, 17 nt, Pseudomonas aeruginosa PA01
ccucggcguagccggcc

SEQ ID NO: 3525904 - RNA, 20 nt, Pseudomonas aeruginosa PA01
ccucggcguagccggccagg

SEQ ID NO: 3525905 - RNA, 15 nt, Pseudomonas aeruginosa PA01
ccucggcgucgcgca

SEQ ID NO: 3525906 - RNA, 15 nt, Pseudomonas aeruginosa PA01
ccucggcguucaccg

SEQ ID NO: 3525907 - RNA, 18 nt, Pseudomonas aeruginosa PA01
ccucggcuaaccgccuuc

SEQ ID NO: 3525908 - RNA, 20 nt, Pseudomonas aeruginosa PA01
ccucggcuucguccugcugc

SEQ ID NO: 3525909 - RNA, 18 nt, Pseudomonas aeruginosa PA01
ccucgggaugcaguucgu

SEQ ID NO: 3525910 - RNA, 19 nt, Pseudomonas aeruginosa PA01
ccucgggaugcaguucguu

SEQ ID NO: 3525911 - RNA, 14 nt, Pseudomonas aeruginosa PA01
ccucgggcaccagc

SEQ ID NO: 3525912 - RNA, 15 nt, Pseudomonas aeruginosa PA01
ccucgggcaccagca

SEQ ID NO: 3525913 - RNA, 15 nt, Pseudomonas aeruginosa PA01
ccucgggcagccccu

SEQ ID NO: 3525914 - RNA, 13 nt, Pseudomonas aeruginosa PA01
ccucgggcagcuu

SEQ ID NO: 3525915 - RNA, 14 nt, Pseudomonas aeruginosa PA01
ccucgggcagcuug

SEQ ID NO: 3525916 - RNA, 20 nt, Pseudomonas aeruginosa PA01
ccucgggcagcuuggcgguc

SEQ ID NO: 3525917 - RNA, 13 nt, Pseudomonas aeruginosa PA01
ccucgggccgcag

SEQ ID NO: 3525918 - RNA, 21 nt, Pseudomonas aeruginosa PA01
ccucgggccggagcaggccau

SEQ ID NO: 3525919 - RNA, 20 nt, Pseudomonas aeruginosa PA01
ccucgggcgagaaucgccga

SEQ ID NO: 3525920 - RNA, 18 nt, Pseudomonas aeruginosa PA01
ccucggggaaacccucag

SEQ ID NO: 3525921 - RNA, 22 nt, Pseudomonas aeruginosa PA01
ccucggggaagcgcggcucggg

SEQ ID NO: 3525922 - RNA, 20 nt, Pseudomonas aeruginosa PA01
ccucggggaaggucaccgaa

SEQ ID NO: 3525923 - RNA, 12 nt, Pseudomonas aeruginosa PA01
ccucggggccga

SEQ ID NO: 3525924 - RNA, 20 nt, Pseudomonas aeruginosa PA01
ccucggggccguccgccagg

SEQ ID NO: 3525925 - RNA, 21 nt, Pseudomonas aeruginosa PA01
ccucggguuuggcgcccgccu

SEQ ID NO: 3525926 - RNA, 13 nt, Pseudomonas aeruginosa PA01
ccucgguagccgg

SEQ ID NO: 3525927 - RNA, 22 nt, Pseudomonas aeruginosa PA01
ccucgguagccggccaaccacc

SEQ ID NO: 3525928 - RNA, 17 nt, Pseudomonas aeruginosa PA01
ccucggucaggcgcugg

SEQ ID NO: 3525929 - RNA, 19 nt, Pseudomonas aeruginosa PA01
ccucggucaggcgcuggug

SEQ ID NO: 3525930 - RNA, 20 nt, Pseudomonas aeruginosa PA01
ccucggucaggcgcugguga

SEQ ID NO: 3525931 - RNA, 20 nt, Pseudomonas aeruginosa PA01
ccugcaacucggcgucgcgc

SEQ ID NO: 3525932 - RNA, 22 nt, Pseudomonas aeruginosa PA01
ccugcaacucggcgucgcgcuu

SEQ ID NO: 3525933 - RNA, 19 nt, Pseudomonas aeruginosa PA01
ccugcaacucgucguccag

SEQ ID NO: 3525934 - RNA, 22 nt, Pseudomonas aeruginosa PA01
ccugcaacucgucguccagcgg

SEQ ID NO: 3525935 - RNA, 15 nt, Pseudomonas aeruginosa PA01
ccugcaacugcucga

SEQ ID NO: 3525936 - RNA, 22 nt, Pseudomonas aeruginosa PA01
ccugcaacuggaaggccgcgcc

SEQ ID NO: 3525937 - RNA, 16 nt, Pseudomonas aeruginosa PA01
ccugcaaggcggugac

SEQ ID NO: 3525938 - RNA, 17 nt, Pseudomonas aeruginosa PA01
ccugcaauggggcggcc

SEQ ID NO: 3525939 - RNA, 18 nt, Pseudomonas aeruginosa PA01
ccugcaauggggcggccg

SEQ ID NO: 3525940 - RNA, 19 nt, Pseudomonas aeruginosa PA01
ccugcaauggggcggccgg

SEQ ID NO: 3525941 - RNA, 18 nt, Pseudomonas aeruginosa PA01
ccugcaauuccaccggcu

SEQ ID NO: 3525942 - RNA, 15 nt, Pseudomonas aeruginosa PA01
ccugcacaucaccuu

SEQ ID NO: 3525943 - RNA, 21 nt, Pseudomonas aeruginosa PA01
ccugcacaucaccuucgcccu

SEQ ID NO: 3525944 - RNA, 19 nt, Pseudomonas aeruginosa PA01
ccugcaccacgcaggcgcg

SEQ ID NO: 3525945 - RNA, 22 nt, Pseudomonas aeruginosa PA01
ccugcaccagccaguccggcag

SEQ ID NO: 3525946 - RNA, 19 nt, Pseudomonas aeruginosa PA01
ccugcacccuuggcgcagg

SEQ ID NO: 3525947 - RNA, 18 nt, Pseudomonas aeruginosa PA01
ccugcaccugcucggggc

SEQ ID NO: 3525948 - RNA, 19 nt, Pseudomonas aeruginosa PA01
ccugcaccuugggaucguc

SEQ ID NO: 3525949 - RNA, 14 nt, Pseudomonas aeruginosa PA01
ccugcacgcugcgc

SEQ ID NO: 3525950 - RNA, 15 nt, Pseudomonas aeruginosa PA01
ccugcacgcugcgcc

SEQ ID NO: 3525951 - RNA, 20 nt, Pseudomonas aeruginosa PA01
ccugcacgcugcgccggcgc

SEQ ID NO: 3525952 - RNA, 17 nt, Pseudomonas aeruginosa PA01
ccugcacggauaccacc

SEQ ID NO: 3525953 - RNA, 21 nt, Pseudomonas aeruginosa PA01
ccugcacggauaccacccgca

SEQ ID NO: 3525954 - RNA, 20 nt, Pseudomonas aeruginosa PA01
ccugcagacgguucagcagc

SEQ ID NO: 3525955 - RNA, 21 nt, Pseudomonas aeruginosa PA01
ccugcagacgguucagcagcg

SEQ ID NO: 3525956 - RNA, 16 nt, Pseudomonas aeruginosa PA01
ccugcagauaaagcug

SEQ ID NO: 3525957 - RNA, 20 nt, Pseudomonas aeruginosa PA01
ccugcagcaccaccucgcca

SEQ ID NO: 3525958 - RNA, 22 nt, Pseudomonas aeruginosa PA01
ccugcagcaccaccucgccaag

SEQ ID NO: 3525959 - RNA, 19 nt, Pseudomonas aeruginosa PA01
ccugcagcaggucgagcag

SEQ ID NO: 3525960 - RNA, 20 nt, Pseudomonas aeruginosa PA01
ccugcagcaggucgagcagu

SEQ ID NO: 3525961 - RNA, 17 nt, Pseudomonas aeruginosa PA01
ccugcagcaguuccagg

SEQ ID NO: 3525962 - RNA, 18 nt, Pseudomonas aeruginosa PA01
ccugcagcaguuccaggc

SEQ ID NO: 3525963 - RNA, 16 nt, Pseudomonas aeruginosa PA01
ccugcagcgacuccag

SEQ ID NO: 3525964 - RNA, 22 nt, Pseudomonas aeruginosa PA01
ccugcagcgccauggggaucac

SEQ ID NO: 3525965 - RNA, 14 nt, Pseudomonas aeruginosa PA01
ccugcagcgccucg

SEQ ID NO: 3525966 - RNA, 23 nt, Pseudomonas aeruginosa PA01
ccugcagcgcgcgcuggucguag

SEQ ID NO: 3525967 - RNA, 14 nt, Pseudomonas aeruginosa PA01
ccugcagcucggug

SEQ ID NO: 3525968 - RNA, 16 nt, Pseudomonas aeruginosa PA01
ccugcaggacccgcga

SEQ ID NO: 3525969 - RNA, 15 nt, Pseudomonas aeruginosa PA01
ccugcaggaucgaga

SEQ ID NO: 3525970 - RNA, 16 nt, Pseudomonas aeruginosa PA01
ccugcaggaucgagac

SEQ ID NO: 3525971 - RNA, 16 nt, Pseudomonas aeruginosa PA01
ccugcaggccgaaucc

SEQ ID NO: 3525972 - RNA, 19 nt, Pseudomonas aeruginosa PA01
ccugcaggccgaauccgcc

SEQ ID NO: 3525973 - RNA, 20 nt, Pseudomonas aeruginosa PA01
ccugcagggcguagugcucc

SEQ ID NO: 3525974 - RNA, 17 nt, Pseudomonas aeruginosa PA01
ccugcagguagcgcugc

SEQ ID NO: 3525975 - RNA, 21 nt, Pseudomonas aeruginosa PA01
ccugcagguagcgcugcgccc

SEQ ID NO: 3525976 - RNA, 16 nt, Pseudomonas aeruginosa PA01
ccugcagguccggguu

SEQ ID NO: 3525977 - RNA, 17 nt, Pseudomonas aeruginosa PA01
ccugcaggucgaggcgc

SEQ ID NO: 3525978 - RNA, 21 nt, Pseudomonas aeruginosa PA01
ccugcaggucgaggcgcucca

SEQ ID NO: 3525979 - RNA, 22 nt, Pseudomonas aeruginosa PA01
ccugcaggucgaggcgcuccac

SEQ ID NO: 3525980 - RNA, 24 nt, Pseudomonas aeruginosa PA01
ccugcaggucgaggcgcuccaccg

SEQ ID NO: 3525981 - RNA, 19 nt, Pseudomonas aeruginosa PA01
ccugcagguuguccagggc

SEQ ID NO: 3525982 - RNA, 22 nt, Pseudomonas aeruginosa PA01
ccugcaucaccaggcugccgcc

SEQ ID NO: 3525983 - RNA, 20 nt, Pseudomonas aeruginosa PA01
ccugcaucacguacggcgcc

SEQ ID NO: 3525984 - RNA, 17 nt, Pseudomonas aeruginosa PA01
ccugcaucuucucccag

SEQ ID NO: 3525985 - RNA, 15 nt, Pseudomonas aeruginosa PA01
ccugcaugccggccg

SEQ ID NO: 3525986 - RNA, 18 nt, Pseudomonas aeruginosa PA01
ccugcaugccggccgucg

SEQ ID NO: 3525987 - RNA, 23 nt, Pseudomonas aeruginosa PA01
ccugcaugccggccgucgcgcac

SEQ ID NO: 3525988 - RNA, 20 nt, Pseudomonas aeruginosa PA01
ccugcaugcuuuugaacacc

SEQ ID NO: 3525989 - RNA, 22 nt, Pseudomonas aeruginosa PA01
ccugcaugcuuuugaacaccag

SEQ ID NO: 3525990 - RNA, 15 nt, Pseudomonas aeruginosa PA01
ccugcaugucaccga

SEQ ID NO: 3525991 - RNA, 16 nt, Pseudomonas aeruginosa PA01
ccugccagaaaaccca

SEQ ID NO: 3525992 - RNA, 23 nt, Pseudomonas aeruginosa PA01
ccugccagaaaacccagcgaagc

SEQ ID NO: 3525993 - RNA, 16 nt, Pseudomonas aeruginosa PA01
ccugccagaccgagau

SEQ ID NO: 3525994 - RNA, 19 nt, Pseudomonas aeruginosa PA01
ccugccagaggaucggcca

SEQ ID NO: 3525995 - RNA, 22 nt, Pseudomonas aeruginosa PA01
ccugccagcgcgucggcacgcc

SEQ ID NO: 3525996 - RNA, 13 nt, Pseudomonas aeruginosa PA01
ccugccaucgaug

SEQ ID NO: 3525997 - RNA, 19 nt, Pseudomonas aeruginosa PA01
ccugccccacuuccggccc

SEQ ID NO: 3525998 - RNA, 20 nt, Pseudomonas aeruginosa PA01
ccugccccacuuccggcccg

SEQ ID NO: 3525999 - RNA, 21 nt, Pseudomonas aeruginosa PA01
ccugccccacuuccggcccgg

SEQ ID NO: 3526000 - RNA, 20 nt, Pseudomonas aeruginosa PA01
ccugccccagcaucgccggc

SEQ ID NO: 3526001 - RNA, 15 nt, Pseudomonas aeruginosa PA01
ccugccccgccggcg

SEQ ID NO: 3526002 - RNA, 18 nt, Pseudomonas aeruginosa PA01
ccugccccgggcgccggg

SEQ ID NO: 3526003 - RNA, 13 nt, Pseudomonas aeruginosa PA01
ccugccccgugca

SEQ ID NO: 3526004 - RNA, 14 nt, Pseudomonas aeruginosa PA01
ccugccccgugcac

SEQ ID NO: 3526005 - RNA, 17 nt, Pseudomonas aeruginosa PA01
ccugcccgcgccucgcu

SEQ ID NO: 3526006 - RNA, 13 nt, Pseudomonas aeruginosa PA01
ccugcccgguggg

SEQ ID NO: 3526007 - RNA, 14 nt, Pseudomonas aeruginosa PA01
ccugcccuccugcu

SEQ ID NO: 3526008 - RNA, 18 nt, Pseudomonas aeruginosa PA01
ccugccgcaggcgggcgc

SEQ ID NO: 3526009 - RNA, 14 nt, Pseudomonas aeruginosa PA01
ccugccgcccggcc

SEQ ID NO: 3526010 - RNA, 16 nt, Pseudomonas aeruginosa PA01
ccugccgcccggccag

SEQ ID NO: 3526011 - RNA, 17 nt, Pseudomonas aeruginosa PA01
ccugccggcacgcucag

SEQ ID NO: 3526012 - RNA, 20 nt, Pseudomonas aeruginosa PA01
ccugccggcgcagaucgcgg

SEQ ID NO: 3526013 - RNA, 17 nt, Pseudomonas aeruginosa PA01
ccugccggugcucggcc

SEQ ID NO: 3526014 - RNA, 16 nt, Pseudomonas aeruginosa PA01
ccugccguauccgcgg

SEQ ID NO: 3526015 - RNA, 20 nt, Pseudomonas aeruginosa PA01
ccugccguauccgcggcagg

SEQ ID NO: 3526016 - RNA, 20 nt, Pseudomonas aeruginosa PA01
ccugccguucgucaccggcg

SEQ ID NO: 3526017 - RNA, 22 nt, Pseudomonas aeruginosa PA01
ccugccguucgucaccggcgcc

SEQ ID NO: 3526018 - RNA, 19 nt, Pseudomonas aeruginosa PA01
ccugccugcgcagggcuuc

SEQ ID NO: 3526019 - RNA, 17 nt, Pseudomonas aeruginosa PA01
ccugcgaauugcgcugg

SEQ ID NO: 3526020 - RNA, 12 nt, Pseudomonas aeruginosa PA01
ccugcgaggcgu

SEQ ID NO: 3526021 - RNA, 17 nt, Pseudomonas aeruginosa PA01
ccugcgaggcgucgauc

SEQ ID NO: 3526022 - RNA, 19 nt, Pseudomonas aeruginosa PA01
ccugcgaggcgucgaucau

SEQ ID NO: 3526023 - RNA, 15 nt, Pseudomonas aeruginosa PA01
ccugcgccagcaucg

SEQ ID NO: 3526024 - RNA, 17 nt, Pseudomonas aeruginosa PA01
ccugcgccgcagcggcc

SEQ ID NO: 3526025 - RNA, 14 nt, Pseudomonas aeruginosa PA01
ccugcgccggacca

SEQ ID NO: 3526026 - RNA, 13 nt, Pseudomonas aeruginosa PA01
ccugcgccggcuc

SEQ ID NO: 3526027 - RNA, 14 nt, Pseudomonas aeruginosa PA01
ccugcgccucgacc

SEQ ID NO: 3526028 - RNA, 17 nt, Pseudomonas aeruginosa PA01
ccugcgccucgaccugg

SEQ ID NO: 3526029 - RNA, 18 nt, Pseudomonas aeruginosa PA01
ccugcgccucggcccugg

SEQ ID NO: 3526030 - RNA, 16 nt, Pseudomonas aeruginosa PA01
ccugcgcgcaccaggc

SEQ ID NO: 3526031 - RNA, 18 nt, Pseudomonas aeruginosa PA01
ccugcgcgcaccaggccu

SEQ ID NO: 3526032 - RNA, 15 nt, Pseudomonas aeruginosa PA01
ccugcgcgccucuuc

SEQ ID NO: 3526033 - RNA, 18 nt, Pseudomonas aeruginosa PA01
ccugcugggccagcgccg

SEQ ID NO: 3526034 - RNA, 22 nt, Pseudomonas aeruginosa PA01
ccugcugggcgucgaacaccgg

SEQ ID NO: 3526035 - RNA, 12 nt, Pseudomonas aeruginosa PA01
ccugcugguggg

SEQ ID NO: 3526036 - RNA, 23 nt, Pseudomonas aeruginosa PA01
ccugcuggugggugaucucgcug

SEQ ID NO: 3526037 - RNA, 18 nt, Pseudomonas aeruginosa PA01
ccugcuguguccggcgga

SEQ ID NO: 3526038 - RNA, 14 nt, Pseudomonas aeruginosa PA01
ccugcuucagcccg

SEQ ID NO: 3526039 - RNA, 17 nt, Pseudomonas aeruginosa PA01
ccugcuucagcccggca

SEQ ID NO: 3526040 - RNA, 22 nt, Pseudomonas aeruginosa PA01
ccugcuucaggaguuucaucuc

SEQ ID NO: 3526041 - RNA, 22 nt, Pseudomonas aeruginosa PA01
ccugcuucagguagugcaacac

SEQ ID NO: 3526042 - RNA, 20 nt, Pseudomonas aeruginosa PA01
ccugcuucaggucgucgggc

SEQ ID NO: 3526043 - RNA, 21 nt, Pseudomonas aeruginosa PA01
ccugcuucaggucgucgggca

SEQ ID NO: 3526044 - RNA, 15 nt, Pseudomonas aeruginosa PA01
ccugcuuccagaccu

SEQ ID NO: 3526045 - RNA, 16 nt, Pseudomonas aeruginosa PA01
ccugcuucgaccaggg

SEQ ID NO: 3526046 - RNA, 14 nt, Pseudomonas aeruginosa PA01
ccugcuugaccuug

SEQ ID NO: 3526047 - RNA, 16 nt, Pseudomonas aeruginosa PA01
ccugcuugaccuugcu

SEQ ID NO: 3526048 - RNA, 12 nt, Pseudomonas aeruginosa PA01
ccugcuugcagg

SEQ ID NO: 3526049 - RNA, 13 nt, Pseudomonas aeruginosa PA01
ccugcuugcagga

SEQ ID NO: 3526050 - RNA, 15 nt, Pseudomonas aeruginosa PA01
ccugcuuggccagcg

SEQ ID NO: 3526051 - RNA, 16 nt, Pseudomonas aeruginosa PA01
ccugcuuggccagcgc

SEQ ID NO: 3526052 - RNA, 17 nt, Pseudomonas aeruginosa PA01
ccugcuuggccagcgcg

SEQ ID NO: 3526053 - RNA, 22 nt, Pseudomonas aeruginosa PA01
ccugcuugggcgccucgccgcg

SEQ ID NO: 3526054 - RNA, 24 nt, Pseudomonas aeruginosa PA01
ccugcuugggcgccucgccgcggc

SEQ ID NO: 3526055 - RNA, 16 nt, Pseudomonas aeruginosa PA01
ccugcuuucccugcug

SEQ ID NO: 3526056 - RNA, 21 nt, Pseudomonas aeruginosa PA01
ccugcuuucccugcugcggca

SEQ ID NO: 3526057 - RNA, 14 nt, Pseudomonas aeruginosa PA01
ccuggaaagaccgg

SEQ ID NO: 3526058 - RNA, 20 nt, Pseudomonas aeruginosa PA01
ccuggaaagaccggcgcccc

SEQ ID NO: 3526059 - RNA, 18 nt, Pseudomonas aeruginosa PA01
ccuggaaaggccucggcg

SEQ ID NO: 3526060 - RNA, 22 nt, Pseudomonas aeruginosa PA01
ccuggaaaggccucggcgaugc

SEQ ID NO: 3526061 - RNA, 18 nt, Pseudomonas aeruginosa PA01
ccuggaacaccaggccgc

SEQ ID NO: 3526062 - RNA, 20 nt, Pseudomonas aeruginosa PA01
ccuggaacuagcccucgacc

SEQ ID NO: 3526063 - RNA, 22 nt, Pseudomonas aeruginosa PA01
ccuggaacuagcccucgaccug

SEQ ID NO: 3526064 - RNA, 20 nt, Pseudomonas aeruginosa PA01
ccuggaacuggucggggcgc

SEQ ID NO: 3526065 - RNA, 14 nt, Pseudomonas aeruginosa PA01
ccuggaagaacagg

SEQ ID NO: 3526066 - RNA, 15 nt, Pseudomonas aeruginosa PA01
ccuggaagaacaggc

SEQ ID NO: 3526067 - RNA, 14 nt, Pseudomonas aeruginosa PA01
ccuggaagcggguu

SEQ ID NO: 3526068 - RNA, 16 nt, Pseudomonas aeruginosa PA01
ccuggaaggcgcuggg

SEQ ID NO: 3526069 - RNA, 22 nt, Pseudomonas aeruginosa PA01
ccuggaauaccccgcggacgau

SEQ ID NO: 3526070 - RNA, 16 nt, Pseudomonas aeruginosa PA01
ccuggaaugccggccg

SEQ ID NO: 3526071 - RNA, 20 nt, Pseudomonas aeruginosa PA01
ccuggaaugccggccggggc

SEQ ID NO: 3526072 - RNA, 17 nt, Pseudomonas aeruginosa PA01
ccuggaauucaggcuuc

SEQ ID NO: 3526073 - RNA, 15 nt, Pseudomonas aeruginosa PA01
ccuggaccccgcccu

SEQ ID NO: 3526074 - RNA, 19 nt, Pseudomonas aeruginosa PA01
ccuggacccgggccuccug

SEQ ID NO: 3526075 - RNA, 22 nt, Pseudomonas aeruginosa PA01
ccuggaccucggguuuggcgcc

SEQ ID NO: 3526076 - RNA, 17 nt, Pseudomonas aeruginosa PA01
ccuggacgaaugcccgu

SEQ ID NO: 3526077 - RNA, 22 nt, Pseudomonas aeruginosa PA01
ccuggacgugggaaaucaccgc

SEQ ID NO: 3526078 - RNA, 17 nt, Pseudomonas aeruginosa PA01
ccuggagaaacucgcgg

SEQ ID NO: 3526079 - RNA, 18 nt, Pseudomonas aeruginosa PA01
ccuggagaaauccggcug

SEQ ID NO: 3526080 - RNA, 13 nt, Pseudomonas aeruginosa PA01
ccuggagcagggc

SEQ ID NO: 3526081 - RNA, 16 nt, Pseudomonas aeruginosa PA01
ccuggagcagggcgau

SEQ ID NO: 3526082 - RNA, 18 nt, Pseudomonas aeruginosa PA01
ccuggagcaguuucggau

SEQ ID NO: 3526083 - RNA, 17 nt, Pseudomonas aeruginosa PA01
ccuggauaagccgcgcc

SEQ ID NO: 3526084 - RNA, 17 nt, Pseudomonas aeruginosa PA01
ccuggauacgcucggcc

SEQ ID NO: 3526085 - RNA, 16 nt, Pseudomonas aeruginosa PA01
ccuggauacgggcgcc

SEQ ID NO: 3526086 - RNA, 21 nt, Pseudomonas aeruginosa PA01
ccuggauacgggcgccagggg

SEQ ID NO: 3526087 - RNA, 19 nt, Pseudomonas aeruginosa PA01
ccuggauaucaccuccugu

SEQ ID NO: 3526088 - RNA, 15 nt, Pseudomonas aeruginosa PA01
ccuggauaucugggc

SEQ ID NO: 3526089 - RNA, 16 nt, Pseudomonas aeruginosa PA01
ccuggaucaccgcggc

SEQ ID NO: 3526090 - RNA, 21 nt, Pseudomonas aeruginosa PA01
ccuggaucaccgcggcgcuga

SEQ ID NO: 3526091 - RNA, 22 nt, Pseudomonas aeruginosa PA01
ccuggaucacgcugaggaaggg

SEQ ID NO: 3526092 - RNA, 20 nt, Pseudomonas aeruginosa PA01
ccuggaucagcgccucgacc

SEQ ID NO: 3526093 - RNA, 12 nt, Pseudomonas aeruginosa PA01
ccuggaucgcca

SEQ ID NO: 3526094 - RNA, 14 nt, Pseudomonas aeruginosa PA01
ccuggaucgccagg

SEQ ID NO: 3526095 - RNA, 19 nt, Pseudomonas aeruginosa PA01
ccuggaucgccuugcgcgu

SEQ ID NO: 3526096 - RNA, 16 nt, Pseudomonas aeruginosa PA01
ccuggaucggcagcuc

SEQ ID NO: 3526097 - RNA, 13 nt, Pseudomonas aeruginosa PA01
ccuggaucuccug

SEQ ID NO: 3526098 - RNA, 15 nt, Pseudomonas aeruginosa PA01
ccuggaucucugcga

SEQ ID NO: 3526099 - RNA, 17 nt, Pseudomonas aeruginosa PA01
ccuggaugaucgcgugg

SEQ ID NO: 3526100 - RNA, 17 nt, Pseudomonas aeruginosa PA01
ccuggaugaucucgcag

SEQ ID NO: 3526101 - RNA, 20 nt, Pseudomonas aeruginosa PA01
ccuggaugaucucgcaguac

SEQ ID NO: 3526102 - RNA, 17 nt, Pseudomonas aeruginosa PA01
ccuggaugcuccgcgcc

SEQ ID NO: 3526103 - RNA, 17 nt, Pseudomonas aeruginosa PA01
ccuggauggugcccggg

SEQ ID NO: 3526104 - RNA, 15 nt, Pseudomonas aeruginosa PA01
ccuggcaaccgucga

SEQ ID NO: 3526105 - RNA, 15 nt, Pseudomonas aeruginosa PA01
ccuggcagacgcugc

SEQ ID NO: 3526106 - RNA, 18 nt, Pseudomonas aeruginosa PA01
ccuggcaggcucaccgcg

SEQ ID NO: 3526107 - RNA, 19 nt, Pseudomonas aeruginosa PA01
ccuggcagguaucgcuggg

SEQ ID NO: 3526108 - RNA, 19 nt, Pseudomonas aeruginosa PA01
ccuggcauggcuuuccagg

SEQ ID NO: 3526109 - RNA, 17 nt, Pseudomonas aeruginosa PA01
ccuggccaauccacaaa

SEQ ID NO: 3526110 - RNA, 13 nt, Pseudomonas aeruginosa PA01
ccuggccacccuu

SEQ ID NO: 3526111 - RNA, 14 nt, Pseudomonas aeruginosa PA01
ccuggccacccuug

SEQ ID NO: 3526112 - RNA, 16 nt, Pseudomonas aeruginosa PA01
ccuggccacgcccggu

SEQ ID NO: 3526113 - RNA, 18 nt, Pseudomonas aeruginosa PA01
ccuggccagcgucgccug

SEQ ID NO: 3526114 - RNA, 21 nt, Pseudomonas aeruginosa PA01
ccuggccagcgucgccugcca

SEQ ID NO: 3526115 - RNA, 13 nt, Pseudomonas aeruginosa PA01
ccuggccaggcgc

SEQ ID NO: 3526116 - RNA, 14 nt, Pseudomonas aeruginosa PA01
ccuggccaggcgcu

SEQ ID NO: 3526117 - RNA, 21 nt, Pseudomonas aeruginosa PA01
ccuggccauucgcuucggcca

SEQ ID NO: 3526118 - RNA, 14 nt, Pseudomonas aeruginosa PA01
ccuggcccggcgca

SEQ ID NO: 3526119 - RNA, 11 nt, Pseudomonas aeruginosa PA01
ccuggcccugg

SEQ ID NO: 3526120 - RNA, 15 nt, Pseudomonas aeruginosa PA01
ccuggcccuggcgca

SEQ ID NO: 3526121 - RNA, 17 nt, Pseudomonas aeruginosa PA01
ccuggcccuggcgcagg

SEQ ID NO: 3526122 - RNA, 19 nt, Pseudomonas aeruginosa PA01
ccuggcccuggcgcaggcg

SEQ ID NO: 3526123 - RNA, 14 nt, Pseudomonas aeruginosa PA01
ccuggccgacccgc

SEQ ID NO: 3526124 - RNA, 15 nt, Pseudomonas aeruginosa PA01
ccuggccgacccgca

SEQ ID NO: 3526125 - RNA, 16 nt, Pseudomonas aeruginosa PA01
ccuggccgacccgcag

SEQ ID NO: 3526126 - RNA, 22 nt, Pseudomonas aeruginosa PA01
ccuggccgacccgcagcggcgc

SEQ ID NO: 3526127 - RNA, 12 nt, Pseudomonas aeruginosa PA01
ccuggccgacgc

SEQ ID NO: 3526128 - RNA, 13 nt, Pseudomonas aeruginosa PA01
ccuggccgagccg

SEQ ID NO: 3526129 - RNA, 16 nt, Pseudomonas aeruginosa PA01
ccuggccgccaaaguu

SEQ ID NO: 3526130 - RNA, 12 nt, Pseudomonas aeruginosa PA01
ccuggccgcgca

SEQ ID NO: 3526131 - RNA, 14 nt, Pseudomonas aeruginosa PA01
ccuggccgcgcagg

SEQ ID NO: 3526132 - RNA, 13 nt, Pseudomonas aeruginosa PA01
ccuggccgcgcgg

SEQ ID NO: 3526133 - RNA, 14 nt, Pseudomonas aeruginosa PA01
ccuggccgcgcggc

SEQ ID NO: 3526134 - RNA, 19 nt, Pseudomonas aeruginosa PA01
ccuggccgcguucgccgag

SEQ ID NO: 3526135 - RNA, 13 nt, Pseudomonas aeruginosa PA01
ccuggccgcugcc

SEQ ID NO: 3526136 - RNA, 19 nt, Pseudomonas aeruginosa PA01
ccuggcuggccagcaggcu

SEQ ID NO: 3526137 - RNA, 20 nt, Pseudomonas aeruginosa PA01
ccuggcuggccagcaggcug

SEQ ID NO: 3526138 - RNA, 16 nt, Pseudomonas aeruginosa PA01
ccuggcuuuccagggc

SEQ ID NO: 3526139 - RNA, 16 nt, Pseudomonas aeruginosa PA01
ccugggaauggcggau

SEQ ID NO: 3526140 - RNA, 19 nt, Pseudomonas aeruginosa PA01
ccugggacaggcgucccug

SEQ ID NO: 3526141 - RNA, 20 nt, Pseudomonas aeruginosa PA01
ccugggagaacuuuucccag

SEQ ID NO: 3526142 - RNA, 14 nt, Pseudomonas aeruginosa PA01
ccugggaugccggg

SEQ ID NO: 3526143 - RNA, 17 nt, Pseudomonas aeruginosa PA01
ccugggauggggcugcc

SEQ ID NO: 3526144 - RNA, 18 nt, Pseudomonas aeruginosa PA01
ccugggauggggcugccg

SEQ ID NO: 3526145 - RNA, 22 nt, Pseudomonas aeruginosa PA01
ccugggauggggcugccggccc

SEQ ID NO: 3526146 - RNA, 19 nt, Pseudomonas aeruginosa PA01
ccugggcaagcugcacggc

SEQ ID NO: 3526147 - RNA, 21 nt, Pseudomonas aeruginosa PA01
ccugggcaagcugcacggcga

SEQ ID NO: 3526148 - RNA, 23 nt, Pseudomonas aeruginosa PA01
ccugggcaagcugcacggcgacc

SEQ ID NO: 3526149 - RNA, 17 nt, Pseudomonas aeruginosa PA01
ccugggccaccuggcuc

SEQ ID NO: 3526150 - RNA, 13 nt, Pseudomonas aeruginosa PA01
ccugggccccggc

SEQ ID NO: 3526151 - RNA, 15 nt, Pseudomonas aeruginosa PA01
ccugggccccggcca

SEQ ID NO: 3526152 - RNA, 18 nt, Pseudomonas aeruginosa PA01
ccugggccccggccaggu

SEQ ID NO: 3526153 - RNA, 15 nt, Pseudomonas aeruginosa PA01
ccugggccccggccg

SEQ ID NO: 3526154 - RNA, 19 nt, Pseudomonas aeruginosa PA01
ccugggccccggccggcag

SEQ ID NO: 3526155 - RNA, 15 nt, Pseudomonas aeruginosa PA01
ccugggccgaaggcc

SEQ ID NO: 3526156 - RNA, 19 nt, Pseudomonas aeruginosa PA01
ccugggccgaaggccaggc

SEQ ID NO: 3526157 - RNA, 12 nt, Pseudomonas aeruginosa PA01
ccugggccgcga

SEQ ID NO: 3526158 - RNA, 16 nt, Pseudomonas aeruginosa PA01
ccugggccgcgagguc

SEQ ID NO: 3526159 - RNA, 12 nt, Pseudomonas aeruginosa PA01
ccugggccggcg

SEQ ID NO: 3526160 - RNA, 18 nt, Pseudomonas aeruginosa PA01
ccugggccggcgccagca

SEQ ID NO: 3526161 - RNA, 20 nt, Pseudomonas aeruginosa PA01
ccugggccggcgccagcagg

SEQ ID NO: 3526162 - RNA, 12 nt, Pseudomonas aeruginosa PA01
ccugggccggcu

SEQ ID NO: 3526163 - RNA, 13 nt, Pseudomonas aeruginosa PA01
ccugggccggcuu

SEQ ID NO: 3526164 - RNA, 15 nt, Pseudomonas aeruginosa PA01
ccugggcgaacagca

SEQ ID NO: 3526165 - RNA, 16 nt, Pseudomonas aeruginosa PA01
ccugggcgaagucgac

SEQ ID NO: 3526166 - RNA, 17 nt, Pseudomonas aeruginosa PA01
ccugggcgaagucgacg

SEQ ID NO: 3526167 - RNA, 20 nt, Pseudomonas aeruginosa PA01
ccugggcgaagucgacgauc

SEQ ID NO: 3526168 - RNA, 15 nt, Pseudomonas aeruginosa PA01
ccugggcgcaggccg

SEQ ID NO: 3526169 - RNA, 13 nt, Pseudomonas aeruginosa PA01
ccugggcgcaggg

SEQ ID NO: 3526170 - RNA, 19 nt, Pseudomonas aeruginosa PA01
ccugggcgccagccgccau

SEQ ID NO: 3526171 - RNA, 14 nt, Pseudomonas aeruginosa PA01
ccugggcgccgcca

SEQ ID NO: 3526172 - RNA, 15 nt, Pseudomonas aeruginosa PA01
ccugggcgccgccag

SEQ ID NO: 3526173 - RNA, 17 nt, Pseudomonas aeruginosa PA01
ccugggcgccgccagcc

SEQ ID NO: 3526174 - RNA, 23 nt, Pseudomonas aeruginosa PA01
ccugggcgcgaauggcauucagc

SEQ ID NO: 3526175 - RNA, 14 nt, Pseudomonas aeruginosa PA01
ccugggcggccucg

SEQ ID NO: 3526176 - RNA, 18 nt, Pseudomonas aeruginosa PA01
ccugggcggcgaccugcg

SEQ ID NO: 3526177 - RNA, 22 nt, Pseudomonas aeruginosa PA01
ccugggcggcgggcccguggca

SEQ ID NO: 3526178 - RNA, 21 nt, Pseudomonas aeruginosa PA01
ccugggcggucggcucagccg

SEQ ID NO: 3526179 - RNA, 23 nt, Pseudomonas aeruginosa PA01
ccugggcggucggcucagccgac

SEQ ID NO: 3526180 - RNA, 19 nt, Pseudomonas aeruginosa PA01
ccugggcggucucggcggg

SEQ ID NO: 3526181 - RNA, 15 nt, Pseudomonas aeruginosa PA01
ccugggcgucgacga

SEQ ID NO: 3526182 - RNA, 21 nt, Pseudomonas aeruginosa PA01
ccugggcgugcuuggcgaggc

SEQ ID NO: 3526183 - RNA, 17 nt, Pseudomonas aeruginosa PA01
ccugggcguuggccagc

SEQ ID NO: 3526184 - RNA, 18 nt, Pseudomonas aeruginosa PA01
ccugggcuucguccgccu

SEQ ID NO: 3526185 - RNA, 18 nt, Pseudomonas aeruginosa PA01
ccuggggaaucugcgcca

SEQ ID NO: 3526186 - RNA, 22 nt, Pseudomonas aeruginosa PA01
ccuggggaaucugcgccaggug

SEQ ID NO: 3526187 - RNA, 15 nt, Pseudomonas aeruginosa PA01
ccuggggacggcagg

SEQ ID NO: 3526188 - RNA, 17 nt, Pseudomonas aeruginosa PA01
ccuggggcggccucagg

SEQ ID NO: 3526189 - RNA, 17 nt, Pseudomonas aeruginosa PA01
ccugggguagccggccg

SEQ ID NO: 3526190 - RNA, 16 nt, Pseudomonas aeruginosa PA01
ccugggguuucugcug

SEQ ID NO: 3526191 - RNA, 21 nt, Pseudomonas aeruginosa PA01
ccugggguuucugcuggccac

SEQ ID NO: 3526192 - RNA, 23 nt, Pseudomonas aeruginosa PA01
ccugggguuucugcuggccaccg

SEQ ID NO: 3526193 - RNA, 21 nt, Pseudomonas aeruginosa PA01
ccuggguagauuuacaagccc

SEQ ID NO: 3526194 - RNA, 14 nt, Pseudomonas aeruginosa PA01
ccuggguauugcgg

SEQ ID NO: 3526195 - RNA, 14 nt, Pseudomonas aeruginosa PA01
ccugggucgacugc

SEQ ID NO: 3526196 - RNA, 16 nt, Pseudomonas aeruginosa PA01
ccugggucgacugcug

SEQ ID NO: 3526197 - RNA, 21 nt, Pseudomonas aeruginosa PA01
ccugggugaacagcggcccga

SEQ ID NO: 3526198 - RNA, 15 nt, Pseudomonas aeruginosa PA01
ccuggguggcgacga

SEQ ID NO: 3526199 - RNA, 20 nt, Pseudomonas aeruginosa PA01
ccuggguggucugcacggca

SEQ ID NO: 3526200 - RNA, 17 nt, Pseudomonas aeruginosa PA01
ccuggguugccgcgccg

SEQ ID NO: 3526201 - RNA, 16 nt, Pseudomonas aeruginosa PA01
ccugguacagcaccca

SEQ ID NO: 3526202 - RNA, 20 nt, Pseudomonas aeruginosa PA01
ccugguacucguccucccag

SEQ ID NO: 3526203 - RNA, 23 nt, Pseudomonas aeruginosa PA01
ccugguagaucugugcggugccg

SEQ ID NO: 3526204 - RNA, 20 nt, Pseudomonas aeruginosa PA01
ccugguagcagagggucgcc

SEQ ID NO: 3526205 - RNA, 22 nt, Pseudomonas aeruginosa PA01
ccugguagcagagggucgccag

SEQ ID NO: 3526206 - RNA, 16 nt, Pseudomonas aeruginosa PA01
ccugguaggcggcgac

SEQ ID NO: 3526207 - RNA, 19 nt, Pseudomonas aeruginosa PA01
ccugguaggcgucgucgac

SEQ ID NO: 3526208 - RNA, 17 nt, Pseudomonas aeruginosa PA01
ccugguaggugcgcugg

SEQ ID NO: 3526209 - RNA, 21 nt, Pseudomonas aeruginosa PA01
ccugguaggugcgcuggcgcc

SEQ ID NO: 3526210 - RNA, 23 nt, Pseudomonas aeruginosa PA01
ccugguaggugcgcuggcgccag

SEQ ID NO: 3526211 - RNA, 15 nt, Pseudomonas aeruginosa PA01
ccugguagucgccgg

SEQ ID NO: 3526212 - RNA, 16 nt, Pseudomonas aeruginosa PA01
ccugguagucgccggu

SEQ ID NO: 3526213 - RNA, 15 nt, Pseudomonas aeruginosa PA01
ccugguagucgcggu

SEQ ID NO: 3526214 - RNA, 18 nt, Pseudomonas aeruginosa PA01
ccugguccaaccgggcau

SEQ ID NO: 3526215 - RNA, 15 nt, Pseudomonas aeruginosa PA01
ccugguccagccagc

SEQ ID NO: 3526216 - RNA, 20 nt, Pseudomonas aeruginosa PA01
ccugguccagccagccgccu

SEQ ID NO: 3526217 - RNA, 22 nt, Pseudomonas aeruginosa PA01
ccugguccggcacuuccuuggu

SEQ ID NO: 3526218 - RNA, 22 nt, Pseudomonas aeruginosa PA01
ccuggucgauauagcccugggc

SEQ ID NO: 3526219 - RNA, 18 nt, Pseudomonas aeruginosa PA01
ccuggucgaucucgucga

SEQ ID NO: 3526220 - RNA, 20 nt, Pseudomonas aeruginosa PA01
ccuggucgaucucgucgaag

SEQ ID NO: 3526221 - RNA, 14 nt, Pseudomonas aeruginosa PA01
ccuggucgccggga

SEQ ID NO: 3526222 - RNA, 23 nt, Pseudomonas aeruginosa PA01
ccuggucgcugaggccgcccugg

SEQ ID NO: 3526223 - RNA, 13 nt, Pseudomonas aeruginosa PA01
ccuggucggcgcg

SEQ ID NO: 3526224 - RNA, 15 nt, Pseudomonas aeruginosa PA01
ccuggucggcgcggc

SEQ ID NO: 3526225 - RNA, 22 nt, Pseudomonas aeruginosa PA01
ccuggucggcgcggcgcuccag

SEQ ID NO: 3526226 - RNA, 13 nt, Pseudomonas aeruginosa PA01
ccuggucggcggc

SEQ ID NO: 3526227 - RNA, 17 nt, Pseudomonas aeruginosa PA01
ccuggucgucguagugg

SEQ ID NO: 3526228 - RNA, 17 nt, Pseudomonas aeruginosa PA01
ccuggucguugcgcgca

SEQ ID NO: 3526229 - RNA, 19 nt, Pseudomonas aeruginosa PA01
ccuggucuucgguggcggc

SEQ ID NO: 3526230 - RNA, 18 nt, Pseudomonas aeruginosa PA01
ccuggugacccggacagc

SEQ ID NO: 3526231 - RNA, 13 nt, Pseudomonas aeruginosa PA01
ccuggugcaccug

SEQ ID NO: 3526232 - RNA, 15 nt, Pseudomonas aeruginosa PA01
ccuggugcaccuggc

SEQ ID NO: 3526233 - RNA, 20 nt, Pseudomonas aeruginosa PA01
ccuggugcacgccgauggcg

SEQ ID NO: 3526234 - RNA, 15 nt, Pseudomonas aeruginosa PA01
ccuggugcacggcga

SEQ ID NO: 3526235 - RNA, 20 nt, Pseudomonas aeruginosa PA01
ccuggugcaggucgcgcggc

SEQ ID NO: 3526236 - RNA, 21 nt, Pseudomonas aeruginosa PA01
ccuggugcccgaugccgcgcc

SEQ ID NO: 3526237 - RNA, 21 nt, Pseudomonas aeruginosa PA01
ccuggugcggcaccagccagg

SEQ ID NO: 3526238 - RNA, 17 nt, Pseudomonas aeruginosa PA01
ccuuccucgcgccuuuu

SEQ ID NO: 3526239 - RNA, 13 nt, Pseudomonas aeruginosa PA01
ccuuccugcuuca

SEQ ID NO: 3526240 - RNA, 14 nt, Pseudomonas aeruginosa PA01
ccuuccugcuucag

SEQ ID NO: 3526241 - RNA, 21 nt, Pseudomonas aeruginosa PA01
ccuuccuucucgaagccgagg

SEQ ID NO: 3526242 - RNA, 18 nt, Pseudomonas aeruginosa PA01
ccuuccuugaccacggcg

SEQ ID NO: 3526243 - RNA, 20 nt, Pseudomonas aeruginosa PA01
ccuuccuugauccacucgcc

SEQ ID NO: 3526244 - RNA, 23 nt, Pseudomonas aeruginosa PA01
ccuucgaacccgcccucguggcg

SEQ ID NO: 3526245 - RNA, 14 nt, Pseudomonas aeruginosa PA01
ccuucgaagccggc

SEQ ID NO: 3526246 - RNA, 15 nt, Pseudomonas aeruginosa PA01
ccuucgaagccggca

SEQ ID NO: 3526247 - RNA, 16 nt, Pseudomonas aeruginosa PA01
ccuucgaagccggcac

SEQ ID NO: 3526248 - RNA, 17 nt, Pseudomonas aeruginosa PA01
ccuucgagcaacacaug

SEQ ID NO: 3526249 - RNA, 18 nt, Pseudomonas aeruginosa PA01
ccuucgagccuggccagg

SEQ ID NO: 3526250 - RNA, 20 nt, Pseudomonas aeruginosa PA01
ccuucgagccuggccaggcg

SEQ ID NO: 3526251 - RNA, 12 nt, Pseudomonas aeruginosa PA01
ccuucgaucacc

SEQ ID NO: 3526252 - RNA, 16 nt, Pseudomonas aeruginosa PA01
ccuucgcaaagcgagc

SEQ ID NO: 3526253 - RNA, 23 nt, Pseudomonas aeruginosa PA01
ccuucgcaaagcgagcgcccgcc

SEQ ID NO: 3526254 - RNA, 15 nt, Pseudomonas aeruginosa PA01
ccuucgccagcaggc

SEQ ID NO: 3526255 - RNA, 24 nt, Pseudomonas aeruginosa PA01
ccuucgccagcaggcucaugccca

SEQ ID NO: 3526256 - RNA, 13 nt, Pseudomonas aeruginosa PA01
ccuucgcccgcug

SEQ ID NO: 3526257 - RNA, 20 nt, Pseudomonas aeruginosa PA01
ccuucgcccgcugcgcugcc

SEQ ID NO: 3526258 - RNA, 22 nt, Pseudomonas aeruginosa PA01
ccuucgcccgcugcgcugccag

SEQ ID NO: 3526259 - RNA, 14 nt, Pseudomonas aeruginosa PA01
ccuucgcccucagc

SEQ ID NO: 3526260 - RNA, 14 nt, Pseudomonas aeruginosa PA01
ccuucgcccugcgu

SEQ ID NO: 3526261 - RNA, 14 nt, Pseudomonas aeruginosa PA01
ccuucgccgaccag

SEQ ID NO: 3526262 - RNA, 17 nt, Pseudomonas aeruginosa PA01
ccuucgccggaagcuuc

SEQ ID NO: 3526263 - RNA, 16 nt, Pseudomonas aeruginosa PA01
ccuucgcgcucgacga

SEQ ID NO: 3526264 - RNA, 15 nt, Pseudomonas aeruginosa PA01
ccuucgcggcggcgc

SEQ ID NO: 3526265 - RNA, 15 nt, Pseudomonas aeruginosa PA01
ccuucgcgggccagg

SEQ ID NO: 3526266 - RNA, 16 nt, Pseudomonas aeruginosa PA01
ccuucgcgggccaggc

SEQ ID NO: 3526267 - RNA, 15 nt, Pseudomonas aeruginosa PA01
ccuucgcguucgcuc

SEQ ID NO: 3526268 - RNA, 19 nt, Pseudomonas aeruginosa PA01
ccuucggaucggucagcga

SEQ ID NO: 3526269 - RNA, 18 nt, Pseudomonas aeruginosa PA01
ccuucggcaggaccucgg

SEQ ID NO: 3526270 - RNA, 12 nt, Pseudomonas aeruginosa PA01
ccuucggcgaca

SEQ ID NO: 3526271 - RNA, 19 nt, Pseudomonas aeruginosa PA01
ccuucggcgacacagacgc

SEQ ID NO: 3526272 - RNA, 20 nt, Pseudomonas aeruginosa PA01
ccuucggcgcucuucagcac

SEQ ID NO: 3526273 - RNA, 21 nt, Pseudomonas aeruginosa PA01
ccuucggcgcucuucagcacg

SEQ ID NO: 3526274 - RNA, 15 nt, Pseudomonas aeruginosa PA01
ccuucggcggccggg

SEQ ID NO: 3526275 - RNA, 16 nt, Pseudomonas aeruginosa PA01
ccuucgguaccugguc

SEQ ID NO: 3526276 - RNA, 19 nt, Pseudomonas aeruginosa PA01
ccuucgguggcgaccagga

SEQ ID NO: 3526277 - RNA, 17 nt, Pseudomonas aeruginosa PA01
ccuucguccaugcucgc

SEQ ID NO: 3526278 - RNA, 19 nt, Pseudomonas aeruginosa PA01
ccuucguccucguggcgcg

SEQ ID NO: 3526279 - RNA, 21 nt, Pseudomonas aeruginosa PA01
ccuucgucgcuggggugcaga

SEQ ID NO: 3526280 - RNA, 15 nt, Pseudomonas aeruginosa PA01
ccuucgucggcuucu

SEQ ID NO: 3526281 - RNA, 16 nt, Pseudomonas aeruginosa PA01
ccuucgugggccugcu

SEQ ID NO: 3526282 - RNA, 19 nt, Pseudomonas aeruginosa PA01
ccuucucccuucagggaga

SEQ ID NO: 3526283 - RNA, 19 nt, Pseudomonas aeruginosa PA01
ccuucuccggggcccggca

SEQ ID NO: 3526284 - RNA, 23 nt, Pseudomonas aeruginosa PA01
ccuucuccggggcccggcaggca

SEQ ID NO: 3526285 - RNA, 15 nt, Pseudomonas aeruginosa PA01
ccuucucgucgccgc

SEQ ID NO: 3526286 - RNA, 19 nt, Pseudomonas aeruginosa PA01
ccuucucgucgccgcccgg

SEQ ID NO: 3526287 - RNA, 22 nt, Pseudomonas aeruginosa PA01
ccuucucgucgccgcccggcag

SEQ ID NO: 3526288 - RNA, 12 nt, Pseudomonas aeruginosa PA01
ccuucugcaccg

SEQ ID NO: 3526289 - RNA, 18 nt, Pseudomonas aeruginosa PA01
ccuucugcaccgugcgcg

SEQ ID NO: 3526290 - RNA, 18 nt, Pseudomonas aeruginosa PA01
ccuucugcaccuuggcca

SEQ ID NO: 3526291 - RNA, 12 nt, Pseudomonas aeruginosa PA01
ccuucuugcugc

SEQ ID NO: 3526292 - RNA, 20 nt, Pseudomonas aeruginosa PA01
ccuucuugcugccggcgucc

SEQ ID NO: 3526293 - RNA, 22 nt, Pseudomonas aeruginosa PA01
ccuucuuuuauacccggcgccc

SEQ ID NO: 3526294 - RNA, 19 nt, Pseudomonas aeruginosa PA01
ccuucuuuuuuucaccgcu

SEQ ID NO: 3526295 - RNA, 19 nt, Pseudomonas aeruginosa PA01
ccuugaaaccggcgaacca

SEQ ID NO: 3526296 - RNA, 16 nt, Pseudomonas aeruginosa PA01
ccuugaacucgcccgg

SEQ ID NO: 3526297 - RNA, 17 nt, Pseudomonas aeruginosa PA01
ccuugaacucgcccggc

SEQ ID NO: 3526298 - RNA, 18 nt, Pseudomonas aeruginosa PA01
ccuugaacucgcccggcu

SEQ ID NO: 3526299 - RNA, 19 nt, Pseudomonas aeruginosa PA01
ccuugaagccuucgcccag

SEQ ID NO: 3526300 - RNA, 13 nt, Pseudomonas aeruginosa PA01
ccuugaagcgcuu

SEQ ID NO: 3526301 - RNA, 19 nt, Pseudomonas aeruginosa PA01
ccuugaauugcugccacuc

SEQ ID NO: 3526302 - RNA, 16 nt, Pseudomonas aeruginosa PA01
ccuugaccaccgccag

SEQ ID NO: 3526303 - RNA, 17 nt, Pseudomonas aeruginosa PA01
ccuugaccaccgccagg

SEQ ID NO: 3526304 - RNA, 19 nt, Pseudomonas aeruginosa PA01
ccuugaccaccgccaggcu

SEQ ID NO: 3526305 - RNA, 20 nt, Pseudomonas aeruginosa PA01
ccuugaccaccgccaggcug

SEQ ID NO: 3526306 - RNA, 21 nt, Pseudomonas aeruginosa PA01
ccuugaccaccgccaggcugg

SEQ ID NO: 3526307 - RNA, 15 nt, Pseudomonas aeruginosa PA01
ccuugaccagcggcc

SEQ ID NO: 3526308 - RNA, 14 nt, Pseudomonas aeruginosa PA01
ccuugaccaucuuu

SEQ ID NO: 3526309 - RNA, 19 nt, Pseudomonas aeruginosa PA01
ccuugaccaucuuuuccug

SEQ ID NO: 3526310 - RNA, 16 nt, Pseudomonas aeruginosa PA01
ccuugaccccaccggu

SEQ ID NO: 3526311 - RNA, 21 nt, Pseudomonas aeruginosa PA01
ccuugacccgguacagcgccu

SEQ ID NO: 3526312 - RNA, 18 nt, Pseudomonas aeruginosa PA01
ccuugacccucugguugg

SEQ ID NO: 3526313 - RNA, 17 nt, Pseudomonas aeruginosa PA01
ccuugacgaagccggcg

SEQ ID NO: 3526314 - RNA, 19 nt, Pseudomonas aeruginosa PA01
ccuugagcacccgggcgac

SEQ ID NO: 3526315 - RNA, 14 nt, Pseudomonas aeruginosa PA01
ccuugagcacgguc

SEQ ID NO: 3526316 - RNA, 23 nt, Pseudomonas aeruginosa PA01
ccuugagcacgucgccuucgcug

SEQ ID NO: 3526317 - RNA, 13 nt, Pseudomonas aeruginosa PA01
ccuugagcaggcg

SEQ ID NO: 3526318 - RNA, 14 nt, Pseudomonas aeruginosa PA01
ccuugagcaggcgg

SEQ ID NO: 3526319 - RNA, 20 nt, Pseudomonas aeruginosa PA01
ccuugagcaggcggccgucc

SEQ ID NO: 3526320 - RNA, 18 nt, Pseudomonas aeruginosa PA01
ccuugagcaugauggugc

SEQ ID NO: 3526321 - RNA, 23 nt, Pseudomonas aeruginosa PA01
ccuugagcaugauggugccgccg

SEQ ID NO: 3526322 - RNA, 17 nt, Pseudomonas aeruginosa PA01
ccuugagccaguccugg

SEQ ID NO: 3526323 - RNA, 22 nt, Pseudomonas aeruginosa PA01
ccuugagccaguccuggacccg

SEQ ID NO: 3526324 - RNA, 13 nt, Pseudomonas aeruginosa PA01
ccuugagcgccag

SEQ ID NO: 3526325 - RNA, 16 nt, Pseudomonas aeruginosa PA01
ccuugagcgccagcag

SEQ ID NO: 3526326 - RNA, 13 nt, Pseudomonas aeruginosa PA01
ccuugagcggcgc

SEQ ID NO: 3526327 - RNA, 15 nt, Pseudomonas aeruginosa PA01
ccuugagcggcgccc

SEQ ID NO: 3526328 - RNA, 18 nt, Pseudomonas aeruginosa PA01
ccuugagcggcgcccugg

SEQ ID NO: 3526329 - RNA, 21 nt, Pseudomonas aeruginosa PA01
ccuugagcggcgcccuggcuc

SEQ ID NO: 3526330 - RNA, 21 nt, Pseudomonas aeruginosa PA01
ccuugaggaaguugcgcagca

SEQ ID NO: 3526331 - RNA, 20 nt, Pseudomonas aeruginosa PA01
ccuugaggcgggccagcagg

SEQ ID NO: 3526332 - RNA, 22 nt, Pseudomonas aeruginosa PA01
ccuugaggcgggccagcagggu

SEQ ID NO: 3526333 - RNA, 19 nt, Pseudomonas aeruginosa PA01
ccuugaggcggguucggcg

SEQ ID NO: 3526334 - RNA, 17 nt, Pseudomonas aeruginosa PA01
ccuugagggccucggcg

SEQ ID NO: 3526335 - RNA, 16 nt, Pseudomonas aeruginosa PA01
ccuugaguagcuggcg

SEQ ID NO: 3526336 - RNA, 23 nt, Pseudomonas aeruginosa PA01
ccuugaguucccagaccuggccg

SEQ ID NO: 3526337 - RNA, 23 nt, Pseudomonas aeruginosa PA01
ccuugaucaccaccacgccgucg

SEQ ID NO: 3526338 - RNA, 15 nt, Pseudomonas aeruginosa PA01
ccuugaucagcgcgc

SEQ ID NO: 3526339 - RNA, 17 nt, Pseudomonas aeruginosa PA01
ccuugaucuuguccggg

SEQ ID NO: 3526340 - RNA, 15 nt, Pseudomonas aeruginosa PA01
ccuugucgccgcugg

SEQ ID NO: 3526341 - RNA, 18 nt, Pseudomonas aeruginosa PA01
ccuugucgccgcugggca

SEQ ID NO: 3526342 - RNA, 12 nt, Pseudomonas aeruginosa PA01
ccuugucgccgg

SEQ ID NO: 3526343 - RNA, 15 nt, Pseudomonas aeruginosa PA01
ccuugucgcgcacca

SEQ ID NO: 3526344 - RNA, 20 nt, Pseudomonas aeruginosa PA01
ccuugucgcugaccggccgc

SEQ ID NO: 3526345 - RNA, 22 nt, Pseudomonas aeruginosa PA01
ccuugucgcugaccggccgcag

SEQ ID NO: 3526346 - RNA, 21 nt, Pseudomonas aeruginosa PA01
ccuugucguuguagaacacgg

SEQ ID NO: 3526347 - RNA, 20 nt, Pseudomonas aeruginosa PA01
ccuugugcgccagcucggcc

SEQ ID NO: 3526348 - RNA, 20 nt, Pseudomonas aeruginosa PA01
ccuuguucaggguggcgacc

SEQ ID NO: 3526349 - RNA, 21 nt, Pseudomonas aeruginosa PA01
ccuuguucaggguggcgaccg

SEQ ID NO: 3526350 - RNA, 24 nt, Pseudomonas aeruginosa PA01
ccuuguucaggguggcgaccgccg

SEQ ID NO: 3526351 - RNA, 13 nt, Pseudomonas aeruginosa PA01
ccuuguucggcug

SEQ ID NO: 3526352 - RNA, 19 nt, Pseudomonas aeruginosa PA01
ccuuguugacguucugccc

SEQ ID NO: 3526353 - RNA, 12 nt, Pseudomonas aeruginosa PA01
ccuuguuuuccu

SEQ ID NO: 3526354 - RNA, 18 nt, Pseudomonas aeruginosa PA01
ccuuguuuuccuggcccu

SEQ ID NO: 3526355 - RNA, 19 nt, Pseudomonas aeruginosa PA01
ccuuucggaacagcgccuu

SEQ ID NO: 3526356 - RNA, 18 nt, Pseudomonas aeruginosa PA01
ccuuugagggucagacca

SEQ ID NO: 3526357 - RNA, 18 nt, Pseudomonas aeruginosa PA01
ccuuuucaauuccgccgc

SEQ ID NO: 3526358 - RNA, 19 nt, Pseudomonas aeruginosa PA01
ccuuuucaauuccgccgcg

SEQ ID NO: 3526359 - RNA, 20 nt, Pseudomonas aeruginosa PA01
ccuuuuccucgaucaggccu

SEQ ID NO: 3526360 - RNA, 16 nt, Pseudomonas aeruginosa PA01
ccuuuucggcacucag

SEQ ID NO: 3526361 - RNA, 20 nt, Pseudomonas aeruginosa PA01
ccuuuugacuugacccgacu

SEQ ID NO: 3526362 - RNA, 11 nt, Pseudomonas aeruginosa PA01
ccuuuuuucag

SEQ ID NO: 3526363 - RNA, 20 nt, Pseudomonas aeruginosa PA01
ccuuuuuugugcccgccccu

SEQ ID NO: 3526364 - RNA, 23 nt, Pseudomonas aeruginosa PA01
ccuuuuuugugcccgccccuuuc

SEQ ID NO: 3526365 - RNA, 17 nt, Pseudomonas aeruginosa PA01
cgaaaaaaggcgccuuc

SEQ ID NO: 3526366 - RNA, 15 nt, Pseudomonas aeruginosa PA01
cgaaaaagccccugc

SEQ ID NO: 3526367 - RNA, 18 nt, Pseudomonas aeruginosa PA01
cgaaaaagcccggcgaau

SEQ ID NO: 3526368 - RNA, 14 nt, Pseudomonas aeruginosa PA01
cgaaaaaggcgcgc

SEQ ID NO: 3526369 - RNA, 17 nt, Pseudomonas aeruginosa PA01
cgaaaaaggcgcgccgg

SEQ ID NO: 3526370 - RNA, 14 nt, Pseudomonas aeruginosa PA01
cgaaaacggcgacc

SEQ ID NO: 3526371 - RNA, 20 nt, Pseudomonas aeruginosa PA01
cgaaaagaagccccgcagcc

SEQ ID NO: 3526372 - RNA, 13 nt, Pseudomonas aeruginosa PA01
cgaaaagagccgc

SEQ ID NO: 3526373 - RNA, 14 nt, Pseudomonas aeruginosa PA01
cgaaaagagccgcg

SEQ ID NO: 3526374 - RNA, 18 nt, Pseudomonas aeruginosa PA01
cgaaaagagccgcgccuu

SEQ ID NO: 3526375 - RNA, 14 nt, Pseudomonas aeruginosa PA01
cgaaaagccgcccc

SEQ ID NO: 3526376 - RNA, 21 nt, Pseudomonas aeruginosa PA01
cgaaaagcgguuucgccaccu

SEQ ID NO: 3526377 - RNA, 18 nt, Pseudomonas aeruginosa PA01
cgaaaauaacgcuugacg

SEQ ID NO: 3526378 - RNA, 18 nt, Pseudomonas aeruginosa PA01
cgaaacagggcgaccaga

SEQ ID NO: 3526379 - RNA, 23 nt, Pseudomonas aeruginosa PA01
cgaaaccaggaucgaacuggcca

SEQ ID NO: 3526380 - RNA, 15 nt, Pseudomonas aeruginosa PA01
cgaaaccggccagcg

SEQ ID NO: 3526381 - RNA, 17 nt, Pseudomonas aeruginosa PA01
cgaaaccggccagcgcg

SEQ ID NO: 3526382 - RNA, 21 nt, Pseudomonas aeruginosa PA01
cgaaaccggccagcgcggcgg

SEQ ID NO: 3526383 - RNA, 21 nt, Pseudomonas aeruginosa PA01
cgaaaccggcgaugcucagcg

SEQ ID NO: 3526384 - RNA, 12 nt, Pseudomonas aeruginosa PA01
cgaaacgccccg

SEQ ID NO: 3526385 - RNA, 15 nt, Pseudomonas aeruginosa PA01
cgaaacgcuggcggc

SEQ ID NO: 3526386 - RNA, 12 nt, Pseudomonas aeruginosa PA01
cgaaacggcagg

SEQ ID NO: 3526387 - RNA, 15 nt, Pseudomonas aeruginosa PA01
cgaaacgggcgcucu

SEQ ID NO: 3526388 - RNA, 17 nt, Pseudomonas aeruginosa PA01
cgaaacgggcgcucugg

SEQ ID NO: 3526389 - RNA, 23 nt, Pseudomonas aeruginosa PA01
cgaaacgggcgcucuggccgcgc

SEQ ID NO: 3526390 - RNA, 17 nt, Pseudomonas aeruginosa PA01
cgaaacgguagcccgcg

SEQ ID NO: 3526391 - RNA, 15 nt, Pseudomonas aeruginosa PA01
cgaaagaagccgcac

SEQ ID NO: 3526392 - RNA, 20 nt, Pseudomonas aeruginosa PA01
cgaaagacgcugcgaccugg

SEQ ID NO: 3526393 - RNA, 16 nt, Pseudomonas aeruginosa PA01
cgaaagccaugcccag

SEQ ID NO: 3526394 - RNA, 17 nt, Pseudomonas aeruginosa PA01
cgaaagccaugcccaga

SEQ ID NO: 3526395 - RNA, 14 nt, Pseudomonas aeruginosa PA01
cgaaagccgaagcg

SEQ ID NO: 3526396 - RNA, 19 nt, Pseudomonas aeruginosa PA01
cgaaagccgccgccgcgcc

SEQ ID NO: 3526397 - RNA, 22 nt, Pseudomonas aeruginosa PA01
cgaaagccgccgccgcgccggc

SEQ ID NO: 3526398 - RNA, 14 nt, Pseudomonas aeruginosa PA01
cgaaagccuccagc

SEQ ID NO: 3526399 - RNA, 17 nt, Pseudomonas aeruginosa PA01
cgaaagccugccgggca

SEQ ID NO: 3526400 - RNA, 14 nt, Pseudomonas aeruginosa PA01
cgaaagcgccccgg

SEQ ID NO: 3526401 - RNA, 12 nt, Pseudomonas aeruginosa PA01
cgaaagcggugc

SEQ ID NO: 3526402 - RNA, 13 nt, Pseudomonas aeruginosa PA01
cgaaagcggugcc

SEQ ID NO: 3526403 - RNA, 15 nt, Pseudomonas aeruginosa PA01
cgaaagcgucagcgc

SEQ ID NO: 3526404 - RNA, 19 nt, Pseudomonas aeruginosa PA01
cgaaagcgucagcgcgcca

SEQ ID NO: 3526405 - RNA, 21 nt, Pseudomonas aeruginosa PA01
cgaaagcgucagcgcgccagc

SEQ ID NO: 3526406 - RNA, 17 nt, Pseudomonas aeruginosa PA01
cgaaagcuucgucgcgc

SEQ ID NO: 3526407 - RNA, 19 nt, Pseudomonas aeruginosa PA01
cgaaagcuucgucgcgcag

SEQ ID NO: 3526408 - RNA, 16 nt, Pseudomonas aeruginosa PA01
cgaaauacucgucgac

SEQ ID NO: 3526409 - RNA, 18 nt, Pseudomonas aeruginosa PA01
cgaaauacucgucgacgg

SEQ ID NO: 3526410 - RNA, 21 nt, Pseudomonas aeruginosa PA01
cgaaauacucgucgacggccu

SEQ ID NO: 3526411 - RNA, 20 nt, Pseudomonas aeruginosa PA01
cgaaauagucgcgggccugg

SEQ ID NO: 3526412 - RNA, 18 nt, Pseudomonas aeruginosa PA01
cgaaauccucgcgcaccg

SEQ ID NO: 3526413 - RNA, 16 nt, Pseudomonas aeruginosa PA01
cgaaaucggcaggcug

SEQ ID NO: 3526414 - RNA, 22 nt, Pseudomonas aeruginosa PA01
cgaaaugcucgugcagguagcc

SEQ ID NO: 3526415 - RNA, 17 nt, Pseudomonas aeruginosa PA01
cgaaauggguucccagc

SEQ ID NO: 3526416 - RNA, 21 nt, Pseudomonas aeruginosa PA01
cgaaauggguucccagcagca

SEQ ID NO: 3526417 - RNA, 16 nt, Pseudomonas aeruginosa PA01
cgaacaacccgccagc

SEQ ID NO: 3526418 - RNA, 15 nt, Pseudomonas aeruginosa PA01
cgaacaacgccgccg

SEQ ID NO: 3526419 - RNA, 16 nt, Pseudomonas aeruginosa PA01
cgaacaacgccgccgg

SEQ ID NO: 3526420 - RNA, 15 nt, Pseudomonas aeruginosa PA01
cgaacaaucccagcu

SEQ ID NO: 3526421 - RNA, 16 nt, Pseudomonas aeruginosa PA01
cgaacaaucggucgcc

SEQ ID NO: 3526422 - RNA, 17 nt, Pseudomonas aeruginosa PA01
cgaacaaucggucgccc

SEQ ID NO: 3526423 - RNA, 18 nt, Pseudomonas aeruginosa PA01
cgaacaaucggucgcccu

SEQ ID NO: 3526424 - RNA, 15 nt, Pseudomonas aeruginosa PA01
cgaacacaccgaccg

SEQ ID NO: 3526425 - RNA, 15 nt, Pseudomonas aeruginosa PA01
cgaacaccaggcgcc

SEQ ID NO: 3526426 - RNA, 18 nt, Pseudomonas aeruginosa PA01
cgaacaccaggcgccagg

SEQ ID NO: 3526427 - RNA, 15 nt, Pseudomonas aeruginosa PA01
cgaacaccggcgccg

SEQ ID NO: 3526428 - RNA, 18 nt, Pseudomonas aeruginosa PA01
cgaacaccggcgccgccu

SEQ ID NO: 3526429 - RNA, 17 nt, Pseudomonas aeruginosa PA01
cgaacaccgggccgccg

SEQ ID NO: 3526430 - RNA, 18 nt, Pseudomonas aeruginosa PA01
cgaacaccgggccgccgg

SEQ ID NO: 3526431 - RNA, 20 nt, Pseudomonas aeruginosa PA01
cgaacaccgggccgccggcg

SEQ ID NO: 3526432 - RNA, 21 nt, Pseudomonas aeruginosa PA01
cgaacaccgggccgccggcga

SEQ ID NO: 3526433 - RNA, 17 nt, Pseudomonas aeruginosa PA01
cgaacaccugcaucacc

SEQ ID NO: 3526434 - RNA, 17 nt, Pseudomonas aeruginosa PA01
cgaacagacgcaggcag

SEQ ID NO: 3526435 - RNA, 14 nt, Pseudomonas aeruginosa PA01
cgaacagcaacacc

SEQ ID NO: 3526436 - RNA, 20 nt, Pseudomonas aeruginosa PA01
cgaacagcaacaccgcgcag

SEQ ID NO: 3526437 - RNA, 17 nt, Pseudomonas aeruginosa PA01
cgaacagcaccuuggcc

SEQ ID NO: 3526438 - RNA, 15 nt, Pseudomonas aeruginosa PA01
cgaacagcagcaagc

SEQ ID NO: 3526439 - RNA, 21 nt, Pseudomonas aeruginosa PA01
cgaacagcagcucgccgcuac

SEQ ID NO: 3526440 - RNA, 19 nt, Pseudomonas aeruginosa PA01
cgaacagcagggaggcgca

SEQ ID NO: 3526441 - RNA, 12 nt, Pseudomonas aeruginosa PA01
cgaacagccaga

SEQ ID NO: 3526442 - RNA, 13 nt, Pseudomonas aeruginosa PA01
cgaacagccagcg

SEQ ID NO: 3526443 - RNA, 20 nt, Pseudomonas aeruginosa PA01
cgaacuucaggccggcgccg

SEQ ID NO: 3526444 - RNA, 14 nt, Pseudomonas aeruginosa PA01
cgaacuucagggcu

SEQ ID NO: 3526445 - RNA, 18 nt, Pseudomonas aeruginosa PA01
cgaagaaaaggcccggcg

SEQ ID NO: 3526446 - RNA, 16 nt, Pseudomonas aeruginosa PA01
cgaagaaagccccugc

SEQ ID NO: 3526447 - RNA, 22 nt, Pseudomonas aeruginosa PA01
cgaagaacaccacgcggugcca

SEQ ID NO: 3526448 - RNA, 17 nt, Pseudomonas aeruginosa PA01
cgaagaaccacuggaug

SEQ ID NO: 3526449 - RNA, 18 nt, Pseudomonas aeruginosa PA01
cgaagaaccacuggaugg

SEQ ID NO: 3526450 - RNA, 15 nt, Pseudomonas aeruginosa PA01
cgaagaacgccagcc

SEQ ID NO: 3526451 - RNA, 21 nt, Pseudomonas aeruginosa PA01
cgaagaacucggcgcugccgg

SEQ ID NO: 3526452 - RNA, 15 nt, Pseudomonas aeruginosa PA01
cgaagaagccggccc

SEQ ID NO: 3526453 - RNA, 16 nt, Pseudomonas aeruginosa PA01
cgaagaaggcucaccg

SEQ ID NO: 3526454 - RNA, 17 nt, Pseudomonas aeruginosa PA01
cgaagaaggcucaccgg

SEQ ID NO: 3526455 - RNA, 21 nt, Pseudomonas aeruginosa PA01
cgaagaaugccuucaccggcg

SEQ ID NO: 3526456 - RNA, 13 nt, Pseudomonas aeruginosa PA01
cgaagaccaccau

SEQ ID NO: 3526457 - RNA, 20 nt, Pseudomonas aeruginosa PA01
cgaagaccaccauggucuuu

SEQ ID NO: 3526458 - RNA, 18 nt, Pseudomonas aeruginosa PA01
cgaagacccccugccgcc

SEQ ID NO: 3526459 - RNA, 20 nt, Pseudomonas aeruginosa PA01
cgaagacccccugcggcccg

SEQ ID NO: 3526460 - RNA, 17 nt, Pseudomonas aeruginosa PA01
cgaagaccuugaacucg

SEQ ID NO: 3526461 - RNA, 21 nt, Pseudomonas aeruginosa PA01
cgaagaccuugaacucgcccg

SEQ ID NO: 3526462 - RNA, 22 nt, Pseudomonas aeruginosa PA01
cgaagaccuugaacucgcccgg

SEQ ID NO: 3526463 - RNA, 12 nt, Pseudomonas aeruginosa PA01
cgaagagcaccu

SEQ ID NO: 3526464 - RNA, 17 nt, Pseudomonas aeruginosa PA01
cgaagagcuggcggccg

SEQ ID NO: 3526465 - RNA, 20 nt, Pseudomonas aeruginosa PA01
cgaagagcuggcggccgcgu

SEQ ID NO: 3526466 - RNA, 17 nt, Pseudomonas aeruginosa PA01
cgaagaggcccucggcg

SEQ ID NO: 3526467 - RNA, 22 nt, Pseudomonas aeruginosa PA01
cgaagaggcccucggcgccgag

SEQ ID NO: 3526468 - RNA, 15 nt, Pseudomonas aeruginosa PA01
cgaagauacccagcg

SEQ ID NO: 3526469 - RNA, 16 nt, Pseudomonas aeruginosa PA01
cgaagauccgcuccag

SEQ ID NO: 3526470 - RNA, 20 nt, Pseudomonas aeruginosa PA01
cgaagaucgacaggccgccg

SEQ ID NO: 3526471 - RNA, 21 nt, Pseudomonas aeruginosa PA01
cgaagaucgacaggccgccgu

SEQ ID NO: 3526472 - RNA, 20 nt, Pseudomonas aeruginosa PA01
cgaagaucucgccauggcgg

SEQ ID NO: 3526473 - RNA, 20 nt, Pseudomonas aeruginosa PA01
cgaagauuccgcugaggaug

SEQ ID NO: 3526474 - RNA, 21 nt, Pseudomonas aeruginosa PA01
cgaagauuccgcugaggaugu

SEQ ID NO: 3526475 - RNA, 15 nt, Pseudomonas aeruginosa PA01
cgaagcaauaccggu

SEQ ID NO: 3526476 - RNA, 17 nt, Pseudomonas aeruginosa PA01
cgaagcagcccagcgcu

SEQ ID NO: 3526477 - RNA, 21 nt, Pseudomonas aeruginosa PA01
cgaagcagccguauggccccu

SEQ ID NO: 3526478 - RNA, 17 nt, Pseudomonas aeruginosa PA01
cgaagccaggaagcggc

SEQ ID NO: 3526479 - RNA, 19 nt, Pseudomonas aeruginosa PA01
cgaagccaggaagcggcgg

SEQ ID NO: 3526480 - RNA, 15 nt, Pseudomonas aeruginosa PA01
cgaagcccagcgagc

SEQ ID NO: 3526481 - RNA, 14 nt, Pseudomonas aeruginosa PA01
cgaagcccagcgcc

SEQ ID NO: 3526482 - RNA, 15 nt, Pseudomonas aeruginosa PA01
cgaagcccagcgccg

SEQ ID NO: 3526483 - RNA, 16 nt, Pseudomonas aeruginosa PA01
cgaagcccagcgccgc

SEQ ID NO: 3526484 - RNA, 15 nt, Pseudomonas aeruginosa PA01
cgaagcccagcgccu

SEQ ID NO: 3526485 - RNA, 14 nt, Pseudomonas aeruginosa PA01
cgaagcccaggcug

SEQ ID NO: 3526486 - RNA, 23 nt, Pseudomonas aeruginosa PA01
cgaagcccaggcugacccggucg

SEQ ID NO: 3526487 - RNA, 17 nt, Pseudomonas aeruginosa PA01
cgaagcccaucgacugc

SEQ ID NO: 3526488 - RNA, 23 nt, Pseudomonas aeruginosa PA01
cgaagcccaucgacugcaacaga

SEQ ID NO: 3526489 - RNA, 19 nt, Pseudomonas aeruginosa PA01
cgaagcccucgcgacggca

SEQ ID NO: 3526490 - RNA, 19 nt, Pseudomonas aeruginosa PA01
cgaagcccugcaaagcggc

SEQ ID NO: 3526491 - RNA, 20 nt, Pseudomonas aeruginosa PA01
cgaagcccugcaaagcggcg

SEQ ID NO: 3526492 - RNA, 15 nt, Pseudomonas aeruginosa PA01
cgaagccgacgccga

SEQ ID NO: 3526493 - RNA, 18 nt, Pseudomonas aeruginosa PA01
cgaagccgacgccgagca

SEQ ID NO: 3526494 - RNA, 15 nt, Pseudomonas aeruginosa PA01
cgaagccgagcugcc

SEQ ID NO: 3526495 - RNA, 18 nt, Pseudomonas aeruginosa PA01
cgaagccgagcugccggg

SEQ ID NO: 3526496 - RNA, 13 nt, Pseudomonas aeruginosa PA01
cgaagccgccgcc

SEQ ID NO: 3526497 - RNA, 14 nt, Pseudomonas aeruginosa PA01
cgaagccgccgccg

SEQ ID NO: 3526498 - RNA, 15 nt, Pseudomonas aeruginosa PA01
cgaagccgcgcccgg

SEQ ID NO: 3526499 - RNA, 19 nt, Pseudomonas aeruginosa PA01
cgaagccgcuggcauucca

SEQ ID NO: 3526500 - RNA, 18 nt, Pseudomonas aeruginosa PA01
cgaagccggauucgcgca

SEQ ID NO: 3526501 - RNA, 16 nt, Pseudomonas aeruginosa PA01
cgaagccggcggcgcg

SEQ ID NO: 3526502 - RNA, 18 nt, Pseudomonas aeruginosa PA01
cgaagccggcggcgcggc

SEQ ID NO: 3526503 - RNA, 22 nt, Pseudomonas aeruginosa PA01
cgaagccguuguagaucggcag

SEQ ID NO: 3526504 - RNA, 19 nt, Pseudomonas aeruginosa PA01
cgaagcgaccgaucaugcc

SEQ ID NO: 3526505 - RNA, 18 nt, Pseudomonas aeruginosa PA01
cgaagcgacggcgcaagg

SEQ ID NO: 3526506 - RNA, 21 nt, Pseudomonas aeruginosa PA01
cgaagcgauuccaugggcaga

SEQ ID NO: 3526507 - RNA, 14 nt, Pseudomonas aeruginosa PA01
cgaagcgcagcagg

SEQ ID NO: 3526508 - RNA, 15 nt, Pseudomonas aeruginosa PA01
cgaagcgcagcaggu

SEQ ID NO: 3526509 - RNA, 22 nt, Pseudomonas aeruginosa PA01
cgaagcgcaggugcaccgcgcu

SEQ ID NO: 3526510 - RNA, 14 nt, Pseudomonas aeruginosa PA01
cgaagcgccaggcg

SEQ ID NO: 3526511 - RNA, 15 nt, Pseudomonas aeruginosa PA01
cgaagcgccaggcgu

SEQ ID NO: 3526512 - RNA, 16 nt, Pseudomonas aeruginosa PA01
cgaagcgccggcggcc

SEQ ID NO: 3526513 - RNA, 12 nt, Pseudomonas aeruginosa PA01
cgaagcgcgccu

SEQ ID NO: 3526514 - RNA, 13 nt, Pseudomonas aeruginosa PA01
cgaagcgcgccug

SEQ ID NO: 3526515 - RNA, 17 nt, Pseudomonas aeruginosa PA01
cgaagcgcgccugcucu

SEQ ID NO: 3526516 - RNA, 14 nt, Pseudomonas aeruginosa PA01
cgaagcgcucgaca

SEQ ID NO: 3526517 - RNA, 16 nt, Pseudomonas aeruginosa PA01
cgaagcgcucggucag

SEQ ID NO: 3526518 - RNA, 17 nt, Pseudomonas aeruginosa PA01
cgaagcgcuugcccagg

SEQ ID NO: 3526519 - RNA, 16 nt, Pseudomonas aeruginosa PA01
cgaagcggaagccggg

SEQ ID NO: 3526520 - RNA, 18 nt, Pseudomonas aeruginosa PA01
cgaagcggaagcgcagcc

SEQ ID NO: 3526521 - RNA, 19 nt, Pseudomonas aeruginosa PA01
cgaagcggaucucgucgcc

SEQ ID NO: 3526522 - RNA, 22 nt, Pseudomonas aeruginosa PA01
cgaagcggaucucgucgccgac

SEQ ID NO: 3526523 - RNA, 12 nt, Pseudomonas aeruginosa PA01
cgaagcggcccu

SEQ ID NO: 3526524 - RNA, 22 nt, Pseudomonas aeruginosa PA01
cgaagcggcccuugucgccgcu

SEQ ID NO: 3526525 - RNA, 16 nt, Pseudomonas aeruginosa PA01
cgaagcggcucggcca

SEQ ID NO: 3526526 - RNA, 21 nt, Pseudomonas aeruginosa PA01
cgaagcggcucggccagggcc

SEQ ID NO: 3526527 - RNA, 22 nt, Pseudomonas aeruginosa PA01
cgaagcggcucggccagggccg

SEQ ID NO: 3526528 - RNA, 18 nt, Pseudomonas aeruginosa PA01
cgaagcggcuggccgcgg

SEQ ID NO: 3526529 - RNA, 19 nt, Pseudomonas aeruginosa PA01
cgaagcggcuggccgcggu

SEQ ID NO: 3526530 - RNA, 18 nt, Pseudomonas aeruginosa PA01
cgaagcggggcuuuuucc

SEQ ID NO: 3526531 - RNA, 14 nt, Pseudomonas aeruginosa PA01
cgaagcggucgccg

SEQ ID NO: 3526532 - RNA, 21 nt, Pseudomonas aeruginosa PA01
cgaagcggucgccggcgcgca

SEQ ID NO: 3526533 - RNA, 13 nt, Pseudomonas aeruginosa PA01
cgaagcgucgaug

SEQ ID NO: 3526534 - RNA, 17 nt, Pseudomonas aeruginosa PA01
cgaagcgugggcggccg

SEQ ID NO: 3526535 - RNA, 20 nt, Pseudomonas aeruginosa PA01
cgaagcgugggcggccggcc

SEQ ID NO: 3526536 - RNA, 16 nt, Pseudomonas aeruginosa PA01
cgaagcuccagcgugc

SEQ ID NO: 3526537 - RNA, 15 nt, Pseudomonas aeruginosa PA01
cgaagcucggcgcga

SEQ ID NO: 3526538 - RNA, 16 nt, Pseudomonas aeruginosa PA01
cgaagcucucgccgcg

SEQ ID NO: 3526539 - RNA, 19 nt, Pseudomonas aeruginosa PA01
cgaagcucucgccgcgcuc

SEQ ID NO: 3526540 - RNA, 12 nt, Pseudomonas aeruginosa PA01
cgaagcuggggc

SEQ ID NO: 3526541 - RNA, 14 nt, Pseudomonas aeruginosa PA01
cgaagcugucgagc

SEQ ID NO: 3526542 - RNA, 12 nt, Pseudomonas aeruginosa PA01
cgaagcugucgg

SEQ ID NO: 3526543 - RNA, 15 nt, Pseudomonas aeruginosa PA01
cgaagcugucggccc

SEQ ID NO: 3526544 - RNA, 18 nt, Pseudomonas aeruginosa PA01
cgaagcugucggcccgcg

SEQ ID NO: 3526545 - RNA, 20 nt, Pseudomonas aeruginosa PA01
cgaagcugucggcccgcgcc

SEQ ID NO: 3526546 - RNA, 20 nt, Pseudomonas aeruginosa PA01
cgaauaccagggcucggacg

SEQ ID NO: 3526547 - RNA, 18 nt, Pseudomonas aeruginosa PA01
cgaauaccagugccgcgg

SEQ ID NO: 3526548 - RNA, 19 nt, Pseudomonas aeruginosa PA01
cgaauaccagugccgcggu

SEQ ID NO: 3526549 - RNA, 18 nt, Pseudomonas aeruginosa PA01
cgaauaccggagcgaacg

SEQ ID NO: 3526550 - RNA, 16 nt, Pseudomonas aeruginosa PA01
cgaauacugcacgccc

SEQ ID NO: 3526551 - RNA, 20 nt, Pseudomonas aeruginosa PA01
cgaauacugcacgcccaggc

SEQ ID NO: 3526552 - RNA, 14 nt, Pseudomonas aeruginosa PA01
cgaauagcgccgca

SEQ ID NO: 3526553 - RNA, 14 nt, Pseudomonas aeruginosa PA01
cgaauagcgccgcg

SEQ ID NO: 3526554 - RNA, 20 nt, Pseudomonas aeruginosa PA01
cgaaucccuuggcugcucgc

SEQ ID NO: 3526555 - RNA, 20 nt, Pseudomonas aeruginosa PA01
cgaauccgcggcccugcucg

SEQ ID NO: 3526556 - RNA, 21 nt, Pseudomonas aeruginosa PA01
cgaauccgcggcccugcucgc

SEQ ID NO: 3526557 - RNA, 17 nt, Pseudomonas aeruginosa PA01
cgaauccuccagccggc

SEQ ID NO: 3526558 - RNA, 18 nt, Pseudomonas aeruginosa PA01
cgaauccuccagccggcg

SEQ ID NO: 3526559 - RNA, 14 nt, Pseudomonas aeruginosa PA01
cgaaucgccuacca

SEQ ID NO: 3526560 - RNA, 12 nt, Pseudomonas aeruginosa PA01
cgaaucggcgca

SEQ ID NO: 3526561 - RNA, 14 nt, Pseudomonas aeruginosa PA01
cgaaucuucggcgc

SEQ ID NO: 3526562 - RNA, 15 nt, Pseudomonas aeruginosa PA01
cgaaucuucggcgcg

SEQ ID NO: 3526563 - RNA, 19 nt, Pseudomonas aeruginosa PA01
cgaaucuucggcgcgccgg

SEQ ID NO: 3526564 - RNA, 18 nt, Pseudomonas aeruginosa PA01
cgaaugagcugcucuacc

SEQ ID NO: 3526565 - RNA, 15 nt, Pseudomonas aeruginosa PA01
cgaaugcccggcagc

SEQ ID NO: 3526566 - RNA, 17 nt, Pseudomonas aeruginosa PA01
cgaaugcccggcagcgc

SEQ ID NO: 3526567 - RNA, 18 nt, Pseudomonas aeruginosa PA01
cgaaugcccggcagcgcc

SEQ ID NO: 3526568 - RNA, 19 nt, Pseudomonas aeruginosa PA01
cgaaugcccgugcgcugcg

SEQ ID NO: 3526569 - RNA, 15 nt, Pseudomonas aeruginosa PA01
cgaauggacaggcgc

SEQ ID NO: 3526570 - RNA, 22 nt, Pseudomonas aeruginosa PA01
cgaauggagggaucgcgcggcu

SEQ ID NO: 3526571 - RNA, 13 nt, Pseudomonas aeruginosa PA01
cgaauggcagcag

SEQ ID NO: 3526572 - RNA, 20 nt, Pseudomonas aeruginosa PA01
cgaauggcagcaggcacagg

SEQ ID NO: 3526573 - RNA, 19 nt, Pseudomonas aeruginosa PA01
cgaauggcauucagcucga

SEQ ID NO: 3526574 - RNA, 17 nt, Pseudomonas aeruginosa PA01
cgaauggcgccggccag

SEQ ID NO: 3526575 - RNA, 22 nt, Pseudomonas aeruginosa PA01
cgaaugguucaucuucgcgcgg

SEQ ID NO: 3526576 - RNA, 16 nt, Pseudomonas aeruginosa PA01
cgaauguccggcgacc

SEQ ID NO: 3526577 - RNA, 21 nt, Pseudomonas aeruginosa PA01
cgacaacgaaaagagccgcgc

SEQ ID NO: 3526578 - RNA, 17 nt, Pseudomonas aeruginosa PA01
cgacaagcauucagcgc

SEQ ID NO: 3526579 - RNA, 18 nt, Pseudomonas aeruginosa PA01
cgacaagcauucagcgcg

SEQ ID NO: 3526580 - RNA, 15 nt, Pseudomonas aeruginosa PA01
cgacaagccuccagc

SEQ ID NO: 3526581 - RNA, 18 nt, Pseudomonas aeruginosa PA01
cgacaaggagcgcgagcg

SEQ ID NO: 3526582 - RNA, 19 nt, Pseudomonas aeruginosa PA01
cgacaaggagcgcgagcgg

SEQ ID NO: 3526583 - RNA, 17 nt, Pseudomonas aeruginosa PA01
cgacaaggcugaggccg

SEQ ID NO: 3526584 - RNA, 14 nt, Pseudomonas aeruginosa PA01
cgacaaucagcggc

SEQ ID NO: 3526585 - RNA, 14 nt, Pseudomonas aeruginosa PA01
cgacaaucgccgag

SEQ ID NO: 3526586 - RNA, 22 nt, Pseudomonas aeruginosa PA01
cgacaaucuugucguucggccc

SEQ ID NO: 3526587 - RNA, 22 nt, Pseudomonas aeruginosa PA01
cgacacaccgacaaucgccgag

SEQ ID NO: 3526588 - RNA, 19 nt, Pseudomonas aeruginosa PA01
cgacacauggucggccagg

SEQ ID NO: 3526589 - RNA, 21 nt, Pseudomonas aeruginosa PA01
cgacaccaugcuccgccuggc

SEQ ID NO: 3526590 - RNA, 22 nt, Pseudomonas aeruginosa PA01
cgacaccaugcuccgccuggcg

SEQ ID NO: 3526591 - RNA, 15 nt, Pseudomonas aeruginosa PA01
cgacaccccggucag

SEQ ID NO: 3526592 - RNA, 18 nt, Pseudomonas aeruginosa PA01
cgacaccccggucaggcc

SEQ ID NO: 3526593 - RNA, 13 nt, Pseudomonas aeruginosa PA01
cgacacccgcgcc

SEQ ID NO: 3526594 - RNA, 17 nt, Pseudomonas aeruginosa PA01
cgacacccgcgccgccg

SEQ ID NO: 3526595 - RNA, 18 nt, Pseudomonas aeruginosa PA01
cgacacccgcgccgccgc

SEQ ID NO: 3526596 - RNA, 19 nt, Pseudomonas aeruginosa PA01
cgacacccgcgccgccgcg

SEQ ID NO: 3526597 - RNA, 20 nt, Pseudomonas aeruginosa PA01
cgacaccgaucaccuggccg

SEQ ID NO: 3526598 - RNA, 14 nt, Pseudomonas aeruginosa PA01
cgacaccgccagca

SEQ ID NO: 3526599 - RNA, 15 nt, Pseudomonas aeruginosa PA01
cgacaccgccagcac

SEQ ID NO: 3526600 - RNA, 16 nt, Pseudomonas aeruginosa PA01
cgacaccgccagcacc

SEQ ID NO: 3526601 - RNA, 17 nt, Pseudomonas aeruginosa PA01
cgacaccucgaucagcg

SEQ ID NO: 3526602 - RNA, 21 nt, Pseudomonas aeruginosa PA01
cgacaccucgaucagcgggua

SEQ ID NO: 3526603 - RNA, 20 nt, Pseudomonas aeruginosa PA01
cgacaccugcaacgcccgcg

SEQ ID NO: 3526604 - RNA, 20 nt, Pseudomonas aeruginosa PA01
cgacacgcacucauagcuca

SEQ ID NO: 3526605 - RNA, 21 nt, Pseudomonas aeruginosa PA01
cgacacgcacucauagcucag

SEQ ID NO: 3526606 - RNA, 23 nt, Pseudomonas aeruginosa PA01
cgacacgugccccaggccgaacu

SEQ ID NO: 3526607 - RNA, 16 nt, Pseudomonas aeruginosa PA01
cgacacguucaggcgu

SEQ ID NO: 3526608 - RNA, 23 nt, Pseudomonas aeruginosa PA01
cgacagauagcaggucacgcccu

SEQ ID NO: 3526609 - RNA, 15 nt, Pseudomonas aeruginosa PA01
cgacagcaccaugcc

SEQ ID NO: 3526610 - RNA, 13 nt, Pseudomonas aeruginosa PA01
cgacagcagcgcc

SEQ ID NO: 3526611 - RNA, 11 nt, Pseudomonas aeruginosa PA01
cgacagcaggu

SEQ ID NO: 3526612 - RNA, 15 nt, Pseudomonas aeruginosa PA01
cgacagcaggucgug

SEQ ID NO: 3526613 - RNA, 12 nt, Pseudomonas aeruginosa PA01
cgacagcaucug

SEQ ID NO: 3526614 - RNA, 14 nt, Pseudomonas aeruginosa PA01
cgacagcaucugcu

SEQ ID NO: 3526615 - RNA, 13 nt, Pseudomonas aeruginosa PA01
cgacagccccggc

SEQ ID NO: 3526616 - RNA, 17 nt, Pseudomonas aeruginosa PA01
cgacagccccggcccgg

SEQ ID NO: 3526617 - RNA, 18 nt, Pseudomonas aeruginosa PA01
cgacagccccggcccggu

SEQ ID NO: 3526618 - RNA, 21 nt, Pseudomonas aeruginosa PA01
cgacagccccggcccggucag

SEQ ID NO: 3526619 - RNA, 14 nt, Pseudomonas aeruginosa PA01
cgacagcgaaugcu

SEQ ID NO: 3526620 - RNA, 23 nt, Pseudomonas aeruginosa PA01
cgacagcgaaugcuugccggcgc

SEQ ID NO: 3526621 - RNA, 15 nt, Pseudomonas aeruginosa PA01
cgacagcgacucuuc

SEQ ID NO: 3526622 - RNA, 18 nt, Pseudomonas aeruginosa PA01
cgacagcggcuggcgcuu

SEQ ID NO: 3526623 - RNA, 21 nt, Pseudomonas aeruginosa PA01
cgacagcggcuggcgcuugcc

SEQ ID NO: 3526624 - RNA, 19 nt, Pseudomonas aeruginosa PA01
cgacagcgucguaguggcg

SEQ ID NO: 3526625 - RNA, 20 nt, Pseudomonas aeruginosa PA01
cgacagcgucguaguggcgc

SEQ ID NO: 3526626 - RNA, 20 nt, Pseudomonas aeruginosa PA01
cgacagcucuggggucaguu

SEQ ID NO: 3526627 - RNA, 13 nt, Pseudomonas aeruginosa PA01
cgacaggcagcgc

SEQ ID NO: 3526628 - RNA, 14 nt, Pseudomonas aeruginosa PA01
cgacaggcagcgcc

SEQ ID NO: 3526629 - RNA, 15 nt, Pseudomonas aeruginosa PA01
cgacaggcagcgccg

SEQ ID NO: 3526630 - RNA, 17 nt, Pseudomonas aeruginosa PA01
cgacaggcagcgccgcc

SEQ ID NO: 3526631 - RNA, 19 nt, Pseudomonas aeruginosa PA01
cgacaggccauucuucucc

SEQ ID NO: 3526632 - RNA, 20 nt, Pseudomonas aeruginosa PA01
cgacaggcccuugaacaggc

SEQ ID NO: 3526633 - RNA, 13 nt, Pseudomonas aeruginosa PA01
cgacaggccgacc

SEQ ID NO: 3526634 - RNA, 14 nt, Pseudomonas aeruginosa PA01
cgacaggccgacca

SEQ ID NO: 3526635 - RNA, 15 nt, Pseudomonas aeruginosa PA01
cgacaggccgaccag

SEQ ID NO: 3526636 - RNA, 19 nt, Pseudomonas aeruginosa PA01
cgacaggccgaccagcagg

SEQ ID NO: 3526637 - RNA, 20 nt, Pseudomonas aeruginosa PA01
cgacaggccgaccagcaggg

SEQ ID NO: 3526638 - RNA, 22 nt, Pseudomonas aeruginosa PA01
cgacaggccgaccagcagggcc

SEQ ID NO: 3526639 - RNA, 14 nt, Pseudomonas aeruginosa PA01
cgacaggccgccgu

SEQ ID NO: 3526640 - RNA, 19 nt, Pseudomonas aeruginosa PA01
cgacaggccggugccgccg

SEQ ID NO: 3526641 - RNA, 20 nt, Pseudomonas aeruginosa PA01
cgacaggccggugccgccgg

SEQ ID NO: 3526642 - RNA, 21 nt, Pseudomonas aeruginosa PA01
cgacaggccggugccgccggc

SEQ ID NO: 3526643 - RNA, 14 nt, Pseudomonas aeruginosa PA01
cgacaggcgaucga

SEQ ID NO: 3526644 - RNA, 18 nt, Pseudomonas aeruginosa PA01
cgacaggcgaucgacgcc

SEQ ID NO: 3526645 - RNA, 20 nt, Pseudomonas aeruginosa PA01
cgacaggcggcgggccggcg

SEQ ID NO: 3526646 - RNA, 18 nt, Pseudomonas aeruginosa PA01
cgacaggcgucuucggcg

SEQ ID NO: 3526647 - RNA, 22 nt, Pseudomonas aeruginosa PA01
cgacaggucgcuuucgcgcaga

SEQ ID NO: 3526648 - RNA, 16 nt, Pseudomonas aeruginosa PA01
cgaccaguaccaggcg

SEQ ID NO: 3526649 - RNA, 22 nt, Pseudomonas aeruginosa PA01
cgaccagucguugaagacgcuc

SEQ ID NO: 3526650 - RNA, 19 nt, Pseudomonas aeruginosa PA01
cgaccaguugcucgcuccg

SEQ ID NO: 3526651 - RNA, 20 nt, Pseudomonas aeruginosa PA01
cgaccaguugcucgcuccga

SEQ ID NO: 3526652 - RNA, 13 nt, Pseudomonas aeruginosa PA01
cgaccaucaccag

SEQ ID NO: 3526653 - RNA, 14 nt, Pseudomonas aeruginosa PA01
cgaccaucauccgc

SEQ ID NO: 3526654 - RNA, 16 nt, Pseudomonas aeruginosa PA01
cgaccaucauccgcgu

SEQ ID NO: 3526655 - RNA, 21 nt, Pseudomonas aeruginosa PA01
cgaccaucauccgcguggcga

SEQ ID NO: 3526656 - RNA, 15 nt, Pseudomonas aeruginosa PA01
cgaccauccagccug

SEQ ID NO: 3526657 - RNA, 16 nt, Pseudomonas aeruginosa PA01
cgaccauccagccugc

SEQ ID NO: 3526658 - RNA, 19 nt, Pseudomonas aeruginosa PA01
cgaccauccagccugcgcu

SEQ ID NO: 3526659 - RNA, 14 nt, Pseudomonas aeruginosa PA01
cgaccaucggcggc

SEQ ID NO: 3526660 - RNA, 15 nt, Pseudomonas aeruginosa PA01
cgaccaucggcggcg

SEQ ID NO: 3526661 - RNA, 21 nt, Pseudomonas aeruginosa PA01
cgaccaucggcggcggcccgc

SEQ ID NO: 3526662 - RNA, 22 nt, Pseudomonas aeruginosa PA01
cgaccaucggcggcggcccgca

SEQ ID NO: 3526663 - RNA, 19 nt, Pseudomonas aeruginosa PA01
cgaccaugguguuggcggc

SEQ ID NO: 3526664 - RNA, 14 nt, Pseudomonas aeruginosa PA01
cgaccauguucacc

SEQ ID NO: 3526665 - RNA, 22 nt, Pseudomonas aeruginosa PA01
cgaccauguucaccagcgcugc

SEQ ID NO: 3526666 - RNA, 23 nt, Pseudomonas aeruginosa PA01
cgaccauucaugggcgcacuccg

SEQ ID NO: 3526667 - RNA, 20 nt, Pseudomonas aeruginosa PA01
cgaccauucccacgacccgc

SEQ ID NO: 3526668 - RNA, 22 nt, Pseudomonas aeruginosa PA01
cgaccauuucccgcgagcagcc

SEQ ID NO: 3526669 - RNA, 14 nt, Pseudomonas aeruginosa PA01
cgacccagaccugc

SEQ ID NO: 3526670 - RNA, 18 nt, Pseudomonas aeruginosa PA01
cgacccagaccugccgcc

SEQ ID NO: 3526671 - RNA, 20 nt, Pseudomonas aeruginosa PA01
cgacccagagcgcgcccugc

SEQ ID NO: 3526672 - RNA, 18 nt, Pseudomonas aeruginosa PA01
cgacccagccgcacgccc

SEQ ID NO: 3526673 - RNA, 12 nt, Pseudomonas aeruginosa PA01
cgacccaggccc

SEQ ID NO: 3526674 - RNA, 15 nt, Pseudomonas aeruginosa PA01
cgacccaggcccagc

SEQ ID NO: 3526675 - RNA, 13 nt, Pseudomonas aeruginosa PA01
cgacccaggccga

SEQ ID NO: 3526676 - RNA, 17 nt, Pseudomonas aeruginosa PA01
cgacccaggccgacagc

SEQ ID NO: 3526677 - RNA, 17 nt, Pseudomonas aeruginosa PA01
cgaccccgaucaccgga

SEQ ID NO: 3526678 - RNA, 15 nt, Pseudomonas aeruginosa PA01
cgacccgcaggccgg

SEQ ID NO: 3526679 - RNA, 16 nt, Pseudomonas aeruginosa PA01
cgacccgcaggccggc

SEQ ID NO: 3526680 - RNA, 14 nt, Pseudomonas aeruginosa PA01
cgacccgcccgccg

SEQ ID NO: 3526681 - RNA, 14 nt, Pseudomonas aeruginosa PA01
cgacccgcugaagg

SEQ ID NO: 3526682 - RNA, 14 nt, Pseudomonas aeruginosa PA01
cgacccggaucaug

SEQ ID NO: 3526683 - RNA, 15 nt, Pseudomonas aeruginosa PA01
cgacccggccgacca

SEQ ID NO: 3526684 - RNA, 16 nt, Pseudomonas aeruginosa PA01
cgacccggccgaccag

SEQ ID NO: 3526685 - RNA, 16 nt, Pseudomonas aeruginosa PA01
cgacccgggucaggcc

SEQ ID NO: 3526686 - RNA, 18 nt, Pseudomonas aeruginosa PA01
cgacccgggucuggggaa

SEQ ID NO: 3526687 - RNA, 15 nt, Pseudomonas aeruginosa PA01
cgacccgguacagcc

SEQ ID NO: 3526688 - RNA, 18 nt, Pseudomonas aeruginosa PA01
cgacccgguacagccaac

SEQ ID NO: 3526689 - RNA, 18 nt, Pseudomonas aeruginosa PA01
cgacccgguuaccggcga

SEQ ID NO: 3526690 - RNA, 21 nt, Pseudomonas aeruginosa PA01
cgacccgguuaccggcgacca

SEQ ID NO: 3526691 - RNA, 22 nt, Pseudomonas aeruginosa PA01
cgacccucauggaaaccccggc

SEQ ID NO: 3526692 - RNA, 19 nt, Pseudomonas aeruginosa PA01
cgacccugcuggccggugc

SEQ ID NO: 3526693 - RNA, 12 nt, Pseudomonas aeruginosa PA01
cgacccuggccg

SEQ ID NO: 3526694 - RNA, 15 nt, Pseudomonas aeruginosa PA01
cgacccuggccgcgc

SEQ ID NO: 3526695 - RNA, 18 nt, Pseudomonas aeruginosa PA01
cgacccuggccgcgcggc

SEQ ID NO: 3526696 - RNA, 19 nt, Pseudomonas aeruginosa PA01
cgacccuggccgcgcggcu

SEQ ID NO: 3526697 - RNA, 22 nt, Pseudomonas aeruginosa PA01
cgacccuggccgcgcggcuugc

SEQ ID NO: 3526698 - RNA, 13 nt, Pseudomonas aeruginosa PA01
cgacccuggcgcc

SEQ ID NO: 3526699 - RNA, 15 nt, Pseudomonas aeruginosa PA01
cgacccuggcgccga

SEQ ID NO: 3526700 - RNA, 21 nt, Pseudomonas aeruginosa PA01
cgacccuggcgccgaccucca

SEQ ID NO: 3526701 - RNA, 19 nt, Pseudomonas aeruginosa PA01
cgacccuucaacggcgacc

SEQ ID NO: 3526702 - RNA, 15 nt, Pseudomonas aeruginosa PA01
cgaccgaacagcgcg

SEQ ID NO: 3526703 - RNA, 16 nt, Pseudomonas aeruginosa PA01
cgaccgaacagcgcgc

SEQ ID NO: 3526704 - RNA, 17 nt, Pseudomonas aeruginosa PA01
cgaccgaacagcgcgcc

SEQ ID NO: 3526705 - RNA, 15 nt, Pseudomonas aeruginosa PA01
cgaccgaagccgcgc

SEQ ID NO: 3526706 - RNA, 17 nt, Pseudomonas aeruginosa PA01
cgaccgacuuggcaguc

SEQ ID NO: 3526707 - RNA, 22 nt, Pseudomonas aeruginosa PA01
cgaccgacuuggcagucgccgc

SEQ ID NO: 3526708 - RNA, 23 nt, Pseudomonas aeruginosa PA01
cgaccgacuuggcagucgccgcc

SEQ ID NO: 3526709 - RNA, 19 nt, Pseudomonas aeruginosa PA01
cgaccgagaugcucgcgca

SEQ ID NO: 3526710 - RNA, 12 nt, Pseudomonas aeruginosa PA01
cgaccgagcagc

SEQ ID NO: 3526711 - RNA, 14 nt, Pseudomonas aeruginosa PA01
cgaccgagcagcgg

SEQ ID NO: 3526712 - RNA, 14 nt, Pseudomonas aeruginosa PA01
cgaccgaucaugcc

SEQ ID NO: 3526713 - RNA, 16 nt, Pseudomonas aeruginosa PA01
cgaccgaucaugcccu

SEQ ID NO: 3526714 - RNA, 15 nt, Pseudomonas aeruginosa PA01
cgaccgcaccgccag

SEQ ID NO: 3526715 - RNA, 16 nt, Pseudomonas aeruginosa PA01
cgaccgcaucguuggc

SEQ ID NO: 3526716 - RNA, 21 nt, Pseudomonas aeruginosa PA01
cgaccgcaucguuggcgccgu

SEQ ID NO: 3526717 - RNA, 19 nt, Pseudomonas aeruginosa PA01
cgaccgccaggcggccgcu

SEQ ID NO: 3526718 - RNA, 12 nt, Pseudomonas aeruginosa PA01
cgaccgcccagg

SEQ ID NO: 3526719 - RNA, 13 nt, Pseudomonas aeruginosa PA01
cgaccgcccaggc

SEQ ID NO: 3526720 - RNA, 14 nt, Pseudomonas aeruginosa PA01
cgaccgcccaggcu

SEQ ID NO: 3526721 - RNA, 15 nt, Pseudomonas aeruginosa PA01
cgaccgcccaggcug

SEQ ID NO: 3526722 - RNA, 16 nt, Pseudomonas aeruginosa PA01
cgaccgcccaggcugc

SEQ ID NO: 3526723 - RNA, 20 nt, Pseudomonas aeruginosa PA01
cgaccgcccaggcugccgcc

SEQ ID NO: 3526724 - RNA, 21 nt, Pseudomonas aeruginosa PA01
cgaccgcccaggcugccgccg

SEQ ID NO: 3526725 - RNA, 22 nt, Pseudomonas aeruginosa PA01
cgaccgcccgccucaggccggg

SEQ ID NO: 3526726 - RNA, 17 nt, Pseudomonas aeruginosa PA01
cgaccgccugccagacc

SEQ ID NO: 3526727 - RNA, 14 nt, Pseudomonas aeruginosa PA01
cgaccgccugcucg

SEQ ID NO: 3526728 - RNA, 15 nt, Pseudomonas aeruginosa PA01
cgaccgccugcucgc

SEQ ID NO: 3526729 - RNA, 17 nt, Pseudomonas aeruginosa PA01
cgaccgccugcucgcgg

SEQ ID NO: 3526730 - RNA, 18 nt, Pseudomonas aeruginosa PA01
cgaccgccugcucgcggc

SEQ ID NO: 3526731 - RNA, 21 nt, Pseudomonas aeruginosa PA01
cgaccgccugcucgcggcugg

SEQ ID NO: 3526732 - RNA, 16 nt, Pseudomonas aeruginosa PA01
cgaccgcgaguucgcc

SEQ ID NO: 3526733 - RNA, 20 nt, Pseudomonas aeruginosa PA01
cgaccgcgaguucgccggcc

SEQ ID NO: 3526734 - RNA, 21 nt, Pseudomonas aeruginosa PA01
cgaccgcgaguucgccggcca

SEQ ID NO: 3526735 - RNA, 23 nt, Pseudomonas aeruginosa PA01
cgaccgcgaguucgccggccagg

SEQ ID NO: 3526736 - RNA, 14 nt, Pseudomonas aeruginosa PA01
cgaccgcgccggcg

SEQ ID NO: 3526737 - RNA, 17 nt, Pseudomonas aeruginosa PA01
cgaccgcgccggcgaua

SEQ ID NO: 3526738 - RNA, 23 nt, Pseudomonas aeruginosa PA01
cgaccgcgcgcauggucgcgcug

SEQ ID NO: 3526739 - RNA, 18 nt, Pseudomonas aeruginosa PA01
cgaccgcgcgccugcaac

SEQ ID NO: 3526740 - RNA, 19 nt, Pseudomonas aeruginosa PA01
cgaccgcguccaugccgua

SEQ ID NO: 3526741 - RNA, 23 nt, Pseudomonas aeruginosa PA01
cgaccggaaucacgucgaucugc

SEQ ID NO: 3526742 - RNA, 18 nt, Pseudomonas aeruginosa PA01
cgaccggauggcucaugg

SEQ ID NO: 3526743 - RNA, 20 nt, Pseudomonas aeruginosa PA01
cgaccggcagucccugccag

SEQ ID NO: 3526744 - RNA, 20 nt, Pseudomonas aeruginosa PA01
cgaccggccuuuuucauggg

SEQ ID NO: 3526745 - RNA, 21 nt, Pseudomonas aeruginosa PA01
cgaccggccuuuuucaugggu

SEQ ID NO: 3526746 - RNA, 15 nt, Pseudomonas aeruginosa PA01
cgaccggcgccggga

SEQ ID NO: 3526747 - RNA, 18 nt, Pseudomonas aeruginosa PA01
cgaccgggcaugccgugg

SEQ ID NO: 3526748 - RNA, 19 nt, Pseudomonas aeruginosa PA01
cgaccgggcgggucuggcg

SEQ ID NO: 3526749 - RNA, 19 nt, Pseudomonas aeruginosa PA01
cgaccggggaguucgaccc

SEQ ID NO: 3526750 - RNA, 17 nt, Pseudomonas aeruginosa PA01
cgacgaagugaccgcgc

SEQ ID NO: 3526751 - RNA, 19 nt, Pseudomonas aeruginosa PA01
cgacgaagugaccgcgcgc

SEQ ID NO: 3526752 - RNA, 19 nt, Pseudomonas aeruginosa PA01
cgacgacaccugcaacgcc

SEQ ID NO: 3526753 - RNA, 18 nt, Pseudomonas aeruginosa PA01
cgacgacaguaccuucca

SEQ ID NO: 3526754 - RNA, 18 nt, Pseudomonas aeruginosa PA01
cgacgacgaaaggccgcg

SEQ ID NO: 3526755 - RNA, 20 nt, Pseudomonas aeruginosa PA01
cgacgacgaaaggccgcgcc

SEQ ID NO: 3526756 - RNA, 21 nt, Pseudomonas aeruginosa PA01
cgacgacgaaaggccgcgccg

SEQ ID NO: 3526757 - RNA, 15 nt, Pseudomonas aeruginosa PA01
cgacgacgaucccgg

SEQ ID NO: 3526758 - RNA, 13 nt, Pseudomonas aeruginosa PA01
cgacgacgggagc

SEQ ID NO: 3526759 - RNA, 13 nt, Pseudomonas aeruginosa PA01
cgacgacugcggc

SEQ ID NO: 3526760 - RNA, 16 nt, Pseudomonas aeruginosa PA01
cgacgacugcggcagc

SEQ ID NO: 3526761 - RNA, 20 nt, Pseudomonas aeruginosa PA01
cgacgagaaaaagcccggca

SEQ ID NO: 3526762 - RNA, 21 nt, Pseudomonas aeruginosa PA01
cgacgagacguugacgaucgc

SEQ ID NO: 3526763 - RNA, 20 nt, Pseudomonas aeruginosa PA01
cgacgagauugaugaagcgc

SEQ ID NO: 3526764 - RNA, 22 nt, Pseudomonas aeruginosa PA01
cgacgagauugaugaagcgcug

SEQ ID NO: 3526765 - RNA, 15 nt, Pseudomonas aeruginosa PA01
cgacgagcagcucgc

SEQ ID NO: 3526766 - RNA, 17 nt, Pseudomonas aeruginosa PA01
cgacgagcagcucgccg

SEQ ID NO: 3526767 - RNA, 18 nt, Pseudomonas aeruginosa PA01
cgacgagcagcucgccgg

SEQ ID NO: 3526768 - RNA, 19 nt, Pseudomonas aeruginosa PA01
cgacgagcagcucgccggc

SEQ ID NO: 3526769 - RNA, 19 nt, Pseudomonas aeruginosa PA01
cgacgaggaacgccucgca

SEQ ID NO: 3526770 - RNA, 22 nt, Pseudomonas aeruginosa PA01
cgacgaggaacgccucgcagag

SEQ ID NO: 3526771 - RNA, 13 nt, Pseudomonas aeruginosa PA01
cgacgaggccugg

SEQ ID NO: 3526772 - RNA, 14 nt, Pseudomonas aeruginosa PA01
cgacgaggcgcggc

SEQ ID NO: 3526773 - RNA, 15 nt, Pseudomonas aeruginosa PA01
cgacgaggcgcggcg

SEQ ID NO: 3526774 - RNA, 16 nt, Pseudomonas aeruginosa PA01
cgacgaggcgcggcgg

SEQ ID NO: 3526775 - RNA, 17 nt, Pseudomonas aeruginosa PA01
cgacgaggcgcggcgga

SEQ ID NO: 3526776 - RNA, 22 nt, Pseudomonas aeruginosa PA01
cgacgagguugcucugggcaug

SEQ ID NO: 3526777 - RNA, 19 nt, Pseudomonas aeruginosa PA01
cgacgaguaaaacggcagg

SEQ ID NO: 3526778 - RNA, 15 nt, Pseudomonas aeruginosa PA01
cgacgauauccacgc

SEQ ID NO: 3526779 - RNA, 23 nt, Pseudomonas aeruginosa PA01
cgacgauauccacgccgucgcac

SEQ ID NO: 3526780 - RNA, 22 nt, Pseudomonas aeruginosa PA01
cgacgaucacccccagcgagcc

SEQ ID NO: 3526781 - RNA, 14 nt, Pseudomonas aeruginosa PA01
cgacgaucagcccg

SEQ ID NO: 3526782 - RNA, 21 nt, Pseudomonas aeruginosa PA01
cgacgaucagcccgccggcga

SEQ ID NO: 3526783 - RNA, 24 nt, Pseudomonas aeruginosa PA01
cgacgaucagcccgccggcgaugc

SEQ ID NO: 3526784 - RNA, 15 nt, Pseudomonas aeruginosa PA01
cgacgaucucaucgc

SEQ ID NO: 3526785 - RNA, 16 nt, Pseudomonas aeruginosa PA01
cgacgaucucaucgcc

SEQ ID NO: 3526786 - RNA, 21 nt, Pseudomonas aeruginosa PA01
cgacgaucucaucgcccauga

SEQ ID NO: 3526787 - RNA, 23 nt, Pseudomonas aeruginosa PA01
cgacgaucugucgauaccagcgc

SEQ ID NO: 3526788 - RNA, 20 nt, Pseudomonas aeruginosa PA01
cgacgaugccgccgccgccc

SEQ ID NO: 3526789 - RNA, 14 nt, Pseudomonas aeruginosa PA01
cgacgaugcgcccc

SEQ ID NO: 3526790 - RNA, 20 nt, Pseudomonas aeruginosa PA01
cgacgaugcgccccagcgcc

SEQ ID NO: 3526791 - RNA, 21 nt, Pseudomonas aeruginosa PA01
cgacgaugggcacgaucugcg

SEQ ID NO: 3526792 - RNA, 18 nt, Pseudomonas aeruginosa PA01
cgacgauguucgaggcgc

SEQ ID NO: 3526793 - RNA, 21 nt, Pseudomonas aeruginosa PA01
cgacgauguucgaggcgccga

SEQ ID NO: 3526794 - RNA, 22 nt, Pseudomonas aeruginosa PA01
cgacgauguucuccacgucguc

SEQ ID NO: 3526795 - RNA, 23 nt, Pseudomonas aeruginosa PA01
cgacgauguuguugcccaccagc

SEQ ID NO: 3526796 - RNA, 22 nt, Pseudomonas aeruginosa PA01
cgacgcacaccgucgaaccagc

SEQ ID NO: 3526797 - RNA, 19 nt, Pseudomonas aeruginosa PA01
cgacgcacucauagcucag

SEQ ID NO: 3526798 - RNA, 22 nt, Pseudomonas aeruginosa PA01
cgacgcacucauagcucagcug

SEQ ID NO: 3526799 - RNA, 16 nt, Pseudomonas aeruginosa PA01
cgacgcagagcgccau

SEQ ID NO: 3526800 - RNA, 15 nt, Pseudomonas aeruginosa PA01
cgacgcagcacggcg

SEQ ID NO: 3526801 - RNA, 16 nt, Pseudomonas aeruginosa PA01
cgacgcagcacggcgg

SEQ ID NO: 3526802 - RNA, 20 nt, Pseudomonas aeruginosa PA01
cgacgcagccgggccgcagc

SEQ ID NO: 3526803 - RNA, 12 nt, Pseudomonas aeruginosa PA01
cgacgcagcgcg

SEQ ID NO: 3526804 - RNA, 15 nt, Pseudomonas aeruginosa PA01
cgacgcagcgcgcgc

SEQ ID NO: 3526805 - RNA, 16 nt, Pseudomonas aeruginosa PA01
cgacgcagcgcgcgcc

SEQ ID NO: 3526806 - RNA, 19 nt, Pseudomonas aeruginosa PA01
cgacgcagcgcgcgccgag

SEQ ID NO: 3526807 - RNA, 20 nt, Pseudomonas aeruginosa PA01
cgacgcagcgcgcgccgagc

SEQ ID NO: 3526808 - RNA, 13 nt, Pseudomonas aeruginosa PA01
cgacgcagggcgg

SEQ ID NO: 3526809 - RNA, 17 nt, Pseudomonas aeruginosa PA01
cgacgcagggcggcgcc

SEQ ID NO: 3526810 - RNA, 20 nt, Pseudomonas aeruginosa PA01
cgacgcagggcggcgccugg

SEQ ID NO: 3526811 - RNA, 14 nt, Pseudomonas aeruginosa PA01
cgacgcauggauca

SEQ ID NO: 3526812 - RNA, 17 nt, Pseudomonas aeruginosa PA01
cgacgcauggaucaugg

SEQ ID NO: 3526813 - RNA, 13 nt, Pseudomonas aeruginosa PA01
cgacgccaccagc

SEQ ID NO: 3526814 - RNA, 19 nt, Pseudomonas aeruginosa PA01
cgacgccaccagccaggcg

SEQ ID NO: 3526815 - RNA, 22 nt, Pseudomonas aeruginosa PA01
cgacgccacccgcaucgaggcc

SEQ ID NO: 3526816 - RNA, 13 nt, Pseudomonas aeruginosa PA01
cgacgccagcggc

SEQ ID NO: 3526817 - RNA, 15 nt, Pseudomonas aeruginosa PA01
cgacgccagcggcga

SEQ ID NO: 3526818 - RNA, 22 nt, Pseudomonas aeruginosa PA01
cgacgccagcggcgaucgccug

SEQ ID NO: 3526819 - RNA, 16 nt, Pseudomonas aeruginosa PA01
cgacgccagcucggcc

SEQ ID NO: 3526820 - RNA, 18 nt, Pseudomonas aeruginosa PA01
cgacgccagcucggccgg

SEQ ID NO: 3526821 - RNA, 22 nt, Pseudomonas aeruginosa PA01
cgacgccagcucggccggcagg

SEQ ID NO: 3526822 - RNA, 14 nt, Pseudomonas aeruginosa PA01
cgacgccauggcgc

SEQ ID NO: 3526823 - RNA, 16 nt, Pseudomonas aeruginosa PA01
cgacgccauggcgcuu

SEQ ID NO: 3526824 - RNA, 17 nt, Pseudomonas aeruginosa PA01
cgacgccauggcgcuuc

SEQ ID NO: 3526825 - RNA, 23 nt, Pseudomonas aeruginosa PA01
cgacgcccauguagaccaccagc

SEQ ID NO: 3526826 - RNA, 22 nt, Pseudomonas aeruginosa PA01
cgacgccccccacucgcguagc

SEQ ID NO: 3526827 - RNA, 14 nt, Pseudomonas aeruginosa PA01
cgacgcccgaggcg

SEQ ID NO: 3526828 - RNA, 15 nt, Pseudomonas aeruginosa PA01
cgacgcccuccagca

SEQ ID NO: 3526829 - RNA, 19 nt, Pseudomonas aeruginosa PA01
cgacgcccuccagcaccgc

SEQ ID NO: 3526830 - RNA, 20 nt, Pseudomonas aeruginosa PA01
cgacgcccuccagcaccgcc

SEQ ID NO: 3526831 - RNA, 22 nt, Pseudomonas aeruginosa PA01
cgacgcccuccagcaccgccug

SEQ ID NO: 3526832 - RNA, 23 nt, Pseudomonas aeruginosa PA01
cgacgcccuccagcaccgccugg

SEQ ID NO: 3526833 - RNA, 14 nt, Pseudomonas aeruginosa PA01
cgacgcccucggcg

SEQ ID NO: 3526834 - RNA, 18 nt, Pseudomonas aeruginosa PA01
cgacgcccucggcgacga

SEQ ID NO: 3526835 - RNA, 19 nt, Pseudomonas aeruginosa PA01
cgacgcccuugcggcgcgg

SEQ ID NO: 3526836 - RNA, 22 nt, Pseudomonas aeruginosa PA01
cgacgcccuugcggcgcggccc

SEQ ID NO: 3526837 - RNA, 20 nt, Pseudomonas aeruginosa PA01
cgacgccgaaggacaggccg

SEQ ID NO: 3526838 - RNA, 14 nt, Pseudomonas aeruginosa PA01
cgacgccgagcagc

SEQ ID NO: 3526839 - RNA, 15 nt, Pseudomonas aeruginosa PA01
cgacgccgagcagca

SEQ ID NO: 3526840 - RNA, 17 nt, Pseudomonas aeruginosa PA01
cgacgccgagcugacca

SEQ ID NO: 3526841 - RNA, 19 nt, Pseudomonas aeruginosa PA01
cgacgccgagcugaccacc

SEQ ID NO: 3526842 - RNA, 16 nt, Pseudomonas aeruginosa PA01
cgacgccgaguuggaa

SEQ ID NO: 3526843 - RNA, 12 nt, Pseudomonas aeruginosa PA01
cgacgccgaugc

SEQ ID NO: 3526844 - RNA, 14 nt, Pseudomonas aeruginosa PA01
cgacgccgccgagc

SEQ ID NO: 3526845 - RNA, 13 nt, Pseudomonas aeruginosa PA01
cgacgccgccugc

SEQ ID NO: 3526846 - RNA, 16 nt, Pseudomonas aeruginosa PA01
cgacgccgccugcgcc

SEQ ID NO: 3526847 - RNA, 18 nt, Pseudomonas aeruginosa PA01
cgacgccgccugcgccuc

SEQ ID NO: 3526848 - RNA, 13 nt, Pseudomonas aeruginosa PA01
cgacgccgcgcug

SEQ ID NO: 3526849 - RNA, 15 nt, Pseudomonas aeruginosa PA01
cgacgccgcggccgg

SEQ ID NO: 3526850 - RNA, 16 nt, Pseudomonas aeruginosa PA01
cgacgccgcggccggc

SEQ ID NO: 3526851 - RNA, 21 nt, Pseudomonas aeruginosa PA01
cgacgccgcggccggcgaccu

SEQ ID NO: 3526852 - RNA, 16 nt, Pseudomonas aeruginosa PA01
cgacguccuccaggac

SEQ ID NO: 3526853 - RNA, 19 nt, Pseudomonas aeruginosa PA01
cgacgucgaucuugaggaa

SEQ ID NO: 3526854 - RNA, 20 nt, Pseudomonas aeruginosa PA01
cgacgucgaugacgauggcg

SEQ ID NO: 3526855 - RNA, 16 nt, Pseudomonas aeruginosa PA01
cgacgucggcggcgga

SEQ ID NO: 3526856 - RNA, 22 nt, Pseudomonas aeruginosa PA01
cgacgucguggauaggcggcgg

SEQ ID NO: 3526857 - RNA, 13 nt, Pseudomonas aeruginosa PA01
cgacgugcacccg

SEQ ID NO: 3526858 - RNA, 14 nt, Pseudomonas aeruginosa PA01
cgacgugggccugc

SEQ ID NO: 3526859 - RNA, 12 nt, Pseudomonas aeruginosa PA01
cgacguucugcu

SEQ ID NO: 3526860 - RNA, 21 nt, Pseudomonas aeruginosa PA01
cgacguucugcucgcugcccg

SEQ ID NO: 3526861 - RNA, 22 nt, Pseudomonas aeruginosa PA01
cgacguugagaaggcgccugag

SEQ ID NO: 3526862 - RNA, 14 nt, Pseudomonas aeruginosa PA01
cgacguugcgcagg

SEQ ID NO: 3526863 - RNA, 15 nt, Pseudomonas aeruginosa PA01
cgacguugcgcaggg

SEQ ID NO: 3526864 - RNA, 17 nt, Pseudomonas aeruginosa PA01
cgacguugcgcaggggc

SEQ ID NO: 3526865 - RNA, 23 nt, Pseudomonas aeruginosa PA01
cgacguugcgcaggggcgcggcg

SEQ ID NO: 3526866 - RNA, 13 nt, Pseudomonas aeruginosa PA01
cgacuaccugggg

SEQ ID NO: 3526867 - RNA, 23 nt, Pseudomonas aeruginosa PA01
cgacuauuccgccaccagccagu

SEQ ID NO: 3526868 - RNA, 16 nt, Pseudomonas aeruginosa PA01
cgacucacccgcugcg

SEQ ID NO: 3526869 - RNA, 16 nt, Pseudomonas aeruginosa PA01
cgacuccagccaggcg

SEQ ID NO: 3526870 - RNA, 17 nt, Pseudomonas aeruginosa PA01
cgacuccagccaggcga

SEQ ID NO: 3526871 - RNA, 22 nt, Pseudomonas aeruginosa PA01
cgacuccagcuucuucugcagc

SEQ ID NO: 3526872 - RNA, 13 nt, Pseudomonas aeruginosa PA01
cgacuccgccagu

SEQ ID NO: 3526873 - RNA, 13 nt, Pseudomonas aeruginosa PA01
cgacuccugcaac

SEQ ID NO: 3526874 - RNA, 14 nt, Pseudomonas aeruginosa PA01
cgacucgagcacca

SEQ ID NO: 3526875 - RNA, 18 nt, Pseudomonas aeruginosa PA01
cgacucgagcaccaccac

SEQ ID NO: 3526876 - RNA, 19 nt, Pseudomonas aeruginosa PA01
cgacucgaugaacgcccug

SEQ ID NO: 3526877 - RNA, 18 nt, Pseudomonas aeruginosa PA01
cgacucgaugcgcagcuu

SEQ ID NO: 3526878 - RNA, 15 nt, Pseudomonas aeruginosa PA01
cgacucgcccuuggg

SEQ ID NO: 3526879 - RNA, 13 nt, Pseudomonas aeruginosa PA01
cgacucgcugggc

SEQ ID NO: 3526880 - RNA, 15 nt, Pseudomonas aeruginosa PA01
cgacucgcugggcgc

SEQ ID NO: 3526881 - RNA, 16 nt, Pseudomonas aeruginosa PA01
cgacucgcugggcgcc

SEQ ID NO: 3526882 - RNA, 20 nt, Pseudomonas aeruginosa PA01
cgacucgcugggcgccggca

SEQ ID NO: 3526883 - RNA, 22 nt, Pseudomonas aeruginosa PA01
cgacucgcugggcgccggcagg

SEQ ID NO: 3526884 - RNA, 12 nt, Pseudomonas aeruginosa PA01
cgacucggcugc

SEQ ID NO: 3526885 - RNA, 18 nt, Pseudomonas aeruginosa PA01
cgacucggcugcaacgcc

SEQ ID NO: 3526886 - RNA, 19 nt, Pseudomonas aeruginosa PA01
cgacucggcugcaacgccg

SEQ ID NO: 3526887 - RNA, 20 nt, Pseudomonas aeruginosa PA01
cgacucggcugcaacgccgc

SEQ ID NO: 3526888 - RNA, 13 nt, Pseudomonas aeruginosa PA01
cgacucgucgccc

SEQ ID NO: 3526889 - RNA, 19 nt, Pseudomonas aeruginosa PA01
cgacucgucgccccacagc

SEQ ID NO: 3526890 - RNA, 22 nt, Pseudomonas aeruginosa PA01
cgacucguugcacgcaggccgc

SEQ ID NO: 3526891 - RNA, 15 nt, Pseudomonas aeruginosa PA01
cgacucuccgcgccg

SEQ ID NO: 3526892 - RNA, 23 nt, Pseudomonas aeruginosa PA01
cgacugaccacgcagagcggcag

SEQ ID NO: 3526893 - RNA, 19 nt, Pseudomonas aeruginosa PA01
cgacugacgaaggcuggag

SEQ ID NO: 3526894 - RNA, 19 nt, Pseudomonas aeruginosa PA01
cgacugagcuaauccggcg

SEQ ID NO: 3526895 - RNA, 16 nt, Pseudomonas aeruginosa PA01
cgacugcaacuggccg

SEQ ID NO: 3526896 - RNA, 18 nt, Pseudomonas aeruginosa PA01
cgacugcaacuggccgag

SEQ ID NO: 3526897 - RNA, 19 nt, Pseudomonas aeruginosa PA01
cgacugcaacuggccgaga

SEQ ID NO: 3526898 - RNA, 14 nt, Pseudomonas aeruginosa PA01
cgacugcacgcaga

SEQ ID NO: 3526899 - RNA, 20 nt, Pseudomonas aeruginosa PA01
cgacugcacgcagacgucga

SEQ ID NO: 3526900 - RNA, 22 nt, Pseudomonas aeruginosa PA01
cgacugcacgcagacgucgagg

SEQ ID NO: 3526901 - RNA, 12 nt, Pseudomonas aeruginosa PA01
cgacugcagcgg

SEQ ID NO: 3526902 - RNA, 15 nt, Pseudomonas aeruginosa PA01
cgacugcaugaccuc

SEQ ID NO: 3526903 - RNA, 15 nt, Pseudomonas aeruginosa PA01
cgacugccgucggcg

SEQ ID NO: 3526904 - RNA, 17 nt, Pseudomonas aeruginosa PA01
cgacugccgucggcgcc

SEQ ID NO: 3526905 - RNA, 20 nt, Pseudomonas aeruginosa PA01
cgacugcgagccgacuucca

SEQ ID NO: 3526906 - RNA, 14 nt, Pseudomonas aeruginosa PA01
cgacugcggcagcu

SEQ ID NO: 3526907 - RNA, 19 nt, Pseudomonas aeruginosa PA01
cgacugcggcagcuuggcg

SEQ ID NO: 3526908 - RNA, 20 nt, Pseudomonas aeruginosa PA01
cgacugcggcagcuuggcga

SEQ ID NO: 3526909 - RNA, 20 nt, Pseudomonas aeruginosa PA01
cgacugcgguuuuccugccc

SEQ ID NO: 3526910 - RNA, 12 nt, Pseudomonas aeruginosa PA01
cgacugcugcug

SEQ ID NO: 3526911 - RNA, 14 nt, Pseudomonas aeruginosa PA01
cgacugcugcugcg

SEQ ID NO: 3526912 - RNA, 18 nt, Pseudomonas aeruginosa PA01
cgacugcugcugcggggc

SEQ ID NO: 3526913 - RNA, 19 nt, Pseudomonas aeruginosa PA01
cgacugcugcugcggggcc

SEQ ID NO: 3526914 - RNA, 16 nt, Pseudomonas aeruginosa PA01
cgacuggaugcagccg

SEQ ID NO: 3526915 - RNA, 21 nt, Pseudomonas aeruginosa PA01
cgacuggcagcgauaaccgcg

SEQ ID NO: 3526916 - RNA, 13 nt, Pseudomonas aeruginosa PA01
cgacuggcccugg

SEQ ID NO: 3526917 - RNA, 19 nt, Pseudomonas aeruginosa PA01
cgacuggggcaucucggcc

SEQ ID NO: 3526918 - RNA, 20 nt, Pseudomonas aeruginosa PA01
cgacuggggcaucucggcca

SEQ ID NO: 3526919 - RNA, 15 nt, Pseudomonas aeruginosa PA01
cgacugucgagcagg

SEQ ID NO: 3526920 - RNA, 20 nt, Pseudomonas aeruginosa PA01
cgacugucgugccuccagcc

SEQ ID NO: 3526921 - RNA, 12 nt, Pseudomonas aeruginosa PA01
cgacuuccaggc

SEQ ID NO: 3526922 - RNA, 14 nt, Pseudomonas aeruginosa PA01
cgacuuccaggcgc

SEQ ID NO: 3526923 - RNA, 23 nt, Pseudomonas aeruginosa PA01
cgacuuccgccuuguccugcaac

SEQ ID NO: 3526924 - RNA, 22 nt, Pseudomonas aeruginosa PA01
cgacuuccugggaugccgggcc

SEQ ID NO: 3526925 - RNA, 18 nt, Pseudomonas aeruginosa PA01
cgacuuccuugcgcgggc

SEQ ID NO: 3526926 - RNA, 13 nt, Pseudomonas aeruginosa PA01
cgacuucgcacca

SEQ ID NO: 3526927 - RNA, 15 nt, Pseudomonas aeruginosa PA01
cgacuucgcaccagc

SEQ ID NO: 3526928 - RNA, 21 nt, Pseudomonas aeruginosa PA01
cgacuucgcaccagccggccg

SEQ ID NO: 3526929 - RNA, 14 nt, Pseudomonas aeruginosa PA01
cgacuugaacaggg

SEQ ID NO: 3526930 - RNA, 23 nt, Pseudomonas aeruginosa PA01
cgacuuggacagcgucuggguga

SEQ ID NO: 3526931 - RNA, 18 nt, Pseudomonas aeruginosa PA01
cgacuuggcagucgccgc

SEQ ID NO: 3526932 - RNA, 22 nt, Pseudomonas aeruginosa PA01
cgagaaaaaccacgggaauggc

SEQ ID NO: 3526933 - RNA, 15 nt, Pseudomonas aeruginosa PA01
cgagaaaaagcccgg

SEQ ID NO: 3526934 - RNA, 17 nt, Pseudomonas aeruginosa PA01
cgagaaaaagcccggca

SEQ ID NO: 3526935 - RNA, 21 nt, Pseudomonas aeruginosa PA01
cgagaaaacccugggaauggc

SEQ ID NO: 3526936 - RNA, 14 nt, Pseudomonas aeruginosa PA01
cgagaaaccgccau

SEQ ID NO: 3526937 - RNA, 20 nt, Pseudomonas aeruginosa PA01
cgagaaagucgaucagcgcg

SEQ ID NO: 3526938 - RNA, 17 nt, Pseudomonas aeruginosa PA01
cgagaaauaggcgcugc

SEQ ID NO: 3526939 - RNA, 13 nt, Pseudomonas aeruginosa PA01
cgagaacccggcc

SEQ ID NO: 3526940 - RNA, 14 nt, Pseudomonas aeruginosa PA01
cgagaacccggcca

SEQ ID NO: 3526941 - RNA, 23 nt, Pseudomonas aeruginosa PA01
cgagaacucguccggucgcaccg

SEQ ID NO: 3526942 - RNA, 22 nt, Pseudomonas aeruginosa PA01
cgagaacuugccggcgccaucg

SEQ ID NO: 3526943 - RNA, 22 nt, Pseudomonas aeruginosa PA01
cgagaagccgaucaggucgcgc

SEQ ID NO: 3526944 - RNA, 23 nt, Pseudomonas aeruginosa PA01
cgagaagccgcccacgggcggcu

SEQ ID NO: 3526945 - RNA, 20 nt, Pseudomonas aeruginosa PA01
cgagaagccggggcaggcau

SEQ ID NO: 3526946 - RNA, 14 nt, Pseudomonas aeruginosa PA01
cgagaaggcugccg

SEQ ID NO: 3526947 - RNA, 21 nt, Pseudomonas aeruginosa PA01
cgagaagguucucggccacca

SEQ ID NO: 3526948 - RNA, 21 nt, Pseudomonas aeruginosa PA01
cgagaccaccgacggcuccgg

SEQ ID NO: 3526949 - RNA, 22 nt, Pseudomonas aeruginosa PA01
cgagaccaccgacggcuccgga

SEQ ID NO: 3526950 - RNA, 22 nt, Pseudomonas aeruginosa PA01
cgagaccaucuggaucaggaag

SEQ ID NO: 3526951 - RNA, 16 nt, Pseudomonas aeruginosa PA01
cgagaccccggcggcg

SEQ ID NO: 3526952 - RNA, 14 nt, Pseudomonas aeruginosa PA01
cgagaccgacgcuc

SEQ ID NO: 3526953 - RNA, 14 nt, Pseudomonas aeruginosa PA01
cgagaccggggauc

SEQ ID NO: 3526954 - RNA, 19 nt, Pseudomonas aeruginosa PA01
cgagcaggccuugcagggc

SEQ ID NO: 3526955 - RNA, 21 nt, Pseudomonas aeruginosa PA01
cgagcaggccuugcagggccg

SEQ ID NO: 3526956 - RNA, 19 nt, Pseudomonas aeruginosa PA01
cgagcaggcgauacaggcg

SEQ ID NO: 3526957 - RNA, 20 nt, Pseudomonas aeruginosa PA01
cgagcaggcgcgccaggccc

SEQ ID NO: 3526958 - RNA, 21 nt, Pseudomonas aeruginosa PA01
cgagcaggcgcgccaggccca

SEQ ID NO: 3526959 - RNA, 23 nt, Pseudomonas aeruginosa PA01
cgagcagggaggagggcgagguc

SEQ ID NO: 3526960 - RNA, 15 nt, Pseudomonas aeruginosa PA01
cgagcagggcacagc

SEQ ID NO: 3526961 - RNA, 17 nt, Pseudomonas aeruginosa PA01
cgagcagggcacagcca

SEQ ID NO: 3526962 - RNA, 13 nt, Pseudomonas aeruginosa PA01
cgagcagggcgau

SEQ ID NO: 3526963 - RNA, 19 nt, Pseudomonas aeruginosa PA01
cgagcagggcgaugccgau

SEQ ID NO: 3526964 - RNA, 21 nt, Pseudomonas aeruginosa PA01
cgagcagggcgaugccgaugg

SEQ ID NO: 3526965 - RNA, 23 nt, Pseudomonas aeruginosa PA01
cgagcagggcgaugccgauggcg

SEQ ID NO: 3526966 - RNA, 15 nt, Pseudomonas aeruginosa PA01
cgagcagggcgcuga

SEQ ID NO: 3526967 - RNA, 20 nt, Pseudomonas aeruginosa PA01
cgagcagggcgcugagcgcg

SEQ ID NO: 3526968 - RNA, 21 nt, Pseudomonas aeruginosa PA01
cgagcagggcgcugagcgcgg

SEQ ID NO: 3526969 - RNA, 12 nt, Pseudomonas aeruginosa PA01
cgagcaggguca

SEQ ID NO: 3526970 - RNA, 21 nt, Pseudomonas aeruginosa PA01
cgagcagggucacgccgauca

SEQ ID NO: 3526971 - RNA, 14 nt, Pseudomonas aeruginosa PA01
cgagcagggucaug

SEQ ID NO: 3526972 - RNA, 20 nt, Pseudomonas aeruginosa PA01
cgagcagggucaugaugccu

SEQ ID NO: 3526973 - RNA, 21 nt, Pseudomonas aeruginosa PA01
cgagcagggucaugaugccuu

SEQ ID NO: 3526974 - RNA, 15 nt, Pseudomonas aeruginosa PA01
cgagcagggucgcga

SEQ ID NO: 3526975 - RNA, 17 nt, Pseudomonas aeruginosa PA01
cgagcagggucgcgagc

SEQ ID NO: 3526976 - RNA, 21 nt, Pseudomonas aeruginosa PA01
cgagcagguagaccgccucgg

SEQ ID NO: 3526977 - RNA, 12 nt, Pseudomonas aeruginosa PA01
cgagcaggucgc

SEQ ID NO: 3526978 - RNA, 18 nt, Pseudomonas aeruginosa PA01
cgagcaggucgcggaacu

SEQ ID NO: 3526979 - RNA, 23 nt, Pseudomonas aeruginosa PA01
cgagcaggugcauguagcgcucc

SEQ ID NO: 3526980 - RNA, 15 nt, Pseudomonas aeruginosa PA01
cgagcaguuccaggc

SEQ ID NO: 3526981 - RNA, 21 nt, Pseudomonas aeruginosa PA01
cgagcaguuccaggcguccgc

SEQ ID NO: 3526982 - RNA, 22 nt, Pseudomonas aeruginosa PA01
cgagcaguucccccagcaccug

SEQ ID NO: 3526983 - RNA, 16 nt, Pseudomonas aeruginosa PA01
cgagcaguuccggcac

SEQ ID NO: 3526984 - RNA, 16 nt, Pseudomonas aeruginosa PA01
cgagcaucucggccag

SEQ ID NO: 3526985 - RNA, 17 nt, Pseudomonas aeruginosa PA01
cgagcaucucggccagg

SEQ ID NO: 3526986 - RNA, 22 nt, Pseudomonas aeruginosa PA01
caacugcuucaggcgcgcggcc

SEQ ID NO: 3526987 - RNA, 23 nt, Pseudomonas aeruginosa PA01
caacugcuucaggcgcgcggcca

SEQ ID NO: 3526988 - RNA, 20 nt, Pseudomonas aeruginosa PA01
caacugcuucaggucgugcu

SEQ ID NO: 3526989 - RNA, 20 nt, Pseudomonas aeruginosa PA01
caacugcuugccgagcuggg

SEQ ID NO: 3526990 - RNA, 20 nt, Pseudomonas aeruginosa PA01
caacuggacgaacgagaagc

SEQ ID NO: 3526991 - RNA, 23 nt, Pseudomonas aeruginosa PA01
caacuggacgaaggccuccucgu

SEQ ID NO: 3526992 - RNA, 20 nt, Pseudomonas aeruginosa PA01
caacuggauacgcuuggcca

SEQ ID NO: 3526993 - RNA, 20 nt, Pseudomonas aeruginosa PA01
caacuggauuuccuucggca

SEQ ID NO: 3526994 - RNA, 21 nt, Pseudomonas aeruginosa PA01
caacuggcguccccaugcccg

SEQ ID NO: 3526995 - RNA, 14 nt, Pseudomonas aeruginosa PA01
caacugguccugag

SEQ ID NO: 3526996 - RNA, 20 nt, Pseudomonas aeruginosa PA01
caacuggucgcagccgcgca

SEQ ID NO: 3526997 - RNA, 17 nt, Pseudomonas aeruginosa PA01
caacugguuggccgccu

SEQ ID NO: 3526998 - RNA, 18 nt, Pseudomonas aeruginosa PA01
caacugguuggccgccug

SEQ ID NO: 3526999 - RNA, 20 nt, Pseudomonas aeruginosa PA01
caacugguuggccgccuggc

SEQ ID NO: 3527000 - RNA, 20 nt, Pseudomonas aeruginosa PA01
caacuuccacucgccgacca

SEQ ID NO: 3527001 - RNA, 15 nt, Pseudomonas aeruginosa PA01
caacuuucccucucu

SEQ ID NO: 3527002 - RNA, 20 nt, Pseudomonas aeruginosa PA01
caagacgaaagagcccggca

SEQ ID NO: 3527003 - RNA, 19 nt, Pseudomonas aeruginosa PA01
caagacggcccgcagaucu

SEQ ID NO: 3527004 - RNA, 14 nt, Pseudomonas aeruginosa PA01
caagcaggccgcgg

SEQ ID NO: 3527005 - RNA, 15 nt, Pseudomonas aeruginosa PA01
caagcaggccgcggu

SEQ ID NO: 3527006 - RNA, 16 nt, Pseudomonas aeruginosa PA01
caagcauucuggaugc

SEQ ID NO: 3527007 - RNA, 19 nt, Pseudomonas aeruginosa PA01
caagccauuccaacuggcg

SEQ ID NO: 3527008 - RNA, 22 nt, Pseudomonas aeruginosa PA01
caagcccaagggcuccgcaagg

SEQ ID NO: 3527009 - RNA, 20 nt, Pseudomonas aeruginosa PA01
caagcccagcucguccaggc

SEQ ID NO: 3527010 - RNA, 11 nt, Pseudomonas aeruginosa PA01
caagcccggcg

SEQ ID NO: 3527011 - RNA, 19 nt, Pseudomonas aeruginosa PA01
caagcccgugggaucgcca

SEQ ID NO: 3527012 - RNA, 13 nt, Pseudomonas aeruginosa PA01
caagcccuggugg

SEQ ID NO: 3527013 - RNA, 16 nt, Pseudomonas aeruginosa PA01
caagccgagcggcaag

SEQ ID NO: 3527014 - RNA, 20 nt, Pseudomonas aeruginosa PA01
caagccgagcggcaaggcca

SEQ ID NO: 3527015 - RNA, 19 nt, Pseudomonas aeruginosa PA01
caagccguuacgacaucga

SEQ ID NO: 3527016 - RNA, 14 nt, Pseudomonas aeruginosa PA01
caagccuccagcgc

SEQ ID NO: 3527017 - RNA, 16 nt, Pseudomonas aeruginosa PA01
caagccuccagcgccg

SEQ ID NO: 3527018 - RNA, 17 nt, Pseudomonas aeruginosa PA01
caagccuccagcgccgc

SEQ ID NO: 3527019 - RNA, 12 nt, Pseudomonas aeruginosa PA01
caagccucgccc

SEQ ID NO: 3527020 - RNA, 15 nt, Pseudomonas aeruginosa PA01
caagccuggcgcgcu

SEQ ID NO: 3527021 - RNA, 19 nt, Pseudomonas aeruginosa PA01
caagccuggcgcgcugcgg

SEQ ID NO: 3527022 - RNA, 23 nt, Pseudomonas aeruginosa PA01
caagccuggcgcgcugcggcagg

SEQ ID NO: 3527023 - RNA, 18 nt, Pseudomonas aeruginosa PA01
caagcgaaccgaggagga

SEQ ID NO: 3527024 - RNA, 13 nt, Pseudomonas aeruginosa PA01
caagcgaucucuc

SEQ ID NO: 3527025 - RNA, 20 nt, Pseudomonas aeruginosa PA01
caagcgcaugaggcuggcca

SEQ ID NO: 3527026 - RNA, 23 nt, Pseudomonas aeruginosa PA01
caagcgcaugaggcuggccagca

SEQ ID NO: 3527027 - RNA, 20 nt, Pseudomonas aeruginosa PA01
caagcgccggcaacagcagc

SEQ ID NO: 3527028 - RNA, 23 nt, Pseudomonas aeruginosa PA01
caagcgcggaaaaucaaaaccag

SEQ ID NO: 3527029 - RNA, 21 nt, Pseudomonas aeruginosa PA01
caagcgcucggccugcgucgc

SEQ ID NO: 3527030 - RNA, 17 nt, Pseudomonas aeruginosa PA01
caagcggauguucuuca

SEQ ID NO: 3527031 - RNA, 21 nt, Pseudomonas aeruginosa PA01
caagcgguuauucgccccagc

SEQ ID NO: 3527032 - RNA, 22 nt, Pseudomonas aeruginosa PA01
caagcgguuauucgccccagcg

SEQ ID NO: 3527033 - RNA, 15 nt, Pseudomonas aeruginosa PA01
caagcgucgccggcc

SEQ ID NO: 3527034 - RNA, 16 nt, Pseudomonas aeruginosa PA01
caagcgucgccggccg

SEQ ID NO: 3527035 - RNA, 16 nt, Pseudomonas aeruginosa PA01
caagcuccccgccgcc

SEQ ID NO: 3527036 - RNA, 19 nt, Pseudomonas aeruginosa PA01
caagcucgacgagccgcga

SEQ ID NO: 3527037 - RNA, 15 nt, Pseudomonas aeruginosa PA01
caagcugcacggcga

SEQ ID NO: 3527038 - RNA, 20 nt, Pseudomonas aeruginosa PA01
caagcuggcgaucgaccugc

SEQ ID NO: 3527039 - RNA, 16 nt, Pseudomonas aeruginosa PA01
caaggaacuggaagcc

SEQ ID NO: 3527040 - RNA, 18 nt, Pseudomonas aeruginosa PA01
caaggagcgcgagcggca

SEQ ID NO: 3527041 - RNA, 17 nt, Pseudomonas aeruginosa PA01
caaggaugcgccagcgg

SEQ ID NO: 3527042 - RNA, 17 nt, Pseudomonas aeruginosa PA01
caaggcacacgcccggc

SEQ ID NO: 3527043 - RNA, 19 nt, Pseudomonas aeruginosa PA01
caaggcacacgcccggcac

SEQ ID NO: 3527044 - RNA, 17 nt, Pseudomonas aeruginosa PA01
caaggcagcguccgaac

SEQ ID NO: 3527045 - RNA, 19 nt, Pseudomonas aeruginosa PA01
caaggcauucaccagcgac

SEQ ID NO: 3527046 - RNA, 16 nt, Pseudomonas aeruginosa PA01
caaggcauugcgcuug

SEQ ID NO: 3527047 - RNA, 17 nt, Pseudomonas aeruginosa PA01
caaggccaagucggccg

SEQ ID NO: 3527048 - RNA, 18 nt, Pseudomonas aeruginosa PA01
caaggccaagucggccgc

SEQ ID NO: 3527049 - RNA, 16 nt, Pseudomonas aeruginosa PA01
caaggccagggcggcg

SEQ ID NO: 3527050 - RNA, 17 nt, Pseudomonas aeruginosa PA01
caaggccaggucgacga

SEQ ID NO: 3527051 - RNA, 18 nt, Pseudomonas aeruginosa PA01
caaggcccugcugcaggg

SEQ ID NO: 3527052 - RNA, 19 nt, Pseudomonas aeruginosa PA01
caaggccgaagaggcccuc

SEQ ID NO: 3527053 - RNA, 16 nt, Pseudomonas aeruginosa PA01
caaggccgccaggccu

SEQ ID NO: 3527054 - RNA, 18 nt, Pseudomonas aeruginosa PA01
caaggccgccaggccucg

SEQ ID NO: 3527055 - RNA, 16 nt, Pseudomonas aeruginosa PA01
caaggccucggcaucc

SEQ ID NO: 3527056 - RNA, 22 nt, Pseudomonas aeruginosa PA01
caaggccucggcauccucgccc

SEQ ID NO: 3527057 - RNA, 20 nt, Pseudomonas aeruginosa PA01
caaggcgacgcucuucagcg

SEQ ID NO: 3527058 - RNA, 22 nt, Pseudomonas aeruginosa PA01
caaggcgcugaagcggccgaga

SEQ ID NO: 3527059 - RNA, 13 nt, Pseudomonas aeruginosa PA01
caaggcggggcuu

SEQ ID NO: 3527060 - RNA, 19 nt, Pseudomonas aeruginosa PA01
caaggcggugaccagcggc

SEQ ID NO: 3527061 - RNA, 23 nt, Pseudomonas aeruginosa PA01
caaggcgucauagcagcgccgcg

SEQ ID NO: 3527062 - RNA, 16 nt, Pseudomonas aeruginosa PA01
caaggcugaggccgac

SEQ ID NO: 3527063 - RNA, 17 nt, Pseudomonas aeruginosa PA01
caagggcacgugcagcg

SEQ ID NO: 3527064 - RNA, 22 nt, Pseudomonas aeruginosa PA01
caagggcacgugcagcggcagc

SEQ ID NO: 3527065 - RNA, 23 nt, Pseudomonas aeruginosa PA01
caagggcacgugcagcggcagcg

SEQ ID NO: 3527066 - RNA, 18 nt, Pseudomonas aeruginosa PA01
caagggccugcucagcgu

SEQ ID NO: 3527067 - RNA, 14 nt, Pseudomonas aeruginosa PA01
caagggccugggcg

SEQ ID NO: 3527068 - RNA, 15 nt, Pseudomonas aeruginosa PA01
caagggccugggcgc

SEQ ID NO: 3527069 - RNA, 15 nt, Pseudomonas aeruginosa PA01
caagggcgccgccga

SEQ ID NO: 3527070 - RNA, 14 nt, Pseudomonas aeruginosa PA01
caaggggccgcgcu

SEQ ID NO: 3527071 - RNA, 23 nt, Pseudomonas aeruginosa PA01
caagguacggggcugcggccucg

SEQ ID NO: 3527072 - RNA, 23 nt, Pseudomonas aeruginosa PA01
caaggucggucucgccaccccgc

SEQ ID NO: 3527073 - RNA, 21 nt, Pseudomonas aeruginosa PA01
caaggucgucucagaccuucc

SEQ ID NO: 3527074 - RNA, 14 nt, Pseudomonas aeruginosa PA01
caaggugaagugau

SEQ ID NO: 3527075 - RNA, 14 nt, Pseudomonas aeruginosa PA01
caaggugcgggccg

SEQ ID NO: 3527076 - RNA, 12 nt, Pseudomonas aeruginosa PA01
caaggugcugcc

SEQ ID NO: 3527077 - RNA, 13 nt, Pseudomonas aeruginosa PA01
caagucggccgcc

SEQ ID NO: 3527078 - RNA, 15 nt, Pseudomonas aeruginosa PA01
caagucggccgccca

SEQ ID NO: 3527079 - RNA, 13 nt, Pseudomonas aeruginosa PA01
caagugcccuggg

SEQ ID NO: 3527080 - RNA, 22 nt, Pseudomonas aeruginosa PA01
caagugcucgauggcgaagcgc

SEQ ID NO: 3527081 - RNA, 20 nt, Pseudomonas aeruginosa PA01
caaguucgcauaggcggcca

SEQ ID NO: 3527082 - RNA, 13 nt, Pseudomonas aeruginosa PA01
caauacaccuugg

SEQ ID NO: 3527083 - RNA, 15 nt, Pseudomonas aeruginosa PA01
caauaccacccuugg

SEQ ID NO: 3527084 - RNA, 15 nt, Pseudomonas aeruginosa PA01
caauacccacagggu

SEQ ID NO: 3527085 - RNA, 18 nt, Pseudomonas aeruginosa PA01
caauagccgggcuuuuuu

SEQ ID NO: 3527086 - RNA, 14 nt, Pseudomonas aeruginosa PA01
caaucagcgcgauu

SEQ ID NO: 3527087 - RNA, 12 nt, Pseudomonas aeruginosa PA01
caaucccagcuc

SEQ ID NO: 3527088 - RNA, 20 nt, Pseudomonas aeruginosa PA01
caauccgauuccgcgcagga

SEQ ID NO: 3527089 - RNA, 18 nt, Pseudomonas aeruginosa PA01
accggcaggacgaugauc

SEQ ID NO: 3527090 - RNA, 17 nt, Pseudomonas aeruginosa PA01
accggcaggaucggcgc

SEQ ID NO: 3527091 - RNA, 22 nt, Pseudomonas aeruginosa PA01
accggcaggucgggcaacggcu

SEQ ID NO: 3527092 - RNA, 19 nt, Pseudomonas aeruginosa PA01
accggcauguagcgcgccg

SEQ ID NO: 3527093 - RNA, 11 nt, Pseudomonas aeruginosa PA01
accggccagcg

SEQ ID NO: 3527094 - RNA, 13 nt, Pseudomonas aeruginosa PA01
accggccagcgca

SEQ ID NO: 3527095 - RNA, 14 nt, Pseudomonas aeruginosa PA01
accggccagcgcau

SEQ ID NO: 3527096 - RNA, 18 nt, Pseudomonas aeruginosa PA01
accggccagcgcaucgag

SEQ ID NO: 3527097 - RNA, 21 nt, Pseudomonas aeruginosa PA01
accggccagcgcaucgaggcc

SEQ ID NO: 3527098 - RNA, 12 nt, Pseudomonas aeruginosa PA01
accggccaggcg

SEQ ID NO: 3527099 - RNA, 14 nt, Pseudomonas aeruginosa PA01
accggccaggcgcu

SEQ ID NO: 3527100 - RNA, 17 nt, Pseudomonas aeruginosa PA01
accggccaggcgcuggu

SEQ ID NO: 3527101 - RNA, 18 nt, Pseudomonas aeruginosa PA01
accggccaggcgcugguc

SEQ ID NO: 3527102 - RNA, 14 nt, Pseudomonas aeruginosa PA01
accggccaggcggu

SEQ ID NO: 3527103 - RNA, 13 nt, Pseudomonas aeruginosa PA01
acuucccugccgg

SEQ ID NO: 3527104 - RNA, 14 nt, Pseudomonas aeruginosa PA01
acuuccggcccggc

SEQ ID NO: 3527105 - RNA, 15 nt, Pseudomonas aeruginosa PA01
acuuccggcccggcc

SEQ ID NO: 3527106 - RNA, 17 nt, Pseudomonas aeruginosa PA01
acuuccggcccggccag

SEQ ID NO: 3527107 - RNA, 20 nt, Pseudomonas aeruginosa PA01
acuuccggcccggccaggcg

SEQ ID NO: 3527108 - RNA, 18 nt, Pseudomonas aeruginosa PA01
acuuccgucacgcccugc

SEQ ID NO: 3527109 - RNA, 17 nt, Pseudomonas aeruginosa PA01
acuuccucggcgaccac

SEQ ID NO: 3527110 - RNA, 18 nt, Pseudomonas aeruginosa PA01
acuuccucggcgaccacc

SEQ ID NO: 3527111 - RNA, 16 nt, Pseudomonas aeruginosa PA01
acuuccugaaggcgcg

SEQ ID NO: 3527112 - RNA, 16 nt, Pseudomonas aeruginosa PA01
acuucgaagccgagcu

SEQ ID NO: 3527113 - RNA, 19 nt, Pseudomonas aeruginosa PA01
acuucgaagccgagcugcc

SEQ ID NO: 3527114 - RNA, 19 nt, Pseudomonas aeruginosa PA01
acuucggcaagcaccuuga

SEQ ID NO: 3527115 - RNA, 14 nt, Pseudomonas aeruginosa PA01
acuucggcgacagc

SEQ ID NO: 3527116 - RNA, 15 nt, Pseudomonas aeruginosa PA01
acuucggcgcgcggc

SEQ ID NO: 3527117 - RNA, 22 nt, Pseudomonas aeruginosa PA01
acuucggcgguggggccgccga

SEQ ID NO: 3527118 - RNA, 23 nt, Pseudomonas aeruginosa PA01
acuucggcgguggggccgccgau

SEQ ID NO: 3527119 - RNA, 13 nt, Pseudomonas aeruginosa PA01
acuucggcuucaa

SEQ ID NO: 3527120 - RNA, 14 nt, Pseudomonas aeruginosa PA01
acuucguccgccac

SEQ ID NO: 3527121 - RNA, 13 nt, Pseudomonas aeruginosa PA01
acuucguccggcc

SEQ ID NO: 3527122 - RNA, 19 nt, Pseudomonas aeruginosa PA01
acuucgucgaagaccaggg

SEQ ID NO: 3527123 - RNA, 17 nt, Pseudomonas aeruginosa PA01
acuucgugccacaggcc

SEQ ID NO: 3527124 - RNA, 22 nt, Pseudomonas aeruginosa PA01
acuucgugccacaggcccugga

SEQ ID NO: 3527125 - RNA, 22 nt, Pseudomonas aeruginosa PA01
acuucuccagguacagccgcag

SEQ ID NO: 3527126 - RNA, 14 nt, Pseudomonas aeruginosa PA01
acuucuucgcugga

SEQ ID NO: 3527127 - RNA, 13 nt, Pseudomonas aeruginosa PA01
acuugaacaccgu

SEQ ID NO: 3527128 - RNA, 14 nt, Pseudomonas aeruginosa PA01
acuugaaccccgaa

SEQ ID NO: 3527129 - RNA, 14 nt, Pseudomonas aeruginosa PA01
acuugaaguguccg

SEQ ID NO: 3527130 - RNA, 23 nt, Pseudomonas aeruginosa PA01
acuugaugucgaugggcgacagc

SEQ ID NO: 3527131 - RNA, 14 nt, Pseudomonas aeruginosa PA01
acuugccagggcag

SEQ ID NO: 3527132 - RNA, 15 nt, Pseudomonas aeruginosa PA01
acuugccagggcagg

SEQ ID NO: 3527133 - RNA, 17 nt, Pseudomonas aeruginosa PA01
acuugccagggcaggga

SEQ ID NO: 3527134 - RNA, 12 nt, Pseudomonas aeruginosa PA01
acuugccgccgc

SEQ ID NO: 3527135 - RNA, 14 nt, Pseudomonas aeruginosa PA01
acuugccggcgcca

SEQ ID NO: 3527136 - RNA, 21 nt, Pseudomonas aeruginosa PA01
acuugccggcgccaucgauca

SEQ ID NO: 3527137 - RNA, 23 nt, Pseudomonas aeruginosa PA01
acuugccggcgccaucgaucagc

SEQ ID NO: 3527138 - RNA, 13 nt, Pseudomonas aeruginosa PA01
acuugcggcccac

SEQ ID NO: 3527139 - RNA, 20 nt, Pseudomonas aeruginosa PA01
acuugcgggugcgcaggcug

SEQ ID NO: 3527140 - RNA, 23 nt, Pseudomonas aeruginosa PA01
acuugcgggugcgcaggcugccu

SEQ ID NO: 3527141 - RNA, 15 nt, Pseudomonas aeruginosa PA01
acuuggcagucgccg

SEQ ID NO: 3527142 - RNA, 13 nt, Pseudomonas aeruginosa PA01
acuuggcccggcg

SEQ ID NO: 3527143 - RNA, 23 nt, Pseudomonas aeruginosa PA01
acuuggcccggcguuucgccggg

SEQ ID NO: 3527144 - RNA, 21 nt, Pseudomonas aeruginosa PA01
acuuggcgcgcagggcaucga

SEQ ID NO: 3527145 - RNA, 13 nt, Pseudomonas aeruginosa PA01
acuuggcuucagc

SEQ ID NO: 3527146 - RNA, 15 nt, Pseudomonas aeruginosa PA01
acuugggcaucagcu

SEQ ID NO: 3527147 - RNA, 16 nt, Pseudomonas aeruginosa PA01
acuugucgaccacgcu

SEQ ID NO: 3527148 - RNA, 12 nt, Pseudomonas aeruginosa PA01
acuugugguggg

SEQ ID NO: 3527149 - RNA, 17 nt, Pseudomonas aeruginosa PA01
acuuucccguuuugccg

SEQ ID NO: 3527150 - RNA, 15 nt, Pseudomonas aeruginosa PA01
acuuuccgaagcccc

SEQ ID NO: 3527151 - RNA, 13 nt, Pseudomonas aeruginosa PA01
acuuuggucgagu

SEQ ID NO: 3527152 - RNA, 15 nt, Pseudomonas aeruginosa PA01
agaaaaagcccggca

SEQ ID NO: 3527153 - RNA, 12 nt, Pseudomonas aeruginosa PA01
agaaaacccugg

SEQ ID NO: 3527154 - RNA, 20 nt, Pseudomonas aeruginosa PA01
agaaaacgcccggcaucugc

SEQ ID NO: 3527155 - RNA, 14 nt, Pseudomonas aeruginosa PA01
agaaaagaaaauuu

SEQ ID NO: 3527156 - RNA, 12 nt, Pseudomonas aeruginosa PA01
agaaaaggcccg

SEQ ID NO: 3527157 - RNA, 13 nt, Pseudomonas aeruginosa PA01
agaaaaggccgcu

SEQ ID NO: 3527158 - RNA, 17 nt, Pseudomonas aeruginosa PA01
agaaaccccgccaaggc

SEQ ID NO: 3527159 - RNA, 18 nt, Pseudomonas aeruginosa PA01
agaaaccgaucagcaccg

SEQ ID NO: 3527160 - RNA, 14 nt, Pseudomonas aeruginosa PA01
agaaacgcagggcc

SEQ ID NO: 3527161 - RNA, 20 nt, Pseudomonas aeruginosa PA01
agaaacgcuugagcuggcgc

SEQ ID NO: 3527162 - RNA, 12 nt, Pseudomonas aeruginosa PA01
agaaacugcagg

SEQ ID NO: 3527163 - RNA, 16 nt, Pseudomonas aeruginosa PA01
agaaagccucaggcgc

SEQ ID NO: 3527164 - RNA, 22 nt, Pseudomonas aeruginosa PA01
agaaagccucaggcgcugcgcg

SEQ ID NO: 3527165 - RNA, 19 nt, Pseudomonas aeruginosa PA01
agaaagcgcaggaagcugc

SEQ ID NO: 3527166 - RNA, 22 nt, Pseudomonas aeruginosa PA01
agaaaggcugcuucggcagccu

SEQ ID NO: 3527167 - RNA, 20 nt, Pseudomonas aeruginosa PA01
agaaagucgaucagcgcgcg

SEQ ID NO: 3527168 - RNA, 16 nt, Pseudomonas aeruginosa PA01
agaaauagaaggucac

SEQ ID NO: 3527169 - RNA, 19 nt, Pseudomonas aeruginosa PA01
agaaauccggcuggcgccg

SEQ ID NO: 3527170 - RNA, 21 nt, Pseudomonas aeruginosa PA01
agaaauccuccggacgccgaa

SEQ ID NO: 3527171 - RNA, 22 nt, Pseudomonas aeruginosa PA01
agaaauccuccggacgccgaac

SEQ ID NO: 3527172 - RNA, 19 nt, Pseudomonas aeruginosa PA01
agaaaugguggaccagcgc

SEQ ID NO: 3527173 - RNA, 23 nt, Pseudomonas aeruginosa PA01
agaacacgccccagaagccccag

SEQ ID NO: 3527174 - RNA, 14 nt, Pseudomonas aeruginosa PA01
agaacacggcuucg

SEQ ID NO: 3527175 - RNA, 18 nt, Pseudomonas aeruginosa PA01
agaacagcagcggcacca

SEQ ID NO: 3527176 - RNA, 21 nt, Pseudomonas aeruginosa PA01
agaacagcagcggcaccagca

SEQ ID NO: 3527177 - RNA, 14 nt, Pseudomonas aeruginosa PA01
agaacagcaggguc

SEQ ID NO: 3527178 - RNA, 20 nt, Pseudomonas aeruginosa PA01
agaacaggcgauagccgacc

SEQ ID NO: 3527179 - RNA, 22 nt, Pseudomonas aeruginosa PA01
agaacaggcgcuucagcucgag

SEQ ID NO: 3527180 - RNA, 17 nt, Pseudomonas aeruginosa PA01
agaacaucggcgcuccg

SEQ ID NO: 3527181 - RNA, 22 nt, Pseudomonas aeruginosa PA01
agaaccaguacuugaacagcag

SEQ ID NO: 3527182 - RNA, 15 nt, Pseudomonas aeruginosa PA01
agaacccggccaggc

SEQ ID NO: 3527183 - RNA, 17 nt, Pseudomonas aeruginosa PA01
agaacccggccaggccc

SEQ ID NO: 3527184 - RNA, 16 nt, Pseudomonas aeruginosa PA01
agaaccgccagcagug

SEQ ID NO: 3527185 - RNA, 19 nt, Pseudomonas aeruginosa PA01
agaacgaaggcuuguccuu

SEQ ID NO: 3527186 - RNA, 17 nt, Pseudomonas aeruginosa PA01
agaacgacaugcucauc

SEQ ID NO: 3527187 - RNA, 22 nt, Pseudomonas aeruginosa PA01
agaacggguugaucagguucgg

SEQ ID NO: 3527188 - RNA, 23 nt, Pseudomonas aeruginosa PA01
agaacguauuuccccaacaucaa

SEQ ID NO: 3527189 - RNA, 14 nt, Pseudomonas aeruginosa PA01
agaacuccuugccg

SEQ ID NO: 3527190 - RNA, 22 nt, Pseudomonas aeruginosa PA01
agaacuccuugccguggcuccu

SEQ ID NO: 3527191 - RNA, 19 nt, Pseudomonas aeruginosa PA01
agaacucggcgcugccggc

SEQ ID NO: 3527192 - RNA, 14 nt, Pseudomonas aeruginosa PA01
agaacugccgggcc

SEQ ID NO: 3527193 - RNA, 17 nt, Pseudomonas aeruginosa PA01
agaacugccgggccagc

SEQ ID NO: 3527194 - RNA, 17 nt, Pseudomonas aeruginosa PA01
agaacugcucggcgucc

SEQ ID NO: 3527195 - RNA, 20 nt, Pseudomonas aeruginosa PA01
agaacugcucggcguccagc

SEQ ID NO: 3527196 - RNA, 17 nt, Pseudomonas aeruginosa PA01
agaacuugccggcgcca

SEQ ID NO: 3527197 - RNA, 15 nt, Pseudomonas aeruginosa PA01
agaacuuuucccagc

SEQ ID NO: 3527198 - RNA, 17 nt, Pseudomonas aeruginosa PA01
agaacuuuucccagcgg

SEQ ID NO: 3527199 - RNA, 21 nt, Pseudomonas aeruginosa PA01
agaacuuuucccagcggcugc

SEQ ID NO: 3527200 - RNA, 14 nt, Pseudomonas aeruginosa PA01
agaagacgcccagc

SEQ ID NO: 3527201 - RNA, 23 nt, Pseudomonas aeruginosa PA01
agaagaugccaaguugccuggca

SEQ ID NO: 3527202 - RNA, 16 nt, Pseudomonas aeruginosa PA01
agaagccagccagguc

SEQ ID NO: 3527203 - RNA, 12 nt, Pseudomonas aeruginosa PA01
agaagccgaccu

SEQ ID NO: 3527204 - RNA, 18 nt, Pseudomonas aeruginosa PA01
agaagccgcgcaaggcag

SEQ ID NO: 3527205 - RNA, 14 nt, Pseudomonas aeruginosa PA01
agaagccgcugacc

SEQ ID NO: 3527206 - RNA, 17 nt, Pseudomonas aeruginosa PA01
agacgccagccgcccug

SEQ ID NO: 3527207 - RNA, 20 nt, Pseudomonas aeruginosa PA01
agacgcccagcagggccagc

SEQ ID NO: 3527208 - RNA, 19 nt, Pseudomonas aeruginosa PA01
agacgcccggaccgaucuc

SEQ ID NO: 3527209 - RNA, 23 nt, Pseudomonas aeruginosa PA01
agacgcccugaggcuuuccugcg

SEQ ID NO: 3527210 - RNA, 17 nt, Pseudomonas aeruginosa PA01
agacgccguccaccagc

SEQ ID NO: 3527211 - RNA, 17 nt, Pseudomonas aeruginosa PA01
agacgcgggcccagcgg

SEQ ID NO: 3527212 - RNA, 16 nt, Pseudomonas aeruginosa PA01
agacgcucggccagcg

SEQ ID NO: 3527213 - RNA, 21 nt, Pseudomonas aeruginosa PA01
agacgcugccgaggaacucgc

SEQ ID NO: 3527214 - RNA, 18 nt, Pseudomonas aeruginosa PA01
agacgcugcgaccuggcg

SEQ ID NO: 3527215 - RNA, 20 nt, Pseudomonas aeruginosa PA01
agacgcugcgaccuggcgcc

SEQ ID NO: 3527216 - RNA, 21 nt, Pseudomonas aeruginosa PA01
agacgcugcgaccuggcgccg

SEQ ID NO: 3527217 - RNA, 22 nt, Pseudomonas aeruginosa PA01
agacggcccgcagaucuucccc

SEQ ID NO: 3527218 - RNA, 13 nt, Pseudomonas aeruginosa PA01
agacgggcgaggc

SEQ ID NO: 3527219 - RNA, 14 nt, Pseudomonas aeruginosa PA01
agacggggccucgc

SEQ ID NO: 3527220 - RNA, 17 nt, Pseudomonas aeruginosa PA01
agacgguucagcagcgg

SEQ ID NO: 3527221 - RNA, 22 nt, Pseudomonas aeruginosa PA01
agacgguucagcagcggcaccc

SEQ ID NO: 3527222 - RNA, 18 nt, Pseudomonas aeruginosa PA01
agacguacagcgggucgg

SEQ ID NO: 3527223 - RNA, 13 nt, Pseudomonas aeruginosa PA01
agacguccagcgc

SEQ ID NO: 3527224 - RNA, 14 nt, Pseudomonas aeruginosa PA01
agacguccagcgcc

SEQ ID NO: 3527225 - RNA, 15 nt, Pseudomonas aeruginosa PA01
agacguccagcgcca

SEQ ID NO: 3527226 - RNA, 18 nt, Pseudomonas aeruginosa PA01
agacgucgagguagucgg

SEQ ID NO: 3527227 - RNA, 16 nt, Pseudomonas aeruginosa PA01
agacgucuuccgggac

SEQ ID NO: 3527228 - RNA, 16 nt, Pseudomonas aeruginosa PA01
agacgugaagccccug

SEQ ID NO: 3527229 - RNA, 12 nt, Pseudomonas aeruginosa PA01
agacgugcuggu

SEQ ID NO: 3527230 - RNA, 19 nt, Pseudomonas aeruginosa PA01
agacguggcauucgucgcc

SEQ ID NO: 3527231 - RNA, 19 nt, Pseudomonas aeruginosa PA01
agacguuguugacguugac

SEQ ID NO: 3527232 - RNA, 24 nt, Pseudomonas aeruginosa PA01
agacuccggcgcagcccagccgcu

SEQ ID NO: 3527233 - RNA, 17 nt, Pseudomonas aeruginosa PA01
agacugucgcggggcuu

SEQ ID NO: 3527234 - RNA, 23 nt, Pseudomonas aeruginosa PA01
agacugucgcggggcuugcgccc

SEQ ID NO: 3527235 - RNA, 18 nt, Pseudomonas aeruginosa PA01
agagacccgccagcggca

SEQ ID NO: 3527236 - RNA, 13 nt, Pseudomonas aeruginosa PA01
agagacugaacuc

SEQ ID NO: 3527237 - RNA, 19 nt, Pseudomonas aeruginosa PA01
agagauauucccgcgacaa

SEQ ID NO: 3527238 - RNA, 19 nt, Pseudomonas aeruginosa PA01
agagauuggguucaggcuc

SEQ ID NO: 3527239 - RNA, 21 nt, Pseudomonas aeruginosa PA01
agagcaccuugucgcugaccg

SEQ ID NO: 3527240 - RNA, 22 nt, Pseudomonas aeruginosa PA01
agagcaccuugucgcugaccgg

SEQ ID NO: 3527241 - RNA, 16 nt, Pseudomonas aeruginosa PA01
agagcacgccgucgcg

SEQ ID NO: 3527242 - RNA, 15 nt, Pseudomonas aeruginosa PA01
agagcagagucgccg

SEQ ID NO: 3527243 - RNA, 15 nt, Pseudomonas aeruginosa PA01
agagcagcaccacgg

SEQ ID NO: 3527244 - RNA, 14 nt, Pseudomonas aeruginosa PA01
agagcagcaccagc

SEQ ID NO: 3527245 - RNA, 15 nt, Pseudomonas aeruginosa PA01
agagcagcaccagca

SEQ ID NO: 3527246 - RNA, 16 nt, Pseudomonas aeruginosa PA01
agagcagcgcggcggc

SEQ ID NO: 3527247 - RNA, 17 nt, Pseudomonas aeruginosa PA01
agagcagcgcggcggcg

SEQ ID NO: 3527248 - RNA, 17 nt, Pseudomonas aeruginosa PA01
agagcagggccuggccc

SEQ ID NO: 3527249 - RNA, 17 nt, Pseudomonas aeruginosa PA01
agagcagggugaagcug

SEQ ID NO: 3527250 - RNA, 20 nt, Pseudomonas aeruginosa PA01
agagcagggugaagcugcgg

SEQ ID NO: 3527251 - RNA, 16 nt, Pseudomonas aeruginosa PA01
agagccaugggccggc

SEQ ID NO: 3527252 - RNA, 19 nt, Pseudomonas aeruginosa PA01
agagcccgccgaacagcaa

SEQ ID NO: 3527253 - RNA, 16 nt, Pseudomonas aeruginosa PA01
agagcccgcggaacgc

SEQ ID NO: 3527254 - RNA, 12 nt, Pseudomonas aeruginosa PA01
agagccgccgaa

SEQ ID NO: 3527255 - RNA, 12 nt, Pseudomonas aeruginosa PA01
agagccgcucgg

SEQ ID NO: 3527256 - RNA, 17 nt, Pseudomonas aeruginosa PA01
agagcgccagccagcgc

SEQ ID NO: 3527257 - RNA, 18 nt, Pseudomonas aeruginosa PA01
agagcgccagccagcgcg

SEQ ID NO: 3527258 - RNA, 18 nt, Pseudomonas aeruginosa PA01
agagcgccaugacccgcg

SEQ ID NO: 3527259 - RNA, 23 nt, Pseudomonas aeruginosa PA01
agagcgcgcccugcaggccgaau

SEQ ID NO: 3527260 - RNA, 14 nt, Pseudomonas aeruginosa PA01
agagcggccagguc

SEQ ID NO: 3527261 - RNA, 12 nt, Pseudomonas aeruginosa PA01
agagcggcgcca

SEQ ID NO: 3527262 - RNA, 17 nt, Pseudomonas aeruginosa PA01
agagcggguagcgccgg

SEQ ID NO: 3527263 - RNA, 15 nt, Pseudomonas aeruginosa PA01
agagcuccagggcug

SEQ ID NO: 3527264 - RNA, 16 nt, Pseudomonas aeruginosa PA01
agagcuccagggcugc

SEQ ID NO: 3527265 - RNA, 17 nt, Pseudomonas aeruginosa PA01
agagcucccugccgccc

SEQ ID NO: 3527266 - RNA, 12 nt, Pseudomonas aeruginosa PA01
agagcuggcggc

SEQ ID NO: 3527267 - RNA, 14 nt, Pseudomonas aeruginosa PA01
agagcuggcggccg

SEQ ID NO: 3527268 - RNA, 16 nt, Pseudomonas aeruginosa PA01
agagcuguccggcgcu

SEQ ID NO: 3527269 - RNA, 17 nt, Pseudomonas aeruginosa PA01
agaggaacaguucggcg

SEQ ID NO: 3527270 - RNA, 22 nt, Pseudomonas aeruginosa PA01
agaggaucuccgaguccugcug

SEQ ID NO: 3527271 - RNA, 19 nt, Pseudomonas aeruginosa PA01
agaggcaacaccaucggcc

SEQ ID NO: 3527272 - RNA, 22 nt, Pseudomonas aeruginosa PA01
agaggcaacaccaucggcccca

SEQ ID NO: 3527273 - RNA, 15 nt, Pseudomonas aeruginosa PA01
agaggcccucggcgc

SEQ ID NO: 3527274 - RNA, 16 nt, Pseudomonas aeruginosa PA01
agaggcccucggcgcc

SEQ ID NO: 3527275 - RNA, 17 nt, Pseudomonas aeruginosa PA01
agaggcccucggcgccg

SEQ ID NO: 3527276 - RNA, 17 nt, Pseudomonas aeruginosa PA01
agaggcgugcuggcuau

SEQ ID NO: 3527277 - RNA, 12 nt, Pseudomonas aeruginosa PA01
agaggcucaacu

SEQ ID NO: 3527278 - RNA, 18 nt, Pseudomonas aeruginosa PA01
agaggcuggcgcucugca

SEQ ID NO: 3527279 - RNA, 20 nt, Pseudomonas aeruginosa PA01
agagggcgaugcccuuggcc

SEQ ID NO: 3527280 - RNA, 12 nt, Pseudomonas aeruginosa PA01
agagggcggcga

SEQ ID NO: 3527281 - RNA, 14 nt, Pseudomonas aeruginosa PA01
agaggggcgcucgu

SEQ ID NO: 3527282 - RNA, 16 nt, Pseudomonas aeruginosa PA01
agagggucagcaggcu

SEQ ID NO: 3527283 - RNA, 14 nt, Pseudomonas aeruginosa PA01
agagggucagccgg

SEQ ID NO: 3527284 - RNA, 15 nt, Pseudomonas aeruginosa PA01
agagggucagccggc

SEQ ID NO: 3527285 - RNA, 16 nt, Pseudomonas aeruginosa PA01
agagggucgccagcga

SEQ ID NO: 3527286 - RNA, 11 nt, Pseudomonas aeruginosa PA01
agaggucggcg

SEQ ID NO: 3527287 - RNA, 15 nt, Pseudomonas aeruginosa PA01
agaggucggcgcgcc

SEQ ID NO: 3527288 - RNA, 16 nt, Pseudomonas aeruginosa PA01
agaggucggcgcgccc

SEQ ID NO: 3527289 - RNA, 20 nt, Pseudomonas aeruginosa PA01
agaggucggcgcgcccggcg

SEQ ID NO: 3527290 - RNA, 13 nt, Pseudomonas aeruginosa PA01
agagguugcgccc

SEQ ID NO: 3527291 - RNA, 14 nt, Pseudomonas aeruginosa PA01
agagguugcgcccg

SEQ ID NO: 3527292 - RNA, 21 nt, Pseudomonas aeruginosa PA01
agagguugcgcccgucgaaga

SEQ ID NO: 3527293 - RNA, 20 nt, Pseudomonas aeruginosa PA01
agagguugcuguagaaugcg

SEQ ID NO: 3527294 - RNA, 16 nt, Pseudomonas aeruginosa PA01
agaguacucggcuacg

SEQ ID NO: 3527295 - RNA, 17 nt, Pseudomonas aeruginosa PA01
agaguccaugcucaggu

SEQ ID NO: 3527296 - RNA, 17 nt, Pseudomonas aeruginosa PA01
agaguccuuguccaggg

SEQ ID NO: 3527297 - RNA, 13 nt, Pseudomonas aeruginosa PA01
agagucgcucgcg

SEQ ID NO: 3527298 - RNA, 15 nt, Pseudomonas aeruginosa PA01
agagugcccaggcgc

SEQ ID NO: 3527299 - RNA, 22 nt, Pseudomonas aeruginosa PA01
agagugcccaggcgcuggcgcc

SEQ ID NO: 3527300 - RNA, 15 nt, Pseudomonas aeruginosa PA01
agaguucgcugcgcg

SEQ ID NO: 3527301 - RNA, 18 nt, Pseudomonas aeruginosa PA01
agaguucgcugcgcgcca

SEQ ID NO: 3527302 - RNA, 21 nt, Pseudomonas aeruginosa PA01
agaguuugccgaacugcaggg

SEQ ID NO: 3527303 - RNA, 23 nt, Pseudomonas aeruginosa PA01
agaguuugccgaacugcagggcg

SEQ ID NO: 3527304 - RNA, 12 nt, Pseudomonas aeruginosa PA01
agauaaaugccc

SEQ ID NO: 3527305 - RNA, 16 nt, Pseudomonas aeruginosa PA01
agauacccagcgggca

SEQ ID NO: 3527306 - RNA, 14 nt, Pseudomonas aeruginosa PA01
agauagccuccucc

SEQ ID NO: 3527307 - RNA, 15 nt, Pseudomonas aeruginosa PA01
agauagggcaucagc

SEQ ID NO: 3527308 - RNA, 16 nt, Pseudomonas aeruginosa PA01
agauagggcaucagcc

SEQ ID NO: 3527309 - RNA, 14 nt, Pseudomonas aeruginosa PA01
agcaccaccucgcc

SEQ ID NO: 3527310 - RNA, 17 nt, Pseudomonas aeruginosa PA01
agcaccacgaugcugau

SEQ ID NO: 3527311 - RNA, 16 nt, Pseudomonas aeruginosa PA01
agcaccacgccgcugg

SEQ ID NO: 3527312 - RNA, 18 nt, Pseudomonas aeruginosa PA01
agcaccacgccgcuggcg

SEQ ID NO: 3527313 - RNA, 13 nt, Pseudomonas aeruginosa PA01
agcaccacgcgca

SEQ ID NO: 3527314 - RNA, 12 nt, Pseudomonas aeruginosa PA01
agcaccagcacc

SEQ ID NO: 3527315 - RNA, 14 nt, Pseudomonas aeruginosa PA01
agcaccagcaccag

SEQ ID NO: 3527316 - RNA, 16 nt, Pseudomonas aeruginosa PA01
agcaccagcaggagca

SEQ ID NO: 3527317 - RNA, 19 nt, Pseudomonas aeruginosa PA01
agcaccagcaggagcaugu

SEQ ID NO: 3527318 - RNA, 14 nt, Pseudomonas aeruginosa PA01
agcaccaggaagcc

SEQ ID NO: 3527319 - RNA, 13 nt, Pseudomonas aeruginosa PA01
agcaccaggcugg

SEQ ID NO: 3527320 - RNA, 16 nt, Pseudomonas aeruginosa PA01
agcaccaggcuggcca

SEQ ID NO: 3527321 - RNA, 17 nt, Pseudomonas aeruginosa PA01
agcaccaggcuggccag

SEQ ID NO: 3527322 - RNA, 17 nt, Pseudomonas aeruginosa PA01
agcaccagggccagggc

SEQ ID NO: 3527323 - RNA, 14 nt, Pseudomonas aeruginosa PA01
agcaccagucccug

SEQ ID NO: 3527324 - RNA, 16 nt, Pseudomonas aeruginosa PA01
agcaccagucccuggc

SEQ ID NO: 3527325 - RNA, 19 nt, Pseudomonas aeruginosa PA01
agcaccaucagccagccca

SEQ ID NO: 3527326 - RNA, 23 nt, Pseudomonas aeruginosa PA01
agcaccaucagccagcccaguuc

SEQ ID NO: 3527327 - RNA, 22 nt, Pseudomonas aeruginosa PA01
agcacccaggauuuguccgcgc

SEQ ID NO: 3527328 - RNA, 12 nt, Pseudomonas aeruginosa PA01
agcacccaggcg

SEQ ID NO: 3527329 - RNA, 19 nt, Pseudomonas aeruginosa PA01
agcacccaugaaaaaggcc

SEQ ID NO: 3527330 - RNA, 19 nt, Pseudomonas aeruginosa PA01
agcacccgcaccagccggc

SEQ ID NO: 3527331 - RNA, 20 nt, Pseudomonas aeruginosa PA01
agcacccgcaccagccggcg

SEQ ID NO: 3527332 - RNA, 23 nt, Pseudomonas aeruginosa PA01
agcacccgcaccagccggcgcuc

SEQ ID NO: 3527333 - RNA, 13 nt, Pseudomonas aeruginosa PA01
agcacccgcaccg

SEQ ID NO: 3527334 - RNA, 19 nt, Pseudomonas aeruginosa PA01
agcacccgcaccgguucga

SEQ ID NO: 3527335 - RNA, 12 nt, Pseudomonas aeruginosa PA01
agcacccgggcg

SEQ ID NO: 3527336 - RNA, 15 nt, Pseudomonas aeruginosa PA01
agcacccgguagccg

SEQ ID NO: 3527337 - RNA, 18 nt, Pseudomonas aeruginosa PA01
agcacccgguagccgauc

SEQ ID NO: 3527338 - RNA, 13 nt, Pseudomonas aeruginosa PA01
agcacccuggcca

SEQ ID NO: 3527339 - RNA, 14 nt, Pseudomonas aeruginosa PA01
agcacccuggccac

SEQ ID NO: 3527340 - RNA, 20 nt, Pseudomonas aeruginosa PA01
agcaccgacucgcccuuggg

SEQ ID NO: 3527341 - RNA, 17 nt, Pseudomonas aeruginosa PA01
agcaccgagacgcccug

SEQ ID NO: 3527342 - RNA, 18 nt, Pseudomonas aeruginosa PA01
agcaccgagacgcccugg

SEQ ID NO: 3527343 - RNA, 20 nt, Pseudomonas aeruginosa PA01
agcaccgagacgcccuggau

SEQ ID NO: 3527344 - RNA, 21 nt, Pseudomonas aeruginosa PA01
agcaccgagcugaucgcgcag

SEQ ID NO: 3527345 - RNA, 20 nt, Pseudomonas aeruginosa PA01
agcaccgauuuccccaaggc

SEQ ID NO: 3527346 - RNA, 16 nt, Pseudomonas aeruginosa PA01
agcaccgccugcaacu

SEQ ID NO: 3527347 - RNA, 17 nt, Pseudomonas aeruginosa PA01
agcaccgccugcaacuc

SEQ ID NO: 3527348 - RNA, 13 nt, Pseudomonas aeruginosa PA01
agcaccgcgccuu

SEQ ID NO: 3527349 - RNA, 17 nt, Pseudomonas aeruginosa PA01
agcaccgcuuucaccag

SEQ ID NO: 3527350 - RNA, 21 nt, Pseudomonas aeruginosa PA01
agcaccgcuuucaccaggguc

SEQ ID NO: 3527351 - RNA, 23 nt, Pseudomonas aeruginosa PA01
agcaccgcuuucaccagggucgc

SEQ ID NO: 3527352 - RNA, 18 nt, Pseudomonas aeruginosa PA01
agcaccggaaaggcgucg

SEQ ID NO: 3527353 - RNA, 19 nt, Pseudomonas aeruginosa PA01
agcaccggaaaggcgucgu

SEQ ID NO: 3527354 - RNA, 16 nt, Pseudomonas aeruginosa PA01
agcaccggccucaagc

SEQ ID NO: 3527355 - RNA, 15 nt, Pseudomonas aeruginosa PA01
agcaccggcggcgcc

SEQ ID NO: 3527356 - RNA, 19 nt, Pseudomonas aeruginosa PA01
agcaccggcggcgccaggc

SEQ ID NO: 3527357 - RNA, 23 nt, Pseudomonas aeruginosa PA01
agcaccggcggcgccaggccggc

SEQ ID NO: 3527358 - RNA, 22 nt, Pseudomonas aeruginosa PA01
agcaccggcuuguugcgcucca

SEQ ID NO: 3527359 - RNA, 17 nt, Pseudomonas aeruginosa PA01
agcaccgggacgaagcg

SEQ ID NO: 3527360 - RNA, 19 nt, Pseudomonas aeruginosa PA01
agcaccgggacgaagcgga

SEQ ID NO: 3527361 - RNA, 22 nt, Pseudomonas aeruginosa PA01
agcaccgggacgaagcggaagc

SEQ ID NO: 3527362 - RNA, 14 nt, Pseudomonas aeruginosa PA01
agcaccguggcgcc

SEQ ID NO: 3527363 - RNA, 20 nt, Pseudomonas aeruginosa PA01
agcaccucccccagcgggcg

SEQ ID NO: 3527364 - RNA, 16 nt, Pseudomonas aeruginosa PA01
agcaccucgaccuggu

SEQ ID NO: 3527365 - RNA, 17 nt, Pseudomonas aeruginosa PA01
agcaccucgacgcccgc

SEQ ID NO: 3527366 - RNA, 13 nt, Pseudomonas aeruginosa PA01
agcaccugcgccg

SEQ ID NO: 3527367 - RNA, 17 nt, Pseudomonas aeruginosa PA01
agcaccugcgggcugcg

SEQ ID NO: 3527368 - RNA, 22 nt, Pseudomonas aeruginosa PA01
agcaccuucaucaccaggucgc

SEQ ID NO: 3527369 - RNA, 14 nt, Pseudomonas aeruginosa PA01
agcacgaaagccau

SEQ ID NO: 3527370 - RNA, 16 nt, Pseudomonas aeruginosa PA01
agcacgaaagccaugc

SEQ ID NO: 3527371 - RNA, 23 nt, Pseudomonas aeruginosa PA01
agcacgaggcucaaucaaucggu

SEQ ID NO: 3527372 - RNA, 15 nt, Pseudomonas aeruginosa PA01
agcacgaugaggcgu

SEQ ID NO: 3527373 - RNA, 17 nt, Pseudomonas aeruginosa PA01
agcacgaugaggcgugg

SEQ ID NO: 3527374 - RNA, 18 nt, Pseudomonas aeruginosa PA01
agcacgaugaggcguggg

SEQ ID NO: 3527375 - RNA, 16 nt, Pseudomonas aeruginosa PA01
agcacgauggcgagga

SEQ ID NO: 3527376 - RNA, 22 nt, Pseudomonas aeruginosa PA01
agcacgcccaguugcgccgccu

SEQ ID NO: 3527377 - RNA, 13 nt, Pseudomonas aeruginosa PA01
agcacgcccuggg

SEQ ID NO: 3527378 - RNA, 15 nt, Pseudomonas aeruginosa PA01
agcacgcccugggac

SEQ ID NO: 3527379 - RNA, 19 nt, Pseudomonas aeruginosa PA01
agcacgcccugggacaggc

SEQ ID NO: 3527380 - RNA, 22 nt, Pseudomonas aeruginosa PA01
agcacgcccugggacaggcguc

SEQ ID NO: 3527381 - RNA, 20 nt, Pseudomonas aeruginosa PA01
agcacgcccuugcuguucgc

SEQ ID NO: 3527382 - RNA, 23 nt, Pseudomonas aeruginosa PA01
agcacgcccuugcuguucgccuu

SEQ ID NO: 3527383 - RNA, 17 nt, Pseudomonas aeruginosa PA01
agcacgccgaucccgau

SEQ ID NO: 3527384 - RNA, 14 nt, Pseudomonas aeruginosa PA01
agcacgccgcgacc

SEQ ID NO: 3527385 - RNA, 16 nt, Pseudomonas aeruginosa PA01
agcacgccuuccagau

SEQ ID NO: 3527386 - RNA, 17 nt, Pseudomonas aeruginosa PA01
agcacgccuuccagauc

SEQ ID NO: 3527387 - RNA, 20 nt, Pseudomonas aeruginosa PA01
agcacgccuuccagaucguc

SEQ ID NO: 3527388 - RNA, 15 nt, Pseudomonas aeruginosa PA01
agcacgcgcauccgu

SEQ ID NO: 3527389 - RNA, 15 nt, Pseudomonas aeruginosa PA01
agcacgcguccgacc

SEQ ID NO: 3527390 - RNA, 20 nt, Pseudomonas aeruginosa PA01
agcacgcucaggcagcgauc

SEQ ID NO: 3527391 - RNA, 12 nt, Pseudomonas aeruginosa PA01
agcacggccucg

SEQ ID NO: 3527392 - RNA, 18 nt, Pseudomonas aeruginosa PA01
agcacggccucgcgugcg

SEQ ID NO: 3527393 - RNA, 13 nt, Pseudomonas aeruginosa PA01
agcacggcgacga

SEQ ID NO: 3527394 - RNA, 17 nt, Pseudomonas aeruginosa PA01
agcacggcgacgaaggc

SEQ ID NO: 3527395 - RNA, 13 nt, Pseudomonas aeruginosa PA01
agcacggcgacgg

SEQ ID NO: 3527396 - RNA, 22 nt, Pseudomonas aeruginosa PA01
agcacggcgauacccaggccgu

SEQ ID NO: 3527397 - RNA, 19 nt, Pseudomonas aeruginosa PA01
agcacggcggcuacccgcg

SEQ ID NO: 3527398 - RNA, 23 nt, Pseudomonas aeruginosa PA01
agcacggcggcuacccgcgccuu

SEQ ID NO: 3527399 - RNA, 18 nt, Pseudomonas aeruginosa PA01
agcacggugaaccaggcg

SEQ ID NO: 3527400 - RNA, 14 nt, Pseudomonas aeruginosa PA01
agcacggugacacc

SEQ ID NO: 3527401 - RNA, 17 nt, Pseudomonas aeruginosa PA01
agcacggugacacccug

SEQ ID NO: 3527402 - RNA, 20 nt, Pseudomonas aeruginosa PA01
agcacggugacacccugccg

SEQ ID NO: 3527403 - RNA, 23 nt, Pseudomonas aeruginosa PA01
agcacgguguuguggcuggccuc

SEQ ID NO: 3527404 - RNA, 16 nt, Pseudomonas aeruginosa PA01
agcacgucguccagcg

SEQ ID NO: 3527405 - RNA, 20 nt, Pseudomonas aeruginosa PA01
agcacgucguccagcgccga

SEQ ID NO: 3527406 - RNA, 22 nt, Pseudomonas aeruginosa PA01
agcacgucguccagcgccgaga

SEQ ID NO: 3527407 - RNA, 17 nt, Pseudomonas aeruginosa PA01
agcacgucuugcaggcu

SEQ ID NO: 3527408 - RNA, 13 nt, Pseudomonas aeruginosa PA01
agcacuacgccca

SEQ ID NO: 3527409 - RNA, 16 nt, Pseudomonas aeruginosa PA01
agcacugguggacggu

SEQ ID NO: 3527410 - RNA, 17 nt, Pseudomonas aeruginosa PA01
agcacuucccaggugcc

SEQ ID NO: 3527411 - RNA, 18 nt, Pseudomonas aeruginosa PA01
agcacuucccaggugccc

SEQ ID NO: 3527412 - RNA, 13 nt, Pseudomonas aeruginosa PA01
agcaggaagccga

SEQ ID NO: 3527413 - RNA, 16 nt, Pseudomonas aeruginosa PA01
agcaggaagccgacca

SEQ ID NO: 3527414 - RNA, 20 nt, Pseudomonas aeruginosa PA01
agcaggaauucgggaaggga

SEQ ID NO: 3527415 - RNA, 21 nt, Pseudomonas aeruginosa PA01
agcaggaauucgggaagggau

SEQ ID NO: 3527416 - RNA, 15 nt, Pseudomonas aeruginosa PA01
agcaggacagcaggg

SEQ ID NO: 3527417 - RNA, 17 nt, Pseudomonas aeruginosa PA01
agcaggacagcaggguc

SEQ ID NO: 3527418 - RNA, 18 nt, Pseudomonas aeruginosa PA01
agcaggaccuggccguug

SEQ ID NO: 3527419 - RNA, 20 nt, Pseudomonas aeruginosa PA01
agcaggguaccgcuggcgcu

SEQ ID NO: 3527420 - RNA, 13 nt, Pseudomonas aeruginosa PA01
agcagggucacgc

SEQ ID NO: 3527421 - RNA, 22 nt, Pseudomonas aeruginosa PA01
agcagggucacgccgaucaccc

SEQ ID NO: 3527422 - RNA, 16 nt, Pseudomonas aeruginosa PA01
agcagggucagcagcg

SEQ ID NO: 3527423 - RNA, 20 nt, Pseudomonas aeruginosa PA01
agcagggucagcagcgccag

SEQ ID NO: 3527424 - RNA, 13 nt, Pseudomonas aeruginosa PA01
agcagggucaggg

SEQ ID NO: 3527425 - RNA, 14 nt, Pseudomonas aeruginosa PA01
agcagggucagggc

SEQ ID NO: 3527426 - RNA, 15 nt, Pseudomonas aeruginosa PA01
agcagggucagggug

SEQ ID NO: 3527427 - RNA, 16 nt, Pseudomonas aeruginosa PA01
agcagggucgcgccgu

SEQ ID NO: 3527428 - RNA, 21 nt, Pseudomonas aeruginosa PA01
agcagggucgcuuccucggca

SEQ ID NO: 3527429 - RNA, 19 nt, Pseudomonas aeruginosa PA01
agcagggugacggugaucg

SEQ ID NO: 3527430 - RNA, 21 nt, Pseudomonas aeruginosa PA01
agcagggugacggugaucgcc

SEQ ID NO: 3527431 - RNA, 21 nt, Pseudomonas aeruginosa PA01
agcagggugcgggcgcgggcg

SEQ ID NO: 3527432 - RNA, 16 nt, Pseudomonas aeruginosa PA01
agcaggguggccaggg

SEQ ID NO: 3527433 - RNA, 12 nt, Pseudomonas aeruginosa PA01
agcagguacagc

SEQ ID NO: 3527434 - RNA, 15 nt, Pseudomonas aeruginosa PA01
agcagguagccaggg

SEQ ID NO: 3527435 - RNA, 12 nt, Pseudomonas aeruginosa PA01
agcagguagccu

SEQ ID NO: 3527436 - RNA, 21 nt, Pseudomonas aeruginosa PA01
agcagguagccugcggccagc

SEQ ID NO: 3527437 - RNA, 23 nt, Pseudomonas aeruginosa PA01
agcagguagccugcggccagcgc

SEQ ID NO: 3527438 - RNA, 16 nt, Pseudomonas aeruginosa PA01
agcagguagugcggcg

SEQ ID NO: 3527439 - RNA, 18 nt, Pseudomonas aeruginosa PA01
agcagguccgcgccucgc

SEQ ID NO: 3527440 - RNA, 13 nt, Pseudomonas aeruginosa PA01
agcaggucgagca

SEQ ID NO: 3527441 - RNA, 17 nt, Pseudomonas aeruginosa PA01
agcaggucgagcaguuc

SEQ ID NO: 3527442 - RNA, 20 nt, Pseudomonas aeruginosa PA01
agcaggucgagggcguccuu

SEQ ID NO: 3527443 - RNA, 14 nt, Pseudomonas aeruginosa PA01
agcaggucgcgcag

SEQ ID NO: 3527444 - RNA, 17 nt, Pseudomonas aeruginosa PA01
agcaggucgcgcugggc

SEQ ID NO: 3527445 - RNA, 14 nt, Pseudomonas aeruginosa PA01
agcaggucgcggaa

SEQ ID NO: 3527446 - RNA, 14 nt, Pseudomonas aeruginosa PA01
agcaggucgcggcc

SEQ ID NO: 3527447 - RNA, 16 nt, Pseudomonas aeruginosa PA01
agcaggucgcggcccc

SEQ ID NO: 3527448 - RNA, 23 nt, Pseudomonas aeruginosa PA01
agcaggucgcggccccagcacug

SEQ ID NO: 3527449 - RNA, 23 nt, Pseudomonas aeruginosa PA01
agcaggucgcggugcaguucgcc

SEQ ID NO: 3527450 - RNA, 16 nt, Pseudomonas aeruginosa PA01
agcaggucggcagcgu

SEQ ID NO: 3527451 - RNA, 21 nt, Pseudomonas aeruginosa PA01
agcaggucggcagcgucgagc

SEQ ID NO: 3527452 - RNA, 14 nt, Pseudomonas aeruginosa PA01
agcaggucggccug

SEQ ID NO: 3527453 - RNA, 15 nt, Pseudomonas aeruginosa PA01
agcaggucgucggcg

SEQ ID NO: 3527454 - RNA, 16 nt, Pseudomonas aeruginosa PA01
agcaggucgucggcga

SEQ ID NO: 3527455 - RNA, 17 nt, Pseudomonas aeruginosa PA01
agcaggucucaccgccc

SEQ ID NO: 3527456 - RNA, 17 nt, Pseudomonas aeruginosa PA01
agcaggucucgacgcgc

SEQ ID NO: 3527457 - RNA, 18 nt, Pseudomonas aeruginosa PA01
agcaggucuuccaccgcg

SEQ ID NO: 3527458 - RNA, 15 nt, Pseudomonas aeruginosa PA01
agcaggugcauguag

SEQ ID NO: 3527459 - RNA, 17 nt, Pseudomonas aeruginosa PA01
agcaggugcauguagcg

SEQ ID NO: 3527460 - RNA, 23 nt, Pseudomonas aeruginosa PA01
agcagguggcgcacugccaggag

SEQ ID NO: 3527461 - RNA, 23 nt, Pseudomonas aeruginosa PA01
agcagguggucgaugggcgagcg

SEQ ID NO: 3527462 - RNA, 20 nt, Pseudomonas aeruginosa PA01
agcagguuccuccugggccg

SEQ ID NO: 3527463 - RNA, 15 nt, Pseudomonas aeruginosa PA01
agcagguucggcggu

SEQ ID NO: 3527464 - RNA, 21 nt, Pseudomonas aeruginosa PA01
agcagguugaccccgcggccg

SEQ ID NO: 3527465 - RNA, 14 nt, Pseudomonas aeruginosa PA01
agcagguugcuggc

SEQ ID NO: 3527466 - RNA, 22 nt, Pseudomonas aeruginosa PA01
agcagguugcuggcgaggaaca

SEQ ID NO: 3527467 - RNA, 20 nt, Pseudomonas aeruginosa PA01
agcaguagugcgacgcagca

SEQ ID NO: 3527468 - RNA, 19 nt, Pseudomonas aeruginosa PA01
agcagucgcacagccaggg

SEQ ID NO: 3527469 - RNA, 17 nt, Pseudomonas aeruginosa PA01
agcagucgcagcucggu

SEQ ID NO: 3527470 - RNA, 15 nt, Pseudomonas aeruginosa PA01
agcagucgccuggcc

SEQ ID NO: 3527471 - RNA, 16 nt, Pseudomonas aeruginosa PA01
agcagucgcggcccug

SEQ ID NO: 3527472 - RNA, 13 nt, Pseudomonas aeruginosa PA01
agcaguucgcccg

SEQ ID NO: 3527473 - RNA, 16 nt, Pseudomonas aeruginosa PA01
agcaguucgcccggcu

SEQ ID NO: 3527474 - RNA, 14 nt, Pseudomonas aeruginosa PA01
agcaguucgucgau

SEQ ID NO: 3527475 - RNA, 14 nt, Pseudomonas aeruginosa PA01
agcaguugcaacag

SEQ ID NO: 3527476 - RNA, 20 nt, Pseudomonas aeruginosa PA01
agcaguugcuggaugucggc

SEQ ID NO: 3527477 - RNA, 17 nt, Pseudomonas aeruginosa PA01
agcaucaccaccgggau

SEQ ID NO: 3527478 - RNA, 23 nt, Pseudomonas aeruginosa PA01
agcaucaccuugcggaacccgcg

SEQ ID NO: 3527479 - RNA, 19 nt, Pseudomonas aeruginosa PA01
agcaucagaggcaacacca

SEQ ID NO: 3527480 - RNA, 14 nt, Pseudomonas aeruginosa PA01
agcaucagcaggaa

SEQ ID NO: 3527481 - RNA, 15 nt, Pseudomonas aeruginosa PA01
agcaucagcaggaag

SEQ ID NO: 3527482 - RNA, 12 nt, Pseudomonas aeruginosa PA01
agcaucagcgac

SEQ ID NO: 3527483 - RNA, 14 nt, Pseudomonas aeruginosa PA01
agcaucagcgacag

SEQ ID NO: 3527484 - RNA, 16 nt, Pseudomonas aeruginosa PA01
agcaucaggucggcgc

SEQ ID NO: 3527485 - RNA, 17 nt, Pseudomonas aeruginosa PA01
agcaucaggucggcgcg

SEQ ID NO: 3527486 - RNA, 20 nt, Pseudomonas aeruginosa PA01
agcaucgcaucggcgaccuu

SEQ ID NO: 3527487 - RNA, 13 nt, Pseudomonas aeruginosa PA01
agcaucgccggca

SEQ ID NO: 3527488 - RNA, 14 nt, Pseudomonas aeruginosa PA01
agcaucggcgcggc

SEQ ID NO: 3527489 - RNA, 22 nt, Pseudomonas aeruginosa PA01
agcaucggcgcggccuucuugc

SEQ ID NO: 3527490 - RNA, 18 nt, Pseudomonas aeruginosa PA01
agcaucucggccaggccc

SEQ ID NO: 3527491 - RNA, 23 nt, Pseudomonas aeruginosa PA01
agcaucugccgggcgcgcugguc

SEQ ID NO: 3527492 - RNA, 13 nt, Pseudomonas aeruginosa PA01
agcaucuggcccg

SEQ ID NO: 3527493 - RNA, 15 nt, Pseudomonas aeruginosa PA01
agcaucuggcccggg

SEQ ID NO: 3527494 - RNA, 17 nt, Pseudomonas aeruginosa PA01
agcaucuggcccggggu

SEQ ID NO: 3527495 - RNA, 23 nt, Pseudomonas aeruginosa PA01
agcaucuucuucaaccgcugguc

SEQ ID NO: 3527496 - RNA, 16 nt, Pseudomonas aeruginosa PA01
agcaugaagugccauu

SEQ ID NO: 3527497 - RNA, 21 nt, Pseudomonas aeruginosa PA01
agcaugaauguggugucgcag

SEQ ID NO: 3527498 - RNA, 11 nt, Pseudomonas aeruginosa PA01
agcaugacgau

SEQ ID NO: 3527499 - RNA, 21 nt, Pseudomonas aeruginosa PA01
agcaugacgauaucggcgccg

SEQ ID NO: 3527500 - RNA, 21 nt, Pseudomonas aeruginosa PA01
agcaugaugccgaggcggccg

SEQ ID NO: 3527501 - RNA, 18 nt, Pseudomonas aeruginosa PA01
agcaugauggugccgccg

SEQ ID NO: 3527502 - RNA, 13 nt, Pseudomonas aeruginosa PA01
agcaugcccagcg

SEQ ID NO: 3527503 - RNA, 20 nt, Pseudomonas aeruginosa PA01
agcaugccgaggaacgccga

SEQ ID NO: 3527504 - RNA, 19 nt, Pseudomonas aeruginosa PA01
agcaugccugcuuucccug

SEQ ID NO: 3527505 - RNA, 20 nt, Pseudomonas aeruginosa PA01
agcaugcucacugcgagcac

SEQ ID NO: 3527506 - RNA, 16 nt, Pseudomonas aeruginosa PA01
agcauggccuugccgg

SEQ ID NO: 3527507 - RNA, 18 nt, Pseudomonas aeruginosa PA01
agcauggcgaagcucggc

SEQ ID NO: 3527508 - RNA, 15 nt, Pseudomonas aeruginosa PA01
agcauggcguuccag

SEQ ID NO: 3527509 - RNA, 14 nt, Pseudomonas aeruginosa PA01
agcauggcguugag

SEQ ID NO: 3527510 - RNA, 19 nt, Pseudomonas aeruginosa PA01
agcauguaggcgcaccagg

SEQ ID NO: 3527511 - RNA, 21 nt, Pseudomonas aeruginosa PA01
agcauguccugcaggcucagc

SEQ ID NO: 3527512 - RNA, 23 nt, Pseudomonas aeruginosa PA01
agcaugucgcuccagaccuccag

SEQ ID NO: 3527513 - RNA, 13 nt, Pseudomonas aeruginosa PA01
agcaugucggcgg

SEQ ID NO: 3527514 - RNA, 20 nt, Pseudomonas aeruginosa PA01
agcauguuguuauggccgac

SEQ ID NO: 3527515 - RNA, 23 nt, Pseudomonas aeruginosa PA01
agcauguuguuauggccgacccg

SEQ ID NO: 3527516 - RNA, 20 nt, Pseudomonas aeruginosa PA01
agcauuaacuuacacggcgu

SEQ ID NO: 3527517 - RNA, 22 nt, Pseudomonas aeruginosa PA01
agcauuaccccgaccaggucgc

SEQ ID NO: 3527518 - RNA, 14 nt, Pseudomonas aeruginosa PA01
agcauucagcgcgc

SEQ ID NO: 3527519 - RNA, 16 nt, Pseudomonas aeruginosa PA01
agcauucagcgcgccc

SEQ ID NO: 3527520 - RNA, 24 nt, Pseudomonas aeruginosa PA01
agcauuccgacaaggagcgcgagc

SEQ ID NO: 3527521 - RNA, 17 nt, Pseudomonas aeruginosa PA01
agcauuccucagcgccg

SEQ ID NO: 3527522 - RNA, 20 nt, Pseudomonas aeruginosa PA01
agcauucuggaugcagccgg

SEQ ID NO: 3527523 - RNA, 21 nt, Pseudomonas aeruginosa PA01
agcagggccgccgaggucagu

SEQ ID NO: 3527524 - RNA, 18 nt, Pseudomonas aeruginosa PA01
agcagggcgaugaacacc

SEQ ID NO: 3527525 - RNA, 18 nt, Pseudomonas aeruginosa PA01
agcagggcgauggccagc

SEQ ID NO: 3527526 - RNA, 20 nt, Pseudomonas aeruginosa PA01
agcagggcgauggccagcgc

SEQ ID NO: 3527527 - RNA, 14 nt, Pseudomonas aeruginosa PA01
agcagggcgccgau

SEQ ID NO: 3527528 - RNA, 21 nt, Pseudomonas aeruginosa PA01
agcagggcgccgaucaggcgu

SEQ ID NO: 3527529 - RNA, 19 nt, Pseudomonas aeruginosa PA01
agcagggcgcugagcgcgg

SEQ ID NO: 3527530 - RNA, 13 nt, Pseudomonas aeruginosa PA01
agcagggcgucgc

SEQ ID NO: 3527531 - RNA, 16 nt, Pseudomonas aeruginosa PA01
agcagggcgucggcgu

SEQ ID NO: 3527532 - RNA, 17 nt, Pseudomonas aeruginosa PA01
agcaggguaccgcuggc

SEQ ID NO: 3527533 - RNA, 11 nt, Pseudomonas putida KT2440
aaaaaaaaggg

SEQ ID NO: 3527534 - RNA, 11 nt, Pseudomonas putida KT2440
aaaaaacuuca

SEQ ID NO: 3527535 - RNA, 14 nt, Pseudomonas putida KT2440
aaaaaagggcaucu

SEQ ID NO: 3527536 - RNA, 18 nt, Pseudomonas putida KT2440
aaaaacuggccagcagcc

SEQ ID NO: 3527537 - RNA, 20 nt, Pseudomonas putida KT2440
aaaaaggggugcaaagcgcc

SEQ ID NO: 3527538 - RNA, 24 nt, Pseudomonas putida KT2440
aaaaaucaugcaguucuaccagca

SEQ ID NO: 3527539 - RNA, 18 nt, Pseudomonas putida KT2440
aaaaaucggguaacaggg

SEQ ID NO: 3527540 - RNA, 11 nt, Pseudomonas putida KT2440
aaaacaacaau

SEQ ID NO: 3527541 - RNA, 12 nt, Pseudomonas putida KT2440
aaaacagcgcgc

SEQ ID NO: 3527542 - RNA, 13 nt, Pseudomonas putida KT2440
aaaaccggccaag

SEQ ID NO: 3527543 - RNA, 21 nt, Pseudomonas putida KT2440
aaaaccugcugacaccgcugc

SEQ ID NO: 3527544 - RNA, 15 nt, Pseudomonas putida KT2440
aaaaccuguuccagc

SEQ ID NO: 3527545 - RNA, 18 nt, Pseudomonas putida KT2440
aaaacgccgggcacugcc

SEQ ID NO: 3527546 - RNA, 23 nt, Pseudomonas putida KT2440
aaaacggaaauaccggggcaccu

SEQ ID NO: 3527547 - RNA, 23 nt, Pseudomonas putida KT2440
aaaacgguuguuucagccuuggc

SEQ ID NO: 3527548 - RNA, 16 nt, Pseudomonas putida KT2440
aaaacuggccagcagc

SEQ ID NO: 3527549 - RNA, 20 nt, Pseudomonas putida KT2440
aaaacuggccagcagccccc

SEQ ID NO: 3527550 - RNA, 23 nt, Pseudomonas putida KT2440
aaaacuggccagcagccccccuu

SEQ ID NO: 3527551 - RNA, 18 nt, Pseudomonas putida KT2440
aaaagaaaaagggcaucu

SEQ ID NO: 3527552 - RNA, 20 nt, Pseudomonas putida KT2440
aaaagaaaaagggcaucuca

SEQ ID NO: 3527553 - RNA, 22 nt, Pseudomonas putida KT2440
aaaagcccacucaauacucgcu

SEQ ID NO: 3527554 - RNA, 16 nt, Pseudomonas putida KT2440
aaaagccgcuggcccu

SEQ ID NO: 3527555 - RNA, 12 nt, Pseudomonas putida KT2440
aaaaggcccgaa

SEQ ID NO: 3527556 - RNA, 17 nt, Pseudomonas putida KT2440
aaaagggucuugcucgc

SEQ ID NO: 3527557 - RNA, 13 nt, Pseudomonas putida KT2440
aaaaguuggccau

SEQ ID NO: 3527558 - RNA, 13 nt, Pseudomonas putida KT2440
aaaauccgccugg

SEQ ID NO: 3527559 - RNA, 18 nt, Pseudomonas putida KT2440
aaaaucggguaacaggga

SEQ ID NO: 3527560 - RNA, 23 nt, Pseudomonas putida KT2440
aaaaugcccgcuguugagcagca

SEQ ID NO: 3527561 - RNA, 17 nt, Pseudomonas putida KT2440
aaacaaugcacagcgcu

SEQ ID NO: 3527562 - RNA, 10 nt, Pseudomonas putida KT2440
aaacacaucc

SEQ ID NO: 3527563 - RNA, 13 nt, Pseudomonas putida KT2440
aaacaccagcaac

SEQ ID NO: 3527564 - RNA, 12 nt, Pseudomonas putida KT2440
aaacagcaguuu

SEQ ID NO: 3527565 - RNA, 20 nt, Pseudomonas putida KT2440
aaacagcaguuugcugcgcu

SEQ ID NO: 3527566 - RNA, 18 nt, Pseudomonas putida KT2440
aaaccaaacgcccgcgca

SEQ ID NO: 3527567 - RNA, 17 nt, Pseudomonas putida KT2440
aaaccacagcggccaca

SEQ ID NO: 3527568 - RNA, 18 nt, Pseudomonas putida KT2440
aaaccacagcggccacag

SEQ ID NO: 3527569 - RNA, 19 nt, Pseudomonas putida KT2440
aaaccacagcggccacagc

SEQ ID NO: 3527570 - RNA, 13 nt, Pseudomonas putida KT2440
aaaccaugcaggu

SEQ ID NO: 3527571 - RNA, 12 nt, Pseudomonas putida KT2440
aaacccaggcaa

SEQ ID NO: 3527572 - RNA, 16 nt, Pseudomonas putida KT2440
aaaccccagcaaggca

SEQ ID NO: 3527573 - RNA, 19 nt, Pseudomonas putida KT2440
aaacccgacaacagcugca

SEQ ID NO: 3527574 - RNA, 20 nt, Pseudomonas putida KT2440
aaacccgccccuauacacau

SEQ ID NO: 3527575 - RNA, 20 nt, Pseudomonas putida KT2440
aaacccgcgccuacaaaaca

SEQ ID NO: 3527576 - RNA, 11 nt, Pseudomonas putida KT2440
aaacccgcucc

SEQ ID NO: 3527577 - RNA, 20 nt, Pseudomonas putida KT2440
aaacccgcuccuacacaggu

SEQ ID NO: 3527578 - RNA, 20 nt, Pseudomonas putida KT2440
aaacccucacgcgccagguc

SEQ ID NO: 3527579 - RNA, 14 nt, Pseudomonas putida KT2440
aaaccgacccugcu

SEQ ID NO: 3527580 - RNA, 17 nt, Pseudomonas putida KT2440
aaaccgcacccaggugc

SEQ ID NO: 3527581 - RNA, 12 nt, Pseudomonas putida KT2440
aaaccgccagcc

SEQ ID NO: 3527582 - RNA, 14 nt, Pseudomonas putida KT2440
aaaccgccccacca

SEQ ID NO: 3527583 - RNA, 20 nt, Pseudomonas putida KT2440
aaaccgcucgaacaagcgcg

SEQ ID NO: 3527584 - RNA, 18 nt, Pseudomonas putida KT2440
aaaccggccuugccgcug

SEQ ID NO: 3527585 - RNA, 17 nt, Pseudomonas putida KT2440
aaaccggguaggcccca

SEQ ID NO: 3527586 - RNA, 13 nt, Pseudomonas putida KT2440
aaaccguccaggu

SEQ ID NO: 3527587 - RNA, 20 nt, Pseudomonas putida KT2440
aaaccguuacauccaugccu

SEQ ID NO: 3527588 - RNA, 20 nt, Pseudomonas putida KT2440
aaaccucacggcgaacaccc

SEQ ID NO: 3527589 - RNA, 20 nt, Pseudomonas putida KT2440
aaaccugugggagcgggcgu

SEQ ID NO: 3527590 - RNA, 12 nt, Pseudomonas putida KT2440
aaaccuucaaca

SEQ ID NO: 3527591 - RNA, 12 nt, Pseudomonas putida KT2440
aaacgccagggc

SEQ ID NO: 3527592 - RNA, 16 nt, Pseudomonas putida KT2440
aaacgccccgacuggu

SEQ ID NO: 3527593 - RNA, 14 nt, Pseudomonas putida KT2440
aaacgccgggcacu

SEQ ID NO: 3527594 - RNA, 20 nt, Pseudomonas putida KT2440
aaacgcggaucgugacgguc

SEQ ID NO: 3527595 - RNA, 13 nt, Pseudomonas putida KT2440
aaacgcugagcga

SEQ ID NO: 3527596 - RNA, 19 nt, Pseudomonas putida KT2440
aaacgucggcagccaugcu

SEQ ID NO: 3527597 - RNA, 16 nt, Pseudomonas putida KT2440
aaacuaauauuugaac

SEQ ID NO: 3527598 - RNA, 20 nt, Pseudomonas putida KT2440
aaacuaauauuugaacaccu

SEQ ID NO: 3527599 - RNA, 17 nt, Pseudomonas putida KT2440
aaacuaccucaagguag

SEQ ID NO: 3527600 - RNA, 14 nt, Pseudomonas putida KT2440
aaacucugcagguc

SEQ ID NO: 3527601 - RNA, 15 nt, Pseudomonas putida KT2440
aaacucugcagguca

SEQ ID NO: 3527602 - RNA, 20 nt, Pseudomonas putida KT2440
aaacugcuggaaaaagaaca

SEQ ID NO: 3527603 - RNA, 21 nt, Pseudomonas putida KT2440
aaacuucucgccucagcgcca

SEQ ID NO: 3527604 - RNA, 22 nt, Pseudomonas putida KT2440
aaagaagucgccacaccacagc

SEQ ID NO: 3527605 - RNA, 16 nt, Pseudomonas putida KT2440
aaagagaagcugcagc

SEQ ID NO: 3527606 - RNA, 22 nt, Pseudomonas putida KT2440
aaagagcaacgguuuaccgccg

SEQ ID NO: 3527607 - RNA, 22 nt, Pseudomonas putida KT2440
aaagaguccgaagcgaacacag

SEQ ID NO: 3527608 - RNA, 12 nt, Pseudomonas putida KT2440
aaagcagcccca

SEQ ID NO: 3527609 - RNA, 14 nt, Pseudomonas putida KT2440
aaagcagccccaaa

SEQ ID NO: 3527610 - RNA, 18 nt, Pseudomonas putida KT2440
aaagcagccccaaaagcc

SEQ ID NO: 3527611 - RNA, 12 nt, Pseudomonas putida KT2440
aaagcagccccc

SEQ ID NO: 3527612 - RNA, 12 nt, Pseudomonas putida KT2440
aaagcaggaugg

SEQ ID NO: 3527613 - RNA, 23 nt, Pseudomonas putida KT2440
aaagcaggauggugacugccagc

SEQ ID NO: 3527614 - RNA, 13 nt, Pseudomonas putida KT2440
aaagccaacugcu

SEQ ID NO: 3527615 - RNA, 12 nt, Pseudomonas putida KT2440
aaagccagcagc

SEQ ID NO: 3527616 - RNA, 13 nt, Pseudomonas putida KT2440
aaagccagcagcc

SEQ ID NO: 3527617 - RNA, 13 nt, Pseudomonas putida KT2440
aaagccagcagug

SEQ ID NO: 3527618 - RNA, 22 nt, Pseudomonas putida KT2440
aaagccagcguaagcuggcuuu

SEQ ID NO: 3527619 - RNA, 13 nt, Pseudomonas putida KT2440
aaagcccaguuca

SEQ ID NO: 3527620 - RNA, 21 nt, Pseudomonas putida KT2440
aaagcccaguucuuggcggcu

SEQ ID NO: 3527621 - RNA, 19 nt, Pseudomonas putida KT2440
aaagcccauaaaccccagc

SEQ ID NO: 3527622 - RNA, 23 nt, Pseudomonas putida KT2440
aaagcccauaaaccccagccuuc

SEQ ID NO: 3527623 - RNA, 15 nt, Pseudomonas putida KT2440
aaagcccgccccaau

SEQ ID NO: 3527624 - RNA, 14 nt, Pseudomonas putida KT2440
aaagccgccaugug

SEQ ID NO: 3527625 - RNA, 14 nt, Pseudomonas putida KT2440
aaagccuaaaggca

SEQ ID NO: 3527626 - RNA, 13 nt, Pseudomonas putida KT2440
aaagcgagcaugg

SEQ ID NO: 3527627 - RNA, 18 nt, Pseudomonas putida KT2440
aaagcgcaaucaaagcag

SEQ ID NO: 3527628 - RNA, 14 nt, Pseudomonas putida KT2440
aaagcgcagcgcag

SEQ ID NO: 3527629 - RNA, 14 nt, Pseudomonas putida KT2440
aaagcgcgccucca

SEQ ID NO: 3527630 - RNA, 23 nt, Pseudomonas putida KT2440
aaagcgcgucugauagccagggc

SEQ ID NO: 3527631 - RNA, 10 nt, Pseudomonas putida KT2440
aaagcggccc

SEQ ID NO: 3527632 - RNA, 20 nt, Pseudomonas putida KT2440
aaagcggccccaguggcuua

SEQ ID NO: 3527633 - RNA, 18 nt, Pseudomonas putida KT2440
aaagcgggcaacugcgcc

SEQ ID NO: 3527634 - RNA, 11 nt, Pseudomonas putida KT2440
aacagcugcau

SEQ ID NO: 3527635 - RNA, 13 nt, Pseudomonas putida KT2440
aacagcugccggg

SEQ ID NO: 3527636 - RNA, 12 nt, Pseudomonas putida KT2440
aacagcugcgcg

SEQ ID NO: 3527637 - RNA, 13 nt, Pseudomonas putida KT2440
aacagcuucaaca

SEQ ID NO: 3527638 - RNA, 18 nt, Pseudomonas putida KT2440
aacagcuucaacaagguc

SEQ ID NO: 3527639 - RNA, 19 nt, Pseudomonas putida KT2440
aacagcuucaacaaggucu

SEQ ID NO: 3527640 - RNA, 11 nt, Pseudomonas putida KT2440
aacaggaucag

SEQ ID NO: 3527641 - RNA, 20 nt, Pseudomonas putida KT2440
aacaggauggcaaagcgcag

SEQ ID NO: 3527642 - RNA, 13 nt, Pseudomonas putida KT2440
aacaggcucucca

SEQ ID NO: 3527643 - RNA, 17 nt, Pseudomonas putida KT2440
aacaggcugauguugau

SEQ ID NO: 3527644 - RNA, 15 nt, Pseudomonas putida KT2440
aacaggcuggccgac

SEQ ID NO: 3527645 - RNA, 21 nt, Pseudomonas putida KT2440
aacagggguucgaguccccua

SEQ ID NO: 3527646 - RNA, 22 nt, Pseudomonas putida KT2440
aacaggucgccgcuguucagcc

SEQ ID NO: 3527647 - RNA, 15 nt, Pseudomonas putida KT2440
aacaggugcucacca

SEQ ID NO: 3527648 - RNA, 15 nt, Pseudomonas putida KT2440
aacagguucgacagu

SEQ ID NO: 3527649 - RNA, 16 nt, Pseudomonas putida KT2440
aacagguucucggcac

SEQ ID NO: 3527650 - RNA, 19 nt, Pseudomonas putida KT2440
aacaguggcccgaugauca

SEQ ID NO: 3527651 - RNA, 19 nt, Pseudomonas putida KT2440
aacaguuucuugccuucca

SEQ ID NO: 3527652 - RNA, 17 nt, Pseudomonas putida KT2440
aacaguuuucaaugcug

SEQ ID NO: 3527653 - RNA, 22 nt, Pseudomonas putida KT2440
aacaguuuucaaugcugcucgc

SEQ ID NO: 3527654 - RNA, 13 nt, Pseudomonas putida KT2440
aacauacgcauca

SEQ ID NO: 3527655 - RNA, 23 nt, Pseudomonas putida KT2440
aacaucagcaggaagcagaugaa

SEQ ID NO: 3527656 - RNA, 18 nt, Pseudomonas putida KT2440
aacaugaaagugacaggu

SEQ ID NO: 3527657 - RNA, 17 nt, Pseudomonas putida KT2440
aacaugccacggccuuc

SEQ ID NO: 3527658 - RNA, 20 nt, Pseudomonas putida KT2440
aacaugccacggccuucuuc

SEQ ID NO: 3527659 - RNA, 15 nt, Pseudomonas putida KT2440
aacauucaccagcca

SEQ ID NO: 3527660 - RNA, 16 nt, Pseudomonas putida KT2440
aacauucaccagccag

SEQ ID NO: 3527661 - RNA, 19 nt, Pseudomonas putida KT2440
aacauucaccagccaggca

SEQ ID NO: 3527662 - RNA, 19 nt, Pseudomonas putida KT2440
aacauugcuaauuucaggu

SEQ ID NO: 3527663 - RNA, 23 nt, Pseudomonas putida KT2440
aaccaaggugcuaccggcgccac

SEQ ID NO: 3527664 - RNA, 18 nt, Pseudomonas putida KT2440
aaccaauuacuuggccug

SEQ ID NO: 3527665 - RNA, 14 nt, Pseudomonas putida KT2440
aaccacacacucuu

SEQ ID NO: 3527666 - RNA, 18 nt, Pseudomonas putida KT2440
aaccacacagaugccgcc

SEQ ID NO: 3527667 - RNA, 13 nt, Pseudomonas putida KT2440
aaccacagcggcc

SEQ ID NO: 3527668 - RNA, 17 nt, Pseudomonas putida KT2440
aaccacagcggccacag

SEQ ID NO: 3527669 - RNA, 21 nt, Pseudomonas putida KT2440
aaccacaucggcgcgcccucc

SEQ ID NO: 3527670 - RNA, 17 nt, Pseudomonas putida KT2440
aaccaccaccgaccgca

SEQ ID NO: 3527671 - RNA, 17 nt, Pseudomonas putida KT2440
aaccacccugaugcagc

SEQ ID NO: 3527672 - RNA, 21 nt, Pseudomonas putida KT2440
aaccacccugaugcagcagug

SEQ ID NO: 3527673 - RNA, 16 nt, Pseudomonas putida KT2440
aaccaccgaugcugug

SEQ ID NO: 3527674 - RNA, 23 nt, Pseudomonas putida KT2440
aaccaccgcucaaacccggcagc

SEQ ID NO: 3527675 - RNA, 21 nt, Pseudomonas putida KT2440
aaccacgccugcgccgcucgu

SEQ ID NO: 3527676 - RNA, 14 nt, Pseudomonas putida KT2440
aaccagcagcgccu

SEQ ID NO: 3527677 - RNA, 12 nt, Pseudomonas putida KT2440
aaccagccagcc

SEQ ID NO: 3527678 - RNA, 18 nt, Pseudomonas putida KT2440
aaccagcccgccgccagu

SEQ ID NO: 3527679 - RNA, 12 nt, Pseudomonas putida KT2440
aaccagcucacc

SEQ ID NO: 3527680 - RNA, 16 nt, Pseudomonas putida KT2440
aaccagucauccucag

SEQ ID NO: 3527681 - RNA, 22 nt, Pseudomonas putida KT2440
aaccagucgauaaaccgugcaa

SEQ ID NO: 3527682 - RNA, 14 nt, Pseudomonas putida KT2440
aaccaugcaggucg

SEQ ID NO: 3527683 - RNA, 14 nt, Pseudomonas putida KT2440
aaccauggaagcuc

SEQ ID NO: 3527684 - RNA, 20 nt, Pseudomonas putida KT2440
aaccauggcgucaggcguuu

SEQ ID NO: 3527685 - RNA, 21 nt, Pseudomonas putida KT2440
aaccauucaaugcgugggucg

SEQ ID NO: 3527686 - RNA, 19 nt, Pseudomonas putida KT2440
aaccauuggugaaagcgca

SEQ ID NO: 3527687 - RNA, 17 nt, Pseudomonas putida KT2440
aacccaccagcacugcu

SEQ ID NO: 3527688 - RNA, 13 nt, Pseudomonas putida KT2440
aacccagccagcg

SEQ ID NO: 3527689 - RNA, 15 nt, Pseudomonas putida KT2440
aacccagccagcgac

SEQ ID NO: 3527690 - RNA, 19 nt, Pseudomonas putida KT2440
aacccagcuugaagcggcc

SEQ ID NO: 3527691 - RNA, 19 nt, Pseudomonas putida KT2440
aacccagguacgaagccau

SEQ ID NO: 3527692 - RNA, 16 nt, Pseudomonas putida KT2440
aaccccacgccuguuu

SEQ ID NO: 3527693 - RNA, 22 nt, Pseudomonas putida KT2440
aaccccagcgcguacagcgaca

SEQ ID NO: 3527694 - RNA, 13 nt, Pseudomonas putida KT2440
aacccccacaggg

SEQ ID NO: 3527695 - RNA, 18 nt, Pseudomonas putida KT2440
aaccccgucgccucaccu

SEQ ID NO: 3527696 - RNA, 22 nt, Pseudomonas putida KT2440
aaccccugauguggcugcaccc

SEQ ID NO: 3527697 - RNA, 18 nt, Pseudomonas putida KT2440
aacccgacaacagcugca

SEQ ID NO: 3527698 - RNA, 19 nt, Pseudomonas putida KT2440
aacccgauuacaagggccu

SEQ ID NO: 3527699 - RNA, 12 nt, Pseudomonas putida KT2440
aacccgcaucau

SEQ ID NO: 3527700 - RNA, 15 nt, Pseudomonas putida KT2440
aacccgcgccuacaa

SEQ ID NO: 3527701 - RNA, 14 nt, Pseudomonas putida KT2440
aacccgcgcugccu

SEQ ID NO: 3527702 - RNA, 10 nt, Pseudomonas putida KT2440
aacccgcucc

SEQ ID NO: 3527703 - RNA, 21 nt, Pseudomonas putida KT2440
aacccgcuccuacaaagcggc

SEQ ID NO: 3527704 - RNA, 22 nt, Pseudomonas putida KT2440
aacccgcuccuacauggaucgc

SEQ ID NO: 3527705 - RNA, 13 nt, Pseudomonas putida KT2440
aacccggccagca

SEQ ID NO: 3527706 - RNA, 15 nt, Pseudomonas putida KT2440
aacccggccagcagg

SEQ ID NO: 3527707 - RNA, 14 nt, Pseudomonas putida KT2440
aacccggccaggcc

SEQ ID NO: 3527708 - RNA, 19 nt, Pseudomonas putida KT2440
aacccggccuuggccgcug

SEQ ID NO: 3527709 - RNA, 18 nt, Pseudomonas putida KT2440
aacccgggucaggcgcaa

SEQ ID NO: 3527710 - RNA, 17 nt, Pseudomonas putida KT2440
aacccgguucgccacgg

SEQ ID NO: 3527711 - RNA, 19 nt, Pseudomonas putida KT2440
aacccgguucgccacggua

SEQ ID NO: 3527712 - RNA, 20 nt, Pseudomonas putida KT2440
aacccgguucgccacgguac

SEQ ID NO: 3527713 - RNA, 22 nt, Pseudomonas putida KT2440
aacccgguuggggacggcagcc

SEQ ID NO: 3527714 - RNA, 20 nt, Pseudomonas putida KT2440
aacccgucagugcucggcaa

SEQ ID NO: 3527715 - RNA, 22 nt, Pseudomonas putida KT2440
aacccgugcaucugcuccccca

SEQ ID NO: 3527716 - RNA, 20 nt, Pseudomonas putida KT2440
aacccucacgcgccaggucg

SEQ ID NO: 3527717 - RNA, 21 nt, Pseudomonas putida KT2440
aacccucgaccucgaucucga

SEQ ID NO: 3527718 - RNA, 20 nt, Pseudomonas putida KT2440
aacccucggccacaucggca

SEQ ID NO: 3527719 - RNA, 17 nt, Pseudomonas putida KT2440
aaccgaacccgcuggcg

SEQ ID NO: 3527720 - RNA, 11 nt, Pseudomonas putida KT2440
aaccgacccug

SEQ ID NO: 3527721 - RNA, 13 nt, Pseudomonas putida KT2440
aaccgacccugcu

SEQ ID NO: 3527722 - RNA, 14 nt, Pseudomonas putida KT2440
aaccgcacccaggu

SEQ ID NO: 3527723 - RNA, 19 nt, Pseudomonas putida KT2440
aaccgcgaagcaggcugcg

SEQ ID NO: 3527724 - RNA, 17 nt, Pseudomonas putida KT2440
aaccgcgccagcuccac

SEQ ID NO: 3527725 - RNA, 12 nt, Pseudomonas putida KT2440
aaccgcgcuggu

SEQ ID NO: 3527726 - RNA, 18 nt, Pseudomonas putida KT2440
aaccgcgcugguaagccu

SEQ ID NO: 3527727 - RNA, 14 nt, Pseudomonas putida KT2440
aaccgcucccaggu

SEQ ID NO: 3527728 - RNA, 21 nt, Pseudomonas putida KT2440
aaccgcugcauggccuggcaa

SEQ ID NO: 3527729 - RNA, 16 nt, Pseudomonas putida KT2440
aaccgcuguacaggug

SEQ ID NO: 3527730 - RNA, 15 nt, Pseudomonas putida KT2440
aaccggaaucugcuc

SEQ ID NO: 3527731 - RNA, 19 nt, Pseudomonas putida KT2440
aaccggccacgaaggccgg

SEQ ID NO: 3527732 - RNA, 20 nt, Pseudomonas putida KT2440
aaccgggucggcgccaggcc

SEQ ID NO: 3527733 - RNA, 14 nt, Pseudomonas putida KT2440
aaccgucuuuaccg

SEQ ID NO: 3527734 - RNA, 21 nt, Pseudomonas putida KT2440
aaccguucacguucaacgccg

SEQ ID NO: 3527735 - RNA, 18 nt, Pseudomonas putida KT2440
aaccguuucaguacagcc

SEQ ID NO: 3527736 - RNA, 14 nt, Pseudomonas putida KT2440
aaccucaacgccau

SEQ ID NO: 3527737 - RNA, 16 nt, Pseudomonas putida KT2440
aaccucaacgccuccc

SEQ ID NO: 3527738 - RNA, 20 nt, Pseudomonas putida KT2440
aaccucacggcgaacacccc

SEQ ID NO: 3527739 - RNA, 22 nt, Pseudomonas putida KT2440
aaccucacuggcauccggcagc

SEQ ID NO: 3527740 - RNA, 22 nt, Pseudomonas putida KT2440
aacugcccaggaucacuggccu

SEQ ID NO: 3527741 - RNA, 21 nt, Pseudomonas putida KT2440
aacugcgggcugaggaaguug

SEQ ID NO: 3527742 - RNA, 15 nt, Pseudomonas putida KT2440
aacugcuccaggcag

SEQ ID NO: 3527743 - RNA, 16 nt, Pseudomonas putida KT2440
aacugcucuaccaacu

SEQ ID NO: 3527744 - RNA, 14 nt, Pseudomonas putida KT2440
aacuggaugaucca

SEQ ID NO: 3527745 - RNA, 14 nt, Pseudomonas putida KT2440
aacuggccagcagc

SEQ ID NO: 3527746 - RNA, 12 nt, Pseudomonas putida KT2440
aacuggccaggg

SEQ ID NO: 3527747 - RNA, 15 nt, Pseudomonas putida KT2440
aacuggcccacccgg

SEQ ID NO: 3527748 - RNA, 19 nt, Pseudomonas putida KT2440
aacuggcccgcgccaggcu

SEQ ID NO: 3527749 - RNA, 15 nt, Pseudomonas putida KT2440
aacuggcgcccggca

SEQ ID NO: 3527750 - RNA, 21 nt, Pseudomonas putida KT2440
aacuggcucaugcgccagggc

SEQ ID NO: 3527751 - RNA, 16 nt, Pseudomonas putida KT2440
aacugggcauccagcu

SEQ ID NO: 3527752 - RNA, 17 nt, Pseudomonas putida KT2440
aacuggucaaacaaugc

SEQ ID NO: 3527753 - RNA, 19 nt, Pseudomonas putida KT2440
aacuguacugacugacguc

SEQ ID NO: 3527754 - RNA, 19 nt, Pseudomonas putida KT2440
aacugucguuuggcgcgau

SEQ ID NO: 3527755 - RNA, 16 nt, Pseudomonas putida KT2440
aacuguuucugcucuu

SEQ ID NO: 3527756 - RNA, 21 nt, Pseudomonas putida KT2440
aacuuaauaugcgccccgucc

SEQ ID NO: 3527757 - RNA, 20 nt, Pseudomonas putida KT2440
aacuuacaucugcgacugca

SEQ ID NO: 3527758 - RNA, 14 nt, Pseudomonas putida KT2440
aacuuacuucggcg

SEQ ID NO: 3527759 - RNA, 15 nt, Pseudomonas putida KT2440
aacuucccucugccu

SEQ ID NO: 3527760 - RNA, 14 nt, Pseudomonas putida KT2440
aacuucgccgaggc

SEQ ID NO: 3527761 - RNA, 16 nt, Pseudomonas putida KT2440
aacuucgguggcucac

SEQ ID NO: 3527762 - RNA, 16 nt, Pseudomonas putida KT2440
aacuugacguccagcu

SEQ ID NO: 3527763 - RNA, 15 nt, Pseudomonas putida KT2440
aacuugcgcaucaac

SEQ ID NO: 3527764 - RNA, 22 nt, Pseudomonas putida KT2440
aacuugcgggucagcagcaccg

SEQ ID NO: 3527765 - RNA, 12 nt, Pseudomonas putida KT2440
aagaaaaacccg

SEQ ID NO: 3527766 - RNA, 12 nt, Pseudomonas putida KT2440
aagaacaucacg

SEQ ID NO: 3527767 - RNA, 18 nt, Pseudomonas putida KT2440
aagaagcuaacccggucu

SEQ ID NO: 3527768 - RNA, 18 nt, Pseudomonas putida KT2440
aagaagcuguagucacca

SEQ ID NO: 3527769 - RNA, 14 nt, Pseudomonas putida KT2440
aagaaggagagccu

SEQ ID NO: 3527770 - RNA, 24 nt, Pseudomonas putida KT2440
aagaaggcugcccucgggcagccu

SEQ ID NO: 3527771 - RNA, 22 nt, Pseudomonas putida KT2440
aagaagucauccggcgcggccu

SEQ ID NO: 3527772 - RNA, 23 nt, Pseudomonas putida KT2440
aagaaguccucccaguacaugau

SEQ ID NO: 3527773 - RNA, 21 nt, Pseudomonas putida KT2440
aagaagucgccacaccacagc

SEQ ID NO: 3527774 - RNA, 12 nt, Pseudomonas putida KT2440
aagaaugccgcc

SEQ ID NO: 3527775 - RNA, 22 nt, Pseudomonas putida KT2440
aagacaguggaaacgacaaggu

SEQ ID NO: 3527776 - RNA, 16 nt, Pseudomonas putida KT2440
aagaccgccgcccagg

SEQ ID NO: 3527777 - RNA, 19 nt, Pseudomonas putida KT2440
aagaccgccgcccagguca

SEQ ID NO: 3527778 - RNA, 15 nt, Pseudomonas putida KT2440
aagaccggguccagc

SEQ ID NO: 3527779 - RNA, 16 nt, Pseudomonas putida KT2440
aagacgaagcgcuugg

SEQ ID NO: 3527780 - RNA, 20 nt, Pseudomonas putida KT2440
aagacgaaguacggcuugcc

SEQ ID NO: 3527781 - RNA, 18 nt, Pseudomonas putida KT2440
aagacgcucgacagcaac

SEQ ID NO: 3527782 - RNA, 16 nt, Pseudomonas putida KT2440
aagagaagcugcagcu

SEQ ID NO: 3527783 - RNA, 19 nt, Pseudomonas putida KT2440
aagagaagcugcagcuuca

SEQ ID NO: 3527784 - RNA, 17 nt, Pseudomonas putida KT2440
aagaggcagcgaaagca

SEQ ID NO: 3527785 - RNA, 16 nt, Pseudomonas putida KT2440
aagaggccagcacagg

SEQ ID NO: 3527786 - RNA, 16 nt, Pseudomonas putida KT2440
aagaggccggcacaga

SEQ ID NO: 3527787 - RNA, 21 nt, Pseudomonas putida KT2440
aagaggccggcacaggaaggc

SEQ ID NO: 3527788 - RNA, 14 nt, Pseudomonas putida KT2440
aagaggccgguacu

SEQ ID NO: 3527789 - RNA, 13 nt, Pseudomonas putida KT2440
aagaguucguaca

SEQ ID NO: 3527790 - RNA, 14 nt, Pseudomonas putida KT2440
aagauacgcgcaga

SEQ ID NO: 3527791 - RNA, 14 nt, Pseudomonas putida KT2440
aagauaguaggcac

SEQ ID NO: 3527792 - RNA, 15 nt, Pseudomonas putida KT2440
aagaucacugcgcag

SEQ ID NO: 3527793 - RNA, 14 nt, Pseudomonas putida KT2440
aagaucagcaccga

SEQ ID NO: 3527794 - RNA, 15 nt, Pseudomonas putida KT2440
aagaucgcccagcug

SEQ ID NO: 3527795 - RNA, 20 nt, Pseudomonas putida KT2440
aagaucgguacaugcgaacg

SEQ ID NO: 3527796 - RNA, 17 nt, Pseudomonas putida KT2440
aagaucugcguggcagu

SEQ ID NO: 3527797 - RNA, 22 nt, Pseudomonas putida KT2440
aagaugaccuugucgacaaagu

SEQ ID NO: 3527798 - RNA, 23 nt, Pseudomonas putida KT2440
aagaugacuggccggagcuggag

SEQ ID NO: 3527799 - RNA, 18 nt, Pseudomonas putida KT2440
aagaugguuuccagcucc

SEQ ID NO: 3527800 - RNA, 14 nt, Pseudomonas putida KT2440
aagauuuucagcca

SEQ ID NO: 3527801 - RNA, 19 nt, Pseudomonas putida KT2440
aagauuuucagccaaauca

SEQ ID NO: 3527802 - RNA, 23 nt, Pseudomonas putida KT2440
aagcaacuguuggaauggcgcac

SEQ ID NO: 3527803 - RNA, 22 nt, Pseudomonas putida KT2440
aagcaagaccggguccagcaac

SEQ ID NO: 3527804 - RNA, 15 nt, Pseudomonas putida KT2440
aagcaaucagaacgu

SEQ ID NO: 3527805 - RNA, 16 nt, Pseudomonas putida KT2440
aagcaccgagaugauc

SEQ ID NO: 3527806 - RNA, 18 nt, Pseudomonas putida KT2440
aagcaccgccacaauccg

SEQ ID NO: 3527807 - RNA, 20 nt, Pseudomonas putida KT2440
aagcaccgccacaauccgcu

SEQ ID NO: 3527808 - RNA, 23 nt, Pseudomonas putida KT2440
aagcaccgcgcacacuucgccgg

SEQ ID NO: 3527809 - RNA, 16 nt, Pseudomonas putida KT2440
aagcacgcgcugagga

SEQ ID NO: 3527810 - RNA, 21 nt, Pseudomonas putida KT2440
aagcacgucgcgauugaucag

SEQ ID NO: 3527811 - RNA, 19 nt, Pseudomonas putida KT2440
aagcagaacaucaggucug

SEQ ID NO: 3527812 - RNA, 12 nt, Pseudomonas putida KT2440
aagcagacagcu

SEQ ID NO: 3527813 - RNA, 14 nt, Pseudomonas putida KT2440
aagcagcagcuugc

SEQ ID NO: 3527814 - RNA, 20 nt, Pseudomonas putida KT2440
aagcagccccagggcccuca

SEQ ID NO: 3527815 - RNA, 22 nt, Pseudomonas putida KT2440
aagcagccccagggcccucaac

SEQ ID NO: 3527816 - RNA, 11 nt, Pseudomonas putida KT2440
aagcagcgaau

SEQ ID NO: 3527817 - RNA, 15 nt, Pseudomonas putida KT2440
aagcaggcgacgcag

SEQ ID NO: 3527818 - RNA, 15 nt, Pseudomonas putida KT2440
aagcagucccagcac

SEQ ID NO: 3527819 - RNA, 23 nt, Pseudomonas putida KT2440
aagcauuacuucuuggagcggcc

SEQ ID NO: 3527820 - RNA, 21 nt, Pseudomonas putida KT2440
aagcauucgcauuaccagcac

SEQ ID NO: 3527821 - RNA, 23 nt, Pseudomonas putida KT2440
aagccaagcgccgucgaacgucc

SEQ ID NO: 3527822 - RNA, 21 nt, Pseudomonas putida KT2440
aagccacgcaccucggccaug

SEQ ID NO: 3527823 - RNA, 13 nt, Pseudomonas putida KT2440
aagccacgccaga

SEQ ID NO: 3527824 - RNA, 22 nt, Pseudomonas putida KT2440
aagccacgccagaaccugacaa

SEQ ID NO: 3527825 - RNA, 21 nt, Pseudomonas putida KT2440
aagccacgcucgugcaggcug

SEQ ID NO: 3527826 - RNA, 14 nt, Pseudomonas putida KT2440
aagccagcagccug

SEQ ID NO: 3527827 - RNA, 17 nt, Pseudomonas putida KT2440
aagccagcagccugugc

SEQ ID NO: 3527828 - RNA, 16 nt, Pseudomonas putida KT2440
aagccaguacgcaggc

SEQ ID NO: 3527829 - RNA, 22 nt, Pseudomonas putida KT2440
aagccauaucccgccagguccg

SEQ ID NO: 3527830 - RNA, 17 nt, Pseudomonas putida KT2440
aagccaugaucagcgcc

SEQ ID NO: 3527831 - RNA, 17 nt, Pseudomonas putida KT2440
aagccaugucuucacga

SEQ ID NO: 3527832 - RNA, 20 nt, Pseudomonas putida KT2440
aagcccaauacccaacagca

SEQ ID NO: 3527833 - RNA, 22 nt, Pseudomonas putida KT2440
aagcccacacaccgcaacccag

SEQ ID NO: 3527834 - RNA, 17 nt, Pseudomonas putida KT2440
aagcccauaaaccccag

SEQ ID NO: 3527835 - RNA, 17 nt, Pseudomonas putida KT2440
aagcccauggcuggcag

SEQ ID NO: 3527836 - RNA, 22 nt, Pseudomonas putida KT2440
aagcccauuucgugggucacgc

SEQ ID NO: 3527837 - RNA, 18 nt, Pseudomonas putida KT2440
aagccccggcaucgcugc

SEQ ID NO: 3527838 - RNA, 19 nt, Pseudomonas putida KT2440
aagccccggcucgcaugag

SEQ ID NO: 3527839 - RNA, 15 nt, Pseudomonas putida KT2440
aagccccuggaagcg

SEQ ID NO: 3527840 - RNA, 21 nt, Pseudomonas putida KT2440
aagcccgcgaagaggccagca

SEQ ID NO: 3527841 - RNA, 16 nt, Pseudomonas putida KT2440
aagcccgcucccacag

SEQ ID NO: 3527842 - RNA, 23 nt, Pseudomonas putida KT2440
aagcccgcuccuacaggggaugc

SEQ ID NO: 3527843 - RNA, 16 nt, Pseudomonas putida KT2440
aagcccggcaccuggc

SEQ ID NO: 3527844 - RNA, 23 nt, Pseudomonas putida KT2440
aagcccggccaggugccgggcuu

SEQ ID NO: 3527845 - RNA, 22 nt, Pseudomonas putida KT2440
aaggcucgcccucgcggcggcu

SEQ ID NO: 3527846 - RNA, 15 nt, Pseudomonas putida KT2440
aaggcugacgccagu

SEQ ID NO: 3527847 - RNA, 18 nt, Pseudomonas putida KT2440
aaggcugcccucgggcag

SEQ ID NO: 3527848 - RNA, 15 nt, Pseudomonas putida KT2440
aaggcugcgcuugag

SEQ ID NO: 3527849 - RNA, 21 nt, Pseudomonas putida KT2440
aaggcuggcaacccgccuccu

SEQ ID NO: 3527850 - RNA, 23 nt, Pseudomonas putida KT2440
aaggcuggccagacgaugauggc

SEQ ID NO: 3527851 - RNA, 15 nt, Pseudomonas putida KT2440
aaggcuggucgcugc

SEQ ID NO: 3527852 - RNA, 16 nt, Pseudomonas putida KT2440
aaggcuggucgcugcc

SEQ ID NO: 3527853 - RNA, 13 nt, Pseudomonas putida KT2440
aaggcuucaaggu

SEQ ID NO: 3527854 - RNA, 23 nt, Pseudomonas putida KT2440
aaggcuugcccucauucgcccgc

SEQ ID NO: 3527855 - RNA, 20 nt, Pseudomonas putida KT2440
aaggcuuggugcucaugauc

SEQ ID NO: 3527856 - RNA, 20 nt, Pseudomonas putida KT2440
aaggcuuuccaccuggccac

SEQ ID NO: 3527857 - RNA, 23 nt, Pseudomonas putida KT2440
aaggcuuuggccguagccaggca

SEQ ID NO: 3527858 - RNA, 15 nt, Pseudomonas putida KT2440
aagggagaguccugc

SEQ ID NO: 3527859 - RNA, 20 nt, Pseudomonas putida KT2440
aagggauuggcaacaaugua

SEQ ID NO: 3527860 - RNA, 22 nt, Pseudomonas putida KT2440
aagggccgcaacgcggcccugg

SEQ ID NO: 3527861 - RNA, 19 nt, Pseudomonas putida KT2440
aagggccgcaaggccgcuc

SEQ ID NO: 3527862 - RNA, 22 nt, Pseudomonas putida KT2440
aagggccgcgacgcggcccugg

SEQ ID NO: 3527863 - RNA, 21 nt, Pseudomonas putida KT2440
aagggccguuacucccacagc

SEQ ID NO: 3527864 - RNA, 18 nt, Pseudomonas putida KT2440
aagggccugcaggcagca

SEQ ID NO: 3527865 - RNA, 20 nt, Pseudomonas putida KT2440
aagggccugcaggcagcaua

SEQ ID NO: 3527866 - RNA, 13 nt, Pseudomonas putida KT2440
aagggccugugcc

SEQ ID NO: 3527867 - RNA, 16 nt, Pseudomonas putida KT2440
aagggccugugccgaa

SEQ ID NO: 3527868 - RNA, 15 nt, Pseudomonas putida KT2440
aagggcgucugcucc

SEQ ID NO: 3527869 - RNA, 19 nt, Pseudomonas putida KT2440
aagggcucaacgccagggc

SEQ ID NO: 3527870 - RNA, 21 nt, Pseudomonas putida KT2440
aagggcucaacgccagggcaa

SEQ ID NO: 3527871 - RNA, 19 nt, Pseudomonas putida KT2440
aaggggccggcacaggcuu

SEQ ID NO: 3527872 - RNA, 22 nt, Pseudomonas putida KT2440
aaggggcggguggaggugcagg

SEQ ID NO: 3527873 - RNA, 19 nt, Pseudomonas putida KT2440
aagggguacgaacgccagu

SEQ ID NO: 3527874 - RNA, 14 nt, Pseudomonas putida KT2440
aagggucgacacca

SEQ ID NO: 3527875 - RNA, 17 nt, Pseudomonas putida KT2440
aagggugaugcccgcag

SEQ ID NO: 3527876 - RNA, 18 nt, Pseudomonas putida KT2440
aagggugucaacaggcug

SEQ ID NO: 3527877 - RNA, 15 nt, Pseudomonas putida KT2440
aagguaguaaaaaua

SEQ ID NO: 3527878 - RNA, 18 nt, Pseudomonas putida KT2440
aagguagugcaccaacgc

SEQ ID NO: 3527879 - RNA, 20 nt, Pseudomonas putida KT2440
aagguagugcaccaacgccg

SEQ ID NO: 3527880 - RNA, 14 nt, Pseudomonas putida KT2440
aagguaucggccau

SEQ ID NO: 3527881 - RNA, 22 nt, Pseudomonas putida KT2440
aagguauggccuuucugcuucc

SEQ ID NO: 3527882 - RNA, 16 nt, Pseudomonas putida KT2440
aagguauucgaggauc

SEQ ID NO: 3527883 - RNA, 23 nt, Pseudomonas putida KT2440
aagguauucgaggaucagcgcag

SEQ ID NO: 3527884 - RNA, 22 nt, Pseudomonas putida KT2440
aaggucacgcccaucaggaaca

SEQ ID NO: 3527885 - RNA, 23 nt, Pseudomonas putida KT2440
aaggucacgcccaucaggaacag

SEQ ID NO: 3527886 - RNA, 15 nt, Pseudomonas putida KT2440
aaggucagccagacg

SEQ ID NO: 3527887 - RNA, 23 nt, Pseudomonas putida KT2440
aaggucccguuauggaugccaau

SEQ ID NO: 3527888 - RNA, 12 nt, Pseudomonas putida KT2440
aaggucggccag

SEQ ID NO: 3527889 - RNA, 21 nt, Pseudomonas putida KT2440
aaggucucuuccugcaccugg

SEQ ID NO: 3527890 - RNA, 15 nt, Pseudomonas putida KT2440
aaggucuucagcuca

SEQ ID NO: 3527891 - RNA, 17 nt, Pseudomonas putida KT2440
aaggugauguugcccgg

SEQ ID NO: 3527892 - RNA, 19 nt, Pseudomonas putida KT2440
aaggugccaacaggcagca

SEQ ID NO: 3527893 - RNA, 13 nt, Pseudomonas putida KT2440
aaggugcccugcu

SEQ ID NO: 3527894 - RNA, 22 nt, Pseudomonas putida KT2440
aagguggcaccgccgcccacgc

SEQ ID NO: 3527895 - RNA, 23 nt, Pseudomonas putida KT2440
aagguggcauuggcgugcucgcg

SEQ ID NO: 3527896 - RNA, 16 nt, Pseudomonas putida KT2440
aagguugccaccagca

SEQ ID NO: 3527897 - RNA, 19 nt, Pseudomonas putida KT2440
aagguugccaccagcauca

SEQ ID NO: 3527898 - RNA, 17 nt, Pseudomonas putida KT2440
aagguuggggccaggcu

SEQ ID NO: 3527899 - RNA, 15 nt, Pseudomonas putida KT2440
aaguaacggccacgg

SEQ ID NO: 3527900 - RNA, 13 nt, Pseudomonas putida KT2440
aaguacaacugcc

SEQ ID NO: 3527901 - RNA, 20 nt, Pseudomonas putida KT2440
aaguacaacugccacccucc

SEQ ID NO: 3527902 - RNA, 13 nt, Pseudomonas putida KT2440
aaguacgccggcg

SEQ ID NO: 3527903 - RNA, 16 nt, Pseudomonas putida KT2440
aaguacggccagcagg

SEQ ID NO: 3527904 - RNA, 16 nt, Pseudomonas putida KT2440
aaguacggcuugccgg

SEQ ID NO: 3527905 - RNA, 17 nt, Pseudomonas putida KT2440
aaguacuugcaggugca

SEQ ID NO: 3527906 - RNA, 21 nt, Pseudomonas putida KT2440
aaguacuugcaggugcagggu

SEQ ID NO: 3527907 - RNA, 18 nt, Pseudomonas putida KT2440
aaguaguguucgccguug

SEQ ID NO: 3527908 - RNA, 22 nt, Pseudomonas putida KT2440
aaguaguguucgccguuguuca

SEQ ID NO: 3527909 - RNA, 15 nt, Pseudomonas putida KT2440
aaguauuaauuugaa

SEQ ID NO: 3527910 - RNA, 13 nt, Pseudomonas putida KT2440
aagucaaccaacu

SEQ ID NO: 3527911 - RNA, 18 nt, Pseudomonas putida KT2440
aagucaaccaacuccuuc

SEQ ID NO: 3527912 - RNA, 14 nt, Pseudomonas putida KT2440
aagucaaccucaac

SEQ ID NO: 3527913 - RNA, 17 nt, Pseudomonas putida KT2440
aagucaaccucaacgcc

SEQ ID NO: 3527914 - RNA, 13 nt, Pseudomonas putida KT2440
aagucagccaggu

SEQ ID NO: 3527915 - RNA, 17 nt, Pseudomonas putida KT2440
aagucauccgccaggcu

SEQ ID NO: 3527916 - RNA, 16 nt, Pseudomonas putida KT2440
aagucaugcucgccgg

SEQ ID NO: 3527917 - RNA, 19 nt, Pseudomonas putida KT2440
aaguccacgaaccugugca

SEQ ID NO: 3527918 - RNA, 22 nt, Pseudomonas putida KT2440
aagucccccaucggcacccgca

SEQ ID NO: 3527919 - RNA, 23 nt, Pseudomonas putida KT2440
aaguccccguugguguccuuguc

SEQ ID NO: 3527920 - RNA, 17 nt, Pseudomonas putida KT2440
aaguccgccaggaaguc

SEQ ID NO: 3527921 - RNA, 18 nt, Pseudomonas putida KT2440
aaguccugcaaaggcccu

SEQ ID NO: 3527922 - RNA, 22 nt, Pseudomonas putida KT2440
aaguccuucaucugucagcgcc

SEQ ID NO: 3527923 - RNA, 16 nt, Pseudomonas putida KT2440
aagucgaacuccuugu

SEQ ID NO: 3527924 - RNA, 15 nt, Pseudomonas putida KT2440
aagucgaccagcagc

SEQ ID NO: 3527925 - RNA, 17 nt, Pseudomonas putida KT2440
aagucgauuuucacgcc

SEQ ID NO: 3527926 - RNA, 13 nt, Pseudomonas putida KT2440
aagucgcacauga

SEQ ID NO: 3527927 - RNA, 22 nt, Pseudomonas putida KT2440
aagucgccacaccacagcugca

SEQ ID NO: 3527928 - RNA, 16 nt, Pseudomonas putida KT2440
aagucgcgcaccaccu

SEQ ID NO: 3527929 - RNA, 16 nt, Pseudomonas putida KT2440
aagucggguuuaccug

SEQ ID NO: 3527930 - RNA, 19 nt, Pseudomonas putida KT2440
aagucgucggcaagcuugc

SEQ ID NO: 3527931 - RNA, 18 nt, Pseudomonas putida KT2440
aagucuguaaucaggcug

SEQ ID NO: 3527932 - RNA, 16 nt, Pseudomonas putida KT2440
aagugaauagccggca

SEQ ID NO: 3527933 - RNA, 22 nt, Pseudomonas putida KT2440
aagugauaacgcgccgcugccu

SEQ ID NO: 3527934 - RNA, 23 nt, Pseudomonas putida KT2440
aagugauaacgcgccgcugccug

SEQ ID NO: 3527935 - RNA, 12 nt, Pseudomonas putida KT2440
aagugccaaggc

SEQ ID NO: 3527936 - RNA, 16 nt, Pseudomonas putida KT2440
aagugccccuggcugu

SEQ ID NO: 3527937 - RNA, 20 nt, Pseudomonas putida KT2440
aagugccgccucguugcgaa

SEQ ID NO: 3527938 - RNA, 13 nt, Pseudomonas putida KT2440
aagugccgugcau

SEQ ID NO: 3527939 - RNA, 20 nt, Pseudomonas putida KT2440
aagugcuguaugauucgccu

SEQ ID NO: 3527940 - RNA, 13 nt, Pseudomonas putida KT2440
aaguguuugaagc

SEQ ID NO: 3527941 - RNA, 23 nt, Pseudomonas putida KT2440
aaguguuugaagcuaaacgaguu

SEQ ID NO: 3527942 - RNA, 12 nt, Pseudomonas putida KT2440
aaguugagcacc

SEQ ID NO: 3527943 - RNA, 17 nt, Pseudomonas putida KT2440
aaguugagcgccgcgau

SEQ ID NO: 3527944 - RNA, 18 nt, Pseudomonas putida KT2440
aaguugcccgaaccuugc

SEQ ID NO: 3527945 - RNA, 21 nt, Pseudomonas putida KT2440
aaguuggaaagcuucuagcaa

SEQ ID NO: 3527946 - RNA, 13 nt, Pseudomonas putida KT2440
aauaaaaacaaca

SEQ ID NO: 3527947 - RNA, 11 nt, Pseudomonas putida KT2440
aauaauaaaaa

SEQ ID NO: 3527948 - RNA, 14 nt, Pseudomonas putida KT2440
aauaauaaaaaaag

SEQ ID NO: 3527949 - RNA, 14 nt, Pseudomonas putida KT2440
aauaaucagaauuu

SEQ ID NO: 3527950 - RNA, 21 nt, Pseudomonas putida KT2440
aauggcguauccacauacugc

SEQ ID NO: 3527951 - RNA, 17 nt, Pseudomonas putida KT2440
aaugggcugcaaagcag

SEQ ID NO: 3527952 - RNA, 16 nt, Pseudomonas putida KT2440
aaugggcuuccccagc

SEQ ID NO: 3527953 - RNA, 13 nt, Pseudomonas putida KT2440
aaugguugaagau

SEQ ID NO: 3527954 - RNA, 20 nt, Pseudomonas putida KT2440
aaugguuuaguccugcagcg

SEQ ID NO: 3527955 - RNA, 21 nt, Pseudomonas putida KT2440
aauguaggaucaaguaccccu

SEQ ID NO: 3527956 - RNA, 18 nt, Pseudomonas putida KT2440
aaugucggagcgggcuug

SEQ ID NO: 3527957 - RNA, 21 nt, Pseudomonas putida KT2440
aauguucaacagccgcggcac

SEQ ID NO: 3527958 - RNA, 19 nt, Pseudomonas putida KT2440
aauuaugagugccaagaau

SEQ ID NO: 3527959 - RNA, 20 nt, Pseudomonas putida KT2440
aauucauaaggaucaugaac

SEQ ID NO: 3527960 - RNA, 13 nt, Pseudomonas putida KT2440
aauuccuugcugg

SEQ ID NO: 3527961 - RNA, 14 nt, Pseudomonas putida KT2440
aauucgugaaccaa

SEQ ID NO: 3527962 - RNA, 15 nt, Pseudomonas putida KT2440
aauucucgagcugau

SEQ ID NO: 3527963 - RNA, 17 nt, Pseudomonas putida KT2440
aauugcgccagccgcuc

SEQ ID NO: 3527964 - RNA, 20 nt, Pseudomonas putida KT2440
aauugcggguguggccacac

SEQ ID NO: 3527965 - RNA, 15 nt, Pseudomonas putida KT2440
aauuggagcggccuu

SEQ ID NO: 3527966 - RNA, 13 nt, Pseudomonas putida KT2440
aauuggagcugaa

SEQ ID NO: 3527967 - RNA, 14 nt, Pseudomonas putida KT2440
aauuggccagcagg

SEQ ID NO: 3527968 - RNA, 21 nt, Pseudomonas putida KT2440
aauuggccggcaggcccggcc

SEQ ID NO: 3527969 - RNA, 20 nt, Pseudomonas putida KT2440
aauuggccggcgcugagcga

SEQ ID NO: 3527970 - RNA, 22 nt, Pseudomonas putida KT2440
aauuggcgagcaggcccgcccc

SEQ ID NO: 3527971 - RNA, 14 nt, Pseudomonas putida KT2440
aauuguucguaggu

SEQ ID NO: 3527972 - RNA, 16 nt, Pseudomonas putida KT2440
aauuguuguccgugug

SEQ ID NO: 3527973 - RNA, 21 nt, Pseudomonas putida KT2440
aauuucauccacauaggccag

SEQ ID NO: 3527974 - RNA, 20 nt, Pseudomonas putida KT2440
aauuucuuucagcucggcac

SEQ ID NO: 3527975 - RNA, 15 nt, Pseudomonas putida KT2440
aauuuucgaccaagg

SEQ ID NO: 3527976 - RNA, 12 nt, Pseudomonas putida KT2440
acaaaccacagc

SEQ ID NO: 3527977 - RNA, 20 nt, Pseudomonas putida KT2440
acaaaccagcggucugcugc

SEQ ID NO: 3527978 - RNA, 15 nt, Pseudomonas putida KT2440
acaaacgccagcaug

SEQ ID NO: 3527979 - RNA, 16 nt, Pseudomonas putida KT2440
acaaacgccagcaugc

SEQ ID NO: 3527980 - RNA, 17 nt, Pseudomonas putida KT2440
acaaacggcuuggcugc

SEQ ID NO: 3527981 - RNA, 15 nt, Pseudomonas putida KT2440
acaaagccccggcag

SEQ ID NO: 3527982 - RNA, 21 nt, Pseudomonas putida KT2440
acaaagccccggcagcgaugc

SEQ ID NO: 3527983 - RNA, 15 nt, Pseudomonas putida KT2440
acaaagcccuugucg

SEQ ID NO: 3527984 - RNA, 16 nt, Pseudomonas putida KT2440
acaaagcucaaaugcu

SEQ ID NO: 3527985 - RNA, 18 nt, Pseudomonas putida KT2440
acaaaggccggcaccgac

SEQ ID NO: 3527986 - RNA, 22 nt, Pseudomonas putida KT2440
acaaaggccggcaccgacagca

SEQ ID NO: 3527987 - RNA, 20 nt, Pseudomonas putida KT2440
acaaaggcgucgcuguucuu

SEQ ID NO: 3527988 - RNA, 20 nt, Pseudomonas putida KT2440
acaaaguugccgaugaugcg

SEQ ID NO: 3527989 - RNA, 18 nt, Pseudomonas putida KT2440
acaaaucggcagaauuuc

SEQ ID NO: 3527990 - RNA, 20 nt, Pseudomonas putida KT2440
acaaaucggcagaauuucag

SEQ ID NO: 3527991 - RNA, 16 nt, Pseudomonas putida KT2440
acaaaucggccuugcg

SEQ ID NO: 3527992 - RNA, 20 nt, Pseudomonas putida KT2440
acaaaucggccuugcgcugg

SEQ ID NO: 3527993 - RNA, 13 nt, Pseudomonas putida KT2440
acaacaaagcccc

SEQ ID NO: 3527994 - RNA, 19 nt, Pseudomonas putida KT2440
acaacaaagccccggcauc

SEQ ID NO: 3527995 - RNA, 13 nt, Pseudomonas putida KT2440
acaacaacaaaaa

SEQ ID NO: 3527996 - RNA, 14 nt, Pseudomonas putida KT2440
acaacaacaaaaaa

SEQ ID NO: 3527997 - RNA, 15 nt, Pseudomonas putida KT2440
acaacaacaaaaaaa

SEQ ID NO: 3527998 - RNA, 14 nt, Pseudomonas putida KT2440
acaacaaccaaucc

SEQ ID NO: 3527999 - RNA, 22 nt, Pseudomonas putida KT2440
acaacaagcgcugguaaaguuc

SEQ ID NO: 3528000 - RNA, 14 nt, Pseudomonas putida KT2440
acaacaggucggcg

SEQ ID NO: 3528001 - RNA, 17 nt, Pseudomonas putida KT2440
acaacagucaacaauca

SEQ ID NO: 3528002 - RNA, 12 nt, Pseudomonas putida KT2440
acaacaugguca

SEQ ID NO: 3528003 - RNA, 18 nt, Pseudomonas putida KT2440
acaacauggucacauguc

SEQ ID NO: 3528004 - RNA, 20 nt, Pseudomonas putida KT2440
acaaccaagcgaacuauccu

SEQ ID NO: 3528005 - RNA, 13 nt, Pseudomonas putida KT2440
acaaccacugcaa

SEQ ID NO: 3528006 - RNA, 20 nt, Pseudomonas putida KT2440
acaaccccaaccucaacgcc

SEQ ID NO: 3528007 - RNA, 19 nt, Pseudomonas putida KT2440
acaaccccugcaaggccag

SEQ ID NO: 3528008 - RNA, 15 nt, Pseudomonas putida KT2440
acaacccgcgcugcc

SEQ ID NO: 3528009 - RNA, 19 nt, Pseudomonas putida KT2440
acaacccuaucagggcugc

SEQ ID NO: 3528010 - RNA, 18 nt, Pseudomonas putida KT2440
acaacccuugcagcgccu

SEQ ID NO: 3528011 - RNA, 18 nt, Pseudomonas putida KT2440
acaaccgaaaaggccaac

SEQ ID NO: 3528012 - RNA, 13 nt, Pseudomonas putida KT2440
acaaccgacgggu

SEQ ID NO: 3528013 - RNA, 15 nt, Pseudomonas putida KT2440
acaaccgcuuucacu

SEQ ID NO: 3528014 - RNA, 18 nt, Pseudomonas putida KT2440
acaaccggggcaggcugu

SEQ ID NO: 3528015 - RNA, 22 nt, Pseudomonas putida KT2440
acaacgacuggucauacuccag

SEQ ID NO: 3528016 - RNA, 22 nt, Pseudomonas putida KT2440
acaacgcagccggcaccgccau

SEQ ID NO: 3528017 - RNA, 16 nt, Pseudomonas putida KT2440
acaacgcgccaccgcc

SEQ ID NO: 3528018 - RNA, 22 nt, Pseudomonas putida KT2440
acaacggcgcuguccagcgcau

SEQ ID NO: 3528019 - RNA, 15 nt, Pseudomonas putida KT2440
acaacgguguggcca

SEQ ID NO: 3528020 - RNA, 14 nt, Pseudomonas putida KT2440
acaacuaucgagca

SEQ ID NO: 3528021 - RNA, 16 nt, Pseudomonas putida KT2440
acaacuaucgagcaug

SEQ ID NO: 3528022 - RNA, 16 nt, Pseudomonas putida KT2440
acaacucaauuucccc

SEQ ID NO: 3528023 - RNA, 16 nt, Pseudomonas putida KT2440
acaacugcuccaggca

SEQ ID NO: 3528024 - RNA, 20 nt, Pseudomonas putida KT2440
acaacuguccugugcgcauu

SEQ ID NO: 3528025 - RNA, 23 nt, Pseudomonas putida KT2440
acaacuguccugugcgcauuuca

SEQ ID NO: 3528026 - RNA, 13 nt, Pseudomonas putida KT2440
acaagaacaacac

SEQ ID NO: 3528027 - RNA, 14 nt, Pseudomonas putida KT2440
acaagauaacaccc

SEQ ID NO: 3528028 - RNA, 21 nt, Pseudomonas putida KT2440
acaagauaacaccccccagca

SEQ ID NO: 3528029 - RNA, 14 nt, Pseudomonas putida KT2440
acaagccacgcacc

SEQ ID NO: 3528030 - RNA, 15 nt, Pseudomonas putida KT2440
acaagccacgcaccu

SEQ ID NO: 3528031 - RNA, 22 nt, Pseudomonas putida KT2440
acaagccacgcaccucggccau

SEQ ID NO: 3528032 - RNA, 19 nt, Pseudomonas putida KT2440
acaagccgacaaaaacaac

SEQ ID NO: 3528033 - RNA, 22 nt, Pseudomonas putida KT2440
acaagccgacaaaaacaacaau

SEQ ID NO: 3528034 - RNA, 19 nt, Pseudomonas putida KT2440
acaagccguaaagcacaca

SEQ ID NO: 3528035 - RNA, 22 nt, Pseudomonas putida KT2440
acaagcgcaggcgguuggccau

SEQ ID NO: 3528036 - RNA, 13 nt, Pseudomonas putida KT2440
acaagcgcauuga

SEQ ID NO: 3528037 - RNA, 18 nt, Pseudomonas putida KT2440
acaaggcaaaggucugcu

SEQ ID NO: 3528038 - RNA, 21 nt, Pseudomonas putida KT2440
acaaggcaaaggucugcugcg

SEQ ID NO: 3528039 - RNA, 18 nt, Pseudomonas putida KT2440
acaaggccaaccacgccu

SEQ ID NO: 3528040 - RNA, 15 nt, Pseudomonas putida KT2440
acaaggcucagcuga

SEQ ID NO: 3528041 - RNA, 17 nt, Pseudomonas putida KT2440
acaagguacucagcggc

SEQ ID NO: 3528042 - RNA, 17 nt, Pseudomonas putida KT2440
acaaggucgccaggcgc

SEQ ID NO: 3528043 - RNA, 16 nt, Pseudomonas putida KT2440
acaaggucuccgggaa

SEQ ID NO: 3528044 - RNA, 21 nt, Pseudomonas putida KT2440
acaagguugcgcaagccucag

SEQ ID NO: 3528045 - RNA, 16 nt, Pseudomonas putida KT2440
acaaguucaaggucau

SEQ ID NO: 3528046 - RNA, 21 nt, Pseudomonas putida KT2440
acaauaggccggucccaauaa

SEQ ID NO: 3528047 - RNA, 16 nt, Pseudomonas putida KT2440
acaaucgccagguaca

SEQ ID NO: 3528048 - RNA, 22 nt, Pseudomonas putida KT2440
acaaucgcgucagcaccggcag

SEQ ID NO: 3528049 - RNA, 14 nt, Pseudomonas putida KT2440
acaaucuucuucau

SEQ ID NO: 3528050 - RNA, 16 nt, Pseudomonas putida KT2440
acaaucuucuucauca

SEQ ID NO: 3528051 - RNA, 15 nt, Pseudomonas putida KT2440
acaaugcacagcgcu

SEQ ID NO: 3528052 - RNA, 15 nt, Pseudomonas putida KT2440
acaauguaccgggcu

SEQ ID NO: 3528053 - RNA, 23 nt, Pseudomonas putida KT2440
acaauguaccgggcuacaugaac

SEQ ID NO: 3528054 - RNA, 22 nt, Pseudomonas putida KT2440
acaauuuggggcugccuugcag

SEQ ID NO: 3528055 - RNA, 19 nt, Pseudomonas putida KT2440
acagcaauaaaaaagcccc

SEQ ID NO: 3528056 - RNA, 12 nt, Pseudomonas putida KT2440
acagcaauucca

SEQ ID NO: 3528057 - RNA, 20 nt, Pseudomonas putida KT2440
acagcaauuccaaugagaau

SEQ ID NO: 3528058 - RNA, 15 nt, Pseudomonas putida KT2440
acagcacaaggcuca

SEQ ID NO: 3528059 - RNA, 14 nt, Pseudomonas putida KT2440
acagcacaccuucc

SEQ ID NO: 3528060 - RNA, 12 nt, Pseudomonas putida KT2440
acagcaccaugc

SEQ ID NO: 3528061 - RNA, 13 nt, Pseudomonas putida KT2440
acagcaccaugcg

SEQ ID NO: 3528062 - RNA, 12 nt, Pseudomonas putida KT2440
acagcacccagg

SEQ ID NO: 3528063 - RNA, 16 nt, Pseudomonas putida KT2440
acagcaccggccaggc

SEQ ID NO: 3528064 - RNA, 18 nt, Pseudomonas putida KT2440
acagcaccggccaggcuc

SEQ ID NO: 3528065 - RNA, 19 nt, Pseudomonas putida KT2440
acagcacgauggcggucga

SEQ ID NO: 3528066 - RNA, 22 nt, Pseudomonas putida KT2440
acagcacgggcacacuggccac

SEQ ID NO: 3528067 - RNA, 19 nt, Pseudomonas putida KT2440
acagcacugcauuggccac

SEQ ID NO: 3528068 - RNA, 13 nt, Pseudomonas putida KT2440
acagcacugccag

SEQ ID NO: 3528069 - RNA, 13 nt, Pseudomonas putida KT2440
acagcagcgccgc

SEQ ID NO: 3528070 - RNA, 15 nt, Pseudomonas putida KT2440
acagcagcgccgcca

SEQ ID NO: 3528071 - RNA, 12 nt, Pseudomonas putida KT2440
acagcagcugca

SEQ ID NO: 3528072 - RNA, 15 nt, Pseudomonas putida KT2440
acagcaggaacagcg

SEQ ID NO: 3528073 - RNA, 21 nt, Pseudomonas putida KT2440
acagcaggaacagcggcagca

SEQ ID NO: 3528074 - RNA, 22 nt, Pseudomonas putida KT2440
acagcaggaacagcggcagcaa

SEQ ID NO: 3528075 - RNA, 15 nt, Pseudomonas putida KT2440
acagcaggccaagga

SEQ ID NO: 3528076 - RNA, 18 nt, Pseudomonas putida KT2440
acagcaguugcugcugcc

SEQ ID NO: 3528077 - RNA, 22 nt, Pseudomonas putida KT2440
acagcaucaaucgcuccaggcg

SEQ ID NO: 3528078 - RNA, 23 nt, Pseudomonas putida KT2440
acagcaucaaucgcuccaggcgg

SEQ ID NO: 3528079 - RNA, 16 nt, Pseudomonas putida KT2440
acagcaucagccaugg

SEQ ID NO: 3528080 - RNA, 14 nt, Pseudomonas putida KT2440
acagcaucugcacc

SEQ ID NO: 3528081 - RNA, 18 nt, Pseudomonas putida KT2440
acagcaucugcaccagga

SEQ ID NO: 3528082 - RNA, 22 nt, Pseudomonas putida KT2440
acagcaugaucuugggcuucau

SEQ ID NO: 3528083 - RNA, 15 nt, Pseudomonas putida KT2440
acagccacagcugcu

SEQ ID NO: 3528084 - RNA, 16 nt, Pseudomonas putida KT2440
acagccacagcugcug

SEQ ID NO: 3528085 - RNA, 14 nt, Pseudomonas putida KT2440
acagccacaugcca

SEQ ID NO: 3528086 - RNA, 15 nt, Pseudomonas putida KT2440
acagccacaugccag

SEQ ID NO: 3528087 - RNA, 13 nt, Pseudomonas putida KT2440
acagccaccgcga

SEQ ID NO: 3528088 - RNA, 23 nt, Pseudomonas putida KT2440
acagccacgcccgucaccuugcc

SEQ ID NO: 3528089 - RNA, 17 nt, Pseudomonas putida KT2440
acagccagaaagccacu

SEQ ID NO: 3528090 - RNA, 17 nt, Pseudomonas putida KT2440
acagccaugccggcaac

SEQ ID NO: 3528091 - RNA, 14 nt, Pseudomonas putida KT2440
acagcccaaggccu

SEQ ID NO: 3528092 - RNA, 19 nt, Pseudomonas putida KT2440
acagcccaaggcuggccag

SEQ ID NO: 3528093 - RNA, 20 nt, Pseudomonas putida KT2440
acagcccaaggcuggccaga

SEQ ID NO: 3528094 - RNA, 13 nt, Pseudomonas putida KT2440
acagccccaucac

SEQ ID NO: 3528095 - RNA, 15 nt, Pseudomonas putida KT2440
acagccccuucccca

SEQ ID NO: 3528096 - RNA, 15 nt, Pseudomonas putida KT2440
acagcccgggcaugu

SEQ ID NO: 3528097 - RNA, 16 nt, Pseudomonas putida KT2440
acagccgcgcaugcug

SEQ ID NO: 3528098 - RNA, 20 nt, Pseudomonas putida KT2440
acagccgcgcaugcugugcc

SEQ ID NO: 3528099 - RNA, 21 nt, Pseudomonas putida KT2440
acagccgcgcaugcugugccc

SEQ ID NO: 3528100 - RNA, 17 nt, Pseudomonas putida KT2440
acagccuaccaacgcag

SEQ ID NO: 3528101 - RNA, 14 nt, Pseudomonas putida KT2440
acagcgagcagccu

SEQ ID NO: 3528102 - RNA, 20 nt, Pseudomonas putida KT2440
acagcgagcagccuggcauu

SEQ ID NO: 3528103 - RNA, 17 nt, Pseudomonas putida KT2440
acagcgcacucucccgc

SEQ ID NO: 3528104 - RNA, 20 nt, Pseudomonas putida KT2440
acagcgcacucucccgcagc

SEQ ID NO: 3528105 - RNA, 15 nt, Pseudomonas putida KT2440
acagcgcagccacca

SEQ ID NO: 3528106 - RNA, 19 nt, Pseudomonas putida KT2440
acagcgcauaggccaaggu

SEQ ID NO: 3528107 - RNA, 19 nt, Pseudomonas putida KT2440
acagcgcccggcgcagcau

SEQ ID NO: 3528108 - RNA, 22 nt, Pseudomonas putida KT2440
acagcgccuggcgagaaggcgu

SEQ ID NO: 3528109 - RNA, 22 nt, Pseudomonas putida KT2440
acagcgccuugaagcuggccgu

SEQ ID NO: 3528110 - RNA, 19 nt, Pseudomonas putida KT2440
acagcgcggaacgucguug

SEQ ID NO: 3528111 - RNA, 18 nt, Pseudomonas putida KT2440
acagcgcguuaggcgaga

SEQ ID NO: 3528112 - RNA, 23 nt, Pseudomonas putida KT2440
acagcggcaauucggccggccag

SEQ ID NO: 3528113 - RNA, 17 nt, Pseudomonas putida KT2440
acagcggcagcaucgac

SEQ ID NO: 3528114 - RNA, 18 nt, Pseudomonas putida KT2440
acagcggcagcaucgacc

SEQ ID NO: 3528115 - RNA, 22 nt, Pseudomonas putida KT2440
acagcggccccaucacccccga

SEQ ID NO: 3528116 - RNA, 21 nt, Pseudomonas putida KT2440
acagcggcgaaggauggaccg

SEQ ID NO: 3528117 - RNA, 22 nt, Pseudomonas putida KT2440
acagcggcgaaggauggaccga

SEQ ID NO: 3528118 - RNA, 23 nt, Pseudomonas putida KT2440
acagcggcgaaggauggaccgac

SEQ ID NO: 3528119 - RNA, 20 nt, Pseudomonas putida KT2440
acagcguuuucgucaagguu

SEQ ID NO: 3528120 - RNA, 18 nt, Pseudomonas putida KT2440
acagcucacuggcaucca

SEQ ID NO: 3528121 - RNA, 19 nt, Pseudomonas putida KT2440
acagcucacuggccaacuc

SEQ ID NO: 3528122 - RNA, 18 nt, Pseudomonas putida KT2440
acagcucauccaggcugc

SEQ ID NO: 3528123 - RNA, 22 nt, Pseudomonas putida KT2440
acagcucauccaggcugcacug

SEQ ID NO: 3528124 - RNA, 20 nt, Pseudomonas putida KT2440
acagcuccagcaacugcgcc

SEQ ID NO: 3528125 - RNA, 23 nt, Pseudomonas putida KT2440
acagcucccgcgcaugcugccag

SEQ ID NO: 3528126 - RNA, 22 nt, Pseudomonas putida KT2440
acagcucgauggccaggaacag

SEQ ID NO: 3528127 - RNA, 15 nt, Pseudomonas putida KT2440
acagcucgcgcugcc

SEQ ID NO: 3528128 - RNA, 16 nt, Pseudomonas putida KT2440
acagcucgcgcugcca

SEQ ID NO: 3528129 - RNA, 20 nt, Pseudomonas putida KT2440
acagcucgcgcugccaggcc

SEQ ID NO: 3528130 - RNA, 20 nt, Pseudomonas putida KT2440
acagcucucaacguucaucc

SEQ ID NO: 3528131 - RNA, 17 nt, Pseudomonas putida KT2440
acagcugcacaucucca

SEQ ID NO: 3528132 - RNA, 19 nt, Pseudomonas putida KT2440
acagcugcggcaugaaggc

SEQ ID NO: 3528133 - RNA, 14 nt, Pseudomonas putida KT2440
acagcugugcugcc

SEQ ID NO: 3528134 - RNA, 18 nt, Pseudomonas putida KT2440
acagcuugcccagcugcg

SEQ ID NO: 3528135 - RNA, 15 nt, Pseudomonas putida KT2440
acagcuugcccauca

SEQ ID NO: 3528136 - RNA, 16 nt, Pseudomonas putida KT2440
acagcuugcccaucac

SEQ ID NO: 3528137 - RNA, 14 nt, Pseudomonas putida KT2440
acaggaaucaccag

SEQ ID NO: 3528138 - RNA, 17 nt, Pseudomonas putida KT2440
acaggaaugucaccgcg

SEQ ID NO: 3528139 - RNA, 23 nt, Pseudomonas putida KT2440
acaggaauuacgcaggcuccaaa

SEQ ID NO: 3528140 - RNA, 21 nt, Pseudomonas putida KT2440
acaggagucuacggaccuccg

SEQ ID NO: 3528141 - RNA, 21 nt, Pseudomonas putida KT2440
acaggauggcaaagcgcagca

SEQ ID NO: 3528142 - RNA, 19 nt, Pseudomonas putida KT2440
acaggauggccgcaggccc

SEQ ID NO: 3528143 - RNA, 13 nt, Pseudomonas putida KT2440
acaggcacaggcc

SEQ ID NO: 3528144 - RNA, 20 nt, Pseudomonas putida KT2440
acaggcacaggcccagcaac

SEQ ID NO: 3528145 - RNA, 21 nt, Pseudomonas putida KT2440
acaggcagaucgaaagacagc

SEQ ID NO: 3528146 - RNA, 15 nt, Pseudomonas putida KT2440
acaggcagucauggg

SEQ ID NO: 3528147 - RNA, 20 nt, Pseudomonas putida KT2440
acaggcauaccgcaacaccu

SEQ ID NO: 3528148 - RNA, 14 nt, Pseudomonas putida KT2440
acaggccagcccca

SEQ ID NO: 3528149 - RNA, 12 nt, Pseudomonas putida KT2440
acaggcccagca

SEQ ID NO: 3528150 - RNA, 15 nt, Pseudomonas putida KT2440
acaggcccagcauga

SEQ ID NO: 3528151 - RNA, 14 nt, Pseudomonas putida KT2440
acaggccugcggcc

SEQ ID NO: 3528152 - RNA, 18 nt, Pseudomonas putida KT2440
acaggccugcggccaggc

SEQ ID NO: 3528153 - RNA, 19 nt, Pseudomonas putida KT2440
acaggccugcggccaggcc

SEQ ID NO: 3528154 - RNA, 19 nt, Pseudomonas putida KT2440
acaggcgaugaaagccuaa

SEQ ID NO: 3528155 - RNA, 13 nt, Pseudomonas putida KT2440
acaggcgcagcag

SEQ ID NO: 3528156 - RNA, 15 nt, Pseudomonas putida KT2440
acaggcgcagcagcu

SEQ ID NO: 3528157 - RNA, 14 nt, Pseudomonas putida KT2440
acaggcguacauca

SEQ ID NO: 3528158 - RNA, 21 nt, Pseudomonas putida KT2440
acaggcuaaagugccuugauc

SEQ ID NO: 3528159 - RNA, 18 nt, Pseudomonas putida KT2440
acaggcucuccucaucga

SEQ ID NO: 3528160 - RNA, 22 nt, Pseudomonas putida KT2440
accaacaguugaccaaggaacu

SEQ ID NO: 3528161 - RNA, 16 nt, Pseudomonas putida KT2440
accaaccccugcggcg

SEQ ID NO: 3528162 - RNA, 12 nt, Pseudomonas putida KT2440
accaacgcagca

SEQ ID NO: 3528163 - RNA, 15 nt, Pseudomonas putida KT2440
accaacgcauuuuca

SEQ ID NO: 3528164 - RNA, 19 nt, Pseudomonas putida KT2440
accaacgguaacguggaca

SEQ ID NO: 3528165 - RNA, 21 nt, Pseudomonas putida KT2440
accaacgguaacguggacagc

SEQ ID NO: 3528166 - RNA, 18 nt, Pseudomonas putida KT2440
accaacugcacccgccag

SEQ ID NO: 3528167 - RNA, 22 nt, Pseudomonas putida KT2440
accaagauuuuuugcucuaaau

SEQ ID NO: 3528168 - RNA, 16 nt, Pseudomonas putida KT2440
accaagcgccccacaa

SEQ ID NO: 3528169 - RNA, 23 nt, Pseudomonas putida KT2440
accaaggccaacugcgcccgccc

SEQ ID NO: 3528170 - RNA, 23 nt, Pseudomonas putida KT2440
accaaggcuugagugguuuucuu

SEQ ID NO: 3528171 - RNA, 23 nt, Pseudomonas putida KT2440
accaaucaacgguggccagcagc

SEQ ID NO: 3528172 - RNA, 16 nt, Pseudomonas putida KT2440
accaauccagcccuca

SEQ ID NO: 3528173 - RNA, 22 nt, Pseudomonas putida KT2440
accaaugucgacguacagcagc

SEQ ID NO: 3528174 - RNA, 20 nt, Pseudomonas putida KT2440
accaauugguuaaaagccaa

SEQ ID NO: 3528175 - RNA, 19 nt, Pseudomonas putida KT2440
accacaaaccacagcggcc

SEQ ID NO: 3528176 - RNA, 22 nt, Pseudomonas putida KT2440
accacaaagccuucccccuccu

SEQ ID NO: 3528177 - RNA, 21 nt, Pseudomonas putida KT2440
accacaagaacugcgacgaac

SEQ ID NO: 3528178 - RNA, 15 nt, Pseudomonas putida KT2440
accacagcggccaca

SEQ ID NO: 3528179 - RNA, 14 nt, Pseudomonas putida KT2440
accacagcugcaca

SEQ ID NO: 3528180 - RNA, 15 nt, Pseudomonas putida KT2440
accacagcugcgcca

SEQ ID NO: 3528181 - RNA, 18 nt, Pseudomonas putida KT2440
accacagcugcgccagcc

SEQ ID NO: 3528182 - RNA, 19 nt, Pseudomonas putida KT2440
accacagcugcgccagccg

SEQ ID NO: 3528183 - RNA, 22 nt, Pseudomonas putida KT2440
accacaggcgcuugaagaagcc

SEQ ID NO: 3528184 - RNA, 14 nt, Pseudomonas putida KT2440
accacauacggcgc

SEQ ID NO: 3528185 - RNA, 11 nt, Pseudomonas putida KT2440
accacaucacg

SEQ ID NO: 3528186 - RNA, 19 nt, Pseudomonas putida KT2440
accacaucacgaucaugcu

SEQ ID NO: 3528187 - RNA, 21 nt, Pseudomonas putida KT2440
accacauccccgccgccagca

SEQ ID NO: 3528188 - RNA, 23 nt, Pseudomonas putida KT2440
accacauccccgccgccagcagc

SEQ ID NO: 3528189 - RNA, 21 nt, Pseudomonas putida KT2440
accaccaacagcaccggccag

SEQ ID NO: 3528190 - RNA, 13 nt, Pseudomonas putida KT2440
accaccaccgacc

SEQ ID NO: 3528191 - RNA, 14 nt, Pseudomonas putida KT2440
accaccagcaacau

SEQ ID NO: 3528192 - RNA, 14 nt, Pseudomonas putida KT2440
accaccaucgccag

SEQ ID NO: 3528193 - RNA, 21 nt, Pseudomonas putida KT2440
accaccaucgccaggccuuca

SEQ ID NO: 3528194 - RNA, 18 nt, Pseudomonas putida KT2440
accaccaucucgcccaug

SEQ ID NO: 3528195 - RNA, 16 nt, Pseudomonas putida KT2440
accacccaccagcagu

SEQ ID NO: 3528196 - RNA, 17 nt, Pseudomonas putida KT2440
accacccccagcgccuc

SEQ ID NO: 3528197 - RNA, 18 nt, Pseudomonas putida KT2440
accaccccuugcaguauc

SEQ ID NO: 3528198 - RNA, 22 nt, Pseudomonas putida KT2440
accacccggucggccagcugcu

SEQ ID NO: 3528199 - RNA, 19 nt, Pseudomonas putida KT2440
accacccugaugcagcagu

SEQ ID NO: 3528200 - RNA, 21 nt, Pseudomonas putida KT2440
accacccugaugcagcagugc

SEQ ID NO: 3528201 - RNA, 22 nt, Pseudomonas putida KT2440
accacccugaugcagcagugcc

SEQ ID NO: 3528202 - RNA, 12 nt, Pseudomonas putida KT2440
accaccgcaucc

SEQ ID NO: 3528203 - RNA, 16 nt, Pseudomonas putida KT2440
accaccgcauccgcac

SEQ ID NO: 3528204 - RNA, 16 nt, Pseudomonas putida KT2440
accaccgccaaggcac

SEQ ID NO: 3528205 - RNA, 14 nt, Pseudomonas putida KT2440
accaccgcucaaac

SEQ ID NO: 3528206 - RNA, 21 nt, Pseudomonas putida KT2440
accaccggguucuugaagaag

SEQ ID NO: 3528207 - RNA, 20 nt, Pseudomonas putida KT2440
accaccgguaggacaaaaac

SEQ ID NO: 3528208 - RNA, 13 nt, Pseudomonas putida KT2440
accaccucauccc

SEQ ID NO: 3528209 - RNA, 17 nt, Pseudomonas putida KT2440
accaccuccaccccgca

SEQ ID NO: 3528210 - RNA, 19 nt, Pseudomonas putida KT2440
accaccuccaccccgcagg

SEQ ID NO: 3528211 - RNA, 18 nt, Pseudomonas putida KT2440
accaccucuaucaccugu

SEQ ID NO: 3528212 - RNA, 22 nt, Pseudomonas putida KT2440
accaccugccaacgcaccgacc

SEQ ID NO: 3528213 - RNA, 24 nt, Pseudomonas putida KT2440
accaccugccaacgcaccgaccac

SEQ ID NO: 3528214 - RNA, 15 nt, Pseudomonas putida KT2440
accaccugggccagu

SEQ ID NO: 3528215 - RNA, 21 nt, Pseudomonas putida KT2440
accaccugggccaguaccuuc

SEQ ID NO: 3528216 - RNA, 12 nt, Pseudomonas putida KT2440
accaccugggcg

SEQ ID NO: 3528217 - RNA, 20 nt, Pseudomonas putida KT2440
accaccugggcgcuuugcac

SEQ ID NO: 3528218 - RNA, 20 nt, Pseudomonas putida KT2440
accacgaacgcccccagccc

SEQ ID NO: 3528219 - RNA, 14 nt, Pseudomonas putida KT2440
accacgaucacgcc

SEQ ID NO: 3528220 - RNA, 22 nt, Pseudomonas putida KT2440
accacgaugccuucgaccacca

SEQ ID NO: 3528221 - RNA, 23 nt, Pseudomonas putida KT2440
accacgccaccaugcucggccag

SEQ ID NO: 3528222 - RNA, 14 nt, Pseudomonas putida KT2440
accacgcccuggcc

SEQ ID NO: 3528223 - RNA, 13 nt, Pseudomonas putida KT2440
accacgccgcugc

SEQ ID NO: 3528224 - RNA, 15 nt, Pseudomonas putida KT2440
accacgccgcugcca

SEQ ID NO: 3528225 - RNA, 15 nt, Pseudomonas putida KT2440
accacggaaggccac

SEQ ID NO: 3528226 - RNA, 17 nt, Pseudomonas putida KT2440
accacggaaggccacgc

SEQ ID NO: 3528227 - RNA, 13 nt, Pseudomonas putida KT2440
accacggcagugg

SEQ ID NO: 3528228 - RNA, 20 nt, Pseudomonas putida KT2440
accacggccggggccuguuc

SEQ ID NO: 3528229 - RNA, 15 nt, Pseudomonas putida KT2440
accacggccuggccu

SEQ ID NO: 3528230 - RNA, 15 nt, Pseudomonas putida KT2440
accacgguaccggca

SEQ ID NO: 3528231 - RNA, 19 nt, Pseudomonas putida KT2440
accacggucgaaccggucu

SEQ ID NO: 3528232 - RNA, 15 nt, Pseudomonas putida KT2440
accacguccggccag

SEQ ID NO: 3528233 - RNA, 17 nt, Pseudomonas putida KT2440
accacguccggccagca

SEQ ID NO: 3528234 - RNA, 18 nt, Pseudomonas putida KT2440
accacguccggccagcaa

SEQ ID NO: 3528235 - RNA, 18 nt, Pseudomonas putida KT2440
accacguuauccagcugc

SEQ ID NO: 3528236 - RNA, 23 nt, Pseudomonas putida KT2440
accacguuauccagcugcaacag

SEQ ID NO: 3528237 - RNA, 23 nt, Pseudomonas putida KT2440
accacguugcgcuugagcagguc

SEQ ID NO: 3528238 - RNA, 14 nt, Pseudomonas putida KT2440
accacuaucgccag

SEQ ID NO: 3528239 - RNA, 15 nt, Pseudomonas putida KT2440
accacuaucgccaga

SEQ ID NO: 3528240 - RNA, 20 nt, Pseudomonas putida KT2440
accacuaucgccagaaacca

SEQ ID NO: 3528241 - RNA, 17 nt, Pseudomonas putida KT2440
accacuccagggucugc

SEQ ID NO: 3528242 - RNA, 14 nt, Pseudomonas putida KT2440
accacugcaggugc

SEQ ID NO: 3528243 - RNA, 17 nt, Pseudomonas putida KT2440
accacugcaggugcagg

SEQ ID NO: 3528244 - RNA, 19 nt, Pseudomonas putida KT2440
accacugcuucugagccag

SEQ ID NO: 3528245 - RNA, 18 nt, Pseudomonas putida KT2440
accacuggaugacgccgc

SEQ ID NO: 3528246 - RNA, 19 nt, Pseudomonas putida KT2440
accacuggaugacgccgca

SEQ ID NO: 3528247 - RNA, 15 nt, Pseudomonas putida KT2440
accacuggggcuucu

SEQ ID NO: 3528248 - RNA, 16 nt, Pseudomonas putida KT2440
accacuucaagcacgc

SEQ ID NO: 3528249 - RNA, 19 nt, Pseudomonas putida KT2440
accacuucacugacaaagc

SEQ ID NO: 3528250 - RNA, 18 nt, Pseudomonas putida KT2440
accacuuccaacacccgg

SEQ ID NO: 3528251 - RNA, 16 nt, Pseudomonas putida KT2440
accacuuuuggcguga

SEQ ID NO: 3528252 - RNA, 19 nt, Pseudomonas putida KT2440
accagaaauggucgcgggc

SEQ ID NO: 3528253 - RNA, 16 nt, Pseudomonas putida KT2440
accagaccagcagcag

SEQ ID NO: 3528254 - RNA, 13 nt, Pseudomonas putida KT2440
accagacgcaggc

SEQ ID NO: 3528255 - RNA, 14 nt, Pseudomonas putida KT2440
accagacgcaggca

SEQ ID NO: 3528256 - RNA, 23 nt, Pseudomonas putida KT2440
accagacggccuucgaagaacac

SEQ ID NO: 3528257 - RNA, 14 nt, Pseudomonas putida KT2440
accagacgggcaug

SEQ ID NO: 3528258 - RNA, 19 nt, Pseudomonas putida KT2440
accagacgggcauggugga

SEQ ID NO: 3528259 - RNA, 22 nt, Pseudomonas putida KT2440
accagacgggcaugguggaagu

SEQ ID NO: 3528260 - RNA, 19 nt, Pseudomonas putida KT2440
accagacucagcgcuugcc

SEQ ID NO: 3528261 - RNA, 13 nt, Pseudomonas putida KT2440
accagaucagccg

SEQ ID NO: 3528262 - RNA, 21 nt, Pseudomonas putida KT2440
accagaugaccaaagaucagc

SEQ ID NO: 3528263 - RNA, 17 nt, Pseudomonas putida KT2440
accagauucaagcccgg

SEQ ID NO: 3528264 - RNA, 21 nt, Pseudomonas putida KT2440
accagauucgccaaggccucg

SEQ ID NO: 3528265 - RNA, 14 nt, Pseudomonas putida KT2440
accaugcuggccaa

SEQ ID NO: 3528266 - RNA, 18 nt, Pseudomonas putida KT2440
accauggccuucgccggu

SEQ ID NO: 3528267 - RNA, 20 nt, Pseudomonas putida KT2440
accauggcgaugaacugccg

SEQ ID NO: 3528268 - RNA, 21 nt, Pseudomonas putida KT2440
accauggcgaugaacugccgg

SEQ ID NO: 3528269 - RNA, 18 nt, Pseudomonas putida KT2440
accauggcuaagccaagc

SEQ ID NO: 3528270 - RNA, 23 nt, Pseudomonas putida KT2440
accaugggcaaugcgagacgcca

SEQ ID NO: 3528271 - RNA, 14 nt, Pseudomonas putida KT2440
accauguuccaguu

SEQ ID NO: 3528272 - RNA, 20 nt, Pseudomonas putida KT2440
accauguugaaaauagcucc

SEQ ID NO: 3528273 - RNA, 14 nt, Pseudomonas putida KT2440
accauucaaugcgu

SEQ ID NO: 3528274 - RNA, 20 nt, Pseudomonas putida KT2440
accauucccugcacaucgcu

SEQ ID NO: 3528275 - RNA, 19 nt, Pseudomonas putida KT2440
accauuggugaaagcgcaa

SEQ ID NO: 3528276 - RNA, 18 nt, Pseudomonas putida KT2440
accauuugucuugaagau

SEQ ID NO: 3528277 - RNA, 19 nt, Pseudomonas putida KT2440
acccaacagaccaccugcc

SEQ ID NO: 3528278 - RNA, 22 nt, Pseudomonas putida KT2440
acccaacagcauccaaagccaa

SEQ ID NO: 3528279 - RNA, 14 nt, Pseudomonas putida KT2440
acccaaccgcgcca

SEQ ID NO: 3528280 - RNA, 15 nt, Pseudomonas putida KT2440
acccaacuccagcgc

SEQ ID NO: 3528281 - RNA, 16 nt, Pseudomonas putida KT2440
acccaacuccagcgcg

SEQ ID NO: 3528282 - RNA, 15 nt, Pseudomonas putida KT2440
acccaaggcauccag

SEQ ID NO: 3528283 - RNA, 18 nt, Pseudomonas putida KT2440
acccaauaaaaacaacag

SEQ ID NO: 3528284 - RNA, 18 nt, Pseudomonas putida KT2440
acccaauagcccaccguc

SEQ ID NO: 3528285 - RNA, 13 nt, Pseudomonas putida KT2440
acccaaucauaua

SEQ ID NO: 3528286 - RNA, 16 nt, Pseudomonas putida KT2440
acccacaagcgcaggc

SEQ ID NO: 3528287 - RNA, 19 nt, Pseudomonas putida KT2440
acccacagagacaccgcag

SEQ ID NO: 3528288 - RNA, 22 nt, Pseudomonas putida KT2440
acccacaggcacaggcccagca

SEQ ID NO: 3528289 - RNA, 18 nt, Pseudomonas putida KT2440
acccaccacaaaccacag

SEQ ID NO: 3528290 - RNA, 14 nt, Pseudomonas putida KT2440
acccaccacggccu

SEQ ID NO: 3528291 - RNA, 13 nt, Pseudomonas putida KT2440
acccaccagcagu

SEQ ID NO: 3528292 - RNA, 16 nt, Pseudomonas putida KT2440
acccaccagcagugcc

SEQ ID NO: 3528293 - RNA, 17 nt, Pseudomonas putida KT2440
acccaccagcagugccc

SEQ ID NO: 3528294 - RNA, 13 nt, Pseudomonas putida KT2440
acccaccagccaa

SEQ ID NO: 3528295 - RNA, 15 nt, Pseudomonas putida KT2440
acccaccagccaaac

SEQ ID NO: 3528296 - RNA, 14 nt, Pseudomonas putida KT2440
acccaccuuggccc

SEQ ID NO: 3528297 - RNA, 17 nt, Pseudomonas putida KT2440
acccacgcccaacccca

SEQ ID NO: 3528298 - RNA, 20 nt, Pseudomonas putida KT2440
acccacgcgcuuggagaagc

SEQ ID NO: 3528299 - RNA, 15 nt, Pseudomonas putida KT2440
acccacggagucagu

SEQ ID NO: 3528300 - RNA, 22 nt, Pseudomonas putida KT2440
acccacggcaauucgccggcag

SEQ ID NO: 3528301 - RNA, 11 nt, Pseudomonas putida KT2440
acccacuggcc

SEQ ID NO: 3528302 - RNA, 17 nt, Pseudomonas putida KT2440
acccacuuggaaaacag

SEQ ID NO: 3528303 - RNA, 20 nt, Pseudomonas putida KT2440
acccagaacagccacagcug

SEQ ID NO: 3528304 - RNA, 23 nt, Pseudomonas putida KT2440
acccagaacagccacagcugcug

SEQ ID NO: 3528305 - RNA, 16 nt, Pseudomonas putida KT2440
acccagaaucccaacc

SEQ ID NO: 3528306 - RNA, 19 nt, Pseudomonas putida KT2440
acccagaugcgggcccugg

SEQ ID NO: 3528307 - RNA, 20 nt, Pseudomonas putida KT2440
acccagcacgaaggccagca

SEQ ID NO: 3528308 - RNA, 19 nt, Pseudomonas putida KT2440
acccagcacuucguccagg

SEQ ID NO: 3528309 - RNA, 10 nt, Pseudomonas putida KT2440
acccagcagg

SEQ ID NO: 3528310 - RNA, 16 nt, Pseudomonas putida KT2440
acccagccacccggcg

SEQ ID NO: 3528311 - RNA, 18 nt, Pseudomonas putida KT2440
acccagccagcgacagca

SEQ ID NO: 3528312 - RNA, 22 nt, Pseudomonas putida KT2440
acccagcccccccaaggcgaac

SEQ ID NO: 3528313 - RNA, 22 nt, Pseudomonas putida KT2440
acccagcgcgaagcccagcuug

SEQ ID NO: 3528314 - RNA, 16 nt, Pseudomonas putida KT2440
acccagcgcggcaaau

SEQ ID NO: 3528315 - RNA, 18 nt, Pseudomonas putida KT2440
acccagcgcggcaaaugc

SEQ ID NO: 3528316 - RNA, 22 nt, Pseudomonas putida KT2440
acccagcgcuugagaccaggcc

SEQ ID NO: 3528317 - RNA, 21 nt, Pseudomonas putida KT2440
acccagcggucagcaucuucu

SEQ ID NO: 3528318 - RNA, 20 nt, Pseudomonas putida KT2440
acccagcguauagccaccgg

SEQ ID NO: 3528319 - RNA, 18 nt, Pseudomonas putida KT2440
acccagcucgccaacacc

SEQ ID NO: 3528320 - RNA, 13 nt, Pseudomonas putida KT2440
acccaggcaacga

SEQ ID NO: 3528321 - RNA, 17 nt, Pseudomonas putida KT2440
acccaggcauacagcug

SEQ ID NO: 3528322 - RNA, 20 nt, Pseudomonas putida KT2440
acccaggcauacagcuggcc

SEQ ID NO: 3528323 - RNA, 19 nt, Pseudomonas putida KT2440
acccaggcccugacgccag

SEQ ID NO: 3528324 - RNA, 20 nt, Pseudomonas putida KT2440
acccaggccguuguaggagc

SEQ ID NO: 3528325 - RNA, 21 nt, Pseudomonas putida KT2440
acccaggcucgcccgggucag

SEQ ID NO: 3528326 - RNA, 15 nt, Pseudomonas putida KT2440
acccagguacgaagc

SEQ ID NO: 3528327 - RNA, 17 nt, Pseudomonas putida KT2440
acccagguacgaagcca

SEQ ID NO: 3528328 - RNA, 16 nt, Pseudomonas putida KT2440
acccaguacggcgcca

SEQ ID NO: 3528329 - RNA, 13 nt, Pseudomonas putida KT2440
acccagucaccuu

SEQ ID NO: 3528330 - RNA, 22 nt, Pseudomonas putida KT2440
acccagucaccuugcuccacca

SEQ ID NO: 3528331 - RNA, 16 nt, Pseudomonas putida KT2440
acccagucgccccgcc

SEQ ID NO: 3528332 - RNA, 23 nt, Pseudomonas putida KT2440
acccagucgccccgccagcgccu

SEQ ID NO: 3528333 - RNA, 16 nt, Pseudomonas putida KT2440
acccauacgcaugaag

SEQ ID NO: 3528334 - RNA, 21 nt, Pseudomonas putida KT2440
acccaucggcgcgaaggucac

SEQ ID NO: 3528335 - RNA, 17 nt, Pseudomonas putida KT2440
acccaugauugaauucu

SEQ ID NO: 3528336 - RNA, 21 nt, Pseudomonas putida KT2440
acccaugguaaaagccgccac

SEQ ID NO: 3528337 - RNA, 20 nt, Pseudomonas putida KT2440
acccauguugucacccagca

SEQ ID NO: 3528338 - RNA, 16 nt, Pseudomonas putida KT2440
acccauuuacugcaga

SEQ ID NO: 3528339 - RNA, 13 nt, Pseudomonas putida KT2440
acccauuugcagc

SEQ ID NO: 3528340 - RNA, 23 nt, Pseudomonas putida KT2440
acccauuugcagcacaaggcugu

SEQ ID NO: 3528341 - RNA, 14 nt, Pseudomonas putida KT2440
accccaacccgguc

SEQ ID NO: 3528342 - RNA, 21 nt, Pseudomonas putida KT2440
accccaacccggucccgcccu

SEQ ID NO: 3528343 - RNA, 21 nt, Pseudomonas putida KT2440
accccaaccucaacgccuccc

SEQ ID NO: 3528344 - RNA, 23 nt, Pseudomonas putida KT2440
accccacaaccccugcaaggcca

SEQ ID NO: 3528345 - RNA, 22 nt, Pseudomonas putida KT2440
accccaccagcacugccuugcc

SEQ ID NO: 3528346 - RNA, 16 nt, Pseudomonas putida KT2440
accccaccggccugga

SEQ ID NO: 3528347 - RNA, 18 nt, Pseudomonas putida KT2440
accccaccggccuggaac

SEQ ID NO: 3528348 - RNA, 15 nt, Pseudomonas putida KT2440
accccagcaaggcaa

SEQ ID NO: 3528349 - RNA, 20 nt, Pseudomonas putida KT2440
accccagcaccacccaccag

SEQ ID NO: 3528350 - RNA, 11 nt, Pseudomonas putida KT2440
accccagcccg

SEQ ID NO: 3528351 - RNA, 14 nt, Pseudomonas putida KT2440
accccagcccgaag

SEQ ID NO: 3528352 - RNA, 13 nt, Pseudomonas putida KT2440
accccagccgcuc

SEQ ID NO: 3528353 - RNA, 21 nt, Pseudomonas putida KT2440
accccagccuucagcaggcgc

SEQ ID NO: 3528354 - RNA, 21 nt, Pseudomonas putida KT2440
accccagcgcguacagcgaca

SEQ ID NO: 3528355 - RNA, 19 nt, Pseudomonas putida KT2440
accccaggccacugguaca

SEQ ID NO: 3528356 - RNA, 15 nt, Pseudomonas putida KT2440
accccaggugcugau

SEQ ID NO: 3528357 - RNA, 20 nt, Pseudomonas putida KT2440
accccaguugaucaacccgu

SEQ ID NO: 3528358 - RNA, 12 nt, Pseudomonas putida KT2440
accccauccaca

SEQ ID NO: 3528359 - RNA, 16 nt, Pseudomonas putida KT2440
accccauccacaucgc

SEQ ID NO: 3528360 - RNA, 13 nt, Pseudomonas putida KT2440
acccccagcgccu

SEQ ID NO: 3528361 - RNA, 15 nt, Pseudomonas putida KT2440
acccccagcgccucc

SEQ ID NO: 3528362 - RNA, 23 nt, Pseudomonas putida KT2440
acccccagguuauccacagggcc

SEQ ID NO: 3528363 - RNA, 13 nt, Pseudomonas putida KT2440
accccccagcagc

SEQ ID NO: 3528364 - RNA, 20 nt, Pseudomonas putida KT2440
acccccgaaucagugcaccg

SEQ ID NO: 3528365 - RNA, 22 nt, Pseudomonas putida KT2440
acccccgaucuauucgacccgc

SEQ ID NO: 3528366 - RNA, 17 nt, Pseudomonas putida KT2440
acccccgccgccagggc

SEQ ID NO: 3528367 - RNA, 17 nt, Pseudomonas putida KT2440
acccccuugccagcaug

SEQ ID NO: 3528368 - RNA, 18 nt, Pseudomonas putida KT2440
accccgaacuucccccuc

SEQ ID NO: 3528369 - RNA, 16 nt, Pseudomonas putida KT2440
accccgacgccggccu

SEQ ID NO: 3528370 - RNA, 15 nt, Pseudomonas putida KT2440
acccggccaaguaca

SEQ ID NO: 3528371 - RNA, 23 nt, Pseudomonas putida KT2440
acccggccaaguacaaacgccag

SEQ ID NO: 3528372 - RNA, 19 nt, Pseudomonas putida KT2440
acccggccagcaggucagc

SEQ ID NO: 3528373 - RNA, 20 nt, Pseudomonas putida KT2440
acccggccuuucgcgccagu

SEQ ID NO: 3528374 - RNA, 18 nt, Pseudomonas putida KT2440
acccggcguacucucguc

SEQ ID NO: 3528375 - RNA, 16 nt, Pseudomonas putida KT2440
acccgggaaacucuug

SEQ ID NO: 3528376 - RNA, 17 nt, Pseudomonas putida KT2440
acccgggaacagcagca

SEQ ID NO: 3528377 - RNA, 17 nt, Pseudomonas putida KT2440
acccgggcagcgggcuc

SEQ ID NO: 3528378 - RNA, 20 nt, Pseudomonas putida KT2440
acccgggcagcgggcucgcc

SEQ ID NO: 3528379 - RNA, 21 nt, Pseudomonas putida KT2440
acccgggcccgcuugcgcggu

SEQ ID NO: 3528380 - RNA, 18 nt, Pseudomonas putida KT2440
acccgggcgcaggggucu

SEQ ID NO: 3528381 - RNA, 15 nt, Pseudomonas putida KT2440
acccgggucaggcgc

SEQ ID NO: 3528382 - RNA, 21 nt, Pseudomonas putida KT2440
acccgguaaaaccgcucgaac

SEQ ID NO: 3528383 - RNA, 18 nt, Pseudomonas putida KT2440
acccggucccgcccggcc

SEQ ID NO: 3528384 - RNA, 17 nt, Pseudomonas putida KT2440
acccgguccugguccga

SEQ ID NO: 3528385 - RNA, 20 nt, Pseudomonas putida KT2440
acccggucgccgacggcaug

SEQ ID NO: 3528386 - RNA, 17 nt, Pseudomonas putida KT2440
acccggucggccagcug

SEQ ID NO: 3528387 - RNA, 19 nt, Pseudomonas putida KT2440
acccggucggccagcugcu

SEQ ID NO: 3528388 - RNA, 22 nt, Pseudomonas putida KT2440
acccggucggccagcugcugcg

SEQ ID NO: 3528389 - RNA, 22 nt, Pseudomonas putida KT2440
acccggugugugcccaccgcag

SEQ ID NO: 3528390 - RNA, 20 nt, Pseudomonas putida KT2440
acccguccaguuccggcagg

SEQ ID NO: 3528391 - RNA, 21 nt, Pseudomonas putida KT2440
acccguccaguuccggcaggu

SEQ ID NO: 3528392 - RNA, 20 nt, Pseudomonas putida KT2440
acccgucgcucuucaaccgc

SEQ ID NO: 3528393 - RNA, 17 nt, Pseudomonas putida KT2440
acccgucugcaggaaaa

SEQ ID NO: 3528394 - RNA, 21 nt, Pseudomonas putida KT2440
acccgucugcaggaaaacggc

SEQ ID NO: 3528395 - RNA, 15 nt, Pseudomonas putida KT2440
acccgugcagggcug

SEQ ID NO: 3528396 - RNA, 19 nt, Pseudomonas putida KT2440
acccgugcaucugcucccc

SEQ ID NO: 3528397 - RNA, 18 nt, Pseudomonas putida KT2440
acccgugcccggcauccg

SEQ ID NO: 3528398 - RNA, 22 nt, Pseudomonas putida KT2440
acccgugcccggcauccgccuc

SEQ ID NO: 3528399 - RNA, 16 nt, Pseudomonas putida KT2440
acccgugccugccugc

SEQ ID NO: 3528400 - RNA, 15 nt, Pseudomonas putida KT2440
acccgugcugcucgc

SEQ ID NO: 3528401 - RNA, 16 nt, Pseudomonas putida KT2440
acccguggcagccccc

SEQ ID NO: 3528402 - RNA, 22 nt, Pseudomonas putida KT2440
acccguuccuacgcaggcaccg

SEQ ID NO: 3528403 - RNA, 14 nt, Pseudomonas putida KT2440
acccuaucggcacu

SEQ ID NO: 3528404 - RNA, 21 nt, Pseudomonas putida KT2440
acccuaugcgugaaacgcagc

SEQ ID NO: 3528405 - RNA, 13 nt, Pseudomonas putida KT2440
acccucaccaacu

SEQ ID NO: 3528406 - RNA, 12 nt, Pseudomonas putida KT2440
acccucacgcgc

SEQ ID NO: 3528407 - RNA, 18 nt, Pseudomonas putida KT2440
acccucacgcgccagguc

SEQ ID NO: 3528408 - RNA, 23 nt, Pseudomonas putida KT2440
acccucacgcgccaggucggaca

SEQ ID NO: 3528409 - RNA, 16 nt, Pseudomonas putida KT2440
acccucccguuugaca

SEQ ID NO: 3528410 - RNA, 19 nt, Pseudomonas putida KT2440
acccucgcacuccgcccgu

SEQ ID NO: 3528411 - RNA, 23 nt, Pseudomonas putida KT2440
acccucguaacgagccuuggcca

SEQ ID NO: 3528412 - RNA, 15 nt, Pseudomonas putida KT2440
acccugaagcccugg

SEQ ID NO: 3528413 - RNA, 14 nt, Pseudomonas putida KT2440
acccugaaucagca

SEQ ID NO: 3528414 - RNA, 20 nt, Pseudomonas putida KT2440
acccugaaucagcaaaccga

SEQ ID NO: 3528415 - RNA, 24 nt, Pseudomonas putida KT2440
acccugaaucagcaaaccgaccag

SEQ ID NO: 3528416 - RNA, 22 nt, Pseudomonas putida KT2440
acccugacucaugccuucggug

SEQ ID NO: 3528417 - RNA, 18 nt, Pseudomonas putida KT2440
acccugagggagcgggcu

SEQ ID NO: 3528418 - RNA, 22 nt, Pseudomonas putida KT2440
acccugagggagcgggcuugcc

SEQ ID NO: 3528419 - RNA, 15 nt, Pseudomonas putida KT2440
acccugaugcagcag

SEQ ID NO: 3528420 - RNA, 18 nt, Pseudomonas putida KT2440
acccugcucgccaucgcc

SEQ ID NO: 3528421 - RNA, 16 nt, Pseudomonas putida KT2440
acccuggaaaaugccc

SEQ ID NO: 3528422 - RNA, 16 nt, Pseudomonas putida KT2440
acccuggcaugccccu

SEQ ID NO: 3528423 - RNA, 22 nt, Pseudomonas putida KT2440
acccuggcccugugcuuugagc

SEQ ID NO: 3528424 - RNA, 15 nt, Pseudomonas putida KT2440
acccugggcuccuca

SEQ ID NO: 3528425 - RNA, 16 nt, Pseudomonas putida KT2440
acccuggucaugcagc

SEQ ID NO: 3528426 - RNA, 17 nt, Pseudomonas putida KT2440
acccuggucaugcagcg

SEQ ID NO: 3528427 - RNA, 15 nt, Pseudomonas putida KT2440
acccugguucuccac

SEQ ID NO: 3528428 - RNA, 20 nt, Pseudomonas putida KT2440
acccuguacccgcuggcuga

SEQ ID NO: 3528429 - RNA, 20 nt, Pseudomonas putida KT2440
acccugucgaucacgggcaa

SEQ ID NO: 3528430 - RNA, 21 nt, Pseudomonas putida KT2440
acccugucguuauccugcagc

SEQ ID NO: 3528431 - RNA, 22 nt, Pseudomonas putida KT2440
acccugucguuauccugcagca

SEQ ID NO: 3528432 - RNA, 13 nt, Pseudomonas putida KT2440
acccuucaucgcc

SEQ ID NO: 3528433 - RNA, 16 nt, Pseudomonas putida KT2440
acccuucaucgccggg

SEQ ID NO: 3528434 - RNA, 16 nt, Pseudomonas putida KT2440
acccuuccagcccgcc

SEQ ID NO: 3528435 - RNA, 19 nt, Pseudomonas putida KT2440
acccuuccccccuggccug

SEQ ID NO: 3528436 - RNA, 14 nt, Pseudomonas putida KT2440
acccuucggccagc

SEQ ID NO: 3528437 - RNA, 16 nt, Pseudomonas putida KT2440
acccuucggccagcag

SEQ ID NO: 3528438 - RNA, 17 nt, Pseudomonas putida KT2440
acccuucggccagcagu

SEQ ID NO: 3528439 - RNA, 18 nt, Pseudomonas putida KT2440
acccuugggcaccagcuu

SEQ ID NO: 3528440 - RNA, 19 nt, Pseudomonas putida KT2440
acccuugggcgugcgcugc

SEQ ID NO: 3528441 - RNA, 14 nt, Pseudomonas putida KT2440
acccuugggcucag

SEQ ID NO: 3528442 - RNA, 18 nt, Pseudomonas putida KT2440
acccuuugccauccaccg

SEQ ID NO: 3528443 - RNA, 15 nt, Pseudomonas putida KT2440
accgaaaacggcggc

SEQ ID NO: 3528444 - RNA, 15 nt, Pseudomonas putida KT2440
accgaaaccacugcu

SEQ ID NO: 3528445 - RNA, 22 nt, Pseudomonas putida KT2440
accgaaaucagcaacgccacca

SEQ ID NO: 3528446 - RNA, 19 nt, Pseudomonas putida KT2440
accgaacccgcugccaccc

SEQ ID NO: 3528447 - RNA, 17 nt, Pseudomonas putida KT2440
accgaaggccgccggca

SEQ ID NO: 3528448 - RNA, 22 nt, Pseudomonas putida KT2440
accgaaggcgucacccgcgcca

SEQ ID NO: 3528449 - RNA, 22 nt, Pseudomonas putida KT2440
accgacaagauaacacccccca

SEQ ID NO: 3528450 - RNA, 21 nt, Pseudomonas putida KT2440
accgacacaugcaaacccugg

SEQ ID NO: 3528451 - RNA, 19 nt, Pseudomonas putida KT2440
accgaccacgguaccggca

SEQ ID NO: 3528452 - RNA, 15 nt, Pseudomonas putida KT2440
accgaccaucggcag

SEQ ID NO: 3528453 - RNA, 22 nt, Pseudomonas putida KT2440
accgaccauuugccauccggua

SEQ ID NO: 3528454 - RNA, 13 nt, Pseudomonas putida KT2440
accgacccacagg

SEQ ID NO: 3528455 - RNA, 15 nt, Pseudomonas putida KT2440
accgacccggccgcu

SEQ ID NO: 3528456 - RNA, 14 nt, Pseudomonas putida KT2440
accgacccugcugc

SEQ ID NO: 3528457 - RNA, 13 nt, Pseudomonas putida KT2440
accgaccgugcau

SEQ ID NO: 3528458 - RNA, 16 nt, Pseudomonas putida KT2440
accgaccgugcauaca

SEQ ID NO: 3528459 - RNA, 20 nt, Pseudomonas putida KT2440
accgaccgugcauacacccg

SEQ ID NO: 3528460 - RNA, 21 nt, Pseudomonas putida KT2440
accgaccgugcauacacccgg

SEQ ID NO: 3528461 - RNA, 19 nt, Pseudomonas putida KT2440
accgaccucuuagcgggca

SEQ ID NO: 3528462 - RNA, 12 nt, Pseudomonas putida KT2440
accgaccucuuc

SEQ ID NO: 3528463 - RNA, 16 nt, Pseudomonas putida KT2440
accgaccugcaacguc

SEQ ID NO: 3528464 - RNA, 16 nt, Pseudomonas putida KT2440
accgacgaacagggcc

SEQ ID NO: 3528465 - RNA, 21 nt, Pseudomonas putida KT2440
accgacgaacagggccggccc

SEQ ID NO: 3528466 - RNA, 15 nt, Pseudomonas putida KT2440
accgacgccgaucaa

SEQ ID NO: 3528467 - RNA, 22 nt, Pseudomonas putida KT2440
accgagaagcagaacaucaggu

SEQ ID NO: 3528468 - RNA, 22 nt, Pseudomonas putida KT2440
accgagaugaucgcggcaauca

SEQ ID NO: 3528469 - RNA, 22 nt, Pseudomonas putida KT2440
accgagcacucggcggcgaaga

SEQ ID NO: 3528470 - RNA, 18 nt, Pseudomonas putida KT2440
accgagccuuccgggcac

SEQ ID NO: 3528471 - RNA, 19 nt, Pseudomonas putida KT2440
accgagcggucgcagguuc

SEQ ID NO: 3528472 - RNA, 12 nt, Pseudomonas putida KT2440
accgaggaggag

SEQ ID NO: 3528473 - RNA, 21 nt, Pseudomonas putida KT2440
accgaggcgaauggcagguga

SEQ ID NO: 3528474 - RNA, 17 nt, Pseudomonas putida KT2440
accgcucagugccgggg

SEQ ID NO: 3528475 - RNA, 13 nt, Pseudomonas putida KT2440
accgcuccgggua

SEQ ID NO: 3528476 - RNA, 20 nt, Pseudomonas putida KT2440
accgcucgaacaagcgcgac

SEQ ID NO: 3528477 - RNA, 22 nt, Pseudomonas putida KT2440
accgcucgaagauauccgccug

SEQ ID NO: 3528478 - RNA, 15 nt, Pseudomonas putida KT2440
accgcucgcgccgcc

SEQ ID NO: 3528479 - RNA, 15 nt, Pseudomonas putida KT2440
accgcucugcgccac

SEQ ID NO: 3528480 - RNA, 19 nt, Pseudomonas putida KT2440
accgcucugcgccacggcg

SEQ ID NO: 3528481 - RNA, 17 nt, Pseudomonas putida KT2440
accgcugcaaucgagcc

SEQ ID NO: 3528482 - RNA, 16 nt, Pseudomonas putida KT2440
accgcugcauggccug

SEQ ID NO: 3528483 - RNA, 16 nt, Pseudomonas putida KT2440
accgcugccagcugcg

SEQ ID NO: 3528484 - RNA, 21 nt, Pseudomonas putida KT2440
accgcugccauagcgcugcac

SEQ ID NO: 3528485 - RNA, 22 nt, Pseudomonas putida KT2440
accgcugccauagcgcugcacc

SEQ ID NO: 3528486 - RNA, 14 nt, Pseudomonas putida KT2440
accgcugcccagcg

SEQ ID NO: 3528487 - RNA, 17 nt, Pseudomonas putida KT2440
accgcugccgaucagca

SEQ ID NO: 3528488 - RNA, 18 nt, Pseudomonas putida KT2440
accgcugccgaucagcac

SEQ ID NO: 3528489 - RNA, 19 nt, Pseudomonas putida KT2440
accgcuggcgccugcggca

SEQ ID NO: 3528490 - RNA, 20 nt, Pseudomonas putida KT2440
accgcugguggcguggcugc

SEQ ID NO: 3528491 - RNA, 16 nt, Pseudomonas putida KT2440
accgcuguacaggugc

SEQ ID NO: 3528492 - RNA, 18 nt, Pseudomonas putida KT2440
accgcuguacaggugcga

SEQ ID NO: 3528493 - RNA, 15 nt, Pseudomonas putida KT2440
accgcuucacccucg

SEQ ID NO: 3528494 - RNA, 13 nt, Pseudomonas putida KT2440
accgcuucaccgc

SEQ ID NO: 3528495 - RNA, 19 nt, Pseudomonas putida KT2440
accgcuugcacagguaucg

SEQ ID NO: 3528496 - RNA, 12 nt, Pseudomonas putida KT2440
accgcuugcgca

SEQ ID NO: 3528497 - RNA, 20 nt, Pseudomonas putida KT2440
accgcuuggaguugcucgag

SEQ ID NO: 3528498 - RNA, 19 nt, Pseudomonas putida KT2440
accgcuuucacuucaucca

SEQ ID NO: 3528499 - RNA, 18 nt, Pseudomonas putida KT2440
accggacgcuugccaccc

SEQ ID NO: 3528500 - RNA, 15 nt, Pseudomonas putida KT2440
accggcaagcccaug

SEQ ID NO: 3528501 - RNA, 16 nt, Pseudomonas putida KT2440
accggcaagcccaugg

SEQ ID NO: 3528502 - RNA, 23 nt, Pseudomonas putida KT2440
accggcaagcccauggcuggcag

SEQ ID NO: 3528503 - RNA, 18 nt, Pseudomonas putida KT2440
accggcaaucgacucaag

SEQ ID NO: 3528504 - RNA, 13 nt, Pseudomonas putida KT2440
accggcaccaucu

SEQ ID NO: 3528505 - RNA, 13 nt, Pseudomonas putida KT2440
accggcaccgccu

SEQ ID NO: 3528506 - RNA, 22 nt, Pseudomonas putida KT2440
accggcaccgccucuaccacgc

SEQ ID NO: 3528507 - RNA, 18 nt, Pseudomonas putida KT2440
accggcaccggcgaacag

SEQ ID NO: 3528508 - RNA, 21 nt, Pseudomonas putida KT2440
accggcaccggcgaacagcaa

SEQ ID NO: 3528509 - RNA, 21 nt, Pseudomonas putida KT2440
accggcaccgggaugcucugc

SEQ ID NO: 3528510 - RNA, 14 nt, Pseudomonas putida KT2440
accggcagagccgg

SEQ ID NO: 3528511 - RNA, 13 nt, Pseudomonas putida KT2440
accggcagcaccu

SEQ ID NO: 3528512 - RNA, 21 nt, Pseudomonas putida KT2440
accggcagcaccugccagccg

SEQ ID NO: 3528513 - RNA, 13 nt, Pseudomonas putida KT2440
accggcagcagca

SEQ ID NO: 3528514 - RNA, 14 nt, Pseudomonas putida KT2440
accggcagcagcaa

SEQ ID NO: 3528515 - RNA, 18 nt, Pseudomonas putida KT2440
accggcaggcgcuucagg

SEQ ID NO: 3528516 - RNA, 20 nt, Pseudomonas putida KT2440
accggcaguacauagaacag

SEQ ID NO: 3528517 - RNA, 18 nt, Pseudomonas putida KT2440
accggcaguagaaagucc

SEQ ID NO: 3528518 - RNA, 18 nt, Pseudomonas putida KT2440
accggcaguucgacgccu

SEQ ID NO: 3528519 - RNA, 22 nt, Pseudomonas putida KT2440
accggcauagcgcaagggggca

SEQ ID NO: 3528520 - RNA, 17 nt, Pseudomonas putida KT2440
accggcauucccggcgc

SEQ ID NO: 3528521 - RNA, 20 nt, Pseudomonas putida KT2440
accggcauucccggcgccau

SEQ ID NO: 3528522 - RNA, 21 nt, Pseudomonas putida KT2440
accggcauucccggcgccaug

SEQ ID NO: 3528523 - RNA, 14 nt, Pseudomonas putida KT2440
accggccaccaggc

SEQ ID NO: 3528524 - RNA, 16 nt, Pseudomonas putida KT2440
accggccacgaaggcc

SEQ ID NO: 3528525 - RNA, 15 nt, Pseudomonas putida KT2440
accggccacgcgcag

SEQ ID NO: 3528526 - RNA, 17 nt, Pseudomonas putida KT2440
accggccacgcgcaguu

SEQ ID NO: 3528527 - RNA, 12 nt, Pseudomonas putida KT2440
accggccagcac

SEQ ID NO: 3528528 - RNA, 11 nt, Pseudomonas putida KT2440
accggccagcu

SEQ ID NO: 3528529 - RNA, 21 nt, Pseudomonas putida KT2440
accggccccccagccagcaga

SEQ ID NO: 3528530 - RNA, 17 nt, Pseudomonas putida KT2440
accggcccugaaggccg

SEQ ID NO: 3528531 - RNA, 21 nt, Pseudomonas putida KT2440
accggcccugaaggccgcucc

SEQ ID NO: 3528532 - RNA, 19 nt, Pseudomonas putida KT2440
accggccgacccgccuggu

SEQ ID NO: 3528533 - RNA, 23 nt, Pseudomonas putida KT2440
accggccgccaggauggcaccga

SEQ ID NO: 3528534 - RNA, 14 nt, Pseudomonas putida KT2440
accggccgcucacc

SEQ ID NO: 3528535 - RNA, 19 nt, Pseudomonas putida KT2440
accggccucuucgcgggca

SEQ ID NO: 3528536 - RNA, 14 nt, Pseudomonas putida KT2440
accggccuggaacc

SEQ ID NO: 3528537 - RNA, 22 nt, Pseudomonas putida KT2440
accggccuugccgcuggcgaug

SEQ ID NO: 3528538 - RNA, 23 nt, Pseudomonas putida KT2440
accggccuugccgcuggcgauga

SEQ ID NO: 3528539 - RNA, 18 nt, Pseudomonas putida KT2440
accggccuugcgcaaggc

SEQ ID NO: 3528540 - RNA, 18 nt, Pseudomonas putida KT2440
accggccuuggccagcuc

SEQ ID NO: 3528541 - RNA, 14 nt, Pseudomonas putida KT2440
accggcgaagacgg

SEQ ID NO: 3528542 - RNA, 17 nt, Pseudomonas putida KT2440
accggcgaguccugccu

SEQ ID NO: 3528543 - RNA, 18 nt, Pseudomonas putida KT2440
accggcgaguccugccuu

SEQ ID NO: 3528544 - RNA, 21 nt, Pseudomonas putida KT2440
accggcgccaaucaucgccag

SEQ ID NO: 3528545 - RNA, 23 nt, Pseudomonas putida KT2440
accggcgccaaucaucgccagca

SEQ ID NO: 3528546 - RNA, 13 nt, Pseudomonas putida KT2440
accggcgccgccc

SEQ ID NO: 3528547 - RNA, 15 nt, Pseudomonas putida KT2440
accggcgccgcccag

SEQ ID NO: 3528548 - RNA, 22 nt, Pseudomonas putida KT2440
accggcggcgaacaucugcucg

SEQ ID NO: 3528549 - RNA, 22 nt, Pseudomonas putida KT2440
accggcguguugccgcugugcu

SEQ ID NO: 3528550 - RNA, 23 nt, Pseudomonas putida KT2440
accggcguguugccgcugugcuu

SEQ ID NO: 3528551 - RNA, 19 nt, Pseudomonas putida KT2440
accggcucaacagcaggug

SEQ ID NO: 3528552 - RNA, 22 nt, Pseudomonas putida KT2440
accggcuccaccugcuccagca

SEQ ID NO: 3528553 - RNA, 23 nt, Pseudomonas putida KT2440
accggcuccaccugcuccagcac

SEQ ID NO: 3528554 - RNA, 23 nt, Pseudomonas putida KT2440
accggcucccccuccacccgguc

SEQ ID NO: 3528555 - RNA, 12 nt, Pseudomonas putida KT2440
accggcucugcc

SEQ ID NO: 3528556 - RNA, 15 nt, Pseudomonas putida KT2440
accggcugcgccggu

SEQ ID NO: 3528557 - RNA, 15 nt, Pseudomonas putida KT2440
accggcuguuggccu

SEQ ID NO: 3528558 - RNA, 22 nt, Pseudomonas putida KT2440
accggcuucgucggcgcggaau

SEQ ID NO: 3528559 - RNA, 17 nt, Pseudomonas putida KT2440
accggcuucuaccacug

SEQ ID NO: 3528560 - RNA, 23 nt, Pseudomonas putida KT2440
accggcuucuaccacuggggcuu

SEQ ID NO: 3528561 - RNA, 16 nt, Pseudomonas putida KT2440
accggcuugcgcccgu

SEQ ID NO: 3528562 - RNA, 15 nt, Pseudomonas putida KT2440
accggcuuguagccg

SEQ ID NO: 3528563 - RNA, 16 nt, Pseudomonas putida KT2440
accggcuuguagccgg

SEQ ID NO: 3528564 - RNA, 15 nt, Pseudomonas putida KT2440
accgggaacaggugc

SEQ ID NO: 3528565 - RNA, 18 nt, Pseudomonas putida KT2440
accgggauggcggcgccu

SEQ ID NO: 3528566 - RNA, 14 nt, Pseudomonas putida KT2440
accgggcgcgauug

SEQ ID NO: 3528567 - RNA, 14 nt, Pseudomonas putida KT2440
accgggcggccacc

SEQ ID NO: 3528568 - RNA, 20 nt, Pseudomonas putida KT2440
accgggcggccaccggccac

SEQ ID NO: 3528569 - RNA, 16 nt, Pseudomonas putida KT2440
accggggcaggcugug

SEQ ID NO: 3528570 - RNA, 18 nt, Pseudomonas putida KT2440
accggguaggccccaggg

SEQ ID NO: 3528571 - RNA, 22 nt, Pseudomonas putida KT2440
accggguaggccccagggggca

SEQ ID NO: 3528572 - RNA, 13 nt, Pseudomonas putida KT2440
accgggucuugaa

SEQ ID NO: 3528573 - RNA, 15 nt, Pseudomonas putida KT2440
accgggugugagaac

SEQ ID NO: 3528574 - RNA, 16 nt, Pseudomonas putida KT2440
accgguacauugcgca

SEQ ID NO: 3528575 - RNA, 21 nt, Pseudomonas putida KT2440
accgguacauugcgcaccccu

SEQ ID NO: 3528576 - RNA, 14 nt, Pseudomonas putida KT2440
accgguaccggcgu

SEQ ID NO: 3528577 - RNA, 17 nt, Pseudomonas putida KT2440
accgguauaacgcacgu

SEQ ID NO: 3528578 - RNA, 22 nt, Pseudomonas putida KT2440
accggucagcccggcuugcacc

SEQ ID NO: 3528579 - RNA, 14 nt, Pseudomonas putida KT2440
accugcugggucag

SEQ ID NO: 3528580 - RNA, 17 nt, Pseudomonas putida KT2440
accugcugggucagcgc

SEQ ID NO: 3528581 - RNA, 20 nt, Pseudomonas putida KT2440
accugcugggucagcgcuga

SEQ ID NO: 3528582 - RNA, 18 nt, Pseudomonas putida KT2440
accugcuucgcgggcacg

SEQ ID NO: 3528583 - RNA, 18 nt, Pseudomonas putida KT2440
accuggaauaccaccuca

SEQ ID NO: 3528584 - RNA, 16 nt, Pseudomonas putida KT2440
accuggaucgccaggc

SEQ ID NO: 3528585 - RNA, 17 nt, Pseudomonas putida KT2440
accuggaucgccaggcu

SEQ ID NO: 3528586 - RNA, 18 nt, Pseudomonas putida KT2440
accuggcccgaacgcagc

SEQ ID NO: 3528587 - RNA, 22 nt, Pseudomonas putida KT2440
accuggccgcguucgcccaggc

SEQ ID NO: 3528588 - RNA, 23 nt, Pseudomonas putida KT2440
accuggccgugccgaggacaaca

SEQ ID NO: 3528589 - RNA, 18 nt, Pseudomonas putida KT2440
accuggcucggcugggcu

SEQ ID NO: 3528590 - RNA, 19 nt, Pseudomonas putida KT2440
accuggcucggcugggcuu

SEQ ID NO: 3528591 - RNA, 20 nt, Pseudomonas putida KT2440
accuggcucggugugcaccu

SEQ ID NO: 3528592 - RNA, 21 nt, Pseudomonas putida KT2440
accuggcucggugugcaccug

SEQ ID NO: 3528593 - RNA, 24 nt, Pseudomonas putida KT2440
accuggcucuucaacaccagcaug

SEQ ID NO: 3528594 - RNA, 15 nt, Pseudomonas putida KT2440
accuggcugcaguga

SEQ ID NO: 3528595 - RNA, 22 nt, Pseudomonas putida KT2440
accuggcugcugugguuuggcc

SEQ ID NO: 3528596 - RNA, 23 nt, Pseudomonas putida KT2440
accuggcugcugugguuuggccc

SEQ ID NO: 3528597 - RNA, 13 nt, Pseudomonas putida KT2440
accugggccaggu

SEQ ID NO: 3528598 - RNA, 23 nt, Pseudomonas putida KT2440
accugggccaguaccuucuggcu

SEQ ID NO: 3528599 - RNA, 18 nt, Pseudomonas putida KT2440
accugggcgucaucaccc

SEQ ID NO: 3528600 - RNA, 14 nt, Pseudomonas putida KT2440
accuggguccaggc

SEQ ID NO: 3528601 - RNA, 15 nt, Pseudomonas putida KT2440
accuggguccaggca

SEQ ID NO: 3528602 - RNA, 14 nt, Pseudomonas putida KT2440
accugguaccccuc

SEQ ID NO: 3528603 - RNA, 16 nt, Pseudomonas putida KT2440
accugguccagcuuca

SEQ ID NO: 3528604 - RNA, 20 nt, Pseudomonas putida KT2440
accugguccagcuucaccuc

SEQ ID NO: 3528605 - RNA, 14 nt, Pseudomonas putida KT2440
accuggugcgccuu

SEQ ID NO: 3528606 - RNA, 17 nt, Pseudomonas putida KT2440
accugguucaucgacuu

SEQ ID NO: 3528607 - RNA, 22 nt, Pseudomonas putida KT2440
accugguucugugcguucaccg

SEQ ID NO: 3528608 - RNA, 15 nt, Pseudomonas putida KT2440
accugguuguagccc

SEQ ID NO: 3528609 - RNA, 13 nt, Pseudomonas putida KT2440
accugguuugagg

SEQ ID NO: 3528610 - RNA, 16 nt, Pseudomonas putida KT2440
accuguaacucagcuu

SEQ ID NO: 3528611 - RNA, 14 nt, Pseudomonas putida KT2440
accugucccagcug

SEQ ID NO: 3528612 - RNA, 17 nt, Pseudomonas putida KT2440
accugucccagcuggca

SEQ ID NO: 3528613 - RNA, 18 nt, Pseudomonas putida KT2440
accugucccagcuggcaa

SEQ ID NO: 3528614 - RNA, 18 nt, Pseudomonas putida KT2440
accugugaagccagggca

SEQ ID NO: 3528615 - RNA, 21 nt, Pseudomonas putida KT2440
accugugaagccagggcaagc

SEQ ID NO: 3528616 - RNA, 20 nt, Pseudomonas putida KT2440
accugugcacagccgugccu

SEQ ID NO: 3528617 - RNA, 12 nt, Pseudomonas putida KT2440
accugugcugaa

SEQ ID NO: 3528618 - RNA, 22 nt, Pseudomonas putida KT2440
accuguggcagcggcuuggccg

SEQ ID NO: 3528619 - RNA, 18 nt, Pseudomonas putida KT2440
accugugggagcgggcau

SEQ ID NO: 3528620 - RNA, 19 nt, Pseudomonas putida KT2440
accugugggagcgggcaug

SEQ ID NO: 3528621 - RNA, 17 nt, Pseudomonas putida KT2440
accugugggagcgggcg

SEQ ID NO: 3528622 - RNA, 17 nt, Pseudomonas putida KT2440
accugugggagcgggcu

SEQ ID NO: 3528623 - RNA, 19 nt, Pseudomonas putida KT2440
accugugggagcgggcuug

SEQ ID NO: 3528624 - RNA, 14 nt, Pseudomonas putida KT2440
accuguggggcaac

SEQ ID NO: 3528625 - RNA, 17 nt, Pseudomonas putida KT2440
accuguggggcaacugc

SEQ ID NO: 3528626 - RNA, 15 nt, Pseudomonas putida KT2440
accugugguggcugc

SEQ ID NO: 3528627 - RNA, 18 nt, Pseudomonas putida KT2440
accugugguggcugcuuc

SEQ ID NO: 3528628 - RNA, 23 nt, Pseudomonas putida KT2440
accugugguuucacacucgccag

SEQ ID NO: 3528629 - RNA, 17 nt, Pseudomonas putida KT2440
accuguuccggccucuu

SEQ ID NO: 3528630 - RNA, 15 nt, Pseudomonas putida KT2440
accuguuucuugucu

SEQ ID NO: 3528631 - RNA, 14 nt, Pseudomonas putida KT2440
accuuacuugcaca

SEQ ID NO: 3528632 - RNA, 19 nt, Pseudomonas putida KT2440
accuuacuugcacauccca

SEQ ID NO: 3528633 - RNA, 16 nt, Pseudomonas putida KT2440
accuuaucggccggca

SEQ ID NO: 3528634 - RNA, 14 nt, Pseudomonas putida KT2440
accuucaacaccaa

SEQ ID NO: 3528635 - RNA, 22 nt, Pseudomonas putida KT2440
accuucacgccauuguucgccu

SEQ ID NO: 3528636 - RNA, 22 nt, Pseudomonas putida KT2440
accuucagcgggucgagccagg

SEQ ID NO: 3528637 - RNA, 15 nt, Pseudomonas putida KT2440
accuuccacucuucc

SEQ ID NO: 3528638 - RNA, 14 nt, Pseudomonas putida KT2440
accuuccagcaaag

SEQ ID NO: 3528639 - RNA, 12 nt, Pseudomonas putida KT2440
accuuccagguc

SEQ ID NO: 3528640 - RNA, 13 nt, Pseudomonas putida KT2440
accuuccaugcgc

SEQ ID NO: 3528641 - RNA, 23 nt, Pseudomonas putida KT2440
accuuccguuaguucgugcaccc

SEQ ID NO: 3528642 - RNA, 15 nt, Pseudomonas putida KT2440
accuucgagccaccg

SEQ ID NO: 3528643 - RNA, 20 nt, Pseudomonas putida KT2440
accuucgauuagacccagau

SEQ ID NO: 3528644 - RNA, 12 nt, Pseudomonas putida KT2440
accuucggcaug

SEQ ID NO: 3528645 - RNA, 13 nt, Pseudomonas putida KT2440
accuucggggaug

SEQ ID NO: 3528646 - RNA, 13 nt, Pseudomonas putida KT2440
accuucucacuga

SEQ ID NO: 3528647 - RNA, 14 nt, Pseudomonas putida KT2440
accuucucacugau

SEQ ID NO: 3528648 - RNA, 13 nt, Pseudomonas putida KT2440
accuucuggcagc

SEQ ID NO: 3528649 - RNA, 23 nt, Pseudomonas putida KT2440
accuugccuaccugaucaccgau

SEQ ID NO: 3528650 - RNA, 18 nt, Pseudomonas putida KT2440
accuugccuuucaucauc

SEQ ID NO: 3528651 - RNA, 23 nt, Pseudomonas putida KT2440
accuugcuccaccaggccacguu

SEQ ID NO: 3528652 - RNA, 20 nt, Pseudomonas putida KT2440
accuugcugaaauccagccg

SEQ ID NO: 3528653 - RNA, 16 nt, Pseudomonas putida KT2440
accuugcuugaccuug

SEQ ID NO: 3528654 - RNA, 16 nt, Pseudomonas putida KT2440
accuugggccggcgca

SEQ ID NO: 3528655 - RNA, 18 nt, Pseudomonas putida KT2440
accuugggccggcgcagg

SEQ ID NO: 3528656 - RNA, 18 nt, Pseudomonas putida KT2440
accuugggcgaggacagc

SEQ ID NO: 3528657 - RNA, 23 nt, Pseudomonas putida KT2440
accuuggugccaaccuugaccac

SEQ ID NO: 3528658 - RNA, 13 nt, Pseudomonas putida KT2440
accuugucagcaa

SEQ ID NO: 3528659 - RNA, 17 nt, Pseudomonas putida KT2440
accuugucagcaaccac

SEQ ID NO: 3528660 - RNA, 16 nt, Pseudomonas putida KT2440
accuugucgacaaagu

SEQ ID NO: 3528661 - RNA, 15 nt, Pseudomonas putida KT2440
accuuguuacccgca

SEQ ID NO: 3528662 - RNA, 23 nt, Pseudomonas putida KT2440
accuuugagugcuucgcccagug

SEQ ID NO: 3528663 - RNA, 17 nt, Pseudomonas putida KT2440
accuuugcggcacaucu

SEQ ID NO: 3528664 - RNA, 22 nt, Pseudomonas putida KT2440
acgaaaaaaagggcaccuccag

SEQ ID NO: 3528665 - RNA, 13 nt, Pseudomonas putida KT2440
acgaaaaagccag

SEQ ID NO: 3528666 - RNA, 20 nt, Pseudomonas putida KT2440
acgaaacccaguacggcgcc

SEQ ID NO: 3528667 - RNA, 16 nt, Pseudomonas putida KT2440
acgaaacgccacgccc

SEQ ID NO: 3528668 - RNA, 19 nt, Pseudomonas putida KT2440
acgaaacgccacgcccaac

SEQ ID NO: 3528669 - RNA, 16 nt, Pseudomonas putida KT2440
acgaacaacgccaccg

SEQ ID NO: 3528670 - RNA, 18 nt, Pseudomonas putida KT2440
acgaacaccagccccagc

SEQ ID NO: 3528671 - RNA, 12 nt, Pseudomonas putida KT2440
acgaacaggcgc

SEQ ID NO: 3528672 - RNA, 11 nt, Pseudomonas putida KT2440
acgaacagugg

SEQ ID NO: 3528673 - RNA, 17 nt, Pseudomonas putida KT2440
acgaacaguggcccgau

SEQ ID NO: 3528674 - RNA, 15 nt, Pseudomonas putida KT2440
acgaacaucagcagg

SEQ ID NO: 3528675 - RNA, 16 nt, Pseudomonas putida KT2440
acgaacuacgcgccag

SEQ ID NO: 3528676 - RNA, 19 nt, Pseudomonas putida KT2440
acgaacucaacgcaacugc

SEQ ID NO: 3528677 - RNA, 12 nt, Pseudomonas putida KT2440
acgaagaucacc

SEQ ID NO: 3528678 - RNA, 22 nt, Pseudomonas putida KT2440
acgaagccaugucuucacgaga

SEQ ID NO: 3528679 - RNA, 21 nt, Pseudomonas putida KT2440
acgaagccgacccgggccagc

SEQ ID NO: 3528680 - RNA, 21 nt, Pseudomonas putida KT2440
acgaagccguugaggccgaac

SEQ ID NO: 3528681 - RNA, 15 nt, Pseudomonas putida KT2440
acgaaggccagcaaa

SEQ ID NO: 3528682 - RNA, 19 nt, Pseudomonas putida KT2440
acgaaggucuugccgugcu

SEQ ID NO: 3528683 - RNA, 21 nt, Pseudomonas putida KT2440
acgaaguugagcaccggcagg

SEQ ID NO: 3528684 - RNA, 17 nt, Pseudomonas putida KT2440
acgcccagcaacugcgc

SEQ ID NO: 3528685 - RNA, 22 nt, Pseudomonas putida KT2440
acgcccaggcggcgugacgugc

SEQ ID NO: 3528686 - RNA, 13 nt, Pseudomonas putida KT2440
acgcccaucagcg

SEQ ID NO: 3528687 - RNA, 18 nt, Pseudomonas putida KT2440
acgcccaucagcgccgcc

SEQ ID NO: 3528688 - RNA, 15 nt, Pseudomonas putida KT2440
acgccccacccgcuc

SEQ ID NO: 3528689 - RNA, 15 nt, Pseudomonas putida KT2440
acgccccaggccgcg

SEQ ID NO: 3528690 - RNA, 13 nt, Pseudomonas putida KT2440
acgcccccagccc

SEQ ID NO: 3528691 - RNA, 21 nt, Pseudomonas putida KT2440
acgccccgaaccuacccggua

SEQ ID NO: 3528692 - RNA, 11 nt, Pseudomonas putida KT2440
acgccccgacu

SEQ ID NO: 3528693 - RNA, 17 nt, Pseudomonas putida KT2440
acgccccuuggcacggc

SEQ ID NO: 3528694 - RNA, 18 nt, Pseudomonas putida KT2440
acgcccgcaacaaccugg

SEQ ID NO: 3528695 - RNA, 20 nt, Pseudomonas putida KT2440
acgcccgcaacaaccuggcc

SEQ ID NO: 3528696 - RNA, 19 nt, Pseudomonas putida KT2440
acgcccgccggcacuuccu

SEQ ID NO: 3528697 - RNA, 17 nt, Pseudomonas putida KT2440
acgcccgcgcauagcag

SEQ ID NO: 3528698 - RNA, 14 nt, Pseudomonas putida KT2440
acgcccgcgugcuu

SEQ ID NO: 3528699 - RNA, 21 nt, Pseudomonas putida KT2440
acgcccgcucccacagguuug

SEQ ID NO: 3528700 - RNA, 18 nt, Pseudomonas putida KT2440
acgcccgcugcaugcucg

SEQ ID NO: 3528701 - RNA, 13 nt, Pseudomonas putida KT2440
acgcccggcaauc

SEQ ID NO: 3528702 - RNA, 17 nt, Pseudomonas putida KT2440
acgcccgguugcaccga

SEQ ID NO: 3528703 - RNA, 19 nt, Pseudomonas putida KT2440
acgcccuagaacaggcggc

SEQ ID NO: 3528704 - RNA, 20 nt, Pseudomonas putida KT2440
acgcccuucauacagcgccu

SEQ ID NO: 3528705 - RNA, 16 nt, Pseudomonas putida KT2440
acgccgacagcggcga

SEQ ID NO: 3528706 - RNA, 18 nt, Pseudomonas putida KT2440
acgccgauagccagcugg

SEQ ID NO: 3528707 - RNA, 21 nt, Pseudomonas putida KT2440
acgccgaucaaugucggagcg

SEQ ID NO: 3528708 - RNA, 21 nt, Pseudomonas putida KT2440
acgccgauguccuugcuggcc

SEQ ID NO: 3528709 - RNA, 12 nt, Pseudomonas putida KT2440
acgccgccccac

SEQ ID NO: 3528710 - RNA, 17 nt, Pseudomonas putida KT2440
acgccgccccacucgcg

SEQ ID NO: 3528711 - RNA, 18 nt, Pseudomonas putida KT2440
acgccgccgaggcaccgg

SEQ ID NO: 3528712 - RNA, 20 nt, Pseudomonas putida KT2440
acgccgccgaggcaccggua

SEQ ID NO: 3528713 - RNA, 16 nt, Pseudomonas putida KT2440
acgccgcugcggcugc

SEQ ID NO: 3528714 - RNA, 18 nt, Pseudomonas putida KT2440
acgccgcugguacagggu

SEQ ID NO: 3528715 - RNA, 14 nt, Pseudomonas putida KT2440
acgccggccaaggu

SEQ ID NO: 3528716 - RNA, 15 nt, Pseudomonas putida KT2440
acgccggcgcacgca

SEQ ID NO: 3528717 - RNA, 19 nt, Pseudomonas putida KT2440
acgccgggcacugcccggc

SEQ ID NO: 3528718 - RNA, 15 nt, Pseudomonas putida KT2440
acgccggucgggcac

SEQ ID NO: 3528719 - RNA, 16 nt, Pseudomonas putida KT2440
acgccggucgggcacu

SEQ ID NO: 3528720 - RNA, 18 nt, Pseudomonas putida KT2440
acgccguacggcccaugu

SEQ ID NO: 3528721 - RNA, 19 nt, Pseudomonas putida KT2440
acgccgugguagcaccgga

SEQ ID NO: 3528722 - RNA, 24 nt, Pseudomonas putida KT2440
acgccguugcggucgguggucagc

SEQ ID NO: 3528723 - RNA, 15 nt, Pseudomonas putida KT2440
acgccguugucacgc

SEQ ID NO: 3528724 - RNA, 18 nt, Pseudomonas putida KT2440
acgccucaugaucugcaa

SEQ ID NO: 3528725 - RNA, 19 nt, Pseudomonas putida KT2440
acgccucaugaucugcaag

SEQ ID NO: 3528726 - RNA, 12 nt, Pseudomonas putida KT2440
acgccucgaagu

SEQ ID NO: 3528727 - RNA, 17 nt, Pseudomonas putida KT2440
acgccucgggcgcucgc

SEQ ID NO: 3528728 - RNA, 22 nt, Pseudomonas putida KT2440
acgccugaagcacgucgcgauu

SEQ ID NO: 3528729 - RNA, 18 nt, Pseudomonas putida KT2440
acgccuuaguucacccac

SEQ ID NO: 3528730 - RNA, 23 nt, Pseudomonas putida KT2440
acgccuuaguucacccacacccg

SEQ ID NO: 3528731 - RNA, 14 nt, Pseudomonas putida KT2440
acgccuucgaacaa

SEQ ID NO: 3528732 - RNA, 15 nt, Pseudomonas putida KT2440
acgccuugcgcucga

SEQ ID NO: 3528733 - RNA, 23 nt, Pseudomonas putida KT2440
acgccuuggccuggcgagucagg

SEQ ID NO: 3528734 - RNA, 19 nt, Pseudomonas putida KT2440
acgccuuggcgcagcaagg

SEQ ID NO: 3528735 - RNA, 15 nt, Pseudomonas putida KT2440
acgcgaaagcgaaga

SEQ ID NO: 3528736 - RNA, 14 nt, Pseudomonas putida KT2440
acgcgaaucgccag

SEQ ID NO: 3528737 - RNA, 20 nt, Pseudomonas putida KT2440
acgcgaaucgccagggcuca

SEQ ID NO: 3528738 - RNA, 19 nt, Pseudomonas putida KT2440
acgcgaaugaugaauaaug

SEQ ID NO: 3528739 - RNA, 21 nt, Pseudomonas putida KT2440
acgcgaaugaugaauaaugcu

SEQ ID NO: 3528740 - RNA, 19 nt, Pseudomonas putida KT2440
acgcgacagggcgcccguu

SEQ ID NO: 3528741 - RNA, 19 nt, Pseudomonas putida KT2440
acgcgaccucagccguggu

SEQ ID NO: 3528742 - RNA, 19 nt, Pseudomonas putida KT2440
acgcgacgggaagugcacu

SEQ ID NO: 3528743 - RNA, 21 nt, Pseudomonas putida KT2440
acgcgauaaugggucaacggc

SEQ ID NO: 3528744 - RNA, 23 nt, Pseudomonas putida KT2440
acgcgauacccaauaaaaacaac

SEQ ID NO: 3528745 - RNA, 14 nt, Pseudomonas putida KT2440
acgcgcaagcugag

SEQ ID NO: 3528746 - RNA, 18 nt, Pseudomonas putida KT2440
acgcgcagagaagccgca

SEQ ID NO: 3528747 - RNA, 15 nt, Pseudomonas putida KT2440
acgcgccaaccgcgc

SEQ ID NO: 3528748 - RNA, 20 nt, Pseudomonas putida KT2440
acgcgccacauagcuggcac

SEQ ID NO: 3528749 - RNA, 12 nt, Pseudomonas putida KT2440
acgcgccagcag

SEQ ID NO: 3528750 - RNA, 13 nt, Pseudomonas putida KT2440
acgcgccagcagc

SEQ ID NO: 3528751 - RNA, 14 nt, Pseudomonas putida KT2440
acgcgccagcagcg

SEQ ID NO: 3528752 - RNA, 20 nt, Pseudomonas putida KT2440
acgcgccaggucggacaggg

SEQ ID NO: 3528753 - RNA, 18 nt, Pseudomonas putida KT2440
acgcgccagucagaagca

SEQ ID NO: 3528754 - RNA, 21 nt, Pseudomonas putida KT2440
acgcgccagucagaagcagcu

SEQ ID NO: 3528755 - RNA, 16 nt, Pseudomonas putida KT2440
acgcgccauccgccac

SEQ ID NO: 3528756 - RNA, 17 nt, Pseudomonas putida KT2440
acgcgcccugugggagc

SEQ ID NO: 3528757 - RNA, 22 nt, Pseudomonas putida KT2440
acgcgcccugugggagcggccu

SEQ ID NO: 3528758 - RNA, 14 nt, Pseudomonas putida KT2440
acgcgccgcugccu

SEQ ID NO: 3528759 - RNA, 17 nt, Pseudomonas putida KT2440
acgcgccgcugccuggg

SEQ ID NO: 3528760 - RNA, 18 nt, Pseudomonas putida KT2440
acgcgccgcugccugggc

SEQ ID NO: 3528761 - RNA, 14 nt, Pseudomonas putida KT2440
acgcgccugcaccu

SEQ ID NO: 3528762 - RNA, 20 nt, Pseudomonas putida KT2440
acgcgcuaccugugggagcg

SEQ ID NO: 3528763 - RNA, 22 nt, Pseudomonas putida KT2440
acgcgcuuggagaagcgaucga

SEQ ID NO: 3528764 - RNA, 19 nt, Pseudomonas putida KT2440
acgcgcuuuuccagcaaag

SEQ ID NO: 3528765 - RNA, 13 nt, Pseudomonas putida KT2440
acgcggaacuggc

SEQ ID NO: 3528766 - RNA, 17 nt, Pseudomonas putida KT2440
acgcggcaaccugcacu

SEQ ID NO: 3528767 - RNA, 18 nt, Pseudomonas putida KT2440
acgcggcaaccugcacua

SEQ ID NO: 3528768 - RNA, 14 nt, Pseudomonas putida KT2440
acgcggcagcagca

SEQ ID NO: 3528769 - RNA, 17 nt, Pseudomonas putida KT2440
acgcggcauuggcgcgc

SEQ ID NO: 3528770 - RNA, 16 nt, Pseudomonas putida KT2440
acgcggccugugccca

SEQ ID NO: 3528771 - RNA, 22 nt, Pseudomonas putida KT2440
acgcgggcaauguccaggugcu

SEQ ID NO: 3528772 - RNA, 14 nt, Pseudomonas putida KT2440
acgcggggcagcgc

SEQ ID NO: 3528773 - RNA, 23 nt, Pseudomonas putida KT2440
acgcggguccagcgcggccacgc

SEQ ID NO: 3528774 - RNA, 15 nt, Pseudomonas putida KT2440
acgcgucaucugcgc

SEQ ID NO: 3528775 - RNA, 16 nt, Pseudomonas putida KT2440
acgcgugccugguugc

SEQ ID NO: 3528776 - RNA, 18 nt, Pseudomonas putida KT2440
acgcguggucgccggcga

SEQ ID NO: 3528777 - RNA, 21 nt, Pseudomonas putida KT2440
acgcguugauuuagcaggcac

SEQ ID NO: 3528778 - RNA, 13 nt, Pseudomonas putida KT2440
acgcucaacccca

SEQ ID NO: 3528779 - RNA, 18 nt, Pseudomonas putida KT2440
acgcucaaccccaucacc

SEQ ID NO: 3528780 - RNA, 18 nt, Pseudomonas putida KT2440
acgcucagugugggggcg

SEQ ID NO: 3528781 - RNA, 13 nt, Pseudomonas putida KT2440
acgcucaugaaca

SEQ ID NO: 3528782 - RNA, 14 nt, Pseudomonas putida KT2440
acgcucaugaacag

SEQ ID NO: 3528783 - RNA, 22 nt, Pseudomonas putida KT2440
acgcucaugcugguuuggcagc

SEQ ID NO: 3528784 - RNA, 18 nt, Pseudomonas putida KT2440
acgcuccugcaugccuuc

SEQ ID NO: 3528785 - RNA, 15 nt, Pseudomonas putida KT2440
acgcucgacagcaac

SEQ ID NO: 3528786 - RNA, 16 nt, Pseudomonas putida KT2440
acgcucggccaguacc

SEQ ID NO: 3528787 - RNA, 23 nt, Pseudomonas putida KT2440
acgcucguccaggcccugcagcg

SEQ ID NO: 3528788 - RNA, 18 nt, Pseudomonas putida KT2440
acgcucuguaucgaacag

SEQ ID NO: 3528789 - RNA, 16 nt, Pseudomonas putida KT2440
acggcuuggcugccgg

SEQ ID NO: 3528790 - RNA, 22 nt, Pseudomonas putida KT2440
acgggaagugcacugccuggcu

SEQ ID NO: 3528791 - RNA, 12 nt, Pseudomonas putida KT2440
acgggacaggcu

SEQ ID NO: 3528792 - RNA, 15 nt, Pseudomonas putida KT2440
acgggaucaccgugu

SEQ ID NO: 3528793 - RNA, 18 nt, Pseudomonas putida KT2440
acgggcaaacaggcugau

SEQ ID NO: 3528794 - RNA, 15 nt, Pseudomonas putida KT2440
acgggcaaccgcauc

SEQ ID NO: 3528795 - RNA, 14 nt, Pseudomonas putida KT2440
acgggcaaggcugg

SEQ ID NO: 3528796 - RNA, 19 nt, Pseudomonas putida KT2440
acgggcacaccuggugcgc

SEQ ID NO: 3528797 - RNA, 17 nt, Pseudomonas putida KT2440
acgggcauuuuucgaac

SEQ ID NO: 3528798 - RNA, 21 nt, Pseudomonas putida KT2440
acgggcauuuuucgaacagcu

SEQ ID NO: 3528799 - RNA, 18 nt, Pseudomonas putida KT2440
acgggccaccaaaggccu

SEQ ID NO: 3528800 - RNA, 18 nt, Pseudomonas putida KT2440
acgggccagccgcgccag

SEQ ID NO: 3528801 - RNA, 20 nt, Pseudomonas putida KT2440
acgggccagccgcgccaggu

SEQ ID NO: 3528802 - RNA, 19 nt, Pseudomonas putida KT2440
acgggcccuuucgcgggua

SEQ ID NO: 3528803 - RNA, 20 nt, Pseudomonas putida KT2440
acgggcgcgacuugauccag

SEQ ID NO: 3528804 - RNA, 18 nt, Pseudomonas putida KT2440
acgggcggaacuggcccu

SEQ ID NO: 3528805 - RNA, 15 nt, Pseudomonas putida KT2440
acgggcugucgagca

SEQ ID NO: 3528806 - RNA, 20 nt, Pseudomonas putida KT2440
acgggcuugugcaucagcgu

SEQ ID NO: 3528807 - RNA, 17 nt, Pseudomonas putida KT2440
acgggcuuuaucgauga

SEQ ID NO: 3528808 - RNA, 14 nt, Pseudomonas putida KT2440
acgggguguugcuu

SEQ ID NO: 3528809 - RNA, 17 nt, Pseudomonas putida KT2440
acgggucgagguggaga

SEQ ID NO: 3528810 - RNA, 15 nt, Pseudomonas putida KT2440
acgggucuuuucuuc

SEQ ID NO: 3528811 - RNA, 14 nt, Pseudomonas putida KT2440
acgggugaccaggc

SEQ ID NO: 3528812 - RNA, 21 nt, Pseudomonas putida KT2440
acgggugaccaggcccagcag

SEQ ID NO: 3528813 - RNA, 14 nt, Pseudomonas putida KT2440
acgggugcgggcuc

SEQ ID NO: 3528814 - RNA, 22 nt, Pseudomonas putida KT2440
acggguguuuccaccccggcag

SEQ ID NO: 3528815 - RNA, 16 nt, Pseudomonas putida KT2440
acggguugaagauggu

SEQ ID NO: 3528816 - RNA, 14 nt, Pseudomonas putida KT2440
acgguacgggcaaa

SEQ ID NO: 3528817 - RNA, 15 nt, Pseudomonas putida KT2440
acgguagccagucug

SEQ ID NO: 3528818 - RNA, 22 nt, Pseudomonas putida KT2440
acgguaggccuugaccagcuug

SEQ ID NO: 3528819 - RNA, 17 nt, Pseudomonas putida KT2440
acgguaguggcggcaac

SEQ ID NO: 3528820 - RNA, 15 nt, Pseudomonas putida KT2440
acggucacugagcca

SEQ ID NO: 3528821 - RNA, 17 nt, Pseudomonas putida KT2440
acggucacugagccagg

SEQ ID NO: 3528822 - RNA, 19 nt, Pseudomonas putida KT2440
acggucacugagccaggcc

SEQ ID NO: 3528823 - RNA, 18 nt, Pseudomonas putida KT2440
acggucagcauccagcca

SEQ ID NO: 3528824 - RNA, 16 nt, Pseudomonas putida KT2440
acggucagcggcaguu

SEQ ID NO: 3528825 - RNA, 20 nt, Pseudomonas putida KT2440
acggucagugaagcgaggug

SEQ ID NO: 3528826 - RNA, 15 nt, Pseudomonas putida KT2440
acggucaugcucagc

SEQ ID NO: 3528827 - RNA, 11 nt, Pseudomonas putida KT2440
acggucgauga

SEQ ID NO: 3528828 - RNA, 15 nt, Pseudomonas putida KT2440
acggucugccggcac

SEQ ID NO: 3528829 - RNA, 14 nt, Pseudomonas putida KT2440
acggugaagagugg

SEQ ID NO: 3528830 - RNA, 23 nt, Pseudomonas putida KT2440
acggugaauuccuugcagcucuu

SEQ ID NO: 3528831 - RNA, 20 nt, Pseudomonas putida KT2440
acggugacaaaggccggcac

SEQ ID NO: 3528832 - RNA, 20 nt, Pseudomonas putida KT2440
acggugccaauaaccggcac

SEQ ID NO: 3528833 - RNA, 14 nt, Pseudomonas putida KT2440
acggugccgaacag

SEQ ID NO: 3528834 - RNA, 12 nt, Pseudomonas putida KT2440
acggugcgccug

SEQ ID NO: 3528835 - RNA, 19 nt, Pseudomonas putida KT2440
acgguggcugccacgggca

SEQ ID NO: 3528836 - RNA, 21 nt, Pseudomonas putida KT2440
acgguggcugccacgggcaua

SEQ ID NO: 3528837 - RNA, 19 nt, Pseudomonas putida KT2440
acgguggcugccagcgcgc

SEQ ID NO: 3528838 - RNA, 16 nt, Pseudomonas putida KT2440
acggugucggacaggu

SEQ ID NO: 3528839 - RNA, 13 nt, Pseudomonas putida KT2440
acgguucgggaag

SEQ ID NO: 3528840 - RNA, 14 nt, Pseudomonas putida KT2440
acgguugacagcac

SEQ ID NO: 3528841 - RNA, 16 nt, Pseudomonas putida KT2440
acgguugcgcccggcg

SEQ ID NO: 3528842 - RNA, 23 nt, Pseudomonas putida KT2440
acgguuucacccuugggcucagc

SEQ ID NO: 3528843 - RNA, 14 nt, Pseudomonas putida KT2440
acguacagcagcuc

SEQ ID NO: 3528844 - RNA, 15 nt, Pseudomonas putida KT2440
acguacagcagcuca

SEQ ID NO: 3528845 - RNA, 19 nt, Pseudomonas putida KT2440
acguaccuggcugcaguga

SEQ ID NO: 3528846 - RNA, 17 nt, Pseudomonas putida KT2440
acguacuccaccaaggc

SEQ ID NO: 3528847 - RNA, 21 nt, Pseudomonas putida KT2440
acguagcgcccgucuggcugc

SEQ ID NO: 3528848 - RNA, 18 nt, Pseudomonas putida KT2440
acguaguaauccggcaac

SEQ ID NO: 3528849 - RNA, 22 nt, Pseudomonas putida KT2440
acguaguccuugugcaguucgc

SEQ ID NO: 3528850 - RNA, 22 nt, Pseudomonas putida KT2440
acguauccgccgcaaugucagc

SEQ ID NO: 3528851 - RNA, 16 nt, Pseudomonas putida KT2440
acgucaaccgugcccg

SEQ ID NO: 3528852 - RNA, 19 nt, Pseudomonas putida KT2440
acgucaaccgugcccgccc

SEQ ID NO: 3528853 - RNA, 15 nt, Pseudomonas putida KT2440
acgucacagccaagc

SEQ ID NO: 3528854 - RNA, 22 nt, Pseudomonas putida KT2440
acgucacccacuucaauggcac

SEQ ID NO: 3528855 - RNA, 15 nt, Pseudomonas putida KT2440
acgucagacuuuccu

SEQ ID NO: 3528856 - RNA, 22 nt, Pseudomonas putida KT2440
acgucagcuacgcgagucaaca

SEQ ID NO: 3528857 - RNA, 21 nt, Pseudomonas putida KT2440
acgucauaguuguggcaacga

SEQ ID NO: 3528858 - RNA, 19 nt, Pseudomonas putida KT2440
acgucauucaaggucagcu

SEQ ID NO: 3528859 - RNA, 23 nt, Pseudomonas putida KT2440
acguccaaucgggugaggaugag

SEQ ID NO: 3528860 - RNA, 14 nt, Pseudomonas putida KT2440
acguccaaugccgc

SEQ ID NO: 3528861 - RNA, 12 nt, Pseudomonas putida KT2440
acguccagccac

SEQ ID NO: 3528862 - RNA, 15 nt, Pseudomonas putida KT2440
acguccagccacuug

SEQ ID NO: 3528863 - RNA, 19 nt, Pseudomonas putida KT2440
acguccgcucuucucgucg

SEQ ID NO: 3528864 - RNA, 15 nt, Pseudomonas putida KT2440
acguccggccagcaa

SEQ ID NO: 3528865 - RNA, 13 nt, Pseudomonas putida KT2440
acgucgcgauuga

SEQ ID NO: 3528866 - RNA, 19 nt, Pseudomonas putida KT2440
acgucgcgauugaucagcg

SEQ ID NO: 3528867 - RNA, 20 nt, Pseudomonas putida KT2440
acgucgcgauugaucagcgc

SEQ ID NO: 3528868 - RNA, 23 nt, Pseudomonas putida KT2440
acgucgcgauugaucagcgccuc

SEQ ID NO: 3528869 - RNA, 16 nt, Pseudomonas putida KT2440
acgucgcgcagggccu

SEQ ID NO: 3528870 - RNA, 14 nt, Pseudomonas putida KT2440
acgucgcgcuggcc

SEQ ID NO: 3528871 - RNA, 21 nt, Pseudomonas putida KT2440
acgucggcguccuucagguag

SEQ ID NO: 3528872 - RNA, 23 nt, Pseudomonas putida KT2440
acgucggggaauggcccagccag

SEQ ID NO: 3528873 - RNA, 17 nt, Pseudomonas putida KT2440
acgucguacucggccgg

SEQ ID NO: 3528874 - RNA, 17 nt, Pseudomonas putida KT2440
acgucguugcaguucac

SEQ ID NO: 3528875 - RNA, 19 nt, Pseudomonas putida KT2440
acgucucgaacggcgccag

SEQ ID NO: 3528876 - RNA, 14 nt, Pseudomonas putida KT2440
acgugauugacccg

SEQ ID NO: 3528877 - RNA, 16 nt, Pseudomonas putida KT2440
acgugcaaggaucacc

SEQ ID NO: 3528878 - RNA, 17 nt, Pseudomonas putida KT2440
acgugcaaggaucacca

SEQ ID NO: 3528879 - RNA, 15 nt, Pseudomonas putida KT2440
acgugcaccggccuu

SEQ ID NO: 3528880 - RNA, 15 nt, Pseudomonas putida KT2440
acgugcacggccuug

SEQ ID NO: 3528881 - RNA, 17 nt, Pseudomonas putida KT2440
acgugcccagaucacuu

SEQ ID NO: 3528882 - RNA, 18 nt, Pseudomonas putida KT2440
acgugcccguuuuccaac

SEQ ID NO: 3528883 - RNA, 16 nt, Pseudomonas putida KT2440
acgugccuucaccagc

SEQ ID NO: 3528884 - RNA, 15 nt, Pseudomonas putida KT2440
acguggacagcagcu

SEQ ID NO: 3528885 - RNA, 17 nt, Pseudomonas putida KT2440
acguggacagcagcuug

SEQ ID NO: 3528886 - RNA, 20 nt, Pseudomonas putida KT2440
acgugggucgggaacagcuc

SEQ ID NO: 3528887 - RNA, 16 nt, Pseudomonas putida KT2440
acgugguacgcguggu

SEQ ID NO: 3528888 - RNA, 13 nt, Pseudomonas putida KT2440
acguggucagcca

SEQ ID NO: 3528889 - RNA, 23 nt, Pseudomonas putida KT2440
acguggucaugccaacggugacu

SEQ ID NO: 3528890 - RNA, 21 nt, Pseudomonas putida KT2440
acguggugcgggccaccaggc

SEQ ID NO: 3528891 - RNA, 11 nt, Pseudomonas putida KT2440
acgugucagug

SEQ ID NO: 3528892 - RNA, 12 nt, Pseudomonas putida KT2440
acguuaccaggc

SEQ ID NO: 3528893 - RNA, 17 nt, Pseudomonas putida KT2440
acguuauccagcugcaa

SEQ ID NO: 3528894 - RNA, 24 nt, Pseudomonas putida KT2440
acugaauuggccggcgcugagcga

SEQ ID NO: 3528895 - RNA, 20 nt, Pseudomonas putida KT2440
acugacaaagccugcaccca

SEQ ID NO: 3528896 - RNA, 12 nt, Pseudomonas putida KT2440
acugaggcaccg

SEQ ID NO: 3528897 - RNA, 14 nt, Pseudomonas putida KT2440
acugaugcccaugc

SEQ ID NO: 3528898 - RNA, 19 nt, Pseudomonas putida KT2440
acugcaacaccggucaggu

SEQ ID NO: 3528899 - RNA, 18 nt, Pseudomonas putida KT2440
acugcaagcaaacgccag

SEQ ID NO: 3528900 - RNA, 22 nt, Pseudomonas putida KT2440
acugcaccaugaauucccuacu

SEQ ID NO: 3528901 - RNA, 19 nt, Pseudomonas putida KT2440
acugcacccgccagccguu

SEQ ID NO: 3528902 - RNA, 17 nt, Pseudomonas putida KT2440
acugcacccgugcaggg

SEQ ID NO: 3528903 - RNA, 17 nt, Pseudomonas putida KT2440
acugcaccucccgccac

SEQ ID NO: 3528904 - RNA, 20 nt, Pseudomonas putida KT2440
acugcacgcuucgauccgcg

SEQ ID NO: 3528905 - RNA, 23 nt, Pseudomonas putida KT2440
acugcacgcuuucgccgaucagc

SEQ ID NO: 3528906 - RNA, 13 nt, Pseudomonas putida KT2440
acugcacugccag

SEQ ID NO: 3528907 - RNA, 16 nt, Pseudomonas putida KT2440
acugcacugccagcgc

SEQ ID NO: 3528908 - RNA, 18 nt, Pseudomonas putida KT2440
acugcacugccagcgccu

SEQ ID NO: 3528909 - RNA, 18 nt, Pseudomonas putida KT2440
acugcagaacauggccga

SEQ ID NO: 3528910 - RNA, 14 nt, Pseudomonas putida KT2440
acugcagagccugc

SEQ ID NO: 3528911 - RNA, 15 nt, Pseudomonas putida KT2440
acugcagagccugca

SEQ ID NO: 3528912 - RNA, 21 nt, Pseudomonas putida KT2440
acugcauuggccacgcccaac

SEQ ID NO: 3528913 - RNA, 21 nt, Pseudomonas putida KT2440
acugccaaguaccaauaccag

SEQ ID NO: 3528914 - RNA, 14 nt, Pseudomonas putida KT2440
acugccaaugcuca

SEQ ID NO: 3528915 - RNA, 13 nt, Pseudomonas putida KT2440
acugccagcaccu

SEQ ID NO: 3528916 - RNA, 20 nt, Pseudomonas putida KT2440
acugcccaagccauccacca

SEQ ID NO: 3528917 - RNA, 19 nt, Pseudomonas putida KT2440
acugcccacccaaccgcgc

SEQ ID NO: 3528918 - RNA, 20 nt, Pseudomonas putida KT2440
acugcccagcagccccacgc

SEQ ID NO: 3528919 - RNA, 18 nt, Pseudomonas putida KT2440
acugcccaggaucacugg

SEQ ID NO: 3528920 - RNA, 22 nt, Pseudomonas putida KT2440
acugccccuguuccauugaagg

SEQ ID NO: 3528921 - RNA, 21 nt, Pseudomonas putida KT2440
acugccgucguuguucuucag

SEQ ID NO: 3528922 - RNA, 14 nt, Pseudomonas putida KT2440
acugccugaucacc

SEQ ID NO: 3528923 - RNA, 19 nt, Pseudomonas putida KT2440
acugccugcaugcgugccu

SEQ ID NO: 3528924 - RNA, 13 nt, Pseudomonas putida KT2440
acugccuugcccu

SEQ ID NO: 3528925 - RNA, 18 nt, Pseudomonas putida KT2440
acugccuugcccugcagc

SEQ ID NO: 3528926 - RNA, 17 nt, Pseudomonas putida KT2440
acugcgaagcccaguuc

SEQ ID NO: 3528927 - RNA, 17 nt, Pseudomonas putida KT2440
acugcgcagcccuccca

SEQ ID NO: 3528928 - RNA, 17 nt, Pseudomonas putida KT2440
acugcgcagucauuuuc

SEQ ID NO: 3528929 - RNA, 18 nt, Pseudomonas putida KT2440
acugcgcccaaucgggua

SEQ ID NO: 3528930 - RNA, 18 nt, Pseudomonas putida KT2440
acugcgcccgccccucgu

SEQ ID NO: 3528931 - RNA, 13 nt, Pseudomonas putida KT2440
acugcgccggcca

SEQ ID NO: 3528932 - RNA, 18 nt, Pseudomonas putida KT2440
acugcgcgauagccugug

SEQ ID NO: 3528933 - RNA, 12 nt, Pseudomonas putida KT2440
acugcgcgaucg

SEQ ID NO: 3528934 - RNA, 17 nt, Pseudomonas putida KT2440
acugcggacagcaaggc

SEQ ID NO: 3528935 - RNA, 21 nt, Pseudomonas putida KT2440
acugcguauuuuugcgccagg

SEQ ID NO: 3528936 - RNA, 22 nt, Pseudomonas putida KT2440
acugcgucuuguaguucaucuu

SEQ ID NO: 3528937 - RNA, 23 nt, Pseudomonas putida KT2440
acugcguucaucgaacugcaagc

SEQ ID NO: 3528938 - RNA, 13 nt, Pseudomonas putida KT2440
acugcuccaggca

SEQ ID NO: 3528939 - RNA, 21 nt, Pseudomonas putida KT2440
acugcuccaggcagccugcca

SEQ ID NO: 3528940 - RNA, 18 nt, Pseudomonas putida KT2440
acugcucgcugccacgca

SEQ ID NO: 3528941 - RNA, 19 nt, Pseudomonas putida KT2440
acugcucgucaaaccggca

SEQ ID NO: 3528942 - RNA, 20 nt, Pseudomonas putida KT2440
acugcucgucaaaccggcac

SEQ ID NO: 3528943 - RNA, 17 nt, Pseudomonas putida KT2440
acugcugaugcgggacc

SEQ ID NO: 3528944 - RNA, 12 nt, Pseudomonas putida KT2440
acugcuggcgcg

SEQ ID NO: 3528945 - RNA, 21 nt, Pseudomonas putida KT2440
acugcuggcgcgaccaucacc

SEQ ID NO: 3528946 - RNA, 16 nt, Pseudomonas putida KT2440
acugcugggucagcac

SEQ ID NO: 3528947 - RNA, 20 nt, Pseudomonas putida KT2440
acugcuguaaucggcgcuga

SEQ ID NO: 3528948 - RNA, 15 nt, Pseudomonas putida KT2440
acugcuucaggccuu

SEQ ID NO: 3528949 - RNA, 19 nt, Pseudomonas putida KT2440
acugcuucaucugcgccug

SEQ ID NO: 3528950 - RNA, 13 nt, Pseudomonas putida KT2440
acugcuucaugaa

SEQ ID NO: 3528951 - RNA, 14 nt, Pseudomonas putida KT2440
acugcuucaugaag

SEQ ID NO: 3528952 - RNA, 16 nt, Pseudomonas putida KT2440
acugcuucugccguuc

SEQ ID NO: 3528953 - RNA, 21 nt, Pseudomonas putida KT2440
acugcuugaacgagccagcca

SEQ ID NO: 3528954 - RNA, 23 nt, Pseudomonas putida KT2440
acugcuuuaucuccaagccgcuu

SEQ ID NO: 3528955 - RNA, 14 nt, Pseudomonas putida KT2440
acuggaucuucucu

SEQ ID NO: 3528956 - RNA, 22 nt, Pseudomonas putida KT2440
acuggcaggcucagggcagcaa

SEQ ID NO: 3528957 - RNA, 14 nt, Pseudomonas putida KT2440
acuggcauccggca

SEQ ID NO: 3528958 - RNA, 15 nt, Pseudomonas putida KT2440
acuggcaucggucac

SEQ ID NO: 3528959 - RNA, 16 nt, Pseudomonas putida KT2440
acuggccagcagggcc

SEQ ID NO: 3528960 - RNA, 11 nt, Pseudomonas putida KT2440
acuggccaggg

SEQ ID NO: 3528961 - RNA, 16 nt, Pseudomonas putida KT2440
acuggcccgcgccagg

SEQ ID NO: 3528962 - RNA, 18 nt, Pseudomonas putida KT2440
acuggcccgcgccaggcu

SEQ ID NO: 3528963 - RNA, 13 nt, Pseudomonas putida KT2440
acuggcccuggcc

SEQ ID NO: 3528964 - RNA, 14 nt, Pseudomonas putida KT2440
acuggccgacauca

SEQ ID NO: 3528965 - RNA, 16 nt, Pseudomonas putida KT2440
acuggccggagcugga

SEQ ID NO: 3528966 - RNA, 18 nt, Pseudomonas putida KT2440
acuggccggagcuggagc

SEQ ID NO: 3528967 - RNA, 19 nt, Pseudomonas putida KT2440
acuggccucuucgcgggua

SEQ ID NO: 3528968 - RNA, 17 nt, Pseudomonas putida KT2440
acuggcgcaccagcggc

SEQ ID NO: 3528969 - RNA, 23 nt, Pseudomonas putida KT2440
acuggcgcaccagcggcuuggca

SEQ ID NO: 3528970 - RNA, 15 nt, Pseudomonas putida KT2440
acuggcgcagcaggu

SEQ ID NO: 3528971 - RNA, 15 nt, Pseudomonas putida KT2440
acuggcgcccggcau

SEQ ID NO: 3528972 - RNA, 20 nt, Pseudomonas putida KT2440
acuggcuauccuucugccgu

SEQ ID NO: 3528973 - RNA, 23 nt, Pseudomonas putida KT2440
acuggcuauccuucugccguuug

SEQ ID NO: 3528974 - RNA, 17 nt, Pseudomonas putida KT2440
acuggcugaccaguguc

SEQ ID NO: 3528975 - RNA, 17 nt, Pseudomonas putida KT2440
acuggcugauagccgcc

SEQ ID NO: 3528976 - RNA, 21 nt, Pseudomonas putida KT2440
acuggcugauagccgccagca

SEQ ID NO: 3528977 - RNA, 11 nt, Pseudomonas putida KT2440
acuggcugccg

SEQ ID NO: 3528978 - RNA, 14 nt, Pseudomonas putida KT2440
acuggcugcugcgg

SEQ ID NO: 3528979 - RNA, 17 nt, Pseudomonas putida KT2440
acugggcgauggcgucg

SEQ ID NO: 3528980 - RNA, 14 nt, Pseudomonas putida KT2440
acugggugcacagg

SEQ ID NO: 3528981 - RNA, 16 nt, Pseudomonas putida KT2440
acugggugcacagguu

SEQ ID NO: 3528982 - RNA, 22 nt, Pseudomonas putida KT2440
acugguaacucaccacaucggc

SEQ ID NO: 3528983 - RNA, 23 nt, Pseudomonas putida KT2440
acugguaaugcucuccagcgaug

SEQ ID NO: 3528984 - RNA, 20 nt, Pseudomonas putida KT2440
acuggucaaacaaugcacag

SEQ ID NO: 3528985 - RNA, 15 nt, Pseudomonas putida KT2440
acuggucgccucgac

SEQ ID NO: 3528986 - RNA, 18 nt, Pseudomonas putida KT2440
acuggugaaucagcccca

SEQ ID NO: 3528987 - RNA, 22 nt, Pseudomonas putida KT2440
acuggugcucugcaggcacacc

SEQ ID NO: 3528988 - RNA, 17 nt, Pseudomonas putida KT2440
acugguggacacugccg

SEQ ID NO: 3528989 - RNA, 13 nt, Pseudomonas putida KT2440
acugguucuccag

SEQ ID NO: 3528990 - RNA, 15 nt, Pseudomonas putida KT2440
acugguucuccaggu

SEQ ID NO: 3528991 - RNA, 21 nt, Pseudomonas putida KT2440
acugucgauggcggugcgcac

SEQ ID NO: 3528992 - RNA, 19 nt, Pseudomonas putida KT2440
acugucggguuggucgcca

SEQ ID NO: 3528993 - RNA, 20 nt, Pseudomonas putida KT2440
acugucguuuggcgcgauca

SEQ ID NO: 3528994 - RNA, 17 nt, Pseudomonas putida KT2440
acugugcccgccaggcg

SEQ ID NO: 3528995 - RNA, 14 nt, Pseudomonas putida KT2440
acugugccuggggc

SEQ ID NO: 3528996 - RNA, 15 nt, Pseudomonas putida KT2440
acugugggaucacuu

SEQ ID NO: 3528997 - RNA, 19 nt, Pseudomonas putida KT2440
acuguggucauccaggcug

SEQ ID NO: 3528998 - RNA, 23 nt, Pseudomonas putida KT2440
acuguuagggaagcucugaucaa

SEQ ID NO: 3528999 - RNA, 15 nt, Pseudomonas putida KT2440
agaagccuuuggccg

SEQ ID NO: 3529000 - RNA, 21 nt, Pseudomonas putida KT2440
agaagcggcuaccgcugcgca

SEQ ID NO: 3529001 - RNA, 14 nt, Pseudomonas putida KT2440
agaagcggggaggc

SEQ ID NO: 3529002 - RNA, 17 nt, Pseudomonas putida KT2440
agaaggcauccagggcg

SEQ ID NO: 3529003 - RNA, 19 nt, Pseudomonas putida KT2440
agaaggcguggugcagacg

SEQ ID NO: 3529004 - RNA, 23 nt, Pseudomonas putida KT2440
agaaggcugcccucgggcagccu

SEQ ID NO: 3529005 - RNA, 14 nt, Pseudomonas putida KT2440
agaagggcugguag

SEQ ID NO: 3529006 - RNA, 15 nt, Pseudomonas putida KT2440
agaagguaucggcca

SEQ ID NO: 3529007 - RNA, 19 nt, Pseudomonas putida KT2440
agaaguccucccaguacau

SEQ ID NO: 3529008 - RNA, 23 nt, Pseudomonas putida KT2440
agaauacccauuuacugcagaac

SEQ ID NO: 3529009 - RNA, 20 nt, Pseudomonas putida KT2440
agaauagccggccucagcag

SEQ ID NO: 3529010 - RNA, 21 nt, Pseudomonas putida KT2440
agaauccguuccuucgaccag

SEQ ID NO: 3529011 - RNA, 13 nt, Pseudomonas putida KT2440
agaaucucaacca

SEQ ID NO: 3529012 - RNA, 19 nt, Pseudomonas putida KT2440
agaaucucaaccaccucua

SEQ ID NO: 3529013 - RNA, 12 nt, Pseudomonas putida KT2440
agaaucugcaca

SEQ ID NO: 3529014 - RNA, 20 nt, Pseudomonas putida KT2440
agaaugugcucggccugggc

SEQ ID NO: 3529015 - RNA, 16 nt, Pseudomonas putida KT2440
agacaacuggccaggg

SEQ ID NO: 3529016 - RNA, 18 nt, Pseudomonas putida KT2440
agacaacuuuacggcuga

SEQ ID NO: 3529017 - RNA, 22 nt, Pseudomonas putida KT2440
agacaaguccuucaucugucag

SEQ ID NO: 3529018 - RNA, 15 nt, Pseudomonas putida KT2440
agacaccacaaaacc

SEQ ID NO: 3529019 - RNA, 15 nt, Pseudomonas putida KT2440
agacacggacucaua

SEQ ID NO: 3529020 - RNA, 16 nt, Pseudomonas putida KT2440
agacacggacucauag

SEQ ID NO: 3529021 - RNA, 14 nt, Pseudomonas putida KT2440
agacagggccuuga

SEQ ID NO: 3529022 - RNA, 16 nt, Pseudomonas putida KT2440
agacauugaagaagcc

SEQ ID NO: 3529023 - RNA, 15 nt, Pseudomonas putida KT2440
agaccacgcgcucgu

SEQ ID NO: 3529024 - RNA, 15 nt, Pseudomonas putida KT2440
agaccagacagcgcu

SEQ ID NO: 3529025 - RNA, 12 nt, Pseudomonas putida KT2440
agaccagcagca

SEQ ID NO: 3529026 - RNA, 13 nt, Pseudomonas putida KT2440
agaccagcagcag

SEQ ID NO: 3529027 - RNA, 12 nt, Pseudomonas putida KT2440
agacccgcaagc

SEQ ID NO: 3529028 - RNA, 19 nt, Pseudomonas putida KT2440
agacccugacucaugccuu

SEQ ID NO: 3529029 - RNA, 20 nt, Pseudomonas putida KT2440
agacccugacucaugccuuc

SEQ ID NO: 3529030 - RNA, 16 nt, Pseudomonas putida KT2440
agaccgccgcccaggu

SEQ ID NO: 3529031 - RNA, 18 nt, Pseudomonas putida KT2440
agaccgccgcccagguca

SEQ ID NO: 3529032 - RNA, 16 nt, Pseudomonas putida KT2440
agaccggguccagcaa

SEQ ID NO: 3529033 - RNA, 15 nt, Pseudomonas putida KT2440
agaccuccgucugcu

SEQ ID NO: 3529034 - RNA, 21 nt, Pseudomonas putida KT2440
agaccuccgucugcucugcca

SEQ ID NO: 3529035 - RNA, 18 nt, Pseudomonas putida KT2440
agaccugcaaugccgcug

SEQ ID NO: 3529036 - RNA, 13 nt, Pseudomonas putida KT2440
agaccugcguugc

SEQ ID NO: 3529037 - RNA, 16 nt, Pseudomonas putida KT2440
agaccuggaggucaug

SEQ ID NO: 3529038 - RNA, 16 nt, Pseudomonas putida KT2440
agaccugugggagcgg

SEQ ID NO: 3529039 - RNA, 17 nt, Pseudomonas putida KT2440
agaccuugccagcgcug

SEQ ID NO: 3529040 - RNA, 18 nt, Pseudomonas putida KT2440
agaccuugcgcacggccu

SEQ ID NO: 3529041 - RNA, 19 nt, Pseudomonas putida KT2440
agaccuugcgcacggccuc

SEQ ID NO: 3529042 - RNA, 13 nt, Pseudomonas putida KT2440
ccauuccgccguc

SEQ ID NO: 3529043 - RNA, 16 nt, Pseudomonas putida KT2440
ccauuccggcugcagc

SEQ ID NO: 3529044 - RNA, 15 nt, Pseudomonas putida KT2440
ccauucgcgggcaag

SEQ ID NO: 3529045 - RNA, 22 nt, Pseudomonas putida KT2440
ccauucgcgggcaagcccgcuc

SEQ ID NO: 3529046 - RNA, 22 nt, Pseudomonas putida KT2440
ccauucgcgggcaugcccgcuc

SEQ ID NO: 3529047 - RNA, 16 nt, Pseudomonas putida KT2440
ccauucgcggguaaac

SEQ ID NO: 3529048 - RNA, 17 nt, Pseudomonas putida KT2440
ccauucgcggguaaacc

SEQ ID NO: 3529049 - RNA, 22 nt, Pseudomonas putida KT2440
ccauucgcggguaaacccgcuc

SEQ ID NO: 3529050 - RNA, 15 nt, Pseudomonas putida KT2440
ccauucguccgacca

SEQ ID NO: 3529051 - RNA, 16 nt, Pseudomonas putida KT2440
ccauugagcacucaac

SEQ ID NO: 3529052 - RNA, 22 nt, Pseudomonas putida KT2440
ccauugagcuguuucaugcugc

SEQ ID NO: 3529053 - RNA, 12 nt, Pseudomonas putida KT2440
ccauugcaggcu

SEQ ID NO: 3529054 - RNA, 14 nt, Pseudomonas putida KT2440
ccauugcccagccu

SEQ ID NO: 3529055 - RNA, 12 nt, Pseudomonas putida KT2440
ccauugcuccau

SEQ ID NO: 3529056 - RNA, 22 nt, Pseudomonas putida KT2440
ccauuggccgcgcgcccaucug

SEQ ID NO: 3529057 - RNA, 16 nt, Pseudomonas putida KT2440
ccauuggggcugcauu

SEQ ID NO: 3529058 - RNA, 19 nt, Pseudomonas putida KT2440
ccauuggggcugcauugca

SEQ ID NO: 3529059 - RNA, 14 nt, Pseudomonas putida KT2440
ccauuuacugcaga

SEQ ID NO: 3529060 - RNA, 14 nt, Pseudomonas putida KT2440
ccauuugcgcuggc

SEQ ID NO: 3529061 - RNA, 18 nt, Pseudomonas putida KT2440
cccaaacagcaucaaugc

SEQ ID NO: 3529062 - RNA, 14 nt, Pseudomonas putida KT2440
cccaaaccgcucga

SEQ ID NO: 3529063 - RNA, 22 nt, Pseudomonas putida KT2440
cccaaacucuugagcuggccgu

SEQ ID NO: 3529064 - RNA, 19 nt, Pseudomonas putida KT2440
cccaacagcauccaaagcc

SEQ ID NO: 3529065 - RNA, 12 nt, Pseudomonas putida KT2440
cccaacagcgcg

SEQ ID NO: 3529066 - RNA, 13 nt, Pseudomonas putida KT2440
cccaaccaccgac

SEQ ID NO: 3529067 - RNA, 13 nt, Pseudomonas putida KT2440
cccaacccagcca

SEQ ID NO: 3529068 - RNA, 12 nt, Pseudomonas putida KT2440
cccaaccccagc

SEQ ID NO: 3529069 - RNA, 19 nt, Pseudomonas putida KT2440
cccaacccggucccgcccu

SEQ ID NO: 3529070 - RNA, 21 nt, Pseudomonas putida KT2440
cccaacccucacucgcggcca

SEQ ID NO: 3529071 - RNA, 16 nt, Pseudomonas putida KT2440
cccaaccucaacgccu

SEQ ID NO: 3529072 - RNA, 20 nt, Pseudomonas putida KT2440
cccaacgaaaaaggcccugc

SEQ ID NO: 3529073 - RNA, 18 nt, Pseudomonas putida KT2440
cccaacgcaaauccuccu

SEQ ID NO: 3529074 - RNA, 15 nt, Pseudomonas putida KT2440
cccaacgccugaagc

SEQ ID NO: 3529075 - RNA, 13 nt, Pseudomonas putida KT2440
cccaacuccagcg

SEQ ID NO: 3529076 - RNA, 14 nt, Pseudomonas putida KT2440
cccaacuccagcgc

SEQ ID NO: 3529077 - RNA, 13 nt, Pseudomonas putida KT2440
cccaaggcaucca

SEQ ID NO: 3529078 - RNA, 14 nt, Pseudomonas putida KT2440
cccaaggcauccag

SEQ ID NO: 3529079 - RNA, 22 nt, Pseudomonas putida KT2440
cccaaggcauccagcucggcaa

SEQ ID NO: 3529080 - RNA, 14 nt, Pseudomonas putida KT2440
cccaaggcuggcca

SEQ ID NO: 3529081 - RNA, 15 nt, Pseudomonas putida KT2440
cccaaggucagccag

SEQ ID NO: 3529082 - RNA, 18 nt, Pseudomonas putida KT2440
cccaaguaguguucgccg

SEQ ID NO: 3529083 - RNA, 19 nt, Pseudomonas putida KT2440
cccaauaaaaacaacaggu

SEQ ID NO: 3529084 - RNA, 15 nt, Pseudomonas putida KT2440
cccaauaauaaaaaa

SEQ ID NO: 3529085 - RNA, 15 nt, Pseudomonas putida KT2440
cccaauacccaacag

SEQ ID NO: 3529086 - RNA, 22 nt, Pseudomonas putida KT2440
cccaauacgcaccgcuaccaug

SEQ ID NO: 3529087 - RNA, 17 nt, Pseudomonas putida KT2440
cccaauagcccaccguc

SEQ ID NO: 3529088 - RNA, 14 nt, Pseudomonas putida KT2440
cccaaucaccaaug

SEQ ID NO: 3529089 - RNA, 19 nt, Pseudomonas putida KT2440
cccaauccucagcgcgugc

SEQ ID NO: 3529090 - RNA, 16 nt, Pseudomonas putida KT2440
cccaaucgccacacaa

SEQ ID NO: 3529091 - RNA, 16 nt, Pseudomonas putida KT2440
cccaaucgccgcaacc

SEQ ID NO: 3529092 - RNA, 18 nt, Pseudomonas putida KT2440
cccaaucgccgcaaccgc

SEQ ID NO: 3529093 - RNA, 13 nt, Pseudomonas putida KT2440
cccaaucgcugug

SEQ ID NO: 3529094 - RNA, 22 nt, Pseudomonas putida KT2440
cccaaugcaugcaucagggucu

SEQ ID NO: 3529095 - RNA, 22 nt, Pseudomonas putida KT2440
cccaaugguuuaguccugcagc

SEQ ID NO: 3529096 - RNA, 16 nt, Pseudomonas putida KT2440
cccaaugucacuucuu

SEQ ID NO: 3529097 - RNA, 14 nt, Pseudomonas putida KT2440
cccacacggcaagc

SEQ ID NO: 3529098 - RNA, 18 nt, Pseudomonas putida KT2440
cccacacggcaagccacg

SEQ ID NO: 3529099 - RNA, 19 nt, Pseudomonas putida KT2440
cccacacggcaagccacgc

SEQ ID NO: 3529100 - RNA, 15 nt, Pseudomonas putida KT2440
cccacagaaggcugc

SEQ ID NO: 3529101 - RNA, 18 nt, Pseudomonas putida KT2440
cccacagauauugcaccg

SEQ ID NO: 3529102 - RNA, 17 nt, Pseudomonas putida KT2440
cccacagcggccccauc

SEQ ID NO: 3529103 - RNA, 14 nt, Pseudomonas putida KT2440
cccacaggcacagg

SEQ ID NO: 3529104 - RNA, 23 nt, Pseudomonas putida KT2440
cccacaggcacaggcccagcaac

SEQ ID NO: 3529105 - RNA, 18 nt, Pseudomonas putida KT2440
cccacagggaccucacag

SEQ ID NO: 3529106 - RNA, 13 nt, Pseudomonas putida KT2440
cccacagggagga

SEQ ID NO: 3529107 - RNA, 20 nt, Pseudomonas putida KT2440
cccacagggcaaacaccuug

SEQ ID NO: 3529108 - RNA, 19 nt, Pseudomonas putida KT2440
cccacagggcgcguguagc

SEQ ID NO: 3529109 - RNA, 19 nt, Pseudomonas putida KT2440
cccacaggggccgcgcagc

SEQ ID NO: 3529110 - RNA, 21 nt, Pseudomonas putida KT2440
cccacaggggccgcgcagccu

SEQ ID NO: 3529111 - RNA, 20 nt, Pseudomonas putida KT2440
cccacagguacucgcaagcu

SEQ ID NO: 3529112 - RNA, 21 nt, Pseudomonas putida KT2440
cccacagguaugugagcugcg

SEQ ID NO: 3529113 - RNA, 15 nt, Pseudomonas putida KT2440
cccacagguccagcg

SEQ ID NO: 3529114 - RNA, 14 nt, Pseudomonas putida KT2440
cccacagguuuagc

SEQ ID NO: 3529115 - RNA, 18 nt, Pseudomonas putida KT2440
cccacagguuuagcgcug

SEQ ID NO: 3529116 - RNA, 20 nt, Pseudomonas putida KT2440
cccacagugcuuccagcagg

SEQ ID NO: 3529117 - RNA, 18 nt, Pseudomonas putida KT2440
cccacagugucccggcca

SEQ ID NO: 3529118 - RNA, 22 nt, Pseudomonas putida KT2440
cccacagugucccggccagggc

SEQ ID NO: 3529119 - RNA, 12 nt, Pseudomonas putida KT2440
cccacauagcgc

SEQ ID NO: 3529120 - RNA, 21 nt, Pseudomonas putida KT2440
cccacauagcgcacuugcacu

SEQ ID NO: 3529121 - RNA, 24 nt, Pseudomonas putida KT2440
cccaccaagggugucaacaggcug

SEQ ID NO: 3529122 - RNA, 14 nt, Pseudomonas putida KT2440
cccaccacauccga

SEQ ID NO: 3529123 - RNA, 11 nt, Pseudomonas putida KT2440
cccaccaccag

SEQ ID NO: 3529124 - RNA, 13 nt, Pseudomonas putida KT2440
cccaccaccuucu

SEQ ID NO: 3529125 - RNA, 20 nt, Pseudomonas putida KT2440
cccaccacggccuggccugc

SEQ ID NO: 3529126 - RNA, 13 nt, Pseudomonas putida KT2440
cccaccagcacug

SEQ ID NO: 3529127 - RNA, 14 nt, Pseudomonas putida KT2440
cccaccagcuccau

SEQ ID NO: 3529128 - RNA, 19 nt, Pseudomonas putida KT2440
cccaccagcugcaccaccu

SEQ ID NO: 3529129 - RNA, 12 nt, Pseudomonas putida KT2440
cccaccauggua

SEQ ID NO: 3529130 - RNA, 12 nt, Pseudomonas putida KT2440
cccacccaccac

SEQ ID NO: 3529131 - RNA, 20 nt, Pseudomonas putida KT2440
cccacccuugaagacaucga

SEQ ID NO: 3529132 - RNA, 14 nt, Pseudomonas putida KT2440
cccaccgacagccc

SEQ ID NO: 3529133 - RNA, 19 nt, Pseudomonas putida KT2440
cccaccgcauugcaggcca

SEQ ID NO: 3529134 - RNA, 14 nt, Pseudomonas putida KT2440
cccaccggcaccau

SEQ ID NO: 3529135 - RNA, 15 nt, Pseudomonas putida KT2440
cccaccggcaccauc

SEQ ID NO: 3529136 - RNA, 16 nt, Pseudomonas putida KT2440
cccaccggccgccgcc

SEQ ID NO: 3529137 - RNA, 19 nt, Pseudomonas putida KT2440
cccaccggccgccgccaga

SEQ ID NO: 3529138 - RNA, 20 nt, Pseudomonas putida KT2440
cccaccggccgccgccagac

SEQ ID NO: 3529139 - RNA, 18 nt, Pseudomonas putida KT2440
cccaccggcuccaccugc

SEQ ID NO: 3529140 - RNA, 16 nt, Pseudomonas putida KT2440
cccaccuucacgccau

SEQ ID NO: 3529141 - RNA, 13 nt, Pseudomonas putida KT2440
cccacgaacacaa

SEQ ID NO: 3529142 - RNA, 14 nt, Pseudomonas putida KT2440
cccacgcacaucgu

SEQ ID NO: 3529143 - RNA, 19 nt, Pseudomonas putida KT2440
cccacgcaguuggccauca

SEQ ID NO: 3529144 - RNA, 12 nt, Pseudomonas putida KT2440
cccacgccggca

SEQ ID NO: 3529145 - RNA, 19 nt, Pseudomonas putida KT2440
cccacgcggguccagcgcg

SEQ ID NO: 3529146 - RNA, 22 nt, Pseudomonas putida KT2440
cccacggcaauucgccggcagc

SEQ ID NO: 3529147 - RNA, 21 nt, Pseudomonas putida KT2440
cccacggcguccaggcccgcc

SEQ ID NO: 3529148 - RNA, 16 nt, Pseudomonas putida KT2440
cccacucacgcaacuc

SEQ ID NO: 3529149 - RNA, 19 nt, Pseudomonas putida KT2440
ccauccccgcacgcggugg

SEQ ID NO: 3529150 - RNA, 12 nt, Pseudomonas putida KT2440
ccauccgccagg

SEQ ID NO: 3529151 - RNA, 19 nt, Pseudomonas putida KT2440
ccauccgguaugcccaugc

SEQ ID NO: 3529152 - RNA, 19 nt, Pseudomonas putida KT2440
ccauccguuacaauaccga

SEQ ID NO: 3529153 - RNA, 15 nt, Pseudomonas putida KT2440
ccauccucggccagg

SEQ ID NO: 3529154 - RNA, 17 nt, Pseudomonas putida KT2440
ccauccugcuguagcgc

SEQ ID NO: 3529155 - RNA, 18 nt, Pseudomonas putida KT2440
ccauccuugaagaacacc

SEQ ID NO: 3529156 - RNA, 19 nt, Pseudomonas putida KT2440
ccauccuugaagaacaccu

SEQ ID NO: 3529157 - RNA, 21 nt, Pseudomonas putida KT2440
ccauccuugaagaacaccugc

SEQ ID NO: 3529158 - RNA, 17 nt, Pseudomonas putida KT2440
ccaucgacccgcugccc

SEQ ID NO: 3529159 - RNA, 19 nt, Pseudomonas putida KT2440
ccaucgacccgcugcccgu

SEQ ID NO: 3529160 - RNA, 16 nt, Pseudomonas putida KT2440
ccaucgaccuggcccg

SEQ ID NO: 3529161 - RNA, 18 nt, Pseudomonas putida KT2440
ccaucgaguaucgccucg

SEQ ID NO: 3529162 - RNA, 18 nt, Pseudomonas putida KT2440
ccaucgcaauccccuccg

SEQ ID NO: 3529163 - RNA, 20 nt, Pseudomonas putida KT2440
ccaucgcauaugccccaggc

SEQ ID NO: 3529164 - RNA, 21 nt, Pseudomonas putida KT2440
ccaucgcauaugccccaggca

SEQ ID NO: 3529165 - RNA, 22 nt, Pseudomonas putida KT2440
ccaucgcauaugccccaggcau

SEQ ID NO: 3529166 - RNA, 23 nt, Pseudomonas putida KT2440
ccaucgcucaccguucuucucca

SEQ ID NO: 3529167 - RNA, 22 nt, Pseudomonas putida KT2440
ccaucggcacccgcacaugccu

SEQ ID NO: 3529168 - RNA, 17 nt, Pseudomonas putida KT2440
ccaucggcgcgaagguc

SEQ ID NO: 3529169 - RNA, 12 nt, Pseudomonas putida KT2440
ccaucggcgucg

SEQ ID NO: 3529170 - RNA, 16 nt, Pseudomonas putida KT2440
ccaucggugccgugca

SEQ ID NO: 3529171 - RNA, 20 nt, Pseudomonas putida KT2440
ccaucggugccgugcagggg

SEQ ID NO: 3529172 - RNA, 15 nt, Pseudomonas putida KT2440
ccaucgucugcauca

SEQ ID NO: 3529173 - RNA, 18 nt, Pseudomonas putida KT2440
ccaucuccagcucaaccc

SEQ ID NO: 3529174 - RNA, 16 nt, Pseudomonas putida KT2440
ccaucucgccaagcau

SEQ ID NO: 3529175 - RNA, 20 nt, Pseudomonas putida KT2440
ccaucucgccaagcauucgc

SEQ ID NO: 3529176 - RNA, 18 nt, Pseudomonas putida KT2440
ccaucuucacggcaagcc

SEQ ID NO: 3529177 - RNA, 22 nt, Pseudomonas putida KT2440
ccaucuucgaauaccaguaaug

SEQ ID NO: 3529178 - RNA, 21 nt, Pseudomonas putida KT2440
ccaucuucgacaguucaagca

SEQ ID NO: 3529179 - RNA, 18 nt, Pseudomonas putida KT2440
ccaucuugcccagggcug

SEQ ID NO: 3529180 - RNA, 20 nt, Pseudomonas putida KT2440
ccaucuugcccagggcugcu

SEQ ID NO: 3529181 - RNA, 14 nt, Pseudomonas putida KT2440
ccaucuugcugcuc

SEQ ID NO: 3529182 - RNA, 23 nt, Pseudomonas putida KT2440
ccaucuugcugcucugcaaugcc

SEQ ID NO: 3529183 - RNA, 22 nt, Pseudomonas putida KT2440
ccaucuugguuggcggagccag

SEQ ID NO: 3529184 - RNA, 22 nt, Pseudomonas putida KT2440
ccaugaaaaagcccggccaggu

SEQ ID NO: 3529185 - RNA, 23 nt, Pseudomonas putida KT2440
ccaugaaaaagcccggccaggug

SEQ ID NO: 3529186 - RNA, 14 nt, Pseudomonas putida KT2440
ccaugaacaccacc

SEQ ID NO: 3529187 - RNA, 16 nt, Pseudomonas putida KT2440
ccaugaacagcacgcc

SEQ ID NO: 3529188 - RNA, 21 nt, Pseudomonas putida KT2440
ccaugaaguucauccagaucg

SEQ ID NO: 3529189 - RNA, 13 nt, Pseudomonas putida KT2440
ccaugaucagcgc

SEQ ID NO: 3529190 - RNA, 15 nt, Pseudomonas putida KT2440
ccaugaucagcgccu

SEQ ID NO: 3529191 - RNA, 16 nt, Pseudomonas putida KT2440
ccaugaucagcgccug

SEQ ID NO: 3529192 - RNA, 19 nt, Pseudomonas putida KT2440
ccaugaucagcgccugcug

SEQ ID NO: 3529193 - RNA, 15 nt, Pseudomonas putida KT2440
ccaugaucgccgccg

SEQ ID NO: 3529194 - RNA, 15 nt, Pseudomonas putida KT2440
ccaugaugaccacca

SEQ ID NO: 3529195 - RNA, 16 nt, Pseudomonas putida KT2440
ccaugaugaccaccag

SEQ ID NO: 3529196 - RNA, 14 nt, Pseudomonas putida KT2440
ccaugcagcccgca

SEQ ID NO: 3529197 - RNA, 16 nt, Pseudomonas putida KT2440
ccaugccaagcccaca

SEQ ID NO: 3529198 - RNA, 16 nt, Pseudomonas putida KT2440
ccaugccacccauauc

SEQ ID NO: 3529199 - RNA, 16 nt, Pseudomonas putida KT2440
ccaugccacccccggc

SEQ ID NO: 3529200 - RNA, 19 nt, Pseudomonas putida KT2440
ccaugccacccccggccga

SEQ ID NO: 3529201 - RNA, 18 nt, Pseudomonas putida KT2440
ccaugcccagcucgcugg

SEQ ID NO: 3529202 - RNA, 16 nt, Pseudomonas putida KT2440
ccaugccccccgccag

SEQ ID NO: 3529203 - RNA, 22 nt, Pseudomonas putida KT2440
ccaugccccgaguaacccuggc

SEQ ID NO: 3529204 - RNA, 18 nt, Pseudomonas putida KT2440
ccaugccccuaccgccaa

SEQ ID NO: 3529205 - RNA, 19 nt, Pseudomonas putida KT2440
ccaugccccucaaugcugc

SEQ ID NO: 3529206 - RNA, 20 nt, Pseudomonas putida KT2440
ccaugccccucaaugcugcc

SEQ ID NO: 3529207 - RNA, 21 nt, Pseudomonas putida KT2440
ccaugccccucaaugcugccu

SEQ ID NO: 3529208 - RNA, 18 nt, Pseudomonas putida KT2440
ccaugcccuugccuucgg

SEQ ID NO: 3529209 - RNA, 12 nt, Pseudomonas putida KT2440
ccaugcgaacug

SEQ ID NO: 3529210 - RNA, 15 nt, Pseudomonas putida KT2440
ccaugcgcaggcagc

SEQ ID NO: 3529211 - RNA, 13 nt, Pseudomonas putida KT2440
ccaugcgccgcug

SEQ ID NO: 3529212 - RNA, 17 nt, Pseudomonas putida KT2440
ccaugcgcgcagcgaac

SEQ ID NO: 3529213 - RNA, 13 nt, Pseudomonas putida KT2440
ccaugcgcgugcg

SEQ ID NO: 3529214 - RNA, 16 nt, Pseudomonas putida KT2440
ccaugcucggccagcu

SEQ ID NO: 3529215 - RNA, 22 nt, Pseudomonas putida KT2440
ccaugcugcagaaccgccagca

SEQ ID NO: 3529216 - RNA, 14 nt, Pseudomonas putida KT2440
ccaugcugcugccc

SEQ ID NO: 3529217 - RNA, 16 nt, Pseudomonas putida KT2440
ccaugcuggccaaggu

SEQ ID NO: 3529218 - RNA, 14 nt, Pseudomonas putida KT2440
ccaugcuuuccagg

SEQ ID NO: 3529219 - RNA, 15 nt, Pseudomonas putida KT2440
ccaugcuuuccaggu

SEQ ID NO: 3529220 - RNA, 19 nt, Pseudomonas putida KT2440
ccaugcuuuccaggucggg

SEQ ID NO: 3529221 - RNA, 17 nt, Pseudomonas putida KT2440
ccauggcaaucagcgac

SEQ ID NO: 3529222 - RNA, 11 nt, Pseudomonas putida KT2440
ccauggccagc

SEQ ID NO: 3529223 - RNA, 18 nt, Pseudomonas putida KT2440
ccauggccagcguggccg

SEQ ID NO: 3529224 - RNA, 12 nt, Pseudomonas putida KT2440
ccauggccaggu

SEQ ID NO: 3529225 - RNA, 13 nt, Pseudomonas putida KT2440
ccauggcccugau

SEQ ID NO: 3529226 - RNA, 21 nt, Pseudomonas putida KT2440
ccauggcccugaucugccccu

SEQ ID NO: 3529227 - RNA, 16 nt, Pseudomonas putida KT2440
ccauggcgacaauggc

SEQ ID NO: 3529228 - RNA, 16 nt, Pseudomonas putida KT2440
ccauggcgcagcucca

SEQ ID NO: 3529229 - RNA, 21 nt, Pseudomonas putida KT2440
ccauggcuaagccaagccggc

SEQ ID NO: 3529230 - RNA, 23 nt, Pseudomonas putida KT2440
ccaugggcaaugcgagacgccac

SEQ ID NO: 3529231 - RNA, 14 nt, Pseudomonas putida KT2440
ccaugggcaggccc

SEQ ID NO: 3529232 - RNA, 17 nt, Pseudomonas putida KT2440
ccaugggcaggcccagg

SEQ ID NO: 3529233 - RNA, 19 nt, Pseudomonas putida KT2440
ccaugggcaggcccaggua

SEQ ID NO: 3529234 - RNA, 21 nt, Pseudomonas putida KT2440
ccaugggcaggucgacccgcg

SEQ ID NO: 3529235 - RNA, 14 nt, Pseudomonas putida KT2440
ccaugggccugcac

SEQ ID NO: 3529236 - RNA, 22 nt, Pseudomonas putida KT2440
ccaugggcuuuucguuggccag

SEQ ID NO: 3529237 - RNA, 16 nt, Pseudomonas putida KT2440
ccaugguaucgagcac

SEQ ID NO: 3529238 - RNA, 16 nt, Pseudomonas putida KT2440
ccauguaacgcuccac

SEQ ID NO: 3529239 - RNA, 15 nt, Pseudomonas putida KT2440
ccauguacugcagac

SEQ ID NO: 3529240 - RNA, 16 nt, Pseudomonas putida KT2440
ccauguacugcagaca

SEQ ID NO: 3529241 - RNA, 12 nt, Pseudomonas putida KT2440
ccauguccaugg

SEQ ID NO: 3529242 - RNA, 20 nt, Pseudomonas putida KT2440
ccaugucggaagccugcauc

SEQ ID NO: 3529243 - RNA, 16 nt, Pseudomonas putida KT2440
ccaugucgugcugccg

SEQ ID NO: 3529244 - RNA, 14 nt, Pseudomonas putida KT2440
ccauguggcgcagc

SEQ ID NO: 3529245 - RNA, 15 nt, Pseudomonas putida KT2440
ccauguggcgcagca

SEQ ID NO: 3529246 - RNA, 15 nt, Pseudomonas putida KT2440
ccauguugcgcagca

SEQ ID NO: 3529247 - RNA, 16 nt, Pseudomonas putida KT2440
ccauguugucacccag

SEQ ID NO: 3529248 - RNA, 18 nt, Pseudomonas putida KT2440
ccauguugucacccagca

SEQ ID NO: 3529249 - RNA, 20 nt, Pseudomonas putida KT2440
ccauguugucacccagcacu

SEQ ID NO: 3529250 - RNA, 19 nt, Pseudomonas putida KT2440
ccauguugucgaagcgcac

SEQ ID NO: 3529251 - RNA, 20 nt, Pseudomonas putida KT2440
ccauguugucgaagcgcacc

SEQ ID NO: 3529252 - RNA, 16 nt, Pseudomonas putida KT2440
ccauguugugcuggcg

SEQ ID NO: 3529253 - RNA, 23 nt, Pseudomonas putida KT2440
ccauguugugcuggcggcugccc

SEQ ID NO: 3529254 - RNA, 20 nt, Pseudomonas putida KT2440
ccauucacgguucuggucac

SEQ ID NO: 3529255 - RNA, 22 nt, Pseudomonas putida KT2440
ccauucaucgauggucuucgcc

SEQ ID NO: 3529256 - RNA, 17 nt, Pseudomonas putida KT2440
agaugaccggccgggcu

SEQ ID NO: 3529257 - RNA, 23 nt, Pseudomonas putida KT2440
agaugaguuccguugcuacugcu

SEQ ID NO: 3529258 - RNA, 18 nt, Pseudomonas putida KT2440
agaugccgccgcugccag

SEQ ID NO: 3529259 - RNA, 15 nt, Pseudomonas putida KT2440
agaugcgcgcugcaa

SEQ ID NO: 3529260 - RNA, 20 nt, Pseudomonas putida KT2440
agauggcaccccagccgcuc

SEQ ID NO: 3529261 - RNA, 21 nt, Pseudomonas putida KT2440
agauggcccggucccgcugcc

SEQ ID NO: 3529262 - RNA, 18 nt, Pseudomonas putida KT2440
agauggcugucugcagcu

SEQ ID NO: 3529263 - RNA, 16 nt, Pseudomonas putida KT2440
agauggugaugccccu

SEQ ID NO: 3529264 - RNA, 18 nt, Pseudomonas putida KT2440
agaugguuuccagcuccg

SEQ ID NO: 3529265 - RNA, 13 nt, Pseudomonas putida KT2440
agauguucaccag

SEQ ID NO: 3529266 - RNA, 17 nt, Pseudomonas putida KT2440
agauucaagcccggcgc

SEQ ID NO: 3529267 - RNA, 13 nt, Pseudomonas putida KT2440
agauuccgggcug

SEQ ID NO: 3529268 - RNA, 16 nt, Pseudomonas putida KT2440
agauuccgggcugcug

SEQ ID NO: 3529269 - RNA, 14 nt, Pseudomonas putida KT2440
agauugaaggggca

SEQ ID NO: 3529270 - RNA, 13 nt, Pseudomonas putida KT2440
agauugagaggac

SEQ ID NO: 3529271 - RNA, 17 nt, Pseudomonas putida KT2440
agauugagaggacuuua

SEQ ID NO: 3529272 - RNA, 14 nt, Pseudomonas putida KT2440
agauugcuuauucu

SEQ ID NO: 3529273 - RNA, 23 nt, Pseudomonas putida KT2440
agauuucaccgagugcccgcgca

SEQ ID NO: 3529274 - RNA, 17 nt, Pseudomonas putida KT2440
agauuucucagcuggaa

SEQ ID NO: 3529275 - RNA, 15 nt, Pseudomonas putida KT2440
agauuuucagccaaa

SEQ ID NO: 3529276 - RNA, 23 nt, Pseudomonas putida KT2440
agcaaaaguuggcugaccggcac

SEQ ID NO: 3529277 - RNA, 12 nt, Pseudomonas putida KT2440
agcaaacgccag

SEQ ID NO: 3529278 - RNA, 17 nt, Pseudomonas putida KT2440
agcaaagcccgccccaa

SEQ ID NO: 3529279 - RNA, 21 nt, Pseudomonas putida KT2440
agcaaaggcgaccuucggguc

SEQ ID NO: 3529280 - RNA, 17 nt, Pseudomonas putida KT2440
agcaaagucuucagcca

SEQ ID NO: 3529281 - RNA, 21 nt, Pseudomonas putida KT2440
agcaaaugacuguuaaucauu

SEQ ID NO: 3529282 - RNA, 19 nt, Pseudomonas putida KT2440
agcaacaacgccuuggccu

SEQ ID NO: 3529283 - RNA, 22 nt, Pseudomonas putida KT2440
agcaacaacgccuuggccuggc

SEQ ID NO: 3529284 - RNA, 21 nt, Pseudomonas putida KT2440
agcaacacauacuccaccgcc

SEQ ID NO: 3529285 - RNA, 17 nt, Pseudomonas putida KT2440
agcaacacauguaggcg

SEQ ID NO: 3529286 - RNA, 22 nt, Pseudomonas putida KT2440
agcaacaccguagcgagcaccg

SEQ ID NO: 3529287 - RNA, 17 nt, Pseudomonas putida KT2440
agcaacacgacgauggc

SEQ ID NO: 3529288 - RNA, 17 nt, Pseudomonas putida KT2440
agcaacagaacgccuug

SEQ ID NO: 3529289 - RNA, 12 nt, Pseudomonas putida KT2440
agcaacaucgcc

SEQ ID NO: 3529290 - RNA, 16 nt, Pseudomonas putida KT2440
agcaacaucugccgaa

SEQ ID NO: 3529291 - RNA, 23 nt, Pseudomonas putida KT2440
agcaacaucugccgaaacuccgg

SEQ ID NO: 3529292 - RNA, 23 nt, Pseudomonas putida KT2440
agcaacgcccgcaacaaccuggc

SEQ ID NO: 3529293 - RNA, 22 nt, Pseudomonas putida KT2440
agcaacgccuuggccugcggga

SEQ ID NO: 3529294 - RNA, 18 nt, Pseudomonas putida KT2440
agcaacgcuagaaacaga

SEQ ID NO: 3529295 - RNA, 21 nt, Pseudomonas putida KT2440
agcaacggacgucccagcagg

SEQ ID NO: 3529296 - RNA, 13 nt, Pseudomonas putida KT2440
agcaacggguuca

SEQ ID NO: 3529297 - RNA, 21 nt, Pseudomonas putida KT2440
agcaacggguucagguacagc

SEQ ID NO: 3529298 - RNA, 20 nt, Pseudomonas putida KT2440
agcaacggugaaaaacgcgg

SEQ ID NO: 3529299 - RNA, 18 nt, Pseudomonas putida KT2440
agcaacgguuuaccgccg

SEQ ID NO: 3529300 - RNA, 20 nt, Pseudomonas putida KT2440
agcaacgguuuaccgccguu

SEQ ID NO: 3529301 - RNA, 15 nt, Pseudomonas putida KT2440
agcaacuaccaugaa

SEQ ID NO: 3529302 - RNA, 21 nt, Pseudomonas putida KT2440
agcaacuccccccgcgccaga

SEQ ID NO: 3529303 - RNA, 17 nt, Pseudomonas putida KT2440
agcaacugggcaaugua

SEQ ID NO: 3529304 - RNA, 16 nt, Pseudomonas putida KT2440
agcaacuggugaauca

SEQ ID NO: 3529305 - RNA, 13 nt, Pseudomonas putida KT2440
agcaacuugcgca

SEQ ID NO: 3529306 - RNA, 14 nt, Pseudomonas putida KT2440
agcaagccgccgau

SEQ ID NO: 3529307 - RNA, 13 nt, Pseudomonas putida KT2440
agcaagccugccg

SEQ ID NO: 3529308 - RNA, 23 nt, Pseudomonas putida KT2440
agcaagcggguaaugucccgcac

SEQ ID NO: 3529309 - RNA, 22 nt, Pseudomonas putida KT2440
agcaagcucaucaccaggcccg

SEQ ID NO: 3529310 - RNA, 11 nt, Pseudomonas putida KT2440
agcaaggcauc

SEQ ID NO: 3529311 - RNA, 19 nt, Pseudomonas putida KT2440
agcaaggccauuucccugc

SEQ ID NO: 3529312 - RNA, 23 nt, Pseudomonas putida KT2440
agcaagucccccaucggcacccg

SEQ ID NO: 3529313 - RNA, 14 nt, Pseudomonas putida KT2440
agcaagugccccug

SEQ ID NO: 3529314 - RNA, 14 nt, Pseudomonas putida KT2440
agcaaugccagccg

SEQ ID NO: 3529315 - RNA, 18 nt, Pseudomonas putida KT2440
agcaaugccaguugauca

SEQ ID NO: 3529316 - RNA, 19 nt, Pseudomonas putida KT2440
agcaaugcccgcucgcugc

SEQ ID NO: 3529317 - RNA, 22 nt, Pseudomonas putida KT2440
agcaaugcgucggcguggaaca

SEQ ID NO: 3529318 - RNA, 15 nt, Pseudomonas putida KT2440
agcaauggcccugga

SEQ ID NO: 3529319 - RNA, 17 nt, Pseudomonas putida KT2440
agcaauugcgagguacc

SEQ ID NO: 3529320 - RNA, 16 nt, Pseudomonas putida KT2440
agcacaaccacugcaa

SEQ ID NO: 3529321 - RNA, 20 nt, Pseudomonas putida KT2440
agcacaagccaugugccugg

SEQ ID NO: 3529322 - RNA, 14 nt, Pseudomonas putida KT2440
agcacaaggccacu

SEQ ID NO: 3529323 - RNA, 12 nt, Pseudomonas putida KT2440
agcacaaggcug

SEQ ID NO: 3529324 - RNA, 17 nt, Pseudomonas putida KT2440
agcacaagggccagguc

SEQ ID NO: 3529325 - RNA, 13 nt, Pseudomonas putida KT2440
agcacacccagca

SEQ ID NO: 3529326 - RNA, 23 nt, Pseudomonas putida KT2440
agcacacgguaggcgucuuccac

SEQ ID NO: 3529327 - RNA, 18 nt, Pseudomonas putida KT2440
agcacagauaaaccugcc

SEQ ID NO: 3529328 - RNA, 21 nt, Pseudomonas putida KT2440
agcacagauaaaccugccacc

SEQ ID NO: 3529329 - RNA, 14 nt, Pseudomonas putida KT2440
agcacagugcggcg

SEQ ID NO: 3529330 - RNA, 19 nt, Pseudomonas putida KT2440
agcacagugcggcggcacu

SEQ ID NO: 3529331 - RNA, 15 nt, Pseudomonas putida KT2440
agcacaucccgucag

SEQ ID NO: 3529332 - RNA, 15 nt, Pseudomonas putida KT2440
agcacauucagcagc

SEQ ID NO: 3529333 - RNA, 16 nt, Pseudomonas putida KT2440
agcacauucagcagcg

SEQ ID NO: 3529334 - RNA, 21 nt, Pseudomonas putida KT2440
agcacauucagcagcgccugg

SEQ ID NO: 3529335 - RNA, 19 nt, Pseudomonas putida KT2440
agcaccacccaccagcagu

SEQ ID NO: 3529336 - RNA, 21 nt, Pseudomonas putida KT2440
agcaccacccaccagcagugc

SEQ ID NO: 3529337 - RNA, 21 nt, Pseudomonas putida KT2440
agcaccaccggacgcuugcca

SEQ ID NO: 3529338 - RNA, 22 nt, Pseudomonas putida KT2440
agcaccacggcggcgaucagcg

SEQ ID NO: 3529339 - RNA, 14 nt, Pseudomonas putida KT2440
agcaccacuggaug

SEQ ID NO: 3529340 - RNA, 23 nt, Pseudomonas putida KT2440
agcaccagcgcgaucaccagccc

SEQ ID NO: 3529341 - RNA, 17 nt, Pseudomonas putida KT2440
agcaccagcuccuggcc

SEQ ID NO: 3529342 - RNA, 16 nt, Pseudomonas putida KT2440
agcaccaucaggcaca

SEQ ID NO: 3529343 - RNA, 17 nt, Pseudomonas putida KT2440
agcaccaucaggcacag

SEQ ID NO: 3529344 - RNA, 13 nt, Pseudomonas putida KT2440
agcaccccagcac

SEQ ID NO: 3529345 - RNA, 16 nt, Pseudomonas putida KT2440
agcaccccagcaccac

SEQ ID NO: 3529346 - RNA, 14 nt, Pseudomonas putida KT2440
agcacccccgguuc

SEQ ID NO: 3529347 - RNA, 13 nt, Pseudomonas putida KT2440
agcacccgcaggc

SEQ ID NO: 3529348 - RNA, 14 nt, Pseudomonas putida KT2440
agcacccgcaggcg

SEQ ID NO: 3529349 - RNA, 21 nt, Pseudomonas putida KT2440
agcacccgcaggcgacgagcc

SEQ ID NO: 3529350 - RNA, 14 nt, Pseudomonas putida KT2440
agcacccgcuuggc

SEQ ID NO: 3529351 - RNA, 16 nt, Pseudomonas putida KT2440
agcacccgcuuggcca

SEQ ID NO: 3529352 - RNA, 19 nt, Pseudomonas putida KT2440
agcacccgcuuggccacca

SEQ ID NO: 3529353 - RNA, 21 nt, Pseudomonas putida KT2440
agcacccgcuuguagcucagg

SEQ ID NO: 3529354 - RNA, 17 nt, Pseudomonas putida KT2440
agcacccuuccccccug

SEQ ID NO: 3529355 - RNA, 21 nt, Pseudomonas putida KT2440
agcaccgaaccggcgaucagg

SEQ ID NO: 3529356 - RNA, 16 nt, Pseudomonas putida KT2440
agcaccgacuggcgua

SEQ ID NO: 3529357 - RNA, 15 nt, Pseudomonas putida KT2440
agcaccgaggcguga

SEQ ID NO: 3529358 - RNA, 18 nt, Pseudomonas putida KT2440
agcaccgaggcgugauca

SEQ ID NO: 3529359 - RNA, 16 nt, Pseudomonas putida KT2440
agcaccgaucagcggc

SEQ ID NO: 3529360 - RNA, 14 nt, Pseudomonas putida KT2440
agcaccgccaccau

SEQ ID NO: 3529361 - RNA, 13 nt, Pseudomonas putida KT2440
cagccaggcacag

SEQ ID NO: 3529362 - RNA, 19 nt, Pseudomonas putida KT2440
cagccaggcugagcccggc

SEQ ID NO: 3529363 - RNA, 13 nt, Pseudomonas putida KT2440
cagccagggccug

SEQ ID NO: 3529364 - RNA, 16 nt, Pseudomonas putida KT2440
cagccagguauggcca

SEQ ID NO: 3529365 - RNA, 17 nt, Pseudomonas putida KT2440
cagccagguauggccag

SEQ ID NO: 3529366 - RNA, 20 nt, Pseudomonas putida KT2440
cagccagguauggccagagc

SEQ ID NO: 3529367 - RNA, 21 nt, Pseudomonas putida KT2440
cagccagguucggaucagcaa

SEQ ID NO: 3529368 - RNA, 13 nt, Pseudomonas putida KT2440
cagccagguuuuu

SEQ ID NO: 3529369 - RNA, 15 nt, Pseudomonas putida KT2440
cagccagucgcgcaa

SEQ ID NO: 3529370 - RNA, 15 nt, Pseudomonas putida KT2440
cagccagugcugccu

SEQ ID NO: 3529371 - RNA, 14 nt, Pseudomonas putida KT2440
cagccaguucgaca

SEQ ID NO: 3529372 - RNA, 16 nt, Pseudomonas putida KT2440
cagccauagccaguag

SEQ ID NO: 3529373 - RNA, 20 nt, Pseudomonas putida KT2440
cagccauaguuuugugccac

SEQ ID NO: 3529374 - RNA, 22 nt, Pseudomonas putida KT2440
cagccauaguuuugugccaccu

SEQ ID NO: 3529375 - RNA, 22 nt, Pseudomonas putida KT2440
cagccaucaucagguacggguu

SEQ ID NO: 3529376 - RNA, 18 nt, Pseudomonas putida KT2440
cagccaucgagcaccggc

SEQ ID NO: 3529377 - RNA, 18 nt, Pseudomonas putida KT2440
cagccaugccggcaacga

SEQ ID NO: 3529378 - RNA, 22 nt, Pseudomonas putida KT2440
cagcccaaggcuggccagacga

SEQ ID NO: 3529379 - RNA, 13 nt, Pseudomonas putida KT2440
cagcccaccacga

SEQ ID NO: 3529380 - RNA, 16 nt, Pseudomonas putida KT2440
cagcccaccgagcuug

SEQ ID NO: 3529381 - RNA, 14 nt, Pseudomonas putida KT2440
cagcccacggccgc

SEQ ID NO: 3529382 - RNA, 13 nt, Pseudomonas putida KT2440
cagcccagcgcca

SEQ ID NO: 3529383 - RNA, 13 nt, Pseudomonas putida KT2440
cagcccagcgccg

SEQ ID NO: 3529384 - RNA, 14 nt, Pseudomonas putida KT2440
cagcccagcgccgc

SEQ ID NO: 3529385 - RNA, 18 nt, Pseudomonas putida KT2440
cagcccagcgccgccggc

SEQ ID NO: 3529386 - RNA, 14 nt, Pseudomonas putida KT2440
cagcccaggcuggc

SEQ ID NO: 3529387 - RNA, 18 nt, Pseudomonas putida KT2440
cagcccaguaccacuucc

SEQ ID NO: 3529388 - RNA, 22 nt, Pseudomonas putida KT2440
cagcccaguagaucgcgccagu

SEQ ID NO: 3529389 - RNA, 17 nt, Pseudomonas putida KT2440
cagcccauagcgccauc

SEQ ID NO: 3529390 - RNA, 16 nt, Pseudomonas putida KT2440
cagcccauccagggcu

SEQ ID NO: 3529391 - RNA, 18 nt, Pseudomonas putida KT2440
cagcccaugaacagcaag

SEQ ID NO: 3529392 - RNA, 19 nt, Pseudomonas putida KT2440
cagcccaugaacagcaagu

SEQ ID NO: 3529393 - RNA, 17 nt, Pseudomonas putida KT2440
cagcccauucgcgggca

SEQ ID NO: 3529394 - RNA, 16 nt, Pseudomonas putida KT2440
cagcccauucgcgggu

SEQ ID NO: 3529395 - RNA, 19 nt, Pseudomonas putida KT2440
cagccccaacccaccagca

SEQ ID NO: 3529396 - RNA, 19 nt, Pseudomonas putida KT2440
cagccccaaccuuccagca

SEQ ID NO: 3529397 - RNA, 12 nt, Pseudomonas putida KT2440
cagccccaaggu

SEQ ID NO: 3529398 - RNA, 20 nt, Pseudomonas putida KT2440
cagccccaagguggaaaucg

SEQ ID NO: 3529399 - RNA, 15 nt, Pseudomonas putida KT2440
cagccccaccucggc

SEQ ID NO: 3529400 - RNA, 13 nt, Pseudomonas putida KT2440
cagccccacgccc

SEQ ID NO: 3529401 - RNA, 15 nt, Pseudomonas putida KT2440
cagccccacgcccag

SEQ ID NO: 3529402 - RNA, 19 nt, Pseudomonas putida KT2440
cagccccagccucagcugg

SEQ ID NO: 3529403 - RNA, 15 nt, Pseudomonas putida KT2440
cagccccagcgccuu

SEQ ID NO: 3529404 - RNA, 20 nt, Pseudomonas putida KT2440
cagccccagcggcagcagca

SEQ ID NO: 3529405 - RNA, 20 nt, Pseudomonas putida KT2440
cagccccagggcccucaacc

SEQ ID NO: 3529406 - RNA, 14 nt, Pseudomonas putida KT2440
cagccccagugugc

SEQ ID NO: 3529407 - RNA, 17 nt, Pseudomonas putida KT2440
cagccccaucaccagcc

SEQ ID NO: 3529408 - RNA, 16 nt, Pseudomonas putida KT2440
cagcccccaccgggcu

SEQ ID NO: 3529409 - RNA, 16 nt, Pseudomonas putida KT2440
cagcccccccaaggcg

SEQ ID NO: 3529410 - RNA, 22 nt, Pseudomonas putida KT2440
cagccccgccaacaacaagcgc

SEQ ID NO: 3529411 - RNA, 16 nt, Pseudomonas putida KT2440
cagccccuagcgcauc

SEQ ID NO: 3529412 - RNA, 19 nt, Pseudomonas putida KT2440
cagccccuuccccaggccg

SEQ ID NO: 3529413 - RNA, 23 nt, Pseudomonas putida KT2440
cagccccuugcucuguucgcugg

SEQ ID NO: 3529414 - RNA, 22 nt, Pseudomonas putida KT2440
cagcccgaacgacacggcaggg

SEQ ID NO: 3529415 - RNA, 14 nt, Pseudomonas putida KT2440
cagcccgaagccgg

SEQ ID NO: 3529416 - RNA, 16 nt, Pseudomonas putida KT2440
cagcccgaagccggca

SEQ ID NO: 3529417 - RNA, 16 nt, Pseudomonas putida KT2440
cagcccgaagcgcagg

SEQ ID NO: 3529418 - RNA, 17 nt, Pseudomonas putida KT2440
cagcccgauaaacacga

SEQ ID NO: 3529419 - RNA, 20 nt, Pseudomonas putida KT2440
cagcccgauaaacacgaaca

SEQ ID NO: 3529420 - RNA, 17 nt, Pseudomonas putida KT2440
cagcccgauggccuuga

SEQ ID NO: 3529421 - RNA, 15 nt, Pseudomonas putida KT2440
cagcccgcaccggcc

SEQ ID NO: 3529422 - RNA, 19 nt, Pseudomonas putida KT2440
cagcccgccacaccgaagc

SEQ ID NO: 3529423 - RNA, 14 nt, Pseudomonas putida KT2440
cagcccgccacccg

SEQ ID NO: 3529424 - RNA, 20 nt, Pseudomonas putida KT2440
cagcccgcccacaugcgagc

SEQ ID NO: 3529425 - RNA, 17 nt, Pseudomonas putida KT2440
cagcccggacugcacca

SEQ ID NO: 3529426 - RNA, 19 nt, Pseudomonas putida KT2440
cagcccggacugcaccagg

SEQ ID NO: 3529427 - RNA, 15 nt, Pseudomonas putida KT2440
cagcccggcgccgag

SEQ ID NO: 3529428 - RNA, 14 nt, Pseudomonas putida KT2440
cagcccggcggcca

SEQ ID NO: 3529429 - RNA, 16 nt, Pseudomonas putida KT2440
cagcccggcggccagc

SEQ ID NO: 3529430 - RNA, 18 nt, Pseudomonas putida KT2440
cagcccggcggccagcac

SEQ ID NO: 3529431 - RNA, 20 nt, Pseudomonas putida KT2440
cagcccggcggccagcacga

SEQ ID NO: 3529432 - RNA, 19 nt, Pseudomonas putida KT2440
cagcccggcguucgaaagc

SEQ ID NO: 3529433 - RNA, 17 nt, Pseudomonas putida KT2440
cagcccggcuccgcgca

SEQ ID NO: 3529434 - RNA, 15 nt, Pseudomonas putida KT2440
cagcccggcuucaca

SEQ ID NO: 3529435 - RNA, 15 nt, Pseudomonas putida KT2440
cagcccgguccaugu

SEQ ID NO: 3529436 - RNA, 16 nt, Pseudomonas putida KT2440
cagcccgguccaugua

SEQ ID NO: 3529437 - RNA, 21 nt, Pseudomonas putida KT2440
cagcccggugaagucaccgaa

SEQ ID NO: 3529438 - RNA, 18 nt, Pseudomonas putida KT2440
cagcccggugcccuugcc

SEQ ID NO: 3529439 - RNA, 19 nt, Pseudomonas putida KT2440
cagcccgucacgugccuuc

SEQ ID NO: 3529440 - RNA, 17 nt, Pseudomonas putida KT2440
cagcccguucuggccuu

SEQ ID NO: 3529441 - RNA, 16 nt, Pseudomonas putida KT2440
cagcccucccagguug

SEQ ID NO: 3529442 - RNA, 21 nt, Pseudomonas putida KT2440
cagcccugccgaggccaugug

SEQ ID NO: 3529443 - RNA, 23 nt, Pseudomonas putida KT2440
cagcccugccgaggccaugugcu

SEQ ID NO: 3529444 - RNA, 12 nt, Pseudomonas putida KT2440
cagcccugcucg

SEQ ID NO: 3529445 - RNA, 21 nt, Pseudomonas putida KT2440
cagcccuucacuguggucauc

SEQ ID NO: 3529446 - RNA, 12 nt, Pseudomonas putida KT2440
cagcccuuccac

SEQ ID NO: 3529447 - RNA, 22 nt, Pseudomonas putida KT2440
cagcccuucgccggcacgcccg

SEQ ID NO: 3529448 - RNA, 14 nt, Pseudomonas putida KT2440
cagcccuucgcggg

SEQ ID NO: 3529449 - RNA, 16 nt, Pseudomonas putida KT2440
cagcccuucgcgggca

SEQ ID NO: 3529450 - RNA, 21 nt, Pseudomonas putida KT2440
cagcccuucgcgggcacgccc

SEQ ID NO: 3529451 - RNA, 15 nt, Pseudomonas putida KT2440
cagcccuugcucggc

SEQ ID NO: 3529452 - RNA, 16 nt, Pseudomonas putida KT2440
cagccgaacuugucug

SEQ ID NO: 3529453 - RNA, 20 nt, Pseudomonas putida KT2440
cagccgaacuugucuguacu

SEQ ID NO: 3529454 - RNA, 16 nt, Pseudomonas putida KT2440
cagccgagccaaccgc

SEQ ID NO: 3529455 - RNA, 20 nt, Pseudomonas putida KT2440
cagccgauacgcuguacuug

SEQ ID NO: 3529456 - RNA, 19 nt, Pseudomonas putida KT2440
cagccgaucacuuccuggc

SEQ ID NO: 3529457 - RNA, 19 nt, Pseudomonas putida KT2440
cagccgcaaccgggucggc

SEQ ID NO: 3529458 - RNA, 18 nt, Pseudomonas putida KT2440
cagccgcacccaggccac

SEQ ID NO: 3529459 - RNA, 13 nt, Pseudomonas putida KT2440
cagccgcaccugc

SEQ ID NO: 3529460 - RNA, 20 nt, Pseudomonas putida KT2440
cagccgcacguuauccacag

SEQ ID NO: 3529461 - RNA, 16 nt, Pseudomonas putida KT2440
cagccgccacaugccc

SEQ ID NO: 3529462 - RNA, 17 nt, Pseudomonas putida KT2440
cagccgccacaugcccg

SEQ ID NO: 3529463 - RNA, 16 nt, Pseudomonas putida KT2440
cagccgccacgaccac

SEQ ID NO: 3529464 - RNA, 16 nt, Pseudomonas putida KT2440
cagccgcccaguucca

SEQ ID NO: 3529465 - RNA, 16 nt, Pseudomonas putida KT2440
cagccgcccgaacggg

SEQ ID NO: 3529466 - RNA, 22 nt, Pseudomonas putida KT2440
cagccgcccuugagcuucagcg

SEQ ID NO: 3529467 - RNA, 17 nt, Pseudomonas putida KT2440
cagcgcaccgugcacca

SEQ ID NO: 3529468 - RNA, 20 nt, Pseudomonas putida KT2440
cagcgcaccgugcaccagca

SEQ ID NO: 3529469 - RNA, 21 nt, Pseudomonas putida KT2440
cagcgcaccgugcaccagcac

SEQ ID NO: 3529470 - RNA, 20 nt, Pseudomonas putida KT2440
cagcgcacucucccgcagcc

SEQ ID NO: 3529471 - RNA, 22 nt, Pseudomonas putida KT2440
cagcgcagcaucuuccugccac

SEQ ID NO: 3529472 - RNA, 17 nt, Pseudomonas putida KT2440
cagcgcagccaccagcu

SEQ ID NO: 3529473 - RNA, 22 nt, Pseudomonas putida KT2440
cagcgcagggaagguggccggc

SEQ ID NO: 3529474 - RNA, 23 nt, Pseudomonas putida KT2440
cagcgcagggaagguggccggca

SEQ ID NO: 3529475 - RNA, 19 nt, Pseudomonas putida KT2440
cagcgcauacagcuugccc

SEQ ID NO: 3529476 - RNA, 15 nt, Pseudomonas putida KT2440
cagcgcauaggccaa

SEQ ID NO: 3529477 - RNA, 20 nt, Pseudomonas putida KT2440
cagcgcauaggccaagguug

SEQ ID NO: 3529478 - RNA, 20 nt, Pseudomonas putida KT2440
cagcgcaugguccugguaac

SEQ ID NO: 3529479 - RNA, 18 nt, Pseudomonas putida KT2440
cagcgccaaaggcgcguc

SEQ ID NO: 3529480 - RNA, 18 nt, Pseudomonas putida KT2440
cagcgccaacgcccccgc

SEQ ID NO: 3529481 - RNA, 17 nt, Pseudomonas putida KT2440
cagcgccaauaccgcgc

SEQ ID NO: 3529482 - RNA, 13 nt, Pseudomonas putida KT2440
cagcgccaccgcg

SEQ ID NO: 3529483 - RNA, 14 nt, Pseudomonas putida KT2440
cagcgccaccgcgc

SEQ ID NO: 3529484 - RNA, 14 nt, Pseudomonas putida KT2440
cagcgccaccggca

SEQ ID NO: 3529485 - RNA, 16 nt, Pseudomonas putida KT2440
cagcgccaccggcagc

SEQ ID NO: 3529486 - RNA, 17 nt, Pseudomonas putida KT2440
cagcgccaccggcagca

SEQ ID NO: 3529487 - RNA, 20 nt, Pseudomonas putida KT2440
cagcgccaccggcagcaaga

SEQ ID NO: 3529488 - RNA, 16 nt, Pseudomonas putida KT2440
cagcgccacgccugca

SEQ ID NO: 3529489 - RNA, 11 nt, Pseudomonas putida KT2440
cagcgccagca

SEQ ID NO: 3529490 - RNA, 20 nt, Pseudomonas putida KT2440
cagcgccagcacgcaggcca

SEQ ID NO: 3529491 - RNA, 14 nt, Pseudomonas putida KT2440
cagcgccagcagcc

SEQ ID NO: 3529492 - RNA, 17 nt, Pseudomonas putida KT2440
cagcgccagcagccggg

SEQ ID NO: 3529493 - RNA, 18 nt, Pseudomonas putida KT2440
cagcgccaguuacccugu

SEQ ID NO: 3529494 - RNA, 13 nt, Pseudomonas putida KT2440
cagcgcccagaac

SEQ ID NO: 3529495 - RNA, 20 nt, Pseudomonas putida KT2440
cagcgcccagaucagcagca

SEQ ID NO: 3529496 - RNA, 21 nt, Pseudomonas putida KT2440
cagcgcccagaucagcagcac

SEQ ID NO: 3529497 - RNA, 12 nt, Pseudomonas putida KT2440
cagcgccccgcc

SEQ ID NO: 3529498 - RNA, 12 nt, Pseudomonas putida KT2440
cagcgcccgcaa

SEQ ID NO: 3529499 - RNA, 19 nt, Pseudomonas putida KT2440
cagcgcccgcugcgccgcu

SEQ ID NO: 3529500 - RNA, 13 nt, Pseudomonas putida KT2440
cagcgcccuucac

SEQ ID NO: 3529501 - RNA, 15 nt, Pseudomonas putida KT2440
cagcgccgauggcca

SEQ ID NO: 3529502 - RNA, 17 nt, Pseudomonas putida KT2440
cagcgccgauggccaau

SEQ ID NO: 3529503 - RNA, 18 nt, Pseudomonas putida KT2440
cagcgccgcaacggccga

SEQ ID NO: 3529504 - RNA, 16 nt, Pseudomonas putida KT2440
cagcgccgcauccagc

SEQ ID NO: 3529505 - RNA, 19 nt, Pseudomonas putida KT2440
cagcgccgcauccagcacu

SEQ ID NO: 3529506 - RNA, 21 nt, Pseudomonas putida KT2440
cagcgccgccaggcccaccac

SEQ ID NO: 3529507 - RNA, 15 nt, Pseudomonas putida KT2440
cagcgccgccaugca

SEQ ID NO: 3529508 - RNA, 12 nt, Pseudomonas putida KT2440
cagcgccgcgau

SEQ ID NO: 3529509 - RNA, 22 nt, Pseudomonas putida KT2440
cagcgccgcgaucaaugggccg

SEQ ID NO: 3529510 - RNA, 20 nt, Pseudomonas putida KT2440
cagcgccgguagcggcuggg

SEQ ID NO: 3529511 - RNA, 17 nt, Pseudomonas putida KT2440
cagcgccucaccgaccc

SEQ ID NO: 3529512 - RNA, 23 nt, Pseudomonas putida KT2440
cagcgccucaccgacccacaggc

SEQ ID NO: 3529513 - RNA, 11 nt, Pseudomonas putida KT2440
cagcgccucca

SEQ ID NO: 3529514 - RNA, 12 nt, Pseudomonas putida KT2440
cagcgccuccag

SEQ ID NO: 3529515 - RNA, 13 nt, Pseudomonas putida KT2440
cagcgccuccccc

SEQ ID NO: 3529516 - RNA, 14 nt, Pseudomonas putida KT2440
cagcgccuccccca

SEQ ID NO: 3529517 - RNA, 15 nt, Pseudomonas putida KT2440
cagcgccucccccag

SEQ ID NO: 3529518 - RNA, 20 nt, Pseudomonas putida KT2440
cagcgccucccccagcgcgg

SEQ ID NO: 3529519 - RNA, 21 nt, Pseudomonas putida KT2440
cagcgccucccccagcgcggu

SEQ ID NO: 3529520 - RNA, 15 nt, Pseudomonas putida KT2440
cagcgccugcagcgc

SEQ ID NO: 3529521 - RNA, 12 nt, Pseudomonas putida KT2440
cagcgccugcuc

SEQ ID NO: 3529522 - RNA, 14 nt, Pseudomonas putida KT2440
cagcgccugcugcc

SEQ ID NO: 3529523 - RNA, 15 nt, Pseudomonas putida KT2440
cagcgccugcugcca

SEQ ID NO: 3529524 - RNA, 14 nt, Pseudomonas putida KT2440
cagcgccugcugcu

SEQ ID NO: 3529525 - RNA, 16 nt, Pseudomonas putida KT2440
cagcgccugcugcugg

SEQ ID NO: 3529526 - RNA, 17 nt, Pseudomonas putida KT2440
cagcgccugcugcugga

SEQ ID NO: 3529527 - RNA, 15 nt, Pseudomonas putida KT2440
cagcgccugcuggug

SEQ ID NO: 3529528 - RNA, 13 nt, Pseudomonas putida KT2440
cagcgccuggcga

SEQ ID NO: 3529529 - RNA, 20 nt, Pseudomonas putida KT2440
cagcgccugugagaucgagc

SEQ ID NO: 3529530 - RNA, 20 nt, Pseudomonas putida KT2440
cagcgccuuggccugcucac

SEQ ID NO: 3529531 - RNA, 14 nt, Pseudomonas putida KT2440
cagcgcgaaacccu

SEQ ID NO: 3529532 - RNA, 21 nt, Pseudomonas putida KT2440
cagcgcgaaacccucacgcgc

SEQ ID NO: 3529533 - RNA, 16 nt, Pseudomonas putida KT2440
cagcgcgacgcagcag

SEQ ID NO: 3529534 - RNA, 18 nt, Pseudomonas putida KT2440
cagcgcgacgcagcagcg

SEQ ID NO: 3529535 - RNA, 15 nt, Pseudomonas putida KT2440
cagcgcgaucaccag

SEQ ID NO: 3529536 - RNA, 20 nt, Pseudomonas putida KT2440
cagcgcgaucaccagccccu

SEQ ID NO: 3529537 - RNA, 14 nt, Pseudomonas putida KT2440
cagcgcgccgaacu

SEQ ID NO: 3529538 - RNA, 13 nt, Pseudomonas putida KT2440
cagcgcgcugagc

SEQ ID NO: 3529539 - RNA, 16 nt, Pseudomonas putida KT2440
cagcgcggaacacacg

SEQ ID NO: 3529540 - RNA, 18 nt, Pseudomonas putida KT2440
cagcgcggucugcggcag

SEQ ID NO: 3529541 - RNA, 19 nt, Pseudomonas putida KT2440
cagcgcggucugcggcagc

SEQ ID NO: 3529542 - RNA, 20 nt, Pseudomonas putida KT2440
cagcgcggucugcggcagca

SEQ ID NO: 3529543 - RNA, 19 nt, Pseudomonas putida KT2440
cagcgcggugaccagcggc

SEQ ID NO: 3529544 - RNA, 20 nt, Pseudomonas putida KT2440
cagcgcggugaccagcggca

SEQ ID NO: 3529545 - RNA, 22 nt, Pseudomonas putida KT2440
cagcgcggugaccagcggcagc

SEQ ID NO: 3529546 - RNA, 14 nt, Pseudomonas putida KT2440
cagcgcguacagcg

SEQ ID NO: 3529547 - RNA, 15 nt, Pseudomonas putida KT2440
cagcgcguacagcga

SEQ ID NO: 3529548 - RNA, 22 nt, Pseudomonas putida KT2440
cagcgcguacagcgacaugccg

SEQ ID NO: 3529549 - RNA, 14 nt, Pseudomonas putida KT2440
cagcgcgucauccg

SEQ ID NO: 3529550 - RNA, 14 nt, Pseudomonas putida KT2440
cagcgcguccagca

SEQ ID NO: 3529551 - RNA, 22 nt, Pseudomonas putida KT2440
cagcgcuaucucggacacguca

SEQ ID NO: 3529552 - RNA, 21 nt, Pseudomonas putida KT2440
cagcgcuccgccaaaccccag

SEQ ID NO: 3529553 - RNA, 14 nt, Pseudomonas putida KT2440
cagcgcucgaugcg

SEQ ID NO: 3529554 - RNA, 17 nt, Pseudomonas putida KT2440
cagcgcucgcugccggu

SEQ ID NO: 3529555 - RNA, 20 nt, Pseudomonas putida KT2440
cagcgcucguaggcuucacg

SEQ ID NO: 3529556 - RNA, 18 nt, Pseudomonas putida KT2440
cagcgcugacucagcggc

SEQ ID NO: 3529557 - RNA, 23 nt, Pseudomonas putida KT2440
cagcgcugacucagcggccuuuc

SEQ ID NO: 3529558 - RNA, 21 nt, Pseudomonas putida KT2440
cagcgcugaguggcaugacca

SEQ ID NO: 3529559 - RNA, 18 nt, Pseudomonas putida KT2440
cagcgcugauaccgaacu

SEQ ID NO: 3529560 - RNA, 17 nt, Pseudomonas putida KT2440
cagcgcugcaagcgcac

SEQ ID NO: 3529561 - RNA, 15 nt, Pseudomonas putida KT2440
cagcgcugccgccuu

SEQ ID NO: 3529562 - RNA, 15 nt, Pseudomonas putida KT2440
cagcgcugcgaggcc

SEQ ID NO: 3529563 - RNA, 21 nt, Pseudomonas putida KT2440
cagcgcugcgaggccccagac

SEQ ID NO: 3529564 - RNA, 20 nt, Pseudomonas putida KT2440
cagcgcugcggguggcguag

SEQ ID NO: 3529565 - RNA, 19 nt, Pseudomonas putida KT2440
cagcgcugggcgguaccca

SEQ ID NO: 3529566 - RNA, 17 nt, Pseudomonas putida KT2440
cagcgcugucccccagc

SEQ ID NO: 3529567 - RNA, 17 nt, Pseudomonas putida KT2440
cagcgcuuccaagugcu

SEQ ID NO: 3529568 - RNA, 14 nt, Pseudomonas putida KT2440
cagcgcuucgauca

SEQ ID NO: 3529569 - RNA, 19 nt, Pseudomonas putida KT2440
cagcgcuucgaucagcgcc

SEQ ID NO: 3529570 - RNA, 14 nt, Pseudomonas putida KT2440
cagcgcuucgaucg

SEQ ID NO: 3529571 - RNA, 16 nt, Pseudomonas putida KT2440
cagcggaaucaccggu

SEQ ID NO: 3529572 - RNA, 16 nt, Pseudomonas putida KT2440
cagcggaucaccgacg

SEQ ID NO: 3529573 - RNA, 16 nt, Pseudomonas putida KT2440
cagcucacuggcaucc

SEQ ID NO: 3529574 - RNA, 14 nt, Pseudomonas putida KT2440
cagcucacuggcca

SEQ ID NO: 3529575 - RNA, 18 nt, Pseudomonas putida KT2440
cagcucacuggccaacuc

SEQ ID NO: 3529576 - RNA, 14 nt, Pseudomonas putida KT2440
cagcucagccagca

SEQ ID NO: 3529577 - RNA, 15 nt, Pseudomonas putida KT2440
cagcucaggccuugc

SEQ ID NO: 3529578 - RNA, 19 nt, Pseudomonas putida KT2440
cagcucaggccuugcucga

SEQ ID NO: 3529579 - RNA, 16 nt, Pseudomonas putida KT2440
cagcucauccagccgc

SEQ ID NO: 3529580 - RNA, 15 nt, Pseudomonas putida KT2440
cagcucauccaggcu

SEQ ID NO: 3529581 - RNA, 18 nt, Pseudomonas putida KT2440
cagcucauccaggcugca

SEQ ID NO: 3529582 - RNA, 19 nt, Pseudomonas putida KT2440
cagcucauccaggcugcac

SEQ ID NO: 3529583 - RNA, 19 nt, Pseudomonas putida KT2440
cagcucauccaucaccugc

SEQ ID NO: 3529584 - RNA, 21 nt, Pseudomonas putida KT2440
cagcucauccaucaccugccc

SEQ ID NO: 3529585 - RNA, 22 nt, Pseudomonas putida KT2440
cagcucaugcgggucaagcugg

SEQ ID NO: 3529586 - RNA, 20 nt, Pseudomonas putida KT2440
cagcucaugggcuucgagca

SEQ ID NO: 3529587 - RNA, 20 nt, Pseudomonas putida KT2440
cagcuccacacucgacgcug

SEQ ID NO: 3529588 - RNA, 22 nt, Pseudomonas putida KT2440
cagcuccacacucgacgcugcc

SEQ ID NO: 3529589 - RNA, 22 nt, Pseudomonas putida KT2440
cagcuccaccaguugguaaaac

SEQ ID NO: 3529590 - RNA, 15 nt, Pseudomonas putida KT2440
cagcuccaccuucca

SEQ ID NO: 3529591 - RNA, 16 nt, Pseudomonas putida KT2440
cagcuccaccuuccac

SEQ ID NO: 3529592 - RNA, 14 nt, Pseudomonas putida KT2440
cagcuccacuggaa

SEQ ID NO: 3529593 - RNA, 17 nt, Pseudomonas putida KT2440
cagcuccacuggaacuc

SEQ ID NO: 3529594 - RNA, 14 nt, Pseudomonas putida KT2440
cagcuccagcacca

SEQ ID NO: 3529595 - RNA, 15 nt, Pseudomonas putida KT2440
cagcuccagcaccaa

SEQ ID NO: 3529596 - RNA, 15 nt, Pseudomonas putida KT2440
cagcuccagcaccuc

SEQ ID NO: 3529597 - RNA, 14 nt, Pseudomonas putida KT2440
cagcuccagcagug

SEQ ID NO: 3529598 - RNA, 15 nt, Pseudomonas putida KT2440
cagcuccagcagugc

SEQ ID NO: 3529599 - RNA, 14 nt, Pseudomonas putida KT2440
cagcuccagccaga

SEQ ID NO: 3529600 - RNA, 15 nt, Pseudomonas putida KT2440
cagcuccauaccaaa

SEQ ID NO: 3529601 - RNA, 13 nt, Pseudomonas putida KT2440
cagcuccauggca

SEQ ID NO: 3529602 - RNA, 17 nt, Pseudomonas putida KT2440
cagcucccgagccagga

SEQ ID NO: 3529603 - RNA, 16 nt, Pseudomonas putida KT2440
cagcucccgcgcaugc

SEQ ID NO: 3529604 - RNA, 20 nt, Pseudomonas putida KT2440
cagcuccgacaggcugugug

SEQ ID NO: 3529605 - RNA, 16 nt, Pseudomonas putida KT2440
cagcuccucugccgac

SEQ ID NO: 3529606 - RNA, 19 nt, Pseudomonas putida KT2440
cagcuccuggcccgcgccc

SEQ ID NO: 3529607 - RNA, 13 nt, Pseudomonas putida KT2440
cagcuccuggcuc

SEQ ID NO: 3529608 - RNA, 20 nt, Pseudomonas putida KT2440
cagcuccuucgcuucgcgca

SEQ ID NO: 3529609 - RNA, 17 nt, Pseudomonas putida KT2440
cagcucgacaacccgcg

SEQ ID NO: 3529610 - RNA, 19 nt, Pseudomonas putida KT2440
cagcucgagcaugcggaua

SEQ ID NO: 3529611 - RNA, 16 nt, Pseudomonas putida KT2440
cagcucgaucagcugg

SEQ ID NO: 3529612 - RNA, 15 nt, Pseudomonas putida KT2440
cagcucgaucagugc

SEQ ID NO: 3529613 - RNA, 17 nt, Pseudomonas putida KT2440
cagcucgaucucccgcg

SEQ ID NO: 3529614 - RNA, 13 nt, Pseudomonas putida KT2440
cagcucgauggcc

SEQ ID NO: 3529615 - RNA, 17 nt, Pseudomonas putida KT2440
cagcucgccaacaccgc

SEQ ID NO: 3529616 - RNA, 19 nt, Pseudomonas putida KT2440
cagcucgccaacaccgccc

SEQ ID NO: 3529617 - RNA, 20 nt, Pseudomonas putida KT2440
cagcucgccaacaccgcccc

SEQ ID NO: 3529618 - RNA, 20 nt, Pseudomonas putida KT2440
cagcucgcccggcacggcgu

SEQ ID NO: 3529619 - RNA, 15 nt, Pseudomonas putida KT2440
cagcucgccgugggg

SEQ ID NO: 3529620 - RNA, 18 nt, Pseudomonas putida KT2440
cagcucgcgcggguaaau

SEQ ID NO: 3529621 - RNA, 13 nt, Pseudomonas putida KT2440
cagcucggccacc

SEQ ID NO: 3529622 - RNA, 14 nt, Pseudomonas putida KT2440
cagcucggccaccc

SEQ ID NO: 3529623 - RNA, 16 nt, Pseudomonas putida KT2440
cagcucggccacccgc

SEQ ID NO: 3529624 - RNA, 17 nt, Pseudomonas putida KT2440
cagcucggccacccgcg

SEQ ID NO: 3529625 - RNA, 18 nt, Pseudomonas putida KT2440
cagcucggccgaugccag

SEQ ID NO: 3529626 - RNA, 23 nt, Pseudomonas putida KT2440
cagcucggccgaugccagguaca

SEQ ID NO: 3529627 - RNA, 23 nt, Pseudomonas putida KT2440
cagcucggccuugcgagccuggg

SEQ ID NO: 3529628 - RNA, 21 nt, Pseudomonas putida KT2440
cagcucgggaacauucucugc

SEQ ID NO: 3529629 - RNA, 16 nt, Pseudomonas putida KT2440
cagcucgucagccacc

SEQ ID NO: 3529630 - RNA, 23 nt, Pseudomonas putida KT2440
cagcucgucagccaccaccagcu

SEQ ID NO: 3529631 - RNA, 14 nt, Pseudomonas putida KT2440
cagcucgucgagca

SEQ ID NO: 3529632 - RNA, 16 nt, Pseudomonas putida KT2440
cagcucgucgagcaac

SEQ ID NO: 3529633 - RNA, 14 nt, Pseudomonas putida KT2440
cagcucguggguca

SEQ ID NO: 3529634 - RNA, 20 nt, Pseudomonas putida KT2440
cagcucgugggucaucuugc

SEQ ID NO: 3529635 - RNA, 12 nt, Pseudomonas putida KT2440
cagcucugcgac

SEQ ID NO: 3529636 - RNA, 21 nt, Pseudomonas putida KT2440
cagcucuggagguagccgugg

SEQ ID NO: 3529637 - RNA, 17 nt, Pseudomonas putida KT2440
cagcucuggcagcagug

SEQ ID NO: 3529638 - RNA, 19 nt, Pseudomonas putida KT2440
cagcucuucaucccugacc

SEQ ID NO: 3529639 - RNA, 21 nt, Pseudomonas putida KT2440
cagcucuucaucccugaccga

SEQ ID NO: 3529640 - RNA, 16 nt, Pseudomonas putida KT2440
cagcucuuccaguuuc

SEQ ID NO: 3529641 - RNA, 19 nt, Pseudomonas putida KT2440
cagcugaagugccaaggcu

SEQ ID NO: 3529642 - RNA, 17 nt, Pseudomonas putida KT2440
cagcugagcgccaucca

SEQ ID NO: 3529643 - RNA, 20 nt, Pseudomonas putida KT2440
cagcugagcgccauccaccu

SEQ ID NO: 3529644 - RNA, 21 nt, Pseudomonas putida KT2440
cagcugagcgccauccaccug

SEQ ID NO: 3529645 - RNA, 12 nt, Pseudomonas putida KT2440
cagcugaucgcc

SEQ ID NO: 3529646 - RNA, 23 nt, Pseudomonas putida KT2440
cagcugaucgccgucgaccaggc

SEQ ID NO: 3529647 - RNA, 22 nt, Pseudomonas putida KT2440
cagcugcaacagaaaaugcccg

SEQ ID NO: 3529648 - RNA, 14 nt, Pseudomonas putida KT2440
cagcugcaacagcg

SEQ ID NO: 3529649 - RNA, 16 nt, Pseudomonas putida KT2440
cagcugcaacagcggc

SEQ ID NO: 3529650 - RNA, 16 nt, Pseudomonas putida KT2440
cagcugcacaucucca

SEQ ID NO: 3529651 - RNA, 18 nt, Pseudomonas putida KT2440
cagcugcaccaccugcuc

SEQ ID NO: 3529652 - RNA, 18 nt, Pseudomonas putida KT2440
cagcugcauauaccgcgc

SEQ ID NO: 3529653 - RNA, 22 nt, Pseudomonas putida KT2440
cagcugcauauaccgcgcacgc

SEQ ID NO: 3529654 - RNA, 17 nt, Pseudomonas putida KT2440
cagcugcauuggcggca

SEQ ID NO: 3529655 - RNA, 22 nt, Pseudomonas putida KT2440
cagcugcauuggcggcaggcgc

SEQ ID NO: 3529656 - RNA, 23 nt, Pseudomonas putida KT2440
cagcugccacucuucaccauggg

SEQ ID NO: 3529657 - RNA, 18 nt, Pseudomonas putida KT2440
cagcugccauacagccag

SEQ ID NO: 3529658 - RNA, 23 nt, Pseudomonas putida KT2440
cagcugccauacagccagaaagc

SEQ ID NO: 3529659 - RNA, 20 nt, Pseudomonas putida KT2440
cagcugccauuucuucagca

SEQ ID NO: 3529660 - RNA, 22 nt, Pseudomonas putida KT2440
cagcugccauuucuucagcagg

SEQ ID NO: 3529661 - RNA, 23 nt, Pseudomonas putida KT2440
cagcugccggaacguuuccagca

SEQ ID NO: 3529662 - RNA, 17 nt, Pseudomonas putida KT2440
cagcugccggccagcgc

SEQ ID NO: 3529663 - RNA, 18 nt, Pseudomonas putida KT2440
cagcugccggccagcgcc

SEQ ID NO: 3529664 - RNA, 19 nt, Pseudomonas putida KT2440
cagcugccggccagcgccu

SEQ ID NO: 3529665 - RNA, 11 nt, Pseudomonas putida KT2440
cagcugcgcac

SEQ ID NO: 3529666 - RNA, 14 nt, Pseudomonas putida KT2440
cagcugcgccagcc

SEQ ID NO: 3529667 - RNA, 13 nt, Pseudomonas putida KT2440
cagcugcgcugcc

SEQ ID NO: 3529668 - RNA, 14 nt, Pseudomonas putida KT2440
cagcugcggcuggg

SEQ ID NO: 3529669 - RNA, 21 nt, Pseudomonas putida KT2440
cagcugcucguacgaguugcc

SEQ ID NO: 3529670 - RNA, 17 nt, Pseudomonas putida KT2440
cagcugcugcggcaccu

SEQ ID NO: 3529671 - RNA, 20 nt, Pseudomonas putida KT2440
cagcugcugcggcaccucgu

SEQ ID NO: 3529672 - RNA, 20 nt, Pseudomonas putida KT2440
cagcuggagacgaacagcgc

SEQ ID NO: 3529673 - RNA, 23 nt, Pseudomonas putida KT2440
cagcuggagacgaacagcgccgc

SEQ ID NO: 3529674 - RNA, 14 nt, Pseudomonas putida KT2440
cagcuggcaaugca

SEQ ID NO: 3529675 - RNA, 13 nt, Pseudomonas putida KT2440
cagcuggccaccu

SEQ ID NO: 3529676 - RNA, 12 nt, Pseudomonas putida KT2440
cagcuggccuuc

SEQ ID NO: 3529677 - RNA, 14 nt, Pseudomonas putida KT2440
cagcuggccuugcg

SEQ ID NO: 3529678 - RNA, 22 nt, Pseudomonas putida KT2440
caggauggcaaagcgcagcaau

SEQ ID NO: 3529679 - RNA, 17 nt, Pseudomonas putida KT2440
caggauggcauuggcca

SEQ ID NO: 3529680 - RNA, 19 nt, Pseudomonas putida KT2440
caggauggcauuggccaac

SEQ ID NO: 3529681 - RNA, 15 nt, Pseudomonas putida KT2440
caggauggccgcagg

SEQ ID NO: 3529682 - RNA, 19 nt, Pseudomonas putida KT2440
caggauggccgcaggccca

SEQ ID NO: 3529683 - RNA, 15 nt, Pseudomonas putida KT2440
caggauugccgcagc

SEQ ID NO: 3529684 - RNA, 18 nt, Pseudomonas putida KT2440
caggauugccgcagcugc

SEQ ID NO: 3529685 - RNA, 21 nt, Pseudomonas putida KT2440
caggauugccgcagcugcggu

SEQ ID NO: 3529686 - RNA, 14 nt, Pseudomonas putida KT2440
caggauuggccgca

SEQ ID NO: 3529687 - RNA, 16 nt, Pseudomonas putida KT2440
caggcaaaaaaaaggg

SEQ ID NO: 3529688 - RNA, 21 nt, Pseudomonas putida KT2440
caggcaaacgcggucagcgaa

SEQ ID NO: 3529689 - RNA, 13 nt, Pseudomonas putida KT2440
caggcaaccgcau

SEQ ID NO: 3529690 - RNA, 19 nt, Pseudomonas putida KT2440
caggcaauggcgaaccgcu

SEQ ID NO: 3529691 - RNA, 23 nt, Pseudomonas putida KT2440
caggcaauugugccgcgccagcu

SEQ ID NO: 3529692 - RNA, 13 nt, Pseudomonas putida KT2440
caggcacaggcca

SEQ ID NO: 3529693 - RNA, 15 nt, Pseudomonas putida KT2440
caggcacaggccagc

SEQ ID NO: 3529694 - RNA, 16 nt, Pseudomonas putida KT2440
caggcacaggccagcc

SEQ ID NO: 3529695 - RNA, 17 nt, Pseudomonas putida KT2440
caggcacaggcccagca

SEQ ID NO: 3529696 - RNA, 14 nt, Pseudomonas putida KT2440
caggcacaggcgca

SEQ ID NO: 3529697 - RNA, 18 nt, Pseudomonas putida KT2440
caggcacaggcgcacacg

SEQ ID NO: 3529698 - RNA, 16 nt, Pseudomonas putida KT2440
caggcaccagcgcugc

SEQ ID NO: 3529699 - RNA, 16 nt, Pseudomonas putida KT2440
caggcacccagccagc

SEQ ID NO: 3529700 - RNA, 22 nt, Pseudomonas putida KT2440
caggcaccgaguaccgucggca

SEQ ID NO: 3529701 - RNA, 19 nt, Pseudomonas putida KT2440
caggcacgacugaacaccu

SEQ ID NO: 3529702 - RNA, 20 nt, Pseudomonas putida KT2440
caggcacgcccgcucccaca

SEQ ID NO: 3529703 - RNA, 20 nt, Pseudomonas putida KT2440
caggcacggcaccagcacca

SEQ ID NO: 3529704 - RNA, 13 nt, Pseudomonas putida KT2440
caggcacuggcca

SEQ ID NO: 3529705 - RNA, 14 nt, Pseudomonas putida KT2440
caggcacuggccag

SEQ ID NO: 3529706 - RNA, 20 nt, Pseudomonas putida KT2440
caggcacuggccagcggcgc

SEQ ID NO: 3529707 - RNA, 14 nt, Pseudomonas putida KT2440
caggcagaccacgc

SEQ ID NO: 3529708 - RNA, 13 nt, Pseudomonas putida KT2440
caggcagaucgaa

SEQ ID NO: 3529709 - RNA, 18 nt, Pseudomonas putida KT2440
caggcagaucgaaagaca

SEQ ID NO: 3529710 - RNA, 23 nt, Pseudomonas putida KT2440
caggcagcacaugccacgcacca

SEQ ID NO: 3529711 - RNA, 15 nt, Pseudomonas putida KT2440
caggcagccuccagg

SEQ ID NO: 3529712 - RNA, 19 nt, Pseudomonas putida KT2440
caggcagccugccagguca

SEQ ID NO: 3529713 - RNA, 15 nt, Pseudomonas putida KT2440
caggcagcgauggcc

SEQ ID NO: 3529714 - RNA, 21 nt, Pseudomonas putida KT2440
caggcagcgauggccgugcaa

SEQ ID NO: 3529715 - RNA, 16 nt, Pseudomonas putida KT2440
caggcagcucgaugua

SEQ ID NO: 3529716 - RNA, 16 nt, Pseudomonas putida KT2440
caggcaggaacuggcu

SEQ ID NO: 3529717 - RNA, 19 nt, Pseudomonas putida KT2440
caggcaggaacuggcugcc

SEQ ID NO: 3529718 - RNA, 14 nt, Pseudomonas putida KT2440
caggcaggccagca

SEQ ID NO: 3529719 - RNA, 20 nt, Pseudomonas putida KT2440
caggcaggccagcacggcca

SEQ ID NO: 3529720 - RNA, 17 nt, Pseudomonas putida KT2440
caggcaguaggccaccg

SEQ ID NO: 3529721 - RNA, 21 nt, Pseudomonas putida KT2440
caggcaguaggugcaggcgua

SEQ ID NO: 3529722 - RNA, 16 nt, Pseudomonas putida KT2440
caggcagucuucaagc

SEQ ID NO: 3529723 - RNA, 16 nt, Pseudomonas putida KT2440
caggcauacaggacca

SEQ ID NO: 3529724 - RNA, 18 nt, Pseudomonas putida KT2440
caggcauacaggaccagg

SEQ ID NO: 3529725 - RNA, 19 nt, Pseudomonas putida KT2440
caggcauacaggaccaggc

SEQ ID NO: 3529726 - RNA, 20 nt, Pseudomonas putida KT2440
caggcauacaggaccaggcc

SEQ ID NO: 3529727 - RNA, 17 nt, Pseudomonas putida KT2440
caggcauaccgcaacac

SEQ ID NO: 3529728 - RNA, 15 nt, Pseudomonas putida KT2440
caggcauacgaggcc

SEQ ID NO: 3529729 - RNA, 20 nt, Pseudomonas putida KT2440
caggcaucgaacgccgccug

SEQ ID NO: 3529730 - RNA, 15 nt, Pseudomonas putida KT2440
caggcaugccagcag

SEQ ID NO: 3529731 - RNA, 19 nt, Pseudomonas putida KT2440
caggcaugccagcagcugg

SEQ ID NO: 3529732 - RNA, 22 nt, Pseudomonas putida KT2440
caggcauuccccggucagcaug

SEQ ID NO: 3529733 - RNA, 20 nt, Pseudomonas putida KT2440
caggcauugcccgcgauagc

SEQ ID NO: 3529734 - RNA, 21 nt, Pseudomonas putida KT2440
caggcauuguugcaacgcagc

SEQ ID NO: 3529735 - RNA, 22 nt, Pseudomonas putida KT2440
caggcauuguugcaacgcagcg

SEQ ID NO: 3529736 - RNA, 23 nt, Pseudomonas putida KT2440
caggcauuguugcaacgcagcgc

SEQ ID NO: 3529737 - RNA, 22 nt, Pseudomonas putida KT2440
caggccaacaaaaaaagcccgc

SEQ ID NO: 3529738 - RNA, 23 nt, Pseudomonas putida KT2440
caggccaacaaaaaaagcccgca

SEQ ID NO: 3529739 - RNA, 18 nt, Pseudomonas putida KT2440
caggccaaggaacguuuc

SEQ ID NO: 3529740 - RNA, 20 nt, Pseudomonas putida KT2440
caggccaaguacggccagca

SEQ ID NO: 3529741 - RNA, 22 nt, Pseudomonas putida KT2440
caggccaaguacggccagcagg

SEQ ID NO: 3529742 - RNA, 17 nt, Pseudomonas putida KT2440
caggccaaugcccaugc

SEQ ID NO: 3529743 - RNA, 21 nt, Pseudomonas putida KT2440
caggccaaugcccaugcccag

SEQ ID NO: 3529744 - RNA, 15 nt, Pseudomonas putida KT2440
caggccaccggcagc

SEQ ID NO: 3529745 - RNA, 16 nt, Pseudomonas putida KT2440
caggccaccggcagca

SEQ ID NO: 3529746 - RNA, 18 nt, Pseudomonas putida KT2440
caggccaccggcagcacc

SEQ ID NO: 3529747 - RNA, 19 nt, Pseudomonas putida KT2440
caggccaccggcagcaccu

SEQ ID NO: 3529748 - RNA, 20 nt, Pseudomonas putida KT2440
caggccaccggcagcaccug

SEQ ID NO: 3529749 - RNA, 21 nt, Pseudomonas putida KT2440
caggccaccggcagcaccugc

SEQ ID NO: 3529750 - RNA, 22 nt, Pseudomonas putida KT2440
caggccaccggcagcaccugcc

SEQ ID NO: 3529751 - RNA, 14 nt, Pseudomonas putida KT2440
caggccacggucca

SEQ ID NO: 3529752 - RNA, 15 nt, Pseudomonas putida KT2440
caggccagccaggua

SEQ ID NO: 3529753 - RNA, 16 nt, Pseudomonas putida KT2440
caggccagcgcacagc

SEQ ID NO: 3529754 - RNA, 23 nt, Pseudomonas putida KT2440
caggccagcgucguguucgccug

SEQ ID NO: 3529755 - RNA, 19 nt, Pseudomonas putida KT2440
caggccagcuucgacgaag

SEQ ID NO: 3529756 - RNA, 20 nt, Pseudomonas putida KT2440
caggccaguuccucggccug

SEQ ID NO: 3529757 - RNA, 16 nt, Pseudomonas putida KT2440
caggccauacagggcc

SEQ ID NO: 3529758 - RNA, 23 nt, Pseudomonas putida KT2440
caggccauacagggccuggcgcg

SEQ ID NO: 3529759 - RNA, 20 nt, Pseudomonas putida KT2440
caggccauauugcugagcca

SEQ ID NO: 3529760 - RNA, 15 nt, Pseudomonas putida KT2440
caggccaucagcagc

SEQ ID NO: 3529761 - RNA, 16 nt, Pseudomonas putida KT2440
caggccaucagcagcu

SEQ ID NO: 3529762 - RNA, 21 nt, Pseudomonas putida KT2440
caggccaucuaagccuccaga

SEQ ID NO: 3529763 - RNA, 16 nt, Pseudomonas putida KT2440
caggccauggugcacg

SEQ ID NO: 3529764 - RNA, 21 nt, Pseudomonas putida KT2440
caggccauggugcacgccagc

SEQ ID NO: 3529765 - RNA, 14 nt, Pseudomonas putida KT2440
caggcccaccaccg

SEQ ID NO: 3529766 - RNA, 16 nt, Pseudomonas putida KT2440
caggcccaccaccggu

SEQ ID NO: 3529767 - RNA, 19 nt, Pseudomonas putida KT2440
caggcccaccagucugcuc

SEQ ID NO: 3529768 - RNA, 22 nt, Pseudomonas putida KT2440
caggcccacggcguccaggccc

SEQ ID NO: 3529769 - RNA, 13 nt, Pseudomonas putida KT2440
caggcccagcagg

SEQ ID NO: 3529770 - RNA, 14 nt, Pseudomonas putida KT2440
caggcccagcaggu

SEQ ID NO: 3529771 - RNA, 21 nt, Pseudomonas putida KT2440
caggcccagcagguacagcac

SEQ ID NO: 3529772 - RNA, 13 nt, Pseudomonas putida KT2440
caggcccagcaug

SEQ ID NO: 3529773 - RNA, 14 nt, Pseudomonas putida KT2440
caggcccagccccg

SEQ ID NO: 3529774 - RNA, 15 nt, Pseudomonas putida KT2440
caggcccagccccgc

SEQ ID NO: 3529775 - RNA, 13 nt, Pseudomonas putida KT2440
caggcccagccgg

SEQ ID NO: 3529776 - RNA, 14 nt, Pseudomonas putida KT2440
caggcccagccggg

SEQ ID NO: 3529777 - RNA, 23 nt, Pseudomonas putida KT2440
caggcccauuucgcgggucaggg

SEQ ID NO: 3529778 - RNA, 18 nt, Pseudomonas putida KT2440
caggccccaggccaucca

SEQ ID NO: 3529779 - RNA, 17 nt, Pseudomonas putida KT2440
caggccccagucauccg

SEQ ID NO: 3529780 - RNA, 20 nt, Pseudomonas putida KT2440
caggccccugcaacagggcg

SEQ ID NO: 3529781 - RNA, 18 nt, Pseudomonas putida KT2440
caggcccgccaccgccuc

SEQ ID NO: 3529782 - RNA, 17 nt, Pseudomonas putida KT2440
caggcccgccagagcau

SEQ ID NO: 3529783 - RNA, 18 nt, Pseudomonas putida KT2440
caggcguaacucagcaac

SEQ ID NO: 3529784 - RNA, 21 nt, Pseudomonas putida KT2440
caggcguaacucagcaacgcu

SEQ ID NO: 3529785 - RNA, 19 nt, Pseudomonas putida KT2440
caggcguacaucagccucg

SEQ ID NO: 3529786 - RNA, 18 nt, Pseudomonas putida KT2440
caggcguggaaaaggcgc

SEQ ID NO: 3529787 - RNA, 17 nt, Pseudomonas putida KT2440
caggcguguuagccgug

SEQ ID NO: 3529788 - RNA, 21 nt, Pseudomonas putida KT2440
caggcguguuagccguggggc

SEQ ID NO: 3529789 - RNA, 18 nt, Pseudomonas putida KT2440
caggcguucaucgaaggc

SEQ ID NO: 3529790 - RNA, 19 nt, Pseudomonas putida KT2440
caggcguucaucgaaggcc

SEQ ID NO: 3529791 - RNA, 16 nt, Pseudomonas putida KT2440
caggcguucgucaagc

SEQ ID NO: 3529792 - RNA, 18 nt, Pseudomonas putida KT2440
caggcguucgucaagcuc

SEQ ID NO: 3529793 - RNA, 22 nt, Pseudomonas putida KT2440
caggcguuuuuccaugcguucg

SEQ ID NO: 3529794 - RNA, 18 nt, Pseudomonas putida KT2440
caggcuaauggcgcgccu

SEQ ID NO: 3529795 - RNA, 15 nt, Pseudomonas putida KT2440
caggcuacgcagcac

SEQ ID NO: 3529796 - RNA, 20 nt, Pseudomonas putida KT2440
caggcuacgcagcacccggu

SEQ ID NO: 3529797 - RNA, 20 nt, Pseudomonas putida KT2440
caggcuagccggucaccgac

SEQ ID NO: 3529798 - RNA, 16 nt, Pseudomonas putida KT2440
caggcuaucgaggggc

SEQ ID NO: 3529799 - RNA, 21 nt, Pseudomonas putida KT2440
caggcuaugccggucagcagc

SEQ ID NO: 3529800 - RNA, 13 nt, Pseudomonas putida KT2440
caggcucagggca

SEQ ID NO: 3529801 - RNA, 13 nt, Pseudomonas putida KT2440
caggcucagggcc

SEQ ID NO: 3529802 - RNA, 14 nt, Pseudomonas putida KT2440
caggcucagucgca

SEQ ID NO: 3529803 - RNA, 18 nt, Pseudomonas putida KT2440
caggcucaucuaccagcu

SEQ ID NO: 3529804 - RNA, 18 nt, Pseudomonas putida KT2440
caggcuccaaagccagcg

SEQ ID NO: 3529805 - RNA, 16 nt, Pseudomonas putida KT2440
caggcucgacggcgca

SEQ ID NO: 3529806 - RNA, 13 nt, Pseudomonas putida KT2440
caggcucggccac

SEQ ID NO: 3529807 - RNA, 19 nt, Pseudomonas putida KT2440
caggcucucagcccauuuc

SEQ ID NO: 3529808 - RNA, 23 nt, Pseudomonas putida KT2440
caggcucucagcccauuucaccu

SEQ ID NO: 3529809 - RNA, 14 nt, Pseudomonas putida KT2440
caggcucuccagcc

SEQ ID NO: 3529810 - RNA, 16 nt, Pseudomonas putida KT2440
caggcucuccagccgc

SEQ ID NO: 3529811 - RNA, 15 nt, Pseudomonas putida KT2440
caggcucuccucauc

SEQ ID NO: 3529812 - RNA, 23 nt, Pseudomonas putida KT2440
caggcucuccucaucgaugcccg

SEQ ID NO: 3529813 - RNA, 22 nt, Pseudomonas putida KT2440
caggcucugaaugucagcgcuc

SEQ ID NO: 3529814 - RNA, 17 nt, Pseudomonas putida KT2440
caggcucugcuccagcu

SEQ ID NO: 3529815 - RNA, 20 nt, Pseudomonas putida KT2440
caggcucugcuccagcugcu

SEQ ID NO: 3529816 - RNA, 15 nt, Pseudomonas putida KT2440
caggcucuugaacug

SEQ ID NO: 3529817 - RNA, 23 nt, Pseudomonas putida KT2440
caggcucuugaacugggcaucca

SEQ ID NO: 3529818 - RNA, 12 nt, Pseudomonas putida KT2440
caggcugacccg

SEQ ID NO: 3529819 - RNA, 21 nt, Pseudomonas putida KT2440
caggcugacguugucauggcu

SEQ ID NO: 3529820 - RNA, 13 nt, Pseudomonas putida KT2440
caggcugagcaga

SEQ ID NO: 3529821 - RNA, 13 nt, Pseudomonas putida KT2440
caggcugagcccg

SEQ ID NO: 3529822 - RNA, 17 nt, Pseudomonas putida KT2440
caggcugaucaccgccg

SEQ ID NO: 3529823 - RNA, 18 nt, Pseudomonas putida KT2440
caggcugaucaccgccgc

SEQ ID NO: 3529824 - RNA, 20 nt, Pseudomonas putida KT2440
caggcugaucaccgccgcca

SEQ ID NO: 3529825 - RNA, 18 nt, Pseudomonas putida KT2440
caggcugauggauuccuc

SEQ ID NO: 3529826 - RNA, 22 nt, Pseudomonas putida KT2440
caggcugauguugaugugcggc

SEQ ID NO: 3529827 - RNA, 16 nt, Pseudomonas putida KT2440
caggcugcacuggcau

SEQ ID NO: 3529828 - RNA, 17 nt, Pseudomonas putida KT2440
caggcugccgccgaaca

SEQ ID NO: 3529829 - RNA, 15 nt, Pseudomonas putida KT2440
caggcugcgcccgca

SEQ ID NO: 3529830 - RNA, 19 nt, Pseudomonas putida KT2440
caggcugcgcccgcacagc

SEQ ID NO: 3529831 - RNA, 23 nt, Pseudomonas putida KT2440
caggcugcgcccgcacagcacgu

SEQ ID NO: 3529832 - RNA, 14 nt, Pseudomonas putida KT2440
caggcugcgccgcc

SEQ ID NO: 3529833 - RNA, 19 nt, Pseudomonas putida KT2440
caggcugcgcgccauggcg

SEQ ID NO: 3529834 - RNA, 18 nt, Pseudomonas putida KT2440
caggcugcgugccugcug

SEQ ID NO: 3529835 - RNA, 21 nt, Pseudomonas putida KT2440
caggcuggauaagaucacugc

SEQ ID NO: 3529836 - RNA, 13 nt, Pseudomonas putida KT2440
caggcuggccacc

SEQ ID NO: 3529837 - RNA, 15 nt, Pseudomonas putida KT2440
caggcuggccaccau

SEQ ID NO: 3529838 - RNA, 21 nt, Pseudomonas putida KT2440
caggcuggccaccaugaacag

SEQ ID NO: 3529839 - RNA, 14 nt, Pseudomonas putida KT2440
caggcuggccagca

SEQ ID NO: 3529840 - RNA, 17 nt, Pseudomonas putida KT2440
caggcuggccagcaagu

SEQ ID NO: 3529841 - RNA, 12 nt, Pseudomonas putida KT2440
caggcuggcgcu

SEQ ID NO: 3529842 - RNA, 19 nt, Pseudomonas putida KT2440
caggcuggcggccaaugcu

SEQ ID NO: 3529843 - RNA, 22 nt, Pseudomonas putida KT2440
caggcuggcgggguggccggca

SEQ ID NO: 3529844 - RNA, 21 nt, Pseudomonas putida KT2440
caggcuggguggugucgacca

SEQ ID NO: 3529845 - RNA, 22 nt, Pseudomonas putida KT2440
caggcuguccacaccaaaguca

SEQ ID NO: 3529846 - RNA, 17 nt, Pseudomonas putida KT2440
caggcugucgaacaggc

SEQ ID NO: 3529847 - RNA, 24 nt, Pseudomonas putida KT2440
caggcugucggcgucggccaugcc

SEQ ID NO: 3529848 - RNA, 15 nt, Pseudomonas putida KT2440
caggcuguguggccg

SEQ ID NO: 3529849 - RNA, 19 nt, Pseudomonas putida KT2440
caggcuguuguacggcagc

SEQ ID NO: 3529850 - RNA, 18 nt, Pseudomonas putida KT2440
caggcuuacuuggucacc

SEQ ID NO: 3529851 - RNA, 13 nt, Pseudomonas putida KT2440
caggcuucaaggc

SEQ ID NO: 3529852 - RNA, 15 nt, Pseudomonas putida KT2440
caggcuucaaggcca

SEQ ID NO: 3529853 - RNA, 19 nt, Pseudomonas putida KT2440
caggcuugaagcugcgcuc

SEQ ID NO: 3529854 - RNA, 15 nt, Pseudomonas putida KT2440
caggcuugccagcuu

SEQ ID NO: 3529855 - RNA, 20 nt, Pseudomonas putida KT2440
caggcuugcuucuugaagcg

SEQ ID NO: 3529856 - RNA, 14 nt, Pseudomonas putida KT2440
caggcuuggcgaac

SEQ ID NO: 3529857 - RNA, 19 nt, Pseudomonas putida KT2440
caggcuuggcgugcggcgu

SEQ ID NO: 3529858 - RNA, 22 nt, Pseudomonas putida KT2440
caggcuuguccuugagcgccgc

SEQ ID NO: 3529859 - RNA, 20 nt, Pseudomonas putida KT2440
caggcuuuccagguccugcu

SEQ ID NO: 3529860 - RNA, 23 nt, Pseudomonas putida KT2440
caggcuuucggccacccggacca

SEQ ID NO: 3529861 - RNA, 17 nt, Pseudomonas putida KT2440
cagggaacugcgcgagc

SEQ ID NO: 3529862 - RNA, 12 nt, Pseudomonas putida KT2440
cagggaagggca

SEQ ID NO: 3529863 - RNA, 21 nt, Pseudomonas putida KT2440
cagggaagggcaaugaucagc

SEQ ID NO: 3529864 - RNA, 15 nt, Pseudomonas putida KT2440
cagggaccucacagc

SEQ ID NO: 3529865 - RNA, 22 nt, Pseudomonas putida KT2440
cagggacgaacccuugaccuug

SEQ ID NO: 3529866 - RNA, 16 nt, Pseudomonas putida KT2440
cagggauacugcugaa

SEQ ID NO: 3529867 - RNA, 21 nt, Pseudomonas putida KT2440
cagggauacugcugaaccuga

SEQ ID NO: 3529868 - RNA, 23 nt, Pseudomonas putida KT2440
cagggauuccuuggucaggucga

SEQ ID NO: 3529869 - RNA, 17 nt, Pseudomonas putida KT2440
cagggcaaaaugcagca

SEQ ID NO: 3529870 - RNA, 19 nt, Pseudomonas putida KT2440
cagggcaaacaccuugccc

SEQ ID NO: 3529871 - RNA, 23 nt, Pseudomonas putida KT2440
cagggcaaacaccuugccccgca

SEQ ID NO: 3529872 - RNA, 13 nt, Pseudomonas putida KT2440
cagggcaaagccc

SEQ ID NO: 3529873 - RNA, 20 nt, Pseudomonas putida KT2440
cagggcaaagcccaguucuu

SEQ ID NO: 3529874 - RNA, 13 nt, Pseudomonas putida KT2440
cagggcaacggca

SEQ ID NO: 3529875 - RNA, 15 nt, Pseudomonas putida KT2440
cagggcaaucgccaa

SEQ ID NO: 3529876 - RNA, 16 nt, Pseudomonas putida KT2440
cagggcaauggcguca

SEQ ID NO: 3529877 - RNA, 23 nt, Pseudomonas putida KT2440
cagggcaauggcgucacagacau

SEQ ID NO: 3529878 - RNA, 22 nt, Pseudomonas putida KT2440
cagggcaccaguugcaggucgg

SEQ ID NO: 3529879 - RNA, 15 nt, Pseudomonas putida KT2440
cagggcacgccaauc

SEQ ID NO: 3529880 - RNA, 15 nt, Pseudomonas putida KT2440
cagggcagcaacgcc

SEQ ID NO: 3529881 - RNA, 13 nt, Pseudomonas putida KT2440
cagggcaggcuga

SEQ ID NO: 3529882 - RNA, 16 nt, Pseudomonas putida KT2440
cagggcaggggacagc

SEQ ID NO: 3529883 - RNA, 20 nt, Pseudomonas putida KT2440
cagggcaucgaccaguacga

SEQ ID NO: 3529884 - RNA, 14 nt, Pseudomonas putida KT2440
cagggcaucggaca

SEQ ID NO: 3529885 - RNA, 15 nt, Pseudomonas putida KT2440
cagggcaucggacag

SEQ ID NO: 3529886 - RNA, 15 nt, Pseudomonas putida KT2440
cagggcaucggcgug

SEQ ID NO: 3529887 - RNA, 18 nt, Pseudomonas putida KT2440
cagggccaggccgauggc

SEQ ID NO: 3529888 - RNA, 21 nt, Pseudomonas putida KT2440
cagguaggcgccacgccgcca

SEQ ID NO: 3529889 - RNA, 21 nt, Pseudomonas putida KT2440
cagguaggugcugaccgccug

SEQ ID NO: 3529890 - RNA, 23 nt, Pseudomonas putida KT2440
cagguaggugcugaccgccugcg

SEQ ID NO: 3529891 - RNA, 20 nt, Pseudomonas putida KT2440
cagguagguuuucggcugga

SEQ ID NO: 3529892 - RNA, 19 nt, Pseudomonas putida KT2440
cagguaguacggcaggcga

SEQ ID NO: 3529893 - RNA, 22 nt, Pseudomonas putida KT2440
cagguaguucacuggccagcag

SEQ ID NO: 3529894 - RNA, 14 nt, Pseudomonas putida KT2440
cagguaguucaugu

SEQ ID NO: 3529895 - RNA, 22 nt, Pseudomonas putida KT2440
cagguauagggcuacguggacc

SEQ ID NO: 3529896 - RNA, 23 nt, Pseudomonas putida KT2440
cagguauccggguccauccccgc

SEQ ID NO: 3529897 - RNA, 16 nt, Pseudomonas putida KT2440
cagguaugugagcugc

SEQ ID NO: 3529898 - RNA, 19 nt, Pseudomonas putida KT2440
cagguaugugagcugcgcg

SEQ ID NO: 3529899 - RNA, 16 nt, Pseudomonas putida KT2440
caggucaaucuugugg

SEQ ID NO: 3529900 - RNA, 16 nt, Pseudomonas putida KT2440
caggucaccgcccagc

SEQ ID NO: 3529901 - RNA, 13 nt, Pseudomonas putida KT2440
caggucagcacgc

SEQ ID NO: 3529902 - RNA, 20 nt, Pseudomonas putida KT2440
caggucagcgcucaaaaaaa

SEQ ID NO: 3529903 - RNA, 18 nt, Pseudomonas putida KT2440
caggucagcguugccgau

SEQ ID NO: 3529904 - RNA, 19 nt, Pseudomonas putida KT2440
caggucauaguucuggcug

SEQ ID NO: 3529905 - RNA, 22 nt, Pseudomonas putida KT2440
caggucauaguucuggcugccu

SEQ ID NO: 3529906 - RNA, 20 nt, Pseudomonas putida KT2440
caggucaucgaagaucagca

SEQ ID NO: 3529907 - RNA, 14 nt, Pseudomonas putida KT2440
caggugcgcaggcu

SEQ ID NO: 3529908 - RNA, 12 nt, Pseudomonas putida KT2440
caggugcgcgcg

SEQ ID NO: 3529909 - RNA, 19 nt, Pseudomonas putida KT2440
caggugcgcgcgcgacagc

SEQ ID NO: 3529910 - RNA, 20 nt, Pseudomonas putida KT2440
caggugcgcgcgcgacagca

SEQ ID NO: 3529911 - RNA, 13 nt, Pseudomonas putida KT2440
caggugcucacca

SEQ ID NO: 3529912 - RNA, 15 nt, Pseudomonas putida KT2440
caggugcucagccac

SEQ ID NO: 3529913 - RNA, 19 nt, Pseudomonas putida KT2440
caggugcuugcggaacacc

SEQ ID NO: 3529914 - RNA, 14 nt, Pseudomonas putida KT2440
cagguggaucagcc

SEQ ID NO: 3529915 - RNA, 19 nt, Pseudomonas putida KT2440
cagguggaucagccgcgcu

SEQ ID NO: 3529916 - RNA, 18 nt, Pseudomonas putida KT2440
caggugguaguccuugcc

SEQ ID NO: 3529917 - RNA, 14 nt, Pseudomonas putida KT2440
caggugugccacuu

SEQ ID NO: 3529918 - RNA, 16 nt, Pseudomonas putida KT2440
caggugugccacuuca

SEQ ID NO: 3529919 - RNA, 16 nt, Pseudomonas putida KT2440
cagguguggaaacccg

SEQ ID NO: 3529920 - RNA, 16 nt, Pseudomonas putida KT2440
cagguguggcucagcu

SEQ ID NO: 3529921 - RNA, 22 nt, Pseudomonas putida KT2440
cagguguggcucagcucggcau

SEQ ID NO: 3529922 - RNA, 21 nt, Pseudomonas putida KT2440
cagguguguagguucacagaa

SEQ ID NO: 3529923 - RNA, 17 nt, Pseudomonas putida KT2440
cagguguuccagcacgu

SEQ ID NO: 3529924 - RNA, 23 nt, Pseudomonas putida KT2440
cagguguuguugcaaccaggcgc

SEQ ID NO: 3529925 - RNA, 23 nt, Pseudomonas putida KT2440
cagguuacgcaccagcuccaaca

SEQ ID NO: 3529926 - RNA, 14 nt, Pseudomonas putida KT2440
cagguuacuggcca

SEQ ID NO: 3529927 - RNA, 16 nt, Pseudomonas putida KT2440
cagguuacuggccaau

SEQ ID NO: 3529928 - RNA, 14 nt, Pseudomonas putida KT2440
cagguucaagccua

SEQ ID NO: 3529929 - RNA, 22 nt, Pseudomonas putida KT2440
cagguucaccguacccagguga

SEQ ID NO: 3529930 - RNA, 14 nt, Pseudomonas putida KT2440
cagguucacuucca

SEQ ID NO: 3529931 - RNA, 23 nt, Pseudomonas putida KT2440
cagguucacuuccacacggcggu

SEQ ID NO: 3529932 - RNA, 14 nt, Pseudomonas putida KT2440
cagguucagcagga

SEQ ID NO: 3529933 - RNA, 17 nt, Pseudomonas putida KT2440
cagguucgaauccugcu

SEQ ID NO: 3529934 - RNA, 23 nt, Pseudomonas putida KT2440
cagguucgaccaccgcaggugca

SEQ ID NO: 3529935 - RNA, 18 nt, Pseudomonas putida KT2440
cagguucgaccacugcag

SEQ ID NO: 3529936 - RNA, 23 nt, Pseudomonas putida KT2440
cagguucgaccacugcaggugca

SEQ ID NO: 3529937 - RNA, 15 nt, Pseudomonas putida KT2440
cagguucgaccagaa

SEQ ID NO: 3529938 - RNA, 18 nt, Pseudomonas putida KT2440
cagguucggcucacugac

SEQ ID NO: 3529939 - RNA, 23 nt, Pseudomonas putida KT2440
cagguucggguaguccuccaaca

SEQ ID NO: 3529940 - RNA, 20 nt, Pseudomonas putida KT2440
cagguucugaaucuggcucu

SEQ ID NO: 3529941 - RNA, 13 nt, Pseudomonas putida KT2440
cagguugaacagc

SEQ ID NO: 3529942 - RNA, 14 nt, Pseudomonas putida KT2440
cagguugaacagca

SEQ ID NO: 3529943 - RNA, 17 nt, Pseudomonas putida KT2440
cagguugaacagcagcg

SEQ ID NO: 3529944 - RNA, 20 nt, Pseudomonas putida KT2440
cagguugaacagcagcgccg

SEQ ID NO: 3529945 - RNA, 23 nt, Pseudomonas putida KT2440
cagguugaacagcagcgccgcca

SEQ ID NO: 3529946 - RNA, 18 nt, Pseudomonas putida KT2440
cagguugaccaacgccag

SEQ ID NO: 3529947 - RNA, 15 nt, Pseudomonas putida KT2440
cagguugauccagcc

SEQ ID NO: 3529948 - RNA, 16 nt, Pseudomonas putida KT2440
cagguugauccagccc

SEQ ID NO: 3529949 - RNA, 13 nt, Pseudomonas putida KT2440
cagguugcacagc

SEQ ID NO: 3529950 - RNA, 13 nt, Pseudomonas putida KT2440
cagguugcaccuc

SEQ ID NO: 3529951 - RNA, 14 nt, Pseudomonas putida KT2440
cagguugcccagca

SEQ ID NO: 3529952 - RNA, 17 nt, Pseudomonas putida KT2440
cagguugcccagcaugc

SEQ ID NO: 3529953 - RNA, 20 nt, Pseudomonas putida KT2440
cagguugcccucggccaccu

SEQ ID NO: 3529954 - RNA, 16 nt, Pseudomonas putida KT2440
cagguugccucaucac

SEQ ID NO: 3529955 - RNA, 18 nt, Pseudomonas putida KT2440
cagguugccucaucaccu

SEQ ID NO: 3529956 - RNA, 17 nt, Pseudomonas putida KT2440
cagguugcgcgccgcca

SEQ ID NO: 3529957 - RNA, 16 nt, Pseudomonas putida KT2440
cagguugcggccaucg

SEQ ID NO: 3529958 - RNA, 22 nt, Pseudomonas putida KT2440
cagguugcgugccucgcccagg

SEQ ID NO: 3529959 - RNA, 20 nt, Pseudomonas putida KT2440
cagguugcguugaccugcug

SEQ ID NO: 3529960 - RNA, 12 nt, Pseudomonas putida KT2440
cagguugcugcc

SEQ ID NO: 3529961 - RNA, 17 nt, Pseudomonas putida KT2440
cagguuggacagcgccc

SEQ ID NO: 3529962 - RNA, 22 nt, Pseudomonas putida KT2440
cagguuggagcggaacucgccc

SEQ ID NO: 3529963 - RNA, 16 nt, Pseudomonas putida KT2440
cagguuggccgccgcc

SEQ ID NO: 3529964 - RNA, 15 nt, Pseudomonas putida KT2440
cagguuggugcaauu

SEQ ID NO: 3529965 - RNA, 14 nt, Pseudomonas putida KT2440
cagguugguggugc

SEQ ID NO: 3529966 - RNA, 17 nt, Pseudomonas putida KT2440
cagguuguucaccuugg

SEQ ID NO: 3529967 - RNA, 18 nt, Pseudomonas putida KT2440
cagguuguucaccuuggg

SEQ ID NO: 3529968 - RNA, 16 nt, Pseudomonas putida KT2440
cagguuuaccggccgc

SEQ ID NO: 3529969 - RNA, 18 nt, Pseudomonas putida KT2440
cagguuuggguuggcuuu

SEQ ID NO: 3529970 - RNA, 15 nt, Pseudomonas putida KT2440
cagguuuuccagccc

SEQ ID NO: 3529971 - RNA, 10 nt, Pseudomonas putida KT2440
caguaaaaac

SEQ ID NO: 3529972 - RNA, 20 nt, Pseudomonas putida KT2440
caguaaaaacuggccagcag

SEQ ID NO: 3529973 - RNA, 18 nt, Pseudomonas putida KT2440
caguaagauacgcgcaga

SEQ ID NO: 3529974 - RNA, 21 nt, Pseudomonas putida KT2440
caguaaggaucgcgcagcagc

SEQ ID NO: 3529975 - RNA, 23 nt, Pseudomonas putida KT2440
caguaauaggugcguggcuguuc

SEQ ID NO: 3529976 - RNA, 19 nt, Pseudomonas putida KT2440
caguaaugcagccggcccc

SEQ ID NO: 3529977 - RNA, 15 nt, Pseudomonas putida KT2440
caguacaacgucaca

SEQ ID NO: 3529978 - RNA, 22 nt, Pseudomonas putida KT2440
caguacaggcaauacaaggcuc

SEQ ID NO: 3529979 - RNA, 14 nt, Pseudomonas putida KT2440
caguacauagaaca

SEQ ID NO: 3529980 - RNA, 15 nt, Pseudomonas putida KT2440
caguacaugaucggg

SEQ ID NO: 3529981 - RNA, 17 nt, Pseudomonas putida KT2440
caguacaugaucggguu

SEQ ID NO: 3529982 - RNA, 14 nt, Pseudomonas putida KT2440
caguaccacuucca

SEQ ID NO: 3529983 - RNA, 16 nt, Pseudomonas putida KT2440
caguaccagcagcaca

SEQ ID NO: 3529984 - RNA, 21 nt, Pseudomonas putida KT2440
caguaccagcagcacaucccg

SEQ ID NO: 3529985 - RNA, 16 nt, Pseudomonas putida KT2440
caguaccgcgccucca

SEQ ID NO: 3529986 - RNA, 14 nt, Pseudomonas putida KT2440
caguacgaacuacg

SEQ ID NO: 3529987 - RNA, 14 nt, Pseudomonas putida KT2440
caguacgccaccca

SEQ ID NO: 3529988 - RNA, 17 nt, Pseudomonas putida KT2440
caguacgccacccagau

SEQ ID NO: 3529989 - RNA, 18 nt, Pseudomonas putida KT2440
caguacgccagcagcgca

SEQ ID NO: 3529990 - RNA, 15 nt, Pseudomonas putida KT2440
caguacgcgccugca

SEQ ID NO: 3529991 - RNA, 22 nt, Pseudomonas putida KT2440
caguacgcgccugcaccuggcu

SEQ ID NO: 3529992 - RNA, 20 nt, Pseudomonas putida KT2440
caguacgggcccuuucgcgg

SEQ ID NO: 3529993 - RNA, 22 nt, Pseudomonas putida KT2440
caguacgggcccuuucgcgggu

SEQ ID NO: 3529994 - RNA, 16 nt, Pseudomonas putida KT2440
caguacuuauaagcag

SEQ ID NO: 3529995 - RNA, 21 nt, Pseudomonas putida KT2440
caguacuuauaagcagcaagc

SEQ ID NO: 3529996 - RNA, 12 nt, Pseudomonas putida KT2440
caguacuucgcg

SEQ ID NO: 3529997 - RNA, 15 nt, Pseudomonas putida KT2440
caguagaagcccaga

SEQ ID NO: 3529998 - RNA, 15 nt, Pseudomonas putida KT2440
caguagagcccccag

SEQ ID NO: 3529999 - RNA, 13 nt, Pseudomonas putida KT2440
caguagcacagug

SEQ ID NO: 3530000 - RNA, 18 nt, Pseudomonas putida KT2440
caguagcuuaaucccgca

SEQ ID NO: 3530001 - RNA, 12 nt, Pseudomonas putida KT2440
caguaggcugca

SEQ ID NO: 3530002 - RNA, 15 nt, Pseudomonas putida KT2440
caguaggcugcagcc

SEQ ID NO: 3530003 - RNA, 12 nt, Pseudomonas putida KT2440
caguaucgcccc

SEQ ID NO: 3530004 - RNA, 23 nt, Pseudomonas putida KT2440
caguaucgccccggucagcagga

SEQ ID NO: 3530005 - RNA, 17 nt, Pseudomonas putida KT2440
caguauugcgucaggcu

SEQ ID NO: 3530006 - RNA, 21 nt, Pseudomonas putida KT2440
cagucaccacacggcagcccc

SEQ ID NO: 3530007 - RNA, 19 nt, Pseudomonas putida KT2440
cagucacccaccggcucca

SEQ ID NO: 3530008 - RNA, 22 nt, Pseudomonas putida KT2440
cagucacccaccggcuccaccu

SEQ ID NO: 3530009 - RNA, 22 nt, Pseudomonas putida KT2440
cagucaccguucuugauccagc

SEQ ID NO: 3530010 - RNA, 13 nt, Pseudomonas putida KT2440
cagucaccuggcc

SEQ ID NO: 3530011 - RNA, 20 nt, Pseudomonas putida KT2440
cagucagccacauccucugc

SEQ ID NO: 3530012 - RNA, 14 nt, Pseudomonas putida KT2440
cagugucaguugcu

SEQ ID NO: 3530013 - RNA, 19 nt, Pseudomonas putida KT2440
cagugucccggccagggcu

SEQ ID NO: 3530014 - RNA, 17 nt, Pseudomonas putida KT2440
cagugucugcgccugcu

SEQ ID NO: 3530015 - RNA, 19 nt, Pseudomonas putida KT2440
cagugucugcgccugcugg

SEQ ID NO: 3530016 - RNA, 17 nt, Pseudomonas putida KT2440
cagugugaccuucaacc

SEQ ID NO: 3530017 - RNA, 18 nt, Pseudomonas putida KT2440
cagugugcaaacacccag

SEQ ID NO: 3530018 - RNA, 14 nt, Pseudomonas putida KT2440
caguguggcaaggg

SEQ ID NO: 3530019 - RNA, 21 nt, Pseudomonas putida KT2440
caguguguugcgguggaagcu

SEQ ID NO: 3530020 - RNA, 22 nt, Pseudomonas putida KT2440
caguguucgaacgggcauuuuu

SEQ ID NO: 3530021 - RNA, 19 nt, Pseudomonas putida KT2440
caguuacccuguacccgcu

SEQ ID NO: 3530022 - RNA, 22 nt, Pseudomonas putida KT2440
caguucaccauccgccagguau

SEQ ID NO: 3530023 - RNA, 17 nt, Pseudomonas putida KT2440
caguucacgcaggcgca

SEQ ID NO: 3530024 - RNA, 19 nt, Pseudomonas putida KT2440
caguucauggcucacaccc

SEQ ID NO: 3530025 - RNA, 20 nt, Pseudomonas putida KT2440
caguucauugcgaaucugca

SEQ ID NO: 3530026 - RNA, 17 nt, Pseudomonas putida KT2440
caguuccaccggcaagc

SEQ ID NO: 3530027 - RNA, 22 nt, Pseudomonas putida KT2440
caguuccaccggcaagcccaug

SEQ ID NO: 3530028 - RNA, 15 nt, Pseudomonas putida KT2440
caguucccggugcug

SEQ ID NO: 3530029 - RNA, 20 nt, Pseudomonas putida KT2440
caguuccggcaggucgauga

SEQ ID NO: 3530030 - RNA, 12 nt, Pseudomonas putida KT2440
caguuccuggcg

SEQ ID NO: 3530031 - RNA, 15 nt, Pseudomonas putida KT2440
caguuccuucagcag

SEQ ID NO: 3530032 - RNA, 22 nt, Pseudomonas putida KT2440
caguuccuugagcacccccggu

SEQ ID NO: 3530033 - RNA, 18 nt, Pseudomonas putida KT2440
caguucgaaaccacccug

SEQ ID NO: 3530034 - RNA, 18 nt, Pseudomonas putida KT2440
caguucgacgcggaccuu

SEQ ID NO: 3530035 - RNA, 18 nt, Pseudomonas putida KT2440
caguucgacgcugcuguc

SEQ ID NO: 3530036 - RNA, 14 nt, Pseudomonas putida KT2440
caguucgagcgccu

SEQ ID NO: 3530037 - RNA, 20 nt, Pseudomonas putida KT2440
caguucgaugcgaagcaagc

SEQ ID NO: 3530038 - RNA, 23 nt, Pseudomonas putida KT2440
caguucgauguaggcagcugccu

SEQ ID NO: 3530039 - RNA, 24 nt, Pseudomonas putida KT2440
caguucgauguaggcagcugccuu

SEQ ID NO: 3530040 - RNA, 14 nt, Pseudomonas putida KT2440
caguucgcacagcu

SEQ ID NO: 3530041 - RNA, 17 nt, Pseudomonas putida KT2440
caguucgcacagcucga

SEQ ID NO: 3530042 - RNA, 19 nt, Pseudomonas putida KT2440
caguucgcagccauaguuu

SEQ ID NO: 3530043 - RNA, 14 nt, Pseudomonas putida KT2440
caguucgcagccca

SEQ ID NO: 3530044 - RNA, 21 nt, Pseudomonas putida KT2440
caguucgccacccgacgccac

SEQ ID NO: 3530045 - RNA, 20 nt, Pseudomonas putida KT2440
caguucggaaaacuccugcu

SEQ ID NO: 3530046 - RNA, 17 nt, Pseudomonas putida KT2440
caguucggacaggcgcu

SEQ ID NO: 3530047 - RNA, 15 nt, Pseudomonas putida KT2440
caguucggcggcccc

SEQ ID NO: 3530048 - RNA, 21 nt, Pseudomonas putida KT2440
caguucgguaaucugcuugcc

SEQ ID NO: 3530049 - RNA, 20 nt, Pseudomonas putida KT2440
caguucguccaccgacggcg

SEQ ID NO: 3530050 - RNA, 22 nt, Pseudomonas putida KT2440
caguucguccaccgacggcgga

SEQ ID NO: 3530051 - RNA, 14 nt, Pseudomonas putida KT2440
caguucguccaggc

SEQ ID NO: 3530052 - RNA, 17 nt, Pseudomonas putida KT2440
caguucguccaggcuuu

SEQ ID NO: 3530053 - RNA, 14 nt, Pseudomonas putida KT2440
caguucgucgagca

SEQ ID NO: 3530054 - RNA, 18 nt, Pseudomonas putida KT2440
caguucgucgagcaucug

SEQ ID NO: 3530055 - RNA, 22 nt, Pseudomonas putida KT2440
caguucugcucagcuacgcugg

SEQ ID NO: 3530056 - RNA, 15 nt, Pseudomonas putida KT2440
caguucuuccagcgg

SEQ ID NO: 3530057 - RNA, 23 nt, Pseudomonas putida KT2440
caguucuuggcggcugggugcca

SEQ ID NO: 3530058 - RNA, 19 nt, Pseudomonas putida KT2440
caguugauaacacuugccg

SEQ ID NO: 3530059 - RNA, 13 nt, Pseudomonas putida KT2440
caguugcagcaac

SEQ ID NO: 3530060 - RNA, 14 nt, Pseudomonas putida KT2440
caguugcaggcgca

SEQ ID NO: 3530061 - RNA, 22 nt, Pseudomonas putida KT2440
caguugccaguguucgaacggg

SEQ ID NO: 3530062 - RNA, 16 nt, Pseudomonas putida KT2440
caguugcgggaagguc

SEQ ID NO: 3530063 - RNA, 16 nt, Pseudomonas putida KT2440
caguugcuggcugguc

SEQ ID NO: 3530064 - RNA, 14 nt, Pseudomonas putida KT2440
caguugcuucugca

SEQ ID NO: 3530065 - RNA, 14 nt, Pseudomonas putida KT2440
caguuggccaucaa

SEQ ID NO: 3530066 - RNA, 16 nt, Pseudomonas putida KT2440
caguuggccggcaugg

SEQ ID NO: 3530067 - RNA, 20 nt, Pseudomonas putida KT2440
caguuggcggcgcagcgcac

SEQ ID NO: 3530068 - RNA, 22 nt, Pseudomonas putida KT2440
caguuggcguauuuuggcaggu

SEQ ID NO: 3530069 - RNA, 18 nt, Pseudomonas putida KT2440
caguugguaaaacacauu

SEQ ID NO: 3530070 - RNA, 12 nt, Pseudomonas putida KT2440
caguuguacucg

SEQ ID NO: 3530071 - RNA, 17 nt, Pseudomonas putida KT2440
caguuguaguucccgcg

SEQ ID NO: 3530072 - RNA, 19 nt, Pseudomonas putida KT2440
caguuguccaggcugcgca

SEQ ID NO: 3530073 - RNA, 17 nt, Pseudomonas putida KT2440
caguuguucgucgagca

SEQ ID NO: 3530074 - RNA, 22 nt, Pseudomonas putida KT2440
caguuguucgucgagcaccacg

SEQ ID NO: 3530075 - RNA, 18 nt, Pseudomonas putida KT2440
caguuucagcgccuucuu

SEQ ID NO: 3530076 - RNA, 14 nt, Pseudomonas putida KT2440
caguuucaucaccg

SEQ ID NO: 3530077 - RNA, 12 nt, Pseudomonas putida KT2440
caguuugcacug

SEQ ID NO: 3530078 - RNA, 16 nt, Pseudomonas putida KT2440
caguuuucaaugcugc

SEQ ID NO: 3530079 - RNA, 11 nt, Pseudomonas putida KT2440
caguuuuucuc

SEQ ID NO: 3530080 - RNA, 17 nt, Pseudomonas putida KT2440
cauaaaccccagccuuc

SEQ ID NO: 3530081 - RNA, 19 nt, Pseudomonas putida KT2440
cauaaaccccagccuucag

SEQ ID NO: 3530082 - RNA, 12 nt, Pseudomonas putida KT2440
cauaacaagaac

SEQ ID NO: 3530083 - RNA, 17 nt, Pseudomonas putida KT2440
cauaaccccccacccag

SEQ ID NO: 3530084 - RNA, 15 nt, Pseudomonas putida KT2440
cauaacgccccagca

SEQ ID NO: 3530085 - RNA, 18 nt, Pseudomonas putida KT2440
cauaagcugucagcaccu

SEQ ID NO: 3530086 - RNA, 17 nt, Pseudomonas putida KT2440
cauacaagaucaagccc

SEQ ID NO: 3530087 - RNA, 14 nt, Pseudomonas putida KT2440
cauacaccccgcgc

SEQ ID NO: 3530088 - RNA, 21 nt, Pseudomonas putida KT2440
cauacacccggucgcucaacu

SEQ ID NO: 3530089 - RNA, 18 nt, Pseudomonas putida KT2440
cauacagccagaaagcca

SEQ ID NO: 3530090 - RNA, 21 nt, Pseudomonas putida KT2440
cauacagccagaaagccacug

SEQ ID NO: 3530091 - RNA, 13 nt, Pseudomonas putida KT2440
cauacagcgccuc

SEQ ID NO: 3530092 - RNA, 18 nt, Pseudomonas putida KT2440
cauacagcgccuccagca

SEQ ID NO: 3530093 - RNA, 17 nt, Pseudomonas putida KT2440
cauacagcuggccuugc

SEQ ID NO: 3530094 - RNA, 21 nt, Pseudomonas putida KT2440
cauacagggauagagccgccu

SEQ ID NO: 3530095 - RNA, 14 nt, Pseudomonas putida KT2440
cauaccaauggcaa

SEQ ID NO: 3530096 - RNA, 17 nt, Pseudomonas putida KT2440
cauaccaauggcaaucg

SEQ ID NO: 3530097 - RNA, 18 nt, Pseudomonas putida KT2440
cauaccaauggcaaucgc

SEQ ID NO: 3530098 - RNA, 23 nt, Pseudomonas putida KT2440
cauaccaauggcaaucgccuggc

SEQ ID NO: 3530099 - RNA, 14 nt, Pseudomonas putida KT2440
cauaccccuccggc

SEQ ID NO: 3530100 - RNA, 20 nt, Pseudomonas putida KT2440
cauaccccuccggccccggu

SEQ ID NO: 3530101 - RNA, 21 nt, Pseudomonas putida KT2440
cauaccgcaacaccugccgca

SEQ ID NO: 3530102 - RNA, 14 nt, Pseudomonas putida KT2440
cauaccgcugggca

SEQ ID NO: 3530103 - RNA, 18 nt, Pseudomonas putida KT2440
cauaccgcugggcacccu

SEQ ID NO: 3530104 - RNA, 23 nt, Pseudomonas putida KT2440
cauaccgguagccucgacccgcu

SEQ ID NO: 3530105 - RNA, 22 nt, Pseudomonas putida KT2440
cauaccucccgcacugcugccg

SEQ ID NO: 3530106 - RNA, 15 nt, Pseudomonas putida KT2440
cauacgcaugaaguc

SEQ ID NO: 3530107 - RNA, 14 nt, Pseudomonas putida KT2440
cauacggucgauga

SEQ ID NO: 3530108 - RNA, 17 nt, Pseudomonas putida KT2440
cauacucuucgcgggcu

SEQ ID NO: 3530109 - RNA, 22 nt, Pseudomonas putida KT2440
cauacucuucgcgggcucgccc

SEQ ID NO: 3530110 - RNA, 12 nt, Pseudomonas putida KT2440
cauacugcugac

SEQ ID NO: 3530111 - RNA, 22 nt, Pseudomonas putida KT2440
cauacuuggccgacauggcgcu

SEQ ID NO: 3530112 - RNA, 12 nt, Pseudomonas putida KT2440
cauagaaauggc

SEQ ID NO: 3530113 - RNA, 15 nt, Pseudomonas putida KT2440
cauagaucucgacaa

SEQ ID NO: 3530114 - RNA, 13 nt, Pseudomonas putida KT2440
cauagcaccagcg

SEQ ID NO: 3530115 - RNA, 13 nt, Pseudomonas putida KT2440
cauagcaguccug

SEQ ID NO: 3530116 - RNA, 20 nt, Pseudomonas putida KT2440
cauagcccgaaaccgccagc

SEQ ID NO: 3530117 - RNA, 18 nt, Pseudomonas putida KT2440
cauccaagugcuaaugcu

SEQ ID NO: 3530118 - RNA, 15 nt, Pseudomonas putida KT2440
cauccacaccagcgg

SEQ ID NO: 3530119 - RNA, 17 nt, Pseudomonas putida KT2440
cauccacaccagcggcg

SEQ ID NO: 3530120 - RNA, 15 nt, Pseudomonas putida KT2440
cauccacaccguacu

SEQ ID NO: 3530121 - RNA, 13 nt, Pseudomonas putida KT2440
cauccacaccuuc

SEQ ID NO: 3530122 - RNA, 16 nt, Pseudomonas putida KT2440
cauccacacgcugcug

SEQ ID NO: 3530123 - RNA, 17 nt, Pseudomonas putida KT2440
cauccacaggcgccccg

SEQ ID NO: 3530124 - RNA, 19 nt, Pseudomonas putida KT2440
cauccacaggcgccccggc

SEQ ID NO: 3530125 - RNA, 15 nt, Pseudomonas putida KT2440
cauccacauaggcca

SEQ ID NO: 3530126 - RNA, 21 nt, Pseudomonas putida KT2440
cauccacaucacugcuguaau

SEQ ID NO: 3530127 - RNA, 14 nt, Pseudomonas putida KT2440
cauccacaucgcca

SEQ ID NO: 3530128 - RNA, 15 nt, Pseudomonas putida KT2440
cauccacaucgccag

SEQ ID NO: 3530129 - RNA, 13 nt, Pseudomonas putida KT2440
cauccaccacccu

SEQ ID NO: 3530130 - RNA, 14 nt, Pseudomonas putida KT2440
cauccaccagcccc

SEQ ID NO: 3530131 - RNA, 15 nt, Pseudomonas putida KT2440
cauccaccagcccca

SEQ ID NO: 3530132 - RNA, 21 nt, Pseudomonas putida KT2440
cauccaccagccccagcgccu

SEQ ID NO: 3530133 - RNA, 14 nt, Pseudomonas putida KT2440
cauccaccgcccca

SEQ ID NO: 3530134 - RNA, 17 nt, Pseudomonas putida KT2440
cauccaccgccccaagc

SEQ ID NO: 3530135 - RNA, 21 nt, Pseudomonas putida KT2440
cauccaccgccccaagcgccu

SEQ ID NO: 3530136 - RNA, 20 nt, Pseudomonas putida KT2440
cauccaccgcgccagccugg

SEQ ID NO: 3530137 - RNA, 18 nt, Pseudomonas putida KT2440
cauccaccgcucgcgccg

SEQ ID NO: 3530138 - RNA, 13 nt, Pseudomonas putida KT2440
cauccaccuguga

SEQ ID NO: 3530139 - RNA, 18 nt, Pseudomonas putida KT2440
cauccacggcguugcccc

SEQ ID NO: 3530140 - RNA, 16 nt, Pseudomonas putida KT2440
cauccagaucggcagu

SEQ ID NO: 3530141 - RNA, 15 nt, Pseudomonas putida KT2440
cauccagcacugccu

SEQ ID NO: 3530142 - RNA, 21 nt, Pseudomonas putida KT2440
cauccagcacugccuggccac

SEQ ID NO: 3530143 - RNA, 18 nt, Pseudomonas putida KT2440
cauccagccauuccaggc

SEQ ID NO: 3530144 - RNA, 13 nt, Pseudomonas putida KT2440
cauccagcgccac

SEQ ID NO: 3530145 - RNA, 14 nt, Pseudomonas putida KT2440
cauccagcgccgcg

SEQ ID NO: 3530146 - RNA, 17 nt, Pseudomonas putida KT2440
cauccagcgccuccccc

SEQ ID NO: 3530147 - RNA, 15 nt, Pseudomonas putida KT2440
cauccagcuccagca

SEQ ID NO: 3530148 - RNA, 16 nt, Pseudomonas putida KT2440
cauccagcucggcaag

SEQ ID NO: 3530149 - RNA, 16 nt, Pseudomonas putida KT2440
cauccagcuucuugug

SEQ ID NO: 3530150 - RNA, 12 nt, Pseudomonas putida KT2440
cauccaggcggg

SEQ ID NO: 3530151 - RNA, 22 nt, Pseudomonas putida KT2440
cauccaggcguucaucgaaggc

SEQ ID NO: 3530152 - RNA, 12 nt, Pseudomonas putida KT2440
cauccaggcugg

SEQ ID NO: 3530153 - RNA, 15 nt, Pseudomonas putida KT2440
cauccagggcuuccu

SEQ ID NO: 3530154 - RNA, 22 nt, Pseudomonas putida KT2440
cauccagguuaucuagcaggug

SEQ ID NO: 3530155 - RNA, 22 nt, Pseudomonas putida KT2440
cauccagguuccccccacgcac

SEQ ID NO: 3530156 - RNA, 23 nt, Pseudomonas putida KT2440
cauccauccaagugcuaaugcuc

SEQ ID NO: 3530157 - RNA, 17 nt, Pseudomonas putida KT2440
cauccaugcaaucacca

SEQ ID NO: 3530158 - RNA, 21 nt, Pseudomonas putida KT2440
cauccaugcaaucaccauccc

SEQ ID NO: 3530159 - RNA, 17 nt, Pseudomonas putida KT2440
cauccauguccauggca

SEQ ID NO: 3530160 - RNA, 17 nt, Pseudomonas putida KT2440
caucccagaacuucacc

SEQ ID NO: 3530161 - RNA, 20 nt, Pseudomonas putida KT2440
caucccagaacuucaccccg

SEQ ID NO: 3530162 - RNA, 12 nt, Pseudomonas putida KT2440
cauccccagcau

SEQ ID NO: 3530163 - RNA, 13 nt, Pseudomonas putida KT2440
cauccccccagcc

SEQ ID NO: 3530164 - RNA, 17 nt, Pseudomonas putida KT2440
caucccccggcccagcc

SEQ ID NO: 3530165 - RNA, 20 nt, Pseudomonas putida KT2440
caucccccggcccagccccg

SEQ ID NO: 3530166 - RNA, 13 nt, Pseudomonas putida KT2440
caucccccuccua

SEQ ID NO: 3530167 - RNA, 23 nt, Pseudomonas putida KT2440
cauccccgcacgcggugggucga

SEQ ID NO: 3530168 - RNA, 21 nt, Pseudomonas putida KT2440
cauccccggccuccucgcggg

SEQ ID NO: 3530169 - RNA, 18 nt, Pseudomonas putida KT2440
caucccgcugugcagcgc

SEQ ID NO: 3530170 - RNA, 19 nt, Pseudomonas putida KT2440
caucccuggcacgcccggc

SEQ ID NO: 3530171 - RNA, 16 nt, Pseudomonas putida KT2440
caucccuguacagauc

SEQ ID NO: 3530172 - RNA, 22 nt, Pseudomonas putida KT2440
cauccgaucuugaaccguugcg

SEQ ID NO: 3530173 - RNA, 17 nt, Pseudomonas putida KT2440
cauccgcaacaugaagc

SEQ ID NO: 3530174 - RNA, 19 nt, Pseudomonas putida KT2440
cauccgcaacaugaagcca

SEQ ID NO: 3530175 - RNA, 18 nt, Pseudomonas putida KT2440
cauccgcaccccaaggcu

SEQ ID NO: 3530176 - RNA, 20 nt, Pseudomonas putida KT2440
cauccgccagguauucggca

SEQ ID NO: 3530177 - RNA, 14 nt, Pseudomonas putida KT2440
cauccgccucaucc

SEQ ID NO: 3530178 - RNA, 12 nt, Pseudomonas putida KT2440
cauccgcggcau

SEQ ID NO: 3530179 - RNA, 16 nt, Pseudomonas putida KT2440
cauccgcguccccuuc

SEQ ID NO: 3530180 - RNA, 18 nt, Pseudomonas putida KT2440
cauccgcguccccuucac

SEQ ID NO: 3530181 - RNA, 20 nt, Pseudomonas putida KT2440
cauccggcagcucaccggca

SEQ ID NO: 3530182 - RNA, 21 nt, Pseudomonas putida KT2440
cauccggccgacucuucacca

SEQ ID NO: 3530183 - RNA, 19 nt, Pseudomonas putida KT2440
cauccggcgcaucgacggg

SEQ ID NO: 3530184 - RNA, 21 nt, Pseudomonas putida KT2440
cauccggcgcggccugcucca

SEQ ID NO: 3530185 - RNA, 19 nt, Pseudomonas putida KT2440
cauccggcggcaucucgca

SEQ ID NO: 3530186 - RNA, 20 nt, Pseudomonas putida KT2440
cauccgggccgucaccgcug

SEQ ID NO: 3530187 - RNA, 22 nt, Pseudomonas putida KT2440
cauccgggccgucaccgcugcc

SEQ ID NO: 3530188 - RNA, 17 nt, Pseudomonas putida KT2440
cauccucaagcugcacc

SEQ ID NO: 3530189 - RNA, 19 nt, Pseudomonas putida KT2440
cauccucaagguuguauuu

SEQ ID NO: 3530190 - RNA, 23 nt, Pseudomonas putida KT2440
cauccucaccggcaaagcugauc

SEQ ID NO: 3530191 - RNA, 15 nt, Pseudomonas putida KT2440
cauccuccgcccugc

SEQ ID NO: 3530192 - RNA, 17 nt, Pseudomonas putida KT2440
cauccuccgcccugccc

SEQ ID NO: 3530193 - RNA, 16 nt, Pseudomonas putida KT2440
cauccucggugcgcgg

SEQ ID NO: 3530194 - RNA, 13 nt, Pseudomonas putida KT2440
cauccugcacugc

SEQ ID NO: 3530195 - RNA, 21 nt, Pseudomonas putida KT2440
cauccugcgcggccacuacca

SEQ ID NO: 3530196 - RNA, 22 nt, Pseudomonas putida KT2440
cauccugcgugcugugcacugc

SEQ ID NO: 3530197 - RNA, 16 nt, Pseudomonas putida KT2440
cauccugcguggcggu

SEQ ID NO: 3530198 - RNA, 21 nt, Pseudomonas putida KT2440
cauccugcucgacaagccgcu

SEQ ID NO: 3530199 - RNA, 14 nt, Pseudomonas putida KT2440
cauccugcuggccc

SEQ ID NO: 3530200 - RNA, 19 nt, Pseudomonas putida KT2440
cauccugcuguagcgccca

SEQ ID NO: 3530201 - RNA, 15 nt, Pseudomonas putida KT2440
caucgaacgccgccu

SEQ ID NO: 3530202 - RNA, 18 nt, Pseudomonas putida KT2440
caucgaagaucagcucau

SEQ ID NO: 3530203 - RNA, 15 nt, Pseudomonas putida KT2440
caucgaagcagugcu

SEQ ID NO: 3530204 - RNA, 16 nt, Pseudomonas putida KT2440
caucgaagcagugcug

SEQ ID NO: 3530205 - RNA, 17 nt, Pseudomonas putida KT2440
caucgacaaucggcuca

SEQ ID NO: 3530206 - RNA, 23 nt, Pseudomonas putida KT2440
caucgacaaucggcucaacagcc

SEQ ID NO: 3530207 - RNA, 20 nt, Pseudomonas putida KT2440
caucgacagguccaccgcuu

SEQ ID NO: 3530208 - RNA, 14 nt, Pseudomonas putida KT2440
caucgacaggugcg

SEQ ID NO: 3530209 - RNA, 19 nt, Pseudomonas putida KT2440
caucgacccuggcauagca

SEQ ID NO: 3530210 - RNA, 13 nt, Pseudomonas putida KT2440
caucgaccggcag

SEQ ID NO: 3530211 - RNA, 21 nt, Pseudomonas putida KT2440
caucgaccugccacugcgcua

SEQ ID NO: 3530212 - RNA, 22 nt, Pseudomonas putida KT2440
caucgacgaugccguacaccau

SEQ ID NO: 3530213 - RNA, 14 nt, Pseudomonas putida KT2440
caucgacucacgcu

SEQ ID NO: 3530214 - RNA, 20 nt, Pseudomonas putida KT2440
caucgacucacgcucguugu

SEQ ID NO: 3530215 - RNA, 22 nt, Pseudomonas putida KT2440
caucgacucacgcucguugucc

SEQ ID NO: 3530216 - RNA, 20 nt, Pseudomonas putida KT2440
caucgagauguggcccggga

SEQ ID NO: 3530217 - RNA, 13 nt, Pseudomonas putida KT2440
caucgaggaaagg

SEQ ID NO: 3530218 - RNA, 15 nt, Pseudomonas putida KT2440
caucgaggcgcgcgc

SEQ ID NO: 3530219 - RNA, 16 nt, Pseudomonas putida KT2440
caucgaggcguuguac

SEQ ID NO: 3530220 - RNA, 21 nt, Pseudomonas putida KT2440
caucgaucaggguuuccaccg

SEQ ID NO: 3530221 - RNA, 15 nt, Pseudomonas putida KT2440
caucgaucaggucga

SEQ ID NO: 3530222 - RNA, 13 nt, Pseudomonas putida KT2440
caugaacacauac

SEQ ID NO: 3530223 - RNA, 14 nt, Pseudomonas putida KT2440
caugaacagcgccc

SEQ ID NO: 3530224 - RNA, 21 nt, Pseudomonas putida KT2440
caugaacucaguuacagaggc

SEQ ID NO: 3530225 - RNA, 22 nt, Pseudomonas putida KT2440
caugaagcggccggccccccca

SEQ ID NO: 3530226 - RNA, 16 nt, Pseudomonas putida KT2440
caugaagcuaagcagg

SEQ ID NO: 3530227 - RNA, 18 nt, Pseudomonas putida KT2440
caugaagcuucaaaccaa

SEQ ID NO: 3530228 - RNA, 18 nt, Pseudomonas putida KT2440
caugaaggacaucaccag

SEQ ID NO: 3530229 - RNA, 20 nt, Pseudomonas putida KT2440
caugaaggacaucaccaggc

SEQ ID NO: 3530230 - RNA, 14 nt, Pseudomonas putida KT2440
caugaaggcccagc

SEQ ID NO: 3530231 - RNA, 21 nt, Pseudomonas putida KT2440
caugaaggcggggagcgaacu

SEQ ID NO: 3530232 - RNA, 13 nt, Pseudomonas putida KT2440
caugaagggacuu

SEQ ID NO: 3530233 - RNA, 22 nt, Pseudomonas putida KT2440
caugaagggacuuaaucaaugc

SEQ ID NO: 3530234 - RNA, 17 nt, Pseudomonas putida KT2440
caugaagucagccaggu

SEQ ID NO: 3530235 - RNA, 14 nt, Pseudomonas putida KT2440
caugacaaacgcca

SEQ ID NO: 3530236 - RNA, 23 nt, Pseudomonas putida KT2440
caugacccuaugcgugaaacgca

SEQ ID NO: 3530237 - RNA, 14 nt, Pseudomonas putida KT2440
caugacuuccaggu

SEQ ID NO: 3530238 - RNA, 17 nt, Pseudomonas putida KT2440
caugacuuccagguagc

SEQ ID NO: 3530239 - RNA, 21 nt, Pseudomonas putida KT2440
caugacuuugccggagguguc

SEQ ID NO: 3530240 - RNA, 16 nt, Pseudomonas putida KT2440
caugagccuggccggu

SEQ ID NO: 3530241 - RNA, 21 nt, Pseudomonas putida KT2440
caugaggauacgacgcaucag

SEQ ID NO: 3530242 - RNA, 23 nt, Pseudomonas putida KT2440
caugaggaucgucacguuuuuug

SEQ ID NO: 3530243 - RNA, 23 nt, Pseudomonas putida KT2440
caugaucaagcuguacaacgcag

SEQ ID NO: 3530244 - RNA, 14 nt, Pseudomonas putida KT2440
caugaucagcgccu

SEQ ID NO: 3530245 - RNA, 23 nt, Pseudomonas putida KT2440
caugaucgcgcuuggcaccggca

SEQ ID NO: 3530246 - RNA, 19 nt, Pseudomonas putida KT2440
caugaucgcggcaaugcgc

SEQ ID NO: 3530247 - RNA, 21 nt, Pseudomonas putida KT2440
caugaucggguucuuccaagu

SEQ ID NO: 3530248 - RNA, 17 nt, Pseudomonas putida KT2440
caugaucugcaagcgca

SEQ ID NO: 3530249 - RNA, 22 nt, Pseudomonas putida KT2440
caugaucugcaagcgcagcccc

SEQ ID NO: 3530250 - RNA, 21 nt, Pseudomonas putida KT2440
caugaugaaguggcgcaggcu

SEQ ID NO: 3530251 - RNA, 20 nt, Pseudomonas putida KT2440
caugaugaaguugcaggcau

SEQ ID NO: 3530252 - RNA, 20 nt, Pseudomonas putida KT2440
caugaugaccaccaggaaca

SEQ ID NO: 3530253 - RNA, 14 nt, Pseudomonas putida KT2440
caugauguacgcca

SEQ ID NO: 3530254 - RNA, 17 nt, Pseudomonas putida KT2440
caugaugucgcugccgc

SEQ ID NO: 3530255 - RNA, 16 nt, Pseudomonas putida KT2440
caugauuacgcugaaa

SEQ ID NO: 3530256 - RNA, 13 nt, Pseudomonas putida KT2440
caugcaacccgca

SEQ ID NO: 3530257 - RNA, 20 nt, Pseudomonas putida KT2440
caugcaacccgcauuccuuc

SEQ ID NO: 3530258 - RNA, 23 nt, Pseudomonas putida KT2440
caugcaacggcacacgcaccacc

SEQ ID NO: 3530259 - RNA, 16 nt, Pseudomonas putida KT2440
caugcaacugcaugau

SEQ ID NO: 3530260 - RNA, 15 nt, Pseudomonas putida KT2440
caugcaagcagccac

SEQ ID NO: 3530261 - RNA, 16 nt, Pseudomonas putida KT2440
caugcaagcagccacc

SEQ ID NO: 3530262 - RNA, 22 nt, Pseudomonas putida KT2440
caugcaauaaccaaucaacggu

SEQ ID NO: 3530263 - RNA, 22 nt, Pseudomonas putida KT2440
caugcacagcgagcagccuggc

SEQ ID NO: 3530264 - RNA, 14 nt, Pseudomonas putida KT2440
caugcacgcagcaa

SEQ ID NO: 3530265 - RNA, 15 nt, Pseudomonas putida KT2440
caugcacugccugca

SEQ ID NO: 3530266 - RNA, 19 nt, Pseudomonas putida KT2440
caugcacuuccaggaaggc

SEQ ID NO: 3530267 - RNA, 18 nt, Pseudomonas putida KT2440
caugcagauggggcagac

SEQ ID NO: 3530268 - RNA, 14 nt, Pseudomonas putida KT2440
caugcagcaccucc

SEQ ID NO: 3530269 - RNA, 16 nt, Pseudomonas putida KT2440
caugcagcaccuccug

SEQ ID NO: 3530270 - RNA, 12 nt, Pseudomonas putida KT2440
caugcagcgcca

SEQ ID NO: 3530271 - RNA, 13 nt, Pseudomonas putida KT2440
caugcagcggcca

SEQ ID NO: 3530272 - RNA, 19 nt, Pseudomonas putida KT2440
caugcagcguggccuucuc

SEQ ID NO: 3530273 - RNA, 21 nt, Pseudomonas putida KT2440
caugcaggucaucgaacaccu

SEQ ID NO: 3530274 - RNA, 22 nt, Pseudomonas putida KT2440
caugcaggucgacgauacccag

SEQ ID NO: 3530275 - RNA, 22 nt, Pseudomonas putida KT2440
caugcaggucgacgaucgccgc

SEQ ID NO: 3530276 - RNA, 22 nt, Pseudomonas putida KT2440
caugcagguucgaccagaacau

SEQ ID NO: 3530277 - RNA, 13 nt, Pseudomonas putida KT2440
caugcaguugagc

SEQ ID NO: 3530278 - RNA, 20 nt, Pseudomonas putida KT2440
caugcaucugcgccccgcuc

SEQ ID NO: 3530279 - RNA, 17 nt, Pseudomonas putida KT2440
caugcaugcguugcacg

SEQ ID NO: 3530280 - RNA, 23 nt, Pseudomonas putida KT2440
caugccaaagaaggacucggcgu

SEQ ID NO: 3530281 - RNA, 21 nt, Pseudomonas putida KT2440
caugccaagcccacacaccgc

SEQ ID NO: 3530282 - RNA, 17 nt, Pseudomonas putida KT2440
caugccacgcaccacca

SEQ ID NO: 3530283 - RNA, 21 nt, Pseudomonas putida KT2440
caugccacggccuucuucacg

SEQ ID NO: 3530284 - RNA, 17 nt, Pseudomonas putida KT2440
caugccagcagcuggcu

SEQ ID NO: 3530285 - RNA, 19 nt, Pseudomonas putida KT2440
caugccagcuaucucccag

SEQ ID NO: 3530286 - RNA, 22 nt, Pseudomonas putida KT2440
caugccauugcaccacccccag

SEQ ID NO: 3530287 - RNA, 18 nt, Pseudomonas putida KT2440
caugccauuggugccacc

SEQ ID NO: 3530288 - RNA, 22 nt, Pseudomonas putida KT2440
caugccauuggugccaccgaug

SEQ ID NO: 3530289 - RNA, 14 nt, Pseudomonas putida KT2440
caugcccaccgcau

SEQ ID NO: 3530290 - RNA, 14 nt, Pseudomonas putida KT2440
caugcccaccgcug

SEQ ID NO: 3530291 - RNA, 20 nt, Pseudomonas putida KT2440
caugcccagcucgcuggcca

SEQ ID NO: 3530292 - RNA, 24 nt, Pseudomonas putida KT2440
caugcccaguucgcgugccaccuc

SEQ ID NO: 3530293 - RNA, 17 nt, Pseudomonas putida KT2440
caugcccauggccagcg

SEQ ID NO: 3530294 - RNA, 13 nt, Pseudomonas putida KT2440
caugccccccgcc

SEQ ID NO: 3530295 - RNA, 21 nt, Pseudomonas putida KT2440
caugccccgggugcagccgca

SEQ ID NO: 3530296 - RNA, 21 nt, Pseudomonas putida KT2440
caugccccucgaacagcgccg

SEQ ID NO: 3530297 - RNA, 14 nt, Pseudomonas putida KT2440
caugcccgccccug

SEQ ID NO: 3530298 - RNA, 15 nt, Pseudomonas putida KT2440
caugcccgccccugc

SEQ ID NO: 3530299 - RNA, 17 nt, Pseudomonas putida KT2440
caugcccgcucccacag

SEQ ID NO: 3530300 - RNA, 22 nt, Pseudomonas putida KT2440
caugcccgcucucacagggacc

SEQ ID NO: 3530301 - RNA, 12 nt, Pseudomonas putida KT2440
caugccgaacga

SEQ ID NO: 3530302 - RNA, 22 nt, Pseudomonas putida KT2440
caugccgaugucggcgugcacc

SEQ ID NO: 3530303 - RNA, 16 nt, Pseudomonas putida KT2440
caugccggccccagac

SEQ ID NO: 3530304 - RNA, 22 nt, Pseudomonas putida KT2440
caugccguaagccgcaggccaa

SEQ ID NO: 3530305 - RNA, 23 nt, Pseudomonas putida KT2440
caugccguaagccgcaggccaau

SEQ ID NO: 3530306 - RNA, 23 nt, Pseudomonas putida KT2440
caugccuaucucuuccagcgucu

SEQ ID NO: 3530307 - RNA, 13 nt, Pseudomonas putida KT2440
caugccuggcucg

SEQ ID NO: 3530308 - RNA, 23 nt, Pseudomonas putida KT2440
caugccugugauuuacgcugggc

SEQ ID NO: 3530309 - RNA, 17 nt, Pseudomonas putida KT2440
caugccuuccugcaccu

SEQ ID NO: 3530310 - RNA, 21 nt, Pseudomonas putida KT2440
caugcgaacgcaggcgcgaca

SEQ ID NO: 3530311 - RNA, 19 nt, Pseudomonas putida KT2440
caugcgaacugcagagccu

SEQ ID NO: 3530312 - RNA, 22 nt, Pseudomonas putida KT2440
caugcgaacugcagagccugca

SEQ ID NO: 3530313 - RNA, 21 nt, Pseudomonas putida KT2440
caugcgaagccgccagcgugc

SEQ ID NO: 3530314 - RNA, 18 nt, Pseudomonas putida KT2440
caugcgaccaguaccgcg

SEQ ID NO: 3530315 - RNA, 17 nt, Pseudomonas putida KT2440
caugcgaugguacagcu

SEQ ID NO: 3530316 - RNA, 18 nt, Pseudomonas putida KT2440
caugcgaugguacagcuc

SEQ ID NO: 3530317 - RNA, 24 nt, Pseudomonas putida KT2440
caugcgaugguacagcucacuggc

SEQ ID NO: 3530318 - RNA, 19 nt, Pseudomonas putida KT2440
caugcgcacggucuccggc

SEQ ID NO: 3530319 - RNA, 12 nt, Pseudomonas putida KT2440
caugcgcaggca

SEQ ID NO: 3530320 - RNA, 16 nt, Pseudomonas putida KT2440
caugcgccacacccgc

SEQ ID NO: 3530321 - RNA, 13 nt, Pseudomonas putida KT2440
caugcgcgcagcg

SEQ ID NO: 3530322 - RNA, 20 nt, Pseudomonas putida KT2440
caugcgcgcagcgaacgccg

SEQ ID NO: 3530323 - RNA, 19 nt, Pseudomonas putida KT2440
caugcgcgugcgugucugu

SEQ ID NO: 3530324 - RNA, 18 nt, Pseudomonas putida KT2440
caugcgcugcagcgucgc

SEQ ID NO: 3530325 - RNA, 14 nt, Pseudomonas putida KT2440
caugcggcaccgcc

SEQ ID NO: 3530326 - RNA, 15 nt, Pseudomonas putida KT2440
cauguugcgcagcaa

SEQ ID NO: 3530327 - RNA, 17 nt, Pseudomonas putida KT2440
cauguugcgcagcaauc

SEQ ID NO: 3530328 - RNA, 20 nt, Pseudomonas putida KT2440
cauguugucacccagcacuu

SEQ ID NO: 3530329 - RNA, 15 nt, Pseudomonas putida KT2440
cauguugugcuggcg

SEQ ID NO: 3530330 - RNA, 19 nt, Pseudomonas putida KT2440
cauuaauuuuaaaggguuu

SEQ ID NO: 3530331 - RNA, 22 nt, Pseudomonas putida KT2440
cauuacaggcagaucgaaagac

SEQ ID NO: 3530332 - RNA, 18 nt, Pseudomonas putida KT2440
cauuacccggcagaauca

SEQ ID NO: 3530333 - RNA, 15 nt, Pseudomonas putida KT2440
cauuacgcggcagca

SEQ ID NO: 3530334 - RNA, 23 nt, Pseudomonas putida KT2440
cauuacgcggcagcagcagcccc

SEQ ID NO: 3530335 - RNA, 13 nt, Pseudomonas putida KT2440
cauucaaagccug

SEQ ID NO: 3530336 - RNA, 16 nt, Pseudomonas putida KT2440
cauucaaagccugcuc

SEQ ID NO: 3530337 - RNA, 16 nt, Pseudomonas putida KT2440
cauucaagaaugcccg

SEQ ID NO: 3530338 - RNA, 12 nt, Pseudomonas putida KT2440
cauucaccagcu

SEQ ID NO: 3530339 - RNA, 22 nt, Pseudomonas putida KT2440
cauucacggcgucgagcagggu

SEQ ID NO: 3530340 - RNA, 15 nt, Pseudomonas putida KT2440
cauucagcagcgccu

SEQ ID NO: 3530341 - RNA, 18 nt, Pseudomonas putida KT2440
cauucagcagcgccuggu

SEQ ID NO: 3530342 - RNA, 12 nt, Pseudomonas putida KT2440
cauucagcucgg

SEQ ID NO: 3530343 - RNA, 22 nt, Pseudomonas putida KT2440
cauucagcucggccacccgcgu

SEQ ID NO: 3530344 - RNA, 12 nt, Pseudomonas putida KT2440
cauucaggccau

SEQ ID NO: 3530345 - RNA, 18 nt, Pseudomonas putida KT2440
cauuccauucggugcagc

SEQ ID NO: 3530346 - RNA, 14 nt, Pseudomonas putida KT2440
cauuccccggucag

SEQ ID NO: 3530347 - RNA, 19 nt, Pseudomonas putida KT2440
cauuccgccgucaccgccg

SEQ ID NO: 3530348 - RNA, 13 nt, Pseudomonas putida KT2440
cauuccggcugca

SEQ ID NO: 3530349 - RNA, 15 nt, Pseudomonas putida KT2440
cauuccgggucgcca

SEQ ID NO: 3530350 - RNA, 15 nt, Pseudomonas putida KT2440
cauuccguuggccac

SEQ ID NO: 3530351 - RNA, 21 nt, Pseudomonas putida KT2440
cauuccguuggccaccaccag

SEQ ID NO: 3530352 - RNA, 17 nt, Pseudomonas putida KT2440
cauucgauagccugcaa

SEQ ID NO: 3530353 - RNA, 23 nt, Pseudomonas putida KT2440
cauucgcauuaccagcaccauca

SEQ ID NO: 3530354 - RNA, 18 nt, Pseudomonas putida KT2440
cauucgcccgcaccgccg

SEQ ID NO: 3530355 - RNA, 15 nt, Pseudomonas putida KT2440
cauucgccggcaagc

SEQ ID NO: 3530356 - RNA, 16 nt, Pseudomonas putida KT2440
cauucgccggcaagcu

SEQ ID NO: 3530357 - RNA, 16 nt, Pseudomonas putida KT2440
cauucgcgggcaagcc

SEQ ID NO: 3530358 - RNA, 21 nt, Pseudomonas putida KT2440
cauucgcggguaaacccgcuc

SEQ ID NO: 3530359 - RNA, 19 nt, Pseudomonas putida KT2440
cauucgcggguaaacccgg

SEQ ID NO: 3530360 - RNA, 20 nt, Pseudomonas putida KT2440
cauucgcgggugaacccgcu

SEQ ID NO: 3530361 - RNA, 19 nt, Pseudomonas putida KT2440
cauucucgccgccgcugac

SEQ ID NO: 3530362 - RNA, 13 nt, Pseudomonas putida KT2440
cauucuucuccaa

SEQ ID NO: 3530363 - RNA, 20 nt, Pseudomonas putida KT2440
cauugagcuguuucaugcug

SEQ ID NO: 3530364 - RNA, 15 nt, Pseudomonas putida KT2440
cauugauaacugcgg

SEQ ID NO: 3530365 - RNA, 17 nt, Pseudomonas putida KT2440
cauugauaacugcggug

SEQ ID NO: 3530366 - RNA, 16 nt, Pseudomonas putida KT2440
cauugaucgccgccag

SEQ ID NO: 3530367 - RNA, 16 nt, Pseudomonas putida KT2440
cauugaugaacgacag

SEQ ID NO: 3530368 - RNA, 21 nt, Pseudomonas putida KT2440
cauugcaagguccuuguaaga

SEQ ID NO: 3530369 - RNA, 22 nt, Pseudomonas putida KT2440
cauugcaccacccccagcgccu

SEQ ID NO: 3530370 - RNA, 23 nt, Pseudomonas putida KT2440
cauugcaccacccccagcgccuc

SEQ ID NO: 3530371 - RNA, 14 nt, Pseudomonas putida KT2440
cauugcagccccaa

SEQ ID NO: 3530372 - RNA, 12 nt, Pseudomonas putida KT2440
cauugcaggcca

SEQ ID NO: 3530373 - RNA, 20 nt, Pseudomonas putida KT2440
cauugccaacagcaguugcu

SEQ ID NO: 3530374 - RNA, 21 nt, Pseudomonas putida KT2440
cauugcccgcgauagcaaacc

SEQ ID NO: 3530375 - RNA, 23 nt, Pseudomonas putida KT2440
cauugccgacuccaacuggacca

SEQ ID NO: 3530376 - RNA, 22 nt, Pseudomonas putida KT2440
cauugcgauguaucagcgccuc

SEQ ID NO: 3530377 - RNA, 18 nt, Pseudomonas putida KT2440
cauugcggccgucaacga

SEQ ID NO: 3530378 - RNA, 23 nt, Pseudomonas putida KT2440
cauugcggcugaauccuagcuuc

SEQ ID NO: 3530379 - RNA, 17 nt, Pseudomonas putida KT2440
cauugcuaauuucaggu

SEQ ID NO: 3530380 - RNA, 17 nt, Pseudomonas putida KT2440
cauugcucacugaccac

SEQ ID NO: 3530381 - RNA, 17 nt, Pseudomonas putida KT2440
cauugcugaucccugcc

SEQ ID NO: 3530382 - RNA, 21 nt, Pseudomonas putida KT2440
cauugcuggaguguaaccaug

SEQ ID NO: 3530383 - RNA, 21 nt, Pseudomonas putida KT2440
cauuggaaaaugaugcagaug

SEQ ID NO: 3530384 - RNA, 16 nt, Pseudomonas putida KT2440
cauuggacgauuguaa

SEQ ID NO: 3530385 - RNA, 22 nt, Pseudomonas putida KT2440
cauuggagcguugcaggcgcuc

SEQ ID NO: 3530386 - RNA, 18 nt, Pseudomonas putida KT2440
cauuggaggugcgcggca

SEQ ID NO: 3530387 - RNA, 17 nt, Pseudomonas putida KT2440
cauuggccaaccagccg

SEQ ID NO: 3530388 - RNA, 21 nt, Pseudomonas putida KT2440
cauuggccaaccagccggcaa

SEQ ID NO: 3530389 - RNA, 16 nt, Pseudomonas putida KT2440
cauuggccgcgcgccc

SEQ ID NO: 3530390 - RNA, 21 nt, Pseudomonas putida KT2440
cauuggcggcaggcgcagcug

SEQ ID NO: 3530391 - RNA, 19 nt, Pseudomonas putida KT2440
cauuggggcugcauugcag

SEQ ID NO: 3530392 - RNA, 17 nt, Pseudomonas putida KT2440
cauugggucccugguuc

SEQ ID NO: 3530393 - RNA, 12 nt, Pseudomonas putida KT2440
cauuggucgugc

SEQ ID NO: 3530394 - RNA, 22 nt, Pseudomonas putida KT2440
cauuggucgugcauguagccaa

SEQ ID NO: 3530395 - RNA, 13 nt, Pseudomonas putida KT2440
cauuggugaaagc

SEQ ID NO: 3530396 - RNA, 23 nt, Pseudomonas putida KT2440
cauugugagucccuguaggcgca

SEQ ID NO: 3530397 - RNA, 21 nt, Pseudomonas putida KT2440
cauuguugcaacgcagcgcgu

SEQ ID NO: 3530398 - RNA, 17 nt, Pseudomonas putida KT2440
cauuucacagcaaaaaa

SEQ ID NO: 3530399 - RNA, 14 nt, Pseudomonas putida KT2440
cauuucaccugcuc

SEQ ID NO: 3530400 - RNA, 18 nt, Pseudomonas putida KT2440
cauuucaccugcucuggc

SEQ ID NO: 3530401 - RNA, 21 nt, Pseudomonas putida KT2440
cauuucacuggcuuccucuuc

SEQ ID NO: 3530402 - RNA, 22 nt, Pseudomonas putida KT2440
cauuucacuggcuuccucuuca

SEQ ID NO: 3530403 - RNA, 11 nt, Pseudomonas putida KT2440
cauuucaggcu

SEQ ID NO: 3530404 - RNA, 21 nt, Pseudomonas putida KT2440
cauuuccauacgugcaccggc

SEQ ID NO: 3530405 - RNA, 21 nt, Pseudomonas putida KT2440
cauuuccgggcaaugcaggca

SEQ ID NO: 3530406 - RNA, 20 nt, Pseudomonas putida KT2440
cauuucgaagcugucuucuu

SEQ ID NO: 3530407 - RNA, 21 nt, Pseudomonas putida KT2440
cauuucgcgcagggugccggc

SEQ ID NO: 3530408 - RNA, 23 nt, Pseudomonas putida KT2440
cauuucgcgcagggugccggcca

SEQ ID NO: 3530409 - RNA, 14 nt, Pseudomonas putida KT2440
cauuucgcggcgca

SEQ ID NO: 3530410 - RNA, 17 nt, Pseudomonas putida KT2440
cauuucguccaggcuca

SEQ ID NO: 3530411 - RNA, 15 nt, Pseudomonas putida KT2440
cauuucugcaugucc

SEQ ID NO: 3530412 - RNA, 15 nt, Pseudomonas putida KT2440
cauuugcagcacaag

SEQ ID NO: 3530413 - RNA, 20 nt, Pseudomonas putida KT2440
cauuuguaggagcggguuua

SEQ ID NO: 3530414 - RNA, 15 nt, Pseudomonas putida KT2440
cauuuucaucaaaag

SEQ ID NO: 3530415 - RNA, 21 nt, Pseudomonas putida KT2440
cauuuucggcaaggcgaccug

SEQ ID NO: 3530416 - RNA, 17 nt, Pseudomonas putida KT2440
ccaaaagcccacucaau

SEQ ID NO: 3530417 - RNA, 19 nt, Pseudomonas putida KT2440
ccaaacaacaaagccccgg

SEQ ID NO: 3530418 - RNA, 21 nt, Pseudomonas putida KT2440
ccaaacaguuggugggcaacc

SEQ ID NO: 3530419 - RNA, 22 nt, Pseudomonas putida KT2440
ccaaaccaggccguugaucagc

SEQ ID NO: 3530420 - RNA, 21 nt, Pseudomonas putida KT2440
ccaaaccauggcgucaggcgu

SEQ ID NO: 3530421 - RNA, 12 nt, Pseudomonas putida KT2440
ccaaaccccagc

SEQ ID NO: 3530422 - RNA, 16 nt, Pseudomonas putida KT2440
ccaaaccccagcaagg

SEQ ID NO: 3530423 - RNA, 17 nt, Pseudomonas putida KT2440
ccaaaccgcugcccagc

SEQ ID NO: 3530424 - RNA, 23 nt, Pseudomonas putida KT2440
ccaaacuugugugaacggcgccu

SEQ ID NO: 3530425 - RNA, 23 nt, Pseudomonas putida KT2440
ccaaagaaggacucggcguagca

SEQ ID NO: 3530426 - RNA, 19 nt, Pseudomonas putida KT2440
ccaaagauaccccugcgcc

SEQ ID NO: 3530427 - RNA, 22 nt, Pseudomonas putida KT2440
ccaaagccaauuugccagcgug

SEQ ID NO: 3530428 - RNA, 15 nt, Pseudomonas putida KT2440
ccaaagcccgugccg

SEQ ID NO: 3530429 - RNA, 23 nt, Pseudomonas putida KT2440
ccaaagcccgugccgcaucagcc

SEQ ID NO: 3530430 - RNA, 17 nt, Pseudomonas putida KT2440
ccaaucgcugugcaaca

SEQ ID NO: 3530431 - RNA, 22 nt, Pseudomonas putida KT2440
ccaaucgggugaggaugaggga

SEQ ID NO: 3530432 - RNA, 16 nt, Pseudomonas putida KT2440
ccaaucuccacccgcc

SEQ ID NO: 3530433 - RNA, 13 nt, Pseudomonas putida KT2440
ccaaucuccagcc

SEQ ID NO: 3530434 - RNA, 18 nt, Pseudomonas putida KT2440
ccaaucuccagcccgaaa

SEQ ID NO: 3530435 - RNA, 22 nt, Pseudomonas putida KT2440
ccaaucucgggguguagcgcag

SEQ ID NO: 3530436 - RNA, 17 nt, Pseudomonas putida KT2440
ccaaucugguuacccaa

SEQ ID NO: 3530437 - RNA, 13 nt, Pseudomonas putida KT2440
ccaaugcacgccu

SEQ ID NO: 3530438 - RNA, 20 nt, Pseudomonas putida KT2440
ccaaugcagcuuugaggcuc

SEQ ID NO: 3530439 - RNA, 21 nt, Pseudomonas putida KT2440
ccaaugcagcuuugaggcuca

SEQ ID NO: 3530440 - RNA, 16 nt, Pseudomonas putida KT2440
ccaaugccgugauggu

SEQ ID NO: 3530441 - RNA, 12 nt, Pseudomonas putida KT2440
ccaauugcgcca

SEQ ID NO: 3530442 - RNA, 23 nt, Pseudomonas putida KT2440
ccaauugguuaaaagccaacugc

SEQ ID NO: 3530443 - RNA, 17 nt, Pseudomonas putida KT2440
ccacaaaaccuuccaug

SEQ ID NO: 3530444 - RNA, 18 nt, Pseudomonas putida KT2440
ccacaaaaucacaggcca

SEQ ID NO: 3530445 - RNA, 13 nt, Pseudomonas putida KT2440
ccacaaaccacag

SEQ ID NO: 3530446 - RNA, 14 nt, Pseudomonas putida KT2440
ccacaaacucuccu

SEQ ID NO: 3530447 - RNA, 22 nt, Pseudomonas putida KT2440
ccacaaacucuccuugcguugc

SEQ ID NO: 3530448 - RNA, 22 nt, Pseudomonas putida KT2440
ccacaaagccuucccccuccug

SEQ ID NO: 3530449 - RNA, 15 nt, Pseudomonas putida KT2440
ccacaaccccugcaa

SEQ ID NO: 3530450 - RNA, 16 nt, Pseudomonas putida KT2440
ccacaacccuugcagc

SEQ ID NO: 3530451 - RNA, 16 nt, Pseudomonas putida KT2440
ccacaagcgcaggcgg

SEQ ID NO: 3530452 - RNA, 21 nt, Pseudomonas putida KT2440
ccacaagcgcaggcgguuggc

SEQ ID NO: 3530453 - RNA, 20 nt, Pseudomonas putida KT2440
ccacaagucggguuuaccug

SEQ ID NO: 3530454 - RNA, 20 nt, Pseudomonas putida KT2440
ccacaauguagucgucggcc

SEQ ID NO: 3530455 - RNA, 19 nt, Pseudomonas putida KT2440
ccacacaccccagaacggc

SEQ ID NO: 3530456 - RNA, 17 nt, Pseudomonas putida KT2440
ccacaccaaagucagcc

SEQ ID NO: 3530457 - RNA, 18 nt, Pseudomonas putida KT2440
ccacaccaaagucagcca

SEQ ID NO: 3530458 - RNA, 17 nt, Pseudomonas putida KT2440
ccacaccacagcugcac

SEQ ID NO: 3530459 - RNA, 15 nt, Pseudomonas putida KT2440
ccacacccgcgcguu

SEQ ID NO: 3530460 - RNA, 20 nt, Pseudomonas putida KT2440
ccacacccucguccccgcgc

SEQ ID NO: 3530461 - RNA, 15 nt, Pseudomonas putida KT2440
ccacacccugcgaag

SEQ ID NO: 3530462 - RNA, 15 nt, Pseudomonas putida KT2440
ccacaccucgacccg

SEQ ID NO: 3530463 - RNA, 22 nt, Pseudomonas putida KT2440
ccacaccugccaggccaaacag

SEQ ID NO: 3530464 - RNA, 17 nt, Pseudomonas putida KT2440
ccacacggcaagccacg

SEQ ID NO: 3530465 - RNA, 18 nt, Pseudomonas putida KT2440
ccacacggcaagccacgc

SEQ ID NO: 3530466 - RNA, 21 nt, Pseudomonas putida KT2440
ccacacggcaagccacgccag

SEQ ID NO: 3530467 - RNA, 16 nt, Pseudomonas putida KT2440
ccacacggcagcccca

SEQ ID NO: 3530468 - RNA, 14 nt, Pseudomonas putida KT2440
ccacacgggcguuc

SEQ ID NO: 3530469 - RNA, 17 nt, Pseudomonas putida KT2440
ccacacucgacgcugcc

SEQ ID NO: 3530470 - RNA, 21 nt, Pseudomonas putida KT2440
ccacacucgacgcugccgucu

SEQ ID NO: 3530471 - RNA, 19 nt, Pseudomonas putida KT2440
ccacacugucccggcacaa

SEQ ID NO: 3530472 - RNA, 21 nt, Pseudomonas putida KT2440
ccacagcagucuugugcugcg

SEQ ID NO: 3530473 - RNA, 17 nt, Pseudomonas putida KT2440
ccacagccauuggccca

SEQ ID NO: 3530474 - RNA, 15 nt, Pseudomonas putida KT2440
ccacagcggccacag

SEQ ID NO: 3530475 - RNA, 20 nt, Pseudomonas putida KT2440
ccacagcggccacagcgcca

SEQ ID NO: 3530476 - RNA, 21 nt, Pseudomonas putida KT2440
ccacagcggccacagcgccaa

SEQ ID NO: 3530477 - RNA, 20 nt, Pseudomonas putida KT2440
ccacaggaaucaccagaccu

SEQ ID NO: 3530478 - RNA, 17 nt, Pseudomonas putida KT2440
ccacaggaauggcacca

SEQ ID NO: 3530479 - RNA, 21 nt, Pseudomonas putida KT2440
ccacaggaauuacgcaggcuc

SEQ ID NO: 3530480 - RNA, 12 nt, Pseudomonas putida KT2440
ccacaggcgccc

SEQ ID NO: 3530481 - RNA, 19 nt, Pseudomonas putida KT2440
ccacaggcgcuugaagaag

SEQ ID NO: 3530482 - RNA, 21 nt, Pseudomonas putida KT2440
ccacaggcgcuugaagaagcc

SEQ ID NO: 3530483 - RNA, 18 nt, Pseudomonas putida KT2440
ccacagggaucgcgccag

SEQ ID NO: 3530484 - RNA, 20 nt, Pseudomonas putida KT2440
ccacagggaucgcgccagcu

SEQ ID NO: 3530485 - RNA, 14 nt, Pseudomonas putida KT2440
ccacaggggccgcg

SEQ ID NO: 3530486 - RNA, 16 nt, Pseudomonas putida KT2440
ccacaggggccgcgca

SEQ ID NO: 3530487 - RNA, 18 nt, Pseudomonas putida KT2440
ccacagguaagucacagg

SEQ ID NO: 3530488 - RNA, 18 nt, Pseudomonas putida KT2440
ccacagguaaugcacaag

SEQ ID NO: 3530489 - RNA, 14 nt, Pseudomonas putida KT2440
ccacagguaccagg

SEQ ID NO: 3530490 - RNA, 15 nt, Pseudomonas putida KT2440
ccacagguaccaggc

SEQ ID NO: 3530491 - RNA, 20 nt, Pseudomonas putida KT2440
ccacagguacucgcaagcuc

SEQ ID NO: 3530492 - RNA, 23 nt, Pseudomonas putida KT2440
ccacagguacucgcaagcuccag

SEQ ID NO: 3530493 - RNA, 20 nt, Pseudomonas putida KT2440
ccacagguacugagucggcc

SEQ ID NO: 3530494 - RNA, 23 nt, Pseudomonas putida KT2440
ccacagguacugagucggccucg

SEQ ID NO: 3530495 - RNA, 16 nt, Pseudomonas putida KT2440
ccacagguacugcgca

SEQ ID NO: 3530496 - RNA, 20 nt, Pseudomonas putida KT2440
ccacagguacugcgcaaucc

SEQ ID NO: 3530497 - RNA, 18 nt, Pseudomonas putida KT2440
ccacagguaugugagcug

SEQ ID NO: 3530498 - RNA, 17 nt, Pseudomonas putida KT2440
ccacagguccagcgcag

SEQ ID NO: 3530499 - RNA, 18 nt, Pseudomonas putida KT2440
ccacaggugacaagcugc

SEQ ID NO: 3530500 - RNA, 23 nt, Pseudomonas putida KT2440
ccacagguuuagcgcuggcuuug

SEQ ID NO: 3530501 - RNA, 21 nt, Pseudomonas putida KT2440
ccacagugcuuccagcaggac

SEQ ID NO: 3530502 - RNA, 22 nt, Pseudomonas putida KT2440
ccacaguucauuguucuggcca

SEQ ID NO: 3530503 - RNA, 14 nt, Pseudomonas putida KT2440
ccacaguugcggga

SEQ ID NO: 3530504 - RNA, 19 nt, Pseudomonas putida KT2440
ccacauacugcuucugccg

SEQ ID NO: 3530505 - RNA, 15 nt, Pseudomonas putida KT2440
ccacauaggccagcu

SEQ ID NO: 3530506 - RNA, 15 nt, Pseudomonas putida KT2440
ccacauccucugccc

SEQ ID NO: 3530507 - RNA, 17 nt, Pseudomonas putida KT2440
ccacaucggcgcgcccu

SEQ ID NO: 3530508 - RNA, 23 nt, Pseudomonas putida KT2440
ccacaugccagcuaucucccagc

SEQ ID NO: 3530509 - RNA, 23 nt, Pseudomonas putida KT2440
ccacaugcgagccgcugccaaag

SEQ ID NO: 3530510 - RNA, 14 nt, Pseudomonas putida KT2440
ccacaugcugcgcc

SEQ ID NO: 3530511 - RNA, 20 nt, Pseudomonas putida KT2440
ccacaugcugcgccccaggu

SEQ ID NO: 3530512 - RNA, 17 nt, Pseudomonas putida KT2440
ccacauggaucagcuca

SEQ ID NO: 3530513 - RNA, 21 nt, Pseudomonas putida KT2440
ccacauggaucagcucauaga

SEQ ID NO: 3530514 - RNA, 12 nt, Pseudomonas putida KT2440
ccacauggccgu

SEQ ID NO: 3530515 - RNA, 16 nt, Pseudomonas putida KT2440
ccaccaaaggccuuga

SEQ ID NO: 3530516 - RNA, 20 nt, Pseudomonas putida KT2440
ccaccaacagcaccggccag

SEQ ID NO: 3530517 - RNA, 14 nt, Pseudomonas putida KT2440
ccaccaaggcugac

SEQ ID NO: 3530518 - RNA, 23 nt, Pseudomonas putida KT2440
ccaccaaggcugacgccaguugg

SEQ ID NO: 3530519 - RNA, 20 nt, Pseudomonas putida KT2440
ccaccaagucgauuuucacg

SEQ ID NO: 3530520 - RNA, 16 nt, Pseudomonas putida KT2440
ccaccacaaaccacag

SEQ ID NO: 3530521 - RNA, 17 nt, Pseudomonas putida KT2440
ccaccacaaaccacagc

SEQ ID NO: 3530522 - RNA, 13 nt, Pseudomonas putida KT2440
ccaccacacgccc

SEQ ID NO: 3530523 - RNA, 21 nt, Pseudomonas putida KT2440
ccaccaccagcgcccuucacg

SEQ ID NO: 3530524 - RNA, 14 nt, Pseudomonas putida KT2440
ccaccacccuggca

SEQ ID NO: 3530525 - RNA, 20 nt, Pseudomonas putida KT2440
ccaccaccgcugauggccaa

SEQ ID NO: 3530526 - RNA, 20 nt, Pseudomonas putida KT2440
ccaccaccguauuaaggcaa

SEQ ID NO: 3530527 - RNA, 13 nt, Pseudomonas putida KT2440
ccaccaccugcag

SEQ ID NO: 3530528 - RNA, 16 nt, Pseudomonas putida KT2440
ccaccaccugcagggu

SEQ ID NO: 3530529 - RNA, 19 nt, Pseudomonas putida KT2440
ccaccacgaugccugggcg

SEQ ID NO: 3530530 - RNA, 17 nt, Pseudomonas putida KT2440
ccaccacggccuggccu

SEQ ID NO: 3530531 - RNA, 17 nt, Pseudomonas putida KT2440
ccaccacgguacuuggc

SEQ ID NO: 3530532 - RNA, 13 nt, Pseudomonas putida KT2440
ccaccacuucugg

SEQ ID NO: 3530533 - RNA, 23 nt, Pseudomonas putida KT2440
ccaccacuugcucggugcugcug

SEQ ID NO: 3530534 - RNA, 14 nt, Pseudomonas putida KT2440
ccaccagacgggca

SEQ ID NO: 3530535 - RNA, 22 nt, Pseudomonas putida KT2440
ccaccugccaacgcaccgacca

SEQ ID NO: 3530536 - RNA, 23 nt, Pseudomonas putida KT2440
ccaccugccaacgcaccgaccac

SEQ ID NO: 3530537 - RNA, 23 nt, Pseudomonas putida KT2440
ccaccugcggcaggugggucacg

SEQ ID NO: 3530538 - RNA, 13 nt, Pseudomonas putida KT2440
ccaccugcuccag

SEQ ID NO: 3530539 - RNA, 22 nt, Pseudomonas putida KT2440
ccaccuggaauucgcugcgcau

SEQ ID NO: 3530540 - RNA, 17 nt, Pseudomonas putida KT2440
ccaccuggccacccggc

SEQ ID NO: 3530541 - RNA, 15 nt, Pseudomonas putida KT2440
ccaccuggcccugcu

SEQ ID NO: 3530542 - RNA, 21 nt, Pseudomonas putida KT2440
ccaccuggcccugcucacgca

SEQ ID NO: 3530543 - RNA, 12 nt, Pseudomonas putida KT2440
ccaccugggcca

SEQ ID NO: 3530544 - RNA, 14 nt, Pseudomonas putida KT2440
ccaccugggccagu

SEQ ID NO: 3530545 - RNA, 16 nt, Pseudomonas putida KT2440
ccaccuuacuugcaca

SEQ ID NO: 3530546 - RNA, 21 nt, Pseudomonas putida KT2440
ccaccuucaauagcggccaac

SEQ ID NO: 3530547 - RNA, 13 nt, Pseudomonas putida KT2440
ccaccuuccacuc

SEQ ID NO: 3530548 - RNA, 16 nt, Pseudomonas putida KT2440
ccaccuuccaggucga

SEQ ID NO: 3530549 - RNA, 21 nt, Pseudomonas putida KT2440
ccaccuuccaggucgaucgca

SEQ ID NO: 3530550 - RNA, 16 nt, Pseudomonas putida KT2440
ccaccuuggcccuucc

SEQ ID NO: 3530551 - RNA, 22 nt, Pseudomonas putida KT2440
ccaccuuguucgagcgccauga

SEQ ID NO: 3530552 - RNA, 15 nt, Pseudomonas putida KT2440
ccacgaaccugugca

SEQ ID NO: 3530553 - RNA, 17 nt, Pseudomonas putida KT2440
ccacgaacgcccccagc

SEQ ID NO: 3530554 - RNA, 19 nt, Pseudomonas putida KT2440
ccacgaacgcccccagccc

SEQ ID NO: 3530555 - RNA, 21 nt, Pseudomonas putida KT2440
ccacgaagcgcggcaaggugg

SEQ ID NO: 3530556 - RNA, 23 nt, Pseudomonas putida KT2440
ccacgaccggcucaacagcaggu

SEQ ID NO: 3530557 - RNA, 16 nt, Pseudomonas putida KT2440
ccacgaccgugaaacc

SEQ ID NO: 3530558 - RNA, 20 nt, Pseudomonas putida KT2440
ccacgaucacgcccgggcca

SEQ ID NO: 3530559 - RNA, 18 nt, Pseudomonas putida KT2440
ccacgaucuuggccaggg

SEQ ID NO: 3530560 - RNA, 21 nt, Pseudomonas putida KT2440
ccacgaucuuggccagggccu

SEQ ID NO: 3530561 - RNA, 18 nt, Pseudomonas putida KT2440
ccacgaugccuucgacca

SEQ ID NO: 3530562 - RNA, 17 nt, Pseudomonas putida KT2440
ccacgcaaaaccugagu

SEQ ID NO: 3530563 - RNA, 15 nt, Pseudomonas putida KT2440
ccacgcacaucgucc

SEQ ID NO: 3530564 - RNA, 22 nt, Pseudomonas putida KT2440
ccacgcacaucguccgccgcgc

SEQ ID NO: 3530565 - RNA, 19 nt, Pseudomonas putida KT2440
ccacgcaccaccaagucga

SEQ ID NO: 3530566 - RNA, 22 nt, Pseudomonas putida KT2440
ccacgcaccagggcuggcagcg

SEQ ID NO: 3530567 - RNA, 14 nt, Pseudomonas putida KT2440
ccacgcaguuggcc

SEQ ID NO: 3530568 - RNA, 15 nt, Pseudomonas putida KT2440
ccacgcaguuggcca

SEQ ID NO: 3530569 - RNA, 17 nt, Pseudomonas putida KT2440
ccacgcaucugcaccug

SEQ ID NO: 3530570 - RNA, 21 nt, Pseudomonas putida KT2440
ccacgcaugccuaucucuucc

SEQ ID NO: 3530571 - RNA, 16 nt, Pseudomonas putida KT2440
ccacgccaccaugcuc

SEQ ID NO: 3530572 - RNA, 15 nt, Pseudomonas putida KT2440
ccacgccagaaccug

SEQ ID NO: 3530573 - RNA, 16 nt, Pseudomonas putida KT2440
ccacgcccaacccagc

SEQ ID NO: 3530574 - RNA, 17 nt, Pseudomonas putida KT2440
ccacgcccaaccccagc

SEQ ID NO: 3530575 - RNA, 17 nt, Pseudomonas putida KT2440
ccacgcccgccggcacu

SEQ ID NO: 3530576 - RNA, 23 nt, Pseudomonas putida KT2440
ccacgcccgccggcacuuccucg

SEQ ID NO: 3530577 - RNA, 14 nt, Pseudomonas putida KT2440
ccacgcccgcugca

SEQ ID NO: 3530578 - RNA, 17 nt, Pseudomonas putida KT2440
ccacgcccgcugcaugc

SEQ ID NO: 3530579 - RNA, 20 nt, Pseudomonas putida KT2440
ccacgcccgucaccuugcca

SEQ ID NO: 3530580 - RNA, 17 nt, Pseudomonas putida KT2440
ccacgcccuggcccgcc

SEQ ID NO: 3530581 - RNA, 23 nt, Pseudomonas putida KT2440
ccacgcccuggcccgccgccacc

SEQ ID NO: 3530582 - RNA, 17 nt, Pseudomonas putida KT2440
ccacgccgaagcgcgcc

SEQ ID NO: 3530583 - RNA, 19 nt, Pseudomonas putida KT2440
ccacgccgaccgcgcgcac

SEQ ID NO: 3530584 - RNA, 21 nt, Pseudomonas putida KT2440
ccacgccgauguccuugcugg

SEQ ID NO: 3530585 - RNA, 12 nt, Pseudomonas putida KT2440
ccacgccgccag

SEQ ID NO: 3530586 - RNA, 21 nt, Pseudomonas putida KT2440
ccacgccgcugccaaccggcu

SEQ ID NO: 3530587 - RNA, 14 nt, Pseudomonas putida KT2440
ccacgccggcaacc

SEQ ID NO: 3530588 - RNA, 21 nt, Pseudomonas putida KT2440
ccacgcuagucaagcugcgcc

SEQ ID NO: 3530589 - RNA, 23 nt, Pseudomonas putida KT2440
ccacgcucaaccccaucaccuug

SEQ ID NO: 3530590 - RNA, 14 nt, Pseudomonas putida KT2440
ccacgcuccagucg

SEQ ID NO: 3530591 - RNA, 14 nt, Pseudomonas putida KT2440
ccacgcugccagga

SEQ ID NO: 3530592 - RNA, 23 nt, Pseudomonas putida KT2440
ccacgcugcggcgaaagccagca

SEQ ID NO: 3530593 - RNA, 13 nt, Pseudomonas putida KT2440
ccacgcuggcacc

SEQ ID NO: 3530594 - RNA, 21 nt, Pseudomonas putida KT2440
ccacggaacaucgaggcgcgc

SEQ ID NO: 3530595 - RNA, 17 nt, Pseudomonas putida KT2440
ccacggaaggccacgcc

SEQ ID NO: 3530596 - RNA, 21 nt, Pseudomonas putida KT2440
ccacggcaaucggcaggccgg

SEQ ID NO: 3530597 - RNA, 21 nt, Pseudomonas putida KT2440
ccacggcaauucgccggcagc

SEQ ID NO: 3530598 - RNA, 20 nt, Pseudomonas putida KT2440
ccacggccaccuugccaucg

SEQ ID NO: 3530599 - RNA, 18 nt, Pseudomonas putida KT2440
ccacggccgaguccuugc

SEQ ID NO: 3530600 - RNA, 13 nt, Pseudomonas putida KT2440
ccacggccgccaa

SEQ ID NO: 3530601 - RNA, 13 nt, Pseudomonas putida KT2440
ccacggccgcgca

SEQ ID NO: 3530602 - RNA, 23 nt, Pseudomonas putida KT2440
ccacggccuucuucacgcaugua

SEQ ID NO: 3530603 - RNA, 18 nt, Pseudomonas putida KT2440
ccacggcggcgaucagcg

SEQ ID NO: 3530604 - RNA, 22 nt, Pseudomonas putida KT2440
ccacggcguccaggcccgccag

SEQ ID NO: 3530605 - RNA, 16 nt, Pseudomonas putida KT2440
ccacgguacgggcaaa

SEQ ID NO: 3530606 - RNA, 15 nt, Pseudomonas putida KT2440
ccacgguauaguggu

SEQ ID NO: 3530607 - RNA, 21 nt, Pseudomonas putida KT2440
ccacggucagcauccagccau

SEQ ID NO: 3530608 - RNA, 12 nt, Pseudomonas putida KT2440
ccacggucggcc

SEQ ID NO: 3530609 - RNA, 24 nt, Pseudomonas putida KT2440
ccacggucggccugcgcuccagca

SEQ ID NO: 3530610 - RNA, 15 nt, Pseudomonas putida KT2440
ccacggucuggcgca

SEQ ID NO: 3530611 - RNA, 21 nt, Pseudomonas putida KT2440
ccacggugccgaacagcacga

SEQ ID NO: 3530612 - RNA, 13 nt, Pseudomonas putida KT2440
ccacgucacgcac

SEQ ID NO: 3530613 - RNA, 19 nt, Pseudomonas putida KT2440
ccacguccggccagcaaca

SEQ ID NO: 3530614 - RNA, 14 nt, Pseudomonas putida KT2440
ccacgucgccagcg

SEQ ID NO: 3530615 - RNA, 18 nt, Pseudomonas putida KT2440
ccacgucuuccuggcgga

SEQ ID NO: 3530616 - RNA, 19 nt, Pseudomonas putida KT2440
ccacguuauccagcugcaa

SEQ ID NO: 3530617 - RNA, 16 nt, Pseudomonas putida KT2440
ccacguucccgccaug

SEQ ID NO: 3530618 - RNA, 21 nt, Pseudomonas putida KT2440
ccacguucccgccauguugcg

SEQ ID NO: 3530619 - RNA, 18 nt, Pseudomonas putida KT2440
ccacguugaucgucggcc

SEQ ID NO: 3530620 - RNA, 20 nt, Pseudomonas putida KT2440
ccacguuugagcaguucguc

SEQ ID NO: 3530621 - RNA, 13 nt, Pseudomonas putida KT2440
ccacguuuucgcg

SEQ ID NO: 3530622 - RNA, 21 nt, Pseudomonas putida KT2440
ccacuaagaagcaaccgcugc

SEQ ID NO: 3530623 - RNA, 20 nt, Pseudomonas putida KT2440
ccacuaccgcaaaugcugcc

SEQ ID NO: 3530624 - RNA, 12 nt, Pseudomonas putida KT2440
ccacuaucgcca

SEQ ID NO: 3530625 - RNA, 22 nt, Pseudomonas putida KT2440
ccacucacgcaacucuaccuca

SEQ ID NO: 3530626 - RNA, 18 nt, Pseudomonas putida KT2440
ccacucaggcgcaaaucg

SEQ ID NO: 3530627 - RNA, 11 nt, Pseudomonas putida KT2440
ccacuccagcc

SEQ ID NO: 3530628 - RNA, 16 nt, Pseudomonas putida KT2440
ccacuccagccgucga

SEQ ID NO: 3530629 - RNA, 21 nt, Pseudomonas putida KT2440
ccacucccauguagaccacca

SEQ ID NO: 3530630 - RNA, 22 nt, Pseudomonas putida KT2440
ccacuccgggugaucauucagg

SEQ ID NO: 3530631 - RNA, 23 nt, Pseudomonas putida KT2440
ccacuccgggugaucauucaggc

SEQ ID NO: 3530632 - RNA, 22 nt, Pseudomonas putida KT2440
ccacucgcgcagcacaucacac

SEQ ID NO: 3530633 - RNA, 11 nt, Pseudomonas putida KT2440
ccacucggcaa

SEQ ID NO: 3530634 - RNA, 16 nt, Pseudomonas putida KT2440
ccacucggcaaucugc

SEQ ID NO: 3530635 - RNA, 18 nt, Pseudomonas putida KT2440
ccacugaccagcccggcu

SEQ ID NO: 3530636 - RNA, 16 nt, Pseudomonas putida KT2440
ccacugcaccaaugac

SEQ ID NO: 3530637 - RNA, 23 nt, Pseudomonas putida KT2440
ccacugcaccaaugacuccgccc

SEQ ID NO: 3530638 - RNA, 22 nt, Pseudomonas putida KT2440
ccacugcacccgugcagggcug

SEQ ID NO: 3530639 - RNA, 21 nt, Pseudomonas putida KT2440
ccagcaccagcgcgaucacca

SEQ ID NO: 3530640 - RNA, 22 nt, Pseudomonas putida KT2440
ccagcaccaucagagcgccagc

SEQ ID NO: 3530641 - RNA, 23 nt, Pseudomonas putida KT2440
ccagcaccaucagagcgccagca

SEQ ID NO: 3530642 - RNA, 23 nt, Pseudomonas putida KT2440
ccagcaccaucaggcacaggcca

SEQ ID NO: 3530643 - RNA, 21 nt, Pseudomonas putida KT2440
ccagcaccccgaacgcgguaa

SEQ ID NO: 3530644 - RNA, 17 nt, Pseudomonas putida KT2440
ccagcacccgcaggcga

SEQ ID NO: 3530645 - RNA, 13 nt, Pseudomonas putida KT2440
ccagcacccgcuu

SEQ ID NO: 3530646 - RNA, 19 nt, Pseudomonas putida KT2440
ccagcaccgaaccggcgau

SEQ ID NO: 3530647 - RNA, 23 nt, Pseudomonas putida KT2440
ccagcaccgaaccggcgaucagg

SEQ ID NO: 3530648 - RNA, 12 nt, Pseudomonas putida KT2440
ccagcaccgccc

SEQ ID NO: 3530649 - RNA, 12 nt, Pseudomonas putida KT2440
ccagcaccggcg

SEQ ID NO: 3530650 - RNA, 19 nt, Pseudomonas putida KT2440
ccagcaccugacgcaagcg

SEQ ID NO: 3530651 - RNA, 14 nt, Pseudomonas putida KT2440
ccagcaccugcagg

SEQ ID NO: 3530652 - RNA, 20 nt, Pseudomonas putida KT2440
ccagcaccugcagguacagc

SEQ ID NO: 3530653 - RNA, 16 nt, Pseudomonas putida KT2440
ccagcaccuggcggcc

SEQ ID NO: 3530654 - RNA, 16 nt, Pseudomonas putida KT2440
ccagcacgaacagcaa

SEQ ID NO: 3530655 - RNA, 16 nt, Pseudomonas putida KT2440
ccagcacgaaggccag

SEQ ID NO: 3530656 - RNA, 19 nt, Pseudomonas putida KT2440
ccagcacgucacccacuuc

SEQ ID NO: 3530657 - RNA, 20 nt, Pseudomonas putida KT2440
ccagcacgucacccacuuca

SEQ ID NO: 3530658 - RNA, 24 nt, Pseudomonas putida KT2440
ccagcacguucucgcucagcguac

SEQ ID NO: 3530659 - RNA, 20 nt, Pseudomonas putida KT2440
ccagcacugccuggccacug

SEQ ID NO: 3530660 - RNA, 14 nt, Pseudomonas putida KT2440
ccagcacugccuug

SEQ ID NO: 3530661 - RNA, 17 nt, Pseudomonas putida KT2440
ccagcacugccuugccc

SEQ ID NO: 3530662 - RNA, 18 nt, Pseudomonas putida KT2440
ccagcacuucguccaggg

SEQ ID NO: 3530663 - RNA, 21 nt, Pseudomonas putida KT2440
ccagcacuucguccagggugg

SEQ ID NO: 3530664 - RNA, 19 nt, Pseudomonas putida KT2440
ccagcacuuuugccaccac

SEQ ID NO: 3530665 - RNA, 20 nt, Pseudomonas putida KT2440
ccagcacuuuugccaccacc

SEQ ID NO: 3530666 - RNA, 22 nt, Pseudomonas putida KT2440
ccagcacuuuugccaccacccg

SEQ ID NO: 3530667 - RNA, 22 nt, Pseudomonas putida KT2440
ccagcagauggcucaucgccgu

SEQ ID NO: 3530668 - RNA, 14 nt, Pseudomonas putida KT2440
ccagcagcaacgca

SEQ ID NO: 3530669 - RNA, 15 nt, Pseudomonas putida KT2440
ccagcagcaccugcc

SEQ ID NO: 3530670 - RNA, 11 nt, Pseudomonas putida KT2440
ccagcagcagc

SEQ ID NO: 3530671 - RNA, 14 nt, Pseudomonas putida KT2440
ccagcagcagcgca

SEQ ID NO: 3530672 - RNA, 20 nt, Pseudomonas putida KT2440
ccagcagcagcgcaccgugc

SEQ ID NO: 3530673 - RNA, 17 nt, Pseudomonas putida KT2440
ccagcagcaguggcaag

SEQ ID NO: 3530674 - RNA, 18 nt, Pseudomonas putida KT2440
ccagcagcaguggcaagc

SEQ ID NO: 3530675 - RNA, 14 nt, Pseudomonas putida KT2440
ccagcagccaacgc

SEQ ID NO: 3530676 - RNA, 23 nt, Pseudomonas putida KT2440
ccagcagccaacgccccaggccg

SEQ ID NO: 3530677 - RNA, 14 nt, Pseudomonas putida KT2440
ccagcagccccccu

SEQ ID NO: 3530678 - RNA, 9 nt, Pseudomonas putida KT2440
ccagcagcg

SEQ ID NO: 3530679 - RNA, 12 nt, Pseudomonas putida KT2440
ccagcagcgaca

SEQ ID NO: 3530680 - RNA, 19 nt, Pseudomonas putida KT2440
ccagcagcgacaccagcgc

SEQ ID NO: 3530681 - RNA, 21 nt, Pseudomonas putida KT2440
ccagcagcgacaccagcgcac

SEQ ID NO: 3530682 - RNA, 14 nt, Pseudomonas putida KT2440
ccagcagcgacacu

SEQ ID NO: 3530683 - RNA, 14 nt, Pseudomonas putida KT2440
ccagcagcgccugc

SEQ ID NO: 3530684 - RNA, 15 nt, Pseudomonas putida KT2440
ccagcagcgccugca

SEQ ID NO: 3530685 - RNA, 18 nt, Pseudomonas putida KT2440
ccagcagcgccugcagcg

SEQ ID NO: 3530686 - RNA, 19 nt, Pseudomonas putida KT2440
ccagcagcgccugcagcgc

SEQ ID NO: 3530687 - RNA, 15 nt, Pseudomonas putida KT2440
ccagcagcgcgugcu

SEQ ID NO: 3530688 - RNA, 20 nt, Pseudomonas putida KT2440
ccagcagcgcuccgccaaac

SEQ ID NO: 3530689 - RNA, 23 nt, Pseudomonas putida KT2440
ccagcagcgcuccgccaaacccc

SEQ ID NO: 3530690 - RNA, 23 nt, Pseudomonas putida KT2440
ccagcagcgcuucgaucgccggc

SEQ ID NO: 3530691 - RNA, 17 nt, Pseudomonas putida KT2440
ccagcagcgggcacagg

SEQ ID NO: 3530692 - RNA, 19 nt, Pseudomonas putida KT2440
ccagcagcgggcacaggcc

SEQ ID NO: 3530693 - RNA, 20 nt, Pseudomonas putida KT2440
ccagcagcgggcacaggccg

SEQ ID NO: 3530694 - RNA, 20 nt, Pseudomonas putida KT2440
ccagcagcggguuccccagc

SEQ ID NO: 3530695 - RNA, 18 nt, Pseudomonas putida KT2440
ccagcagcuccauaccaa

SEQ ID NO: 3530696 - RNA, 13 nt, Pseudomonas putida KT2440
ccagcagcuggcu

SEQ ID NO: 3530697 - RNA, 18 nt, Pseudomonas putida KT2440
ccagcagcuggcuugucu

SEQ ID NO: 3530698 - RNA, 12 nt, Pseudomonas putida KT2440
ccagcagcuuca

SEQ ID NO: 3530699 - RNA, 16 nt, Pseudomonas putida KT2440
ccagcagcuucuucac

SEQ ID NO: 3530700 - RNA, 23 nt, Pseudomonas putida KT2440
ccagcagcuucuucacaccggcc

SEQ ID NO: 3530701 - RNA, 19 nt, Pseudomonas putida KT2440
ccagcaggacccggcugga

SEQ ID NO: 3530702 - RNA, 23 nt, Pseudomonas putida KT2440
ccagcaggacgauaccguuguag

SEQ ID NO: 3530703 - RNA, 13 nt, Pseudomonas putida KT2440
ccagcaggccacc

SEQ ID NO: 3530704 - RNA, 19 nt, Pseudomonas putida KT2440
ccagcaggccaccggcagc

SEQ ID NO: 3530705 - RNA, 21 nt, Pseudomonas putida KT2440
ccagcaggccaccggcagcac

SEQ ID NO: 3530706 - RNA, 13 nt, Pseudomonas putida KT2440
ccagcaggccaua

SEQ ID NO: 3530707 - RNA, 15 nt, Pseudomonas putida KT2440
ccagcaggccauaca

SEQ ID NO: 3530708 - RNA, 12 nt, Pseudomonas putida KT2440
ccagcaggcccg

SEQ ID NO: 3530709 - RNA, 22 nt, Pseudomonas putida KT2440
ccagcaggccgaacucgauucg

SEQ ID NO: 3530710 - RNA, 17 nt, Pseudomonas putida KT2440
ccagcaggcuggcggcc

SEQ ID NO: 3530711 - RNA, 17 nt, Pseudomonas putida KT2440
ccagcaggcuugccagc

SEQ ID NO: 3530712 - RNA, 22 nt, Pseudomonas putida KT2440
ccagcagggccaucaucugcug

SEQ ID NO: 3530713 - RNA, 17 nt, Pseudomonas putida KT2440
ccagcagggccggccca

SEQ ID NO: 3530714 - RNA, 17 nt, Pseudomonas putida KT2440
ccagcaggggcagaugc

SEQ ID NO: 3530715 - RNA, 17 nt, Pseudomonas putida KT2440
ccagcaggguggccagc

SEQ ID NO: 3530716 - RNA, 14 nt, Pseudomonas putida KT2440
ccagcagguacacc

SEQ ID NO: 3530717 - RNA, 17 nt, Pseudomonas putida KT2440
ccagcagguacaccgcc

SEQ ID NO: 3530718 - RNA, 19 nt, Pseudomonas putida KT2440
ccagcagguacaccgccuc

SEQ ID NO: 3530719 - RNA, 21 nt, Pseudomonas putida KT2440
ccagcagguacaccgccucgg

SEQ ID NO: 3530720 - RNA, 16 nt, Pseudomonas putida KT2440
ccagcagguacagcac

SEQ ID NO: 3530721 - RNA, 20 nt, Pseudomonas putida KT2440
ccagcaggucagcacgcgcu

SEQ ID NO: 3530722 - RNA, 16 nt, Pseudomonas putida KT2440
ccagcaggucggcacg

SEQ ID NO: 3530723 - RNA, 23 nt, Pseudomonas putida KT2440
ccagcaggucggcacgcaccugu

SEQ ID NO: 3530724 - RNA, 17 nt, Pseudomonas putida KT2440
ccagcagguucaacggc

SEQ ID NO: 3530725 - RNA, 20 nt, Pseudomonas putida KT2440
ccagcagguuggacagcgcc

SEQ ID NO: 3530726 - RNA, 21 nt, Pseudomonas putida KT2440
ccagcagugcaucgaagcagg

SEQ ID NO: 3530727 - RNA, 22 nt, Pseudomonas putida KT2440
ccagcagugcaucgaagcaggc

SEQ ID NO: 3530728 - RNA, 12 nt, Pseudomonas putida KT2440
ccagcagugcca

SEQ ID NO: 3530729 - RNA, 12 nt, Pseudomonas putida KT2440
ccagcagugccg

SEQ ID NO: 3530730 - RNA, 14 nt, Pseudomonas putida KT2440
ccagcagugcggca

SEQ ID NO: 3530731 - RNA, 18 nt, Pseudomonas putida KT2440
ccagcaguucgcgcacca

SEQ ID NO: 3530732 - RNA, 21 nt, Pseudomonas putida KT2440
ccagcaguucgcgcaccaucg

SEQ ID NO: 3530733 - RNA, 23 nt, Pseudomonas putida KT2440
ccagcaguuggcugccggccucg

SEQ ID NO: 3530734 - RNA, 21 nt, Pseudomonas putida KT2440
ccagcaucaacaggucgccgc

SEQ ID NO: 3530735 - RNA, 23 nt, Pseudomonas putida KT2440
ccagcaucacccucacgaugacc

SEQ ID NO: 3530736 - RNA, 18 nt, Pseudomonas putida KT2440
ccagcaucacgccgcgcu

SEQ ID NO: 3530737 - RNA, 18 nt, Pseudomonas putida KT2440
ccagcaucagcacaccca

SEQ ID NO: 3530738 - RNA, 19 nt, Pseudomonas putida KT2440
ccagcaucagcacacccag

SEQ ID NO: 3530739 - RNA, 19 nt, Pseudomonas putida KT2440
ccagcaucgccccaggagg

SEQ ID NO: 3530740 - RNA, 17 nt, Pseudomonas putida KT2440
ccagcaucucggccagu

SEQ ID NO: 3530741 - RNA, 18 nt, Pseudomonas putida KT2440
ccagcaucucggccagug

SEQ ID NO: 3530742 - RNA, 16 nt, Pseudomonas putida KT2440
ccagcaugaacgcagc

SEQ ID NO: 3530743 - RNA, 15 nt, Pseudomonas putida KT2440
ccagcaugcugguua

SEQ ID NO: 3530744 - RNA, 14 nt, Pseudomonas putida KT2440
ccagcgaggguucc

SEQ ID NO: 3530745 - RNA, 13 nt, Pseudomonas putida KT2440
ccagcgaguggcc

SEQ ID NO: 3530746 - RNA, 15 nt, Pseudomonas putida KT2440
ccagcgaguggccac

SEQ ID NO: 3530747 - RNA, 23 nt, Pseudomonas putida KT2440
ccagcgauaaaccagcagcgccu

SEQ ID NO: 3530748 - RNA, 17 nt, Pseudomonas putida KT2440
ccagcgaugacccggcc

SEQ ID NO: 3530749 - RNA, 16 nt, Pseudomonas putida KT2440
ccagcgaugcugucgg

SEQ ID NO: 3530750 - RNA, 14 nt, Pseudomonas putida KT2440
ccagcgauggcgga

SEQ ID NO: 3530751 - RNA, 19 nt, Pseudomonas putida KT2440
ccagcgauggcggaucagc

SEQ ID NO: 3530752 - RNA, 16 nt, Pseudomonas putida KT2440
ccagcgauucaguuca

SEQ ID NO: 3530753 - RNA, 13 nt, Pseudomonas putida KT2440
ccagcgcacagcu

SEQ ID NO: 3530754 - RNA, 23 nt, Pseudomonas putida KT2440
ccagcgcauacagcuugcccauc

SEQ ID NO: 3530755 - RNA, 17 nt, Pseudomonas putida KT2440
ccagcgcaucaacgccu

SEQ ID NO: 3530756 - RNA, 15 nt, Pseudomonas putida KT2440
ccagcgcaucggcca

SEQ ID NO: 3530757 - RNA, 20 nt, Pseudomonas putida KT2440
ccagcgcaucggccacuucg

SEQ ID NO: 3530758 - RNA, 17 nt, Pseudomonas putida KT2440
ccagcgcaugcaucugc

SEQ ID NO: 3530759 - RNA, 17 nt, Pseudomonas putida KT2440
ccagcgccacccaggca

SEQ ID NO: 3530760 - RNA, 19 nt, Pseudomonas putida KT2440
ccagcgccaccgcgcgguu

SEQ ID NO: 3530761 - RNA, 15 nt, Pseudomonas putida KT2440
ccagcgccagcagcc

SEQ ID NO: 3530762 - RNA, 13 nt, Pseudomonas putida KT2440
ccagcgccagcca

SEQ ID NO: 3530763 - RNA, 13 nt, Pseudomonas putida KT2440
ccagcgccaguac

SEQ ID NO: 3530764 - RNA, 15 nt, Pseudomonas putida KT2440
ccagcgccgccaugc

SEQ ID NO: 3530765 - RNA, 19 nt, Pseudomonas putida KT2440
ccagcgccucaccgaccca

SEQ ID NO: 3530766 - RNA, 12 nt, Pseudomonas putida KT2440
ccagcgccugca

SEQ ID NO: 3530767 - RNA, 17 nt, Pseudomonas putida KT2440
ccagcgccugcaggccc

SEQ ID NO: 3530768 - RNA, 18 nt, Pseudomonas putida KT2440
ccagcgccuuggccugcu

SEQ ID NO: 3530769 - RNA, 21 nt, Pseudomonas putida KT2440
ccagcgccuuggccugcucac

SEQ ID NO: 3530770 - RNA, 18 nt, Pseudomonas putida KT2440
ccagcgcgaagcccagcu

SEQ ID NO: 3530771 - RNA, 22 nt, Pseudomonas putida KT2440
ccagcgcgaucaccagccccuc

SEQ ID NO: 3530772 - RNA, 15 nt, Pseudomonas putida KT2440
ccagcgcgccagcag

SEQ ID NO: 3530773 - RNA, 17 nt, Pseudomonas putida KT2440
ccagcgcgcugagcagg

SEQ ID NO: 3530774 - RNA, 16 nt, Pseudomonas putida KT2440
ccagcgcgcugcgcaa

SEQ ID NO: 3530775 - RNA, 19 nt, Pseudomonas putida KT2440
ccagcgcgcugcgcaagga

SEQ ID NO: 3530776 - RNA, 19 nt, Pseudomonas putida KT2440
ccagcgcggcaaaugcggc

SEQ ID NO: 3530777 - RNA, 15 nt, Pseudomonas putida KT2440
ccagcgcggccacgc

SEQ ID NO: 3530778 - RNA, 16 nt, Pseudomonas putida KT2440
ccagcgcggccacgcc

SEQ ID NO: 3530779 - RNA, 17 nt, Pseudomonas putida KT2440
ccagcgcggccacgccc

SEQ ID NO: 3530780 - RNA, 17 nt, Pseudomonas putida KT2440
ccagcgcgguagcugcc

SEQ ID NO: 3530781 - RNA, 19 nt, Pseudomonas putida KT2440
ccagcgcgguagcugccgc

SEQ ID NO: 3530782 - RNA, 18 nt, Pseudomonas putida KT2440
ccagcgcggucugcggca

SEQ ID NO: 3530783 - RNA, 22 nt, Pseudomonas putida KT2440
ccagcgcggucugcggcagcac

SEQ ID NO: 3530784 - RNA, 17 nt, Pseudomonas putida KT2440
ccagcgcguacagcgac

SEQ ID NO: 3530785 - RNA, 17 nt, Pseudomonas putida KT2440
ccagcgcuccagcaacg

SEQ ID NO: 3530786 - RNA, 20 nt, Pseudomonas putida KT2440
ccagcgcucguaggcuucac

SEQ ID NO: 3530787 - RNA, 13 nt, Pseudomonas putida KT2440
ccagcgcugcauu

SEQ ID NO: 3530788 - RNA, 21 nt, Pseudomonas putida KT2440
ccagcgcugucccccagcccu

SEQ ID NO: 3530789 - RNA, 20 nt, Pseudomonas putida KT2440
ccagcgcuugagaccaggcc

SEQ ID NO: 3530790 - RNA, 20 nt, Pseudomonas putida KT2440
ccagcggcaaccugacccgc

SEQ ID NO: 3530791 - RNA, 13 nt, Pseudomonas putida KT2440
ccagcggcaagcc

SEQ ID NO: 3530792 - RNA, 23 nt, Pseudomonas putida KT2440
ccagcggcaaggucaacggcaac

SEQ ID NO: 3530793 - RNA, 12 nt, Pseudomonas putida KT2440
ccagcggcagca

SEQ ID NO: 3530794 - RNA, 15 nt, Pseudomonas putida KT2440
ccagcggcagcagca

SEQ ID NO: 3530795 - RNA, 21 nt, Pseudomonas putida KT2440
ccagcggcaguugcaggcgca

SEQ ID NO: 3530796 - RNA, 16 nt, Pseudomonas putida KT2440
ccagcggccagcgccu

SEQ ID NO: 3530797 - RNA, 16 nt, Pseudomonas putida KT2440
ccagcggccgcuugau

SEQ ID NO: 3530798 - RNA, 12 nt, Pseudomonas putida KT2440
ccagcggcgugu

SEQ ID NO: 3530799 - RNA, 18 nt, Pseudomonas putida KT2440
ccagcggcucgcucaggc

SEQ ID NO: 3530800 - RNA, 21 nt, Pseudomonas putida KT2440
ccagcggcucgcucaggcgca

SEQ ID NO: 3530801 - RNA, 15 nt, Pseudomonas putida KT2440
ccagcgggcccagca

SEQ ID NO: 3530802 - RNA, 15 nt, Pseudomonas putida KT2440
ccagcgggucgucgc

SEQ ID NO: 3530803 - RNA, 17 nt, Pseudomonas putida KT2440
ccagcgggucgucgccc

SEQ ID NO: 3530804 - RNA, 23 nt, Pseudomonas putida KT2440
ccagcgggucgucgcccaggcgc

SEQ ID NO: 3530805 - RNA, 22 nt, Pseudomonas putida KT2440
ccagcggguggucgcugcggca

SEQ ID NO: 3530806 - RNA, 14 nt, Pseudomonas putida KT2440
ccagcggucugcug

SEQ ID NO: 3530807 - RNA, 15 nt, Pseudomonas putida KT2440
ccagcggucugcugc

SEQ ID NO: 3530808 - RNA, 22 nt, Pseudomonas putida KT2440
ccagcggucugcugcgucagca

SEQ ID NO: 3530809 - RNA, 23 nt, Pseudomonas putida KT2440
ccagcggucugcugcgucagcau

SEQ ID NO: 3530810 - RNA, 18 nt, Pseudomonas putida KT2440
ccagcggugccagucauu

SEQ ID NO: 3530811 - RNA, 20 nt, Pseudomonas putida KT2440
ccagcgguggguggcucauc

SEQ ID NO: 3530812 - RNA, 14 nt, Pseudomonas putida KT2440
ccagcgguugagau

SEQ ID NO: 3530813 - RNA, 15 nt, Pseudomonas putida KT2440
ccagcguaagcuggc

SEQ ID NO: 3530814 - RNA, 15 nt, Pseudomonas putida KT2440
ccagcgucaccacca

SEQ ID NO: 3530815 - RNA, 18 nt, Pseudomonas putida KT2440
ccagcgucaccccucggc

SEQ ID NO: 3530816 - RNA, 22 nt, Pseudomonas putida KT2440
ccagcgucacccguggcagccc

SEQ ID NO: 3530817 - RNA, 21 nt, Pseudomonas putida KT2440
ccagcgucagggucucgcggc

SEQ ID NO: 3530818 - RNA, 14 nt, Pseudomonas putida KT2440
ccagcgucagugac

SEQ ID NO: 3530819 - RNA, 18 nt, Pseudomonas putida KT2440
ccagcgucagugacaggc

SEQ ID NO: 3530820 - RNA, 18 nt, Pseudomonas putida KT2440
ccagcgucgucugcguga

SEQ ID NO: 3530821 - RNA, 21 nt, Pseudomonas putida KT2440
ccagcgucuuuggccugcuug

SEQ ID NO: 3530822 - RNA, 22 nt, Pseudomonas putida KT2440
ccagcgucuuuggccugcuuga

SEQ ID NO: 3530823 - RNA, 16 nt, Pseudomonas putida KT2440
ccagcgugaaccggcu

SEQ ID NO: 3530824 - RNA, 18 nt, Pseudomonas putida KT2440
ccagcgugcccgccacac

SEQ ID NO: 3530825 - RNA, 16 nt, Pseudomonas putida KT2440
ccagcguggccgccaa

SEQ ID NO: 3530826 - RNA, 21 nt, Pseudomonas putida KT2440
ccagcguggccugcaagccgg

SEQ ID NO: 3530827 - RNA, 23 nt, Pseudomonas putida KT2440
ccagcguggccugcaagccggcg

SEQ ID NO: 3530828 - RNA, 17 nt, Pseudomonas putida KT2440
ccagcgugggccgugca

SEQ ID NO: 3530829 - RNA, 16 nt, Pseudomonas putida KT2440
ccagcguuccugggcg

SEQ ID NO: 3530830 - RNA, 16 nt, Pseudomonas putida KT2440
ccagcguucggccagc

SEQ ID NO: 3530831 - RNA, 16 nt, Pseudomonas putida KT2440
ccagcguuuccggguu

SEQ ID NO: 3530832 - RNA, 21 nt, Pseudomonas putida KT2440
ccagcguuuguaaguaggcgc

SEQ ID NO: 3530833 - RNA, 23 nt, Pseudomonas putida KT2440
ccagcguuuguaaguaggcgcug

SEQ ID NO: 3530834 - RNA, 21 nt, Pseudomonas putida KT2440
ccagcuacgcgagccaccguc

SEQ ID NO: 3530835 - RNA, 18 nt, Pseudomonas putida KT2440
ccagcuaucucccagccu

SEQ ID NO: 3530836 - RNA, 22 nt, Pseudomonas putida KT2440
ccagcuaucucccagccugggc

SEQ ID NO: 3530837 - RNA, 22 nt, Pseudomonas putida KT2440
ccagcucaaaccccccaugcuc

SEQ ID NO: 3530838 - RNA, 22 nt, Pseudomonas putida KT2440
ccagcucaaccccaaaccgcuc

SEQ ID NO: 3530839 - RNA, 12 nt, Pseudomonas putida KT2440
ccagcucaacgc

SEQ ID NO: 3530840 - RNA, 13 nt, Pseudomonas putida KT2440
ccagcucaacgcg

SEQ ID NO: 3530841 - RNA, 14 nt, Pseudomonas putida KT2440
ccagcucacagcac

SEQ ID NO: 3530842 - RNA, 15 nt, Pseudomonas putida KT2440
ccagcucacgcaagc

SEQ ID NO: 3530843 - RNA, 16 nt, Pseudomonas putida KT2440
ccagcucauccagccg

SEQ ID NO: 3530844 - RNA, 18 nt, Pseudomonas putida KT2440
ccagcucauccagccgcg

SEQ ID NO: 3530845 - RNA, 16 nt, Pseudomonas putida KT2440
ccagcuccaccuucca

SEQ ID NO: 3530846 - RNA, 13 nt, Pseudomonas putida KT2440
ccagcuccagcac

SEQ ID NO: 3530847 - RNA, 15 nt, Pseudomonas putida KT2440
ccagcuccagcaccu

SEQ ID NO: 3530848 - RNA, 13 nt, Pseudomonas putida KT2440
ccagcuccaggcg

SEQ ID NO: 3530849 - RNA, 17 nt, Pseudomonas putida KT2440
ccaggccgcccacccac

SEQ ID NO: 3530850 - RNA, 19 nt, Pseudomonas putida KT2440
ccaggccggcgcagauggu

SEQ ID NO: 3530851 - RNA, 22 nt, Pseudomonas putida KT2440
ccaggccgugcuugaggccgcc

SEQ ID NO: 3530852 - RNA, 18 nt, Pseudomonas putida KT2440
ccaggccguugaucagcg

SEQ ID NO: 3530853 - RNA, 14 nt, Pseudomonas putida KT2440
ccaggccugcggca

SEQ ID NO: 3530854 - RNA, 12 nt, Pseudomonas putida KT2440
ccaggccuuuga

SEQ ID NO: 3530855 - RNA, 18 nt, Pseudomonas putida KT2440
ccaggcgcagcagcucgu

SEQ ID NO: 3530856 - RNA, 13 nt, Pseudomonas putida KT2440
ccaggcgcaucac

SEQ ID NO: 3530857 - RNA, 14 nt, Pseudomonas putida KT2440
ccaggcgccgcagc

SEQ ID NO: 3530858 - RNA, 15 nt, Pseudomonas putida KT2440
ccaggcgcgccugca

SEQ ID NO: 3530859 - RNA, 14 nt, Pseudomonas putida KT2440
ccaggcgcggcucg

SEQ ID NO: 3530860 - RNA, 14 nt, Pseudomonas putida KT2440
ccaggcggccagcc

SEQ ID NO: 3530861 - RNA, 14 nt, Pseudomonas putida KT2440
ccaggcggucgccc

SEQ ID NO: 3530862 - RNA, 18 nt, Pseudomonas putida KT2440
ccaggcggucgcccaugu

SEQ ID NO: 3530863 - RNA, 24 nt, Pseudomonas putida KT2440
ccaggcggucgcccauguugcgcu

SEQ ID NO: 3530864 - RNA, 18 nt, Pseudomonas putida KT2440
ccaggcggucggccagcg

SEQ ID NO: 3530865 - RNA, 16 nt, Pseudomonas putida KT2440
ccaggcguaaacccag

SEQ ID NO: 3530866 - RNA, 16 nt, Pseudomonas putida KT2440
ccaggcguauucggcc

SEQ ID NO: 3530867 - RNA, 23 nt, Pseudomonas putida KT2440
ccaggcguauucggccaccagcc

SEQ ID NO: 3530868 - RNA, 13 nt, Pseudomonas putida KT2440
ccaggcgucgauc

SEQ ID NO: 3530869 - RNA, 14 nt, Pseudomonas putida KT2440
ccaggcucaggccu

SEQ ID NO: 3530870 - RNA, 12 nt, Pseudomonas putida KT2440
ccaggcucucca

SEQ ID NO: 3530871 - RNA, 14 nt, Pseudomonas putida KT2440
ccaggcucuccagc

SEQ ID NO: 3530872 - RNA, 21 nt, Pseudomonas putida KT2440
ccaggcucuccagccgcugcu

SEQ ID NO: 3530873 - RNA, 12 nt, Pseudomonas putida KT2440
ccaggcugagcc

SEQ ID NO: 3530874 - RNA, 19 nt, Pseudomonas putida KT2440
ccaggcugccaaaccgccc

SEQ ID NO: 3530875 - RNA, 21 nt, Pseudomonas putida KT2440
ccaggcugccaaaccgcccca

SEQ ID NO: 3530876 - RNA, 18 nt, Pseudomonas putida KT2440
ccaggcugcgcgccaugg

SEQ ID NO: 3530877 - RNA, 14 nt, Pseudomonas putida KT2440
ccaggcuggccacc

SEQ ID NO: 3530878 - RNA, 13 nt, Pseudomonas putida KT2440
ccaggcuggccag

SEQ ID NO: 3530879 - RNA, 14 nt, Pseudomonas putida KT2440
ccaggcuggccagc

SEQ ID NO: 3530880 - RNA, 15 nt, Pseudomonas putida KT2440
ccaggcuggccagca

SEQ ID NO: 3530881 - RNA, 19 nt, Pseudomonas putida KT2440
ccaggcuggcgcuaccccu

SEQ ID NO: 3530882 - RNA, 17 nt, Pseudomonas putida KT2440
ccaggcuuucgaccucg

SEQ ID NO: 3530883 - RNA, 18 nt, Pseudomonas putida KT2440
ccagggaaauuggccagc

SEQ ID NO: 3530884 - RNA, 22 nt, Pseudomonas putida KT2440
ccagggcaaaaugcagcaagcu

SEQ ID NO: 3530885 - RNA, 23 nt, Pseudomonas putida KT2440
ccagggcaaaaugcagcaagcug

SEQ ID NO: 3530886 - RNA, 20 nt, Pseudomonas putida KT2440
ccagggcaagcaaucagaac

SEQ ID NO: 3530887 - RNA, 16 nt, Pseudomonas putida KT2440
ccagggcaaucgccaa

SEQ ID NO: 3530888 - RNA, 15 nt, Pseudomonas putida KT2440
ccagggcaucgacca

SEQ ID NO: 3530889 - RNA, 20 nt, Pseudomonas putida KT2440
ccagggcaucgaccaguacg

SEQ ID NO: 3530890 - RNA, 23 nt, Pseudomonas putida KT2440
ccagggcaucgaucccuggggcc

SEQ ID NO: 3530891 - RNA, 17 nt, Pseudomonas putida KT2440
ccagggcaucggacagg

SEQ ID NO: 3530892 - RNA, 18 nt, Pseudomonas putida KT2440
ccagggcaucggcgcccc

SEQ ID NO: 3530893 - RNA, 21 nt, Pseudomonas putida KT2440
ccagggcaucggcgccccgca

SEQ ID NO: 3530894 - RNA, 20 nt, Pseudomonas putida KT2440
ccagggcccgccgcgcggcu

SEQ ID NO: 3530895 - RNA, 21 nt, Pseudomonas putida KT2440
ccagggcccgccgcgcggcuu

SEQ ID NO: 3530896 - RNA, 14 nt, Pseudomonas putida KT2440
ccagggcccucaac

SEQ ID NO: 3530897 - RNA, 24 nt, Pseudomonas putida KT2440
ccagggcccucaacccucgcccag

SEQ ID NO: 3530898 - RNA, 15 nt, Pseudomonas putida KT2440
ccagggccugaccgc

SEQ ID NO: 3530899 - RNA, 16 nt, Pseudomonas putida KT2440
ccagggccugaccgcc

SEQ ID NO: 3530900 - RNA, 19 nt, Pseudomonas putida KT2440
ccagggcgcaacgcccgcg

SEQ ID NO: 3530901 - RNA, 17 nt, Pseudomonas putida KT2440
ccagggcggcgcccagu

SEQ ID NO: 3530902 - RNA, 18 nt, Pseudomonas putida KT2440
ccagggcggcgcccagua

SEQ ID NO: 3530903 - RNA, 14 nt, Pseudomonas putida KT2440
ccagggcgucgaac

SEQ ID NO: 3530904 - RNA, 18 nt, Pseudomonas putida KT2440
ccagggcucuaccccuuc

SEQ ID NO: 3530905 - RNA, 16 nt, Pseudomonas putida KT2440
ccagggggcagcugcu

SEQ ID NO: 3530906 - RNA, 18 nt, Pseudomonas putida KT2440
ccagggggcagcugcuga

SEQ ID NO: 3530907 - RNA, 18 nt, Pseudomonas putida KT2440
ccagggguuuccuuuggg

SEQ ID NO: 3530908 - RNA, 22 nt, Pseudomonas putida KT2440
ccaggguaccgccguccaccau

SEQ ID NO: 3530909 - RNA, 20 nt, Pseudomonas putida KT2440
ccagggucugcgcuucaagc

SEQ ID NO: 3530910 - RNA, 14 nt, Pseudomonas putida KT2440
ccaggguggcguug

SEQ ID NO: 3530911 - RNA, 23 nt, Pseudomonas putida KT2440
ccaggguggcguugagcuugagc

SEQ ID NO: 3530912 - RNA, 16 nt, Pseudomonas putida KT2440
ccaggguuaccugcgc

SEQ ID NO: 3530913 - RNA, 16 nt, Pseudomonas putida KT2440
ccagguaaaccugccu

SEQ ID NO: 3530914 - RNA, 21 nt, Pseudomonas putida KT2440
ccagguaaucaguucgcagcc

SEQ ID NO: 3530915 - RNA, 13 nt, Pseudomonas putida KT2440
ccagguaaugcgc

SEQ ID NO: 3530916 - RNA, 19 nt, Pseudomonas putida KT2440
ccagguacaguucccggug

SEQ ID NO: 3530917 - RNA, 21 nt, Pseudomonas putida KT2440
ccagguacaguucccggugcu

SEQ ID NO: 3530918 - RNA, 18 nt, Pseudomonas putida KT2440
ccagguacgaagccaugu

SEQ ID NO: 3530919 - RNA, 17 nt, Pseudomonas putida KT2440
ccagguacucgcgcugu

SEQ ID NO: 3530920 - RNA, 19 nt, Pseudomonas putida KT2440
ccagguaucgcaccgugcu

SEQ ID NO: 3530921 - RNA, 13 nt, Pseudomonas putida KT2440
ccagguauggcca

SEQ ID NO: 3530922 - RNA, 17 nt, Pseudomonas putida KT2440
ccagguauggccagagc

SEQ ID NO: 3530923 - RNA, 18 nt, Pseudomonas putida KT2440
ccaggucacccuggucac

SEQ ID NO: 3530924 - RNA, 12 nt, Pseudomonas putida KT2440
ccaggucaggac

SEQ ID NO: 3530925 - RNA, 23 nt, Pseudomonas putida KT2440
ccaggucauccgcacgcauguca

SEQ ID NO: 3530926 - RNA, 19 nt, Pseudomonas putida KT2440
ccagguccaccagcaggcu

SEQ ID NO: 3530927 - RNA, 14 nt, Pseudomonas putida KT2440
ccagguccaggcca

SEQ ID NO: 3530928 - RNA, 16 nt, Pseudomonas putida KT2440
ccagguccaggccagc

SEQ ID NO: 3530929 - RNA, 18 nt, Pseudomonas putida KT2440
ccagguccaggccagcuu

SEQ ID NO: 3530930 - RNA, 21 nt, Pseudomonas putida KT2440
ccagguccgguaacuggccca

SEQ ID NO: 3530931 - RNA, 22 nt, Pseudomonas putida KT2440
ccagguccuugcuguugcugca

SEQ ID NO: 3530932 - RNA, 17 nt, Pseudomonas putida KT2440
ccaggucgauccgggug

SEQ ID NO: 3530933 - RNA, 16 nt, Pseudomonas putida KT2440
ccaggucgccagcacc

SEQ ID NO: 3530934 - RNA, 19 nt, Pseudomonas putida KT2440
ccaggucgccagcaccauc

SEQ ID NO: 3530935 - RNA, 17 nt, Pseudomonas putida KT2440
ccaggucgccggugugc

SEQ ID NO: 3530936 - RNA, 14 nt, Pseudomonas putida KT2440
ccaggucggacagg

SEQ ID NO: 3530937 - RNA, 20 nt, Pseudomonas putida KT2440
ccaggucggcggggcccgga

SEQ ID NO: 3530938 - RNA, 19 nt, Pseudomonas putida KT2440
ccaggucggggugauugca

SEQ ID NO: 3530939 - RNA, 20 nt, Pseudomonas putida KT2440
ccaggucuuccuccgacagc

SEQ ID NO: 3530940 - RNA, 22 nt, Pseudomonas putida KT2440
ccaggugaaucagcggcaggcu

SEQ ID NO: 3530941 - RNA, 16 nt, Pseudomonas putida KT2440
ccaggugaugcaggca

SEQ ID NO: 3530942 - RNA, 21 nt, Pseudomonas putida KT2440
ccaggugcagguacugcaugu

SEQ ID NO: 3530943 - RNA, 19 nt, Pseudomonas putida KT2440
ccaggugccaacggucaga

SEQ ID NO: 3530944 - RNA, 15 nt, Pseudomonas putida KT2440
ccaggugccaggcuc

SEQ ID NO: 3530945 - RNA, 17 nt, Pseudomonas putida KT2440
ccaggugccaggcucag

SEQ ID NO: 3530946 - RNA, 17 nt, Pseudomonas putida KT2440
ccaggugcgcaccuugg

SEQ ID NO: 3530947 - RNA, 22 nt, Pseudomonas putida KT2440
ccaggugcucgaugaucauccc

SEQ ID NO: 3530948 - RNA, 20 nt, Pseudomonas putida KT2440
ccaggugcuugcggaacacc

SEQ ID NO: 3530949 - RNA, 18 nt, Pseudomonas putida KT2440
ccagguggaucggcgugc

SEQ ID NO: 3530950 - RNA, 13 nt, Pseudomonas putida KT2440
ccagguggccgcc

SEQ ID NO: 3530951 - RNA, 17 nt, Pseudomonas putida KT2440
ccagguggccgccaccg

SEQ ID NO: 3530952 - RNA, 14 nt, Pseudomonas putida KT2440
ccagguggccuucc

SEQ ID NO: 3530953 - RNA, 22 nt, Pseudomonas putida KT2440
ccaggugguaacuggccaguug

SEQ ID NO: 3530954 - RNA, 13 nt, Pseudomonas putida KT2440
ccaguuggcggcg

SEQ ID NO: 3530955 - RNA, 20 nt, Pseudomonas putida KT2440
ccaguuggcggcgcagcgca

SEQ ID NO: 3530956 - RNA, 22 nt, Pseudomonas putida KT2440
ccaguuggcggcgcagcgcacg

SEQ ID NO: 3530957 - RNA, 22 nt, Pseudomonas putida KT2440
ccaguugguaaaacacauugcg

SEQ ID NO: 3530958 - RNA, 17 nt, Pseudomonas putida KT2440
ccaguuguugggcagcc

SEQ ID NO: 3530959 - RNA, 16 nt, Pseudomonas putida KT2440
ccaguuuuuguaccug

SEQ ID NO: 3530960 - RNA, 19 nt, Pseudomonas putida KT2440
ccauacaagaucaagcccc

SEQ ID NO: 3530961 - RNA, 19 nt, Pseudomonas putida KT2440
ccauaccucuucacugcuc

SEQ ID NO: 3530962 - RNA, 12 nt, Pseudomonas putida KT2440
ccauaccugcuu

SEQ ID NO: 3530963 - RNA, 21 nt, Pseudomonas putida KT2440
ccauacgcaugaagucauggg

SEQ ID NO: 3530964 - RNA, 22 nt, Pseudomonas putida KT2440
ccauacuuggccgacauggcgc

SEQ ID NO: 3530965 - RNA, 15 nt, Pseudomonas putida KT2440
ccauagccugcugcu

SEQ ID NO: 3530966 - RNA, 13 nt, Pseudomonas putida KT2440
ccauagcgcugca

SEQ ID NO: 3530967 - RNA, 16 nt, Pseudomonas putida KT2440
ccauagcuuuccagca

SEQ ID NO: 3530968 - RNA, 18 nt, Pseudomonas putida KT2440
ccauagggccagcggcuu

SEQ ID NO: 3530969 - RNA, 16 nt, Pseudomonas putida KT2440
ccauagguuauccaca

SEQ ID NO: 3530970 - RNA, 18 nt, Pseudomonas putida KT2440
ccauaguugaccagcacc

SEQ ID NO: 3530971 - RNA, 19 nt, Pseudomonas putida KT2440
ccauaguugaccagcacca

SEQ ID NO: 3530972 - RNA, 12 nt, Pseudomonas putida KT2440
ccauaucccgcc

SEQ ID NO: 3530973 - RNA, 15 nt, Pseudomonas putida KT2440
ccauauucagcuuca

SEQ ID NO: 3530974 - RNA, 21 nt, Pseudomonas putida KT2440
ccaucaauacgcuggaucacc

SEQ ID NO: 3530975 - RNA, 14 nt, Pseudomonas putida KT2440
ccaucaccacaaaa

SEQ ID NO: 3530976 - RNA, 16 nt, Pseudomonas putida KT2440
ccaucaccagcccgaa

SEQ ID NO: 3530977 - RNA, 11 nt, Pseudomonas putida KT2440
ccaucaccgcc

SEQ ID NO: 3530978 - RNA, 21 nt, Pseudomonas putida KT2440
ccaucaccgccagcauggccg

SEQ ID NO: 3530979 - RNA, 16 nt, Pseudomonas putida KT2440
ccaucaccgccagguc

SEQ ID NO: 3530980 - RNA, 19 nt, Pseudomonas putida KT2440
ccaucaccggcgaguccug

SEQ ID NO: 3530981 - RNA, 18 nt, Pseudomonas putida KT2440
ccaucagagcgccagcaa

SEQ ID NO: 3530982 - RNA, 12 nt, Pseudomonas putida KT2440
ccaucagcagcu

SEQ ID NO: 3530983 - RNA, 18 nt, Pseudomonas putida KT2440
ccaucagcagcuguugcu

SEQ ID NO: 3530984 - RNA, 16 nt, Pseudomonas putida KT2440
ccaucagccgcgggcu

SEQ ID NO: 3530985 - RNA, 20 nt, Pseudomonas putida KT2440
ccaucagcgccgccaauaac

SEQ ID NO: 3530986 - RNA, 13 nt, Pseudomonas putida KT2440
ccaucagggcgau

SEQ ID NO: 3530987 - RNA, 20 nt, Pseudomonas putida KT2440
ccaucagggcgaugcgcaca

SEQ ID NO: 3530988 - RNA, 23 nt, Pseudomonas putida KT2440
ccaucagguauugcgcaaggccg

SEQ ID NO: 3530989 - RNA, 22 nt, Pseudomonas putida KT2440
ccaucagugcccccgccacagg

SEQ ID NO: 3530990 - RNA, 22 nt, Pseudomonas putida KT2440
ccaucaucagacagaagccugu

SEQ ID NO: 3530991 - RNA, 14 nt, Pseudomonas putida KT2440
ccaucaucugcuga

SEQ ID NO: 3530992 - RNA, 18 nt, Pseudomonas putida KT2440
ccaucaugcgacaggcgu

SEQ ID NO: 3530993 - RNA, 21 nt, Pseudomonas putida KT2440
ccaucauucgauagccugcaa

SEQ ID NO: 3530994 - RNA, 22 nt, Pseudomonas putida KT2440
ccaucauucgauagccugcaaa

SEQ ID NO: 3530995 - RNA, 20 nt, Pseudomonas putida KT2440
ccaucauuuccugaaccaug

SEQ ID NO: 3530996 - RNA, 16 nt, Pseudomonas putida KT2440
ccauccaacgcaucca

SEQ ID NO: 3530997 - RNA, 16 nt, Pseudomonas putida KT2440
ccauccacaucgccag

SEQ ID NO: 3530998 - RNA, 19 nt, Pseudomonas putida KT2440
ccauccacaucgccaggug

SEQ ID NO: 3530999 - RNA, 16 nt, Pseudomonas putida KT2440
ccauccaccagcccca

SEQ ID NO: 3531000 - RNA, 14 nt, Pseudomonas putida KT2440
ccauccaccggauc

SEQ ID NO: 3531001 - RNA, 22 nt, Pseudomonas putida KT2440
ccauccacggcguugccccuuc

SEQ ID NO: 3531002 - RNA, 15 nt, Pseudomonas putida KT2440
ccauccagcggcgac

SEQ ID NO: 3531003 - RNA, 15 nt, Pseudomonas putida KT2440
ccauccagucggcgc

SEQ ID NO: 3531004 - RNA, 21 nt, Pseudomonas putida KT2440
ccaucccacucauaaugaaaa

SEQ ID NO: 3531005 - RNA, 16 nt, Pseudomonas putida KT2440
cggugcacggccguug

SEQ ID NO: 3531006 - RNA, 18 nt, Pseudomonas putida KT2440
cggugcagaacguacugg

SEQ ID NO: 3531007 - RNA, 18 nt, Pseudomonas putida KT2440
cggugcagcaccuccacc

SEQ ID NO: 3531008 - RNA, 17 nt, Pseudomonas putida KT2440
cggugcagguuggagcg

SEQ ID NO: 3531009 - RNA, 18 nt, Pseudomonas putida KT2440
cggugcauccaacgcugc

SEQ ID NO: 3531010 - RNA, 13 nt, Pseudomonas putida KT2440
cggugccacccaa

SEQ ID NO: 3531011 - RNA, 15 nt, Pseudomonas putida KT2440
cggugccagucauuc

SEQ ID NO: 3531012 - RNA, 18 nt, Pseudomonas putida KT2440
cggugccauccaccgcgc

SEQ ID NO: 3531013 - RNA, 22 nt, Pseudomonas putida KT2440
cggugccauccaccgcgccagc

SEQ ID NO: 3531014 - RNA, 14 nt, Pseudomonas putida KT2440
cggugcccacugca

SEQ ID NO: 3531015 - RNA, 17 nt, Pseudomonas putida KT2440
cggugcccacugcagcc

SEQ ID NO: 3531016 - RNA, 12 nt, Pseudomonas putida KT2440
cggugccccggu

SEQ ID NO: 3531017 - RNA, 17 nt, Pseudomonas putida KT2440
cggugcccuugccgccc

SEQ ID NO: 3531018 - RNA, 23 nt, Pseudomonas putida KT2440
cggugccggcagcucgcgcugcg

SEQ ID NO: 3531019 - RNA, 15 nt, Pseudomonas putida KT2440
cggugccggccaauc

SEQ ID NO: 3531020 - RNA, 15 nt, Pseudomonas putida KT2440
cggugccugcagccc

SEQ ID NO: 3531021 - RNA, 17 nt, Pseudomonas putida KT2440
cggugccuucaggcgcu

SEQ ID NO: 3531022 - RNA, 15 nt, Pseudomonas putida KT2440
cggugcgcgccagcg

SEQ ID NO: 3531023 - RNA, 20 nt, Pseudomonas putida KT2440
cggugcggcgacagggcgaa

SEQ ID NO: 3531024 - RNA, 22 nt, Pseudomonas putida KT2440
cggugcguacucgaccacuguc

SEQ ID NO: 3531025 - RNA, 17 nt, Pseudomonas putida KT2440
cggugcucaggcucagc

SEQ ID NO: 3531026 - RNA, 14 nt, Pseudomonas putida KT2440
cggugcugaccacc

SEQ ID NO: 3531027 - RNA, 15 nt, Pseudomonas putida KT2440
cggugcugccgaggc

SEQ ID NO: 3531028 - RNA, 17 nt, Pseudomonas putida KT2440
cggugcuuucugcugug

SEQ ID NO: 3531029 - RNA, 19 nt, Pseudomonas putida KT2440
cgguggaaauuggccagca

SEQ ID NO: 3531030 - RNA, 20 nt, Pseudomonas putida KT2440
cgguggaaucggcuccaggc

SEQ ID NO: 3531031 - RNA, 16 nt, Pseudomonas putida KT2440
cgguggcaaaucgaaa

SEQ ID NO: 3531032 - RNA, 15 nt, Pseudomonas putida KT2440
cgguggcaucaccgg

SEQ ID NO: 3531033 - RNA, 15 nt, Pseudomonas putida KT2440
cgguggccugagccg

SEQ ID NO: 3531034 - RNA, 23 nt, Pseudomonas putida KT2440
cgguggcgccuugauuaccagcg

SEQ ID NO: 3531035 - RNA, 14 nt, Pseudomonas putida KT2440
cgguggcggcagca

SEQ ID NO: 3531036 - RNA, 13 nt, Pseudomonas putida KT2440
cgguggcggccgc

SEQ ID NO: 3531037 - RNA, 17 nt, Pseudomonas putida KT2440
cgguggcucacaucauc

SEQ ID NO: 3531038 - RNA, 19 nt, Pseudomonas putida KT2440
cgguggcucuccucuccca

SEQ ID NO: 3531039 - RNA, 19 nt, Pseudomonas putida KT2440
cgguggcugccagcgcgcu

SEQ ID NO: 3531040 - RNA, 20 nt, Pseudomonas putida KT2440
cggugggcaacagcugcgcg

SEQ ID NO: 3531041 - RNA, 18 nt, Pseudomonas putida KT2440
cgguggggugucuggugu

SEQ ID NO: 3531042 - RNA, 18 nt, Pseudomonas putida KT2440
cggugguuggacacaggc

SEQ ID NO: 3531043 - RNA, 17 nt, Pseudomonas putida KT2440
cgguguaggagcggguu

SEQ ID NO: 3531044 - RNA, 20 nt, Pseudomonas putida KT2440
cgguguaucggccaguugcc

SEQ ID NO: 3531045 - RNA, 13 nt, Pseudomonas putida KT2440
cggugucggccag

SEQ ID NO: 3531046 - RNA, 15 nt, Pseudomonas putida KT2440
cggugucggccagcu

SEQ ID NO: 3531047 - RNA, 16 nt, Pseudomonas putida KT2440
cggugucuuccggcau

SEQ ID NO: 3531048 - RNA, 21 nt, Pseudomonas putida KT2440
cggugugcuccagcuccaggc

SEQ ID NO: 3531049 - RNA, 20 nt, Pseudomonas putida KT2440
cggugugcucggcgaugccg

SEQ ID NO: 3531050 - RNA, 13 nt, Pseudomonas putida KT2440
cgguguggcaaau

SEQ ID NO: 3531051 - RNA, 13 nt, Pseudomonas putida KT2440
cgguguggccaag

SEQ ID NO: 3531052 - RNA, 12 nt, Pseudomonas putida KT2440
cgguguucgcgg

SEQ ID NO: 3531053 - RNA, 23 nt, Pseudomonas putida KT2440
cgguguuuccacagguaccaggc

SEQ ID NO: 3531054 - RNA, 14 nt, Pseudomonas putida KT2440
cgguuaagcgccac

SEQ ID NO: 3531055 - RNA, 22 nt, Pseudomonas putida KT2440
cgguucgaccgacaugccaaag

SEQ ID NO: 3531056 - RNA, 20 nt, Pseudomonas putida KT2440
cgguucgcccccacgggcau

SEQ ID NO: 3531057 - RNA, 13 nt, Pseudomonas putida KT2440
cgguucuggcagc

SEQ ID NO: 3531058 - RNA, 16 nt, Pseudomonas putida KT2440
cgguucuucgccugca

SEQ ID NO: 3531059 - RNA, 15 nt, Pseudomonas putida KT2440
cgguugacagcacgg

SEQ ID NO: 3531060 - RNA, 17 nt, Pseudomonas putida KT2440
cgguugaccacgaugcc

SEQ ID NO: 3531061 - RNA, 21 nt, Pseudomonas putida KT2440
cgguugaccgccgccaccauc

SEQ ID NO: 3531062 - RNA, 15 nt, Pseudomonas putida KT2440
cgguugaugcagcgc

SEQ ID NO: 3531063 - RNA, 16 nt, Pseudomonas putida KT2440
cgguugaugcagcgcc

SEQ ID NO: 3531064 - RNA, 13 nt, Pseudomonas putida KT2440
cgguugccaagca

SEQ ID NO: 3531065 - RNA, 15 nt, Pseudomonas putida KT2440
cgguugcgcagccgg

SEQ ID NO: 3531066 - RNA, 19 nt, Pseudomonas putida KT2440
cgguuggcgauccauucac

SEQ ID NO: 3531067 - RNA, 16 nt, Pseudomonas putida KT2440
cgguugggcaagugcg

SEQ ID NO: 3531068 - RNA, 16 nt, Pseudomonas putida KT2440
cgguuggugcgccucc

SEQ ID NO: 3531069 - RNA, 17 nt, Pseudomonas putida KT2440
cgguuggugcgccucca

SEQ ID NO: 3531070 - RNA, 22 nt, Pseudomonas putida KT2440
cgguuggugcgccuccagcagc

SEQ ID NO: 3531071 - RNA, 23 nt, Pseudomonas putida KT2440
cgguuggugcgccuccagcagcg

SEQ ID NO: 3531072 - RNA, 18 nt, Pseudomonas putida KT2440
cgguuguagaucgccggc

SEQ ID NO: 3531073 - RNA, 22 nt, Pseudomonas putida KT2440
cgguuguagaucgccggcagca

SEQ ID NO: 3531074 - RNA, 19 nt, Pseudomonas putida KT2440
cgguugucgaccuggcucu

SEQ ID NO: 3531075 - RNA, 23 nt, Pseudomonas putida KT2440
cgguuucguaagcgcugcgcagg

SEQ ID NO: 3531076 - RNA, 15 nt, Pseudomonas putida KT2440
cgguuucucacagcg

SEQ ID NO: 3531077 - RNA, 16 nt, Pseudomonas putida KT2440
cgguuucucgcagcag

SEQ ID NO: 3531078 - RNA, 23 nt, Pseudomonas putida KT2440
cgguuucucgcagcagcaccggc

SEQ ID NO: 3531079 - RNA, 15 nt, Pseudomonas putida KT2440
cgguuugaagccaua

SEQ ID NO: 3531080 - RNA, 13 nt, Pseudomonas putida KT2440
cgguuugcuccgc

SEQ ID NO: 3531081 - RNA, 20 nt, Pseudomonas putida KT2440
cguaacgagccuuggccagc

SEQ ID NO: 3531082 - RNA, 12 nt, Pseudomonas putida KT2440
cguacacugcag

SEQ ID NO: 3531083 - RNA, 20 nt, Pseudomonas putida KT2440
cguacacugcaggagcgggc

SEQ ID NO: 3531084 - RNA, 21 nt, Pseudomonas putida KT2440
cguacacugcaggagcgggca

SEQ ID NO: 3531085 - RNA, 15 nt, Pseudomonas putida KT2440
cguacagcgacaugc

SEQ ID NO: 3531086 - RNA, 16 nt, Pseudomonas putida KT2440
cguacagcugcucacc

SEQ ID NO: 3531087 - RNA, 13 nt, Pseudomonas putida KT2440
cguacaucagccu

SEQ ID NO: 3531088 - RNA, 23 nt, Pseudomonas putida KT2440
cguacaucggguaagccaugcgc

SEQ ID NO: 3531089 - RNA, 16 nt, Pseudomonas putida KT2440
cguacaugguguaguc

SEQ ID NO: 3531090 - RNA, 19 nt, Pseudomonas putida KT2440
cguaccagcagggccauca

SEQ ID NO: 3531091 - RNA, 24 nt, Pseudomonas putida KT2440
cguacccaggugaugcaggcaauc

SEQ ID NO: 3531092 - RNA, 12 nt, Pseudomonas putida KT2440
cguacccggcug

SEQ ID NO: 3531093 - RNA, 18 nt, Pseudomonas putida KT2440
cguacccuuccuggagac

SEQ ID NO: 3531094 - RNA, 15 nt, Pseudomonas putida KT2440
cguaccuggcugcug

SEQ ID NO: 3531095 - RNA, 16 nt, Pseudomonas putida KT2440
cguaccuuucaugccu

SEQ ID NO: 3531096 - RNA, 18 nt, Pseudomonas putida KT2440
cguacgcgggcagacuuc

SEQ ID NO: 3531097 - RNA, 12 nt, Pseudomonas putida KT2440
cguacuggacgu

SEQ ID NO: 3531098 - RNA, 17 nt, Pseudomonas putida KT2440
cguacuggccgcugaac

SEQ ID NO: 3531099 - RNA, 14 nt, Pseudomonas putida KT2440
cguacuuuucucuc

SEQ ID NO: 3531100 - RNA, 13 nt, Pseudomonas putida KT2440
cguagaaaggaga

SEQ ID NO: 3531101 - RNA, 18 nt, Pseudomonas putida KT2440
cguagaugccguaguagc

SEQ ID NO: 3531102 - RNA, 19 nt, Pseudomonas putida KT2440
cguagcaggaucugcugca

SEQ ID NO: 3531103 - RNA, 14 nt, Pseudomonas putida KT2440
cguagcgagcaccg

SEQ ID NO: 3531104 - RNA, 15 nt, Pseudomonas putida KT2440
cguagcgcuucagcu

SEQ ID NO: 3531105 - RNA, 20 nt, Pseudomonas putida KT2440
cguagcuguuaggcuugacg

SEQ ID NO: 3531106 - RNA, 14 nt, Pseudomonas putida KT2440
cguagcuguugcgc

SEQ ID NO: 3531107 - RNA, 18 nt, Pseudomonas putida KT2440
cguagcuguugcgcuggg

SEQ ID NO: 3531108 - RNA, 14 nt, Pseudomonas putida KT2440
cguaggagcgggcu

SEQ ID NO: 3531109 - RNA, 19 nt, Pseudomonas putida KT2440
cguaggagcgggcuugccc

SEQ ID NO: 3531110 - RNA, 21 nt, Pseudomonas putida KT2440
cguaggcacacccggccaagu

SEQ ID NO: 3531111 - RNA, 16 nt, Pseudomonas putida KT2440
cguggcuguugcgguu

SEQ ID NO: 3531112 - RNA, 22 nt, Pseudomonas putida KT2440
cguggcuugcgacuugugcauc

SEQ ID NO: 3531113 - RNA, 18 nt, Pseudomonas putida KT2440
cgugggcgcaacaucgau

SEQ ID NO: 3531114 - RNA, 22 nt, Pseudomonas putida KT2440
cguggggccugccgguacagcc

SEQ ID NO: 3531115 - RNA, 19 nt, Pseudomonas putida KT2440
cgugggggaucucuucguc

SEQ ID NO: 3531116 - RNA, 22 nt, Pseudomonas putida KT2440
cguggggucugcccggccagca

SEQ ID NO: 3531117 - RNA, 16 nt, Pseudomonas putida KT2440
cgugggucacgcagag

SEQ ID NO: 3531118 - RNA, 20 nt, Pseudomonas putida KT2440
cgugggucaugucggcagcc

SEQ ID NO: 3531119 - RNA, 17 nt, Pseudomonas putida KT2440
cgugggucgggaacagc

SEQ ID NO: 3531120 - RNA, 20 nt, Pseudomonas putida KT2440
cgugggucgggaacagcucu

SEQ ID NO: 3531121 - RNA, 21 nt, Pseudomonas putida KT2440
cgugggucgggaacagcucug

SEQ ID NO: 3531122 - RNA, 22 nt, Pseudomonas putida KT2440
cguggugaauggcgagcccggc

SEQ ID NO: 3531123 - RNA, 16 nt, Pseudomonas putida KT2440
cguggugauguucuca

SEQ ID NO: 3531124 - RNA, 13 nt, Pseudomonas putida KT2440
cguggugcagacg

SEQ ID NO: 3531125 - RNA, 15 nt, Pseudomonas putida KT2440
cguggugcgggccac

SEQ ID NO: 3531126 - RNA, 16 nt, Pseudomonas putida KT2440
cguggugcgggccacc

SEQ ID NO: 3531127 - RNA, 22 nt, Pseudomonas putida KT2440
cguggugcgggccaccaggccu

SEQ ID NO: 3531128 - RNA, 18 nt, Pseudomonas putida KT2440
cgugguucaucaccagcc

SEQ ID NO: 3531129 - RNA, 20 nt, Pseudomonas putida KT2440
cgugguucaucaccagcccc

SEQ ID NO: 3531130 - RNA, 14 nt, Pseudomonas putida KT2440
cgugguucuugccg

SEQ ID NO: 3531131 - RNA, 19 nt, Pseudomonas putida KT2440
cgugguucuugccgagcag

SEQ ID NO: 3531132 - RNA, 23 nt, Pseudomonas putida KT2440
cgugguucuugccgagcagcgcg

SEQ ID NO: 3531133 - RNA, 19 nt, Pseudomonas putida KT2440
cgugguugagguucugcuc

SEQ ID NO: 3531134 - RNA, 15 nt, Pseudomonas putida KT2440
cgugguugcugaugu

SEQ ID NO: 3531135 - RNA, 16 nt, Pseudomonas putida KT2440
cguguaggagcggguu

SEQ ID NO: 3531136 - RNA, 22 nt, Pseudomonas putida KT2440
cguguaguagcuccagcccagc

SEQ ID NO: 3531137 - RNA, 23 nt, Pseudomonas putida KT2440
cgugucaguggucgugccauuca

SEQ ID NO: 3531138 - RNA, 13 nt, Pseudomonas putida KT2440
cguguccagcagg

SEQ ID NO: 3531139 - RNA, 15 nt, Pseudomonas putida KT2440
cguguucccagcacc

SEQ ID NO: 3531140 - RNA, 17 nt, Pseudomonas putida KT2440
cguguuccccgaccaaa

SEQ ID NO: 3531141 - RNA, 18 nt, Pseudomonas putida KT2440
cguguuccccgaccaaau

SEQ ID NO: 3531142 - RNA, 19 nt, Pseudomonas putida KT2440
cguguucgcgaggaaaccc

SEQ ID NO: 3531143 - RNA, 16 nt, Pseudomonas putida KT2440
cguguugcagcggguu

SEQ ID NO: 3531144 - RNA, 13 nt, Pseudomonas putida KT2440
cguguuguucgcc

SEQ ID NO: 3531145 - RNA, 14 nt, Pseudomonas putida KT2440
cguuaccaccgggu

SEQ ID NO: 3531146 - RNA, 21 nt, Pseudomonas putida KT2440
cguuaccccguugcgcagcag

SEQ ID NO: 3531147 - RNA, 16 nt, Pseudomonas putida KT2440
cguuacucccacagcg

SEQ ID NO: 3531148 - RNA, 16 nt, Pseudomonas putida KT2440
cguuacuguuccagcg

SEQ ID NO: 3531149 - RNA, 18 nt, Pseudomonas putida KT2440
cguuauccagcugcaaca

SEQ ID NO: 3531150 - RNA, 19 nt, Pseudomonas putida KT2440
cguuauggaaggcaaagau

SEQ ID NO: 3531151 - RNA, 21 nt, Pseudomonas putida KT2440
cguuauggaaggcaaagauuu

SEQ ID NO: 3531152 - RNA, 22 nt, Pseudomonas putida KT2440
cguuauugcacuuccacuccag

SEQ ID NO: 3531153 - RNA, 20 nt, Pseudomonas putida KT2440
cguucaacuucgguggcuca

SEQ ID NO: 3531154 - RNA, 19 nt, Pseudomonas putida KT2440
cguucaccguugccgccac

SEQ ID NO: 3531155 - RNA, 21 nt, Pseudomonas putida KT2440
cguucacuguugccgccacca

SEQ ID NO: 3531156 - RNA, 12 nt, Pseudomonas putida KT2440
cguucagcaaga

SEQ ID NO: 3531157 - RNA, 21 nt, Pseudomonas putida KT2440
cguucagccgaucacuuccug

SEQ ID NO: 3531158 - RNA, 18 nt, Pseudomonas putida KT2440
cguucagcuugucgacca

SEQ ID NO: 3531159 - RNA, 18 nt, Pseudomonas putida KT2440
cguucaggucauugucau

SEQ ID NO: 3531160 - RNA, 13 nt, Pseudomonas putida KT2440
cguucaugccggc

SEQ ID NO: 3531161 - RNA, 14 nt, Pseudomonas putida KT2440
cguuccagccaggc

SEQ ID NO: 3531162 - RNA, 15 nt, Pseudomonas putida KT2440
cguuccagccaggcg

SEQ ID NO: 3531163 - RNA, 13 nt, Pseudomonas putida KT2440
cguucccaauguc

SEQ ID NO: 3531164 - RNA, 23 nt, Pseudomonas putida KT2440
cguucccgggcagguucgacucc

SEQ ID NO: 3531165 - RNA, 16 nt, Pseudomonas putida KT2440
cguuccugggcguucu

SEQ ID NO: 3531166 - RNA, 22 nt, Pseudomonas putida KT2440
cguucgaaagcccauaaacccc

SEQ ID NO: 3531167 - RNA, 17 nt, Pseudomonas putida KT2440
cguucgccauaggccgc

SEQ ID NO: 3531168 - RNA, 19 nt, Pseudomonas putida KT2440
cguucgcccaggcgccgca

SEQ ID NO: 3531169 - RNA, 14 nt, Pseudomonas putida KT2440
cguucgcccugcgc

SEQ ID NO: 3531170 - RNA, 15 nt, Pseudomonas putida KT2440
cguucgcccugcgcc

SEQ ID NO: 3531171 - RNA, 18 nt, Pseudomonas putida KT2440
cguucgcgggcacgcccg

SEQ ID NO: 3531172 - RNA, 16 nt, Pseudomonas putida KT2440
cguucggcaucgacga

SEQ ID NO: 3531173 - RNA, 16 nt, Pseudomonas putida KT2440
cguucggcccgcugcc

SEQ ID NO: 3531174 - RNA, 17 nt, Pseudomonas putida KT2440
cguucgggucaacucag

SEQ ID NO: 3531175 - RNA, 14 nt, Pseudomonas putida KT2440
cguucggugcacgg

SEQ ID NO: 3531176 - RNA, 15 nt, Pseudomonas putida KT2440
cguucgguguccuug

SEQ ID NO: 3531177 - RNA, 18 nt, Pseudomonas putida KT2440
cguucgucaagcucgacc

SEQ ID NO: 3531178 - RNA, 23 nt, Pseudomonas putida KT2440
cguucgucaagcucgacccgcgu

SEQ ID NO: 3531179 - RNA, 18 nt, Pseudomonas putida KT2440
cguucuccagcuccuggc

SEQ ID NO: 3531180 - RNA, 15 nt, Pseudomonas putida KT2440
cguucuugaagauga

SEQ ID NO: 3531181 - RNA, 15 nt, Pseudomonas putida KT2440
cguugaccccgccgc

SEQ ID NO: 3531182 - RNA, 14 nt, Pseudomonas putida KT2440
cguugaggccgaac

SEQ ID NO: 3531183 - RNA, 23 nt, Pseudomonas putida KT2440
cguugaggccgaacaccgccagc

SEQ ID NO: 3531184 - RNA, 16 nt, Pseudomonas putida KT2440
cguugaucagcgacac

SEQ ID NO: 3531185 - RNA, 16 nt, Pseudomonas putida KT2440
cguugaugaucugcuc

SEQ ID NO: 3531186 - RNA, 21 nt, Pseudomonas putida KT2440
cguugaugaugcgcaccggag

SEQ ID NO: 3531187 - RNA, 20 nt, Pseudomonas putida KT2440
cguugaugcgcuugaaguga

SEQ ID NO: 3531188 - RNA, 18 nt, Pseudomonas putida KT2440
cguugcagccccagccuc

SEQ ID NO: 3531189 - RNA, 21 nt, Pseudomonas putida KT2440
cguugccagaaaaguuggcca

SEQ ID NO: 3531190 - RNA, 23 nt, Pseudomonas putida KT2440
cguugcccccagccggucaucca

SEQ ID NO: 3531191 - RNA, 12 nt, Pseudomonas putida KT2440
cguugccuucgc

SEQ ID NO: 3531192 - RNA, 17 nt, Pseudomonas putida KT2440
cguugcgaagcggccug

SEQ ID NO: 3531193 - RNA, 15 nt, Pseudomonas putida KT2440
cguugcgcagcagca

SEQ ID NO: 3531194 - RNA, 24 nt, Pseudomonas putida KT2440
cguugcgcucgagcccgccagcag

SEQ ID NO: 3531195 - RNA, 20 nt, Pseudomonas putida KT2440
cguugcgcugguucauugcc

SEQ ID NO: 3531196 - RNA, 17 nt, Pseudomonas putida KT2440
cguugcgggucagcucg

SEQ ID NO: 3531197 - RNA, 20 nt, Pseudomonas putida KT2440
cguugcuccagcucacagca

SEQ ID NO: 3531198 - RNA, 15 nt, Pseudomonas putida KT2440
cguugcugguguggc

SEQ ID NO: 3531199 - RNA, 15 nt, Pseudomonas putida KT2440
cguuggacgccgcac

SEQ ID NO: 3531200 - RNA, 16 nt, Pseudomonas putida KT2440
cguuggccaccaccag

SEQ ID NO: 3531201 - RNA, 12 nt, Pseudomonas putida KT2440
cguuggccagcu

SEQ ID NO: 3531202 - RNA, 21 nt, Pseudomonas putida KT2440
cguuggccagcuuggcuuucg

SEQ ID NO: 3531203 - RNA, 15 nt, Pseudomonas putida KT2440
cguuggccaggucga

SEQ ID NO: 3531204 - RNA, 15 nt, Pseudomonas putida KT2440
cguuggccgccagcg

SEQ ID NO: 3531205 - RNA, 17 nt, Pseudomonas putida KT2440
cguuggccgccagcggc

SEQ ID NO: 3531206 - RNA, 18 nt, Pseudomonas putida KT2440
cguuggccgccagcggca

SEQ ID NO: 3531207 - RNA, 20 nt, Pseudomonas putida KT2440
cguuggcgaagucggccugg

SEQ ID NO: 3531208 - RNA, 17 nt, Pseudomonas putida KT2440
cguuguagcccaccacc

SEQ ID NO: 3531209 - RNA, 23 nt, Pseudomonas putida KT2440
cguuguagcgcgguccggugaua

SEQ ID NO: 3531210 - RNA, 22 nt, Pseudomonas putida KT2440
cguuguagcggccaucgcagaa

SEQ ID NO: 3531211 - RNA, 17 nt, Pseudomonas putida KT2440
cguugucagccuucaga

SEQ ID NO: 3531212 - RNA, 12 nt, Pseudomonas putida KT2440
cguuguccagca

SEQ ID NO: 3531213 - RNA, 17 nt, Pseudomonas putida KT2440
cguuguccagcagcagc

SEQ ID NO: 3531214 - RNA, 18 nt, Pseudomonas putida KT2440
cguuguccagcagcagcg

SEQ ID NO: 3531215 - RNA, 15 nt, Pseudomonas putida KT2440
cguuguccgacagcu

SEQ ID NO: 3531216 - RNA, 16 nt, Pseudomonas putida KT2440
cuagucgaaaaaccga

SEQ ID NO: 3531217 - RNA, 17 nt, Pseudomonas putida KT2440
cuauauagaagcgggga

SEQ ID NO: 3531218 - RNA, 23 nt, Pseudomonas putida KT2440
cuauaucucugguacaacaacaa

SEQ ID NO: 3531219 - RNA, 20 nt, Pseudomonas putida KT2440
cuaucagccgugaugagguu

SEQ ID NO: 3531220 - RNA, 21 nt, Pseudomonas putida KT2440
cuauccggagcuccccucaga

SEQ ID NO: 3531221 - RNA, 18 nt, Pseudomonas putida KT2440
cuauccuacgcgccaguc

SEQ ID NO: 3531222 - RNA, 21 nt, Pseudomonas putida KT2440
cuauccuacgcgccagucaga

SEQ ID NO: 3531223 - RNA, 20 nt, Pseudomonas putida KT2440
cuauccugugggagcgggcu

SEQ ID NO: 3531224 - RNA, 16 nt, Pseudomonas putida KT2440
cuaucucaggccaguu

SEQ ID NO: 3531225 - RNA, 16 nt, Pseudomonas putida KT2440
cuaucucuuccagcgu

SEQ ID NO: 3531226 - RNA, 19 nt, Pseudomonas putida KT2440
cuaucugcguuucgcuggc

SEQ ID NO: 3531227 - RNA, 13 nt, Pseudomonas putida KT2440
cuaugccaccugu

SEQ ID NO: 3531228 - RNA, 20 nt, Pseudomonas putida KT2440
cuaugccaccuguugccgcu

SEQ ID NO: 3531229 - RNA, 14 nt, Pseudomonas putida KT2440
cuaugccggggcug

SEQ ID NO: 3531230 - RNA, 20 nt, Pseudomonas putida KT2440
cuaugccuuggaggcugggc

SEQ ID NO: 3531231 - RNA, 22 nt, Pseudomonas putida KT2440
cuaugcggugguugucgcaccc

SEQ ID NO: 3531232 - RNA, 15 nt, Pseudomonas putida KT2440
cuauggaugccagcg

SEQ ID NO: 3531233 - RNA, 11 nt, Pseudomonas putida KT2440
cuauggccgga

SEQ ID NO: 3531234 - RNA, 22 nt, Pseudomonas putida KT2440
cuauggcuuuugcccuucuggu

SEQ ID NO: 3531235 - RNA, 18 nt, Pseudomonas putida KT2440
cuauggggugagcggcuu

SEQ ID NO: 3531236 - RNA, 13 nt, Pseudomonas putida KT2440
cuauuuaccuguc

SEQ ID NO: 3531237 - RNA, 12 nt, Pseudomonas putida KT2440
cucaaaaaaaua

SEQ ID NO: 3531238 - RNA, 20 nt, Pseudomonas putida KT2440
cucaaacaaaaacgccgccc

SEQ ID NO: 3531239 - RNA, 18 nt, Pseudomonas putida KT2440
cucaaacccggcagccac

SEQ ID NO: 3531240 - RNA, 21 nt, Pseudomonas putida KT2440
cucaaagcgcaaaaccaccag

SEQ ID NO: 3531241 - RNA, 13 nt, Pseudomonas putida KT2440
cucaaaggcagcc

SEQ ID NO: 3531242 - RNA, 17 nt, Pseudomonas putida KT2440
cucaacaccagacucag

SEQ ID NO: 3531243 - RNA, 16 nt, Pseudomonas putida KT2440
cucaacaccaucuuca

SEQ ID NO: 3531244 - RNA, 23 nt, Pseudomonas putida KT2440
cucaacaccaucuucaugcaaua

SEQ ID NO: 3531245 - RNA, 23 nt, Pseudomonas putida KT2440
cucaacagccacgcccgucaccu

SEQ ID NO: 3531246 - RNA, 19 nt, Pseudomonas putida KT2440
cucaacagguucgacagug

SEQ ID NO: 3531247 - RNA, 17 nt, Pseudomonas putida KT2440
cucaaccagcugcgugg

SEQ ID NO: 3531248 - RNA, 21 nt, Pseudomonas putida KT2440
cucaaccggugcaacugccac

SEQ ID NO: 3531249 - RNA, 21 nt, Pseudomonas putida KT2440
cucaacgcaacugcggccccu

SEQ ID NO: 3531250 - RNA, 20 nt, Pseudomonas putida KT2440
cucaacgccagggcaaucgc

SEQ ID NO: 3531251 - RNA, 15 nt, Pseudomonas putida KT2440
cucaacgccaucagg

SEQ ID NO: 3531252 - RNA, 14 nt, Pseudomonas putida KT2440
cucaacuucccucu

SEQ ID NO: 3531253 - RNA, 22 nt, Pseudomonas putida KT2440
cucaagaaaucgggucaucccc

SEQ ID NO: 3531254 - RNA, 13 nt, Pseudomonas putida KT2440
cucaagcccugcc

SEQ ID NO: 3531255 - RNA, 17 nt, Pseudomonas putida KT2440
cucaagccgguuggcgu

SEQ ID NO: 3531256 - RNA, 17 nt, Pseudomonas putida KT2440
cucaagccugccaaauc

SEQ ID NO: 3531257 - RNA, 21 nt, Pseudomonas putida KT2440
cucaagccugccaaaucccuu

SEQ ID NO: 3531258 - RNA, 13 nt, Pseudomonas putida KT2440
cucaagcgcagcc

SEQ ID NO: 3531259 - RNA, 16 nt, Pseudomonas putida KT2440
cucaagcgcagccuug

SEQ ID NO: 3531260 - RNA, 20 nt, Pseudomonas putida KT2440
cucaagcgcagccuugugcu

SEQ ID NO: 3531261 - RNA, 13 nt, Pseudomonas putida KT2440
cucaagcggccuc

SEQ ID NO: 3531262 - RNA, 23 nt, Pseudomonas putida KT2440
cucaagcuucauguacagguucu

SEQ ID NO: 3531263 - RNA, 17 nt, Pseudomonas putida KT2440
cucaaggcuuuccaccu

SEQ ID NO: 3531264 - RNA, 17 nt, Pseudomonas putida KT2440
cucaagggcgcugauca

SEQ ID NO: 3531265 - RNA, 21 nt, Pseudomonas putida KT2440
cucaagggcgcugaucaagcc

SEQ ID NO: 3531266 - RNA, 23 nt, Pseudomonas putida KT2440
cucaagggcgcugaucaagcccg

SEQ ID NO: 3531267 - RNA, 21 nt, Pseudomonas putida KT2440
cucaagggguacgaacgccag

SEQ ID NO: 3531268 - RNA, 15 nt, Pseudomonas putida KT2440
cucaagucugcauag

SEQ ID NO: 3531269 - RNA, 10 nt, Pseudomonas putida KT2440
cucaauagcg

SEQ ID NO: 3531270 - RNA, 19 nt, Pseudomonas putida KT2440
cucaaucaaccagcccgcc

SEQ ID NO: 3531271 - RNA, 23 nt, Pseudomonas putida KT2440
cucaauuucuaaaagcuggcgcg

SEQ ID NO: 3531272 - RNA, 20 nt, Pseudomonas putida KT2440
cucacagcacucguugaagc

SEQ ID NO: 3531273 - RNA, 14 nt, Pseudomonas putida KT2440
cucacaggcucagu

SEQ ID NO: 3531274 - RNA, 14 nt, Pseudomonas putida KT2440
cucacaucaucgcc

SEQ ID NO: 3531275 - RNA, 14 nt, Pseudomonas putida KT2440
cucaccccgccccu

SEQ ID NO: 3531276 - RNA, 11 nt, Pseudomonas putida KT2440
cucacccgcuu

SEQ ID NO: 3531277 - RNA, 15 nt, Pseudomonas putida KT2440
cucaccgacccacag

SEQ ID NO: 3531278 - RNA, 20 nt, Pseudomonas putida KT2440
cucaccgcagcccagcgccg

SEQ ID NO: 3531279 - RNA, 18 nt, Pseudomonas putida KT2440
cucaccgccaacccgauc

SEQ ID NO: 3531280 - RNA, 16 nt, Pseudomonas putida KT2440
cucaccgccgccccgc

SEQ ID NO: 3531281 - RNA, 21 nt, Pseudomonas putida KT2440
cucaccgccggcucgucacug

SEQ ID NO: 3531282 - RNA, 14 nt, Pseudomonas putida KT2440
cucaccgcgcccaa

SEQ ID NO: 3531283 - RNA, 16 nt, Pseudomonas putida KT2440
cucaccuacugccguc

SEQ ID NO: 3531284 - RNA, 19 nt, Pseudomonas putida KT2440
cucaccugguaccccucga

SEQ ID NO: 3531285 - RNA, 19 nt, Pseudomonas putida KT2440
cucaccuuaucggccggca

SEQ ID NO: 3531286 - RNA, 18 nt, Pseudomonas putida KT2440
cucacgaugacccuucca

SEQ ID NO: 3531287 - RNA, 20 nt, Pseudomonas putida KT2440
cucacgaugacccuuccagc

SEQ ID NO: 3531288 - RNA, 16 nt, Pseudomonas putida KT2440
cucacgcaucugcgcu

SEQ ID NO: 3531289 - RNA, 14 nt, Pseudomonas putida KT2440
cucacgcauggccg

SEQ ID NO: 3531290 - RNA, 23 nt, Pseudomonas putida KT2440
cucacgcauggccgaggucuggu

SEQ ID NO: 3531291 - RNA, 22 nt, Pseudomonas putida KT2440
cucacgcgccacauagcuggca

SEQ ID NO: 3531292 - RNA, 13 nt, Pseudomonas putida KT2440
cucacgcgccagg

SEQ ID NO: 3531293 - RNA, 24 nt, Pseudomonas putida KT2440
cucacgcucguuguccagcagcag

SEQ ID NO: 3531294 - RNA, 17 nt, Pseudomonas putida KT2440
cucacggcagugcaccc

SEQ ID NO: 3531295 - RNA, 20 nt, Pseudomonas putida KT2440
cucacggccauccugcugua

SEQ ID NO: 3531296 - RNA, 14 nt, Pseudomonas putida KT2440
cucacguucgccau

SEQ ID NO: 3531297 - RNA, 23 nt, Pseudomonas putida KT2440
cucacguucgccauaggccgccu

SEQ ID NO: 3531298 - RNA, 18 nt, Pseudomonas putida KT2440
cucacguuugggcggcgu

SEQ ID NO: 3531299 - RNA, 14 nt, Pseudomonas putida KT2440
cucacucaccgcac

SEQ ID NO: 3531300 - RNA, 13 nt, Pseudomonas putida KT2440
cucacugaacgca

SEQ ID NO: 3531301 - RNA, 19 nt, Pseudomonas putida KT2440
cucacuggcauccagcgcc

SEQ ID NO: 3531302 - RNA, 20 nt, Pseudomonas putida KT2440
cucacuggcauccagcgcca

SEQ ID NO: 3531303 - RNA, 14 nt, Pseudomonas putida KT2440
cucacuggcauccg

SEQ ID NO: 3531304 - RNA, 23 nt, Pseudomonas putida KT2440
cucacuggcauccggcagcucac

SEQ ID NO: 3531305 - RNA, 18 nt, Pseudomonas putida KT2440
cucagaaucagcuugcca

SEQ ID NO: 3531306 - RNA, 17 nt, Pseudomonas putida KT2440
cucagaguaacugaaug

SEQ ID NO: 3531307 - RNA, 23 nt, Pseudomonas putida KT2440
cucagaucagaacgaggcguugg

SEQ ID NO: 3531308 - RNA, 20 nt, Pseudomonas putida KT2440
cucagcacauucagcagcgc

SEQ ID NO: 3531309 - RNA, 22 nt, Pseudomonas putida KT2440
cucagcagguugaacagcagcg

SEQ ID NO: 3531310 - RNA, 18 nt, Pseudomonas putida KT2440
cucagccacgcuggcacc

SEQ ID NO: 3531311 - RNA, 20 nt, Pseudomonas putida KT2440
cucagccacgcuggcaccca

SEQ ID NO: 3531312 - RNA, 15 nt, Pseudomonas putida KT2440
cucagccaggcugag

SEQ ID NO: 3531313 - RNA, 21 nt, Pseudomonas putida KT2440
cucagccaggcugagcccggc

SEQ ID NO: 3531314 - RNA, 12 nt, Pseudomonas putida KT2440
cucagccgccac

SEQ ID NO: 3531315 - RNA, 13 nt, Pseudomonas putida KT2440
cucagccgccaca

SEQ ID NO: 3531316 - RNA, 21 nt, Pseudomonas putida KT2440
cucagcgcagcuucucaagca

SEQ ID NO: 3531317 - RNA, 14 nt, Pseudomonas putida KT2440
cucagcgcccgcug

SEQ ID NO: 3531318 - RNA, 22 nt, Pseudomonas putida KT2440
cucagcgcccgcugcgccgcuc

SEQ ID NO: 3531319 - RNA, 16 nt, Pseudomonas putida KT2440
cucagcgcgugcuugu

SEQ ID NO: 3531320 - RNA, 23 nt, Pseudomonas putida KT2440
cucagcgugacgauggccaccag

SEQ ID NO: 3531321 - RNA, 20 nt, Pseudomonas putida KT2440
cuccacggcaaucggcaggc

SEQ ID NO: 3531322 - RNA, 18 nt, Pseudomonas putida KT2440
cuccacggucagcaucca

SEQ ID NO: 3531323 - RNA, 15 nt, Pseudomonas putida KT2440
cuccacguucccgcc

SEQ ID NO: 3531324 - RNA, 17 nt, Pseudomonas putida KT2440
cuccacguucccgccau

SEQ ID NO: 3531325 - RNA, 23 nt, Pseudomonas putida KT2440
cuccacuggaacucgaucggcac

SEQ ID NO: 3531326 - RNA, 19 nt, Pseudomonas putida KT2440
cuccacugugcccgccagg

SEQ ID NO: 3531327 - RNA, 24 nt, Pseudomonas putida KT2440
cuccacugugcccgccaggcgcaa

SEQ ID NO: 3531328 - RNA, 17 nt, Pseudomonas putida KT2440
cuccagaaaaucagggg

SEQ ID NO: 3531329 - RNA, 19 nt, Pseudomonas putida KT2440
cuccagaaaaucaggggua

SEQ ID NO: 3531330 - RNA, 15 nt, Pseudomonas putida KT2440
cuccagagcccgcuc

SEQ ID NO: 3531331 - RNA, 20 nt, Pseudomonas putida KT2440
cuccagagcccgcucgguca

SEQ ID NO: 3531332 - RNA, 22 nt, Pseudomonas putida KT2440
cuccagcaacaacgccuuggcc

SEQ ID NO: 3531333 - RNA, 21 nt, Pseudomonas putida KT2440
cuccagcaacaucugccgaaa

SEQ ID NO: 3531334 - RNA, 13 nt, Pseudomonas putida KT2440
cuccagcaacggu

SEQ ID NO: 3531335 - RNA, 22 nt, Pseudomonas putida KT2440
cuccagcacaccgcgcaccucg

SEQ ID NO: 3531336 - RNA, 21 nt, Pseudomonas putida KT2440
cuccagcaccgauucaaagcc

SEQ ID NO: 3531337 - RNA, 13 nt, Pseudomonas putida KT2440
cuccagcaccgcc

SEQ ID NO: 3531338 - RNA, 13 nt, Pseudomonas putida KT2440
cuccagcaccuga

SEQ ID NO: 3531339 - RNA, 19 nt, Pseudomonas putida KT2440
cuccagcaccugacgcaag

SEQ ID NO: 3531340 - RNA, 22 nt, Pseudomonas putida KT2440
cuccagcaccugacgcaagcgc

SEQ ID NO: 3531341 - RNA, 17 nt, Pseudomonas putida KT2440
cuccagcacuuuugcca

SEQ ID NO: 3531342 - RNA, 19 nt, Pseudomonas putida KT2440
cuccagcacuuuugccacc

SEQ ID NO: 3531343 - RNA, 10 nt, Pseudomonas putida KT2440
cuccagcagc

SEQ ID NO: 3531344 - RNA, 23 nt, Pseudomonas putida KT2440
cuccagcagcgacaccagcgcac

SEQ ID NO: 3531345 - RNA, 17 nt, Pseudomonas putida KT2440
cuccagcagcuccacau

SEQ ID NO: 3531346 - RNA, 14 nt, Pseudomonas putida KT2440
cuccagcaggggca

SEQ ID NO: 3531347 - RNA, 19 nt, Pseudomonas putida KT2440
cuccagcagugccguggca

SEQ ID NO: 3531348 - RNA, 17 nt, Pseudomonas putida KT2440
cuccagcauggcgauca

SEQ ID NO: 3531349 - RNA, 20 nt, Pseudomonas putida KT2440
cuccagccaacggucgauca

SEQ ID NO: 3531350 - RNA, 12 nt, Pseudomonas putida KT2440
cuccagccagau

SEQ ID NO: 3531351 - RNA, 18 nt, Pseudomonas putida KT2440
cuccagcccggcuucaca

SEQ ID NO: 3531352 - RNA, 18 nt, Pseudomonas putida KT2440
cuccagcccugcucgcca

SEQ ID NO: 3531353 - RNA, 21 nt, Pseudomonas putida KT2440
cuccagcccugcucgccaaau

SEQ ID NO: 3531354 - RNA, 13 nt, Pseudomonas putida KT2440
cuccagccgcugc

SEQ ID NO: 3531355 - RNA, 15 nt, Pseudomonas putida KT2440
cuccagccgcugcug

SEQ ID NO: 3531356 - RNA, 16 nt, Pseudomonas putida KT2440
cuccagcgaugacccg

SEQ ID NO: 3531357 - RNA, 22 nt, Pseudomonas putida KT2440
cuccagcgcacgcaacaggucg

SEQ ID NO: 3531358 - RNA, 14 nt, Pseudomonas putida KT2440
cuccagcgccagca

SEQ ID NO: 3531359 - RNA, 16 nt, Pseudomonas putida KT2440
cuccagcgccagcagc

SEQ ID NO: 3531360 - RNA, 20 nt, Pseudomonas putida KT2440
cuccagcgcgguagauuuca

SEQ ID NO: 3531361 - RNA, 18 nt, Pseudomonas putida KT2440
cuccagcgucccggucaa

SEQ ID NO: 3531362 - RNA, 19 nt, Pseudomonas putida KT2440
cuccagcguuugcacggac

SEQ ID NO: 3531363 - RNA, 23 nt, Pseudomonas putida KT2440
cuccagcuccuggcccgcgcccu

SEQ ID NO: 3531364 - RNA, 22 nt, Pseudomonas putida KT2440
cuccagcucgccauucucgauc

SEQ ID NO: 3531365 - RNA, 23 nt, Pseudomonas putida KT2440
cuccagcucgccauucucgauca

SEQ ID NO: 3531366 - RNA, 13 nt, Pseudomonas putida KT2440
cuccagcucgccg

SEQ ID NO: 3531367 - RNA, 11 nt, Pseudomonas putida KT2440
cuccagcugaa

SEQ ID NO: 3531368 - RNA, 15 nt, Pseudomonas putida KT2440
cuccaggcacaggcg

SEQ ID NO: 3531369 - RNA, 17 nt, Pseudomonas putida KT2440
cuccaggccugcggcag

SEQ ID NO: 3531370 - RNA, 16 nt, Pseudomonas putida KT2440
cuccagggcaggcuga

SEQ ID NO: 3531371 - RNA, 16 nt, Pseudomonas putida KT2440
cuccagggucugcgcu

SEQ ID NO: 3531372 - RNA, 19 nt, Pseudomonas putida KT2440
cuccagguaauccagcucg

SEQ ID NO: 3531373 - RNA, 19 nt, Pseudomonas putida KT2440
cuccaggugaaucagcggc

SEQ ID NO: 3531374 - RNA, 21 nt, Pseudomonas putida KT2440
cuccaggugaaucagcggcag

SEQ ID NO: 3531375 - RNA, 23 nt, Pseudomonas putida KT2440
cuccaggugaaucagcggcaggc

SEQ ID NO: 3531376 - RNA, 14 nt, Pseudomonas putida KT2440
cuccaggugcacca

SEQ ID NO: 3531377 - RNA, 19 nt, Pseudomonas putida KT2440
cuccaggugcaccaacacu

SEQ ID NO: 3531378 - RNA, 16 nt, Pseudomonas putida KT2440
cuccaguugccagugu

SEQ ID NO: 3531379 - RNA, 16 nt, Pseudomonas putida KT2440
cuccaguuguugggca

SEQ ID NO: 3531380 - RNA, 18 nt, Pseudomonas putida KT2440
cuccaguuguugggcagc

SEQ ID NO: 3531381 - RNA, 16 nt, Pseudomonas putida KT2440
cuccauagguuaucca

SEQ ID NO: 3531382 - RNA, 23 nt, Pseudomonas putida KT2440
cuccaucaccaaaggcccguggu

SEQ ID NO: 3531383 - RNA, 14 nt, Pseudomonas putida KT2440
cuccaucgucugca

SEQ ID NO: 3531384 - RNA, 13 nt, Pseudomonas putida KT2440
cuccaucuccagc

SEQ ID NO: 3531385 - RNA, 13 nt, Pseudomonas putida KT2440
cuccaucucgugg

SEQ ID NO: 3531386 - RNA, 18 nt, Pseudomonas putida KT2440
cuccaucuucucgcgcag

SEQ ID NO: 3531387 - RNA, 18 nt, Pseudomonas putida KT2440
cuccaugaaggccggcau

SEQ ID NO: 3531388 - RNA, 14 nt, Pseudomonas putida KT2440
cuccauggccaggg

SEQ ID NO: 3531389 - RNA, 21 nt, Pseudomonas putida KT2440
cuccauggccagggcaaacac

SEQ ID NO: 3531390 - RNA, 22 nt, Pseudomonas putida KT2440
cuccauggccagggcaaacaca

SEQ ID NO: 3531391 - RNA, 20 nt, Pseudomonas putida KT2440
cuccaugguaaagcccgaag

SEQ ID NO: 3531392 - RNA, 13 nt, Pseudomonas putida KT2440
cucccacaggaau

SEQ ID NO: 3531393 - RNA, 20 nt, Pseudomonas putida KT2440
cucccacaggaauggcacca

SEQ ID NO: 3531394 - RNA, 23 nt, Pseudomonas putida KT2440
cucccacaggaauggcaccagau

SEQ ID NO: 3531395 - RNA, 12 nt, Pseudomonas putida KT2440
cucccacaggga

SEQ ID NO: 3531396 - RNA, 22 nt, Pseudomonas putida KT2440
cucccacagggaccucacagcc

SEQ ID NO: 3531397 - RNA, 21 nt, Pseudomonas putida KT2440
cucccacagggaucgcgccag

SEQ ID NO: 3531398 - RNA, 13 nt, Pseudomonas putida KT2440
cucccacagguaa

SEQ ID NO: 3531399 - RNA, 19 nt, Pseudomonas putida KT2440
cucccacagguccagcgca

SEQ ID NO: 3531400 - RNA, 22 nt, Pseudomonas putida KT2440
cucccacaggugcagcacaggu

SEQ ID NO: 3531401 - RNA, 23 nt, Pseudomonas putida KT2440
cucccacagguucgguaaugccc

SEQ ID NO: 3531402 - RNA, 23 nt, Pseudomonas putida KT2440
cucccacagguuuagcgcuggcu

SEQ ID NO: 3531403 - RNA, 12 nt, Pseudomonas putida KT2440
cucccaccagca

SEQ ID NO: 3531404 - RNA, 13 nt, Pseudomonas putida KT2440
cucccagcgcugu

SEQ ID NO: 3531405 - RNA, 22 nt, Pseudomonas putida KT2440
cucccagcgcugucccccagcc

SEQ ID NO: 3531406 - RNA, 17 nt, Pseudomonas putida KT2440
cucccaggacuucagca

SEQ ID NO: 3531407 - RNA, 12 nt, Pseudomonas putida KT2440
cucccaggccuc

SEQ ID NO: 3531408 - RNA, 16 nt, Pseudomonas putida KT2440
cucccaguacaugauc

SEQ ID NO: 3531409 - RNA, 20 nt, Pseudomonas putida KT2440
cucccaguacaugaucgggu

SEQ ID NO: 3531410 - RNA, 19 nt, Pseudomonas putida KT2440
cuccccaaccaccucccca

SEQ ID NO: 3531411 - RNA, 15 nt, Pseudomonas putida KT2440
cuccccaccaggcaa

SEQ ID NO: 3531412 - RNA, 23 nt, Pseudomonas putida KT2440
cuccccaccaucaauacgcugga

SEQ ID NO: 3531413 - RNA, 15 nt, Pseudomonas putida KT2440
cucccccagcgcggu

SEQ ID NO: 3531414 - RNA, 13 nt, Pseudomonas putida KT2440
cucccccaucagu

SEQ ID NO: 3531415 - RNA, 13 nt, Pseudomonas putida KT2440
cucccccuccacc

SEQ ID NO: 3531416 - RNA, 16 nt, Pseudomonas putida KT2440
cuccccucagacagag

SEQ ID NO: 3531417 - RNA, 12 nt, Pseudomonas putida KT2440
cucccgagccag

SEQ ID NO: 3531418 - RNA, 23 nt, Pseudomonas putida KT2440
cucccgagccaggaagaucacgu

SEQ ID NO: 3531419 - RNA, 13 nt, Pseudomonas putida KT2440
cucccgcacugcu

SEQ ID NO: 3531420 - RNA, 19 nt, Pseudomonas putida KT2440
cucccgcacugcugccgcc

SEQ ID NO: 3531421 - RNA, 17 nt, Pseudomonas putida KT2440
cucccgccacggccacc

SEQ ID NO: 3531422 - RNA, 20 nt, Pseudomonas putida KT2440
cucccgcgaacgcccgaccu

SEQ ID NO: 3531423 - RNA, 16 nt, Pseudomonas putida KT2440
cucccgcgcauccucc

SEQ ID NO: 3531424 - RNA, 17 nt, Pseudomonas putida KT2440
cucccgcgcaugcugcc

SEQ ID NO: 3531425 - RNA, 18 nt, Pseudomonas putida KT2440
cucccgcgcaugcugcca

SEQ ID NO: 3531426 - RNA, 16 nt, Pseudomonas putida KT2440
cucgaccagaucagcc

SEQ ID NO: 3531427 - RNA, 14 nt, Pseudomonas putida KT2440
cucgacccagccac

SEQ ID NO: 3531428 - RNA, 20 nt, Pseudomonas putida KT2440
cucgacccgcccgccaugca

SEQ ID NO: 3531429 - RNA, 12 nt, Pseudomonas putida KT2440
cucgacccgccg

SEQ ID NO: 3531430 - RNA, 14 nt, Pseudomonas putida KT2440
cucgacccgcuggc

SEQ ID NO: 3531431 - RNA, 19 nt, Pseudomonas putida KT2440
cucgacccgucgcugccaa

SEQ ID NO: 3531432 - RNA, 16 nt, Pseudomonas putida KT2440
cucgaccgccgcacag

SEQ ID NO: 3531433 - RNA, 16 nt, Pseudomonas putida KT2440
cucgacgccccggccu

SEQ ID NO: 3531434 - RNA, 18 nt, Pseudomonas putida KT2440
cucgacgccccggccugc

SEQ ID NO: 3531435 - RNA, 20 nt, Pseudomonas putida KT2440
cucgacgccuuggcgcagca

SEQ ID NO: 3531436 - RNA, 16 nt, Pseudomonas putida KT2440
cucgacgcgcgcagcc

SEQ ID NO: 3531437 - RNA, 17 nt, Pseudomonas putida KT2440
cucgacgcgcgcagccu

SEQ ID NO: 3531438 - RNA, 22 nt, Pseudomonas putida KT2440
cucgacgcggacccggcauccu

SEQ ID NO: 3531439 - RNA, 12 nt, Pseudomonas putida KT2440
cucgacggcgca

SEQ ID NO: 3531440 - RNA, 16 nt, Pseudomonas putida KT2440
cucgacguugagccag

SEQ ID NO: 3531441 - RNA, 20 nt, Pseudomonas putida KT2440
cucgacguuuaccugcagcu

SEQ ID NO: 3531442 - RNA, 16 nt, Pseudomonas putida KT2440
cucgagaaacgccagc

SEQ ID NO: 3531443 - RNA, 19 nt, Pseudomonas putida KT2440
cucgagaaacucacgcaug

SEQ ID NO: 3531444 - RNA, 15 nt, Pseudomonas putida KT2440
cucgagcccgccagc

SEQ ID NO: 3531445 - RNA, 16 nt, Pseudomonas putida KT2440
cucgagcccgccagca

SEQ ID NO: 3531446 - RNA, 14 nt, Pseudomonas putida KT2440
cucgaggaagcggc

SEQ ID NO: 3531447 - RNA, 16 nt, Pseudomonas putida KT2440
cucgaggaagcggcca

SEQ ID NO: 3531448 - RNA, 23 nt, Pseudomonas putida KT2440
cucgauacggucuuuuccccuua

SEQ ID NO: 3531449 - RNA, 13 nt, Pseudomonas putida KT2440
cucgauagcagcg

SEQ ID NO: 3531450 - RNA, 22 nt, Pseudomonas putida KT2440
cucgauaugccgccguucaggc

SEQ ID NO: 3531451 - RNA, 19 nt, Pseudomonas putida KT2440
cucgaucaccugcggccug

SEQ ID NO: 3531452 - RNA, 20 nt, Pseudomonas putida KT2440
cucgaucacgaaucgggucc

SEQ ID NO: 3531453 - RNA, 15 nt, Pseudomonas putida KT2440
cucgaucccgccgcc

SEQ ID NO: 3531454 - RNA, 16 nt, Pseudomonas putida KT2440
cucgaucccgccgcca

SEQ ID NO: 3531455 - RNA, 22 nt, Pseudomonas putida KT2440
cucgaucgccauguguacgccg

SEQ ID NO: 3531456 - RNA, 23 nt, Pseudomonas putida KT2440
cucgaucgccauguguacgccgc

SEQ ID NO: 3531457 - RNA, 13 nt, Pseudomonas putida KT2440
cucgaucggcacc

SEQ ID NO: 3531458 - RNA, 20 nt, Pseudomonas putida KT2440
cucgaucggcacccccuuca

SEQ ID NO: 3531459 - RNA, 17 nt, Pseudomonas putida KT2440
cucgaucucacaggcga

SEQ ID NO: 3531460 - RNA, 21 nt, Pseudomonas putida KT2440
cucgaugaagucgcacaugaa

SEQ ID NO: 3531461 - RNA, 19 nt, Pseudomonas putida KT2440
cucgaugcaauccgccaca

SEQ ID NO: 3531462 - RNA, 23 nt, Pseudomonas putida KT2440
cucgaugccuuugcaaagcgcac

SEQ ID NO: 3531463 - RNA, 21 nt, Pseudomonas putida KT2440
cucgaugcggucuuccagcgg

SEQ ID NO: 3531464 - RNA, 22 nt, Pseudomonas putida KT2440
cucgauggccaggaacagcgcc

SEQ ID NO: 3531465 - RNA, 19 nt, Pseudomonas putida KT2440
cucgaugucuuccagacca

SEQ ID NO: 3531466 - RNA, 23 nt, Pseudomonas putida KT2440
cucgaugugcgugaacacugcca

SEQ ID NO: 3531467 - RNA, 13 nt, Pseudomonas putida KT2440
cucgauugacccc

SEQ ID NO: 3531468 - RNA, 20 nt, Pseudomonas putida KT2440
cucgcacgcauguccuuggc

SEQ ID NO: 3531469 - RNA, 22 nt, Pseudomonas putida KT2440
cucgcacgcauguccuuggccc

SEQ ID NO: 3531470 - RNA, 14 nt, Pseudomonas putida KT2440
cucgcagcagcacc

SEQ ID NO: 3531471 - RNA, 22 nt, Pseudomonas putida KT2440
cucgccaaauguaggaucaagu

SEQ ID NO: 3531472 - RNA, 17 nt, Pseudomonas putida KT2440
cucgccaacaccgcccc

SEQ ID NO: 3531473 - RNA, 17 nt, Pseudomonas putida KT2440
cucgccagccugcagcg

SEQ ID NO: 3531474 - RNA, 21 nt, Pseudomonas putida KT2440
cucgccauaagcugucagcac

SEQ ID NO: 3531475 - RNA, 17 nt, Pseudomonas putida KT2440
cucgccauucaccagcu

SEQ ID NO: 3531476 - RNA, 21 nt, Pseudomonas putida KT2440
cucgccauucaccagcuucag

SEQ ID NO: 3531477 - RNA, 14 nt, Pseudomonas putida KT2440
cucgcccaccagcu

SEQ ID NO: 3531478 - RNA, 20 nt, Pseudomonas putida KT2440
cucgcccaccagcugcacca

SEQ ID NO: 3531479 - RNA, 14 nt, Pseudomonas putida KT2440
cucgcccaccgaca

SEQ ID NO: 3531480 - RNA, 19 nt, Pseudomonas putida KT2440
cucgcccacucacgcaacu

SEQ ID NO: 3531481 - RNA, 12 nt, Pseudomonas putida KT2440
cucgcccagcag

SEQ ID NO: 3531482 - RNA, 13 nt, Pseudomonas putida KT2440
cucgcccagcagc

SEQ ID NO: 3531483 - RNA, 14 nt, Pseudomonas putida KT2440
cucgcccaggccgc

SEQ ID NO: 3531484 - RNA, 14 nt, Pseudomonas putida KT2440
cucgcccaugggcu

SEQ ID NO: 3531485 - RNA, 14 nt, Pseudomonas putida KT2440
cucgccccgcgcaa

SEQ ID NO: 3531486 - RNA, 15 nt, Pseudomonas putida KT2440
cucgcccggcacggc

SEQ ID NO: 3531487 - RNA, 21 nt, Pseudomonas putida KT2440
cucgcccggcacggcgugcuc

SEQ ID NO: 3531488 - RNA, 14 nt, Pseudomonas putida KT2440
cucgcccgggucag

SEQ ID NO: 3531489 - RNA, 18 nt, Pseudomonas putida KT2440
cucgcccgggucaggucg

SEQ ID NO: 3531490 - RNA, 19 nt, Pseudomonas putida KT2440
cucgcccgguuuggccuga

SEQ ID NO: 3531491 - RNA, 22 nt, Pseudomonas putida KT2440
cucgccgcccaguggcacacca

SEQ ID NO: 3531492 - RNA, 13 nt, Pseudomonas putida KT2440
cucgccgccgcga

SEQ ID NO: 3531493 - RNA, 17 nt, Pseudomonas putida KT2440
cucgccgcuguacacca

SEQ ID NO: 3531494 - RNA, 16 nt, Pseudomonas putida KT2440
cucgccggccuuggcg

SEQ ID NO: 3531495 - RNA, 17 nt, Pseudomonas putida KT2440
cucgccggguuccacca

SEQ ID NO: 3531496 - RNA, 22 nt, Pseudomonas putida KT2440
cucgccguacucggucugguaa

SEQ ID NO: 3531497 - RNA, 14 nt, Pseudomonas putida KT2440
cucgccucacagcg

SEQ ID NO: 3531498 - RNA, 14 nt, Pseudomonas putida KT2440
cucgccucaccgca

SEQ ID NO: 3531499 - RNA, 12 nt, Pseudomonas putida KT2440
cucgccucagcg

SEQ ID NO: 3531500 - RNA, 15 nt, Pseudomonas putida KT2440
cucgccucagcgcca

SEQ ID NO: 3531501 - RNA, 14 nt, Pseudomonas putida KT2440
cucgccuggccaua

SEQ ID NO: 3531502 - RNA, 22 nt, Pseudomonas putida KT2440
cucgcgauccaucuucaccuug

SEQ ID NO: 3531503 - RNA, 15 nt, Pseudomonas putida KT2440
cucgcgcaacaccgc

SEQ ID NO: 3531504 - RNA, 12 nt, Pseudomonas putida KT2440
cucgcgcagcau

SEQ ID NO: 3531505 - RNA, 14 nt, Pseudomonas putida KT2440
cucgcgcauccagc

SEQ ID NO: 3531506 - RNA, 17 nt, Pseudomonas putida KT2440
cucgcgcauccagccag

SEQ ID NO: 3531507 - RNA, 14 nt, Pseudomonas putida KT2440
cucgcgcaugaucg

SEQ ID NO: 3531508 - RNA, 13 nt, Pseudomonas putida KT2440
cucgcgcugccag

SEQ ID NO: 3531509 - RNA, 14 nt, Pseudomonas putida KT2440
cucgcgcugccagg

SEQ ID NO: 3531510 - RNA, 17 nt, Pseudomonas putida KT2440
cucgcgcuguuccagcc

SEQ ID NO: 3531511 - RNA, 14 nt, Pseudomonas putida KT2440
cucgcgcuuggcca

SEQ ID NO: 3531512 - RNA, 15 nt, Pseudomonas putida KT2440
cucgcgcuuggccag

SEQ ID NO: 3531513 - RNA, 16 nt, Pseudomonas putida KT2440
cucgcgcuuuucaucu

SEQ ID NO: 3531514 - RNA, 20 nt, Pseudomonas putida KT2440
cucgcggcgaaugcugcaga

SEQ ID NO: 3531515 - RNA, 21 nt, Pseudomonas putida KT2440
cucgcggcggcuaagcgccag

SEQ ID NO: 3531516 - RNA, 15 nt, Pseudomonas putida KT2440
cucgcgguggaucgc

SEQ ID NO: 3531517 - RNA, 13 nt, Pseudomonas putida KT2440
cucgcucaggcca

SEQ ID NO: 3531518 - RNA, 23 nt, Pseudomonas putida KT2440
cucgcucaggccaugcugcgcca

SEQ ID NO: 3531519 - RNA, 19 nt, Pseudomonas putida KT2440
cucgcucaggcgcagcgca

SEQ ID NO: 3531520 - RNA, 18 nt, Pseudomonas putida KT2440
cucgcugaacacgcaggu

SEQ ID NO: 3531521 - RNA, 21 nt, Pseudomonas putida KT2440
cucgcugccacgcaugccuau

SEQ ID NO: 3531522 - RNA, 16 nt, Pseudomonas putida KT2440
cucgcugccccagucu

SEQ ID NO: 3531523 - RNA, 16 nt, Pseudomonas putida KT2440
cucgcugccggcgugg

SEQ ID NO: 3531524 - RNA, 21 nt, Pseudomonas putida KT2440
cucgcugccuuuggccgccag

SEQ ID NO: 3531525 - RNA, 14 nt, Pseudomonas putida KT2440
cucgcugcgaucga

SEQ ID NO: 3531526 - RNA, 19 nt, Pseudomonas putida KT2440
cucgcugucguccagcucg

SEQ ID NO: 3531527 - RNA, 21 nt, Pseudomonas putida KT2440
cucgcuucccccaaucuccag

SEQ ID NO: 3531528 - RNA, 19 nt, Pseudomonas putida KT2440
cucgcuuuccaaaccugcg

SEQ ID NO: 3531529 - RNA, 21 nt, Pseudomonas putida KT2440
cucgcuuuccaaaccugcgac

SEQ ID NO: 3531530 - RNA, 17 nt, Pseudomonas putida KT2440
cucggacacgucacuga

SEQ ID NO: 3531531 - RNA, 19 nt, Pseudomonas putida KT2440
cucucaacguucauccccu

SEQ ID NO: 3531532 - RNA, 16 nt, Pseudomonas putida KT2440
cucuccaauccgcagc

SEQ ID NO: 3531533 - RNA, 21 nt, Pseudomonas putida KT2440
cucuccacguccacuaccucc

SEQ ID NO: 3531534 - RNA, 20 nt, Pseudomonas putida KT2440
cucuccauugcgccugucac

SEQ ID NO: 3531535 - RNA, 19 nt, Pseudomonas putida KT2440
cucucccgcagccgauacg

SEQ ID NO: 3531536 - RNA, 16 nt, Pseudomonas putida KT2440
cucuccgaggccgggc

SEQ ID NO: 3531537 - RNA, 18 nt, Pseudomonas putida KT2440
cucuccucucccaccagc

SEQ ID NO: 3531538 - RNA, 11 nt, Pseudomonas putida KT2440
cucuccuugcg

SEQ ID NO: 3531539 - RNA, 23 nt, Pseudomonas putida KT2440
cucucgaaguagcgcucuuugcc

SEQ ID NO: 3531540 - RNA, 23 nt, Pseudomonas putida KT2440
cucucgaucaugcggcaagccaa

SEQ ID NO: 3531541 - RNA, 14 nt, Pseudomonas putida KT2440
cucucgauugaccc

SEQ ID NO: 3531542 - RNA, 13 nt, Pseudomonas putida KT2440
cucucgucaccug

SEQ ID NO: 3531543 - RNA, 22 nt, Pseudomonas putida KT2440
cucugacauaacaagaacaaca

SEQ ID NO: 3531544 - RNA, 18 nt, Pseudomonas putida KT2440
cucugaccggcacugcac

SEQ ID NO: 3531545 - RNA, 14 nt, Pseudomonas putida KT2440
cucugaucaauuca

SEQ ID NO: 3531546 - RNA, 17 nt, Pseudomonas putida KT2440
cucugcaaugccgccaa

SEQ ID NO: 3531547 - RNA, 11 nt, Pseudomonas putida KT2440
cucugcagcag

SEQ ID NO: 3531548 - RNA, 20 nt, Pseudomonas putida KT2440
cucugcaggcacacccggac

SEQ ID NO: 3531549 - RNA, 17 nt, Pseudomonas putida KT2440
cucugcccgcaaggcaa

SEQ ID NO: 3531550 - RNA, 12 nt, Pseudomonas putida KT2440
cucugccgacaa

SEQ ID NO: 3531551 - RNA, 15 nt, Pseudomonas putida KT2440
cucugccgagaggau

SEQ ID NO: 3531552 - RNA, 18 nt, Pseudomonas putida KT2440
cucugccgcaccaggucc

SEQ ID NO: 3531553 - RNA, 16 nt, Pseudomonas putida KT2440
cucugccgccccucca

SEQ ID NO: 3531554 - RNA, 12 nt, Pseudomonas putida KT2440
cucugcgccugc

SEQ ID NO: 3531555 - RNA, 13 nt, Pseudomonas putida KT2440
cucugcgccugcg

SEQ ID NO: 3531556 - RNA, 12 nt, Pseudomonas putida KT2440
cucugcggccuu

SEQ ID NO: 3531557 - RNA, 15 nt, Pseudomonas putida KT2440
cucugcggccuucaa

SEQ ID NO: 3531558 - RNA, 22 nt, Pseudomonas putida KT2440
cucugcugcggauacagcgccc

SEQ ID NO: 3531559 - RNA, 11 nt, Pseudomonas putida KT2440
cucugcugcuc

SEQ ID NO: 3531560 - RNA, 21 nt, Pseudomonas putida KT2440
cucugcugcucugccgccgca

SEQ ID NO: 3531561 - RNA, 20 nt, Pseudomonas putida KT2440
cucugcuucgggaauaccag

SEQ ID NO: 3531562 - RNA, 16 nt, Pseudomonas putida KT2440
cucuggguagccaccu

SEQ ID NO: 3531563 - RNA, 15 nt, Pseudomonas putida KT2440
cucugguacaacaac

SEQ ID NO: 3531564 - RNA, 22 nt, Pseudomonas putida KT2440
cucugguacaacaacaaaaaaa

SEQ ID NO: 3531565 - RNA, 23 nt, Pseudomonas putida KT2440
cucuguaucgaacaggcagacca

SEQ ID NO: 3531566 - RNA, 22 nt, Pseudomonas putida KT2440
cucuguuccauuucacuggcuu

SEQ ID NO: 3531567 - RNA, 14 nt, Pseudomonas putida KT2440
cucuguuucugccc

SEQ ID NO: 3531568 - RNA, 22 nt, Pseudomonas putida KT2440
cucuucaaccaguucagcgccc

SEQ ID NO: 3531569 - RNA, 23 nt, Pseudomonas putida KT2440
cucuucaaccuguuccggccucu

SEQ ID NO: 3531570 - RNA, 13 nt, Pseudomonas putida KT2440
cucuucacugcuc

SEQ ID NO: 3531571 - RNA, 17 nt, Pseudomonas putida KT2440
cucuucaucccugaccg

SEQ ID NO: 3531572 - RNA, 14 nt, Pseudomonas putida KT2440
cucuuccagcucgc

SEQ ID NO: 3531573 - RNA, 18 nt, Pseudomonas putida KT2440
cucuucccaccaccagcg

SEQ ID NO: 3531574 - RNA, 22 nt, Pseudomonas putida KT2440
cucuuccccgcccaagcggcag

SEQ ID NO: 3531575 - RNA, 13 nt, Pseudomonas putida KT2440
cucuuccuggcug

SEQ ID NO: 3531576 - RNA, 14 nt, Pseudomonas putida KT2440
cucuuccuugaucu

SEQ ID NO: 3531577 - RNA, 23 nt, Pseudomonas putida KT2440
cucuuccuugaucuucaugaagu

SEQ ID NO: 3531578 - RNA, 16 nt, Pseudomonas putida KT2440
cucuucgaagacgccg

SEQ ID NO: 3531579 - RNA, 18 nt, Pseudomonas putida KT2440
cucuucgcagcacaaggc

SEQ ID NO: 3531580 - RNA, 14 nt, Pseudomonas putida KT2440
cucuucgcgggcaa

SEQ ID NO: 3531581 - RNA, 14 nt, Pseudomonas putida KT2440
cucuucgcgggcac

SEQ ID NO: 3531582 - RNA, 20 nt, Pseudomonas putida KT2440
cucuucgcgggcacgcccgc

SEQ ID NO: 3531583 - RNA, 19 nt, Pseudomonas putida KT2440
cucuucgcgggcaugcccg

SEQ ID NO: 3531584 - RNA, 22 nt, Pseudomonas putida KT2440
cucuucgcgggcucgcccacuc

SEQ ID NO: 3531585 - RNA, 18 nt, Pseudomonas putida KT2440
cucuucgcggguaaaccc

SEQ ID NO: 3531586 - RNA, 19 nt, Pseudomonas putida KT2440
cucuucgcgggugaacccg

SEQ ID NO: 3531587 - RNA, 17 nt, Pseudomonas putida KT2440
cucuucggccaguuuca

SEQ ID NO: 3531588 - RNA, 14 nt, Pseudomonas putida KT2440
cucuucguucuuga

SEQ ID NO: 3531589 - RNA, 22 nt, Pseudomonas putida KT2440
cucuucugccaguugcuucugc

SEQ ID NO: 3531590 - RNA, 15 nt, Pseudomonas putida KT2440
cucuucuggggugau

SEQ ID NO: 3531591 - RNA, 15 nt, Pseudomonas putida KT2440
cucuucuucaaggcu

SEQ ID NO: 3531592 - RNA, 17 nt, Pseudomonas putida KT2440
cucuugaacugggcauc

SEQ ID NO: 3531593 - RNA, 14 nt, Pseudomonas putida KT2440
cucuugagcuggcc

SEQ ID NO: 3531594 - RNA, 12 nt, Pseudomonas putida KT2440
cucuugaggucg

SEQ ID NO: 3531595 - RNA, 13 nt, Pseudomonas putida KT2440
cucuugcccggcc

SEQ ID NO: 3531596 - RNA, 20 nt, Pseudomonas putida KT2440
cucuugcuuguuauggcacu

SEQ ID NO: 3531597 - RNA, 13 nt, Pseudomonas putida KT2440
cugaaacaucagc

SEQ ID NO: 3531598 - RNA, 16 nt, Pseudomonas putida KT2440
cugaaaccccgcccca

SEQ ID NO: 3531599 - RNA, 17 nt, Pseudomonas putida KT2440
cugaaaguucagcgccu

SEQ ID NO: 3531600 - RNA, 19 nt, Pseudomonas putida KT2440
cugaaauccagccgcccga

SEQ ID NO: 3531601 - RNA, 15 nt, Pseudomonas putida KT2440
cugaaaucuuugcuu

SEQ ID NO: 3531602 - RNA, 22 nt, Pseudomonas putida KT2440
cugaaauggcggcccagccagu

SEQ ID NO: 3531603 - RNA, 17 nt, Pseudomonas putida KT2440
cugaaauuuuugaaauu

SEQ ID NO: 3531604 - RNA, 21 nt, Pseudomonas putida KT2440
cugaaauuuuugaaauuuuug

SEQ ID NO: 3531605 - RNA, 14 nt, Pseudomonas putida KT2440
cugaacaccugcca

SEQ ID NO: 3531606 - RNA, 16 nt, Pseudomonas putida KT2440
cugaacaccugccagc

SEQ ID NO: 3531607 - RNA, 17 nt, Pseudomonas putida KT2440
cugaacaccugccagcc

SEQ ID NO: 3531608 - RNA, 16 nt, Pseudomonas putida KT2440
cugaacacgcaggucu

SEQ ID NO: 3531609 - RNA, 21 nt, Pseudomonas putida KT2440
cugaacacgcucaugaacagc

SEQ ID NO: 3531610 - RNA, 19 nt, Pseudomonas putida KT2440
cugaaccaugcgccgcugc

SEQ ID NO: 3531611 - RNA, 21 nt, Pseudomonas putida KT2440
cugaacggugaagucaaccaa

SEQ ID NO: 3531612 - RNA, 15 nt, Pseudomonas putida KT2440
cugaacuucaaccgc

SEQ ID NO: 3531613 - RNA, 22 nt, Pseudomonas putida KT2440
cugaacuucaaccgcacccgca

SEQ ID NO: 3531614 - RNA, 15 nt, Pseudomonas putida KT2440
cugaagacgcuugcg

SEQ ID NO: 3531615 - RNA, 19 nt, Pseudomonas putida KT2440
cugaagccaguacgcgccu

SEQ ID NO: 3531616 - RNA, 22 nt, Pseudomonas putida KT2440
cugaagccaguacgcgccugca

SEQ ID NO: 3531617 - RNA, 21 nt, Pseudomonas putida KT2440
cugaagcccuggaugacacgg

SEQ ID NO: 3531618 - RNA, 22 nt, Pseudomonas putida KT2440
cugaagcccuggaugacacgga

SEQ ID NO: 3531619 - RNA, 23 nt, Pseudomonas putida KT2440
cugaagcgcgggucuuccaccac

SEQ ID NO: 3531620 - RNA, 13 nt, Pseudomonas putida KT2440
cugaagcucucca

SEQ ID NO: 3531621 - RNA, 19 nt, Pseudomonas putida KT2440
cugaagcucuccagcaggu

SEQ ID NO: 3531622 - RNA, 18 nt, Pseudomonas putida KT2440
cugaaggccgcuccugcg

SEQ ID NO: 3531623 - RNA, 19 nt, Pseudomonas putida KT2440
cugaagugaauagccggca

SEQ ID NO: 3531624 - RNA, 20 nt, Pseudomonas putida KT2440
cugaagugaauagccggcac

SEQ ID NO: 3531625 - RNA, 22 nt, Pseudomonas putida KT2440
cugaauacaccagcuugaugcu

SEQ ID NO: 3531626 - RNA, 21 nt, Pseudomonas putida KT2440
cugaauacagccaauggcaaa

SEQ ID NO: 3531627 - RNA, 13 nt, Pseudomonas putida KT2440
cugaaucuggcuc

SEQ ID NO: 3531628 - RNA, 15 nt, Pseudomonas putida KT2440
cugaaucuggcucug

SEQ ID NO: 3531629 - RNA, 20 nt, Pseudomonas putida KT2440
cugaaucuggcucugcagcg

SEQ ID NO: 3531630 - RNA, 19 nt, Pseudomonas putida KT2440
cugaaucuugcgcgccagc

SEQ ID NO: 3531631 - RNA, 21 nt, Pseudomonas putida KT2440
cugaaugaaaaagccccgcca

SEQ ID NO: 3531632 - RNA, 22 nt, Pseudomonas putida KT2440
cugaauggcuggugaagcccuu

SEQ ID NO: 3531633 - RNA, 20 nt, Pseudomonas putida KT2440
cugaauguacaaugcacuuc

SEQ ID NO: 3531634 - RNA, 19 nt, Pseudomonas putida KT2440
cugaaugucagcgcucggg

SEQ ID NO: 3531635 - RNA, 21 nt, Pseudomonas putida KT2440
cugaaugucaucugaggcccg

SEQ ID NO: 3531636 - RNA, 18 nt, Pseudomonas putida KT2440
cgggcgaguggucggcgu

SEQ ID NO: 3531637 - RNA, 15 nt, Pseudomonas putida KT2440
cgggcgauugccagg

SEQ ID NO: 3531638 - RNA, 13 nt, Pseudomonas putida KT2440
cgggcgcaccacg

SEQ ID NO: 3531639 - RNA, 13 nt, Pseudomonas putida KT2440
cgggcgcaggcaa

SEQ ID NO: 3531640 - RNA, 15 nt, Pseudomonas putida KT2440
cgggcgcaggcagca

SEQ ID NO: 3531641 - RNA, 15 nt, Pseudomonas putida KT2440
cgggcgcccuggcau

SEQ ID NO: 3531642 - RNA, 15 nt, Pseudomonas putida KT2440
cgggcgcgcccgcuc

SEQ ID NO: 3531643 - RNA, 24 nt, Pseudomonas putida KT2440
cgggcgcucgcgguucaucggcaa

SEQ ID NO: 3531644 - RNA, 13 nt, Pseudomonas putida KT2440
cgggcgcugaagc

SEQ ID NO: 3531645 - RNA, 18 nt, Pseudomonas putida KT2440
cgggcggaacuggcccug

SEQ ID NO: 3531646 - RNA, 16 nt, Pseudomonas putida KT2440
cgggcggccaccggcc

SEQ ID NO: 3531647 - RNA, 13 nt, Pseudomonas putida KT2440
cgggcgggugcau

SEQ ID NO: 3531648 - RNA, 18 nt, Pseudomonas putida KT2440
cgggcgguugggcaagug

SEQ ID NO: 3531649 - RNA, 18 nt, Pseudomonas putida KT2440
cgggcgguugucgaccug

SEQ ID NO: 3531650 - RNA, 16 nt, Pseudomonas putida KT2440
cgggcguaccuggcug

SEQ ID NO: 3531651 - RNA, 23 nt, Pseudomonas putida KT2440
cgggcgucuuccagguggccgcc

SEQ ID NO: 3531652 - RNA, 20 nt, Pseudomonas putida KT2440
cgggcgugcccgcgaaugca

SEQ ID NO: 3531653 - RNA, 19 nt, Pseudomonas putida KT2440
cgggcgugccugcgaaugg

SEQ ID NO: 3531654 - RNA, 23 nt, Pseudomonas putida KT2440
cgggcgugccugcgaauggccgc

SEQ ID NO: 3531655 - RNA, 22 nt, Pseudomonas putida KT2440
cgggcgugcguuugcgaaccuc

SEQ ID NO: 3531656 - RNA, 22 nt, Pseudomonas putida KT2440
cgggcguucagcuugucgacca

SEQ ID NO: 3531657 - RNA, 23 nt, Pseudomonas putida KT2440
cgggcguugaucuguugcugcag

SEQ ID NO: 3531658 - RNA, 21 nt, Pseudomonas putida KT2440
cgggcuacgcaaaccaaacgc

SEQ ID NO: 3531659 - RNA, 22 nt, Pseudomonas putida KT2440
cgggcucgcccacacggcaagc

SEQ ID NO: 3531660 - RNA, 17 nt, Pseudomonas putida KT2440
cgggcucguuauccgcg

SEQ ID NO: 3531661 - RNA, 18 nt, Pseudomonas putida KT2440
cgggcugagcccaaccuc

SEQ ID NO: 3531662 - RNA, 21 nt, Pseudomonas putida KT2440
cgggcugagcccaaccucuga

SEQ ID NO: 3531663 - RNA, 18 nt, Pseudomonas putida KT2440
cgggcugcaaagcgggca

SEQ ID NO: 3531664 - RNA, 23 nt, Pseudomonas putida KT2440
cgggcugcaaagcgggcaacugc

SEQ ID NO: 3531665 - RNA, 15 nt, Pseudomonas putida KT2440
cgggcugcucccgca

SEQ ID NO: 3531666 - RNA, 12 nt, Pseudomonas putida KT2440
cgggcugcugcc

SEQ ID NO: 3531667 - RNA, 17 nt, Pseudomonas putida KT2440
cgggcugcugccgcccc

SEQ ID NO: 3531668 - RNA, 19 nt, Pseudomonas putida KT2440
cgggcugcugccgccccaa

SEQ ID NO: 3531669 - RNA, 14 nt, Pseudomonas putida KT2440
cgggcugcugcgca

SEQ ID NO: 3531670 - RNA, 16 nt, Pseudomonas putida KT2440
cgggcuggcugcccga

SEQ ID NO: 3531671 - RNA, 14 nt, Pseudomonas putida KT2440
cgggcugucgagca

SEQ ID NO: 3531672 - RNA, 18 nt, Pseudomonas putida KT2440
cgggcuuccagucggccu

SEQ ID NO: 3531673 - RNA, 19 nt, Pseudomonas putida KT2440
cgggcuuccagucggccug

SEQ ID NO: 3531674 - RNA, 16 nt, Pseudomonas putida KT2440
cgggcuugcccaugaa

SEQ ID NO: 3531675 - RNA, 23 nt, Pseudomonas putida KT2440
cgggcuugcccaugaagcggccg

SEQ ID NO: 3531676 - RNA, 14 nt, Pseudomonas putida KT2440
cgggcuugcccgcg

SEQ ID NO: 3531677 - RNA, 18 nt, Pseudomonas putida KT2440
cgggcuugcccgcgaaga

SEQ ID NO: 3531678 - RNA, 18 nt, Pseudomonas putida KT2440
cgggcuugcccgcgaagg

SEQ ID NO: 3531679 - RNA, 18 nt, Pseudomonas putida KT2440
cgggcuuggugaugggcg

SEQ ID NO: 3531680 - RNA, 16 nt, Pseudomonas putida KT2440
cgggcuuuccacgccu

SEQ ID NO: 3531681 - RNA, 16 nt, Pseudomonas putida KT2440
cgggcuuucugguucu

SEQ ID NO: 3531682 - RNA, 20 nt, Pseudomonas putida KT2440
cgggcuuuggucgcggcgcu

SEQ ID NO: 3531683 - RNA, 17 nt, Pseudomonas putida KT2440
cggggaauggcccagcc

SEQ ID NO: 3531684 - RNA, 18 nt, Pseudomonas putida KT2440
cggggaauggcccagcca

SEQ ID NO: 3531685 - RNA, 19 nt, Pseudomonas putida KT2440
cggggaucuugcuggccgg

SEQ ID NO: 3531686 - RNA, 20 nt, Pseudomonas putida KT2440
cggggaucuugcuggccggu

SEQ ID NO: 3531687 - RNA, 16 nt, Pseudomonas putida KT2440
cgguaaacgucggcag

SEQ ID NO: 3531688 - RNA, 21 nt, Pseudomonas putida KT2440
cgguaaacgucggcagccaug

SEQ ID NO: 3531689 - RNA, 21 nt, Pseudomonas putida KT2440
cgguaaacguggucagccacg

SEQ ID NO: 3531690 - RNA, 23 nt, Pseudomonas putida KT2440
cgguaaagaacaugaucaagcug

SEQ ID NO: 3531691 - RNA, 15 nt, Pseudomonas putida KT2440
cgguaaagcgcgccu

SEQ ID NO: 3531692 - RNA, 18 nt, Pseudomonas putida KT2440
cgguaaagcgcgccucca

SEQ ID NO: 3531693 - RNA, 19 nt, Pseudomonas putida KT2440
cgguaaccggaauagaaca

SEQ ID NO: 3531694 - RNA, 18 nt, Pseudomonas putida KT2440
cgguaacgggccagccgc

SEQ ID NO: 3531695 - RNA, 19 nt, Pseudomonas putida KT2440
cgguaacguggacagcagc

SEQ ID NO: 3531696 - RNA, 22 nt, Pseudomonas putida KT2440
cgguaaugaccuggaucgccag

SEQ ID NO: 3531697 - RNA, 19 nt, Pseudomonas putida KT2440
cgguacaaaucuucccgcg

SEQ ID NO: 3531698 - RNA, 13 nt, Pseudomonas putida KT2440
cgguacagccagc

SEQ ID NO: 3531699 - RNA, 21 nt, Pseudomonas putida KT2440
cgguacagccuaccaacgcag

SEQ ID NO: 3531700 - RNA, 12 nt, Pseudomonas putida KT2440
cgguaccagcag

SEQ ID NO: 3531701 - RNA, 13 nt, Pseudomonas putida KT2440
cgguaccagcagg

SEQ ID NO: 3531702 - RNA, 14 nt, Pseudomonas putida KT2440
cgguacccgccagc

SEQ ID NO: 3531703 - RNA, 14 nt, Pseudomonas putida KT2440
cgguaccgccacca

SEQ ID NO: 3531704 - RNA, 17 nt, Pseudomonas putida KT2440
cgguaccgccaccaauc

SEQ ID NO: 3531705 - RNA, 14 nt, Pseudomonas putida KT2440
cgguaccgcucugc

SEQ ID NO: 3531706 - RNA, 13 nt, Pseudomonas putida KT2440
cgguaccggcaau

SEQ ID NO: 3531707 - RNA, 14 nt, Pseudomonas putida KT2440
cgguaccggccagc

SEQ ID NO: 3531708 - RNA, 16 nt, Pseudomonas putida KT2440
cgguaccguucgccag

SEQ ID NO: 3531709 - RNA, 18 nt, Pseudomonas putida KT2440
cgguaccguucgccagcu

SEQ ID NO: 3531710 - RNA, 20 nt, Pseudomonas putida KT2440
cgguaccuggaauaccaccu

SEQ ID NO: 3531711 - RNA, 13 nt, Pseudomonas putida KT2440
cgguagagcaaau

SEQ ID NO: 3531712 - RNA, 17 nt, Pseudomonas putida KT2440
cgguagccucgacccgc

SEQ ID NO: 3531713 - RNA, 21 nt, Pseudomonas putida KT2440
cgguagccugguuuucgcucg

SEQ ID NO: 3531714 - RNA, 16 nt, Pseudomonas putida KT2440
cgguagcgcgccugcu

SEQ ID NO: 3531715 - RNA, 14 nt, Pseudomonas putida KT2440
cgguagcggcagca

SEQ ID NO: 3531716 - RNA, 18 nt, Pseudomonas putida KT2440
cgguagcggcugggcgcg

SEQ ID NO: 3531717 - RNA, 20 nt, Pseudomonas putida KT2440
cgguagggaucaccgccagc

SEQ ID NO: 3531718 - RNA, 22 nt, Pseudomonas putida KT2440
cgguagggaucaccgccagcag

SEQ ID NO: 3531719 - RNA, 18 nt, Pseudomonas putida KT2440
cgguagugaugcaucagc

SEQ ID NO: 3531720 - RNA, 18 nt, Pseudomonas putida KT2440
cgguagugcggccggguc

SEQ ID NO: 3531721 - RNA, 22 nt, Pseudomonas putida KT2440
cgguauauaucucgggcuucca

SEQ ID NO: 3531722 - RNA, 16 nt, Pseudomonas putida KT2440
cgguaucggccagccg

SEQ ID NO: 3531723 - RNA, 17 nt, Pseudomonas putida KT2440
cgguaucggccagccgu

SEQ ID NO: 3531724 - RNA, 19 nt, Pseudomonas putida KT2440
cgguaugcccaugcucugc

SEQ ID NO: 3531725 - RNA, 20 nt, Pseudomonas putida KT2440
cgguauucgagaaugugcuu

SEQ ID NO: 3531726 - RNA, 21 nt, Pseudomonas putida KT2440
cgguauucgagaaugugcuuc

SEQ ID NO: 3531727 - RNA, 21 nt, Pseudomonas putida KT2440
cggucaaggugguuucgccgu

SEQ ID NO: 3531728 - RNA, 22 nt, Pseudomonas putida KT2440
cggucaauuggagcggccuugu

SEQ ID NO: 3531729 - RNA, 16 nt, Pseudomonas putida KT2440
cggucaccucgcaacc

SEQ ID NO: 3531730 - RNA, 20 nt, Pseudomonas putida KT2440
cggucacgauccccaccagc

SEQ ID NO: 3531731 - RNA, 22 nt, Pseudomonas putida KT2440
cggucacgauccccaccagcau

SEQ ID NO: 3531732 - RNA, 16 nt, Pseudomonas putida KT2440
cggucacugagccagg

SEQ ID NO: 3531733 - RNA, 17 nt, Pseudomonas putida KT2440
cggucacugagccaggc

SEQ ID NO: 3531734 - RNA, 14 nt, Pseudomonas putida KT2440
cggucagcaccgug

SEQ ID NO: 3531735 - RNA, 22 nt, Pseudomonas putida KT2440
cggucagcaucuucuuccccgu

SEQ ID NO: 3531736 - RNA, 14 nt, Pseudomonas putida KT2440
cggucagcgcugcg

SEQ ID NO: 3531737 - RNA, 17 nt, Pseudomonas putida KT2440
cggucagcggcaguugc

SEQ ID NO: 3531738 - RNA, 16 nt, Pseudomonas putida KT2440
cggucaggcgcagcgu

SEQ ID NO: 3531739 - RNA, 14 nt, Pseudomonas putida KT2440
cggucagguacucg

SEQ ID NO: 3531740 - RNA, 12 nt, Pseudomonas putida KT2440
cggucagguagc

SEQ ID NO: 3531741 - RNA, 18 nt, Pseudomonas putida KT2440
cggucaguaccuggccgc

SEQ ID NO: 3531742 - RNA, 14 nt, Pseudomonas putida KT2440
cggucauacagccc

SEQ ID NO: 3531743 - RNA, 15 nt, Pseudomonas putida KT2440
cggucauacauccag

SEQ ID NO: 3531744 - RNA, 16 nt, Pseudomonas putida KT2440
cggccacccuccgggu

SEQ ID NO: 3531745 - RNA, 15 nt, Pseudomonas putida KT2440
cggccaccgaccaug

SEQ ID NO: 3531746 - RNA, 13 nt, Pseudomonas putida KT2440
cggccaccgccgg

SEQ ID NO: 3531747 - RNA, 17 nt, Pseudomonas putida KT2440
cggccaccgccgggugg

SEQ ID NO: 3531748 - RNA, 13 nt, Pseudomonas putida KT2440
cggccaccgccuc

SEQ ID NO: 3531749 - RNA, 20 nt, Pseudomonas putida KT2440
cggccaccggccacgcgcag

SEQ ID NO: 3531750 - RNA, 19 nt, Pseudomonas putida KT2440
cggccaccugccccagcgu

SEQ ID NO: 3531751 - RNA, 14 nt, Pseudomonas putida KT2440
cggccaccuggccu

SEQ ID NO: 3531752 - RNA, 20 nt, Pseudomonas putida KT2440
cggccaccuggccuuccagc

SEQ ID NO: 3531753 - RNA, 15 nt, Pseudomonas putida KT2440
cggccaccuggucga

SEQ ID NO: 3531754 - RNA, 15 nt, Pseudomonas putida KT2440
cggccacgaaggccg

SEQ ID NO: 3531755 - RNA, 17 nt, Pseudomonas putida KT2440
cggccacgaaggccggu

SEQ ID NO: 3531756 - RNA, 12 nt, Pseudomonas putida KT2440
cggccacgcccu

SEQ ID NO: 3531757 - RNA, 14 nt, Pseudomonas putida KT2440
cggccacgcgcgcc

SEQ ID NO: 3531758 - RNA, 15 nt, Pseudomonas putida KT2440
cggccacgucggugg

SEQ ID NO: 3531759 - RNA, 18 nt, Pseudomonas putida KT2440
cggccagaccuugcgcac

SEQ ID NO: 3531760 - RNA, 19 nt, Pseudomonas putida KT2440
cggccagaccuugcgcacg

SEQ ID NO: 3531761 - RNA, 19 nt, Pseudomonas putida KT2440
cggccagaucggccagcuu

SEQ ID NO: 3531762 - RNA, 22 nt, Pseudomonas putida KT2440
cggccagcaccgaaccggcgau

SEQ ID NO: 3531763 - RNA, 21 nt, Pseudomonas putida KT2440
cggccagcacuacgccggcca

SEQ ID NO: 3531764 - RNA, 22 nt, Pseudomonas putida KT2440
cggccagcacuacgccggccaa

SEQ ID NO: 3531765 - RNA, 12 nt, Pseudomonas putida KT2440
cggccagcagga

SEQ ID NO: 3531766 - RNA, 12 nt, Pseudomonas putida KT2440
cggccagcaggc

SEQ ID NO: 3531767 - RNA, 20 nt, Pseudomonas putida KT2440
cggccagcaggccauacagg

SEQ ID NO: 3531768 - RNA, 15 nt, Pseudomonas putida KT2440
cggccagcaggucag

SEQ ID NO: 3531769 - RNA, 23 nt, Pseudomonas putida KT2440
cggccagcagguugaacagguug

SEQ ID NO: 3531770 - RNA, 17 nt, Pseudomonas putida KT2440
cggccagccaacggcau

SEQ ID NO: 3531771 - RNA, 15 nt, Pseudomonas putida KT2440
cggccagcccgccac

SEQ ID NO: 3531772 - RNA, 14 nt, Pseudomonas putida KT2440
cggccagccgccgc

SEQ ID NO: 3531773 - RNA, 16 nt, Pseudomonas putida KT2440
cggccagcgacccuga

SEQ ID NO: 3531774 - RNA, 13 nt, Pseudomonas putida KT2440
cggccagcgccug

SEQ ID NO: 3531775 - RNA, 14 nt, Pseudomonas putida KT2440
cggccagcgccugc

SEQ ID NO: 3531776 - RNA, 13 nt, Pseudomonas putida KT2440
cggccagcggcac

SEQ ID NO: 3531777 - RNA, 15 nt, Pseudomonas putida KT2440
cggccagcucggccg

SEQ ID NO: 3531778 - RNA, 13 nt, Pseudomonas putida KT2440
cggccagcugcgc

SEQ ID NO: 3531779 - RNA, 14 nt, Pseudomonas putida KT2440
cggccagcugcgca

SEQ ID NO: 3531780 - RNA, 21 nt, Pseudomonas putida KT2440
cggccagcugcgcaccggcuu

SEQ ID NO: 3531781 - RNA, 16 nt, Pseudomonas putida KT2440
cggccagcugcugcgg

SEQ ID NO: 3531782 - RNA, 17 nt, Pseudomonas putida KT2440
cggccagcugcugcggc

SEQ ID NO: 3531783 - RNA, 20 nt, Pseudomonas putida KT2440
cggccagcugcugcggcacc

SEQ ID NO: 3531784 - RNA, 15 nt, Pseudomonas putida KT2440
cggccaggccggcgc

SEQ ID NO: 3531785 - RNA, 22 nt, Pseudomonas putida KT2440
cggccaggccggcgcagauggu

SEQ ID NO: 3531786 - RNA, 21 nt, Pseudomonas putida KT2440
cggccaggccgugcuugaggc

SEQ ID NO: 3531787 - RNA, 21 nt, Pseudomonas putida KT2440
cggccaggcucgacggcgcaa

SEQ ID NO: 3531788 - RNA, 13 nt, Pseudomonas putida KT2440
cggccagggcauc

SEQ ID NO: 3531789 - RNA, 18 nt, Pseudomonas putida KT2440
cggccagggcccgccgcg

SEQ ID NO: 3531790 - RNA, 12 nt, Pseudomonas putida KT2440
cggccaggucac

SEQ ID NO: 3531791 - RNA, 22 nt, Pseudomonas putida KT2440
cggccaguaaggaucgcgcagc

SEQ ID NO: 3531792 - RNA, 21 nt, Pseudomonas putida KT2440
cggccaguaccaggucgccag

SEQ ID NO: 3531793 - RNA, 23 nt, Pseudomonas putida KT2440
cggccaguaccaggucgccagca

SEQ ID NO: 3531794 - RNA, 17 nt, Pseudomonas putida KT2440
cggccaguaccuuggcg

SEQ ID NO: 3531795 - RNA, 18 nt, Pseudomonas putida KT2440
cggccagugaagcucgau

SEQ ID NO: 3531796 - RNA, 14 nt, Pseudomonas putida KT2440
cggccagugcgccc

SEQ ID NO: 3531797 - RNA, 16 nt, Pseudomonas putida KT2440
cggccaguggccuugg

SEQ ID NO: 3531798 - RNA, 21 nt, Pseudomonas putida KT2440
cggccaguugccccaggccca

SEQ ID NO: 3531799 - RNA, 15 nt, Pseudomonas putida KT2440
cggccaguuguccgg

SEQ ID NO: 3531800 - RNA, 22 nt, Pseudomonas putida KT2440
cggccaguuucagcgccuucuu

SEQ ID NO: 3531801 - RNA, 21 nt, Pseudomonas putida KT2440
cggccauaccgguagccucga

SEQ ID NO: 3531802 - RNA, 14 nt, Pseudomonas putida KT2440
cggccauccugcug

SEQ ID NO: 3531803 - RNA, 23 nt, Pseudomonas putida KT2440
cggccauccugcuguagcgccca

SEQ ID NO: 3531804 - RNA, 21 nt, Pseudomonas putida KT2440
cggccaucgacgugcuuggca

SEQ ID NO: 3531805 - RNA, 15 nt, Pseudomonas putida KT2440
cggccauggguguca

SEQ ID NO: 3531806 - RNA, 16 nt, Pseudomonas putida KT2440
cggcccaaucgccaca

SEQ ID NO: 3531807 - RNA, 21 nt, Pseudomonas putida KT2440
cggcccacggcgucuggucgc

SEQ ID NO: 3531808 - RNA, 16 nt, Pseudomonas putida KT2440
cggcgcugggcuuacg

SEQ ID NO: 3531809 - RNA, 18 nt, Pseudomonas putida KT2440
cggcgcugucggucagca

SEQ ID NO: 3531810 - RNA, 20 nt, Pseudomonas putida KT2440
cggcgcuugaucugccaggc

SEQ ID NO: 3531811 - RNA, 23 nt, Pseudomonas putida KT2440
cggcgcuugaucugccaggcacc

SEQ ID NO: 3531812 - RNA, 13 nt, Pseudomonas putida KT2440
cggcgcuuggccg

SEQ ID NO: 3531813 - RNA, 14 nt, Pseudomonas putida KT2440
cggcgcuuggccgg

SEQ ID NO: 3531814 - RNA, 21 nt, Pseudomonas putida KT2440
cggcgcuuuucuucgcugcug

SEQ ID NO: 3531815 - RNA, 23 nt, Pseudomonas putida KT2440
cggcggauagccccgcccagcag

SEQ ID NO: 3531816 - RNA, 18 nt, Pseudomonas putida KT2440
cggcggauguuggccacg

SEQ ID NO: 3531817 - RNA, 14 nt, Pseudomonas putida KT2440
cggcggcaacggug

SEQ ID NO: 3531818 - RNA, 15 nt, Pseudomonas putida KT2440
cggcggcaacggugg

SEQ ID NO: 3531819 - RNA, 18 nt, Pseudomonas putida KT2440
cggcggcacugaugccca

SEQ ID NO: 3531820 - RNA, 18 nt, Pseudomonas putida KT2440
cggcggcauccaggcggg

SEQ ID NO: 3531821 - RNA, 12 nt, Pseudomonas putida KT2440
cggcggccagca

SEQ ID NO: 3531822 - RNA, 13 nt, Pseudomonas putida KT2440
cggcggccccggc

SEQ ID NO: 3531823 - RNA, 14 nt, Pseudomonas putida KT2440
cggcggccccggcg

SEQ ID NO: 3531824 - RNA, 18 nt, Pseudomonas putida KT2440
cggcggccccggcgccgc

SEQ ID NO: 3531825 - RNA, 14 nt, Pseudomonas putida KT2440
cggcggccgagggu

SEQ ID NO: 3531826 - RNA, 14 nt, Pseudomonas putida KT2440
cggcggccucgguc

SEQ ID NO: 3531827 - RNA, 15 nt, Pseudomonas putida KT2440
cggcggccugcugcc

SEQ ID NO: 3531828 - RNA, 16 nt, Pseudomonas putida KT2440
cggcggccugcugccg

SEQ ID NO: 3531829 - RNA, 22 nt, Pseudomonas putida KT2440
cggcggcgaacaucugcucggg

SEQ ID NO: 3531830 - RNA, 14 nt, Pseudomonas putida KT2440
cggcggcgaucagc

SEQ ID NO: 3531831 - RNA, 19 nt, Pseudomonas putida KT2440
cggcggcuaagcgccagca

SEQ ID NO: 3531832 - RNA, 18 nt, Pseudomonas putida KT2440
cggcggcuuccagggcug

SEQ ID NO: 3531833 - RNA, 21 nt, Pseudomonas putida KT2440
cggcggcuuccagggcugguu

SEQ ID NO: 3531834 - RNA, 20 nt, Pseudomonas putida KT2440
cggcggcuuucagcgccgcu

SEQ ID NO: 3531835 - RNA, 18 nt, Pseudomonas putida KT2440
cggcggggcccggacagg

SEQ ID NO: 3531836 - RNA, 22 nt, Pseudomonas putida KT2440
cggcggguggagauuggucggc

SEQ ID NO: 3531837 - RNA, 23 nt, Pseudomonas putida KT2440
cggcggguggagauuggucggca

SEQ ID NO: 3531838 - RNA, 15 nt, Pseudomonas putida KT2440
cggcggugacacugc

SEQ ID NO: 3531839 - RNA, 16 nt, Pseudomonas putida KT2440
cggcggugacacugcc

SEQ ID NO: 3531840 - RNA, 24 nt, Pseudomonas putida KT2440
cggcgguuaagaaggcgaauagca

SEQ ID NO: 3531841 - RNA, 16 nt, Pseudomonas putida KT2440
cggcgguucugcgcac

SEQ ID NO: 3531842 - RNA, 17 nt, Pseudomonas putida KT2440
cggcgguucugcgcacg

SEQ ID NO: 3531843 - RNA, 20 nt, Pseudomonas putida KT2440
cggcgguucugcgcacgacc

SEQ ID NO: 3531844 - RNA, 21 nt, Pseudomonas putida KT2440
cggcgguucugcgcacgacca

SEQ ID NO: 3531845 - RNA, 20 nt, Pseudomonas putida KT2440
cggcgguucuucaacuccug

SEQ ID NO: 3531846 - RNA, 18 nt, Pseudomonas putida KT2440
cggcgguugucgucgacc

SEQ ID NO: 3531847 - RNA, 19 nt, Pseudomonas putida KT2440
cggcgguugucgucgaccg

SEQ ID NO: 3531848 - RNA, 21 nt, Pseudomonas putida KT2440
cggcguacucucgucgaggcu

SEQ ID NO: 3531849 - RNA, 15 nt, Pseudomonas putida KT2440
cggcguacugcacgc

SEQ ID NO: 3531850 - RNA, 19 nt, Pseudomonas putida KT2440
cggcguagaccagugcaac

SEQ ID NO: 3531851 - RNA, 22 nt, Pseudomonas putida KT2440
cggcguauacccggucagggug

SEQ ID NO: 3531852 - RNA, 21 nt, Pseudomonas putida KT2440
cggcguauggcuucacggcca

SEQ ID NO: 3531853 - RNA, 22 nt, Pseudomonas putida KT2440
cggcgucaacgguaacguuggc

SEQ ID NO: 3531854 - RNA, 16 nt, Pseudomonas putida KT2440
cggcgucaccuuccug

SEQ ID NO: 3531855 - RNA, 21 nt, Pseudomonas putida KT2440
cggcgucaccuuccugggcuu

SEQ ID NO: 3531856 - RNA, 14 nt, Pseudomonas putida KT2440
cggcgucagccgcg

SEQ ID NO: 3531857 - RNA, 17 nt, Pseudomonas putida KT2440
cggcgucaguucgacgc

SEQ ID NO: 3531858 - RNA, 14 nt, Pseudomonas putida KT2440
cggcguccaggccc

SEQ ID NO: 3531859 - RNA, 21 nt, Pseudomonas putida KT2440
cggcgucgaacaacggcagcg

SEQ ID NO: 3531860 - RNA, 13 nt, Pseudomonas putida KT2440
cggcgucgagcag

SEQ ID NO: 3531861 - RNA, 21 nt, Pseudomonas putida KT2440
cggcgucgaucugcagguggu

SEQ ID NO: 3531862 - RNA, 22 nt, Pseudomonas putida KT2440
cggcgucuggucgcuuuccaga

SEQ ID NO: 3531863 - RNA, 19 nt, Pseudomonas putida KT2440
cggcgugagcaucggcguu

SEQ ID NO: 3531864 - RNA, 13 nt, Pseudomonas putida KT2440
cggcgugcuccac

SEQ ID NO: 3531865 - RNA, 14 nt, Pseudomonas putida KT2440
cggcgugcuccaca

SEQ ID NO: 3531866 - RNA, 14 nt, Pseudomonas putida KT2440
cggcgugguccagc

SEQ ID NO: 3531867 - RNA, 16 nt, Pseudomonas putida KT2440
cggcgugguccagcgu

SEQ ID NO: 3531868 - RNA, 14 nt, Pseudomonas putida KT2440
cggcguguccagca

SEQ ID NO: 3531869 - RNA, 15 nt, Pseudomonas putida KT2440
cggcguucaggcgcg

SEQ ID NO: 3531870 - RNA, 14 nt, Pseudomonas putida KT2440
cggcguugauccgg

SEQ ID NO: 3531871 - RNA, 15 nt, Pseudomonas putida KT2440
cggcguuggcuucca

SEQ ID NO: 3531872 - RNA, 22 nt, Pseudomonas putida KT2440
cggcguuggcuuccacggcgcg

SEQ ID NO: 3531873 - RNA, 14 nt, Pseudomonas putida KT2440
cggcguuugcgagc

SEQ ID NO: 3531874 - RNA, 22 nt, Pseudomonas putida KT2440
cggcguuugcgagcgcgggcag

SEQ ID NO: 3531875 - RNA, 14 nt, Pseudomonas putida KT2440
cggcuaagcgccag

SEQ ID NO: 3531876 - RNA, 18 nt, Pseudomonas putida KT2440
cggcuacccagccgggca

SEQ ID NO: 3531877 - RNA, 16 nt, Pseudomonas putida KT2440
cggcuaccccgaugcg

SEQ ID NO: 3531878 - RNA, 21 nt, Pseudomonas putida KT2440
cggcuagccaucgcaccacgu

SEQ ID NO: 3531879 - RNA, 13 nt, Pseudomonas putida KT2440
cggcuagcgccug

SEQ ID NO: 3531880 - RNA, 14 nt, Pseudomonas putida KT2440
cggcuagcgccuga

SEQ ID NO: 3531881 - RNA, 16 nt, Pseudomonas putida KT2440
cggcuagcgccugaca

SEQ ID NO: 3531882 - RNA, 17 nt, Pseudomonas putida KT2440
cggcuaucucaggccag

SEQ ID NO: 3531883 - RNA, 20 nt, Pseudomonas putida KT2440
cggcucaacaccaucuucau

SEQ ID NO: 3531884 - RNA, 17 nt, Pseudomonas putida KT2440
cggcucaacagcaggug

SEQ ID NO: 3531885 - RNA, 14 nt, Pseudomonas putida KT2440
cggcucacccacca

SEQ ID NO: 3531886 - RNA, 19 nt, Pseudomonas putida KT2440
cggcucacccaccagccaa

SEQ ID NO: 3531887 - RNA, 22 nt, Pseudomonas putida KT2440
cggcucacccaccagccaaacc

SEQ ID NO: 3531888 - RNA, 15 nt, Pseudomonas putida KT2440
cggcucaccgcagcc

SEQ ID NO: 3531889 - RNA, 18 nt, Pseudomonas putida KT2440
cggcucaccgcagcccag

SEQ ID NO: 3531890 - RNA, 19 nt, Pseudomonas putida KT2440
cggcucaccgcagcccagc

SEQ ID NO: 3531891 - RNA, 20 nt, Pseudomonas putida KT2440
cggcucaccgcagcccagcg

SEQ ID NO: 3531892 - RNA, 14 nt, Pseudomonas putida KT2440
cggcucacgccccg

SEQ ID NO: 3531893 - RNA, 15 nt, Pseudomonas putida KT2440
cggcucacugcucau

SEQ ID NO: 3531894 - RNA, 15 nt, Pseudomonas putida KT2440
cggcuccagcgcacg

SEQ ID NO: 3531895 - RNA, 22 nt, Pseudomonas putida KT2440
cggcuccaggcacaggcgcaca

SEQ ID NO: 3531896 - RNA, 22 nt, Pseudomonas putida KT2440
cggcuccaggugaaucagcggc

SEQ ID NO: 3531897 - RNA, 14 nt, Pseudomonas putida KT2440
cggcucccccucca

SEQ ID NO: 3531898 - RNA, 15 nt, Pseudomonas putida KT2440
cggcucccccuccac

SEQ ID NO: 3531899 - RNA, 18 nt, Pseudomonas putida KT2440
cggcucccccuccacccg

SEQ ID NO: 3531900 - RNA, 18 nt, Pseudomonas putida KT2440
cggcuccggcguguccag

SEQ ID NO: 3531901 - RNA, 16 nt, Pseudomonas putida KT2440
cggcuccuugaugcug

SEQ ID NO: 3531902 - RNA, 20 nt, Pseudomonas putida KT2440
cggcucgcaugagccggggc

SEQ ID NO: 3531903 - RNA, 22 nt, Pseudomonas putida KT2440
cggcucgccauugaugcucagg

SEQ ID NO: 3531904 - RNA, 17 nt, Pseudomonas putida KT2440
cggcucgcugaacacgc

SEQ ID NO: 3531905 - RNA, 13 nt, Pseudomonas putida KT2440
cggcucggccacc

SEQ ID NO: 3531906 - RNA, 14 nt, Pseudomonas putida KT2440
cggcucggccacca

SEQ ID NO: 3531907 - RNA, 19 nt, Pseudomonas putida KT2440
cggcucggccaccacccgc

SEQ ID NO: 3531908 - RNA, 18 nt, Pseudomonas putida KT2440
cggcucgucacugccguc

SEQ ID NO: 3531909 - RNA, 20 nt, Pseudomonas putida KT2440
cggcucuaucuucaggcauc

SEQ ID NO: 3531910 - RNA, 17 nt, Pseudomonas putida KT2440
cggcucugacauaacaa

SEQ ID NO: 3531911 - RNA, 20 nt, Pseudomonas putida KT2440
cggcucugacauaacaagaa

SEQ ID NO: 3531912 - RNA, 14 nt, Pseudomonas putida KT2440
cggcucugccggug

SEQ ID NO: 3531913 - RNA, 19 nt, Pseudomonas putida KT2440
cggcucugccgguguucgc

SEQ ID NO: 3531914 - RNA, 18 nt, Pseudomonas putida KT2440
cggcucuucuuucaggua

SEQ ID NO: 3531915 - RNA, 13 nt, Pseudomonas putida KT2440
cggcugaaaccgc

SEQ ID NO: 3531916 - RNA, 18 nt, Pseudomonas putida KT2440
cggcugaaaccgcgaauc

SEQ ID NO: 3531917 - RNA, 19 nt, Pseudomonas putida KT2440
cggcugaaaccgcgaaucg

SEQ ID NO: 3531918 - RNA, 23 nt, Pseudomonas putida KT2440
cggcugaacacgcucaugaacag

SEQ ID NO: 3531919 - RNA, 16 nt, Pseudomonas putida KT2440
cggcugaacuuccagg

SEQ ID NO: 3531920 - RNA, 19 nt, Pseudomonas putida KT2440
cggcugaacuuccaggucg

SEQ ID NO: 3531921 - RNA, 15 nt, Pseudomonas putida KT2440
cggcugaagaagcua

SEQ ID NO: 3531922 - RNA, 18 nt, Pseudomonas putida KT2440
cggcugaccaccucggcc

SEQ ID NO: 3531923 - RNA, 19 nt, Pseudomonas putida KT2440
cggcugaccuguucgcgca

SEQ ID NO: 3531924 - RNA, 12 nt, Pseudomonas putida KT2440
cggcugagccgg

SEQ ID NO: 3531925 - RNA, 16 nt, Pseudomonas putida KT2440
cggcugagccggcugg

SEQ ID NO: 3531926 - RNA, 19 nt, Pseudomonas putida KT2440
cggcugagccggcuggcgu

SEQ ID NO: 3531927 - RNA, 21 nt, Pseudomonas putida KT2440
cggcugccuacccaggcaacg

SEQ ID NO: 3531928 - RNA, 20 nt, Pseudomonas putida KT2440
cggcugcucgaucagguuga

SEQ ID NO: 3531929 - RNA, 14 nt, Pseudomonas putida KT2440
cggcugcugguucu

SEQ ID NO: 3531930 - RNA, 12 nt, Pseudomonas putida KT2440
cggcuggcacuc

SEQ ID NO: 3531931 - RNA, 21 nt, Pseudomonas putida KT2440
cggcuggccacguaggcacuc

SEQ ID NO: 3531932 - RNA, 14 nt, Pseudomonas putida KT2440
cggcuggcgcaugc

SEQ ID NO: 3531933 - RNA, 15 nt, Pseudomonas putida KT2440
cggcuggcgcaugca

SEQ ID NO: 3531934 - RNA, 12 nt, Pseudomonas putida KT2440
cggcuggcuucg

SEQ ID NO: 3531935 - RNA, 15 nt, Pseudomonas putida KT2440
cggcugggugccauc

SEQ ID NO: 3531936 - RNA, 18 nt, Pseudomonas putida KT2440
cggcuggugucggccagg

SEQ ID NO: 3531937 - RNA, 19 nt, Pseudomonas putida KT2440
cggcugucaguggucuuca

SEQ ID NO: 3531938 - RNA, 17 nt, Pseudomonas putida KT2440
cggcuguccagcaaggg

SEQ ID NO: 3531939 - RNA, 15 nt, Pseudomonas putida KT2440
cggcuguuccucgcc

SEQ ID NO: 3531940 - RNA, 14 nt, Pseudomonas putida KT2440
cggcuguucgcagc

SEQ ID NO: 3531941 - RNA, 14 nt, Pseudomonas putida KT2440
cggcuucaagagga

SEQ ID NO: 3531942 - RNA, 20 nt, Pseudomonas putida KT2440
cggcuucagguucacuucca

SEQ ID NO: 3531943 - RNA, 19 nt, Pseudomonas putida KT2440
cggcuuccagcgauggcgg

SEQ ID NO: 3531944 - RNA, 14 nt, Pseudomonas putida KT2440
cggcuuccagggcu

SEQ ID NO: 3531945 - RNA, 21 nt, Pseudomonas putida KT2440
cggcuucgacgcuuuccuggu

SEQ ID NO: 3531946 - RNA, 17 nt, Pseudomonas putida KT2440
cggcuucgaugcccggc

SEQ ID NO: 3531947 - RNA, 19 nt, Pseudomonas putida KT2440
cggcuucgccgguguucgc

SEQ ID NO: 3531948 - RNA, 21 nt, Pseudomonas putida KT2440
cggcuucgccgguguucgcgg

SEQ ID NO: 3531949 - RNA, 17 nt, Pseudomonas putida KT2440
cggcuucuaccacuggg

SEQ ID NO: 3531950 - RNA, 19 nt, Pseudomonas putida KT2440
cggcuugaaaucauccaug

SEQ ID NO: 3531951 - RNA, 23 nt, Pseudomonas putida KT2440
cggcuugauauccagcaccggcg

SEQ ID NO: 3531952 - RNA, 13 nt, Pseudomonas putida KT2440
cggcuugcccggg

SEQ ID NO: 3531953 - RNA, 16 nt, Pseudomonas putida KT2440
cggcuugcccgggcgc

SEQ ID NO: 3531954 - RNA, 16 nt, Pseudomonas putida KT2440
cggcuugccggcaaua

SEQ ID NO: 3531955 - RNA, 23 nt, Pseudomonas putida KT2440
cggcuugccggcaauaccggcca

SEQ ID NO: 3531956 - RNA, 13 nt, Pseudomonas putida KT2440
cggcuugcgcccg

SEQ ID NO: 3531957 - RNA, 22 nt, Pseudomonas putida KT2440
cggcuugcgcccguaacgguca

SEQ ID NO: 3531958 - RNA, 12 nt, Pseudomonas putida KT2440
cggcuugcgccg

SEQ ID NO: 3531959 - RNA, 20 nt, Pseudomonas putida KT2440
cggcuugcuccaagugccgu

SEQ ID NO: 3531960 - RNA, 18 nt, Pseudomonas putida KT2440
cggcuugcucgcggcgca

SEQ ID NO: 3531961 - RNA, 20 nt, Pseudomonas putida KT2440
cggcuuggcacgaaacgcca

SEQ ID NO: 3531962 - RNA, 14 nt, Pseudomonas putida KT2440
cggcuuggcugccg

SEQ ID NO: 3531963 - RNA, 18 nt, Pseudomonas putida KT2440
cggcuuggcugccggccu

SEQ ID NO: 3531964 - RNA, 21 nt, Pseudomonas putida KT2440
cggcuuguucuguuucaccag

SEQ ID NO: 3531965 - RNA, 17 nt, Pseudomonas putida KT2440
cggcuuucucaagccug

SEQ ID NO: 3531966 - RNA, 19 nt, Pseudomonas putida KT2440
cggcuuuuuuguuuggcuu

SEQ ID NO: 3531967 - RNA, 16 nt, Pseudomonas putida KT2440
cgggaaaagccugcca

SEQ ID NO: 3531968 - RNA, 17 nt, Pseudomonas putida KT2440
cgggaaaagccugccag

SEQ ID NO: 3531969 - RNA, 23 nt, Pseudomonas putida KT2440
cgggaaaagccugccagguccga

SEQ ID NO: 3531970 - RNA, 13 nt, Pseudomonas putida KT2440
cgggaacacccag

SEQ ID NO: 3531971 - RNA, 16 nt, Pseudomonas putida KT2440
cgggaacagcagcacc

SEQ ID NO: 3531972 - RNA, 17 nt, Pseudomonas putida KT2440
cgggaacagcagcaccg

SEQ ID NO: 3531973 - RNA, 18 nt, Pseudomonas putida KT2440
cgggaacagccgcgcaug

SEQ ID NO: 3531974 - RNA, 16 nt, Pseudomonas putida KT2440
cgggaagcgcccgccc

SEQ ID NO: 3531975 - RNA, 23 nt, Pseudomonas putida KT2440
cgggaagcgcccgcccaccacca

SEQ ID NO: 3531976 - RNA, 14 nt, Pseudomonas putida KT2440
cgggaaggucggcc

SEQ ID NO: 3531977 - RNA, 17 nt, Pseudomonas putida KT2440
cgggaaguccgccagga

SEQ ID NO: 3531978 - RNA, 18 nt, Pseudomonas putida KT2440
cgggaaguuacgggucga

SEQ ID NO: 3531979 - RNA, 15 nt, Pseudomonas putida KT2440
cgggaauugcagccc

SEQ ID NO: 3531980 - RNA, 16 nt, Pseudomonas putida KT2440
cgggacagcaccaugc

SEQ ID NO: 3531981 - RNA, 17 nt, Pseudomonas putida KT2440
cgggaccagcaccaccu

SEQ ID NO: 3531982 - RNA, 15 nt, Pseudomonas putida KT2440
cgggagucgaaccug

SEQ ID NO: 3531983 - RNA, 20 nt, Pseudomonas putida KT2440
cgggauaaccgcagauggcc

SEQ ID NO: 3531984 - RNA, 21 nt, Pseudomonas putida KT2440
cgggauaaccgcagauggccg

SEQ ID NO: 3531985 - RNA, 22 nt, Pseudomonas putida KT2440
cgggauaaccgcagauggccgc

SEQ ID NO: 3531986 - RNA, 19 nt, Pseudomonas putida KT2440
cgggauaccggugucuucc

SEQ ID NO: 3531987 - RNA, 21 nt, Pseudomonas putida KT2440
cgggauacugcgcacgaauac

SEQ ID NO: 3531988 - RNA, 12 nt, Pseudomonas putida KT2440
cgggaucagcac

SEQ ID NO: 3531989 - RNA, 16 nt, Pseudomonas putida KT2440
cgggaucagcacgccc

SEQ ID NO: 3531990 - RNA, 23 nt, Pseudomonas putida KT2440
cgggaucagcacgcccaucagcg

SEQ ID NO: 3531991 - RNA, 20 nt, Pseudomonas putida KT2440
cgggaugcucugcagcagcg

SEQ ID NO: 3531992 - RNA, 13 nt, Pseudomonas putida KT2440
cgggauguucagg

SEQ ID NO: 3531993 - RNA, 16 nt, Pseudomonas putida KT2440
cgggauugccgucaaa

SEQ ID NO: 3531994 - RNA, 16 nt, Pseudomonas putida KT2440
cgggcaaacaggcuga

SEQ ID NO: 3531995 - RNA, 21 nt, Pseudomonas putida KT2440
cgggcaaacaggcugauguug

SEQ ID NO: 3531996 - RNA, 14 nt, Pseudomonas putida KT2440
cgggcaaacccgcg

SEQ ID NO: 3531997 - RNA, 16 nt, Pseudomonas putida KT2440
cgggcaaacuggcgcc

SEQ ID NO: 3531998 - RNA, 22 nt, Pseudomonas putida KT2440
cgggcaaacuggcgcccggcau

SEQ ID NO: 3531999 - RNA, 13 nt, Pseudomonas putida KT2440
cgggcaaagcacc

SEQ ID NO: 3532000 - RNA, 13 nt, Pseudomonas putida KT2440
cgggcaaagccca

SEQ ID NO: 3532001 - RNA, 13 nt, Pseudomonas putida KT2440
cgggcaaccgcau

SEQ ID NO: 3532002 - RNA, 20 nt, Pseudomonas putida KT2440
cgggcaaccgcauccccggc

SEQ ID NO: 3532003 - RNA, 17 nt, Pseudomonas putida KT2440
cgggcaacugcgccugg

SEQ ID NO: 3532004 - RNA, 13 nt, Pseudomonas putida KT2440
cgggcaagcccgc

SEQ ID NO: 3532005 - RNA, 20 nt, Pseudomonas putida KT2440
cgggcaagcccgcucccaca

SEQ ID NO: 3532006 - RNA, 20 nt, Pseudomonas putida KT2440
cgggcaagcccgcuccuacg

SEQ ID NO: 3532007 - RNA, 21 nt, Pseudomonas putida KT2440
cgggcaagccgucucugaccg

SEQ ID NO: 3532008 - RNA, 17 nt, Pseudomonas putida KT2440
cgggcaaggccagugcc

SEQ ID NO: 3532009 - RNA, 13 nt, Pseudomonas putida KT2440
cgggcaauggcca

SEQ ID NO: 3532010 - RNA, 16 nt, Pseudomonas putida KT2440
cgggcaauguccaggu

SEQ ID NO: 3532011 - RNA, 16 nt, Pseudomonas putida KT2440
cgggcacaccuggugc

SEQ ID NO: 3532012 - RNA, 18 nt, Pseudomonas putida KT2440
cgggcacaccuggugcgc

SEQ ID NO: 3532013 - RNA, 17 nt, Pseudomonas putida KT2440
cgggcacaggcccagca

SEQ ID NO: 3532014 - RNA, 18 nt, Pseudomonas putida KT2440
cgggcacaggcccagcau

SEQ ID NO: 3532015 - RNA, 20 nt, Pseudomonas putida KT2440
cggcaaaggccucuucaggc

SEQ ID NO: 3532016 - RNA, 16 nt, Pseudomonas putida KT2440
cggcaaagguggcacc

SEQ ID NO: 3532017 - RNA, 13 nt, Pseudomonas putida KT2440
cggcaacaccagc

SEQ ID NO: 3532018 - RNA, 14 nt, Pseudomonas putida KT2440
cggcaacaccagca

SEQ ID NO: 3532019 - RNA, 17 nt, Pseudomonas putida KT2440
cggcaacaccagcagcc

SEQ ID NO: 3532020 - RNA, 18 nt, Pseudomonas putida KT2440
cggcaacauucaccagcc

SEQ ID NO: 3532021 - RNA, 20 nt, Pseudomonas putida KT2440
cggcaacauucaccagccag

SEQ ID NO: 3532022 - RNA, 21 nt, Pseudomonas putida KT2440
cggcaacauucaccagccagg

SEQ ID NO: 3532023 - RNA, 15 nt, Pseudomonas putida KT2440
cggcaaccaccaaca

SEQ ID NO: 3532024 - RNA, 15 nt, Pseudomonas putida KT2440
cggcaaccauggcuu

SEQ ID NO: 3532025 - RNA, 13 nt, Pseudomonas putida KT2440
cggcaacccggca

SEQ ID NO: 3532026 - RNA, 14 nt, Pseudomonas putida KT2440
cggcaacccggcag

SEQ ID NO: 3532027 - RNA, 18 nt, Pseudomonas putida KT2440
cggcaacccggcagucag

SEQ ID NO: 3532028 - RNA, 23 nt, Pseudomonas putida KT2440
cggcaacccggcagucagggucu

SEQ ID NO: 3532029 - RNA, 20 nt, Pseudomonas putida KT2440
cggcaacccuucggccagca

SEQ ID NO: 3532030 - RNA, 22 nt, Pseudomonas putida KT2440
cggcaacccuucggccagcagu

SEQ ID NO: 3532031 - RNA, 14 nt, Pseudomonas putida KT2440
cggcaaccugaccc

SEQ ID NO: 3532032 - RNA, 23 nt, Pseudomonas putida KT2440
cggcaaccugacccgcgccucga

SEQ ID NO: 3532033 - RNA, 18 nt, Pseudomonas putida KT2440
cggcaaccugcucgcuca

SEQ ID NO: 3532034 - RNA, 20 nt, Pseudomonas putida KT2440
cggcaacgauacccacgccc

SEQ ID NO: 3532035 - RNA, 16 nt, Pseudomonas putida KT2440
cggcaacgauggucgc

SEQ ID NO: 3532036 - RNA, 14 nt, Pseudomonas putida KT2440
cggcaacgccagca

SEQ ID NO: 3532037 - RNA, 14 nt, Pseudomonas putida KT2440
cggcaacuccucca

SEQ ID NO: 3532038 - RNA, 16 nt, Pseudomonas putida KT2440
cggcaacuccuccagc

SEQ ID NO: 3532039 - RNA, 17 nt, Pseudomonas putida KT2440
cggcaacuccuccagcc

SEQ ID NO: 3532040 - RNA, 14 nt, Pseudomonas putida KT2440
cggcaacuggcaca

SEQ ID NO: 3532041 - RNA, 14 nt, Pseudomonas putida KT2440
cggcaacuggcauc

SEQ ID NO: 3532042 - RNA, 14 nt, Pseudomonas putida KT2440
cggcaagccaaagu

SEQ ID NO: 3532043 - RNA, 13 nt, Pseudomonas putida KT2440
cggcaagccacgc

SEQ ID NO: 3532044 - RNA, 22 nt, Pseudomonas putida KT2440
cggcaagcccauggcuggcagc

SEQ ID NO: 3532045 - RNA, 14 nt, Pseudomonas putida KT2440
cggcaagcugguca

SEQ ID NO: 3532046 - RNA, 15 nt, Pseudomonas putida KT2440
cggcaagcuggucag

SEQ ID NO: 3532047 - RNA, 18 nt, Pseudomonas putida KT2440
cggcaagcuggucaggug

SEQ ID NO: 3532048 - RNA, 16 nt, Pseudomonas putida KT2440
cggcaagcuugccagc

SEQ ID NO: 3532049 - RNA, 18 nt, Pseudomonas putida KT2440
cggcaaggcauccagaaa

SEQ ID NO: 3532050 - RNA, 19 nt, Pseudomonas putida KT2440
cggcaaggcgaccugccag

SEQ ID NO: 3532051 - RNA, 21 nt, Pseudomonas putida KT2440
cggcaaggcgaccugccagcc

SEQ ID NO: 3532052 - RNA, 21 nt, Pseudomonas putida KT2440
cggcaagggcgaaccaggugc

SEQ ID NO: 3532053 - RNA, 23 nt, Pseudomonas putida KT2440
cggcaagguagccugcugacgca

SEQ ID NO: 3532054 - RNA, 22 nt, Pseudomonas putida KT2440
cggcaaggucaacggcaacgcc

SEQ ID NO: 3532055 - RNA, 19 nt, Pseudomonas putida KT2440
cggcaauacaacgaucagc

SEQ ID NO: 3532056 - RNA, 22 nt, Pseudomonas putida KT2440
cggcaauaccgauuaucgagcu

SEQ ID NO: 3532057 - RNA, 20 nt, Pseudomonas putida KT2440
cggcaaucacgaacaccagc

SEQ ID NO: 3532058 - RNA, 15 nt, Pseudomonas putida KT2440
cggcaauccgcugga

SEQ ID NO: 3532059 - RNA, 21 nt, Pseudomonas putida KT2440
cggcaauccgcuggaauggug

SEQ ID NO: 3532060 - RNA, 15 nt, Pseudomonas putida KT2440
cggcaauccugggug

SEQ ID NO: 3532061 - RNA, 16 nt, Pseudomonas putida KT2440
cggcaauccuggguga

SEQ ID NO: 3532062 - RNA, 13 nt, Pseudomonas putida KT2440
cggcaaucgacuc

SEQ ID NO: 3532063 - RNA, 13 nt, Pseudomonas putida KT2440
cggcaaucgccag

SEQ ID NO: 3532064 - RNA, 14 nt, Pseudomonas putida KT2440
cggcaaucgccagg

SEQ ID NO: 3532065 - RNA, 15 nt, Pseudomonas putida KT2440
cggcaaucgccgggc

SEQ ID NO: 3532066 - RNA, 19 nt, Pseudomonas putida KT2440
cggcaaucgggaucaugcc

SEQ ID NO: 3532067 - RNA, 16 nt, Pseudomonas putida KT2440
cggcaaucugcagcag

SEQ ID NO: 3532068 - RNA, 18 nt, Pseudomonas putida KT2440
cggcaaucugcagcagca

SEQ ID NO: 3532069 - RNA, 16 nt, Pseudomonas putida KT2440
cggcaaucugcccaca

SEQ ID NO: 3532070 - RNA, 21 nt, Pseudomonas putida KT2440
cggcaaugaccaagcaacgca

SEQ ID NO: 3532071 - RNA, 20 nt, Pseudomonas putida KT2440
cggcaaugcgccggucgcgu

SEQ ID NO: 3532072 - RNA, 23 nt, Pseudomonas putida KT2440
cggcaaugcgcgcgaaggcccgc

SEQ ID NO: 3532073 - RNA, 18 nt, Pseudomonas putida KT2440
cggcaauggcccgcucca

SEQ ID NO: 3532074 - RNA, 12 nt, Pseudomonas putida KT2440
cggcaauggccg

SEQ ID NO: 3532075 - RNA, 13 nt, Pseudomonas putida KT2440
cggcaauggccgg

SEQ ID NO: 3532076 - RNA, 18 nt, Pseudomonas putida KT2440
cggcaauucgccggcagc

SEQ ID NO: 3532077 - RNA, 18 nt, Pseudomonas putida KT2440
cggcaauugccaccggcg

SEQ ID NO: 3532078 - RNA, 20 nt, Pseudomonas putida KT2440
cggcaauugccaccggcgcu

SEQ ID NO: 3532079 - RNA, 23 nt, Pseudomonas putida KT2440
cggcaauugccaccggcgcugcg

SEQ ID NO: 3532080 - RNA, 17 nt, Pseudomonas putida KT2440
cggcacaaccgaacccg

SEQ ID NO: 3532081 - RNA, 23 nt, Pseudomonas putida KT2440
cggcacaaccgaacccgcugcca

SEQ ID NO: 3532082 - RNA, 21 nt, Pseudomonas putida KT2440
cggcacaacgcgccaccgccg

SEQ ID NO: 3532083 - RNA, 16 nt, Pseudomonas putida KT2440
cggcacaccacgccaa

SEQ ID NO: 3532084 - RNA, 21 nt, Pseudomonas putida KT2440
cggcacaccacgccaaccuga

SEQ ID NO: 3532085 - RNA, 16 nt, Pseudomonas putida KT2440
cggcaucgccuccagc

SEQ ID NO: 3532086 - RNA, 13 nt, Pseudomonas putida KT2440
cggcaucgcugcc

SEQ ID NO: 3532087 - RNA, 15 nt, Pseudomonas putida KT2440
cggcaugcccgcccc

SEQ ID NO: 3532088 - RNA, 12 nt, Pseudomonas putida KT2440
cggcaugcgccg

SEQ ID NO: 3532089 - RNA, 14 nt, Pseudomonas putida KT2440
cggcaugcgcguau

SEQ ID NO: 3532090 - RNA, 12 nt, Pseudomonas putida KT2440
cggcauggcgug

SEQ ID NO: 3532091 - RNA, 20 nt, Pseudomonas putida KT2440
cggcauggcgugcccggcaa

SEQ ID NO: 3532092 - RNA, 14 nt, Pseudomonas putida KT2440
cggcauguagccac

SEQ ID NO: 3532093 - RNA, 21 nt, Pseudomonas putida KT2440
cggcauguagccacgcugcca

SEQ ID NO: 3532094 - RNA, 16 nt, Pseudomonas putida KT2440
cggcaugucgaugcgg

SEQ ID NO: 3532095 - RNA, 19 nt, Pseudomonas putida KT2440
cggcaugugcacuggcagg

SEQ ID NO: 3532096 - RNA, 13 nt, Pseudomonas putida KT2440
cggcauguucauc

SEQ ID NO: 3532097 - RNA, 21 nt, Pseudomonas putida KT2440
cggcauguucaucaccggcca

SEQ ID NO: 3532098 - RNA, 22 nt, Pseudomonas putida KT2440
cggcauugggcggggugaucga

SEQ ID NO: 3532099 - RNA, 20 nt, Pseudomonas putida KT2440
cggccaaagcuguugaaggc

SEQ ID NO: 3532100 - RNA, 15 nt, Pseudomonas putida KT2440
cggccaacaacgacu

SEQ ID NO: 3532101 - RNA, 17 nt, Pseudomonas putida KT2440
cggccaacauucacggc

SEQ ID NO: 3532102 - RNA, 18 nt, Pseudomonas putida KT2440
cggccaacauucacggcg

SEQ ID NO: 3532103 - RNA, 22 nt, Pseudomonas putida KT2440
cggccaacgacaggucggcgau

SEQ ID NO: 3532104 - RNA, 17 nt, Pseudomonas putida KT2440
cggccaacgcugcucgg

SEQ ID NO: 3532105 - RNA, 22 nt, Pseudomonas putida KT2440
cggccaagccgcugccacaggu

SEQ ID NO: 3532106 - RNA, 18 nt, Pseudomonas putida KT2440
cggccaaggucagcaagc

SEQ ID NO: 3532107 - RNA, 19 nt, Pseudomonas putida KT2440
cggccaaguacaaacgcca

SEQ ID NO: 3532108 - RNA, 15 nt, Pseudomonas putida KT2440
cggccaaucgaucug

SEQ ID NO: 3532109 - RNA, 22 nt, Pseudomonas putida KT2440
cggccaaucgaucugcucgccc

SEQ ID NO: 3532110 - RNA, 15 nt, Pseudomonas putida KT2440
cggccaaucgcggcc

SEQ ID NO: 3532111 - RNA, 18 nt, Pseudomonas putida KT2440
cggccaaugcacgccugu

SEQ ID NO: 3532112 - RNA, 21 nt, Pseudomonas putida KT2440
cggccacacgggcguucagcu

SEQ ID NO: 3532113 - RNA, 19 nt, Pseudomonas putida KT2440
cggccacaucggcaaguug

SEQ ID NO: 3532114 - RNA, 18 nt, Pseudomonas putida KT2440
cggccaccacacugguca

SEQ ID NO: 3532115 - RNA, 12 nt, Pseudomonas putida KT2440
cggccaccaccc

SEQ ID NO: 3532116 - RNA, 15 nt, Pseudomonas putida KT2440
cggccaccacccgcu

SEQ ID NO: 3532117 - RNA, 14 nt, Pseudomonas putida KT2440
cggccaccaccggg

SEQ ID NO: 3532118 - RNA, 19 nt, Pseudomonas putida KT2440
cggccaccacuucuggcug

SEQ ID NO: 3532119 - RNA, 13 nt, Pseudomonas putida KT2440
cggccaccagccc

SEQ ID NO: 3532120 - RNA, 19 nt, Pseudomonas putida KT2440
cggccaccauguacugcag

SEQ ID NO: 3532121 - RNA, 13 nt, Pseudomonas putida KT2440
cggccacccgcgu

SEQ ID NO: 3532122 - RNA, 21 nt, Pseudomonas putida KT2440
cggccacccggaccagcgccg

SEQ ID NO: 3532123 - RNA, 15 nt, Pseudomonas putida KT2440
cggccacccuccggg

SEQ ID NO: 3532124 - RNA, 18 nt, Pseudomonas putida KT2440
ccgggccaacuugcgcag

SEQ ID NO: 3532125 - RNA, 14 nt, Pseudomonas putida KT2440
ccgggccaggcccc

SEQ ID NO: 3532126 - RNA, 21 nt, Pseudomonas putida KT2440
ccgggccgcuugcucaggcuc

SEQ ID NO: 3532127 - RNA, 21 nt, Pseudomonas putida KT2440
ccgggccugauuggcaucgcu

SEQ ID NO: 3532128 - RNA, 21 nt, Pseudomonas putida KT2440
ccgggccuucaaccucacugg

SEQ ID NO: 3532129 - RNA, 13 nt, Pseudomonas putida KT2440
ccgggcgcaccac

SEQ ID NO: 3532130 - RNA, 16 nt, Pseudomonas putida KT2440
ccgggcgcaggcagca

SEQ ID NO: 3532131 - RNA, 17 nt, Pseudomonas putida KT2440
ccgggcgcaggcagcac

SEQ ID NO: 3532132 - RNA, 22 nt, Pseudomonas putida KT2440
ccgggcgcgguuuuuucaugcc

SEQ ID NO: 3532133 - RNA, 18 nt, Pseudomonas putida KT2440
ccgggcgggugcauggcu

SEQ ID NO: 3532134 - RNA, 22 nt, Pseudomonas putida KT2440
ccgggcgguugucgaccuggcu

SEQ ID NO: 3532135 - RNA, 15 nt, Pseudomonas putida KT2440
ccgggcugcaaagcg

SEQ ID NO: 3532136 - RNA, 13 nt, Pseudomonas putida KT2440
ccgggcugcugcg

SEQ ID NO: 3532137 - RNA, 17 nt, Pseudomonas putida KT2440
ccgggcugcugcgcagc

SEQ ID NO: 3532138 - RNA, 19 nt, Pseudomonas putida KT2440
ccgggcugcugcgcagccc

SEQ ID NO: 3532139 - RNA, 16 nt, Pseudomonas putida KT2440
ccggggaucuugcugg

SEQ ID NO: 3532140 - RNA, 17 nt, Pseudomonas putida KT2440
ccggggaucuugcuggc

SEQ ID NO: 3532141 - RNA, 14 nt, Pseudomonas putida KT2440
ccggggcaaccugg

SEQ ID NO: 3532142 - RNA, 20 nt, Pseudomonas putida KT2440
ccggggcaccuugaagugcg

SEQ ID NO: 3532143 - RNA, 20 nt, Pseudomonas putida KT2440
ccggggcagcaucaccacgc

SEQ ID NO: 3532144 - RNA, 13 nt, Pseudomonas putida KT2440
ccggggcaggcug

SEQ ID NO: 3532145 - RNA, 22 nt, Pseudomonas putida KT2440
ccggggcaggcugugcggcaac

SEQ ID NO: 3532146 - RNA, 12 nt, Pseudomonas putida KT2440
ccggggcaugcg

SEQ ID NO: 3532147 - RNA, 22 nt, Pseudomonas putida KT2440
ccggggcucacagcccgggcau

SEQ ID NO: 3532148 - RNA, 22 nt, Pseudomonas putida KT2440
ccggggcuuuuugauggugcag

SEQ ID NO: 3532149 - RNA, 21 nt, Pseudomonas putida KT2440
ccgggggugcuuaaguuucau

SEQ ID NO: 3532150 - RNA, 21 nt, Pseudomonas putida KT2440
ccggggguggcgagcagguca

SEQ ID NO: 3532151 - RNA, 15 nt, Pseudomonas putida KT2440
ccgggguaauggcgc

SEQ ID NO: 3532152 - RNA, 21 nt, Pseudomonas putida KT2440
ccggggugcagauccaggugc

SEQ ID NO: 3532153 - RNA, 19 nt, Pseudomonas putida KT2440
ccggggugucugggcacuu

SEQ ID NO: 3532154 - RNA, 21 nt, Pseudomonas putida KT2440
ccgggguguuacgccaggcgu

SEQ ID NO: 3532155 - RNA, 23 nt, Pseudomonas putida KT2440
ccgggguuuuuuauugccugcca

SEQ ID NO: 3532156 - RNA, 23 nt, Pseudomonas putida KT2440
ccggguaaucagcuugaacacga

SEQ ID NO: 3532157 - RNA, 19 nt, Pseudomonas putida KT2440
ccggguaaucgccaggccc

SEQ ID NO: 3532158 - RNA, 20 nt, Pseudomonas putida KT2440
ccggguacagccccugcauc

SEQ ID NO: 3532159 - RNA, 23 nt, Pseudomonas putida KT2440
ccggguacagccccugcauccgu

SEQ ID NO: 3532160 - RNA, 16 nt, Pseudomonas putida KT2440
ccggguacuucucgac

SEQ ID NO: 3532161 - RNA, 22 nt, Pseudomonas putida KT2440
ccggguagaagggggcaaugcg

SEQ ID NO: 3532162 - RNA, 22 nt, Pseudomonas putida KT2440
ccggguagaucauuaccugcag

SEQ ID NO: 3532163 - RNA, 21 nt, Pseudomonas putida KT2440
ccgggucaaggccagcgccug

SEQ ID NO: 3532164 - RNA, 14 nt, Pseudomonas putida KT2440
ccgggucacggcug

SEQ ID NO: 3532165 - RNA, 16 nt, Pseudomonas putida KT2440
ccggguccaccucugc

SEQ ID NO: 3532166 - RNA, 18 nt, Pseudomonas putida KT2440
ccggguccaccucugcgg

SEQ ID NO: 3532167 - RNA, 17 nt, Pseudomonas putida KT2440
ccggguccagcaaccgg

SEQ ID NO: 3532168 - RNA, 12 nt, Pseudomonas putida KT2440
ccggguccagug

SEQ ID NO: 3532169 - RNA, 15 nt, Pseudomonas putida KT2440
ccggguccagugccg

SEQ ID NO: 3532170 - RNA, 20 nt, Pseudomonas putida KT2440
ccgggucgccguugucgccc

SEQ ID NO: 3532171 - RNA, 22 nt, Pseudomonas putida KT2440
ccgggucgccguugucgcccgc

SEQ ID NO: 3532172 - RNA, 18 nt, Pseudomonas putida KT2440
ccgggucggcgccaggcc

SEQ ID NO: 3532173 - RNA, 19 nt, Pseudomonas putida KT2440
ccgggucggcgccaggccu

SEQ ID NO: 3532174 - RNA, 13 nt, Pseudomonas putida KT2440
ccgggucuucagg

SEQ ID NO: 3532175 - RNA, 19 nt, Pseudomonas putida KT2440
ccgggugaucauucaggca

SEQ ID NO: 3532176 - RNA, 15 nt, Pseudomonas putida KT2440
ccgggugcaucggca

SEQ ID NO: 3532177 - RNA, 23 nt, Pseudomonas putida KT2440
ccgggugcuggcucgcugcccca

SEQ ID NO: 3532178 - RNA, 18 nt, Pseudomonas putida KT2440
ccggguuaccgcacagca

SEQ ID NO: 3532179 - RNA, 16 nt, Pseudomonas putida KT2440
ccggguucugcaggau

SEQ ID NO: 3532180 - RNA, 20 nt, Pseudomonas putida KT2440
ccggguugcccucgcaugcg

SEQ ID NO: 3532181 - RNA, 16 nt, Pseudomonas putida KT2440
ccggguuuacaccacc

SEQ ID NO: 3532182 - RNA, 23 nt, Pseudomonas putida KT2440
ccggguuugaagcccggccgcgc

SEQ ID NO: 3532183 - RNA, 19 nt, Pseudomonas putida KT2440
ccggguuuuuugugccugu

SEQ ID NO: 3532184 - RNA, 17 nt, Pseudomonas putida KT2440
ccgguaacgggccagcc

SEQ ID NO: 3532185 - RNA, 21 nt, Pseudomonas putida KT2440
ccgguaacgguaauggccggc

SEQ ID NO: 3532186 - RNA, 15 nt, Pseudomonas putida KT2440
ccgguaacuggccca

SEQ ID NO: 3532187 - RNA, 17 nt, Pseudomonas putida KT2440
ccgguaacuggcccacc

SEQ ID NO: 3532188 - RNA, 18 nt, Pseudomonas putida KT2440
ccgguaauagcggcgguu

SEQ ID NO: 3532189 - RNA, 16 nt, Pseudomonas putida KT2440
ccgguacauugcgcac

SEQ ID NO: 3532190 - RNA, 15 nt, Pseudomonas putida KT2440
ccgguaccagcaggc

SEQ ID NO: 3532191 - RNA, 20 nt, Pseudomonas putida KT2440
ccgguacccaaggccagccc

SEQ ID NO: 3532192 - RNA, 18 nt, Pseudomonas putida KT2440
ccgguaccgccaccaauc

SEQ ID NO: 3532193 - RNA, 22 nt, Pseudomonas putida KT2440
ccgguaccgccaccaaucuggu

SEQ ID NO: 3532194 - RNA, 15 nt, Pseudomonas putida KT2440
ccgguaccggauagc

SEQ ID NO: 3532195 - RNA, 22 nt, Pseudomonas putida KT2440
ccgguaccggcguuucuucgag

SEQ ID NO: 3532196 - RNA, 15 nt, Pseudomonas putida KT2440
ccgguacugcccaua

SEQ ID NO: 3532197 - RNA, 19 nt, Pseudomonas putida KT2440
ccgguagccucgacccgcu

SEQ ID NO: 3532198 - RNA, 17 nt, Pseudomonas putida KT2440
ccgguagcugcgcaggu

SEQ ID NO: 3532199 - RNA, 17 nt, Pseudomonas putida KT2440
ccgguaggucuaaccgc

SEQ ID NO: 3532200 - RNA, 13 nt, Pseudomonas putida KT2440
ccgguauagcgac

SEQ ID NO: 3532201 - RNA, 20 nt, Pseudomonas putida KT2440
ccgguauuggccacguugau

SEQ ID NO: 3532202 - RNA, 20 nt, Pseudomonas putida KT2440
ccggucacccccaucagcgg

SEQ ID NO: 3532203 - RNA, 19 nt, Pseudomonas putida KT2440
ccggucaccgaccaucggc

SEQ ID NO: 3532204 - RNA, 22 nt, Pseudomonas putida KT2440
ccggucaccgaccaucggcagg

SEQ ID NO: 3532205 - RNA, 16 nt, Pseudomonas putida KT2440
ccggucaccugcaaca

SEQ ID NO: 3532206 - RNA, 19 nt, Pseudomonas putida KT2440
ccggucacgauccccacca

SEQ ID NO: 3532207 - RNA, 18 nt, Pseudomonas putida KT2440
ccggucacuggcgacagc

SEQ ID NO: 3532208 - RNA, 13 nt, Pseudomonas putida KT2440
ccggucagcagca

SEQ ID NO: 3532209 - RNA, 14 nt, Pseudomonas putida KT2440
ccggucauccagca

SEQ ID NO: 3532210 - RNA, 17 nt, Pseudomonas putida KT2440
ccggucauggcgcgcca

SEQ ID NO: 3532211 - RNA, 22 nt, Pseudomonas putida KT2440
cgcuccuacgcggggcagcgca

SEQ ID NO: 3532212 - RNA, 23 nt, Pseudomonas putida KT2440
cgcuccuacgcucuaucccccuu

SEQ ID NO: 3532213 - RNA, 20 nt, Pseudomonas putida KT2440
cgcuccuacgggcaaccgca

SEQ ID NO: 3532214 - RNA, 16 nt, Pseudomonas putida KT2440
cgcuccuacuacggcc

SEQ ID NO: 3532215 - RNA, 17 nt, Pseudomonas putida KT2440
cgcuccuacuacggccu

SEQ ID NO: 3532216 - RNA, 23 nt, Pseudomonas putida KT2440
cgcuccucggccguaaaguccgu

SEQ ID NO: 3532217 - RNA, 16 nt, Pseudomonas putida KT2440
cgcuccugcacaaccc

SEQ ID NO: 3532218 - RNA, 20 nt, Pseudomonas putida KT2440
cgcuccuggucaucgaagcc

SEQ ID NO: 3532219 - RNA, 15 nt, Pseudomonas putida KT2440
cgcuccuucaccagg

SEQ ID NO: 3532220 - RNA, 20 nt, Pseudomonas putida KT2440
cgcucgaagauauccgccug

SEQ ID NO: 3532221 - RNA, 21 nt, Pseudomonas putida KT2440
cgcucgaagauauccgccuga

SEQ ID NO: 3532222 - RNA, 19 nt, Pseudomonas putida KT2440
cgcucgacagcaacuucuc

SEQ ID NO: 3532223 - RNA, 14 nt, Pseudomonas putida KT2440
cgcucgacauccag

SEQ ID NO: 3532224 - RNA, 12 nt, Pseudomonas putida KT2440
cgcucgaccaga

SEQ ID NO: 3532225 - RNA, 16 nt, Pseudomonas putida KT2440
cgcucgacgcgcgcag

SEQ ID NO: 3532226 - RNA, 19 nt, Pseudomonas putida KT2440
cgcucgacgcgcgcagccu

SEQ ID NO: 3532227 - RNA, 20 nt, Pseudomonas putida KT2440
cgcucgacgcgcgcagccug

SEQ ID NO: 3532228 - RNA, 16 nt, Pseudomonas putida KT2440
cgcucgagaaacgcca

SEQ ID NO: 3532229 - RNA, 17 nt, Pseudomonas putida KT2440
cgcucgagaaacgccag

SEQ ID NO: 3532230 - RNA, 18 nt, Pseudomonas putida KT2440
cgcucgagaaacgccagc

SEQ ID NO: 3532231 - RNA, 14 nt, Pseudomonas putida KT2440
cgcucgauaugccg

SEQ ID NO: 3532232 - RNA, 15 nt, Pseudomonas putida KT2440
cgcucgauaugccgc

SEQ ID NO: 3532233 - RNA, 17 nt, Pseudomonas putida KT2440
cgcucgauaugccgccg

SEQ ID NO: 3532234 - RNA, 21 nt, Pseudomonas putida KT2440
cgcucgccacacaaauccagg

SEQ ID NO: 3532235 - RNA, 14 nt, Pseudomonas putida KT2440
cgcucgcccagcag

SEQ ID NO: 3532236 - RNA, 18 nt, Pseudomonas putida KT2440
cgcucgcccagcagccaa

SEQ ID NO: 3532237 - RNA, 18 nt, Pseudomonas putida KT2440
cgcucgccggguuccacc

SEQ ID NO: 3532238 - RNA, 12 nt, Pseudomonas putida KT2440
cgcucgccuggc

SEQ ID NO: 3532239 - RNA, 17 nt, Pseudomonas putida KT2440
cgcucgcgaauguucuc

SEQ ID NO: 3532240 - RNA, 16 nt, Pseudomonas putida KT2440
cgcucgcgcaggaacc

SEQ ID NO: 3532241 - RNA, 13 nt, Pseudomonas putida KT2440
cgcucgcgccgcc

SEQ ID NO: 3532242 - RNA, 15 nt, Pseudomonas putida KT2440
cgcucgcgccgccgc

SEQ ID NO: 3532243 - RNA, 15 nt, Pseudomonas putida KT2440
cgcucgcgguucauc

SEQ ID NO: 3532244 - RNA, 17 nt, Pseudomonas putida KT2440
cgcucgcgguucaucgg

SEQ ID NO: 3532245 - RNA, 18 nt, Pseudomonas putida KT2440
cgcucgcugcgaucgaaa

SEQ ID NO: 3532246 - RNA, 21 nt, Pseudomonas putida KT2440
cgcucguagagcuuggacagg

SEQ ID NO: 3532247 - RNA, 19 nt, Pseudomonas putida KT2440
cgcucguaggcuucacgcg

SEQ ID NO: 3532248 - RNA, 20 nt, Pseudomonas putida KT2440
cgcucguaggcuucacgcgc

SEQ ID NO: 3532249 - RNA, 12 nt, Pseudomonas putida KT2440
cgcucguccagg

SEQ ID NO: 3532250 - RNA, 16 nt, Pseudomonas putida KT2440
cgcucguccaggcccu

SEQ ID NO: 3532251 - RNA, 13 nt, Pseudomonas putida KT2440
cgcucgugcaggc

SEQ ID NO: 3532252 - RNA, 16 nt, Pseudomonas putida KT2440
cgcucguuguccagca

SEQ ID NO: 3532253 - RNA, 21 nt, Pseudomonas putida KT2440
cgcucuaucccccuuuggccu

SEQ ID NO: 3532254 - RNA, 14 nt, Pseudomonas putida KT2440
cgcucucacaggga

SEQ ID NO: 3532255 - RNA, 21 nt, Pseudomonas putida KT2440
cgcucucgcuuuugcuugcag

SEQ ID NO: 3532256 - RNA, 14 nt, Pseudomonas putida KT2440
cgcucugcgccugc

SEQ ID NO: 3532257 - RNA, 16 nt, Pseudomonas putida KT2440
cgcucuggcacucaag

SEQ ID NO: 3532258 - RNA, 21 nt, Pseudomonas putida KT2440
cgcucuguaucgaacaggcag

SEQ ID NO: 3532259 - RNA, 23 nt, Pseudomonas putida KT2440
cgcucuuugccacucagcggguc

SEQ ID NO: 3532260 - RNA, 14 nt, Pseudomonas putida KT2440
cgcugaaacaucag

SEQ ID NO: 3532261 - RNA, 14 nt, Pseudomonas putida KT2440
cgcugaacacgccc

SEQ ID NO: 3532262 - RNA, 17 nt, Pseudomonas putida KT2440
cgcugaaccucaccgcc

SEQ ID NO: 3532263 - RNA, 18 nt, Pseudomonas putida KT2440
cgcugaccaacaggcugg

SEQ ID NO: 3532264 - RNA, 20 nt, Pseudomonas putida KT2440
cgcugaccaacaggcuggca

SEQ ID NO: 3532265 - RNA, 21 nt, Pseudomonas putida KT2440
cgcugaccaacaggcuggcau

SEQ ID NO: 3532266 - RNA, 17 nt, Pseudomonas putida KT2440
cgcugaccacgccgaag

SEQ ID NO: 3532267 - RNA, 21 nt, Pseudomonas putida KT2440
cgcugaccgaugaucugccgg

SEQ ID NO: 3532268 - RNA, 18 nt, Pseudomonas putida KT2440
cgcugacucagcggccuu

SEQ ID NO: 3532269 - RNA, 19 nt, Pseudomonas putida KT2440
cgcugacucagcggccuuu

SEQ ID NO: 3532270 - RNA, 15 nt, Pseudomonas putida KT2440
cgcugagcgacagca

SEQ ID NO: 3532271 - RNA, 23 nt, Pseudomonas putida KT2440
cgcugagggaaaacucggucagg

SEQ ID NO: 3532272 - RNA, 14 nt, Pseudomonas putida KT2440
cgcugaucagcugg

SEQ ID NO: 3532273 - RNA, 15 nt, Pseudomonas putida KT2440
cgcugaucagcuggu

SEQ ID NO: 3532274 - RNA, 19 nt, Pseudomonas putida KT2440
cgcugauccgcuuucggca

SEQ ID NO: 3532275 - RNA, 13 nt, Pseudomonas putida KT2440
cgcugaucgcggg

SEQ ID NO: 3532276 - RNA, 18 nt, Pseudomonas putida KT2440
cgcugauucaacgcccca

SEQ ID NO: 3532277 - RNA, 23 nt, Pseudomonas putida KT2440
cgcugcaacacgucauacagccc

SEQ ID NO: 3532278 - RNA, 14 nt, Pseudomonas putida KT2440
cgcugcacaggcca

SEQ ID NO: 3532279 - RNA, 15 nt, Pseudomonas putida KT2440
cgcugcacaggccag

SEQ ID NO: 3532280 - RNA, 22 nt, Pseudomonas putida KT2440
cgcugcacaggccagccccagc

SEQ ID NO: 3532281 - RNA, 20 nt, Pseudomonas putida KT2440
cgcugcaccgaaggccgccg

SEQ ID NO: 3532282 - RNA, 23 nt, Pseudomonas putida KT2440
cgcugcaccgaaggccgccggca

SEQ ID NO: 3532283 - RNA, 17 nt, Pseudomonas putida KT2440
cgcugcacgucgcgcag

SEQ ID NO: 3532284 - RNA, 13 nt, Pseudomonas putida KT2440
cgcugcacuucca

SEQ ID NO: 3532285 - RNA, 17 nt, Pseudomonas putida KT2440
cgcugcauggcggcacc

SEQ ID NO: 3532286 - RNA, 20 nt, Pseudomonas putida KT2440
cgcugcauugucauugccca

SEQ ID NO: 3532287 - RNA, 22 nt, Pseudomonas putida KT2440
cgcugccaaaguccggcgaagc

SEQ ID NO: 3532288 - RNA, 19 nt, Pseudomonas putida KT2440
cgcugccaaaucagugacc

SEQ ID NO: 3532289 - RNA, 14 nt, Pseudomonas putida KT2440
cgcugccaccuucc

SEQ ID NO: 3532290 - RNA, 17 nt, Pseudomonas putida KT2440
cgcugccaccuuccagg

SEQ ID NO: 3532291 - RNA, 15 nt, Pseudomonas putida KT2440
cgcugccacgcaugc

SEQ ID NO: 3532292 - RNA, 21 nt, Pseudomonas putida KT2440
cgcugccagcugcgcugccug

SEQ ID NO: 3532293 - RNA, 14 nt, Pseudomonas putida KT2440
cgcugccaggaagc

SEQ ID NO: 3532294 - RNA, 18 nt, Pseudomonas putida KT2440
cgcugccauagcgcugca

SEQ ID NO: 3532295 - RNA, 21 nt, Pseudomonas putida KT2440
cgcugccauagcgcugcaccg

SEQ ID NO: 3532296 - RNA, 16 nt, Pseudomonas putida KT2440
cgcugccaugcgcugc

SEQ ID NO: 3532297 - RNA, 15 nt, Pseudomonas putida KT2440
cgcugcccaggugcc

SEQ ID NO: 3532298 - RNA, 18 nt, Pseudomonas putida KT2440
cgcugcccaggugccagg

SEQ ID NO: 3532299 - RNA, 16 nt, Pseudomonas putida KT2440
cgcugccccaagugcc

SEQ ID NO: 3532300 - RNA, 19 nt, Pseudomonas putida KT2440
cgcugccccaagugccaga

SEQ ID NO: 3532301 - RNA, 14 nt, Pseudomonas putida KT2440
cgcugcccgggcaa

SEQ ID NO: 3532302 - RNA, 15 nt, Pseudomonas putida KT2440
cgcugcccgggcaaa

SEQ ID NO: 3532303 - RNA, 17 nt, Pseudomonas putida KT2440
cgcugcccgggcaaagc

SEQ ID NO: 3532304 - RNA, 16 nt, Pseudomonas putida KT2440
cgcugcccucggccgg

SEQ ID NO: 3532305 - RNA, 15 nt, Pseudomonas putida KT2440
cgcugccgaucagca

SEQ ID NO: 3532306 - RNA, 19 nt, Pseudomonas putida KT2440
cgcugccggcguggcgagc

SEQ ID NO: 3532307 - RNA, 21 nt, Pseudomonas putida KT2440
cgcugccgucucgucacuggc

SEQ ID NO: 3532308 - RNA, 22 nt, Pseudomonas putida KT2440
cgcugccgucucgucacuggcu

SEQ ID NO: 3532309 - RNA, 18 nt, Pseudomonas putida KT2440
cgcugccgugcaggucag

SEQ ID NO: 3532310 - RNA, 15 nt, Pseudomonas putida KT2440
cgcugccuccacacc

SEQ ID NO: 3532311 - RNA, 14 nt, Pseudomonas putida KT2440
cgcugccugcgcuu

SEQ ID NO: 3532312 - RNA, 15 nt, Pseudomonas putida KT2440
cgcugccugcgcuuc

SEQ ID NO: 3532313 - RNA, 15 nt, Pseudomonas putida KT2440
cgcugccugcuggcg

SEQ ID NO: 3532314 - RNA, 16 nt, Pseudomonas putida KT2440
cgcugccugggcacca

SEQ ID NO: 3532315 - RNA, 17 nt, Pseudomonas putida KT2440
cgcugccuuccaaccag

SEQ ID NO: 3532316 - RNA, 12 nt, Pseudomonas putida KT2440
cgcuucgccagc

SEQ ID NO: 3532317 - RNA, 15 nt, Pseudomonas putida KT2440
cgcuucgccagcgcc

SEQ ID NO: 3532318 - RNA, 14 nt, Pseudomonas putida KT2440
cgcuucgccgcgcu

SEQ ID NO: 3532319 - RNA, 15 nt, Pseudomonas putida KT2440
cgcuucgccgcgcug

SEQ ID NO: 3532320 - RNA, 15 nt, Pseudomonas putida KT2440
cgcuucgcgcacuga

SEQ ID NO: 3532321 - RNA, 23 nt, Pseudomonas putida KT2440
cgcuucgcggccaagccgcugcc

SEQ ID NO: 3532322 - RNA, 14 nt, Pseudomonas putida KT2440
cgcuucggcaugca

SEQ ID NO: 3532323 - RNA, 16 nt, Pseudomonas putida KT2440
cgcuucggcgcgggca

SEQ ID NO: 3532324 - RNA, 18 nt, Pseudomonas putida KT2440
cgcuucggcgcgggcacc

SEQ ID NO: 3532325 - RNA, 22 nt, Pseudomonas putida KT2440
cgcuucggcgcgggcacccugg

SEQ ID NO: 3532326 - RNA, 20 nt, Pseudomonas putida KT2440
cgcuucggugugcuccagcu

SEQ ID NO: 3532327 - RNA, 23 nt, Pseudomonas putida KT2440
cgcuucggugugcuccagcucca

SEQ ID NO: 3532328 - RNA, 21 nt, Pseudomonas putida KT2440
cgcuucuggacaagaagcggc

SEQ ID NO: 3532329 - RNA, 12 nt, Pseudomonas putida KT2440
cgcuugaagaag

SEQ ID NO: 3532330 - RNA, 17 nt, Pseudomonas putida KT2440
cgcuugagaccaggccu

SEQ ID NO: 3532331 - RNA, 20 nt, Pseudomonas putida KT2440
cgcuugagcgaaacccggcg

SEQ ID NO: 3532332 - RNA, 15 nt, Pseudomonas putida KT2440
cgcuugagcgcgccg

SEQ ID NO: 3532333 - RNA, 16 nt, Pseudomonas putida KT2440
cgcuugaggcuuucaa

SEQ ID NO: 3532334 - RNA, 21 nt, Pseudomonas putida KT2440
cgcuugaucugccaggcacca

SEQ ID NO: 3532335 - RNA, 22 nt, Pseudomonas putida KT2440
cgcuugcaguuguccaggcugc

SEQ ID NO: 3532336 - RNA, 23 nt, Pseudomonas putida KT2440
cgcuugccaaggcuagccacggc

SEQ ID NO: 3532337 - RNA, 19 nt, Pseudomonas putida KT2440
cgcuugccacccaggcccu

SEQ ID NO: 3532338 - RNA, 21 nt, Pseudomonas putida KT2440
cgcuugccacggcguggagcg

SEQ ID NO: 3532339 - RNA, 13 nt, Pseudomonas putida KT2440
cgcuugcccggcu

SEQ ID NO: 3532340 - RNA, 16 nt, Pseudomonas putida KT2440
cgcuugcccggcucca

SEQ ID NO: 3532341 - RNA, 17 nt, Pseudomonas putida KT2440
cgcuugccgcugcggau

SEQ ID NO: 3532342 - RNA, 22 nt, Pseudomonas putida KT2440
cgcuugccuuccucggccaugc

SEQ ID NO: 3532343 - RNA, 23 nt, Pseudomonas putida KT2440
cgcuugcgaaggagaauccacuu

SEQ ID NO: 3532344 - RNA, 19 nt, Pseudomonas putida KT2440
cgcuugcgcauggccgcca

SEQ ID NO: 3532345 - RNA, 20 nt, Pseudomonas putida KT2440
cgcuugcgcauggccgccac

SEQ ID NO: 3532346 - RNA, 18 nt, Pseudomonas putida KT2440
cgcuugcgguccugcacc

SEQ ID NO: 3532347 - RNA, 22 nt, Pseudomonas putida KT2440
cgcuugcuguguuaccagucca

SEQ ID NO: 3532348 - RNA, 22 nt, Pseudomonas putida KT2440
cgcuuggaguugcucgagugcg

SEQ ID NO: 3532349 - RNA, 23 nt, Pseudomonas putida KT2440
cgcuuggaguugcucgagugcga

SEQ ID NO: 3532350 - RNA, 21 nt, Pseudomonas putida KT2440
cgcuuggcaccggcagcagca

SEQ ID NO: 3532351 - RNA, 14 nt, Pseudomonas putida KT2440
cgcuuggccaccac

SEQ ID NO: 3532352 - RNA, 16 nt, Pseudomonas putida KT2440
cgcuuggccaccacgu

SEQ ID NO: 3532353 - RNA, 23 nt, Pseudomonas putida KT2440
cgcuuggccagaaacggcggcag

SEQ ID NO: 3532354 - RNA, 23 nt, Pseudomonas putida KT2440
cgcuuggccagacucagcugcug

SEQ ID NO: 3532355 - RNA, 18 nt, Pseudomonas putida KT2440
cgcuuggucggcgccccu

SEQ ID NO: 3532356 - RNA, 24 nt, Pseudomonas putida KT2440
cgcuuguaaagaauucggacugug

SEQ ID NO: 3532357 - RNA, 16 nt, Pseudomonas putida KT2440
cgcuugucgccacccg

SEQ ID NO: 3532358 - RNA, 13 nt, Pseudomonas putida KT2440
cgcuuucagccga

SEQ ID NO: 3532359 - RNA, 17 nt, Pseudomonas putida KT2440
cgcuuuccaaaccugcg

SEQ ID NO: 3532360 - RNA, 18 nt, Pseudomonas putida KT2440
cgcuuuccagcuguacgc

SEQ ID NO: 3532361 - RNA, 13 nt, Pseudomonas putida KT2440
cgcuuuccugguu

SEQ ID NO: 3532362 - RNA, 16 nt, Pseudomonas putida KT2440
cgcuuugcacccgcgc

SEQ ID NO: 3532363 - RNA, 19 nt, Pseudomonas putida KT2440
cgcuuugcacccgcgcgcu

SEQ ID NO: 3532364 - RNA, 16 nt, Pseudomonas putida KT2440
cgcuuugcgcaaccga

SEQ ID NO: 3532365 - RNA, 17 nt, Pseudomonas putida KT2440
cgcuuugcgccccuuuc

SEQ ID NO: 3532366 - RNA, 16 nt, Pseudomonas putida KT2440
cgcuuuggcagcagcc

SEQ ID NO: 3532367 - RNA, 22 nt, Pseudomonas putida KT2440
cgcuuuggcagcagccucggcc

SEQ ID NO: 3532368 - RNA, 23 nt, Pseudomonas putida KT2440
cgcuuuggcagcagccucggccu

SEQ ID NO: 3532369 - RNA, 22 nt, Pseudomonas putida KT2440
cgcuuugugcacaagcugcuga

SEQ ID NO: 3532370 - RNA, 17 nt, Pseudomonas putida KT2440
cgcuuuguuugcuggca

SEQ ID NO: 3532371 - RNA, 16 nt, Pseudomonas putida KT2440
cgcuuuuccaguuccu

SEQ ID NO: 3532372 - RNA, 18 nt, Pseudomonas putida KT2440
cgcuuuucuucgcugcug

SEQ ID NO: 3532373 - RNA, 19 nt, Pseudomonas putida KT2440
cgcuuuuggcugugcaccc

SEQ ID NO: 3532374 - RNA, 16 nt, Pseudomonas putida KT2440
cggaaaaggccggcca

SEQ ID NO: 3532375 - RNA, 23 nt, Pseudomonas putida KT2440
cggaacaggaucagcggcuuguu

SEQ ID NO: 3532376 - RNA, 22 nt, Pseudomonas putida KT2440
cggaacagugguuugcguugau

SEQ ID NO: 3532377 - RNA, 21 nt, Pseudomonas putida KT2440
cggaacgucguugcaguucac

SEQ ID NO: 3532378 - RNA, 12 nt, Pseudomonas putida KT2440
cggaacucggcg

SEQ ID NO: 3532379 - RNA, 12 nt, Pseudomonas putida KT2440
cggaacugcucu

SEQ ID NO: 3532380 - RNA, 14 nt, Pseudomonas putida KT2440
cggaacugcucuuc

SEQ ID NO: 3532381 - RNA, 15 nt, Pseudomonas putida KT2440
cggaagauacccgcc

SEQ ID NO: 3532382 - RNA, 20 nt, Pseudomonas putida KT2440
cggaagaucaccuggucgac

SEQ ID NO: 3532383 - RNA, 21 nt, Pseudomonas putida KT2440
cggaagaucaccuggucgacc

SEQ ID NO: 3532384 - RNA, 22 nt, Pseudomonas putida KT2440
cggaagaucaccuggucgaccg

SEQ ID NO: 3532385 - RNA, 16 nt, Pseudomonas putida KT2440
cggaagcucuccaggg

SEQ ID NO: 3532386 - RNA, 18 nt, Pseudomonas putida KT2440
cggaagcucuccaggguu

SEQ ID NO: 3532387 - RNA, 19 nt, Pseudomonas putida KT2440
cggaagcucuccaggguuc

SEQ ID NO: 3532388 - RNA, 21 nt, Pseudomonas putida KT2440
cggaauaccgauugccucagg

SEQ ID NO: 3532389 - RNA, 14 nt, Pseudomonas putida KT2440
cggaaucaccggua

SEQ ID NO: 3532390 - RNA, 17 nt, Pseudomonas putida KT2440
cggaauccgcacacgcu

SEQ ID NO: 3532391 - RNA, 19 nt, Pseudomonas putida KT2440
cggaaugcccgggcgcagg

SEQ ID NO: 3532392 - RNA, 20 nt, Pseudomonas putida KT2440
cggaaugcccgggcgcaggc

SEQ ID NO: 3532393 - RNA, 14 nt, Pseudomonas putida KT2440
cggaaugcucguca

SEQ ID NO: 3532394 - RNA, 15 nt, Pseudomonas putida KT2440
cggaaugucggcguu

SEQ ID NO: 3532395 - RNA, 23 nt, Pseudomonas putida KT2440
cggaauguuaccggccuggcauu

SEQ ID NO: 3532396 - RNA, 20 nt, Pseudomonas putida KT2440
cggaauucgcggcggcgcga

SEQ ID NO: 3532397 - RNA, 21 nt, Pseudomonas putida KT2440
cggacaacuuggcaccgaccc

SEQ ID NO: 3532398 - RNA, 22 nt, Pseudomonas putida KT2440
cggacaacuuggcaccgacccg

SEQ ID NO: 3532399 - RNA, 19 nt, Pseudomonas putida KT2440
cggacaauuucugcgucgu

SEQ ID NO: 3532400 - RNA, 12 nt, Pseudomonas putida KT2440
cggacaggcgcu

SEQ ID NO: 3532401 - RNA, 17 nt, Pseudomonas putida KT2440
cggacaggcgcuugacc

SEQ ID NO: 3532402 - RNA, 15 nt, Pseudomonas putida KT2440
cggacagguuggcgc

SEQ ID NO: 3532403 - RNA, 16 nt, Pseudomonas putida KT2440
cggacagguuggcgcc

SEQ ID NO: 3532404 - RNA, 16 nt, Pseudomonas putida KT2440
cggaccaccugggcca

SEQ ID NO: 3532405 - RNA, 15 nt, Pseudomonas putida KT2440
cggaccagcgccgca

SEQ ID NO: 3532406 - RNA, 21 nt, Pseudomonas putida KT2440
cggacccagcggucagcaucu

SEQ ID NO: 3532407 - RNA, 17 nt, Pseudomonas putida KT2440
cggacccugguucucca

SEQ ID NO: 3532408 - RNA, 23 nt, Pseudomonas putida KT2440
cggacccuugugugggccuugcu

SEQ ID NO: 3532409 - RNA, 16 nt, Pseudomonas putida KT2440
cggaccugccgcagcg

SEQ ID NO: 3532410 - RNA, 19 nt, Pseudomonas putida KT2440
cggaccugccgcagcgauc

SEQ ID NO: 3532411 - RNA, 17 nt, Pseudomonas putida KT2440
cggacgcuugccaccca

SEQ ID NO: 3532412 - RNA, 20 nt, Pseudomonas putida KT2440
cggacucauagcucagcugg

SEQ ID NO: 3532413 - RNA, 23 nt, Pseudomonas putida KT2440
cggacucgacgucguaggcuuug

SEQ ID NO: 3532414 - RNA, 18 nt, Pseudomonas putida KT2440
cggacugcaccaggucca

SEQ ID NO: 3532415 - RNA, 17 nt, Pseudomonas putida KT2440
cggagaacgggcugucg

SEQ ID NO: 3532416 - RNA, 18 nt, Pseudomonas putida KT2440
cggagagguggcagaaca

SEQ ID NO: 3532417 - RNA, 14 nt, Pseudomonas putida KT2440
cggagauuggccag

SEQ ID NO: 3532418 - RNA, 20 nt, Pseudomonas putida KT2440
cggagauuggccagcaggcc

SEQ ID NO: 3532419 - RNA, 15 nt, Pseudomonas putida KT2440
cggagccaaucucgg

SEQ ID NO: 3532420 - RNA, 16 nt, Pseudomonas putida KT2440
cgccgcagguccaccu

SEQ ID NO: 3532421 - RNA, 14 nt, Pseudomonas putida KT2440
cgccgcauccagca

SEQ ID NO: 3532422 - RNA, 21 nt, Pseudomonas putida KT2440
cgccgcauccagcacugccug

SEQ ID NO: 3532423 - RNA, 15 nt, Pseudomonas putida KT2440
cgccgcauccucgug

SEQ ID NO: 3532424 - RNA, 13 nt, Pseudomonas putida KT2440
cgccgcaucgcca

SEQ ID NO: 3532425 - RNA, 20 nt, Pseudomonas putida KT2440
cgccgcaucguuauccagca

SEQ ID NO: 3532426 - RNA, 21 nt, Pseudomonas putida KT2440
cgccgcaucguuauccagcac

SEQ ID NO: 3532427 - RNA, 19 nt, Pseudomonas putida KT2440
cgccgccaaccccuccagc

SEQ ID NO: 3532428 - RNA, 19 nt, Pseudomonas putida KT2440
cgccgccaccagcgccgcc

SEQ ID NO: 3532429 - RNA, 11 nt, Pseudomonas putida KT2440
cgccgccaccu

SEQ ID NO: 3532430 - RNA, 14 nt, Pseudomonas putida KT2440
cgccgccaccugcg

SEQ ID NO: 3532431 - RNA, 15 nt, Pseudomonas putida KT2440
cgccgccacgaucga

SEQ ID NO: 3532432 - RNA, 15 nt, Pseudomonas putida KT2440
cgccgccagaccacc

SEQ ID NO: 3532433 - RNA, 21 nt, Pseudomonas putida KT2440
cgccgccagaccaccucaucc

SEQ ID NO: 3532434 - RNA, 22 nt, Pseudomonas putida KT2440
cgccgccagaccaccucauccc

SEQ ID NO: 3532435 - RNA, 13 nt, Pseudomonas putida KT2440
cgccgccagcggc

SEQ ID NO: 3532436 - RNA, 14 nt, Pseudomonas putida KT2440
cgccgccagcugcu

SEQ ID NO: 3532437 - RNA, 14 nt, Pseudomonas putida KT2440
cgccgccaggccca

SEQ ID NO: 3532438 - RNA, 17 nt, Pseudomonas putida KT2440
cgccgccaggcggucgc

SEQ ID NO: 3532439 - RNA, 13 nt, Pseudomonas putida KT2440
cgccgccagggca

SEQ ID NO: 3532440 - RNA, 15 nt, Pseudomonas putida KT2440
cgccgcccaauacgc

SEQ ID NO: 3532441 - RNA, 14 nt, Pseudomonas putida KT2440
cgccgcccagguca

SEQ ID NO: 3532442 - RNA, 14 nt, Pseudomonas putida KT2440
cgccgccccccagu

SEQ ID NO: 3532443 - RNA, 23 nt, Pseudomonas putida KT2440
cgccgcccccuucacugaucggg

SEQ ID NO: 3532444 - RNA, 22 nt, Pseudomonas putida KT2440
cgccgcccuuggugcaccagcu

SEQ ID NO: 3532445 - RNA, 15 nt, Pseudomonas putida KT2440
cgccgccgaacucug

SEQ ID NO: 3532446 - RNA, 22 nt, Pseudomonas putida KT2440
cgccgccgagcugaugccggag

SEQ ID NO: 3532447 - RNA, 17 nt, Pseudomonas putida KT2440
cgccgccgagugcgcgg

SEQ ID NO: 3532448 - RNA, 19 nt, Pseudomonas putida KT2440
cgccgccgauagcagcacc

SEQ ID NO: 3532449 - RNA, 23 nt, Pseudomonas putida KT2440
cgccgccgcugaccacgccgaag

SEQ ID NO: 3532450 - RNA, 20 nt, Pseudomonas putida KT2440
cgccgccgguuucucgcagc

SEQ ID NO: 3532451 - RNA, 15 nt, Pseudomonas putida KT2440
cgccgccuccaccgg

SEQ ID NO: 3532452 - RNA, 21 nt, Pseudomonas putida KT2440
cgccgccuucgccaaggucca

SEQ ID NO: 3532453 - RNA, 13 nt, Pseudomonas putida KT2440
cgccgcgaucaau

SEQ ID NO: 3532454 - RNA, 20 nt, Pseudomonas putida KT2440
cgccgcgcggcuugcucgcg

SEQ ID NO: 3532455 - RNA, 19 nt, Pseudomonas putida KT2440
cgccgcgcugauaucgaua

SEQ ID NO: 3532456 - RNA, 17 nt, Pseudomonas putida KT2440
cgccgcucgauaugccg

SEQ ID NO: 3532457 - RNA, 20 nt, Pseudomonas putida KT2440
cgccgcucgauaugccgccg

SEQ ID NO: 3532458 - RNA, 16 nt, Pseudomonas putida KT2440
cgccgcucugcccgcg

SEQ ID NO: 3532459 - RNA, 13 nt, Pseudomonas putida KT2440
cgccgcugccagc

SEQ ID NO: 3532460 - RNA, 14 nt, Pseudomonas putida KT2440
cgccgcugccagca

SEQ ID NO: 3532461 - RNA, 15 nt, Pseudomonas putida KT2440
cgccgcugccagcag

SEQ ID NO: 3532462 - RNA, 14 nt, Pseudomonas putida KT2440
cgccgcugccuggg

SEQ ID NO: 3532463 - RNA, 20 nt, Pseudomonas putida KT2440
cgccgcugcugcgccucgca

SEQ ID NO: 3532464 - RNA, 19 nt, Pseudomonas putida KT2440
cgccgcugguacaggguca

SEQ ID NO: 3532465 - RNA, 22 nt, Pseudomonas putida KT2440
cgccgcugguacagggucagga

SEQ ID NO: 3532466 - RNA, 17 nt, Pseudomonas putida KT2440
cgccgcuguucagcccu

SEQ ID NO: 3532467 - RNA, 14 nt, Pseudomonas putida KT2440
cgccgcuucagccu

SEQ ID NO: 3532468 - RNA, 15 nt, Pseudomonas putida KT2440
cgccgcuucagccuu

SEQ ID NO: 3532469 - RNA, 23 nt, Pseudomonas putida KT2440
cgccgcuucagccuuuuccagcu

SEQ ID NO: 3532470 - RNA, 21 nt, Pseudomonas putida KT2440
cgccgcuucggcaugcacggc

SEQ ID NO: 3532471 - RNA, 22 nt, Pseudomonas putida KT2440
cgccgcuuuguuugcuggcaug

SEQ ID NO: 3532472 - RNA, 16 nt, Pseudomonas putida KT2440
cgccggauuucuucca

SEQ ID NO: 3532473 - RNA, 14 nt, Pseudomonas putida KT2440
cgccggcaacuccu

SEQ ID NO: 3532474 - RNA, 19 nt, Pseudomonas putida KT2440
cgccggcaacuccuccagc

SEQ ID NO: 3532475 - RNA, 17 nt, Pseudomonas putida KT2440
cgccggcaacuggcauc

SEQ ID NO: 3532476 - RNA, 18 nt, Pseudomonas putida KT2440
cgccggcaacuggcaucg

SEQ ID NO: 3532477 - RNA, 19 nt, Pseudomonas putida KT2440
cgccggcaagcuggucagg

SEQ ID NO: 3532478 - RNA, 20 nt, Pseudomonas putida KT2440
cgccggcaagcuggucaggu

SEQ ID NO: 3532479 - RNA, 16 nt, Pseudomonas putida KT2440
cgccggcacgcccgcu

SEQ ID NO: 3532480 - RNA, 22 nt, Pseudomonas putida KT2440
cgccggcacgcuaccaccuggc

SEQ ID NO: 3532481 - RNA, 19 nt, Pseudomonas putida KT2440
cgccggcaucgccuccagc

SEQ ID NO: 3532482 - RNA, 13 nt, Pseudomonas putida KT2440
cgccggccaaggu

SEQ ID NO: 3532483 - RNA, 21 nt, Pseudomonas putida KT2440
cgccggccaaggucagcaagc

SEQ ID NO: 3532484 - RNA, 21 nt, Pseudomonas putida KT2440
cgccggccauugccgcgccgc

SEQ ID NO: 3532485 - RNA, 22 nt, Pseudomonas putida KT2440
cgccggccauugccgcgccgca

SEQ ID NO: 3532486 - RNA, 14 nt, Pseudomonas putida KT2440
cgccggccgcacuu

SEQ ID NO: 3532487 - RNA, 15 nt, Pseudomonas putida KT2440
cgccggcgccgugcu

SEQ ID NO: 3532488 - RNA, 18 nt, Pseudomonas putida KT2440
cgccggcgucggcgcgca

SEQ ID NO: 3532489 - RNA, 20 nt, Pseudomonas putida KT2440
cgccggcgucggcgcgcaac

SEQ ID NO: 3532490 - RNA, 16 nt, Pseudomonas putida KT2440
cgccgggaugguaacg

SEQ ID NO: 3532491 - RNA, 14 nt, Pseudomonas putida KT2440
cgccgggcacugcc

SEQ ID NO: 3532492 - RNA, 13 nt, Pseudomonas putida KT2440
cgccgggcccagg

SEQ ID NO: 3532493 - RNA, 19 nt, Pseudomonas putida KT2440
cgccgggccuugaccagca

SEQ ID NO: 3532494 - RNA, 15 nt, Pseudomonas putida KT2440
cgccggguuccacca

SEQ ID NO: 3532495 - RNA, 19 nt, Pseudomonas putida KT2440
cgccggguugcucauccac

SEQ ID NO: 3532496 - RNA, 17 nt, Pseudomonas putida KT2440
cgccgguagcggcuggg

SEQ ID NO: 3532497 - RNA, 16 nt, Pseudomonas putida KT2440
cgccgguauucgcgag

SEQ ID NO: 3532498 - RNA, 13 nt, Pseudomonas putida KT2440
cgccgguggcggc

SEQ ID NO: 3532499 - RNA, 17 nt, Pseudomonas putida KT2440
cgccgguggcggccgca

SEQ ID NO: 3532500 - RNA, 14 nt, Pseudomonas putida KT2440
cgccgguugcgcag

SEQ ID NO: 3532501 - RNA, 21 nt, Pseudomonas putida KT2440
cgccgguugcgcagccggccu

SEQ ID NO: 3532502 - RNA, 14 nt, Pseudomonas putida KT2440
cgccgguuucguca

SEQ ID NO: 3532503 - RNA, 16 nt, Pseudomonas putida KT2440
cgccgguuucucgcag

SEQ ID NO: 3532504 - RNA, 17 nt, Pseudomonas putida KT2440
cgccgguuucucgcagc

SEQ ID NO: 3532505 - RNA, 21 nt, Pseudomonas putida KT2440
cgccgguuucucgcagcagca

SEQ ID NO: 3532506 - RNA, 22 nt, Pseudomonas putida KT2440
cgccguagccaaccgagucaac

SEQ ID NO: 3532507 - RNA, 17 nt, Pseudomonas putida KT2440
cgccguauucaccggua

SEQ ID NO: 3532508 - RNA, 16 nt, Pseudomonas putida KT2440
cgccguauucggcggu

SEQ ID NO: 3532509 - RNA, 14 nt, Pseudomonas putida KT2440
cgccgucgaccuug

SEQ ID NO: 3532510 - RNA, 13 nt, Pseudomonas putida KT2440
cgccgugcaguuc

SEQ ID NO: 3532511 - RNA, 17 nt, Pseudomonas putida KT2440
cgccgugcuacggccgu

SEQ ID NO: 3532512 - RNA, 21 nt, Pseudomonas putida KT2440
cgccgugcucuucguggaacu

SEQ ID NO: 3532513 - RNA, 13 nt, Pseudomonas putida KT2440
cgccgugcuugug

SEQ ID NO: 3532514 - RNA, 14 nt, Pseudomonas putida KT2440
cgccguggugccgg

SEQ ID NO: 3532515 - RNA, 15 nt, Pseudomonas putida KT2440
cgccguguucccagc

SEQ ID NO: 3532516 - RNA, 15 nt, Pseudomonas putida KT2440
cgccguucaccguug

SEQ ID NO: 3532517 - RNA, 22 nt, Pseudomonas putida KT2440
cgccguucaccguugccgccac

SEQ ID NO: 3532518 - RNA, 19 nt, Pseudomonas putida KT2440
cgccguugaaagacugcuc

SEQ ID NO: 3532519 - RNA, 21 nt, Pseudomonas putida KT2440
cgccguugcggucggugguca

SEQ ID NO: 3532520 - RNA, 18 nt, Pseudomonas putida KT2440
cgccguugucgcccgccc

SEQ ID NO: 3532521 - RNA, 20 nt, Pseudomonas putida KT2440
cgccguuguucacggucagg

SEQ ID NO: 3532522 - RNA, 14 nt, Pseudomonas putida KT2440
cgccguuucagcca

SEQ ID NO: 3532523 - RNA, 19 nt, Pseudomonas putida KT2440
cgccguuucagccacauug

SEQ ID NO: 3532524 - RNA, 22 nt, Pseudomonas putida KT2440
cgccuacaacauaccgcugggc

SEQ ID NO: 3532525 - RNA, 13 nt, Pseudomonas putida KT2440
cgccuacaggcaa

SEQ ID NO: 3532526 - RNA, 19 nt, Pseudomonas putida KT2440
cgccuauccugugggagcg

SEQ ID NO: 3532527 - RNA, 18 nt, Pseudomonas putida KT2440
cgccuaugaaaccgagcg

SEQ ID NO: 3532528 - RNA, 13 nt, Pseudomonas putida KT2440
cgccucaccgacc

SEQ ID NO: 3532529 - RNA, 20 nt, Pseudomonas putida KT2440
cgccucaccgacccacaggc

SEQ ID NO: 3532530 - RNA, 13 nt, Pseudomonas putida KT2440
cgccucagcgcca

SEQ ID NO: 3532531 - RNA, 19 nt, Pseudomonas putida KT2440
cgccucauccucgcccacc

SEQ ID NO: 3532532 - RNA, 22 nt, Pseudomonas putida KT2440
cgccucauccucgcccaccagc

SEQ ID NO: 3532533 - RNA, 18 nt, Pseudomonas putida KT2440
cgccucaugcagcaccuc

SEQ ID NO: 3532534 - RNA, 23 nt, Pseudomonas putida KT2440
cgccucaugcagcaccuccugca

SEQ ID NO: 3532535 - RNA, 14 nt, Pseudomonas putida KT2440
cgccuccaccggga

SEQ ID NO: 3532536 - RNA, 18 nt, Pseudomonas putida KT2440
cgccuccaccgggauggc

SEQ ID NO: 3532537 - RNA, 24 nt, Pseudomonas putida KT2440
cgccuccaccuggaauucgcugcg

SEQ ID NO: 3532538 - RNA, 16 nt, Pseudomonas putida KT2440
cgccuccacggucagc

SEQ ID NO: 3532539 - RNA, 21 nt, Pseudomonas putida KT2440
cgccuccacggucagcaucca

SEQ ID NO: 3532540 - RNA, 13 nt, Pseudomonas putida KT2440
cgccuccagcagc

SEQ ID NO: 3532541 - RNA, 14 nt, Pseudomonas putida KT2440
cgccuccagcagcg

SEQ ID NO: 3532542 - RNA, 23 nt, Pseudomonas putida KT2440
cgccuccagcagcgacaccagcg

SEQ ID NO: 3532543 - RNA, 17 nt, Pseudomonas putida KT2440
cgccuccagcaggggca

SEQ ID NO: 3532544 - RNA, 14 nt, Pseudomonas putida KT2440
cgccuccagcuggc

SEQ ID NO: 3532545 - RNA, 19 nt, Pseudomonas putida KT2440
cgccuccaggcguugcggg

SEQ ID NO: 3532546 - RNA, 18 nt, Pseudomonas putida KT2440
cgccucccccacccccgc

SEQ ID NO: 3532547 - RNA, 19 nt, Pseudomonas putida KT2440
cgccucccccuccacuguc

SEQ ID NO: 3532548 - RNA, 13 nt, Pseudomonas putida KT2440
cgccuccggcgcu

SEQ ID NO: 3532549 - RNA, 13 nt, Pseudomonas putida KT2440
cgccuccugcugc

SEQ ID NO: 3532550 - RNA, 15 nt, Pseudomonas putida KT2440
cgccuccugcugcug

SEQ ID NO: 3532551 - RNA, 18 nt, Pseudomonas putida KT2440
cgccucgaacaccugcgc

SEQ ID NO: 3532552 - RNA, 21 nt, Pseudomonas putida KT2440
cgccucgaacaccugcgcccc

SEQ ID NO: 3532553 - RNA, 16 nt, Pseudomonas putida KT2440
cgccucgacgcagaca

SEQ ID NO: 3532554 - RNA, 17 nt, Pseudomonas putida KT2440
cgccucgaucauuuccg

SEQ ID NO: 3532555 - RNA, 22 nt, Pseudomonas putida KT2440
cgccucgaucgucgacaacgca

SEQ ID NO: 3532556 - RNA, 22 nt, Pseudomonas putida KT2440
cgccucgaugugcgugaacacu

SEQ ID NO: 3532557 - RNA, 17 nt, Pseudomonas putida KT2440
cgccucgcagguaaucg

SEQ ID NO: 3532558 - RNA, 20 nt, Pseudomonas putida KT2440
cgccucgcccaggccgccga

SEQ ID NO: 3532559 - RNA, 23 nt, Pseudomonas putida KT2440
cgccucgcccuugucagccgccg

SEQ ID NO: 3532560 - RNA, 20 nt, Pseudomonas putida KT2440
cgccucgcuggcgguguaga

SEQ ID NO: 3532561 - RNA, 16 nt, Pseudomonas putida KT2440
cgccucggcacugcac

SEQ ID NO: 3532562 - RNA, 22 nt, Pseudomonas putida KT2440
cgccucggcuacgccgccgcug

SEQ ID NO: 3532563 - RNA, 14 nt, Pseudomonas putida KT2440
cgccucgggcgcuc

SEQ ID NO: 3532564 - RNA, 19 nt, Pseudomonas putida KT2440
cgccucguugcgaagcggc

SEQ ID NO: 3532565 - RNA, 22 nt, Pseudomonas putida KT2440
cgccucguugcgaagcggccug

SEQ ID NO: 3532566 - RNA, 21 nt, Pseudomonas putida KT2440
cgccucguuggcgaagucggc

SEQ ID NO: 3532567 - RNA, 18 nt, Pseudomonas putida KT2440
cgccucuaccacgccgcu

SEQ ID NO: 3532568 - RNA, 19 nt, Pseudomonas putida KT2440
cgccucuuugcccugggcg

SEQ ID NO: 3532569 - RNA, 16 nt, Pseudomonas putida KT2440
cgccugaacagcauca

SEQ ID NO: 3532570 - RNA, 19 nt, Pseudomonas putida KT2440
cgccugaacagcaucagcc

SEQ ID NO: 3532571 - RNA, 22 nt, Pseudomonas putida KT2440
cgccugaaccaccgggaucuug

SEQ ID NO: 3532572 - RNA, 20 nt, Pseudomonas putida KT2440
cgccugaagcacgucgcgau

SEQ ID NO: 3532573 - RNA, 22 nt, Pseudomonas putida KT2440
cgccugaaucuugcgcgccagc

SEQ ID NO: 3532574 - RNA, 23 nt, Pseudomonas putida KT2440
cgccugaaucuugcgcgccagcg

SEQ ID NO: 3532575 - RNA, 17 nt, Pseudomonas putida KT2440
cgccugacgccgccagc

SEQ ID NO: 3532576 - RNA, 23 nt, Pseudomonas putida KT2440
cgccugacgccgccagcgcucca

SEQ ID NO: 3532577 - RNA, 18 nt, Pseudomonas putida KT2440
cgccugauuacccugcgc

SEQ ID NO: 3532578 - RNA, 20 nt, Pseudomonas putida KT2440
cgccugauuacccugcgcca

SEQ ID NO: 3532579 - RNA, 19 nt, Pseudomonas putida KT2440
cgccugcaccugacgagcg

SEQ ID NO: 3532580 - RNA, 14 nt, Pseudomonas putida KT2440
cgccugcaccuggc

SEQ ID NO: 3532581 - RNA, 16 nt, Pseudomonas putida KT2440
cgccugcaccuggcug

SEQ ID NO: 3532582 - RNA, 17 nt, Pseudomonas putida KT2440
cgccugcaggcccaggu

SEQ ID NO: 3532583 - RNA, 14 nt, Pseudomonas putida KT2440
cgccugcagggccu

SEQ ID NO: 3532584 - RNA, 23 nt, Pseudomonas putida KT2440
cgccugcccgccccccaccuggc

SEQ ID NO: 3532585 - RNA, 24 nt, Pseudomonas putida KT2440
cgccugccgccuguguucgcugcg

SEQ ID NO: 3532586 - RNA, 16 nt, Pseudomonas putida KT2440
cgccugccuggcccuc

SEQ ID NO: 3532587 - RNA, 14 nt, Pseudomonas putida KT2440
cgccugcgcacggc

SEQ ID NO: 3532588 - RNA, 19 nt, Pseudomonas putida KT2440
cgccugcgcacggcgcugg

SEQ ID NO: 3532589 - RNA, 13 nt, Pseudomonas putida KT2440
cgccugcgccagc

SEQ ID NO: 3532590 - RNA, 14 nt, Pseudomonas putida KT2440
cgccugcgccagcg

SEQ ID NO: 3532591 - RNA, 17 nt, Pseudomonas putida KT2440
cgccugcgccagcgggu

SEQ ID NO: 3532592 - RNA, 16 nt, Pseudomonas putida KT2440
cgccugcgccagugcc

SEQ ID NO: 3532593 - RNA, 23 nt, Pseudomonas putida KT2440
cgccugcggcaucagggcccggg

SEQ ID NO: 3532594 - RNA, 17 nt, Pseudomonas putida KT2440
cgccugcucaaucaacc

SEQ ID NO: 3532595 - RNA, 22 nt, Pseudomonas putida KT2440
cgccugcugccaggccgcacgc

SEQ ID NO: 3532596 - RNA, 20 nt, Pseudomonas putida KT2440
cgccugcuuggccgacuggc

SEQ ID NO: 3532597 - RNA, 20 nt, Pseudomonas putida KT2440
cgccuggacgguauaggccc

SEQ ID NO: 3532598 - RNA, 22 nt, Pseudomonas putida KT2440
cgccuggacgguauaggccccg

SEQ ID NO: 3532599 - RNA, 15 nt, Pseudomonas putida KT2440
cgccuggccgcugcg

SEQ ID NO: 3532600 - RNA, 14 nt, Pseudomonas putida KT2440
cgccuggccggccg

SEQ ID NO: 3532601 - RNA, 12 nt, Pseudomonas putida KT2440
cgccuggcgcag

SEQ ID NO: 3532602 - RNA, 19 nt, Pseudomonas putida KT2440
cgccuggcgccugcgccag

SEQ ID NO: 3532603 - RNA, 14 nt, Pseudomonas putida KT2440
cgccuggugccagc

SEQ ID NO: 3532604 - RNA, 17 nt, Pseudomonas putida KT2440
cgccuggugccagcggc

SEQ ID NO: 3532605 - RNA, 19 nt, Pseudomonas putida KT2440
cgccuggugccagcggcca

SEQ ID NO: 3532606 - RNA, 20 nt, Pseudomonas putida KT2440
cgccugugagaucgagcgcc

SEQ ID NO: 3532607 - RNA, 21 nt, Pseudomonas putida KT2440
cgccugugagaucgagcgccg

SEQ ID NO: 3532608 - RNA, 20 nt, Pseudomonas putida KT2440
cgccugugcggccaaugcac

SEQ ID NO: 3532609 - RNA, 19 nt, Pseudomonas putida KT2440
cgccuucacugcgcggugc

SEQ ID NO: 3532610 - RNA, 17 nt, Pseudomonas putida KT2440
cgccuucagcagccggu

SEQ ID NO: 3532611 - RNA, 22 nt, Pseudomonas putida KT2440
cgccuucagcgccccaucauuu

SEQ ID NO: 3532612 - RNA, 22 nt, Pseudomonas putida KT2440
cgccuucauaggcggccacggc

SEQ ID NO: 3532613 - RNA, 17 nt, Pseudomonas putida KT2440
cgccuucgcccgaccgc

SEQ ID NO: 3532614 - RNA, 22 nt, Pseudomonas putida KT2440
cgccuucgcccgaccgccagcc

SEQ ID NO: 3532615 - RNA, 20 nt, Pseudomonas putida KT2440
cgccuucguacaucggguaa

SEQ ID NO: 3532616 - RNA, 14 nt, Pseudomonas putida KT2440
cgccuucuccagcu

SEQ ID NO: 3532617 - RNA, 20 nt, Pseudomonas putida KT2440
cgccuugaggaccuugcggg

SEQ ID NO: 3532618 - RNA, 20 nt, Pseudomonas putida KT2440
cgccuugauuaccagcgccc

SEQ ID NO: 3532619 - RNA, 16 nt, Pseudomonas putida KT2440
cgccuugcuuggcagc

SEQ ID NO: 3532620 - RNA, 14 nt, Pseudomonas putida KT2440
cgccuuggcagccu

SEQ ID NO: 3532621 - RNA, 13 nt, Pseudomonas putida KT2440
cgccuuggcgcag

SEQ ID NO: 3532622 - RNA, 15 nt, Pseudomonas putida KT2440
cgccuuggcgcagca

SEQ ID NO: 3532623 - RNA, 22 nt, Pseudomonas putida KT2440
cgccuugggcaacaccgccaga

SEQ ID NO: 3532624 - RNA, 20 nt, Pseudomonas putida KT2440
cgccuugucggcacgcgcca

SEQ ID NO: 3532625 - RNA, 15 nt, Pseudomonas putida KT2440
cgccuuucaggucga

SEQ ID NO: 3532626 - RNA, 15 nt, Pseudomonas putida KT2440
cgccuuuuccaccag

SEQ ID NO: 3532627 - RNA, 17 nt, Pseudomonas putida KT2440
cgccuuuuccaccagcc

SEQ ID NO: 3532628 - RNA, 19 nt, Pseudomonas putida KT2440
cgcgaaaagccugcaccag

SEQ ID NO: 3532629 - RNA, 15 nt, Pseudomonas putida KT2440
cgcgaaacacagcag

SEQ ID NO: 3532630 - RNA, 21 nt, Pseudomonas putida KT2440
cgcgaaacacagcaggccaag

SEQ ID NO: 3532631 - RNA, 15 nt, Pseudomonas putida KT2440
cgcgaaacgcggcaa

SEQ ID NO: 3532632 - RNA, 16 nt, Pseudomonas putida KT2440
cgcgaaagggccagca

SEQ ID NO: 3532633 - RNA, 15 nt, Pseudomonas putida KT2440
cgcgaaagggccgca

SEQ ID NO: 3532634 - RNA, 15 nt, Pseudomonas putida KT2440
cgcgaaagggccgcg

SEQ ID NO: 3532635 - RNA, 16 nt, Pseudomonas putida KT2440
cgcgaaaggggcgcaa

SEQ ID NO: 3532636 - RNA, 20 nt, Pseudomonas putida KT2440
cgcgaaaggggcgcaaugcg

SEQ ID NO: 3532637 - RNA, 22 nt, Pseudomonas putida KT2440
cgcgaacaccggcagagccggu

SEQ ID NO: 3532638 - RNA, 14 nt, Pseudomonas putida KT2440
cgcgaacaggcccu

SEQ ID NO: 3532639 - RNA, 19 nt, Pseudomonas putida KT2440
cgcgaacgacuucggcaac

SEQ ID NO: 3532640 - RNA, 16 nt, Pseudomonas putida KT2440
cgcgaagaggccagca

SEQ ID NO: 3532641 - RNA, 17 nt, Pseudomonas putida KT2440
cgcgaagaggccagcac

SEQ ID NO: 3532642 - RNA, 19 nt, Pseudomonas putida KT2440
cgcgaagaggccagcacag

SEQ ID NO: 3532643 - RNA, 15 nt, Pseudomonas putida KT2440
cgcgaagaggccagg

SEQ ID NO: 3532644 - RNA, 19 nt, Pseudomonas putida KT2440
cgcgaagaggccggccccg

SEQ ID NO: 3532645 - RNA, 23 nt, Pseudomonas putida KT2440
cgcgaagaggccggccccggcaa

SEQ ID NO: 3532646 - RNA, 20 nt, Pseudomonas putida KT2440
cgcgaagaggccgguacagg

SEQ ID NO: 3532647 - RNA, 22 nt, Pseudomonas putida KT2440
cgcgaagaggccgguacugccc

SEQ ID NO: 3532648 - RNA, 22 nt, Pseudomonas putida KT2440
cgcgaagagggcgacaccgguc

SEQ ID NO: 3532649 - RNA, 14 nt, Pseudomonas putida KT2440
cgcgaagcaggcug

SEQ ID NO: 3532650 - RNA, 14 nt, Pseudomonas putida KT2440
cgcgaagggccgca

SEQ ID NO: 3532651 - RNA, 20 nt, Pseudomonas putida KT2440
cgcgaagggccgcaaagcgg

SEQ ID NO: 3532652 - RNA, 20 nt, Pseudomonas putida KT2440
cgcgaagggcugccgcgcag

SEQ ID NO: 3532653 - RNA, 22 nt, Pseudomonas putida KT2440
cgcgaaggggccggcacaggcu

SEQ ID NO: 3532654 - RNA, 18 nt, Pseudomonas putida KT2440
cgcgaauacgauagcggc

SEQ ID NO: 3532655 - RNA, 22 nt, Pseudomonas putida KT2440
cgcgaauacgguggcggcagca

SEQ ID NO: 3532656 - RNA, 12 nt, Pseudomonas putida KT2440
cgcgaaucacca

SEQ ID NO: 3532657 - RNA, 17 nt, Pseudomonas putida KT2440
cgcgaaucgccagggcu

SEQ ID NO: 3532658 - RNA, 22 nt, Pseudomonas putida KT2440
cgcgaaucgccuucagcgcccc

SEQ ID NO: 3532659 - RNA, 15 nt, Pseudomonas putida KT2440
cgcgaaugcuacaga

SEQ ID NO: 3532660 - RNA, 14 nt, Pseudomonas putida KT2440
cgcgaaugcuccgg

SEQ ID NO: 3532661 - RNA, 18 nt, Pseudomonas putida KT2440
cgcgaaugcuccggcgac

SEQ ID NO: 3532662 - RNA, 22 nt, Pseudomonas putida KT2440
cgcgaaugggccgcaaagcggc

SEQ ID NO: 3532663 - RNA, 15 nt, Pseudomonas putida KT2440
cgcgaaugggccgcc

SEQ ID NO: 3532664 - RNA, 18 nt, Pseudomonas putida KT2440
cgcgaaugggcugcaaag

SEQ ID NO: 3532665 - RNA, 22 nt, Pseudomonas putida KT2440
cgcgaauguucucggucacgac

SEQ ID NO: 3532666 - RNA, 16 nt, Pseudomonas putida KT2440
cgcgacagcguugcuc

SEQ ID NO: 3532667 - RNA, 15 nt, Pseudomonas putida KT2440
cgcgacagggcgccc

SEQ ID NO: 3532668 - RNA, 18 nt, Pseudomonas putida KT2440
cgcgacaguucgccaccc

SEQ ID NO: 3532669 - RNA, 18 nt, Pseudomonas putida KT2440
cgcgacaugaucagcggg

SEQ ID NO: 3532670 - RNA, 19 nt, Pseudomonas putida KT2440
cgcgaccaucaccgccagc

SEQ ID NO: 3532671 - RNA, 14 nt, Pseudomonas putida KT2440
cgcgaccucagccg

SEQ ID NO: 3532672 - RNA, 15 nt, Pseudomonas putida KT2440
cgcgaccucagccgu

SEQ ID NO: 3532673 - RNA, 21 nt, Pseudomonas putida KT2440
cgcgacgaagaugucgaugua

SEQ ID NO: 3532674 - RNA, 19 nt, Pseudomonas putida KT2440
cgcgacgauggacagccca

SEQ ID NO: 3532675 - RNA, 13 nt, Pseudomonas putida KT2440
cgcgacgcagcag

SEQ ID NO: 3532676 - RNA, 14 nt, Pseudomonas putida KT2440
cgcgacgcagcagc

SEQ ID NO: 3532677 - RNA, 15 nt, Pseudomonas putida KT2440
cgcgacgcagcagcg

SEQ ID NO: 3532678 - RNA, 14 nt, Pseudomonas putida KT2440
cgcgacgggcugcu

SEQ ID NO: 3532679 - RNA, 23 nt, Pseudomonas putida KT2440
cgcgacgguugacagcacggccu

SEQ ID NO: 3532680 - RNA, 18 nt, Pseudomonas putida KT2440
cgcgacuccugugggagc

SEQ ID NO: 3532681 - RNA, 19 nt, Pseudomonas putida KT2440
cgcgacugaagcgcggguc

SEQ ID NO: 3532682 - RNA, 21 nt, Pseudomonas putida KT2440
cgcgagaaugcugcgcagcug

SEQ ID NO: 3532683 - RNA, 20 nt, Pseudomonas putida KT2440
cgcgagcaagcucgcuccua

SEQ ID NO: 3532684 - RNA, 19 nt, Pseudomonas putida KT2440
cgcgagccagaucauggcg

SEQ ID NO: 3532685 - RNA, 18 nt, Pseudomonas putida KT2440
cgcgagccuugccaacgg

SEQ ID NO: 3532686 - RNA, 19 nt, Pseudomonas putida KT2440
cgcgagcgucucgccaaac

SEQ ID NO: 3532687 - RNA, 20 nt, Pseudomonas putida KT2440
cgcgagcgucucgccaaacu

SEQ ID NO: 3532688 - RNA, 19 nt, Pseudomonas putida KT2440
cgcgagcguuaccaacagu

SEQ ID NO: 3532689 - RNA, 21 nt, Pseudomonas putida KT2440
cgcgagcguuaccaacaguug

SEQ ID NO: 3532690 - RNA, 17 nt, Pseudomonas putida KT2440
cgcgaggaaacccgcgc

SEQ ID NO: 3532691 - RNA, 12 nt, Pseudomonas putida KT2440
cgcgaggcucuu

SEQ ID NO: 3532692 - RNA, 21 nt, Pseudomonas putida KT2440
cgcgagggcaucagcgcaccc

SEQ ID NO: 3532693 - RNA, 17 nt, Pseudomonas putida KT2440
cgcgaguaaagccagca

SEQ ID NO: 3532694 - RNA, 19 nt, Pseudomonas putida KT2440
cgcgaguaaagccagcagc

SEQ ID NO: 3532695 - RNA, 18 nt, Pseudomonas putida KT2440
cgcgaguaacgcccuuca

SEQ ID NO: 3532696 - RNA, 19 nt, Pseudomonas putida KT2440
cgcgagucaggcugcacaa

SEQ ID NO: 3532697 - RNA, 22 nt, Pseudomonas putida KT2440
cgcgaguccuccaacucgcgca

SEQ ID NO: 3532698 - RNA, 19 nt, Pseudomonas putida KT2440
cgcgagugucgaugucgau

SEQ ID NO: 3532699 - RNA, 14 nt, Pseudomonas putida KT2440
cgcgauagccugug

SEQ ID NO: 3532700 - RNA, 20 nt, Pseudomonas putida KT2440
cgcgauagccuguggggcaa

SEQ ID NO: 3532701 - RNA, 24 nt, Pseudomonas putida KT2440
cgcgauagccuguggggcaacugc

SEQ ID NO: 3532702 - RNA, 13 nt, Pseudomonas putida KT2440
cgcgauagcucag

SEQ ID NO: 3532703 - RNA, 20 nt, Pseudomonas putida KT2440
cgcgauagggaucaccucgu

SEQ ID NO: 3532704 - RNA, 22 nt, Pseudomonas putida KT2440
cgcgauagggcugcggggcagc

SEQ ID NO: 3532705 - RNA, 19 nt, Pseudomonas putida KT2440
cgcgauaucagcgccagca

SEQ ID NO: 3532706 - RNA, 20 nt, Pseudomonas putida KT2440
cgcgauaucagcgccagcac

SEQ ID NO: 3532707 - RNA, 20 nt, Pseudomonas putida KT2440
cgcgauauucagugcgcagg

SEQ ID NO: 3532708 - RNA, 21 nt, Pseudomonas putida KT2440
cgcgauauucagugcgcaggu

SEQ ID NO: 3532709 - RNA, 17 nt, Pseudomonas putida KT2440
cgcgaucacgcaggccc

SEQ ID NO: 3532710 - RNA, 18 nt, Pseudomonas putida KT2440
cgcgaucccugugggagc

SEQ ID NO: 3532711 - RNA, 23 nt, Pseudomonas putida KT2440
cgcgaucgcuuguaggagcgggu

SEQ ID NO: 3532712 - RNA, 21 nt, Pseudomonas putida KT2440
cgcgaugccgacagccaccgc

SEQ ID NO: 3532713 - RNA, 13 nt, Pseudomonas putida KT2440
cgcgaugcgccgc

SEQ ID NO: 3532714 - RNA, 15 nt, Pseudomonas putida KT2440
cgcgaugcgccgcgc

SEQ ID NO: 3532715 - RNA, 15 nt, Pseudomonas putida KT2440
cgcgauggauggcac

SEQ ID NO: 3532716 - RNA, 19 nt, Pseudomonas putida KT2440
cgcgaugggcugcaaagca

SEQ ID NO: 3532717 - RNA, 20 nt, Pseudomonas putida KT2440
cgcgaugggcugcaaagcag

SEQ ID NO: 3532718 - RNA, 17 nt, Pseudomonas putida KT2440
cgcgauucguagcgguu

SEQ ID NO: 3532719 - RNA, 17 nt, Pseudomonas putida KT2440
cgcgauugaucagcgcc

SEQ ID NO: 3532720 - RNA, 19 nt, Pseudomonas putida KT2440
cgcgauugaucagcgccuc

SEQ ID NO: 3532721 - RNA, 20 nt, Pseudomonas putida KT2440
cgcgcaaaugcuugcccgcc

SEQ ID NO: 3532722 - RNA, 22 nt, Pseudomonas putida KT2440
cgcgcaaaugcuugcccgccuu

SEQ ID NO: 3532723 - RNA, 16 nt, Pseudomonas putida KT2440
cgcgcaacaaggccaa

SEQ ID NO: 3532724 - RNA, 17 nt, Pseudomonas putida KT2440
cgcgcaacaccgccagc

SEQ ID NO: 3532725 - RNA, 18 nt, Pseudomonas putida KT2440
cgcgcaacaccgccagcg

SEQ ID NO: 3532726 - RNA, 18 nt, Pseudomonas putida KT2440
cgcgcaacacuucaggcu

SEQ ID NO: 3532727 - RNA, 13 nt, Pseudomonas putida KT2440
cgcgcaacagcaa

SEQ ID NO: 3532728 - RNA, 12 nt, Pseudomonas putida KT2440
cgcgcaacugcc

SEQ ID NO: 3532729 - RNA, 14 nt, Pseudomonas putida KT2440
cgcgcaagcaggug

SEQ ID NO: 3532730 - RNA, 15 nt, Pseudomonas putida KT2440
cgcgcaagccgcugu

SEQ ID NO: 3532731 - RNA, 19 nt, Pseudomonas putida KT2440
cgcgcaagcguucgagcau

SEQ ID NO: 3532732 - RNA, 21 nt, Pseudomonas putida KT2440
cgcgcaccaccugaugcacca

SEQ ID NO: 3532733 - RNA, 19 nt, Pseudomonas putida KT2440
cgcgcaccaucggcuccag

SEQ ID NO: 3532734 - RNA, 15 nt, Pseudomonas putida KT2440
cgcgcaccuccugcg

SEQ ID NO: 3532735 - RNA, 20 nt, Pseudomonas putida KT2440
cgcgcacgguaggugaugcg

SEQ ID NO: 3532736 - RNA, 15 nt, Pseudomonas putida KT2440
cgcgcacuugccagc

SEQ ID NO: 3532737 - RNA, 16 nt, Pseudomonas putida KT2440
cgcgcagacgggcgac

SEQ ID NO: 3532738 - RNA, 17 nt, Pseudomonas putida KT2440
cgcgcagacgggcgacg

SEQ ID NO: 3532739 - RNA, 15 nt, Pseudomonas putida KT2440
cgcgcagagaagccg

SEQ ID NO: 3532740 - RNA, 22 nt, Pseudomonas putida KT2440
cgcgcagcacaucacacagcgg

SEQ ID NO: 3532741 - RNA, 15 nt, Pseudomonas putida KT2440
cgcgcagcacuuccu

SEQ ID NO: 3532742 - RNA, 13 nt, Pseudomonas putida KT2440
cgcgcagcaucug

SEQ ID NO: 3532743 - RNA, 13 nt, Pseudomonas putida KT2440
cgcgcagcggccc

SEQ ID NO: 3532744 - RNA, 19 nt, Pseudomonas putida KT2440
cgcgcagcggccccuuuca

SEQ ID NO: 3532745 - RNA, 12 nt, Pseudomonas putida KT2440
cgcgcaggccac

SEQ ID NO: 3532746 - RNA, 14 nt, Pseudomonas putida KT2440
cgcgcaggcgcugc

SEQ ID NO: 3532747 - RNA, 21 nt, Pseudomonas putida KT2440
cgcgcagggugccggccagcg

SEQ ID NO: 3532748 - RNA, 16 nt, Pseudomonas putida KT2440
cgcgcaggguuuucag

SEQ ID NO: 3532749 - RNA, 20 nt, Pseudomonas putida KT2440
cgcgcaggguuuucagcgcc

SEQ ID NO: 3532750 - RNA, 23 nt, Pseudomonas putida KT2440
cgcgcaggguuuucagcgccgca

SEQ ID NO: 3532751 - RNA, 17 nt, Pseudomonas putida KT2440
cgcgcagguuguucggc

SEQ ID NO: 3532752 - RNA, 13 nt, Pseudomonas putida KT2440
cgcgcaucagccg

SEQ ID NO: 3532753 - RNA, 16 nt, Pseudomonas putida KT2440
cgcgcaucagccgcgc

SEQ ID NO: 3532754 - RNA, 20 nt, Pseudomonas putida KT2440
cgcgcaucagccgcgcccuc

SEQ ID NO: 3532755 - RNA, 17 nt, Pseudomonas putida KT2440
cgcgcaucauccaccac

SEQ ID NO: 3532756 - RNA, 15 nt, Pseudomonas putida KT2440
cgcgcauccacaggc

SEQ ID NO: 3532757 - RNA, 18 nt, Pseudomonas putida KT2440
cgcgcauccacaggcgcc

SEQ ID NO: 3532758 - RNA, 14 nt, Pseudomonas putida KT2440
cgcgcauccagcag

SEQ ID NO: 3532759 - RNA, 16 nt, Pseudomonas putida KT2440
cgcgcauccagccaga

SEQ ID NO: 3532760 - RNA, 17 nt, Pseudomonas putida KT2440
cgcgcauccagccagau

SEQ ID NO: 3532761 - RNA, 23 nt, Pseudomonas putida KT2440
cgcgcauccggaauuucugcacc

SEQ ID NO: 3532762 - RNA, 23 nt, Pseudomonas putida KT2440
cgcgcauccuccgcccugcccuc

SEQ ID NO: 3532763 - RNA, 21 nt, Pseudomonas putida KT2440
cgcgcaugaaggacaucacca

SEQ ID NO: 3532764 - RNA, 24 nt, Pseudomonas putida KT2440
cgcgcaugaaggacaucaccaggc

SEQ ID NO: 3532765 - RNA, 21 nt, Pseudomonas putida KT2440
cgcgcaugaugaaguggcgca

SEQ ID NO: 3532766 - RNA, 22 nt, Pseudomonas putida KT2440
cgcgcaugaugaaguggcgcag

SEQ ID NO: 3532767 - RNA, 16 nt, Pseudomonas putida KT2440
cgcgcaugcugccagg

SEQ ID NO: 3532768 - RNA, 18 nt, Pseudomonas putida KT2440
cgcgcaugcugugcccug

SEQ ID NO: 3532769 - RNA, 12 nt, Pseudomonas putida KT2440
cgcgcauggccg

SEQ ID NO: 3532770 - RNA, 17 nt, Pseudomonas putida KT2440
cgcgcauuucguccagg

SEQ ID NO: 3532771 - RNA, 18 nt, Pseudomonas putida KT2440
cgcgcauuucguccaggc

SEQ ID NO: 3532772 - RNA, 20 nt, Pseudomonas putida KT2440
cgcgcauuucguccaggcuc

SEQ ID NO: 3532773 - RNA, 17 nt, Pseudomonas putida KT2440
cgcgcauuugcuccagg

SEQ ID NO: 3532774 - RNA, 15 nt, Pseudomonas putida KT2440
cgcgccaaagccugg

SEQ ID NO: 3532775 - RNA, 18 nt, Pseudomonas putida KT2440
cgcgccaaccgcgccagc

SEQ ID NO: 3532776 - RNA, 20 nt, Pseudomonas putida KT2440
cgcgccaaccgcgccagcaa

SEQ ID NO: 3532777 - RNA, 22 nt, Pseudomonas putida KT2440
cgcgccaaccgcgccagcaaug

SEQ ID NO: 3532778 - RNA, 15 nt, Pseudomonas putida KT2440
cgcgccaccagcccc

SEQ ID NO: 3532779 - RNA, 13 nt, Pseudomonas putida KT2440
cgcgccaccgccg

SEQ ID NO: 3532780 - RNA, 18 nt, Pseudomonas putida KT2440
cgcgccaccgccgugccg

SEQ ID NO: 3532781 - RNA, 21 nt, Pseudomonas putida KT2440
cgcgccaccgggcgcgauugc

SEQ ID NO: 3532782 - RNA, 16 nt, Pseudomonas putida KT2440
cgcgccacgcaccagg

SEQ ID NO: 3532783 - RNA, 14 nt, Pseudomonas putida KT2440
cgcgccacucccau

SEQ ID NO: 3532784 - RNA, 12 nt, Pseudomonas putida KT2440
cgcgccagcagc

SEQ ID NO: 3532785 - RNA, 14 nt, Pseudomonas putida KT2440
cgcgccagcagcgc

SEQ ID NO: 3532786 - RNA, 13 nt, Pseudomonas putida KT2440
cgcgccagccugg

SEQ ID NO: 3532787 - RNA, 13 nt, Pseudomonas putida KT2440
cgcgccagcgcau

SEQ ID NO: 3532788 - RNA, 16 nt, Pseudomonas putida KT2440
cgcgccagcgcaugca

SEQ ID NO: 3532789 - RNA, 14 nt, Pseudomonas putida KT2440
cgcgccagcggcca

SEQ ID NO: 3532790 - RNA, 16 nt, Pseudomonas putida KT2440
cgcgccagcggccagc

SEQ ID NO: 3532791 - RNA, 19 nt, Pseudomonas putida KT2440
cgcgccagcggccagcgcc

SEQ ID NO: 3532792 - RNA, 12 nt, Pseudomonas putida KT2440
cgcgccagcggg

SEQ ID NO: 3532793 - RNA, 22 nt, Pseudomonas putida KT2440
cgcgccagcgggucgucgccca

SEQ ID NO: 3532794 - RNA, 13 nt, Pseudomonas putida KT2440
cgcgccagcucca

SEQ ID NO: 3532795 - RNA, 15 nt, Pseudomonas putida KT2440
cgcgccagcuccaca

SEQ ID NO: 3532796 - RNA, 16 nt, Pseudomonas putida KT2440
cgcgccaggcugcgcu

SEQ ID NO: 3532797 - RNA, 16 nt, Pseudomonas putida KT2440
cgcgccagggcaacgg

SEQ ID NO: 3532798 - RNA, 16 nt, Pseudomonas putida KT2440
cgcgccaggucggaca

SEQ ID NO: 3532799 - RNA, 19 nt, Pseudomonas putida KT2440
cgcgccaggucggcggggc

SEQ ID NO: 3532800 - RNA, 18 nt, Pseudomonas putida KT2440
cgcgccaguuccacgacc

SEQ ID NO: 3532801 - RNA, 18 nt, Pseudomonas putida KT2440
cgcgccaguucgacgcug

SEQ ID NO: 3532802 - RNA, 18 nt, Pseudomonas putida KT2440
cgcgccaguucgcggcgc

SEQ ID NO: 3532803 - RNA, 15 nt, Pseudomonas putida KT2440
cgcgccaucagcugc

SEQ ID NO: 3532804 - RNA, 15 nt, Pseudomonas putida KT2440
cgcgccauccgccac

SEQ ID NO: 3532805 - RNA, 17 nt, Pseudomonas putida KT2440
cgcgccaugccccuacc

SEQ ID NO: 3532806 - RNA, 21 nt, Pseudomonas putida KT2440
cgcgccaugccccuaccgcca

SEQ ID NO: 3532807 - RNA, 13 nt, Pseudomonas putida KT2440
cgcgccauggccu

SEQ ID NO: 3532808 - RNA, 16 nt, Pseudomonas putida KT2440
cgcgccauggccuggc

SEQ ID NO: 3532809 - RNA, 14 nt, Pseudomonas putida KT2440
cgcgccauuggccg

SEQ ID NO: 3532810 - RNA, 19 nt, Pseudomonas putida KT2440
cgcgccauuggccgcgcgc

SEQ ID NO: 3532811 - RNA, 20 nt, Pseudomonas putida KT2440
cgcgccauuggccgcgcgcc

SEQ ID NO: 3532812 - RNA, 21 nt, Pseudomonas putida KT2440
cgcgccauuggccgcgcgccc

SEQ ID NO: 3532813 - RNA, 21 nt, Pseudomonas putida KT2440
cgcgcccacagugucccggcc

SEQ ID NO: 3532814 - RNA, 13 nt, Pseudomonas putida KT2440
cgcgcccaggccc

SEQ ID NO: 3532815 - RNA, 16 nt, Pseudomonas putida KT2440
cgcgcccaucugcacg

SEQ ID NO: 3532816 - RNA, 22 nt, Pseudomonas putida KT2440
cgcgcccccgcucccacagggg

SEQ ID NO: 3532817 - RNA, 15 nt, Pseudomonas putida KT2440
cgcgcccgcagugca

SEQ ID NO: 3532818 - RNA, 22 nt, Pseudomonas putida KT2440
cgcgcccgcgaagaggccggca

SEQ ID NO: 3532819 - RNA, 14 nt, Pseudomonas putida KT2440
cgcgcccggcgcau

SEQ ID NO: 3532820 - RNA, 16 nt, Pseudomonas putida KT2440
cgcgcccggcuugccc

SEQ ID NO: 3532821 - RNA, 18 nt, Pseudomonas putida KT2440
cgcgcccggcuugcccgg

SEQ ID NO: 3532822 - RNA, 20 nt, Pseudomonas putida KT2440
cgcgcccggcuugcccgggc

SEQ ID NO: 3532823 - RNA, 14 nt, Pseudomonas putida KT2440
cgcgcccucuuccg

SEQ ID NO: 3532824 - RNA, 14 nt, Pseudomonas putida KT2440
cgcgcccugcucau

SEQ ID NO: 3532825 - RNA, 19 nt, Pseudomonas putida KT2440
cgcgcccugcucauccagc

SEQ ID NO: 3532826 - RNA, 20 nt, Pseudomonas putida KT2440
cgcgcccugcucauccagca

SEQ ID NO: 3532827 - RNA, 15 nt, Pseudomonas putida KT2440
cgcgcccugugggag

SEQ ID NO: 3532828 - RNA, 18 nt, Pseudomonas putida KT2440
cgcgccgacagccucaag

SEQ ID NO: 3532829 - RNA, 13 nt, Pseudomonas putida KT2440
cgcgccgaccagu

SEQ ID NO: 3532830 - RNA, 14 nt, Pseudomonas putida KT2440
cgcgccgaccagua

SEQ ID NO: 3532831 - RNA, 18 nt, Pseudomonas putida KT2440
cgcgccgauugcugccga

SEQ ID NO: 3532832 - RNA, 14 nt, Pseudomonas putida KT2440
cgcgccgccaaccc

SEQ ID NO: 3532833 - RNA, 15 nt, Pseudomonas putida KT2440
cgcgccgccaacccc

SEQ ID NO: 3532834 - RNA, 13 nt, Pseudomonas putida KT2440
cgcgccgcccagc

SEQ ID NO: 3532835 - RNA, 12 nt, Pseudomonas putida KT2440
cgcgccgccgca

SEQ ID NO: 3532836 - RNA, 21 nt, Pseudomonas putida KT2440
cgcgccgccgcugcugcgccu

SEQ ID NO: 3532837 - RNA, 22 nt, Pseudomonas putida KT2440
cgcgccgccgcugcugcgccuc

SEQ ID NO: 3532838 - RNA, 15 nt, Pseudomonas putida KT2440
cgcgccggcgucgau

SEQ ID NO: 3532839 - RNA, 19 nt, Pseudomonas putida KT2440
cgcgccggcgucgaucugc

SEQ ID NO: 3532840 - RNA, 16 nt, Pseudomonas putida KT2440
cgcgccuacagcggcc

SEQ ID NO: 3532841 - RNA, 22 nt, Pseudomonas putida KT2440
cgcgccuacagcggccugugca

SEQ ID NO: 3532842 - RNA, 13 nt, Pseudomonas putida KT2440
cgcgccuacaggc

SEQ ID NO: 3532843 - RNA, 20 nt, Pseudomonas putida KT2440
cgcgccuacaggcaaccgca

SEQ ID NO: 3532844 - RNA, 18 nt, Pseudomonas putida KT2440
cgcgccuacgacggccug

SEQ ID NO: 3532845 - RNA, 12 nt, Pseudomonas putida KT2440
cgcgccuccagc

SEQ ID NO: 3532846 - RNA, 16 nt, Pseudomonas putida KT2440
cgcgccucgcggugca

SEQ ID NO: 3532847 - RNA, 13 nt, Pseudomonas putida KT2440
cgcgccugcaccu

SEQ ID NO: 3532848 - RNA, 15 nt, Pseudomonas putida KT2440
cgcgccuggcucgau

SEQ ID NO: 3532849 - RNA, 23 nt, Pseudomonas putida KT2440
cgcgccuggucgccgccacccac

SEQ ID NO: 3532850 - RNA, 20 nt, Pseudomonas putida KT2440
cgcgccuucauaggcggcca

SEQ ID NO: 3532851 - RNA, 14 nt, Pseudomonas putida KT2440
cgcgccuucgcugg

SEQ ID NO: 3532852 - RNA, 17 nt, Pseudomonas putida KT2440
cgcgccuucgcuggcga

SEQ ID NO: 3532853 - RNA, 23 nt, Pseudomonas putida KT2440
cgcgccuucgcuggcgacgaagc

SEQ ID NO: 3532854 - RNA, 23 nt, Pseudomonas putida KT2440
cgcgccuugaggaccuugcgggu

SEQ ID NO: 3532855 - RNA, 22 nt, Pseudomonas putida KT2440
cgcgccuugauacgcccaucca

SEQ ID NO: 3532856 - RNA, 15 nt, Pseudomonas putida KT2440
cgcgccuugcgcacg

SEQ ID NO: 3532857 - RNA, 17 nt, Pseudomonas putida KT2440
cgcgccuugcgccaggu

SEQ ID NO: 3532858 - RNA, 16 nt, Pseudomonas putida KT2440
cgcgcgaaggcccgcu

SEQ ID NO: 3532859 - RNA, 22 nt, Pseudomonas putida KT2440
cgcgcgacagcacgggcacacu

SEQ ID NO: 3532860 - RNA, 16 nt, Pseudomonas putida KT2440
cgcgcgaugcgccgcg

SEQ ID NO: 3532861 - RNA, 17 nt, Pseudomonas putida KT2440
cgcgcgcagacgggcga

SEQ ID NO: 3532862 - RNA, 16 nt, Pseudomonas putida KT2440
cgcgcgcccaggccca

SEQ ID NO: 3532863 - RNA, 14 nt, Pseudomonas putida KT2440
cgcgcgcgacagca

SEQ ID NO: 3532864 - RNA, 13 nt, Pseudomonas putida KT2440
cgcgcgcgaccgc

SEQ ID NO: 3532865 - RNA, 15 nt, Pseudomonas putida KT2440
cgcgcggcgcaucgc

SEQ ID NO: 3532866 - RNA, 16 nt, Pseudomonas putida KT2440
cgcgcggcucggccac

SEQ ID NO: 3532867 - RNA, 21 nt, Pseudomonas putida KT2440
cgcgcgggcaauggccacacg

SEQ ID NO: 3532868 - RNA, 14 nt, Pseudomonas putida KT2440
cgcgcgggcucugu

SEQ ID NO: 3532869 - RNA, 13 nt, Pseudomonas putida KT2440
cgcgcgggugcga

SEQ ID NO: 3532870 - RNA, 21 nt, Pseudomonas putida KT2440
cgcgcgggugcgagaggcgcu

SEQ ID NO: 3532871 - RNA, 17 nt, Pseudomonas putida KT2440
cgcgcgguuaagcgcca

SEQ ID NO: 3532872 - RNA, 18 nt, Pseudomonas putida KT2440
cgcgcgguucaccagcag

SEQ ID NO: 3532873 - RNA, 20 nt, Pseudomonas putida KT2440
cgcgcuaaaggccgcuccug

SEQ ID NO: 3532874 - RNA, 22 nt, Pseudomonas putida KT2440
cgcgcuaaaggccgcuccugca

SEQ ID NO: 3532875 - RNA, 23 nt, Pseudomonas putida KT2440
cgcgcuaaaggccgcuccugcac

SEQ ID NO: 3532876 - RNA, 14 nt, Pseudomonas putida KT2440
cgcgcugagcaggu

SEQ ID NO: 3532877 - RNA, 14 nt, Pseudomonas putida KT2440
cgcgcugcagcucc

SEQ ID NO: 3532878 - RNA, 15 nt, Pseudomonas putida KT2440
cgcgcugccaggccg

SEQ ID NO: 3532879 - RNA, 15 nt, Pseudomonas putida KT2440
cgcgcugcgcaagga

SEQ ID NO: 3532880 - RNA, 14 nt, Pseudomonas putida KT2440
cgcgcuggcacugc

SEQ ID NO: 3532881 - RNA, 14 nt, Pseudomonas putida KT2440
cgcgcuggccgccc

SEQ ID NO: 3532882 - RNA, 23 nt, Pseudomonas putida KT2440
cgcgcuggccgcccgcccgcguc

SEQ ID NO: 3532883 - RNA, 18 nt, Pseudomonas putida KT2440
cgcgcuggcgcuggucaa

SEQ ID NO: 3532884 - RNA, 23 nt, Pseudomonas putida KT2440
cgcgcugguaagccucgagcgcu

SEQ ID NO: 3532885 - RNA, 19 nt, Pseudomonas putida KT2440
cgcgcuguuccagcccggc

SEQ ID NO: 3532886 - RNA, 15 nt, Pseudomonas putida KT2440
cgcgcuucagggucg

SEQ ID NO: 3532887 - RNA, 21 nt, Pseudomonas putida KT2440
cgcgcuuggagaagcgaucga

SEQ ID NO: 3532888 - RNA, 19 nt, Pseudomonas putida KT2440
cgcgcuuggcaccggcagc

SEQ ID NO: 3532889 - RNA, 21 nt, Pseudomonas putida KT2440
cgcgcuuggcaccggcagcag

SEQ ID NO: 3532890 - RNA, 14 nt, Pseudomonas putida KT2440
cgcgcuuggccagg

SEQ ID NO: 3532891 - RNA, 16 nt, Pseudomonas putida KT2440
cgcgcuuggcggcccu

SEQ ID NO: 3532892 - RNA, 21 nt, Pseudomonas putida KT2440
cgcgcuuugugcacaagcugc

SEQ ID NO: 3532893 - RNA, 20 nt, Pseudomonas putida KT2440
cgcgcuuuucaucuucaucg

SEQ ID NO: 3532894 - RNA, 21 nt, Pseudomonas putida KT2440
cgcggaaauaccagacgcagg

SEQ ID NO: 3532895 - RNA, 13 nt, Pseudomonas putida KT2440
cgcggaacuggcu

SEQ ID NO: 3532896 - RNA, 18 nt, Pseudomonas putida KT2440
cgcggaacuggcugacca

SEQ ID NO: 3532897 - RNA, 15 nt, Pseudomonas putida KT2440
cgcggacccggcauc

SEQ ID NO: 3532898 - RNA, 19 nt, Pseudomonas putida KT2440
cgcggaccuugucgccagu

SEQ ID NO: 3532899 - RNA, 17 nt, Pseudomonas putida KT2440
cgcggaucaacccgcga

SEQ ID NO: 3532900 - RNA, 16 nt, Pseudomonas putida KT2440
cgcggaucugcugcuu

SEQ ID NO: 3532901 - RNA, 13 nt, Pseudomonas putida KT2440
cgcggaugcgccu

SEQ ID NO: 3532902 - RNA, 14 nt, Pseudomonas putida KT2440
cgcggaugcgccug

SEQ ID NO: 3532903 - RNA, 15 nt, Pseudomonas putida KT2440
cgcggaugugacgcu

SEQ ID NO: 3532904 - RNA, 21 nt, Pseudomonas putida KT2440
cgcggcaaacuucucgccuca

SEQ ID NO: 3532905 - RNA, 18 nt, Pseudomonas putida KT2440
cgcggcaaagaucgccca

SEQ ID NO: 3532906 - RNA, 21 nt, Pseudomonas putida KT2440
cgcggcaaagaucgcccagcu

SEQ ID NO: 3532907 - RNA, 19 nt, Pseudomonas putida KT2440
cgcggcaaagguggcaccg

SEQ ID NO: 3532908 - RNA, 14 nt, Pseudomonas putida KT2440
cgcggcaagcccgc

SEQ ID NO: 3532909 - RNA, 17 nt, Pseudomonas putida KT2440
cgcggcaaucacgaaca

SEQ ID NO: 3532910 - RNA, 16 nt, Pseudomonas putida KT2440
cgcggcaauccgcugg

SEQ ID NO: 3532911 - RNA, 18 nt, Pseudomonas putida KT2440
cgcggcaauccgcuggaa

SEQ ID NO: 3532912 - RNA, 22 nt, Pseudomonas putida KT2440
cgcggcacaacgcgccaccgcc

SEQ ID NO: 3532913 - RNA, 17 nt, Pseudomonas putida KT2440
cgcggcacccaauagcc

SEQ ID NO: 3532914 - RNA, 13 nt, Pseudomonas putida KT2440
cgcggcaccggcu

SEQ ID NO: 3532915 - RNA, 21 nt, Pseudomonas putida KT2440
cgcggcaccggcuugagcagu

SEQ ID NO: 3532916 - RNA, 19 nt, Pseudomonas putida KT2440
cgcggcagcaugaacagcg

SEQ ID NO: 3532917 - RNA, 20 nt, Pseudomonas putida KT2440
cgcggcagcaugaacagcgc

SEQ ID NO: 3532918 - RNA, 16 nt, Pseudomonas putida KT2440
cgcggcagcccuucgc

SEQ ID NO: 3532919 - RNA, 24 nt, Pseudomonas putida KT2440
cgcggcagcccuucgcgggcacgc

SEQ ID NO: 3532920 - RNA, 13 nt, Pseudomonas putida KT2440
cgcggcaugcccg

SEQ ID NO: 3532921 - RNA, 22 nt, Pseudomonas putida KT2440
cgcggcaugucgaugcggugcu

SEQ ID NO: 3532922 - RNA, 16 nt, Pseudomonas putida KT2440
cgcggcaugugcgggu

SEQ ID NO: 3532923 - RNA, 17 nt, Pseudomonas putida KT2440
cgcggccaacauucacg

SEQ ID NO: 3532924 - RNA, 13 nt, Pseudomonas putida KT2440
cgcggcccacagu

SEQ ID NO: 3532925 - RNA, 13 nt, Pseudomonas putida KT2440
cgcggcccagccc

SEQ ID NO: 3532926 - RNA, 19 nt, Pseudomonas putida KT2440
cgcggcccaguuucgccag

SEQ ID NO: 3532927 - RNA, 24 nt, Pseudomonas putida KT2440
cgcggccccagauucuggcaggca

SEQ ID NO: 3532928 - RNA, 15 nt, Pseudomonas putida KT2440
cgcggccccagggcu

SEQ ID NO: 3532929 - RNA, 23 nt, Pseudomonas putida KT2440
cgcggcccccuguagauaggcug

SEQ ID NO: 3532930 - RNA, 18 nt, Pseudomonas putida KT2440
cgcggcccgaucagccag

SEQ ID NO: 3532931 - RNA, 16 nt, Pseudomonas putida KT2440
cgcggccgaaacgcga

SEQ ID NO: 3532932 - RNA, 22 nt, Pseudomonas putida KT2440
cgcggccgggcuucaaacccgg

SEQ ID NO: 3532933 - RNA, 16 nt, Pseudomonas putida KT2440
cgcggccgggucgaag

SEQ ID NO: 3532934 - RNA, 18 nt, Pseudomonas putida KT2440
cgcggccuacccgggcgc

SEQ ID NO: 3532935 - RNA, 23 nt, Pseudomonas putida KT2440
cgcggccuacccgggcgcagggg

SEQ ID NO: 3532936 - RNA, 14 nt, Pseudomonas putida KT2440
cgcggccugcucca

SEQ ID NO: 3532937 - RNA, 15 nt, Pseudomonas putida KT2440
cgcggccugcuccac

SEQ ID NO: 3532938 - RNA, 16 nt, Pseudomonas putida KT2440
cgcggccuugccguag

SEQ ID NO: 3532939 - RNA, 22 nt, Pseudomonas putida KT2440
cgcggcgaacacagcggccuug

SEQ ID NO: 3532940 - RNA, 17 nt, Pseudomonas putida KT2440
cgcggcgcaucgcgagc

SEQ ID NO: 3532941 - RNA, 14 nt, Pseudomonas putida KT2440
cgcggcgcccagca

SEQ ID NO: 3532942 - RNA, 14 nt, Pseudomonas putida KT2440
cgcggcgcccuggc

SEQ ID NO: 3532943 - RNA, 18 nt, Pseudomonas putida KT2440
cgcggcgcgcccugcuca

SEQ ID NO: 3532944 - RNA, 14 nt, Pseudomonas putida KT2440
cgcggcggcaacgg

SEQ ID NO: 3532945 - RNA, 21 nt, Pseudomonas putida KT2440
cgcggcggcuaagcgccagca

SEQ ID NO: 3532946 - RNA, 19 nt, Pseudomonas putida KT2440
cgcggcguugucagccuuc

SEQ ID NO: 3532947 - RNA, 17 nt, Pseudomonas putida KT2440
cgcggcucgaugcugcg

SEQ ID NO: 3532948 - RNA, 21 nt, Pseudomonas putida KT2440
cgcggcucgcugcgcuggcca

SEQ ID NO: 3532949 - RNA, 21 nt, Pseudomonas putida KT2440
cgcggcuggugucggccaggg

SEQ ID NO: 3532950 - RNA, 14 nt, Pseudomonas putida KT2440
cgcggcuucgaugc

SEQ ID NO: 3532951 - RNA, 20 nt, Pseudomonas putida KT2440
cgcggcuucgaugcccggca

SEQ ID NO: 3532952 - RNA, 17 nt, Pseudomonas putida KT2440
cgcgggagacccguucc

SEQ ID NO: 3532953 - RNA, 19 nt, Pseudomonas putida KT2440
cgcgggagacccguuccua

SEQ ID NO: 3532954 - RNA, 17 nt, Pseudomonas putida KT2440
cgcgggcaaacccgcgc

SEQ ID NO: 3532955 - RNA, 21 nt, Pseudomonas putida KT2440
cgcgggcaaacccgcgccuac

SEQ ID NO: 3532956 - RNA, 20 nt, Pseudomonas putida KT2440
cgcgggcaagcccgcaccca

SEQ ID NO: 3532957 - RNA, 16 nt, Pseudomonas putida KT2440
cgcgggcaagcccgcg

SEQ ID NO: 3532958 - RNA, 19 nt, Pseudomonas putida KT2440
cgcgggcaagcccgcgaag

SEQ ID NO: 3532959 - RNA, 20 nt, Pseudomonas putida KT2440
cgcgggcaagcccgcuccua

SEQ ID NO: 3532960 - RNA, 12 nt, Pseudomonas putida KT2440
cgcgggcacccu

SEQ ID NO: 3532961 - RNA, 13 nt, Pseudomonas putida KT2440
cgcgggcacgccc

SEQ ID NO: 3532962 - RNA, 16 nt, Pseudomonas putida KT2440
cgcgggcacgcccgcu

SEQ ID NO: 3532963 - RNA, 20 nt, Pseudomonas putida KT2440
cgcgggcacgcccgcuccca

SEQ ID NO: 3532964 - RNA, 21 nt, Pseudomonas putida KT2440
cgcgggcacgcccgcucccac

SEQ ID NO: 3532965 - RNA, 17 nt, Pseudomonas putida KT2440
cgcgggcagaugaggaa

SEQ ID NO: 3532966 - RNA, 21 nt, Pseudomonas putida KT2440
cgcgggcaugcccgcucccac

SEQ ID NO: 3532967 - RNA, 18 nt, Pseudomonas putida KT2440
cgcgggccaaggucagca

SEQ ID NO: 3532968 - RNA, 13 nt, Pseudomonas putida KT2440
cgcgggccagccc

SEQ ID NO: 3532969 - RNA, 20 nt, Pseudomonas putida KT2440
cgcgggccagguggccuucc

SEQ ID NO: 3532970 - RNA, 12 nt, Pseudomonas putida KT2440
cgcgggccuucu

SEQ ID NO: 3532971 - RNA, 20 nt, Pseudomonas putida KT2440
cgcgggcgcgcccgcuccca

SEQ ID NO: 3532972 - RNA, 13 nt, Pseudomonas putida KT2440
cgcgggcggcgcu

SEQ ID NO: 3532973 - RNA, 24 nt, Pseudomonas putida KT2440
cgcgggcggcgcucgaucucacag

SEQ ID NO: 3532974 - RNA, 22 nt, Pseudomonas putida KT2440
cgcgggcgucgcgaucacgcag

SEQ ID NO: 3532975 - RNA, 21 nt, Pseudomonas putida KT2440
cgcgggcgucggucgccccca

SEQ ID NO: 3532976 - RNA, 13 nt, Pseudomonas putida KT2440
cgcgggcgugccc

SEQ ID NO: 3532977 - RNA, 12 nt, Pseudomonas putida KT2440
cgcgggcucgcc

SEQ ID NO: 3532978 - RNA, 13 nt, Pseudomonas putida KT2440
cgcgggcucgccc

SEQ ID NO: 3532979 - RNA, 20 nt, Pseudomonas putida KT2440
cgcgggcucgcccacuccca

SEQ ID NO: 3532980 - RNA, 14 nt, Pseudomonas putida KT2440
cgcgggcucgcccg

SEQ ID NO: 3532981 - RNA, 12 nt, Pseudomonas putida KT2440
cgcggggcagcg

SEQ ID NO: 3532982 - RNA, 20 nt, Pseudomonas putida KT2440
cgcggggugaucgccucgug

SEQ ID NO: 3532983 - RNA, 23 nt, Pseudomonas putida KT2440
cgcggggugaucgccucgugcag

SEQ ID NO: 3532984 - RNA, 16 nt, Pseudomonas putida KT2440
cgcggguaaacccgcg

SEQ ID NO: 3532985 - RNA, 17 nt, Pseudomonas putida KT2440
cgcggguaaacccgcgc

SEQ ID NO: 3532986 - RNA, 21 nt, Pseudomonas putida KT2440
cgcggguaaacccgcgccuac

SEQ ID NO: 3532987 - RNA, 20 nt, Pseudomonas putida KT2440
cgcggguaaacccgcuccca

SEQ ID NO: 3532988 - RNA, 21 nt, Pseudomonas putida KT2440
cgcggguaaacccgcucccac

SEQ ID NO: 3532989 - RNA, 20 nt, Pseudomonas putida KT2440
cgcggguaaacccgcuccua

SEQ ID NO: 3532990 - RNA, 21 nt, Pseudomonas putida KT2440
cgcggguaaacccgcuccuac

SEQ ID NO: 3532991 - RNA, 20 nt, Pseudomonas putida KT2440
cgcggguagacccgcuccua

SEQ ID NO: 3532992 - RNA, 21 nt, Pseudomonas putida KT2440
cgcggguagacccgcuccuac

SEQ ID NO: 3532993 - RNA, 13 nt, Pseudomonas putida KT2440
cgcgggucagggg

SEQ ID NO: 3532994 - RNA, 19 nt, Pseudomonas putida KT2440
cgcggguccagcgcggcca

SEQ ID NO: 3532995 - RNA, 23 nt, Pseudomonas putida KT2440
cgcggguccagcgcggccacgcc

SEQ ID NO: 3532996 - RNA, 21 nt, Pseudomonas putida KT2440
cgcgggugaacccgcuccuac

SEQ ID NO: 3532997 - RNA, 20 nt, Pseudomonas putida KT2440
cgcgggugaacccgcuccug

SEQ ID NO: 3532998 - RNA, 21 nt, Pseudomonas putida KT2440
cgcgggugaacccgcuccugc

SEQ ID NO: 3532999 - RNA, 19 nt, Pseudomonas putida KT2440
cgcgggugcgagaggcgcu

SEQ ID NO: 3533000 - RNA, 16 nt, Pseudomonas putida KT2440
cgcggguuuacccgcg

SEQ ID NO: 3533001 - RNA, 20 nt, Pseudomonas putida KT2440
cgcgguaagauugcaggcca

SEQ ID NO: 3533002 - RNA, 18 nt, Pseudomonas putida KT2440
cgcgguaagcaccacccc

SEQ ID NO: 3533003 - RNA, 18 nt, Pseudomonas putida KT2440
cgcgguaaugaccuggau

SEQ ID NO: 3533004 - RNA, 23 nt, Pseudomonas putida KT2440
cgcgguaaugcgcacggcuucgc

SEQ ID NO: 3533005 - RNA, 13 nt, Pseudomonas putida KT2440
cgcgguaccugug

SEQ ID NO: 3533006 - RNA, 21 nt, Pseudomonas putida KT2440
cgcggucaauuggagcggccu

SEQ ID NO: 3533007 - RNA, 14 nt, Pseudomonas putida KT2440
cgcgguccuugccg

SEQ ID NO: 3533008 - RNA, 16 nt, Pseudomonas putida KT2440
cgcggucgaugcagga

SEQ ID NO: 3533009 - RNA, 16 nt, Pseudomonas putida KT2440
cgcggucugcggcagc

SEQ ID NO: 3533010 - RNA, 17 nt, Pseudomonas putida KT2440
cgcggugaccagcggca

SEQ ID NO: 3533011 - RNA, 21 nt, Pseudomonas putida KT2440
cgcggugaccagcggcagcaa

SEQ ID NO: 3533012 - RNA, 14 nt, Pseudomonas putida KT2440
cgcggugaggcaac

SEQ ID NO: 3533013 - RNA, 21 nt, Pseudomonas putida KT2440
cgcggugauggcgcauggccu

SEQ ID NO: 3533014 - RNA, 15 nt, Pseudomonas putida KT2440
cgcggugcggcgaca

SEQ ID NO: 3533015 - RNA, 23 nt, Pseudomonas putida KT2440
cgcggugcggcgacagggcgaag

SEQ ID NO: 3533016 - RNA, 13 nt, Pseudomonas putida KT2440
cgcggugcucgau

SEQ ID NO: 3533017 - RNA, 13 nt, Pseudomonas putida KT2440
cgcggugcugacc

SEQ ID NO: 3533018 - RNA, 13 nt, Pseudomonas putida KT2440
cgcgguggagggc

SEQ ID NO: 3533019 - RNA, 13 nt, Pseudomonas putida KT2440
cgcgguggcuggc

SEQ ID NO: 3533020 - RNA, 17 nt, Pseudomonas putida KT2440
cgcgguuucugcaacca

SEQ ID NO: 3533021 - RNA, 22 nt, Pseudomonas putida KT2440
cgcgguuucugcaaccacgacc

SEQ ID NO: 3533022 - RNA, 20 nt, Pseudomonas putida KT2440
cgcgguuuggucgcggcaaa

SEQ ID NO: 3533023 - RNA, 14 nt, Pseudomonas putida KT2440
cgcguacgaauacg

SEQ ID NO: 3533024 - RNA, 18 nt, Pseudomonas putida KT2440
cgcguaguacuccagcag

SEQ ID NO: 3533025 - RNA, 19 nt, Pseudomonas putida KT2440
cgcguaguacuccagcagc

SEQ ID NO: 3533026 - RNA, 15 nt, Pseudomonas putida KT2440
cgcguaucaggcauc

SEQ ID NO: 3533027 - RNA, 23 nt, Pseudomonas putida KT2440
cgcguauccuugcccaccaggau

SEQ ID NO: 3533028 - RNA, 14 nt, Pseudomonas putida KT2440
cgcgucagcucaag

SEQ ID NO: 3533029 - RNA, 22 nt, Pseudomonas putida KT2440
cgcgucauacucuucgcgggcu

SEQ ID NO: 3533030 - RNA, 16 nt, Pseudomonas putida KT2440
cgcgucaucugcgcac

SEQ ID NO: 3533031 - RNA, 22 nt, Pseudomonas putida KT2440
cgcguccagcaacagcugccgg

SEQ ID NO: 3533032 - RNA, 14 nt, Pseudomonas putida KT2440
cgcguccagcccgg

SEQ ID NO: 3533033 - RNA, 14 nt, Pseudomonas putida KT2440
cgcgucccccggua

SEQ ID NO: 3533034 - RNA, 17 nt, Pseudomonas putida KT2440
cgcgucccccgguacca

SEQ ID NO: 3533035 - RNA, 19 nt, Pseudomonas putida KT2440
cgcgucccccgguaccagc

SEQ ID NO: 3533036 - RNA, 19 nt, Pseudomonas putida KT2440
cgcguccuggacccgcagc

SEQ ID NO: 3533037 - RNA, 22 nt, Pseudomonas putida KT2440
cgcgucgacaaaccgcacccgg

SEQ ID NO: 3533038 - RNA, 14 nt, Pseudomonas putida KT2440
cgcgucgauacgcu

SEQ ID NO: 3533039 - RNA, 13 nt, Pseudomonas putida KT2440
cgcgucgcggccc

SEQ ID NO: 3533040 - RNA, 19 nt, Pseudomonas putida KT2440
cgcgucgucaugguccuug

SEQ ID NO: 3533041 - RNA, 19 nt, Pseudomonas putida KT2440
cgcgucucuuucaggcaca

SEQ ID NO: 3533042 - RNA, 15 nt, Pseudomonas putida KT2440
cgcgucugccgcagc

SEQ ID NO: 3533043 - RNA, 17 nt, Pseudomonas putida KT2440
cgcgucugccgcagccc

SEQ ID NO: 3533044 - RNA, 20 nt, Pseudomonas putida KT2440
cgcgucugcuucuucgcggg

SEQ ID NO: 3533045 - RNA, 21 nt, Pseudomonas putida KT2440
cgcgucugcuucuucgcgggc

SEQ ID NO: 3533046 - RNA, 13 nt, Pseudomonas putida KT2440
cgcgugccccccc

SEQ ID NO: 3533047 - RNA, 21 nt, Pseudomonas putida KT2440
cgcgugcggggcaucgccgag

SEQ ID NO: 3533048 - RNA, 18 nt, Pseudomonas putida KT2440
cgcgugcuugugcuccca

SEQ ID NO: 3533049 - RNA, 21 nt, Pseudomonas putida KT2440
cgcgugcuugugcucccacag

SEQ ID NO: 3533050 - RNA, 15 nt, Pseudomonas putida KT2440
cgcgugguccugaug

SEQ ID NO: 3533051 - RNA, 15 nt, Pseudomonas putida KT2440
cgcguguagcccgcu

SEQ ID NO: 3533052 - RNA, 16 nt, Pseudomonas putida KT2440
cgcgugugcaggugga

SEQ ID NO: 3533053 - RNA, 22 nt, Pseudomonas putida KT2440
cgcgugugcucgaggaagcggc

SEQ ID NO: 3533054 - RNA, 15 nt, Pseudomonas putida KT2440
cgcguucacaucgcc

SEQ ID NO: 3533055 - RNA, 14 nt, Pseudomonas putida KT2440
cgcguucaugccgg

SEQ ID NO: 3533056 - RNA, 19 nt, Pseudomonas putida KT2440
cgcguucuuucucccaggc

SEQ ID NO: 3533057 - RNA, 20 nt, Pseudomonas putida KT2440
cgcguugauuuagcaggcac

SEQ ID NO: 3533058 - RNA, 19 nt, Pseudomonas putida KT2440
ccggugccauccaccgcgc

SEQ ID NO: 3533059 - RNA, 14 nt, Pseudomonas putida KT2440
ccggugcccuugcc

SEQ ID NO: 3533060 - RNA, 15 nt, Pseudomonas putida KT2440
ccggugcccuugccg

SEQ ID NO: 3533061 - RNA, 23 nt, Pseudomonas putida KT2440
ccggugccgaagucauccauggc

SEQ ID NO: 3533062 - RNA, 20 nt, Pseudomonas putida KT2440
ccggugccgccugggucagg

SEQ ID NO: 3533063 - RNA, 13 nt, Pseudomonas putida KT2440
ccggugccgcgcc

SEQ ID NO: 3533064 - RNA, 17 nt, Pseudomonas putida KT2440
ccggugcgcgggcgucg

SEQ ID NO: 3533065 - RNA, 22 nt, Pseudomonas putida KT2440
ccggugcgcgggcgucggucgc

SEQ ID NO: 3533066 - RNA, 12 nt, Pseudomonas putida KT2440
ccgguggccuug

SEQ ID NO: 3533067 - RNA, 15 nt, Pseudomonas putida KT2440
ccgguggcggccgca

SEQ ID NO: 3533068 - RNA, 22 nt, Pseudomonas putida KT2440
ccgguggcuucguggugcuggc

SEQ ID NO: 3533069 - RNA, 17 nt, Pseudomonas putida KT2440
ccgguggggugucuggu

SEQ ID NO: 3533070 - RNA, 20 nt, Pseudomonas putida KT2440
ccggugguaauuggccggca

SEQ ID NO: 3533071 - RNA, 21 nt, Pseudomonas putida KT2440
ccggugguacagacaaucauc

SEQ ID NO: 3533072 - RNA, 18 nt, Pseudomonas putida KT2440
ccgguggugaccucgaug

SEQ ID NO: 3533073 - RNA, 20 nt, Pseudomonas putida KT2440
ccgguggugaccucgaugcc

SEQ ID NO: 3533074 - RNA, 19 nt, Pseudomonas putida KT2440
ccgguguaccauccaguac

SEQ ID NO: 3533075 - RNA, 21 nt, Pseudomonas putida KT2440
ccgguguaggagcggguuuac

SEQ ID NO: 3533076 - RNA, 18 nt, Pseudomonas putida KT2440
ccggugugugcccaccgc

SEQ ID NO: 3533077 - RNA, 14 nt, Pseudomonas putida KT2440
ccgguguucgcggg

SEQ ID NO: 3533078 - RNA, 15 nt, Pseudomonas putida KT2440
ccgguguucgcgggc

SEQ ID NO: 3533079 - RNA, 17 nt, Pseudomonas putida KT2440
ccgguguucgcgggcau

SEQ ID NO: 3533080 - RNA, 17 nt, Pseudomonas putida KT2440
ccgguguucuucaggca

SEQ ID NO: 3533081 - RNA, 18 nt, Pseudomonas putida KT2440
ccgguucagucgguaugc

SEQ ID NO: 3533082 - RNA, 15 nt, Pseudomonas putida KT2440
ccgguucgccgccgg

SEQ ID NO: 3533083 - RNA, 18 nt, Pseudomonas putida KT2440
ccgguucgcgagaaccgg

SEQ ID NO: 3533084 - RNA, 17 nt, Pseudomonas putida KT2440
ccgguugcaggcgagcu

SEQ ID NO: 3533085 - RNA, 21 nt, Pseudomonas putida KT2440
ccgguugcgcagccggccuug

SEQ ID NO: 3533086 - RNA, 17 nt, Pseudomonas putida KT2440
ccgguugcuccagcgug

SEQ ID NO: 3533087 - RNA, 19 nt, Pseudomonas putida KT2440
ccgguuggggacggcagcc

SEQ ID NO: 3533088 - RNA, 18 nt, Pseudomonas putida KT2440
ccgguuucucgcagcagc

SEQ ID NO: 3533089 - RNA, 21 nt, Pseudomonas putida KT2440
ccgguuucucgcagcagcacc

SEQ ID NO: 3533090 - RNA, 22 nt, Pseudomonas putida KT2440
ccguaagccgcaggccaaugca

SEQ ID NO: 3533091 - RNA, 13 nt, Pseudomonas putida KT2440
ccguacaccaugc

SEQ ID NO: 3533092 - RNA, 19 nt, Pseudomonas putida KT2440
ccguaccuucggcgacagg

SEQ ID NO: 3533093 - RNA, 21 nt, Pseudomonas putida KT2440
ccguaccuucggcgacaggug

SEQ ID NO: 3533094 - RNA, 17 nt, Pseudomonas putida KT2440
ccguacgguagccccag

SEQ ID NO: 3533095 - RNA, 20 nt, Pseudomonas putida KT2440
ccguacgguagccccagccg

SEQ ID NO: 3533096 - RNA, 15 nt, Pseudomonas putida KT2440
ccguacuggcugcac

SEQ ID NO: 3533097 - RNA, 22 nt, Pseudomonas putida KT2440
ccguagccaaccgagucaacac

SEQ ID NO: 3533098 - RNA, 15 nt, Pseudomonas putida KT2440
ccguagcgcugacca

SEQ ID NO: 3533099 - RNA, 15 nt, Pseudomonas putida KT2440
ccguaggagcgggcu

SEQ ID NO: 3533100 - RNA, 16 nt, Pseudomonas putida KT2440
ccguaggagcgggcuu

SEQ ID NO: 3533101 - RNA, 17 nt, Pseudomonas putida KT2440
ccguaggagcggguuua

SEQ ID NO: 3533102 - RNA, 20 nt, Pseudomonas putida KT2440
ccguaggagcggguuuaccc

SEQ ID NO: 3533103 - RNA, 16 nt, Pseudomonas putida KT2440
ccguagggggccgcuu

SEQ ID NO: 3533104 - RNA, 22 nt, Pseudomonas putida KT2440
ccguaguaagccagcccugccg

SEQ ID NO: 3533105 - RNA, 19 nt, Pseudomonas putida KT2440
ccguaguagccuucuucgg

SEQ ID NO: 3533106 - RNA, 18 nt, Pseudomonas putida KT2440
ccguaguaggagcggguu

SEQ ID NO: 3533107 - RNA, 12 nt, Pseudomonas putida KT2440
ccguauacccau

SEQ ID NO: 3533108 - RNA, 20 nt, Pseudomonas putida KT2440
ccguauggcguugcucaaca

SEQ ID NO: 3533109 - RNA, 17 nt, Pseudomonas putida KT2440
ccguauugguagccacg

SEQ ID NO: 3533110 - RNA, 16 nt, Pseudomonas putida KT2440
ccgucaacucgccaaa

SEQ ID NO: 3533111 - RNA, 12 nt, Pseudomonas putida KT2440
ccgucaccagcg

SEQ ID NO: 3533112 - RNA, 14 nt, Pseudomonas putida KT2440
ccgucaccagcguc

SEQ ID NO: 3533113 - RNA, 16 nt, Pseudomonas putida KT2440
ccgucaccgccgccug

SEQ ID NO: 3533114 - RNA, 17 nt, Pseudomonas putida KT2440
ccgucaccgcugccgau

SEQ ID NO: 3533115 - RNA, 14 nt, Pseudomonas putida KT2440
ccgucaccuugcca

SEQ ID NO: 3533116 - RNA, 19 nt, Pseudomonas putida KT2440
ccgucagcagcaggcgcga

SEQ ID NO: 3533117 - RNA, 15 nt, Pseudomonas putida KT2440
ccgucagcggcaaca

SEQ ID NO: 3533118 - RNA, 20 nt, Pseudomonas putida KT2440
ccgucagcggcaacaccagc

SEQ ID NO: 3533119 - RNA, 21 nt, Pseudomonas putida KT2440
ccgucagcggcaacaccagca

SEQ ID NO: 3533120 - RNA, 15 nt, Pseudomonas putida KT2440
ccgucaggcaaacca

SEQ ID NO: 3533121 - RNA, 14 nt, Pseudomonas putida KT2440
ccgucaggcaaacg

SEQ ID NO: 3533122 - RNA, 15 nt, Pseudomonas putida KT2440
ccgucaggccucccc

SEQ ID NO: 3533123 - RNA, 16 nt, Pseudomonas putida KT2440
ccgucaggccuccccg

SEQ ID NO: 3533124 - RNA, 17 nt, Pseudomonas putida KT2440
ccgucagugcucggcaa

SEQ ID NO: 3533125 - RNA, 20 nt, Pseudomonas putida KT2440
ccgucauugcucaccguggu

SEQ ID NO: 3533126 - RNA, 16 nt, Pseudomonas putida KT2440
ccguccaacgggcgga

SEQ ID NO: 3533127 - RNA, 17 nt, Pseudomonas putida KT2440
ccguccaacgggcggaa

SEQ ID NO: 3533128 - RNA, 19 nt, Pseudomonas putida KT2440
ccguccaacgggcggaacu

SEQ ID NO: 3533129 - RNA, 12 nt, Pseudomonas putida KT2440
ccguccagcuga

SEQ ID NO: 3533130 - RNA, 22 nt, Pseudomonas putida KT2440
ccguccagcugagcgccaucca

SEQ ID NO: 3533131 - RNA, 16 nt, Pseudomonas putida KT2440
ccguccaggaacgcug

SEQ ID NO: 3533132 - RNA, 18 nt, Pseudomonas putida KT2440
ccguccagguccaggcca

SEQ ID NO: 3533133 - RNA, 19 nt, Pseudomonas putida KT2440
ccguccagguccaggccag

SEQ ID NO: 3533134 - RNA, 22 nt, Pseudomonas putida KT2440
ccguccaguuccggcaggucga

SEQ ID NO: 3533135 - RNA, 19 nt, Pseudomonas putida KT2440
ccguccccaaccggguuug

SEQ ID NO: 3533136 - RNA, 19 nt, Pseudomonas putida KT2440
ccguccggcaugcgccgau

SEQ ID NO: 3533137 - RNA, 23 nt, Pseudomonas putida KT2440
ccgucgaacguccgcucuucucg

SEQ ID NO: 3533138 - RNA, 15 nt, Pseudomonas putida KT2440
ccgucgaagcccgcg

SEQ ID NO: 3533139 - RNA, 14 nt, Pseudomonas putida KT2440
ccgucgaccaggca

SEQ ID NO: 3533140 - RNA, 21 nt, Pseudomonas putida KT2440
ccgucgacuuuugccacccga

SEQ ID NO: 3533141 - RNA, 19 nt, Pseudomonas putida KT2440
ccgucgauuacccagcgcg

SEQ ID NO: 3533142 - RNA, 15 nt, Pseudomonas putida KT2440
ccgucgcgcccaccg

SEQ ID NO: 3533143 - RNA, 11 nt, Pseudomonas putida KT2440
ccgucggccuc

SEQ ID NO: 3533144 - RNA, 14 nt, Pseudomonas putida KT2440
ccgucggcgucaac

SEQ ID NO: 3533145 - RNA, 21 nt, Pseudomonas putida KT2440
ccgucgggcacgaucagcagc

SEQ ID NO: 3533146 - RNA, 13 nt, Pseudomonas putida KT2440
ccgucgguaaaca

SEQ ID NO: 3533147 - RNA, 20 nt, Pseudomonas putida KT2440
ccgucguaggagcggguuua

SEQ ID NO: 3533148 - RNA, 21 nt, Pseudomonas putida KT2440
ccgucguguaggagcggguuc

SEQ ID NO: 3533149 - RNA, 18 nt, Pseudomonas putida KT2440
ccgucguuguucuucagg

SEQ ID NO: 3533150 - RNA, 18 nt, Pseudomonas putida KT2440
ccgucuuccucgacccag

SEQ ID NO: 3533151 - RNA, 23 nt, Pseudomonas putida KT2440
ccgucuuccucgacccagccacc

SEQ ID NO: 3533152 - RNA, 16 nt, Pseudomonas putida KT2440
ccgugaaccaucccac

SEQ ID NO: 3533153 - RNA, 18 nt, Pseudomonas putida KT2440
ccgugaaccaucccacuc

SEQ ID NO: 3533154 - RNA, 21 nt, Pseudomonas putida KT2440
ccgugaagacgcacacucccc

SEQ ID NO: 3533155 - RNA, 20 nt, Pseudomonas putida KT2440
ccgugacgaaggcgguaugg

SEQ ID NO: 3533156 - RNA, 17 nt, Pseudomonas putida KT2440
ccgugacuaguggccac

SEQ ID NO: 3533157 - RNA, 14 nt, Pseudomonas putida KT2440
ccgugagcauggca

SEQ ID NO: 3533158 - RNA, 15 nt, Pseudomonas putida KT2440
ccgugagggcgccga

SEQ ID NO: 3533159 - RNA, 17 nt, Pseudomonas putida KT2440
ccgugcaaacaacuccg

SEQ ID NO: 3533160 - RNA, 21 nt, Pseudomonas putida KT2440
ccgugcaaaugccccgggcag

SEQ ID NO: 3533161 - RNA, 22 nt, Pseudomonas putida KT2440
ccgugcaaaugccccgggcagg

SEQ ID NO: 3533162 - RNA, 14 nt, Pseudomonas putida KT2440
ccgugcaaccgcuc

SEQ ID NO: 3533163 - RNA, 21 nt, Pseudomonas putida KT2440
ccgugcaacgccgguagcugc

SEQ ID NO: 3533164 - RNA, 17 nt, Pseudomonas putida KT2440
ccgugcaccagcaccac

SEQ ID NO: 3533165 - RNA, 18 nt, Pseudomonas putida KT2440
ccgugcaccagcaccacc

SEQ ID NO: 3533166 - RNA, 12 nt, Pseudomonas putida KT2440
ccgugcagcacc

SEQ ID NO: 3533167 - RNA, 17 nt, Pseudomonas putida KT2440
ccgugcagggcgccgau

SEQ ID NO: 3533168 - RNA, 13 nt, Pseudomonas putida KT2440
ccgugcagggcug

SEQ ID NO: 3533169 - RNA, 16 nt, Pseudomonas putida KT2440
ccgugcaggucagcgu

SEQ ID NO: 3533170 - RNA, 14 nt, Pseudomonas putida KT2440
ccgugcauacaccc

SEQ ID NO: 3533171 - RNA, 12 nt, Pseudomonas putida KT2440
ccgugccaggug

SEQ ID NO: 3533172 - RNA, 14 nt, Pseudomonas putida KT2440
ccgugcccaccagc

SEQ ID NO: 3533173 - RNA, 17 nt, Pseudomonas putida KT2440
ccgugcccaccagcgcu

SEQ ID NO: 3533174 - RNA, 17 nt, Pseudomonas putida KT2440
ccgugcccgcccacgcc

SEQ ID NO: 3533175 - RNA, 21 nt, Pseudomonas putida KT2440
ccgugcccgcccacgccgcug

SEQ ID NO: 3533176 - RNA, 16 nt, Pseudomonas putida KT2440
ccgugcccggcauccg

SEQ ID NO: 3533177 - RNA, 18 nt, Pseudomonas putida KT2440
ccgugcccggcauccgcc

SEQ ID NO: 3533178 - RNA, 21 nt, Pseudomonas putida KT2440
ccgugcccggcauccgccuca

SEQ ID NO: 3533179 - RNA, 13 nt, Pseudomonas putida KT2440
ccgugccugccug

SEQ ID NO: 3533180 - RNA, 15 nt, Pseudomonas putida KT2440
ccgugccugccugca

SEQ ID NO: 3533181 - RNA, 13 nt, Pseudomonas putida KT2440
ccgugccuuccag

SEQ ID NO: 3533182 - RNA, 17 nt, Pseudomonas putida KT2440
ccgugcgccuaucaggc

SEQ ID NO: 3533183 - RNA, 17 nt, Pseudomonas putida KT2440
ccgugcggccaaagcug

SEQ ID NO: 3533184 - RNA, 18 nt, Pseudomonas putida KT2440
ccgugcugucggugaagc

SEQ ID NO: 3533185 - RNA, 23 nt, Pseudomonas putida KT2440
ccgugcuguguuucgcccccggc

SEQ ID NO: 3533186 - RNA, 14 nt, Pseudomonas putida KT2440
ccgugcuugcgggc

SEQ ID NO: 3533187 - RNA, 14 nt, Pseudomonas putida KT2440
ccgugcuuucaagc

SEQ ID NO: 3533188 - RNA, 15 nt, Pseudomonas putida KT2440
ccguggcaacgccac

SEQ ID NO: 3533189 - RNA, 18 nt, Pseudomonas putida KT2440
ccguggcaacgccacacu

SEQ ID NO: 3533190 - RNA, 13 nt, Pseudomonas putida KT2440
ccguggcagcccc

SEQ ID NO: 3533191 - RNA, 17 nt, Pseudomonas putida KT2440
ccguggcaggcaguucg

SEQ ID NO: 3533192 - RNA, 16 nt, Pseudomonas putida KT2440
ccgugguagcaccgga

SEQ ID NO: 3533193 - RNA, 20 nt, Pseudomonas putida KT2440
ccgugguaggagcggguuca

SEQ ID NO: 3533194 - RNA, 23 nt, Pseudomonas putida KT2440
ccgugguaucgcuuacagauguc

SEQ ID NO: 3533195 - RNA, 17 nt, Pseudomonas putida KT2440
ccguggucgugaggugc

SEQ ID NO: 3533196 - RNA, 19 nt, Pseudomonas putida KT2440
ccgugguucuugccgagca

SEQ ID NO: 3533197 - RNA, 15 nt, Pseudomonas putida KT2440
ccgugguuggagcgc

SEQ ID NO: 3533198 - RNA, 15 nt, Pseudomonas putida KT2440
ccguguacgacugcc

SEQ ID NO: 3533199 - RNA, 20 nt, Pseudomonas putida KT2440
ccguguacgacugccgcccu

SEQ ID NO: 3533200 - RNA, 13 nt, Pseudomonas putida KT2440
ccgugucgaacug

SEQ ID NO: 3533201 - RNA, 16 nt, Pseudomonas putida KT2440
ccguguucccagcacc

SEQ ID NO: 3533202 - RNA, 13 nt, Pseudomonas putida KT2440
ccguguucgcgag

SEQ ID NO: 3533203 - RNA, 19 nt, Pseudomonas putida KT2440
ccguguugcagcggguuug

SEQ ID NO: 3533204 - RNA, 17 nt, Pseudomonas putida KT2440
ccguuacauccaugccu

SEQ ID NO: 3533205 - RNA, 18 nt, Pseudomonas putida KT2440
ccguuagguuuucggcgc

SEQ ID NO: 3533206 - RNA, 18 nt, Pseudomonas putida KT2440
ccguuaguucgugcaccc

SEQ ID NO: 3533207 - RNA, 18 nt, Pseudomonas putida KT2440
ccguuauggaugccaauu

SEQ ID NO: 3533208 - RNA, 17 nt, Pseudomonas putida KT2440
ccguucaccguugccgc

SEQ ID NO: 3533209 - RNA, 22 nt, Pseudomonas putida KT2440
ccguucacguucaacgccguac

SEQ ID NO: 3533210 - RNA, 18 nt, Pseudomonas putida KT2440
ccguuccuacgcaggcac

SEQ ID NO: 3533211 - RNA, 14 nt, Pseudomonas putida KT2440
ccguucgccagcuu

SEQ ID NO: 3533212 - RNA, 20 nt, Pseudomonas putida KT2440
ccguucgcccugcgccugca

SEQ ID NO: 3533213 - RNA, 22 nt, Pseudomonas putida KT2440
ccguucgcggucggucagcacc

SEQ ID NO: 3533214 - RNA, 14 nt, Pseudomonas putida KT2440
ccguucggcgcgcu

SEQ ID NO: 3533215 - RNA, 21 nt, Pseudomonas putida KT2440
ccguugaaagacugcuccggc

SEQ ID NO: 3533216 - RNA, 15 nt, Pseudomonas putida KT2440
ccguugaucagcgac

SEQ ID NO: 3533217 - RNA, 18 nt, Pseudomonas putida KT2440
ccguugaucagcgacacc

SEQ ID NO: 3533218 - RNA, 23 nt, Pseudomonas putida KT2440
ccguugaucagcgacaccgccaa

SEQ ID NO: 3533219 - RNA, 22 nt, Pseudomonas putida KT2440
ccguugcgccgcucgcccagca

SEQ ID NO: 3533220 - RNA, 20 nt, Pseudomonas putida KT2440
ccguugcggucgguggucag

SEQ ID NO: 3533221 - RNA, 22 nt, Pseudomonas putida KT2440
ccguugcugcggggugcucugc

SEQ ID NO: 3533222 - RNA, 22 nt, Pseudomonas putida KT2440
ccguuggacgccgcaccgucga

SEQ ID NO: 3533223 - RNA, 17 nt, Pseudomonas putida KT2440
ccguuggcaucugcugg

SEQ ID NO: 3533224 - RNA, 15 nt, Pseudomonas putida KT2440
ccguuggucagcgac

SEQ ID NO: 3533225 - RNA, 23 nt, Pseudomonas putida KT2440
ccguuggucagcgacugccaaug

SEQ ID NO: 3533226 - RNA, 18 nt, Pseudomonas putida KT2440
ccguuguucacggucagg

SEQ ID NO: 3533227 - RNA, 14 nt, Pseudomonas putida KT2440
ccguuugaagccaa

SEQ ID NO: 3533228 - RNA, 15 nt, Pseudomonas putida KT2440
ccguuugcuggccug

SEQ ID NO: 3533229 - RNA, 16 nt, Pseudomonas putida KT2440
ccguuuucgguaauca

SEQ ID NO: 3533230 - RNA, 24 nt, Pseudomonas putida KT2440
ccuaagggcuagaugcugguucga

SEQ ID NO: 3533231 - RNA, 22 nt, Pseudomonas putida KT2440
ccuacaaaacauacgcggcuuu

SEQ ID NO: 3533232 - RNA, 23 nt, Pseudomonas putida KT2440
ccuacaagguugcgcaagccuca

SEQ ID NO: 3533233 - RNA, 14 nt, Pseudomonas putida KT2440
ccuacaggcaaccg

SEQ ID NO: 3533234 - RNA, 16 nt, Pseudomonas putida KT2440
ccuacaggcaaccgca

SEQ ID NO: 3533235 - RNA, 22 nt, Pseudomonas putida KT2440
ccuacaggcaaccgcauccccu

SEQ ID NO: 3533236 - RNA, 19 nt, Pseudomonas putida KT2440
ccuacagggguagcgucaa

SEQ ID NO: 3533237 - RNA, 14 nt, Pseudomonas putida KT2440
ccuacccaggcaac

SEQ ID NO: 3533238 - RNA, 21 nt, Pseudomonas putida KT2440
ccuacccgaggguggucuugg

SEQ ID NO: 3533239 - RNA, 12 nt, Pseudomonas putida KT2440
ccuacccgggcg

SEQ ID NO: 3533240 - RNA, 16 nt, Pseudomonas putida KT2440
ccuaccgccaacgaau

SEQ ID NO: 3533241 - RNA, 15 nt, Pseudomonas putida KT2440
ccuacgacgggcuga

SEQ ID NO: 3533242 - RNA, 15 nt, Pseudomonas putida KT2440
ccuacgcagucagcc

SEQ ID NO: 3533243 - RNA, 19 nt, Pseudomonas putida KT2440
ccuacgcccccagccuuga

SEQ ID NO: 3533244 - RNA, 12 nt, Pseudomonas putida KT2440
ccuacgcugguu

SEQ ID NO: 3533245 - RNA, 16 nt, Pseudomonas putida KT2440
ccuacgggcaaccgca

SEQ ID NO: 3533246 - RNA, 14 nt, Pseudomonas putida KT2440
ccuacgggcgagcg

SEQ ID NO: 3533247 - RNA, 18 nt, Pseudomonas putida KT2440
ccuacgggcgagcgcgca

SEQ ID NO: 3533248 - RNA, 22 nt, Pseudomonas putida KT2440
ccuacgggcgagcgcgcaggcg

SEQ ID NO: 3533249 - RNA, 22 nt, Pseudomonas putida KT2440
ccuacggggguucacagccggc

SEQ ID NO: 3533250 - RNA, 23 nt, Pseudomonas putida KT2440
ccuacggggguucacagccggca

SEQ ID NO: 3533251 - RNA, 13 nt, Pseudomonas putida KT2440
ccuacgucagcuu

SEQ ID NO: 3533252 - RNA, 21 nt, Pseudomonas putida KT2440
ccuacuccgcucauuggaaaa

SEQ ID NO: 3533253 - RNA, 16 nt, Pseudomonas putida KT2440
ccuagaacaggcggcu

SEQ ID NO: 3533254 - RNA, 15 nt, Pseudomonas putida KT2440
ccuagcaaggccucc

SEQ ID NO: 3533255 - RNA, 22 nt, Pseudomonas putida KT2440
ccuagccaaucugauuugcgcu

SEQ ID NO: 3533256 - RNA, 21 nt, Pseudomonas putida KT2440
ccuagguaguaaagcccccag

SEQ ID NO: 3533257 - RNA, 13 nt, Pseudomonas putida KT2440
ccuaucagaucga

SEQ ID NO: 3533258 - RNA, 17 nt, Pseudomonas putida KT2440
ccuaucgcucuggcacu

SEQ ID NO: 3533259 - RNA, 17 nt, Pseudomonas putida KT2440
ccuauggggugagcggc

SEQ ID NO: 3533260 - RNA, 19 nt, Pseudomonas putida KT2440
ccucaaaccggaucgggca

SEQ ID NO: 3533261 - RNA, 16 nt, Pseudomonas putida KT2440
ccucaaaucgcugcgg

SEQ ID NO: 3533262 - RNA, 18 nt, Pseudomonas putida KT2440
ccucaaaugcgcccugcu

SEQ ID NO: 3533263 - RNA, 21 nt, Pseudomonas putida KT2440
ccucaacgccucccccacccc

SEQ ID NO: 3533264 - RNA, 15 nt, Pseudomonas putida KT2440
ccucaagcugcaccg

SEQ ID NO: 3533265 - RNA, 19 nt, Pseudomonas putida KT2440
ccucaagguaggggcagcc

SEQ ID NO: 3533266 - RNA, 23 nt, Pseudomonas putida KT2440
ccucaagguaggggcagccaggu

SEQ ID NO: 3533267 - RNA, 12 nt, Pseudomonas putida KT2440
ccucaagugccg

SEQ ID NO: 3533268 - RNA, 15 nt, Pseudomonas putida KT2440
ccucaaguucccgau

SEQ ID NO: 3533269 - RNA, 24 nt, Pseudomonas putida KT2440
ccucaaucacauccacagccucca

SEQ ID NO: 3533270 - RNA, 12 nt, Pseudomonas putida KT2440
ccucaaucacug

SEQ ID NO: 3533271 - RNA, 14 nt, Pseudomonas putida KT2440
ccucaaucacugcg

SEQ ID NO: 3533272 - RNA, 19 nt, Pseudomonas putida KT2440
ccucaaugggcuuccccag

SEQ ID NO: 3533273 - RNA, 13 nt, Pseudomonas putida KT2440
ccucacagccuuc

SEQ ID NO: 3533274 - RNA, 13 nt, Pseudomonas putida KT2440
ccucacagcgccg

SEQ ID NO: 3533275 - RNA, 13 nt, Pseudomonas putida KT2440
ccucacauucacc

SEQ ID NO: 3533276 - RNA, 16 nt, Pseudomonas putida KT2440
ccucacauucaccgcc

SEQ ID NO: 3533277 - RNA, 16 nt, Pseudomonas putida KT2440
ccucaccgacccacag

SEQ ID NO: 3533278 - RNA, 18 nt, Pseudomonas putida KT2440
ccucaccgacccacaggc

SEQ ID NO: 3533279 - RNA, 19 nt, Pseudomonas putida KT2440
ccucaccgacccacaggca

SEQ ID NO: 3533280 - RNA, 14 nt, Pseudomonas putida KT2440
ccucaccgccgcau

SEQ ID NO: 3533281 - RNA, 14 nt, Pseudomonas putida KT2440
ccucaccuccaccg

SEQ ID NO: 3533282 - RNA, 15 nt, Pseudomonas putida KT2440
ccucacgcacaaccg

SEQ ID NO: 3533283 - RNA, 13 nt, Pseudomonas putida KT2440
ccucacgcgccag

SEQ ID NO: 3533284 - RNA, 16 nt, Pseudomonas putida KT2440
ccucacgcgccagguc

SEQ ID NO: 3533285 - RNA, 18 nt, Pseudomonas putida KT2440
ccucacgcgccaggucgg

SEQ ID NO: 3533286 - RNA, 18 nt, Pseudomonas putida KT2440
ccucacggcgaacacccc

SEQ ID NO: 3533287 - RNA, 21 nt, Pseudomonas putida KT2440
ccucagccaggcugagcccgg

SEQ ID NO: 3533288 - RNA, 11 nt, Pseudomonas putida KT2440
ccucagcgcca

SEQ ID NO: 3533289 - RNA, 22 nt, Pseudomonas putida KT2440
ccucagcgccaauaccgcgcau

SEQ ID NO: 3533290 - RNA, 12 nt, Pseudomonas putida KT2440
ccucaggcacau

SEQ ID NO: 3533291 - RNA, 21 nt, Pseudomonas putida KT2440
ccucagggauaacgucacagg

SEQ ID NO: 3533292 - RNA, 23 nt, Pseudomonas putida KT2440
ccucauagcuuucaggcgcagca

SEQ ID NO: 3533293 - RNA, 14 nt, Pseudomonas putida KT2440
ccucauaguaaggc

SEQ ID NO: 3533294 - RNA, 19 nt, Pseudomonas putida KT2440
ccucaucaggccgaaggcc

SEQ ID NO: 3533295 - RNA, 14 nt, Pseudomonas putida KT2440
ccucaucaguuccg

SEQ ID NO: 3533296 - RNA, 15 nt, Pseudomonas putida KT2440
ccucaucaguuccga

SEQ ID NO: 3533297 - RNA, 15 nt, Pseudomonas putida KT2440
ccucaucccccggcc

SEQ ID NO: 3533298 - RNA, 17 nt, Pseudomonas putida KT2440
ccucaucccccggccca

SEQ ID NO: 3533299 - RNA, 18 nt, Pseudomonas putida KT2440
ccucaucgacccuggcau

SEQ ID NO: 3533300 - RNA, 16 nt, Pseudomonas putida KT2440
ccucaucgaugcccgu

SEQ ID NO: 3533301 - RNA, 20 nt, Pseudomonas putida KT2440
ccucauucaaagccugcucc

SEQ ID NO: 3533302 - RNA, 21 nt, Pseudomonas putida KT2440
ccucauucagugccuggguca

SEQ ID NO: 3533303 - RNA, 16 nt, Pseudomonas putida KT2440
ccuccaacucgcgcau

SEQ ID NO: 3533304 - RNA, 13 nt, Pseudomonas putida KT2440
ccuccaccccgca

SEQ ID NO: 3533305 - RNA, 19 nt, Pseudomonas putida KT2440
ccuccaccccgcaggccgc

SEQ ID NO: 3533306 - RNA, 22 nt, Pseudomonas putida KT2440
ccuccaccccgcaggccgcagc

SEQ ID NO: 3533307 - RNA, 12 nt, Pseudomonas putida KT2440
ccuccacccggu

SEQ ID NO: 3533308 - RNA, 13 nt, Pseudomonas putida KT2440
ccuccacgccacc

SEQ ID NO: 3533309 - RNA, 14 nt, Pseudomonas putida KT2440
ccuccagcaacauc

SEQ ID NO: 3533310 - RNA, 15 nt, Pseudomonas putida KT2440
ccuccagcacaccgc

SEQ ID NO: 3533311 - RNA, 23 nt, Pseudomonas putida KT2440
ccuccagcagcgacaccagcgca

SEQ ID NO: 3533312 - RNA, 22 nt, Pseudomonas putida KT2440
ccuccagcauggcgaucaacga

SEQ ID NO: 3533313 - RNA, 16 nt, Pseudomonas putida KT2440
ccuccagcccggcuuc

SEQ ID NO: 3533314 - RNA, 20 nt, Pseudomonas putida KT2440
ccuccagcccggcuucacag

SEQ ID NO: 3533315 - RNA, 13 nt, Pseudomonas putida KT2440
ccuccagcccugc

SEQ ID NO: 3533316 - RNA, 22 nt, Pseudomonas putida KT2440
ccuccagcccugcucgccaaau

SEQ ID NO: 3533317 - RNA, 23 nt, Pseudomonas putida KT2440
ccuccagccgacggccaauggcc

SEQ ID NO: 3533318 - RNA, 12 nt, Pseudomonas putida KT2440
ccuccagcuggc

SEQ ID NO: 3533319 - RNA, 14 nt, Pseudomonas putida KT2440
ccuccagcuggcca

SEQ ID NO: 3533320 - RNA, 23 nt, Pseudomonas putida KT2440
ccuccagcuggccaucgacccgc

SEQ ID NO: 3533321 - RNA, 21 nt, Pseudomonas putida KT2440
ccuccaggucauccgcacgca

SEQ ID NO: 3533322 - RNA, 23 nt, Pseudomonas putida KT2440
ccuccaggucauccgcacgcaug

SEQ ID NO: 3533323 - RNA, 16 nt, Pseudomonas putida KT2440
ccuccaguugccagug

SEQ ID NO: 3533324 - RNA, 18 nt, Pseudomonas putida KT2440
ccuccccaaucaccagga

SEQ ID NO: 3533325 - RNA, 20 nt, Pseudomonas putida KT2440
ccucccccacccccgcccca

SEQ ID NO: 3533326 - RNA, 16 nt, Pseudomonas putida KT2440
ccuccccuucccgcca

SEQ ID NO: 3533327 - RNA, 17 nt, Pseudomonas putida KT2440
ccucccgcacugcugcc

SEQ ID NO: 3533328 - RNA, 12 nt, Pseudomonas putida KT2440
ccucccgcgcau

SEQ ID NO: 3533329 - RNA, 20 nt, Pseudomonas putida KT2440
ccucccgcgcauccuccgcc

SEQ ID NO: 3533330 - RNA, 18 nt, Pseudomonas putida KT2440
ccuccgagucuccgcgcu

SEQ ID NO: 3533331 - RNA, 14 nt, Pseudomonas putida KT2440
ccuccgcccugccc

SEQ ID NO: 3533332 - RNA, 14 nt, Pseudomonas putida KT2440
ccuccgccugcggc

SEQ ID NO: 3533333 - RNA, 23 nt, Pseudomonas putida KT2440
ccuccggaucgguccauugcucg

SEQ ID NO: 3533334 - RNA, 11 nt, Pseudomonas putida KT2440
ccuccggcccc

SEQ ID NO: 3533335 - RNA, 22 nt, Pseudomonas putida KT2440
ccuccggccccggugcauccaa

SEQ ID NO: 3533336 - RNA, 21 nt, Pseudomonas putida KT2440
ccuccgggucaggccgaugcg

SEQ ID NO: 3533337 - RNA, 13 nt, Pseudomonas putida KT2440
ccuccucaccgca

SEQ ID NO: 3533338 - RNA, 21 nt, Pseudomonas putida KT2440
ccuccucgcgggcaaacccgc

SEQ ID NO: 3533339 - RNA, 18 nt, Pseudomonas putida KT2440
ccuccugaccaacuuuuc

SEQ ID NO: 3533340 - RNA, 14 nt, Pseudomonas putida KT2440
ccuccugccggggu

SEQ ID NO: 3533341 - RNA, 23 nt, Pseudomonas putida KT2440
ccuccugcggcagauccugcagc

SEQ ID NO: 3533342 - RNA, 12 nt, Pseudomonas putida KT2440
ccuccugcugcu

SEQ ID NO: 3533343 - RNA, 21 nt, Pseudomonas putida KT2440
ccuccuucagguaauccacca

SEQ ID NO: 3533344 - RNA, 14 nt, Pseudomonas putida KT2440
ccucgaacagcagu

SEQ ID NO: 3533345 - RNA, 15 nt, Pseudomonas putida KT2440
ccucgaacagcaguu

SEQ ID NO: 3533346 - RNA, 20 nt, Pseudomonas putida KT2440
ccucgaacauggccacggug

SEQ ID NO: 3533347 - RNA, 10 nt, Pseudomonas putida KT2440
ccucgaacuc

SEQ ID NO: 3533348 - RNA, 15 nt, Pseudomonas putida KT2440
ccucgaaguaggcaa

SEQ ID NO: 3533349 - RNA, 13 nt, Pseudomonas putida KT2440
ccucgacacccag

SEQ ID NO: 3533350 - RNA, 20 nt, Pseudomonas putida KT2440
ccucgaccacgaucuuggcc

SEQ ID NO: 3533351 - RNA, 15 nt, Pseudomonas putida KT2440
ccucgaccaggcgcu

SEQ ID NO: 3533352 - RNA, 22 nt, Pseudomonas putida KT2440
ccucgaccaggcgcucgcucca

SEQ ID NO: 3533353 - RNA, 12 nt, Pseudomonas putida KT2440
ccucgacccagc

SEQ ID NO: 3533354 - RNA, 16 nt, Pseudomonas putida KT2440
ccucgacccccuugcc

SEQ ID NO: 3533355 - RNA, 20 nt, Pseudomonas putida KT2440
ccucgacccccuugccagca

SEQ ID NO: 3533356 - RNA, 13 nt, Pseudomonas putida KT2440
ccucgaccuggcc

SEQ ID NO: 3533357 - RNA, 16 nt, Pseudomonas putida KT2440
ccucgacgcagacaaa

SEQ ID NO: 3533358 - RNA, 18 nt, Pseudomonas putida KT2440
ccucgacgccuuggcgca

SEQ ID NO: 3533359 - RNA, 15 nt, Pseudomonas putida KT2440
ccucgacgggcaggc

SEQ ID NO: 3533360 - RNA, 18 nt, Pseudomonas putida KT2440
ccucgacgggcaggcggu

SEQ ID NO: 3533361 - RNA, 17 nt, Pseudomonas putida KT2440
ccucgagcgcuuucagc

SEQ ID NO: 3533362 - RNA, 19 nt, Pseudomonas putida KT2440
ccucgagcgcuuucagccg

SEQ ID NO: 3533363 - RNA, 22 nt, Pseudomonas putida KT2440
ccucgagguacgagucagcgug

SEQ ID NO: 3533364 - RNA, 14 nt, Pseudomonas putida KT2440
ccucgagugcgcug

SEQ ID NO: 3533365 - RNA, 16 nt, Pseudomonas putida KT2440
ccucgagugcgcugau

SEQ ID NO: 3533366 - RNA, 17 nt, Pseudomonas putida KT2440
ccucgagugcgcugauc

SEQ ID NO: 3533367 - RNA, 15 nt, Pseudomonas putida KT2440
ccucgaucacacccu

SEQ ID NO: 3533368 - RNA, 12 nt, Pseudomonas putida KT2440
ccucgaucccgc

SEQ ID NO: 3533369 - RNA, 19 nt, Pseudomonas putida KT2440
ccucgaugcccuccagccc

SEQ ID NO: 3533370 - RNA, 19 nt, Pseudomonas putida KT2440
ccucgaugguuaucuucuc

SEQ ID NO: 3533371 - RNA, 20 nt, Pseudomonas putida KT2440
ccucgaugucuuccagacca

SEQ ID NO: 3533372 - RNA, 16 nt, Pseudomonas putida KT2440
ccucgcccaccagcug

SEQ ID NO: 3533373 - RNA, 15 nt, Pseudomonas putida KT2440
ccucgcccaggucaa

SEQ ID NO: 3533374 - RNA, 15 nt, Pseudomonas putida KT2440
ccucgccccgcgcaa

SEQ ID NO: 3533375 - RNA, 14 nt, Pseudomonas putida KT2440
ccucgcucagcuug

SEQ ID NO: 3533376 - RNA, 13 nt, Pseudomonas putida KT2440
ccucgcugaccag

SEQ ID NO: 3533377 - RNA, 18 nt, Pseudomonas putida KT2440
ccucgcugaccaguugcu

SEQ ID NO: 3533378 - RNA, 18 nt, Pseudomonas putida KT2440
ccucgcugcccaacgccu

SEQ ID NO: 3533379 - RNA, 20 nt, Pseudomonas putida KT2440
ccucgcugccuuuggccgcc

SEQ ID NO: 3533380 - RNA, 22 nt, Pseudomonas putida KT2440
ccucggaaaugaagacggugag

SEQ ID NO: 3533381 - RNA, 13 nt, Pseudomonas putida KT2440
ccucggcacugca

SEQ ID NO: 3533382 - RNA, 17 nt, Pseudomonas putida KT2440
ccucggccacaucggca

SEQ ID NO: 3533383 - RNA, 18 nt, Pseudomonas putida KT2440
ccucggccaggucgaucc

SEQ ID NO: 3533384 - RNA, 24 nt, Pseudomonas putida KT2440
ccucggccggggccaggcgcggcu

SEQ ID NO: 3533385 - RNA, 22 nt, Pseudomonas putida KT2440
ccucggcgaucagcuucaacug

SEQ ID NO: 3533386 - RNA, 15 nt, Pseudomonas putida KT2440
ccucggcgaucgcca

SEQ ID NO: 3533387 - RNA, 16 nt, Pseudomonas putida KT2440
ccucggcgaucgccag

SEQ ID NO: 3533388 - RNA, 20 nt, Pseudomonas putida KT2440
ccucggcgccauaggcuugc

SEQ ID NO: 3533389 - RNA, 17 nt, Pseudomonas putida KT2440
ccucggcguucagcucg

SEQ ID NO: 3533390 - RNA, 20 nt, Pseudomonas putida KT2440
ccucggcuacgccgccgcug

SEQ ID NO: 3533391 - RNA, 22 nt, Pseudomonas putida KT2440
ccucgggcuuggcacgcuggcu

SEQ ID NO: 3533392 - RNA, 17 nt, Pseudomonas putida KT2440
ccucggucgccgagccg

SEQ ID NO: 3533393 - RNA, 22 nt, Pseudomonas putida KT2440
ccucgguggcucuccucuccca

SEQ ID NO: 3533394 - RNA, 16 nt, Pseudomonas putida KT2440
ccucgucaugcagcgc

SEQ ID NO: 3533395 - RNA, 17 nt, Pseudomonas putida KT2440
ccucgucaugcagcgcc

SEQ ID NO: 3533396 - RNA, 16 nt, Pseudomonas putida KT2440
ccucguccagcucguc

SEQ ID NO: 3533397 - RNA, 18 nt, Pseudomonas putida KT2440
ccucguccaucuugcugc

SEQ ID NO: 3533398 - RNA, 19 nt, Pseudomonas putida KT2440
ccucgucgauguagaugcc

SEQ ID NO: 3533399 - RNA, 22 nt, Pseudomonas putida KT2440
ccucgucgcgguccuugccgua

SEQ ID NO: 3533400 - RNA, 22 nt, Pseudomonas putida KT2440
ccucgugaccgaccaccugcuc

SEQ ID NO: 3533401 - RNA, 18 nt, Pseudomonas putida KT2440
ccucgugcagcugcaccg

SEQ ID NO: 3533402 - RNA, 19 nt, Pseudomonas putida KT2440
ccucgugcagcugcaccga

SEQ ID NO: 3533403 - RNA, 16 nt, Pseudomonas putida KT2440
ccucguuacuggugga

SEQ ID NO: 3533404 - RNA, 17 nt, Pseudomonas putida KT2440
ccucguucagccaacgg

SEQ ID NO: 3533405 - RNA, 18 nt, Pseudomonas putida KT2440
ccucguucgcgggcacgc

SEQ ID NO: 3533406 - RNA, 18 nt, Pseudomonas putida KT2440
ccucguugcgaagcggcc

SEQ ID NO: 3533407 - RNA, 18 nt, Pseudomonas putida KT2440
ccucuaucaccuguuccc

SEQ ID NO: 3533408 - RNA, 16 nt, Pseudomonas putida KT2440
ccucuaugccaccugu

SEQ ID NO: 3533409 - RNA, 15 nt, Pseudomonas putida KT2440
ccucucagcaccauu

SEQ ID NO: 3533410 - RNA, 13 nt, Pseudomonas putida KT2440
ccucugcccgcag

SEQ ID NO: 3533411 - RNA, 19 nt, Pseudomonas putida KT2440
ccucugcggccuucaagcu

SEQ ID NO: 3533412 - RNA, 11 nt, Pseudomonas putida KT2440
ccucugcugcg

SEQ ID NO: 3533413 - RNA, 22 nt, Pseudomonas putida KT2440
ccucugcugcggauacagcgcc

SEQ ID NO: 3533414 - RNA, 18 nt, Pseudomonas putida KT2440
ccucuggcgugcaccugu

SEQ ID NO: 3533415 - RNA, 21 nt, Pseudomonas putida KT2440
ccucuggguagccaccuuuga

SEQ ID NO: 3533416 - RNA, 22 nt, Pseudomonas putida KT2440
ccucuggguagccaccuuugac

SEQ ID NO: 3533417 - RNA, 16 nt, Pseudomonas putida KT2440
ccucuguaacugcgca

SEQ ID NO: 3533418 - RNA, 14 nt, Pseudomonas putida KT2440
ccucugugggagcg

SEQ ID NO: 3533419 - RNA, 18 nt, Pseudomonas putida KT2440
ccucuguuugcuggucag

SEQ ID NO: 3533420 - RNA, 23 nt, Pseudomonas putida KT2440
ccucuuagcgggcaaauccgccc

SEQ ID NO: 3533421 - RNA, 22 nt, Pseudomonas putida KT2440
ccucuucaccgucggcgcugau

SEQ ID NO: 3533422 - RNA, 21 nt, Pseudomonas putida KT2440
ccucuucgaagacgccgccau

SEQ ID NO: 3533423 - RNA, 22 nt, Pseudomonas putida KT2440
ccucuucgcgggcaagcccgcu

SEQ ID NO: 3533424 - RNA, 24 nt, Pseudomonas putida KT2440
ccucuucgcggguaaacccgcgcc

SEQ ID NO: 3533425 - RNA, 23 nt, Pseudomonas putida KT2440
ccucuucgcggguaaacccgcuc

SEQ ID NO: 3533426 - RNA, 18 nt, Pseudomonas putida KT2440
ccucuucgcggguaagcc

SEQ ID NO: 3533427 - RNA, 18 nt, Pseudomonas putida KT2440
ccucuucgcgggugaacc

SEQ ID NO: 3533428 - RNA, 19 nt, Pseudomonas putida KT2440
ccucuucgcgggugaaccc

SEQ ID NO: 3533429 - RNA, 15 nt, Pseudomonas putida KT2440
ccucuucggccagca

SEQ ID NO: 3533430 - RNA, 18 nt, Pseudomonas putida KT2440
ccucuucggccagcaacu

SEQ ID NO: 3533431 - RNA, 16 nt, Pseudomonas putida KT2440
ccugaaaccccgcccc

SEQ ID NO: 3533432 - RNA, 14 nt, Pseudomonas putida KT2440
ccugaacaaggccu

SEQ ID NO: 3533433 - RNA, 23 nt, Pseudomonas putida KT2440
ccugaaccaccgggaucuuggcg

SEQ ID NO: 3533434 - RNA, 15 nt, Pseudomonas putida KT2440
ccugaacgaugcccg

SEQ ID NO: 3533435 - RNA, 19 nt, Pseudomonas putida KT2440
ccugaacgaugcccgggcc

SEQ ID NO: 3533436 - RNA, 18 nt, Pseudomonas putida KT2440
ccugaacgcugcgcgggu

SEQ ID NO: 3533437 - RNA, 20 nt, Pseudomonas putida KT2440
ccugaagcaggggcuggacu

SEQ ID NO: 3533438 - RNA, 14 nt, Pseudomonas putida KT2440
ccugaagcccugga

SEQ ID NO: 3533439 - RNA, 12 nt, Pseudomonas putida KT2440
ccugaaucagca

SEQ ID NO: 3533440 - RNA, 17 nt, Pseudomonas putida KT2440
ccugaaugucaucugag

SEQ ID NO: 3533441 - RNA, 23 nt, Pseudomonas putida KT2440
ccugaaugucaucugaggcccga

SEQ ID NO: 3533442 - RNA, 17 nt, Pseudomonas putida KT2440
ccugacacauaggcagc

SEQ ID NO: 3533443 - RNA, 16 nt, Pseudomonas putida KT2440
ccugacauccugcucc

SEQ ID NO: 3533444 - RNA, 13 nt, Pseudomonas putida KT2440
ccugaccaucagc

SEQ ID NO: 3533445 - RNA, 13 nt, Pseudomonas putida KT2440
ccugaccauuggc

SEQ ID NO: 3533446 - RNA, 17 nt, Pseudomonas putida KT2440
ccugaccauuggccaac

SEQ ID NO: 3533447 - RNA, 22 nt, Pseudomonas putida KT2440
ccugacgcaagcgcgccgccac

SEQ ID NO: 3533448 - RNA, 16 nt, Pseudomonas putida KT2440
ccugacgccgccagcg

SEQ ID NO: 3533449 - RNA, 14 nt, Pseudomonas putida KT2440
ccugacgcgccgcc

SEQ ID NO: 3533450 - RNA, 15 nt, Pseudomonas putida KT2440
ccugacgcugcacuu

SEQ ID NO: 3533451 - RNA, 19 nt, Pseudomonas putida KT2440
ccugacgcugcacuuccac

SEQ ID NO: 3533452 - RNA, 19 nt, Pseudomonas putida KT2440
ccugacgggccucuucgcg

SEQ ID NO: 3533453 - RNA, 14 nt, Pseudomonas putida KT2440
ccugagccugcagg

SEQ ID NO: 3533454 - RNA, 20 nt, Pseudomonas putida KT2440
ccugagccuuguucgcgcag

SEQ ID NO: 3533455 - RNA, 16 nt, Pseudomonas putida KT2440
ccugagcggugaaacc

SEQ ID NO: 3533456 - RNA, 13 nt, Pseudomonas putida KT2440
ccugagcuucaac

SEQ ID NO: 3533457 - RNA, 14 nt, Pseudomonas putida KT2440
ccugagcuucaacg

SEQ ID NO: 3533458 - RNA, 16 nt, Pseudomonas putida KT2440
ccugagcuucaacgcg

SEQ ID NO: 3533459 - RNA, 20 nt, Pseudomonas putida KT2440
ccugagcuucaaucaugaag

SEQ ID NO: 3533460 - RNA, 20 nt, Pseudomonas putida KT2440
ccugagggcucauccacccc

SEQ ID NO: 3533461 - RNA, 21 nt, Pseudomonas putida KT2440
ccugagggucgugagccugca

SEQ ID NO: 3533462 - RNA, 24 nt, Pseudomonas putida KT2440
ccugaguauucuccuucuuccaga

SEQ ID NO: 3533463 - RNA, 18 nt, Pseudomonas putida KT2440
ccugagucaggcgcccug

SEQ ID NO: 3533464 - RNA, 20 nt, Pseudomonas putida KT2440
ccugagucaggcgcccugcc

SEQ ID NO: 3533465 - RNA, 18 nt, Pseudomonas putida KT2440
ccugagucuggcgccuga

SEQ ID NO: 3533466 - RNA, 17 nt, Pseudomonas putida KT2440
ccugauagcgcuuuucc

SEQ ID NO: 3533467 - RNA, 14 nt, Pseudomonas putida KT2440
ccugauaggacugc

SEQ ID NO: 3533468 - RNA, 16 nt, Pseudomonas putida KT2440
ccugauaggacugcuu

SEQ ID NO: 3533469 - RNA, 23 nt, Pseudomonas putida KT2440
ccugaucaagguuucagcagcgu

SEQ ID NO: 3533470 - RNA, 16 nt, Pseudomonas putida KT2440
ccugaucagacuuugc

SEQ ID NO: 3533471 - RNA, 23 nt, Pseudomonas putida KT2440
ccugaucagacuuugcggacgaa

SEQ ID NO: 3533472 - RNA, 23 nt, Pseudomonas putida KT2440
ccugaucgaugagcgagcccgcg

SEQ ID NO: 3533473 - RNA, 19 nt, Pseudomonas putida KT2440
ccugaucgguuggguuggc

SEQ ID NO: 3533474 - RNA, 14 nt, Pseudomonas putida KT2440
ccugaugcagcagu

SEQ ID NO: 3533475 - RNA, 16 nt, Pseudomonas putida KT2440
ccugaugcagcagugc

SEQ ID NO: 3533476 - RNA, 21 nt, Pseudomonas putida KT2440
ccugaugcagcagugccagca

SEQ ID NO: 3533477 - RNA, 23 nt, Pseudomonas putida KT2440
ccugaugcgagcuaccugacuug

SEQ ID NO: 3533478 - RNA, 20 nt, Pseudomonas putida KT2440
ccugauguucggugcucagg

SEQ ID NO: 3533479 - RNA, 13 nt, Pseudomonas putida KT2440
ccugauugccugg

SEQ ID NO: 3533480 - RNA, 17 nt, Pseudomonas putida KT2440
ccugcaaacgcaggugc

SEQ ID NO: 3533481 - RNA, 12 nt, Pseudomonas putida KT2440
ccugcaacaccu

SEQ ID NO: 3533482 - RNA, 16 nt, Pseudomonas putida KT2440
ccugcaacagggcgcu

SEQ ID NO: 3533483 - RNA, 23 nt, Pseudomonas putida KT2440
ccugcaacagggcgcuugcccgc

SEQ ID NO: 3533484 - RNA, 13 nt, Pseudomonas putida KT2440
ccugcaaccccug

SEQ ID NO: 3533485 - RNA, 21 nt, Pseudomonas putida KT2440
ccugcaacccgucagugcucg

SEQ ID NO: 3533486 - RNA, 19 nt, Pseudomonas putida KT2440
ccugcaacgucgccacgcg

SEQ ID NO: 3533487 - RNA, 16 nt, Pseudomonas putida KT2440
ccugcaacucggccuu

SEQ ID NO: 3533488 - RNA, 14 nt, Pseudomonas putida KT2440
ccugcaacugggca

SEQ ID NO: 3533489 - RNA, 20 nt, Pseudomonas putida KT2440
ccugcaaggcaaugcccaug

SEQ ID NO: 3533490 - RNA, 13 nt, Pseudomonas putida KT2440
ccugcaauaacgc

SEQ ID NO: 3533491 - RNA, 22 nt, Pseudomonas putida KT2440
ccugcacaacccuaucagggcu

SEQ ID NO: 3533492 - RNA, 13 nt, Pseudomonas putida KT2440
ccugcacacugcc

SEQ ID NO: 3533493 - RNA, 19 nt, Pseudomonas putida KT2440
ccugcacacugcccagcag

SEQ ID NO: 3533494 - RNA, 20 nt, Pseudomonas putida KT2440
ccugcacaucggccaccgcc

SEQ ID NO: 3533495 - RNA, 13 nt, Pseudomonas putida KT2440
ccugcaccacaug

SEQ ID NO: 3533496 - RNA, 16 nt, Pseudomonas putida KT2440
ccugcaccaguuccug

SEQ ID NO: 3533497 - RNA, 17 nt, Pseudomonas putida KT2440
ccugcaccaguuccugg

SEQ ID NO: 3533498 - RNA, 18 nt, Pseudomonas putida KT2440
ccugcaccaguuccuggc

SEQ ID NO: 3533499 - RNA, 15 nt, Pseudomonas putida KT2440
ccugcaccgaagcac

SEQ ID NO: 3533500 - RNA, 18 nt, Pseudomonas putida KT2440
ccugcaccgaagcaccac

SEQ ID NO: 3533501 - RNA, 21 nt, Pseudomonas putida KT2440
ccugcaccuggcugagguuca

SEQ ID NO: 3533502 - RNA, 20 nt, Pseudomonas putida KT2440
ccugcaccuuguuacccgca

SEQ ID NO: 3533503 - RNA, 17 nt, Pseudomonas putida KT2440
ccugcacgcucagugug

SEQ ID NO: 3533504 - RNA, 19 nt, Pseudomonas putida KT2440
ccugcacggcaaaguccag

SEQ ID NO: 3533505 - RNA, 18 nt, Pseudomonas putida KT2440
ccugcacugcacccucuu

SEQ ID NO: 3533506 - RNA, 19 nt, Pseudomonas putida KT2440
ccugcacugcacccucuuc

SEQ ID NO: 3533507 - RNA, 21 nt, Pseudomonas putida KT2440
ccugcacugcacccucuuccu

SEQ ID NO: 3533508 - RNA, 16 nt, Pseudomonas putida KT2440
ccugcacuggccucuu

SEQ ID NO: 3533509 - RNA, 15 nt, Pseudomonas putida KT2440
ccugcacugggcgaa

SEQ ID NO: 3533510 - RNA, 10 nt, Pseudomonas putida KT2440
ccugcagaga

SEQ ID NO: 3533511 - RNA, 18 nt, Pseudomonas putida KT2440
ccugcagagacaucucca

SEQ ID NO: 3533512 - RNA, 14 nt, Pseudomonas putida KT2440
ccugcagcaccagc

SEQ ID NO: 3533513 - RNA, 16 nt, Pseudomonas putida KT2440
ccugcagcacccuucc

SEQ ID NO: 3533514 - RNA, 13 nt, Pseudomonas putida KT2440
ccugcagcaggcc

SEQ ID NO: 3533515 - RNA, 14 nt, Pseudomonas putida KT2440
ccugcagcccggca

SEQ ID NO: 3533516 - RNA, 22 nt, Pseudomonas putida KT2440
ccugcagcgcggcgaucaacgc

SEQ ID NO: 3533517 - RNA, 23 nt, Pseudomonas putida KT2440
ccugcagcgcggcgaucaacgca

SEQ ID NO: 3533518 - RNA, 17 nt, Pseudomonas putida KT2440
ccugcagcucagccagc

SEQ ID NO: 3533519 - RNA, 18 nt, Pseudomonas putida KT2440
ccugcagcucagccagca

SEQ ID NO: 3533520 - RNA, 19 nt, Pseudomonas putida KT2440
ccugcagcuucccggccug

SEQ ID NO: 3533521 - RNA, 18 nt, Pseudomonas putida KT2440
ccugcaggaaccuccguu

SEQ ID NO: 3533522 - RNA, 17 nt, Pseudomonas putida KT2440
ccugcaggagcggguuc

SEQ ID NO: 3533523 - RNA, 16 nt, Pseudomonas putida KT2440
ccugcaggcccaggug

SEQ ID NO: 3533524 - RNA, 19 nt, Pseudomonas putida KT2440
ccugcaggcccuguagaua

SEQ ID NO: 3533525 - RNA, 19 nt, Pseudomonas putida KT2440
ccugcaggcgcggugccgg

SEQ ID NO: 3533526 - RNA, 14 nt, Pseudomonas putida KT2440
ccugcaggcugccg

SEQ ID NO: 3533527 - RNA, 21 nt, Pseudomonas putida KT2440
ccugcagggaacugcgcgagc

SEQ ID NO: 3533528 - RNA, 16 nt, Pseudomonas putida KT2440
ccugcagggcgagcac

SEQ ID NO: 3533529 - RNA, 19 nt, Pseudomonas putida KT2440
ccugcagguacagcagcug

SEQ ID NO: 3533530 - RNA, 18 nt, Pseudomonas putida KT2440
ccugcauaugcagggccu

SEQ ID NO: 3533531 - RNA, 16 nt, Pseudomonas putida KT2440
ccugcauccacaccag

SEQ ID NO: 3533532 - RNA, 19 nt, Pseudomonas putida KT2440
ccugcauccacaccagcgg

SEQ ID NO: 3533533 - RNA, 17 nt, Pseudomonas putida KT2440
ccugcaugcgugccuug

SEQ ID NO: 3533534 - RNA, 17 nt, Pseudomonas putida KT2440
ccugcaugcucaucgcg

SEQ ID NO: 3533535 - RNA, 19 nt, Pseudomonas putida KT2440
ccugcauggcauucgccac

SEQ ID NO: 3533536 - RNA, 20 nt, Pseudomonas putida KT2440
ccugcauggcauucgccacu

SEQ ID NO: 3533537 - RNA, 23 nt, Pseudomonas putida KT2440
ccugcauugcgcgucacugcacc

SEQ ID NO: 3533538 - RNA, 14 nt, Pseudomonas putida KT2440
ccugccaacgcacc

SEQ ID NO: 3533539 - RNA, 19 nt, Pseudomonas putida KT2440
ccugccaacgcaccgacca

SEQ ID NO: 3533540 - RNA, 19 nt, Pseudomonas putida KT2440
ccugccacacacccgggcc

SEQ ID NO: 3533541 - RNA, 12 nt, Pseudomonas putida KT2440
ccugccacccau

SEQ ID NO: 3533542 - RNA, 21 nt, Pseudomonas putida KT2440
ccugccacgauggucacccgc

SEQ ID NO: 3533543 - RNA, 20 nt, Pseudomonas putida KT2440
ccugccacucguccgggcgc

SEQ ID NO: 3533544 - RNA, 14 nt, Pseudomonas putida KT2440
ccugccacugcgcu

SEQ ID NO: 3533545 - RNA, 15 nt, Pseudomonas putida KT2440
ccugccagcaccagc

SEQ ID NO: 3533546 - RNA, 12 nt, Pseudomonas putida KT2440
ccugccagcccc

SEQ ID NO: 3533547 - RNA, 13 nt, Pseudomonas putida KT2440
ccugccagccccg

SEQ ID NO: 3533548 - RNA, 13 nt, Pseudomonas putida KT2440
ccugccagccgca

SEQ ID NO: 3533549 - RNA, 17 nt, Pseudomonas putida KT2440
ccugccagccgcaaccg

SEQ ID NO: 3533550 - RNA, 18 nt, Pseudomonas putida KT2440
ccugccaggucaccgccc

SEQ ID NO: 3533551 - RNA, 11 nt, Pseudomonas putida KT2440
ccugccccagc

SEQ ID NO: 3533552 - RNA, 16 nt, Pseudomonas putida KT2440
ccugccccagcgucac

SEQ ID NO: 3533553 - RNA, 19 nt, Pseudomonas putida KT2440
ccugccccagcgucacccg

SEQ ID NO: 3533554 - RNA, 21 nt, Pseudomonas putida KT2440
ccugcccgaucgccucgcugg

SEQ ID NO: 3533555 - RNA, 17 nt, Pseudomonas putida KT2440
ccugcccgccccccacc

SEQ ID NO: 3533556 - RNA, 14 nt, Pseudomonas putida KT2440
ccugcccgguacgc

SEQ ID NO: 3533557 - RNA, 23 nt, Pseudomonas putida KT2440
ccugcccucgacaaucgccaggu

SEQ ID NO: 3533558 - RNA, 13 nt, Pseudomonas putida KT2440
ccugccgaggcca

SEQ ID NO: 3533559 - RNA, 16 nt, Pseudomonas putida KT2440
ccugccgaucuucgcc

SEQ ID NO: 3533560 - RNA, 20 nt, Pseudomonas putida KT2440
ccugccgaugggcacuggcc

SEQ ID NO: 3533561 - RNA, 21 nt, Pseudomonas putida KT2440
ccugccgaugggcacuggcca

SEQ ID NO: 3533562 - RNA, 23 nt, Pseudomonas putida KT2440
ccugccgaugggcacuggccacc

SEQ ID NO: 3533563 - RNA, 18 nt, Pseudomonas putida KT2440
ccugccgggucaaggcca

SEQ ID NO: 3533564 - RNA, 21 nt, Pseudomonas putida KT2440
ccugccgggucaaggccagcg

SEQ ID NO: 3533565 - RNA, 18 nt, Pseudomonas putida KT2440
ccugccuaccaccgcauc

SEQ ID NO: 3533566 - RNA, 14 nt, Pseudomonas putida KT2440
ccugccuggcccuc

SEQ ID NO: 3533567 - RNA, 20 nt, Pseudomonas putida KT2440
ccugccuugcgauaccccgc

SEQ ID NO: 3533568 - RNA, 21 nt, Pseudomonas putida KT2440
ccugcgauugcgauccgcccc

SEQ ID NO: 3533569 - RNA, 14 nt, Pseudomonas putida KT2440
ccugcgcaggcgcc

SEQ ID NO: 3533570 - RNA, 12 nt, Pseudomonas putida KT2440
ccugcgccagcg

SEQ ID NO: 3533571 - RNA, 16 nt, Pseudomonas putida KT2440
ccugcgcccaaucacc

SEQ ID NO: 3533572 - RNA, 21 nt, Pseudomonas putida KT2440
ccugcgcccaguagcgccacc

SEQ ID NO: 3533573 - RNA, 23 nt, Pseudomonas putida KT2440
ccugcgccccgguacgacgcacc

SEQ ID NO: 3533574 - RNA, 11 nt, Pseudomonas putida KT2440
ccugcgccgcc

SEQ ID NO: 3533575 - RNA, 14 nt, Pseudomonas putida KT2440
ccugcgccgccacc

SEQ ID NO: 3533576 - RNA, 16 nt, Pseudomonas putida KT2440
ccugcgccgccaccug

SEQ ID NO: 3533577 - RNA, 21 nt, Pseudomonas putida KT2440
ccugcgccgggaaaucuuccg

SEQ ID NO: 3533578 - RNA, 18 nt, Pseudomonas putida KT2440
ccugcgccuguuuuccau

SEQ ID NO: 3533579 - RNA, 23 nt, Pseudomonas putida KT2440
ccugcgccuugcuuggcagcggc

SEQ ID NO: 3533580 - RNA, 17 nt, Pseudomonas putida KT2440
ccugcgcuccagcagcu

SEQ ID NO: 3533581 - RNA, 18 nt, Pseudomonas putida KT2440
ccugcgcuccagcagcuc

SEQ ID NO: 3533582 - RNA, 16 nt, Pseudomonas putida KT2440
ccugcgcuugcaccag

SEQ ID NO: 3533583 - RNA, 22 nt, Pseudomonas putida KT2440
ccugcggaaaagcgagguacgg

SEQ ID NO: 3533584 - RNA, 20 nt, Pseudomonas putida KT2440
ccugcggcagauccugcagc

SEQ ID NO: 3533585 - RNA, 22 nt, Pseudomonas putida KT2440
ccugcggcagauccugcagccg

SEQ ID NO: 3533586 - RNA, 16 nt, Pseudomonas putida KT2440
ccugcggccaggccgg

SEQ ID NO: 3533587 - RNA, 23 nt, Pseudomonas putida KT2440
ccugcggcugccccaacugcauc

SEQ ID NO: 3533588 - RNA, 21 nt, Pseudomonas putida KT2440
ccugcggcuguccagcaaggg

SEQ ID NO: 3533589 - RNA, 16 nt, Pseudomonas putida KT2440
ccugcgggagcgggcg

SEQ ID NO: 3533590 - RNA, 18 nt, Pseudomonas putida KT2440
ccugcgggucauccucaa

SEQ ID NO: 3533591 - RNA, 17 nt, Pseudomonas putida KT2440
ccugcguaauuccugug

SEQ ID NO: 3533592 - RNA, 17 nt, Pseudomonas putida KT2440
ccugcguacccagcccc

SEQ ID NO: 3533593 - RNA, 19 nt, Pseudomonas putida KT2440
ccugcguacccagcccccc

SEQ ID NO: 3533594 - RNA, 14 nt, Pseudomonas putida KT2440
ccugcgucaggacc

SEQ ID NO: 3533595 - RNA, 21 nt, Pseudomonas putida KT2440
ccugcgucaggaccugguccc

SEQ ID NO: 3533596 - RNA, 15 nt, Pseudomonas putida KT2440
ccugcguugccccca

SEQ ID NO: 3533597 - RNA, 20 nt, Pseudomonas putida KT2440
ccugcguugcccccagccgg

SEQ ID NO: 3533598 - RNA, 14 nt, Pseudomonas putida KT2440
ccugcucauccagc

SEQ ID NO: 3533599 - RNA, 14 nt, Pseudomonas putida KT2440
ccugcuccacaauc

SEQ ID NO: 3533600 - RNA, 17 nt, Pseudomonas putida KT2440
ccugcuccagcacccgc

SEQ ID NO: 3533601 - RNA, 16 nt, Pseudomonas putida KT2440
ccugcuccagcaccug

SEQ ID NO: 3533602 - RNA, 15 nt, Pseudomonas putida KT2440
ccugcuccggaaucc

SEQ ID NO: 3533603 - RNA, 16 nt, Pseudomonas putida KT2440
ccugcuccugauaguu

SEQ ID NO: 3533604 - RNA, 14 nt, Pseudomonas putida KT2440
ccugcuccuggucc

SEQ ID NO: 3533605 - RNA, 19 nt, Pseudomonas putida KT2440
ccugcuccugguccugcgc

SEQ ID NO: 3533606 - RNA, 15 nt, Pseudomonas putida KT2440
ccugcucgacaagcc

SEQ ID NO: 3533607 - RNA, 19 nt, Pseudomonas putida KT2440
ccugcucgacaagccgcug

SEQ ID NO: 3533608 - RNA, 20 nt, Pseudomonas putida KT2440
ccugcucgccaaauguagga

SEQ ID NO: 3533609 - RNA, 21 nt, Pseudomonas putida KT2440
ccugcucgcucaggcucuuga

SEQ ID NO: 3533610 - RNA, 17 nt, Pseudomonas putida KT2440
ccugcugacaccgcugc

SEQ ID NO: 3533611 - RNA, 13 nt, Pseudomonas putida KT2440
ccugcugacgcag

SEQ ID NO: 3533612 - RNA, 18 nt, Pseudomonas putida KT2440
ccugcugauuagaguagu

SEQ ID NO: 3533613 - RNA, 18 nt, Pseudomonas putida KT2440
ccugcugcaacaacugga

SEQ ID NO: 3533614 - RNA, 16 nt, Pseudomonas putida KT2440
ccugcugcaacagcuc

SEQ ID NO: 3533615 - RNA, 15 nt, Pseudomonas putida KT2440
ccugcugcagcuccg

SEQ ID NO: 3533616 - RNA, 17 nt, Pseudomonas putida KT2440
ccugcugcagcuccgga

SEQ ID NO: 3533617 - RNA, 13 nt, Pseudomonas putida KT2440
ccugcugcaggcu

SEQ ID NO: 3533618 - RNA, 16 nt, Pseudomonas putida KT2440
ccugcugccaggccgc

SEQ ID NO: 3533619 - RNA, 17 nt, Pseudomonas putida KT2440
ccugcugccgcaccucg

SEQ ID NO: 3533620 - RNA, 16 nt, Pseudomonas putida KT2440
ccugcugccguuuauu

SEQ ID NO: 3533621 - RNA, 14 nt, Pseudomonas putida KT2440
ccugcugcucccca

SEQ ID NO: 3533622 - RNA, 13 nt, Pseudomonas putida KT2440
ccugcugcucgcu

SEQ ID NO: 3533623 - RNA, 17 nt, Pseudomonas putida KT2440
ccugcugcuggcacgcc

SEQ ID NO: 3533624 - RNA, 14 nt, Pseudomonas putida KT2440
ccugcuggccaauc

SEQ ID NO: 3533625 - RNA, 19 nt, Pseudomonas putida KT2440
ccugcuggccaaucuccac

SEQ ID NO: 3533626 - RNA, 15 nt, Pseudomonas putida KT2440
ccugcuggccgcgca

SEQ ID NO: 3533627 - RNA, 16 nt, Pseudomonas putida KT2440
ccugcuggccgcgcag

SEQ ID NO: 3533628 - RNA, 22 nt, Pseudomonas putida KT2440
ccugcuggcucagcgagcgguu

SEQ ID NO: 3533629 - RNA, 11 nt, Pseudomonas putida KT2440
ccugcugggcg

SEQ ID NO: 3533630 - RNA, 18 nt, Pseudomonas putida KT2440
ccugcugggucagcgcug

SEQ ID NO: 3533631 - RNA, 14 nt, Pseudomonas putida KT2440
ccugcugguacagc

SEQ ID NO: 3533632 - RNA, 19 nt, Pseudomonas putida KT2440
ccugcugguacagccggcu

SEQ ID NO: 3533633 - RNA, 16 nt, Pseudomonas putida KT2440
ccugcuguagcgccca

SEQ ID NO: 3533634 - RNA, 21 nt, Pseudomonas putida KT2440
ccugcuguagcgcccacaagu

SEQ ID NO: 3533635 - RNA, 20 nt, Pseudomonas putida KT2440
ccugcuucgcgggcacgccc

SEQ ID NO: 3533636 - RNA, 18 nt, Pseudomonas putida KT2440
ccugcuugaucaggcccg

SEQ ID NO: 3533637 - RNA, 14 nt, Pseudomonas putida KT2440
ccugcuugccgcug

SEQ ID NO: 3533638 - RNA, 13 nt, Pseudomonas putida KT2440
ccugcuugccggg

SEQ ID NO: 3533639 - RNA, 16 nt, Pseudomonas putida KT2440
ccugcuugccgggugc

SEQ ID NO: 3533640 - RNA, 19 nt, Pseudomonas putida KT2440
ccugcuugccgggugcauc

SEQ ID NO: 3533641 - RNA, 20 nt, Pseudomonas putida KT2440
ccugcuugccgggugcaucg

SEQ ID NO: 3533642 - RNA, 16 nt, Pseudomonas putida KT2440
ccugcuuggcaccuau

SEQ ID NO: 3533643 - RNA, 13 nt, Pseudomonas putida KT2440
ccugcuuggccga

SEQ ID NO: 3533644 - RNA, 18 nt, Pseudomonas putida KT2440
ccuggaaaauccgcuuga

SEQ ID NO: 3533645 - RNA, 20 nt, Pseudomonas putida KT2440
ccuggacaaucucggcaaaa

SEQ ID NO: 3533646 - RNA, 16 nt, Pseudomonas putida KT2440
ccuggacccgcagcag

SEQ ID NO: 3533647 - RNA, 19 nt, Pseudomonas putida KT2440
ccuggacgguauaggcccc

SEQ ID NO: 3533648 - RNA, 21 nt, Pseudomonas putida KT2440
ccuggagaccuuucccaugac

SEQ ID NO: 3533649 - RNA, 14 nt, Pseudomonas putida KT2440
ccuggagagcccca

SEQ ID NO: 3533650 - RNA, 14 nt, Pseudomonas putida KT2440
ccuggaucagccgc

SEQ ID NO: 3533651 - RNA, 17 nt, Pseudomonas putida KT2440
ccuggaucagccgcgcc

SEQ ID NO: 3533652 - RNA, 17 nt, Pseudomonas putida KT2440
ccuggaucgccaggcug

SEQ ID NO: 3533653 - RNA, 17 nt, Pseudomonas putida KT2440
ccuggaucgcucucgcu

SEQ ID NO: 3533654 - RNA, 20 nt, Pseudomonas putida KT2440
ccuggaugacgauaugcccg

SEQ ID NO: 3533655 - RNA, 15 nt, Pseudomonas putida KT2440
ccuggaugcgggcuu

SEQ ID NO: 3533656 - RNA, 17 nt, Pseudomonas putida KT2440
ccuggcacgcccggcac

SEQ ID NO: 3533657 - RNA, 17 nt, Pseudomonas putida KT2440
ccuggcagccgaagcug

SEQ ID NO: 3533658 - RNA, 17 nt, Pseudomonas putida KT2440
ccuggcaugccccucga

SEQ ID NO: 3533659 - RNA, 16 nt, Pseudomonas putida KT2440
ccuggccacuguugca

SEQ ID NO: 3533660 - RNA, 17 nt, Pseudomonas putida KT2440
ccuggccacuguugcag

SEQ ID NO: 3533661 - RNA, 23 nt, Pseudomonas putida KT2440
ccuggccauaguugaccagcacc

SEQ ID NO: 3533662 - RNA, 16 nt, Pseudomonas putida KT2440
ccuggcccgaacgcag

SEQ ID NO: 3533663 - RNA, 18 nt, Pseudomonas putida KT2440
ccuggcccgaacgcagcg

SEQ ID NO: 3533664 - RNA, 19 nt, Pseudomonas putida KT2440
ccuggcccgaacgcagcgc

SEQ ID NO: 3533665 - RNA, 14 nt, Pseudomonas putida KT2440
ccuggcccgcagcg

SEQ ID NO: 3533666 - RNA, 15 nt, Pseudomonas putida KT2440
ccuggcccgccgcca

SEQ ID NO: 3533667 - RNA, 22 nt, Pseudomonas putida KT2440
ccuggcccgccgccaccagcgc

SEQ ID NO: 3533668 - RNA, 16 nt, Pseudomonas putida KT2440
ccuggcccugcucacg

SEQ ID NO: 3533669 - RNA, 21 nt, Pseudomonas putida KT2440
ccuggcccugcucacgcagcu

SEQ ID NO: 3533670 - RNA, 22 nt, Pseudomonas putida KT2440
ccuggcccuuucgcgggcacgc

SEQ ID NO: 3533671 - RNA, 15 nt, Pseudomonas putida KT2440
ccuggccgcugcgcc

SEQ ID NO: 3533672 - RNA, 22 nt, Pseudomonas putida KT2440
ccuggccgguguggccaaggcg

SEQ ID NO: 3533673 - RNA, 22 nt, Pseudomonas putida KT2440
ccuggccgugacgccgugggcu

SEQ ID NO: 3533674 - RNA, 13 nt, Pseudomonas putida KT2440
ccuggccugcaga

SEQ ID NO: 3533675 - RNA, 15 nt, Pseudomonas putida KT2440
ccuggccugcaugcu

SEQ ID NO: 3533676 - RNA, 14 nt, Pseudomonas putida KT2440
ccuggccuggccaa

SEQ ID NO: 3533677 - RNA, 16 nt, Pseudomonas putida KT2440
ccuggccuuccagcug

SEQ ID NO: 3533678 - RNA, 16 nt, Pseudomonas putida KT2440
ccuggcgcaguucguc

SEQ ID NO: 3533679 - RNA, 17 nt, Pseudomonas putida KT2440
ccuggcgccugcgccag

SEQ ID NO: 3533680 - RNA, 19 nt, Pseudomonas putida KT2440
ccuggcgccugcgccagug

SEQ ID NO: 3533681 - RNA, 15 nt, Pseudomonas putida KT2440
ccuggcgcuccucca

SEQ ID NO: 3533682 - RNA, 17 nt, Pseudomonas putida KT2440
ccuggcgcuccuccagc

SEQ ID NO: 3533683 - RNA, 14 nt, Pseudomonas putida KT2440
ccuggcggcccgcc

SEQ ID NO: 3533684 - RNA, 18 nt, Pseudomonas putida KT2440
ccuggcggcccgccggca

SEQ ID NO: 3533685 - RNA, 21 nt, Pseudomonas putida KT2440
ccuggcgguaaacguggucag

SEQ ID NO: 3533686 - RNA, 18 nt, Pseudomonas putida KT2440
ccuggcgguugaccaggg

SEQ ID NO: 3533687 - RNA, 20 nt, Pseudomonas putida KT2440
ccuggcgguugaccagggcg

SEQ ID NO: 3533688 - RNA, 24 nt, Pseudomonas putida KT2440
ccuggcguacccgucgcucuucaa

SEQ ID NO: 3533689 - RNA, 22 nt, Pseudomonas putida KT2440
ccuggcucaccuuaucggccgg

SEQ ID NO: 3533690 - RNA, 17 nt, Pseudomonas putida KT2440
ccuggcucgaucacgaa

SEQ ID NO: 3533691 - RNA, 23 nt, Pseudomonas putida KT2440
ccuggcucgaucacgaacacauc

SEQ ID NO: 3533692 - RNA, 18 nt, Pseudomonas putida KT2440
ccuggcugcagugaagaa

SEQ ID NO: 3533693 - RNA, 14 nt, Pseudomonas putida KT2440
ccuggcuggcagcc

SEQ ID NO: 3533694 - RNA, 23 nt, Pseudomonas putida KT2440
ccuggcuggcagccggcgccggu

SEQ ID NO: 3533695 - RNA, 16 nt, Pseudomonas putida KT2440
ccuggcuuuccagguc

SEQ ID NO: 3533696 - RNA, 20 nt, Pseudomonas putida KT2440
ccuggcuuuccagguccuug

SEQ ID NO: 3533697 - RNA, 22 nt, Pseudomonas putida KT2440
ccugggaagcugcagcagcuuc

SEQ ID NO: 3533698 - RNA, 16 nt, Pseudomonas putida KT2440
ccugggccggugggca

SEQ ID NO: 3533699 - RNA, 23 nt, Pseudomonas putida KT2440
ccugggccggugggcaacagcug

SEQ ID NO: 3533700 - RNA, 17 nt, Pseudomonas putida KT2440
ccugggccuucgcccgc

SEQ ID NO: 3533701 - RNA, 16 nt, Pseudomonas putida KT2440
ccugggcgucaaaguu

SEQ ID NO: 3533702 - RNA, 13 nt, Pseudomonas putida KT2440
ccugggcguucug

SEQ ID NO: 3533703 - RNA, 14 nt, Pseudomonas putida KT2440
ccugggcguucuga

SEQ ID NO: 3533704 - RNA, 23 nt, Pseudomonas putida KT2440
ccugggcuucaugcugcugcagc

SEQ ID NO: 3533705 - RNA, 14 nt, Pseudomonas putida KT2440
ccuggggcaggccc

SEQ ID NO: 3533706 - RNA, 18 nt, Pseudomonas putida KT2440
ccuggggcaggcccggca

SEQ ID NO: 3533707 - RNA, 13 nt, Pseudomonas putida KT2440
ccugggggucgcc

SEQ ID NO: 3533708 - RNA, 21 nt, Pseudomonas putida KT2440
ccugggucaaccccaggugcu

SEQ ID NO: 3533709 - RNA, 15 nt, Pseudomonas putida KT2440
ccugggucagcuccu

SEQ ID NO: 3533710 - RNA, 13 nt, Pseudomonas putida KT2440
ccugggucagcug

SEQ ID NO: 3533711 - RNA, 14 nt, Pseudomonas putida KT2440
ccugggucaggcgu

SEQ ID NO: 3533712 - RNA, 18 nt, Pseudomonas putida KT2440
ccuggguccaggcacacc

SEQ ID NO: 3533713 - RNA, 17 nt, Pseudomonas putida KT2440
ccugggugaccaccagc

SEQ ID NO: 3533714 - RNA, 19 nt, Pseudomonas putida KT2440
ccuggguuuuaaccggccc

SEQ ID NO: 3533715 - RNA, 20 nt, Pseudomonas putida KT2440
ccuggguuuuaaccggcccu

SEQ ID NO: 3533716 - RNA, 12 nt, Pseudomonas putida KT2440
ccugguaccccu

SEQ ID NO: 3533717 - RNA, 21 nt, Pseudomonas putida KT2440
ccugguaggucacuucagugc

SEQ ID NO: 3533718 - RNA, 20 nt, Pseudomonas putida KT2440
ccuggucacucugccgcccc

SEQ ID NO: 3533719 - RNA, 22 nt, Pseudomonas putida KT2440
ccuggucaugcagcgggucgca

SEQ ID NO: 3533720 - RNA, 22 nt, Pseudomonas putida KT2440
ccugguccccauagcuuuccag

SEQ ID NO: 3533721 - RNA, 16 nt, Pseudomonas putida KT2440
ccugguccgugagaaa

SEQ ID NO: 3533722 - RNA, 14 nt, Pseudomonas putida KT2440
ccuggucgccgcca

SEQ ID NO: 3533723 - RNA, 15 nt, Pseudomonas putida KT2440
ccuggucgcgggcca

SEQ ID NO: 3533724 - RNA, 16 nt, Pseudomonas putida KT2440
ccuggucgcgggccag

SEQ ID NO: 3533725 - RNA, 21 nt, Pseudomonas putida KT2440
ccuggucuucguuacgcccgg

SEQ ID NO: 3533726 - RNA, 23 nt, Pseudomonas putida KT2440
ccuggucuucguuacgcccggca

SEQ ID NO: 3533727 - RNA, 16 nt, Pseudomonas putida KT2440
ccuggugccagcggcc

SEQ ID NO: 3533728 - RNA, 22 nt, Pseudomonas putida KT2440
ccugguuauccagguaaaccug

SEQ ID NO: 3533729 - RNA, 23 nt, Pseudomonas putida KT2440
ccugguuauuuuuuaacaaggca

SEQ ID NO: 3533730 - RNA, 13 nt, Pseudomonas putida KT2440
ccugguuggccag

SEQ ID NO: 3533731 - RNA, 23 nt, Pseudomonas putida KT2440
ccugguuguagcccgggcagccg

SEQ ID NO: 3533732 - RNA, 16 nt, Pseudomonas putida KT2440
ccuguaacucagcuua

SEQ ID NO: 3533733 - RNA, 20 nt, Pseudomonas putida KT2440
ccuguacacagcccaaggcu

SEQ ID NO: 3533734 - RNA, 11 nt, Pseudomonas putida KT2440
ccuguaccgac

SEQ ID NO: 3533735 - RNA, 19 nt, Pseudomonas putida KT2440
ccuguagagcgccuugucg

SEQ ID NO: 3533736 - RNA, 21 nt, Pseudomonas putida KT2440
ccuguaggaauuucggcguug

SEQ ID NO: 3533737 - RNA, 17 nt, Pseudomonas putida KT2440
ccuguaggagcgggcuu

SEQ ID NO: 3533738 - RNA, 19 nt, Pseudomonas putida KT2440
ccuguaggagcggguuuac

SEQ ID NO: 3533739 - RNA, 23 nt, Pseudomonas putida KT2440
ccuguaggagcggguuuacccgc

SEQ ID NO: 3533740 - RNA, 18 nt, Pseudomonas putida KT2440
ccuguaggaucggguuua

SEQ ID NO: 3533741 - RNA, 23 nt, Pseudomonas putida KT2440
ccuguaggaucggguuuacccgc

SEQ ID NO: 3533742 - RNA, 19 nt, Pseudomonas putida KT2440
ccuguaggcgcaacucagc

SEQ ID NO: 3533743 - RNA, 20 nt, Pseudomonas putida KT2440
ccuguaggugcggcuuuagc

SEQ ID NO: 3533744 - RNA, 19 nt, Pseudomonas putida KT2440
ccuguaguacacgaggaua

SEQ ID NO: 3533745 - RNA, 20 nt, Pseudomonas putida KT2440
ccuguaucggccucuucgcg

SEQ ID NO: 3533746 - RNA, 18 nt, Pseudomonas putida KT2440
ccugucacguugcccgac

SEQ ID NO: 3533747 - RNA, 18 nt, Pseudomonas putida KT2440
ccugucauggcagucgua

SEQ ID NO: 3533748 - RNA, 16 nt, Pseudomonas putida KT2440
ccuguccaggcaauca

SEQ ID NO: 3533749 - RNA, 20 nt, Pseudomonas putida KT2440
ccuguccaggcaaucacuga

SEQ ID NO: 3533750 - RNA, 12 nt, Pseudomonas putida KT2440
ccuguccccuug

SEQ ID NO: 3533751 - RNA, 22 nt, Pseudomonas putida KT2440
ccugucgcgacgggcugcuccc

SEQ ID NO: 3533752 - RNA, 18 nt, Pseudomonas putida KT2440
ccugucgcucuuaauuca

SEQ ID NO: 3533753 - RNA, 18 nt, Pseudomonas putida KT2440
ccugucguuauccugcag

SEQ ID NO: 3533754 - RNA, 19 nt, Pseudomonas putida KT2440
ccugucguuauccugcagc

SEQ ID NO: 3533755 - RNA, 22 nt, Pseudomonas putida KT2440
ccugucguuauccugcagcacc

SEQ ID NO: 3533756 - RNA, 19 nt, Pseudomonas putida KT2440
ccugugaaugcgauggugg

SEQ ID NO: 3533757 - RNA, 22 nt, Pseudomonas putida KT2440
ccugugagaucgagcgccgccc

SEQ ID NO: 3533758 - RNA, 16 nt, Pseudomonas putida KT2440
ccugugaggccuucag

SEQ ID NO: 3533759 - RNA, 19 nt, Pseudomonas putida KT2440
ccugugaggccuucagcgc

SEQ ID NO: 3533760 - RNA, 22 nt, Pseudomonas putida KT2440
ccugugccgaaccaccgaugcc

SEQ ID NO: 3533761 - RNA, 21 nt, Pseudomonas putida KT2440
ccugugccggcagcgagcgcu

SEQ ID NO: 3533762 - RNA, 17 nt, Pseudomonas putida KT2440
ccugugccggccucuuc

SEQ ID NO: 3533763 - RNA, 19 nt, Pseudomonas putida KT2440
ccugugccggccucuucgc

SEQ ID NO: 3533764 - RNA, 20 nt, Pseudomonas putida KT2440
ccugugccggccucuucgcg

SEQ ID NO: 3533765 - RNA, 13 nt, Pseudomonas putida KT2440
ccugugcggcgua

SEQ ID NO: 3533766 - RNA, 19 nt, Pseudomonas putida KT2440
ccugugcuggccucuucgc

SEQ ID NO: 3533767 - RNA, 20 nt, Pseudomonas putida KT2440
ccugugcuggccucuucgcg

SEQ ID NO: 3533768 - RNA, 22 nt, Pseudomonas putida KT2440
ccugugcuuugagcaggcgcuc

SEQ ID NO: 3533769 - RNA, 20 nt, Pseudomonas putida KT2440
ccuguggaagcgggcgugcc

SEQ ID NO: 3533770 - RNA, 24 nt, Pseudomonas putida KT2440
ccugugggagcacaagcacgcgcu

SEQ ID NO: 3533771 - RNA, 15 nt, Pseudomonas putida KT2440
ccugugggagcgggc

SEQ ID NO: 3533772 - RNA, 17 nt, Pseudomonas putida KT2440
ccugugggagcgggcau

SEQ ID NO: 3533773 - RNA, 20 nt, Pseudomonas putida KT2440
ccugugggagcgggcaugcc

SEQ ID NO: 3533774 - RNA, 23 nt, Pseudomonas putida KT2440
ccugugggagcgggcaugcccgc

SEQ ID NO: 3533775 - RNA, 16 nt, Pseudomonas putida KT2440
ccugugggagcgggcg

SEQ ID NO: 3533776 - RNA, 20 nt, Pseudomonas putida KT2440
ccugugggagcgggcgcgcc

SEQ ID NO: 3533777 - RNA, 18 nt, Pseudomonas putida KT2440
ccuguggggcaacugcgc

SEQ ID NO: 3533778 - RNA, 19 nt, Pseudomonas putida KT2440
ccuguggggcaacugcgcg

SEQ ID NO: 3533779 - RNA, 21 nt, Pseudomonas putida KT2440
ccuguggggcaacugcgcgau

SEQ ID NO: 3533780 - RNA, 23 nt, Pseudomonas putida KT2440
ccugugguuucacacucgccagg

SEQ ID NO: 3533781 - RNA, 20 nt, Pseudomonas putida KT2440
ccuguguaggagcggguuua

SEQ ID NO: 3533782 - RNA, 14 nt, Pseudomonas putida KT2440
ccuguguccacccc

SEQ ID NO: 3533783 - RNA, 16 nt, Pseudomonas putida KT2440
ccuguguucaaccacc

SEQ ID NO: 3533784 - RNA, 20 nt, Pseudomonas putida KT2440
ccuguguuuucccaauccuc

SEQ ID NO: 3533785 - RNA, 14 nt, Pseudomonas putida KT2440
ccuguuccagcccc

SEQ ID NO: 3533786 - RNA, 15 nt, Pseudomonas putida KT2440
ccuguuccagccccu

SEQ ID NO: 3533787 - RNA, 20 nt, Pseudomonas putida KT2440
ccuguuccggcccuuucgcg

SEQ ID NO: 3533788 - RNA, 16 nt, Pseudomonas putida KT2440
ccuguuccggccucuu

SEQ ID NO: 3533789 - RNA, 19 nt, Pseudomonas putida KT2440
ccuguuccggccucuucgc

SEQ ID NO: 3533790 - RNA, 16 nt, Pseudomonas putida KT2440
ccuguugccgcuucga

SEQ ID NO: 3533791 - RNA, 17 nt, Pseudomonas putida KT2440
ccuguugccgcuucgac

SEQ ID NO: 3533792 - RNA, 15 nt, Pseudomonas putida KT2440
ccuguugcgauuucu

SEQ ID NO: 3533793 - RNA, 15 nt, Pseudomonas putida KT2440
ccuguuugccgaggu

SEQ ID NO: 3533794 - RNA, 20 nt, Pseudomonas putida KT2440
ccuuaaggucaaucagggau

SEQ ID NO: 3533795 - RNA, 19 nt, Pseudomonas putida KT2440
ccuuacgcagccuucugug

SEQ ID NO: 3533796 - RNA, 18 nt, Pseudomonas putida KT2440
ccuuauccuucaggcgcu

SEQ ID NO: 3533797 - RNA, 15 nt, Pseudomonas putida KT2440
ccuucaacaccaacu

SEQ ID NO: 3533798 - RNA, 13 nt, Pseudomonas putida KT2440
ccuucaacccuuc

SEQ ID NO: 3533799 - RNA, 14 nt, Pseudomonas putida KT2440
ccuucaagcucccc

SEQ ID NO: 3533800 - RNA, 15 nt, Pseudomonas putida KT2440
ccuucaauagcggcc

SEQ ID NO: 3533801 - RNA, 15 nt, Pseudomonas putida KT2440
ccuucaccaccaggu

SEQ ID NO: 3533802 - RNA, 16 nt, Pseudomonas putida KT2440
ccuucacgccagccgu

SEQ ID NO: 3533803 - RNA, 17 nt, Pseudomonas putida KT2440
ccuucacgcucaugcug

SEQ ID NO: 3533804 - RNA, 12 nt, Pseudomonas putida KT2440
ccuucagcagcc

SEQ ID NO: 3533805 - RNA, 15 nt, Pseudomonas putida KT2440
ccuucagcagccggu

SEQ ID NO: 3533806 - RNA, 18 nt, Pseudomonas putida KT2440
ccuucagcggccgcgcaa

SEQ ID NO: 3533807 - RNA, 19 nt, Pseudomonas putida KT2440
ccuucagcgggucgagcca

SEQ ID NO: 3533808 - RNA, 21 nt, Pseudomonas putida KT2440
ccuucagcgggucgagccagg

SEQ ID NO: 3533809 - RNA, 23 nt, Pseudomonas putida KT2440
ccuucagcgggucgagccaggcg

SEQ ID NO: 3533810 - RNA, 18 nt, Pseudomonas putida KT2440
ccuucaggcacaccucgg

SEQ ID NO: 3533811 - RNA, 19 nt, Pseudomonas putida KT2440
ccuucaggcacaccucggu

SEQ ID NO: 3533812 - RNA, 14 nt, Pseudomonas putida KT2440
ccuucaggccccag

SEQ ID NO: 3533813 - RNA, 19 nt, Pseudomonas putida KT2440
ccuucaggcgcucaccccg

SEQ ID NO: 3533814 - RNA, 18 nt, Pseudomonas putida KT2440
ccuucaggcgcugguuga

SEQ ID NO: 3533815 - RNA, 22 nt, Pseudomonas putida KT2440
ccuucagggccgguuaaaaccc

SEQ ID NO: 3533816 - RNA, 22 nt, Pseudomonas putida KT2440
ccuucagguuuggggugagcga

SEQ ID NO: 3533817 - RNA, 19 nt, Pseudomonas putida KT2440
ccuucauacagcgccucca

SEQ ID NO: 3533818 - RNA, 20 nt, Pseudomonas putida KT2440
ccuucauacagcgccuccag

SEQ ID NO: 3533819 - RNA, 18 nt, Pseudomonas putida KT2440
ccuucauagaacuuaaau

SEQ ID NO: 3533820 - RNA, 21 nt, Pseudomonas putida KT2440
ccuucauaggcggccacggcc

SEQ ID NO: 3533821 - RNA, 22 nt, Pseudomonas putida KT2440
ccuucaugccgaacgauucugc

SEQ ID NO: 3533822 - RNA, 15 nt, Pseudomonas putida KT2440
ccuuccaaccagcca

SEQ ID NO: 3533823 - RNA, 21 nt, Pseudomonas putida KT2440
ccuuccaaccagccagccacc

SEQ ID NO: 3533824 - RNA, 20 nt, Pseudomonas putida KT2440
ccuuccacucuuccaccgcc

SEQ ID NO: 3533825 - RNA, 14 nt, Pseudomonas putida KT2440
ccuuccagcccgcc

SEQ ID NO: 3533826 - RNA, 16 nt, Pseudomonas putida KT2440
ccuuccagcccgccug

SEQ ID NO: 3533827 - RNA, 17 nt, Pseudomonas putida KT2440
ccuuccagcccgccugc

SEQ ID NO: 3533828 - RNA, 19 nt, Pseudomonas putida KT2440
ccuuccagcccgccugcuc

SEQ ID NO: 3533829 - RNA, 14 nt, Pseudomonas putida KT2440
ccuuccagcugcgg

SEQ ID NO: 3533830 - RNA, 18 nt, Pseudomonas putida KT2440
ccuuccagcuucugcugg

SEQ ID NO: 3533831 - RNA, 14 nt, Pseudomonas putida KT2440
ccuuccaugccccu

SEQ ID NO: 3533832 - RNA, 15 nt, Pseudomonas putida KT2440
ccuuccccaggccgc

SEQ ID NO: 3533833 - RNA, 18 nt, Pseudomonas putida KT2440
ccuuccccaggccgccca

SEQ ID NO: 3533834 - RNA, 20 nt, Pseudomonas putida KT2440
ccuucccgccauugcaccac

SEQ ID NO: 3533835 - RNA, 21 nt, Pseudomonas putida KT2440
ccuucccgccauugcaccacg

SEQ ID NO: 3533836 - RNA, 22 nt, Pseudomonas putida KT2440
ccuucccgccuggcgccugcgc

SEQ ID NO: 3533837 - RNA, 16 nt, Pseudomonas putida KT2440
ccuuccgaccggucau

SEQ ID NO: 3533838 - RNA, 19 nt, Pseudomonas putida KT2440
ccuuccgcgugccccccca

SEQ ID NO: 3533839 - RNA, 21 nt, Pseudomonas putida KT2440
ccuuccguuaguucgugcacc

SEQ ID NO: 3533840 - RNA, 13 nt, Pseudomonas putida KT2440
ccuuccugcaccu

SEQ ID NO: 3533841 - RNA, 21 nt, Pseudomonas putida KT2440
ccuuccuugaacucagugccu

SEQ ID NO: 3533842 - RNA, 21 nt, Pseudomonas putida KT2440
ccuucgaccagaacagcucga

SEQ ID NO: 3533843 - RNA, 14 nt, Pseudomonas putida KT2440
ccuucgacuucccg

SEQ ID NO: 3533844 - RNA, 18 nt, Pseudomonas putida KT2440
ccuucgcaggcacgcccg

SEQ ID NO: 3533845 - RNA, 21 nt, Pseudomonas putida KT2440
ccuucgcaggcacgcccgcuc

SEQ ID NO: 3533846 - RNA, 15 nt, Pseudomonas putida KT2440
ccuucgccaacugca

SEQ ID NO: 3533847 - RNA, 16 nt, Pseudomonas putida KT2440
ccuucgccaacugcac

SEQ ID NO: 3533848 - RNA, 15 nt, Pseudomonas putida KT2440
ccuucgccaaggucc

SEQ ID NO: 3533849 - RNA, 18 nt, Pseudomonas putida KT2440
ccuucgccaagguccagc

SEQ ID NO: 3533850 - RNA, 18 nt, Pseudomonas putida KT2440
ccuucgcccgaccgccag

SEQ ID NO: 3533851 - RNA, 13 nt, Pseudomonas putida KT2440
ccuucgcgggcuc

SEQ ID NO: 3533852 - RNA, 20 nt, Pseudomonas putida KT2440
ccuucgcgggcuuuuuuuug

SEQ ID NO: 3533853 - RNA, 17 nt, Pseudomonas putida KT2440
ccuucgcucaggugcac

SEQ ID NO: 3533854 - RNA, 20 nt, Pseudomonas putida KT2440
ccuucggagguagccaccug

SEQ ID NO: 3533855 - RNA, 16 nt, Pseudomonas putida KT2440
ccuucggccacacggg

SEQ ID NO: 3533856 - RNA, 17 nt, Pseudomonas putida KT2440
ccuucggugcuggcgcu

SEQ ID NO: 3533857 - RNA, 21 nt, Pseudomonas putida KT2440
ccuucggugcuggcgcucaau

SEQ ID NO: 3533858 - RNA, 19 nt, Pseudomonas putida KT2440
ccuucgucgcuggccagcu

SEQ ID NO: 3533859 - RNA, 23 nt, Pseudomonas putida KT2440
ccuucuauuaaugcacgccugga

SEQ ID NO: 3533860 - RNA, 23 nt, Pseudomonas putida KT2440
ccuucuccgccuaccgcgucgcc

SEQ ID NO: 3533861 - RNA, 13 nt, Pseudomonas putida KT2440
ccuucucuuccgg

SEQ ID NO: 3533862 - RNA, 22 nt, Pseudomonas putida KT2440
ccuucugaaaggcguaggcaca

SEQ ID NO: 3533863 - RNA, 18 nt, Pseudomonas putida KT2440
ccuucugccguuugcugg

SEQ ID NO: 3533864 - RNA, 22 nt, Pseudomonas putida KT2440
ccuucugcgucgacucuuccca

SEQ ID NO: 3533865 - RNA, 14 nt, Pseudomonas putida KT2440
ccuucuggcagccg

SEQ ID NO: 3533866 - RNA, 22 nt, Pseudomonas putida KT2440
ccuucuuccagaacggcgcccg

SEQ ID NO: 3533867 - RNA, 14 nt, Pseudomonas putida KT2440
ccuucuugugcaca

SEQ ID NO: 3533868 - RNA, 14 nt, Pseudomonas putida KT2440
ccuucuuguuguuc

SEQ ID NO: 3533869 - RNA, 18 nt, Pseudomonas putida KT2440
ccuugaacggcauuucca

SEQ ID NO: 3533870 - RNA, 16 nt, Pseudomonas putida KT2440
ccuugaagaacaccug

SEQ ID NO: 3533871 - RNA, 16 nt, Pseudomonas putida KT2440
ccuugaagcuggccgu

SEQ ID NO: 3533872 - RNA, 12 nt, Pseudomonas putida KT2440
ccuugaccagcu

SEQ ID NO: 3533873 - RNA, 14 nt, Pseudomonas putida KT2440
ccuugaccagcuug

SEQ ID NO: 3533874 - RNA, 15 nt, Pseudomonas putida KT2440
ccuugaccucgacca

SEQ ID NO: 3533875 - RNA, 13 nt, Pseudomonas putida KT2440
ccuugagcacccc

SEQ ID NO: 3533876 - RNA, 20 nt, Pseudomonas putida KT2440
ccuugagcgccgcgcccaug

SEQ ID NO: 3533877 - RNA, 15 nt, Pseudomonas putida KT2440
ccuugaggggcggcg

SEQ ID NO: 3533878 - RNA, 23 nt, Pseudomonas putida KT2440
ccuugagguagucgauccaggug

SEQ ID NO: 3533879 - RNA, 16 nt, Pseudomonas putida KT2440
ccuugaguucccaggc

SEQ ID NO: 3533880 - RNA, 18 nt, Pseudomonas putida KT2440
ccuugaguucccaggcag

SEQ ID NO: 3533881 - RNA, 20 nt, Pseudomonas putida KT2440
ccuugaguucccaggcagcc

SEQ ID NO: 3533882 - RNA, 22 nt, Pseudomonas putida KT2440
ccuugaguucccaggcagccuc

SEQ ID NO: 3533883 - RNA, 12 nt, Pseudomonas putida KT2440
ccuugauacgcc

SEQ ID NO: 3533884 - RNA, 15 nt, Pseudomonas putida KT2440
ccuugauacgcccau

SEQ ID NO: 3533885 - RNA, 14 nt, Pseudomonas putida KT2440
ccuugaucaaugcc

SEQ ID NO: 3533886 - RNA, 14 nt, Pseudomonas putida KT2440
ccuugaucaggccc

SEQ ID NO: 3533887 - RNA, 15 nt, Pseudomonas putida KT2440
ccuugaucaggcccu

SEQ ID NO: 3533888 - RNA, 21 nt, Pseudomonas putida KT2440
ccuugaucaggggccgcgcag

SEQ ID NO: 3533889 - RNA, 17 nt, Pseudomonas putida KT2440
ccuugauuaccagcgcc

SEQ ID NO: 3533890 - RNA, 14 nt, Pseudomonas putida KT2440
ccuugcacaguucg

SEQ ID NO: 3533891 - RNA, 22 nt, Pseudomonas putida KT2440
ccuugcacaguucgaaaaccug

SEQ ID NO: 3533892 - RNA, 15 nt, Pseudomonas putida KT2440
ccuugcacucccccu

SEQ ID NO: 3533893 - RNA, 16 nt, Pseudomonas putida KT2440
ccuugcacucccccuu

SEQ ID NO: 3533894 - RNA, 13 nt, Pseudomonas putida KT2440
ccuugcagcgccg

SEQ ID NO: 3533895 - RNA, 18 nt, Pseudomonas putida KT2440
ccuugcagcgccgcaucc

SEQ ID NO: 3533896 - RNA, 23 nt, Pseudomonas putida KT2440
ccuugcagcgccgcauccagcac

SEQ ID NO: 3533897 - RNA, 13 nt, Pseudomonas putida KT2440
ccuugcagggcac

SEQ ID NO: 3533898 - RNA, 14 nt, Pseudomonas putida KT2440
ccuugcagggcacc

SEQ ID NO: 3533899 - RNA, 15 nt, Pseudomonas putida KT2440
ccuugccaacggcac

SEQ ID NO: 3533900 - RNA, 20 nt, Pseudomonas putida KT2440
ccuugccagcauggugcagg

SEQ ID NO: 3533901 - RNA, 14 nt, Pseudomonas putida KT2440
ccuugccagugauc

SEQ ID NO: 3533902 - RNA, 21 nt, Pseudomonas putida KT2440
ccuugccauaacuccagcgcc

SEQ ID NO: 3533903 - RNA, 14 nt, Pseudomonas putida KT2440
ccuugccaucgacc

SEQ ID NO: 3533904 - RNA, 16 nt, Pseudomonas putida KT2440
ccuugcccaccaggau

SEQ ID NO: 3533905 - RNA, 20 nt, Pseudomonas putida KT2440
ccuugcccagcuccagcacc

SEQ ID NO: 3533906 - RNA, 16 nt, Pseudomonas putida KT2440
ccuugccccacucggc

SEQ ID NO: 3533907 - RNA, 19 nt, Pseudomonas putida KT2440
ccuugccccgcaggccgcc

SEQ ID NO: 3533908 - RNA, 20 nt, Pseudomonas putida KT2440
ccuugcccugcagcuucccg

SEQ ID NO: 3533909 - RNA, 18 nt, Pseudomonas putida KT2440
ccuugccguagaugccgu

SEQ ID NO: 3533910 - RNA, 16 nt, Pseudomonas putida KT2440
ccuugccuaccugauc

SEQ ID NO: 3533911 - RNA, 14 nt, Pseudomonas putida KT2440
ccuugccugggccg

SEQ ID NO: 3533912 - RNA, 16 nt, Pseudomonas putida KT2440
ccuugccugggccggu

SEQ ID NO: 3533913 - RNA, 20 nt, Pseudomonas putida KT2440
ccuugcgauaccccgcugcc

SEQ ID NO: 3533914 - RNA, 15 nt, Pseudomonas putida KT2440
ccuugcgcacgcgcu

SEQ ID NO: 3533915 - RNA, 15 nt, Pseudomonas putida KT2440
ccuugcgcaucaagc

SEQ ID NO: 3533916 - RNA, 14 nt, Pseudomonas putida KT2440
ccuugcgccaggug

SEQ ID NO: 3533917 - RNA, 17 nt, Pseudomonas putida KT2440
ccuugcgcggcgcgccc

SEQ ID NO: 3533918 - RNA, 22 nt, Pseudomonas putida KT2440
ccuugcgcggcgcgcccugcuc

SEQ ID NO: 3533919 - RNA, 15 nt, Pseudomonas putida KT2440
ccuugcgcucgacgc

SEQ ID NO: 3533920 - RNA, 22 nt, Pseudomonas putida KT2440
ccuugcgcucgacgcgcgcagc

SEQ ID NO: 3533921 - RNA, 15 nt, Pseudomonas putida KT2440
ccuugcgcugggcau

SEQ ID NO: 3533922 - RNA, 21 nt, Pseudomonas putida KT2440
ccuugcggaccaccugggcca

SEQ ID NO: 3533923 - RNA, 16 nt, Pseudomonas putida KT2440
ccuugcggcaagcuca

SEQ ID NO: 3533924 - RNA, 22 nt, Pseudomonas putida KT2440
ccuugcggcaagcucagguuac

SEQ ID NO: 3533925 - RNA, 17 nt, Pseudomonas putida KT2440
ccuugcgggaacaccca

SEQ ID NO: 3533926 - RNA, 17 nt, Pseudomonas putida KT2440
ccuugcgugccucagcc

SEQ ID NO: 3533927 - RNA, 17 nt, Pseudomonas putida KT2440
ccuugcguugcaacaag

SEQ ID NO: 3533928 - RNA, 18 nt, Pseudomonas putida KT2440
ccuugcuccaccaggcca

SEQ ID NO: 3533929 - RNA, 19 nt, Pseudomonas putida KT2440
ccuugcuccaccaggccac

SEQ ID NO: 3533930 - RNA, 17 nt, Pseudomonas putida KT2440
ccuugcucggccagccg

SEQ ID NO: 3533931 - RNA, 21 nt, Pseudomonas putida KT2440
ccuugcugaaauccagccgcc

SEQ ID NO: 3533932 - RNA, 22 nt, Pseudomonas putida KT2440
ccuugcugaaauccagccgccc

SEQ ID NO: 3533933 - RNA, 23 nt, Pseudomonas putida KT2440
ccuugcugaaauccagccgcccg

SEQ ID NO: 3533934 - RNA, 16 nt, Pseudomonas putida KT2440
ccuugcugcagcaggc

SEQ ID NO: 3533935 - RNA, 17 nt, Pseudomonas putida KT2440
ccuugcugcagcaggcu

SEQ ID NO: 3533936 - RNA, 18 nt, Pseudomonas putida KT2440
ccuugcuggaacugcugc

SEQ ID NO: 3533937 - RNA, 19 nt, Pseudomonas putida KT2440
ccuugcuggccaccgcgcu

SEQ ID NO: 3533938 - RNA, 16 nt, Pseudomonas putida KT2440
ccuugcuguagcccac

SEQ ID NO: 3533939 - RNA, 21 nt, Pseudomonas putida KT2440
ccuugcuguagcccaccaggu

SEQ ID NO: 3533940 - RNA, 17 nt, Pseudomonas putida KT2440
ccuuggacaccaggcug

SEQ ID NO: 3533941 - RNA, 21 nt, Pseudomonas putida KT2440
ccuuggcacggccagccagca

SEQ ID NO: 3533942 - RNA, 13 nt, Pseudomonas putida KT2440
ccuuggcagccuc

SEQ ID NO: 3533943 - RNA, 16 nt, Pseudomonas putida KT2440
ccuuggcagcgcugca

SEQ ID NO: 3533944 - RNA, 11 nt, Pseudomonas putida KT2440
ccuuggccacc

SEQ ID NO: 3533945 - RNA, 19 nt, Pseudomonas putida KT2440
ccuuggccagcucauccag

SEQ ID NO: 3533946 - RNA, 21 nt, Pseudomonas putida KT2440
ccuuggccagcucauccagcc

SEQ ID NO: 3533947 - RNA, 22 nt, Pseudomonas putida KT2440
ccuuggccagcucauccagccg

SEQ ID NO: 3533948 - RNA, 13 nt, Pseudomonas putida KT2440
ccuuggccgccag

SEQ ID NO: 3533949 - RNA, 19 nt, Pseudomonas putida KT2440
ccuuggccgccaguaccaa

SEQ ID NO: 3533950 - RNA, 16 nt, Pseudomonas putida KT2440
ccuuggccgcuggccc

SEQ ID NO: 3533951 - RNA, 17 nt, Pseudomonas putida KT2440
ccuuggccgcuggcccu

SEQ ID NO: 3533952 - RNA, 23 nt, Pseudomonas putida KT2440
ccuuggccgguuucagucagcca

SEQ ID NO: 3533953 - RNA, 20 nt, Pseudomonas putida KT2440
ccuuggccucacauucaccg

SEQ ID NO: 3533954 - RNA, 13 nt, Pseudomonas putida KT2440
ccuuggccugcuc

SEQ ID NO: 3533955 - RNA, 18 nt, Pseudomonas putida KT2440
ccuuggccugcucacccg

SEQ ID NO: 3533956 - RNA, 13 nt, Pseudomonas putida KT2440
ccuuggccugggg

SEQ ID NO: 3533957 - RNA, 16 nt, Pseudomonas putida KT2440
ccuuggccuuggcagc

SEQ ID NO: 3533958 - RNA, 23 nt, Pseudomonas putida KT2440
ccuuggcgaaugcgcucauccag

SEQ ID NO: 3533959 - RNA, 23 nt, Pseudomonas putida KT2440
ccuuggcgacgugcccagaucac

SEQ ID NO: 3533960 - RNA, 20 nt, Pseudomonas putida KT2440
ccuuggcgcacuuguuccag

SEQ ID NO: 3533961 - RNA, 21 nt, Pseudomonas putida KT2440
ccuuggcgcggcggauaagcu

SEQ ID NO: 3533962 - RNA, 22 nt, Pseudomonas putida KT2440
ccuuggcgcguuucgaucucgc

SEQ ID NO: 3533963 - RNA, 17 nt, Pseudomonas putida KT2440
ccuuggcuacgcaaggu

SEQ ID NO: 3533964 - RNA, 22 nt, Pseudomonas putida KT2440
ccuuggcuacgcaaggugccaa

SEQ ID NO: 3533965 - RNA, 16 nt, Pseudomonas putida KT2440
ccuugggcaacaccgc

SEQ ID NO: 3533966 - RNA, 19 nt, Pseudomonas putida KT2440
ccuugggcaacaccgccag

SEQ ID NO: 3533967 - RNA, 13 nt, Pseudomonas putida KT2440
ccuugggcccaca

SEQ ID NO: 3533968 - RNA, 18 nt, Pseudomonas putida KT2440
ccuugggcgaggacagca

SEQ ID NO: 3533969 - RNA, 18 nt, Pseudomonas putida KT2440
ccuugggcgugcgcugca

SEQ ID NO: 3533970 - RNA, 20 nt, Pseudomonas putida KT2440
ccuuggucaggaucacccag

SEQ ID NO: 3533971 - RNA, 13 nt, Pseudomonas putida KT2440
ccuuggugcaaug

SEQ ID NO: 3533972 - RNA, 20 nt, Pseudomonas putida KT2440
ccuuggugcaauggucauug

SEQ ID NO: 3533973 - RNA, 21 nt, Pseudomonas putida KT2440
ccuuggugcaugcaagcagcc

SEQ ID NO: 3533974 - RNA, 20 nt, Pseudomonas putida KT2440
ccuugguguaauccaucacc

SEQ ID NO: 3533975 - RNA, 13 nt, Pseudomonas putida KT2440
ccuuguaggagcu

SEQ ID NO: 3533976 - RNA, 16 nt, Pseudomonas putida KT2440
ccuugucagcaaccac

SEQ ID NO: 3533977 - RNA, 14 nt, Pseudomonas putida KT2440
ccuugucagccgcc

SEQ ID NO: 3533978 - RNA, 18 nt, Pseudomonas putida KT2440
ccuugucagccgccgcug

SEQ ID NO: 3533979 - RNA, 18 nt, Pseudomonas putida KT2440
ccuugucaguucugcuca

SEQ ID NO: 3533980 - RNA, 16 nt, Pseudomonas putida KT2440
ccuuguccagcaggcc

SEQ ID NO: 3533981 - RNA, 16 nt, Pseudomonas putida KT2440
ccuugucgaguuucag

SEQ ID NO: 3533982 - RNA, 21 nt, Pseudomonas putida KT2440
ccuugucggcacgcgccagca

SEQ ID NO: 3533983 - RNA, 22 nt, Pseudomonas putida KT2440
ccuugucggcacgcgccagcag

SEQ ID NO: 3533984 - RNA, 11 nt, Pseudomonas putida KT2440
ccuugucucug

SEQ ID NO: 3533985 - RNA, 14 nt, Pseudomonas putida KT2440
ccuugugcaguucg

SEQ ID NO: 3533986 - RNA, 21 nt, Pseudomonas putida KT2440
ccuugugcaguucgcacagcu

SEQ ID NO: 3533987 - RNA, 19 nt, Pseudomonas putida KT2440
ccuugugcgccaccgacuc

SEQ ID NO: 3533988 - RNA, 22 nt, Pseudomonas putida KT2440
ccuugugggagcgggacugccc

SEQ ID NO: 3533989 - RNA, 18 nt, Pseudomonas putida KT2440
ccuuguuauccaggcugg

SEQ ID NO: 3533990 - RNA, 15 nt, Pseudomonas putida KT2440
ccuuguucaacacug

SEQ ID NO: 3533991 - RNA, 22 nt, Pseudomonas putida KT2440
ccuuguuccacgcgcaggcgcu

SEQ ID NO: 3533992 - RNA, 20 nt, Pseudomonas putida KT2440
ccuuguugccacccagauca

SEQ ID NO: 3533993 - RNA, 14 nt, Pseudomonas putida KT2440
ccuuuacuggccau

SEQ ID NO: 3533994 - RNA, 18 nt, Pseudomonas putida KT2440
ccuuuauuacuagauggc

SEQ ID NO: 3533995 - RNA, 15 nt, Pseudomonas putida KT2440
ccuuucccaugacga

SEQ ID NO: 3533996 - RNA, 22 nt, Pseudomonas putida KT2440
ccuuucgcgggagacccguucc

SEQ ID NO: 3533997 - RNA, 19 nt, Pseudomonas putida KT2440
ccuuucgcgggcgcgcccg

SEQ ID NO: 3533998 - RNA, 16 nt, Pseudomonas putida KT2440
ccuuucgcggguaaac

SEQ ID NO: 3533999 - RNA, 15 nt, Pseudomonas putida KT2440
ccuuucuccagcaac

SEQ ID NO: 3534000 - RNA, 17 nt, Pseudomonas putida KT2440
ccuuucuuaugccuggg

SEQ ID NO: 3534001 - RNA, 16 nt, Pseudomonas putida KT2440
ccuuugagugcuucgc

SEQ ID NO: 3534002 - RNA, 21 nt, Pseudomonas putida KT2440
ccuuugcaaagcgcaccgcgc

SEQ ID NO: 3534003 - RNA, 13 nt, Pseudomonas putida KT2440
ccuuugccaucca

SEQ ID NO: 3534004 - RNA, 22 nt, Pseudomonas putida KT2440
ccuuugcggcacaucucaaggc

SEQ ID NO: 3534005 - RNA, 20 nt, Pseudomonas putida KT2440
ccuuugguuggcuuguccag

SEQ ID NO: 3534006 - RNA, 17 nt, Pseudomonas putida KT2440
ccuuuucgcggguaaac

SEQ ID NO: 3534007 - RNA, 19 nt, Pseudomonas putida KT2440
ccuuuuuuuauuuuucugg

SEQ ID NO: 3534008 - RNA, 17 nt, Pseudomonas putida KT2440
ccuuuuuuuugccuggg

SEQ ID NO: 3534009 - RNA, 13 nt, Pseudomonas putida KT2440
cgaaaaaccgcuc

SEQ ID NO: 3534010 - RNA, 16 nt, Pseudomonas putida KT2440
cgaaaaggccugcacu

SEQ ID NO: 3534011 - RNA, 14 nt, Pseudomonas putida KT2440
cgaaacacagcagg

SEQ ID NO: 3534012 - RNA, 16 nt, Pseudomonas putida KT2440
cgaaacacagcaggcc

SEQ ID NO: 3534013 - RNA, 14 nt, Pseudomonas putida KT2440
cgaaaccgccagcc

SEQ ID NO: 3534014 - RNA, 17 nt, Pseudomonas putida KT2440
cgaaacgaaacccugcu

SEQ ID NO: 3534015 - RNA, 21 nt, Pseudomonas putida KT2440
cgaaacgcaggcucugcgcca

SEQ ID NO: 3534016 - RNA, 24 nt, Pseudomonas putida KT2440
cgaaacgcaggcucugcgccagca

SEQ ID NO: 3534017 - RNA, 16 nt, Pseudomonas putida KT2440
cgaaacgccacgccca

SEQ ID NO: 3534018 - RNA, 17 nt, Pseudomonas putida KT2440
cgaaacgcggcaaccug

SEQ ID NO: 3534019 - RNA, 16 nt, Pseudomonas putida KT2440
cgaaacguagucgacc

SEQ ID NO: 3534020 - RNA, 17 nt, Pseudomonas putida KT2440
cgaaacugcgcucaacc

SEQ ID NO: 3534021 - RNA, 22 nt, Pseudomonas putida KT2440
cgaaacugcgcucaaccagccg

SEQ ID NO: 3534022 - RNA, 22 nt, Pseudomonas putida KT2440
cgaaagccagcagugcggcaac

SEQ ID NO: 3534023 - RNA, 21 nt, Pseudomonas putida KT2440
cgaaagcccauaaaccccagc

SEQ ID NO: 3534024 - RNA, 18 nt, Pseudomonas putida KT2440
cgaaagcgguugagauga

SEQ ID NO: 3534025 - RNA, 18 nt, Pseudomonas putida KT2440
cgaaagggccgcaaagcg

SEQ ID NO: 3534026 - RNA, 15 nt, Pseudomonas putida KT2440
cgaaaucagccuuca

SEQ ID NO: 3534027 - RNA, 21 nt, Pseudomonas putida KT2440
cgaaaucagccuucagugcuu

SEQ ID NO: 3534028 - RNA, 21 nt, Pseudomonas putida KT2440
cgaaaucugccugcugcaaca

SEQ ID NO: 3534029 - RNA, 22 nt, Pseudomonas putida KT2440
cgaaaugauccccggcgacggc

SEQ ID NO: 3534030 - RNA, 21 nt, Pseudomonas putida KT2440
cgaaauuaccuuacugcaguu

SEQ ID NO: 3534031 - RNA, 12 nt, Pseudomonas putida KT2440
cgaacaaaaccc

SEQ ID NO: 3534032 - RNA, 19 nt, Pseudomonas putida KT2440
cgaacaacggcagcgacag

SEQ ID NO: 3534033 - RNA, 22 nt, Pseudomonas putida KT2440
cgaacaacuguccugugcgcau

SEQ ID NO: 3534034 - RNA, 21 nt, Pseudomonas putida KT2440
cgaacaaggcucagcugaugu

SEQ ID NO: 3534035 - RNA, 17 nt, Pseudomonas putida KT2440
cgaacaauucuuccagc

SEQ ID NO: 3534036 - RNA, 23 nt, Pseudomonas putida KT2440
cgaacacaaucgguucgcccggu

SEQ ID NO: 3534037 - RNA, 23 nt, Pseudomonas putida KT2440
cgaacacauagucgauacccagg

SEQ ID NO: 3534038 - RNA, 15 nt, Pseudomonas putida KT2440
cgaacaccgccagcc

SEQ ID NO: 3534039 - RNA, 19 nt, Pseudomonas putida KT2440
cgaacaccgguuuguccug

SEQ ID NO: 3534040 - RNA, 20 nt, Pseudomonas putida KT2440
cgaacacgggcgaagcccgu

SEQ ID NO: 3534041 - RNA, 17 nt, Pseudomonas putida KT2440
cgaacagcaccgccaug

SEQ ID NO: 3534042 - RNA, 22 nt, Pseudomonas putida KT2440
cgaacagcaccgccauggccag

SEQ ID NO: 3534043 - RNA, 14 nt, Pseudomonas putida KT2440
cgaacagcacugcc

SEQ ID NO: 3534044 - RNA, 12 nt, Pseudomonas putida KT2440
cgaacagccaga

SEQ ID NO: 3534045 - RNA, 20 nt, Pseudomonas putida KT2440
cgaacagccagaugcgcgcu

SEQ ID NO: 3534046 - RNA, 23 nt, Pseudomonas putida KT2440
cgaacagcgaaguguucggggug

SEQ ID NO: 3534047 - RNA, 17 nt, Pseudomonas putida KT2440
cgaacagcgccggcagu

SEQ ID NO: 3534048 - RNA, 22 nt, Pseudomonas putida KT2440
cgaacagcugaucgccgucgac

SEQ ID NO: 3534049 - RNA, 14 nt, Pseudomonas putida KT2440
cgaacagcuugcca

SEQ ID NO: 3534050 - RNA, 15 nt, Pseudomonas putida KT2440
cgaacaggcagacca

SEQ ID NO: 3534051 - RNA, 13 nt, Pseudomonas putida KT2440
cgaacaggcccug

SEQ ID NO: 3534052 - RNA, 20 nt, Pseudomonas putida KT2440
cgaacagggccucgauuucu

SEQ ID NO: 3534053 - RNA, 21 nt, Pseudomonas putida KT2440
cgaacaguggcccgaugauca

SEQ ID NO: 3534054 - RNA, 18 nt, Pseudomonas putida KT2440
cgaacauggccacggugu

SEQ ID NO: 3534055 - RNA, 14 nt, Pseudomonas putida KT2440
cgaaccacagcacg

SEQ ID NO: 3534056 - RNA, 15 nt, Pseudomonas putida KT2440
cgaaccacagcacgc

SEQ ID NO: 3534057 - RNA, 12 nt, Pseudomonas putida KT2440
cgaaccacaucg

SEQ ID NO: 3534058 - RNA, 21 nt, Pseudomonas putida KT2440
cgaaccaguacugggcguccu

SEQ ID NO: 3534059 - RNA, 15 nt, Pseudomonas putida KT2440
cgaacccgcuggcga

SEQ ID NO: 3534060 - RNA, 19 nt, Pseudomonas putida KT2440
cgaacccgcuggcgaucag

SEQ ID NO: 3534061 - RNA, 13 nt, Pseudomonas putida KT2440
cgaacccuugacc

SEQ ID NO: 3534062 - RNA, 14 nt, Pseudomonas putida KT2440
cgaacccuugaccu

SEQ ID NO: 3534063 - RNA, 15 nt, Pseudomonas putida KT2440
cgaacccuugaccuu

SEQ ID NO: 3534064 - RNA, 14 nt, Pseudomonas putida KT2440
cgaaccugcccggg

SEQ ID NO: 3534065 - RNA, 19 nt, Pseudomonas putida KT2440
cgaaccuggaucgcucucg

SEQ ID NO: 3534066 - RNA, 22 nt, Pseudomonas putida KT2440
cgaaccuggcguacccgucgcu

SEQ ID NO: 3534067 - RNA, 22 nt, Pseudomonas putida KT2440
cgaaccuugcuugaccuuguca

SEQ ID NO: 3534068 - RNA, 19 nt, Pseudomonas putida KT2440
cgaacgacacggcaggguu

SEQ ID NO: 3534069 - RNA, 18 nt, Pseudomonas putida KT2440
cgaacgaguccgggcggu

SEQ ID NO: 3534070 - RNA, 14 nt, Pseudomonas putida KT2440
cgaacgcagcgccg

SEQ ID NO: 3534071 - RNA, 14 nt, Pseudomonas putida KT2440
cgaacgcccccagc

SEQ ID NO: 3534072 - RNA, 17 nt, Pseudomonas putida KT2440
cgaacgccgccugccga

SEQ ID NO: 3534073 - RNA, 19 nt, Pseudomonas putida KT2440
cgaacgcgaguaacgcccu

SEQ ID NO: 3534074 - RNA, 18 nt, Pseudomonas putida KT2440
cgaacggcgccagcagug

SEQ ID NO: 3534075 - RNA, 20 nt, Pseudomonas putida KT2440
cgaacggguuggcauggccc

SEQ ID NO: 3534076 - RNA, 19 nt, Pseudomonas putida KT2440
cgaacguuucgucauccac

SEQ ID NO: 3534077 - RNA, 18 nt, Pseudomonas putida KT2440
cgaacucaugcuccugcg

SEQ ID NO: 3534078 - RNA, 16 nt, Pseudomonas putida KT2440
cgaacuccccaccagg

SEQ ID NO: 3534079 - RNA, 18 nt, Pseudomonas putida KT2440
cgaacuccccaccaggca

SEQ ID NO: 3534080 - RNA, 15 nt, Pseudomonas putida KT2440
cgaacuucuccagcg

SEQ ID NO: 3534081 - RNA, 21 nt, Pseudomonas putida KT2440
cgaacuuggguaacacgguga

SEQ ID NO: 3534082 - RNA, 23 nt, Pseudomonas putida KT2440
cgaagaagccggcaucgccaaca

SEQ ID NO: 3534083 - RNA, 23 nt, Pseudomonas putida KT2440
cgaagaagucauccggcgcggcc

SEQ ID NO: 3534084 - RNA, 13 nt, Pseudomonas putida KT2440
cgaagaccgccgc

SEQ ID NO: 3534085 - RNA, 19 nt, Pseudomonas putida KT2440
cgaagaccgccgcccaggu

SEQ ID NO: 3534086 - RNA, 20 nt, Pseudomonas putida KT2440
cgaagaccgccgcccagguc

SEQ ID NO: 3534087 - RNA, 22 nt, Pseudomonas putida KT2440
cgaagaccgccgcccaggucau

SEQ ID NO: 3534088 - RNA, 21 nt, Pseudomonas putida KT2440
cgaagaggccaguaccagcag

SEQ ID NO: 3534089 - RNA, 22 nt, Pseudomonas putida KT2440
cgaagaggccaguaccagcagc

SEQ ID NO: 3534090 - RNA, 23 nt, Pseudomonas putida KT2440
cgaagaggccaguaccagcagca

SEQ ID NO: 3534091 - RNA, 14 nt, Pseudomonas putida KT2440
cgaagaggcccgaa

SEQ ID NO: 3534092 - RNA, 21 nt, Pseudomonas putida KT2440
cgaagaggcccgaacagacaa

SEQ ID NO: 3534093 - RNA, 16 nt, Pseudomonas putida KT2440
cgaagaggccggcaca

SEQ ID NO: 3534094 - RNA, 23 nt, Pseudomonas putida KT2440
cgaagaggccggcacagacaccg

SEQ ID NO: 3534095 - RNA, 23 nt, Pseudomonas putida KT2440
cgaagaggccggcacaggaaggc

SEQ ID NO: 3534096 - RNA, 18 nt, Pseudomonas putida KT2440
cgaagaucagcaccgagu

SEQ ID NO: 3534097 - RNA, 18 nt, Pseudomonas putida KT2440
cgaagaucgguacaugcg

SEQ ID NO: 3534098 - RNA, 18 nt, Pseudomonas putida KT2440
cgaagcaccacuggauga

SEQ ID NO: 3534099 - RNA, 14 nt, Pseudomonas putida KT2440
cgaagcaggcugcg

SEQ ID NO: 3534100 - RNA, 22 nt, Pseudomonas putida KT2440
cgaagccaagcgccgucgaacg

SEQ ID NO: 3534101 - RNA, 17 nt, Pseudomonas putida KT2440
cgaagccaugucuucac

SEQ ID NO: 3534102 - RNA, 12 nt, Pseudomonas putida KT2440
cgaagcccaguu

SEQ ID NO: 3534103 - RNA, 18 nt, Pseudomonas putida KT2440
cgaagcccgugccaucca

SEQ ID NO: 3534104 - RNA, 17 nt, Pseudomonas putida KT2440
cgaagcccguggcccuc

SEQ ID NO: 3534105 - RNA, 22 nt, Pseudomonas putida KT2440
cgaagccgacccgggccagcca

SEQ ID NO: 3534106 - RNA, 14 nt, Pseudomonas putida KT2440
cgaagcgcaggucc

SEQ ID NO: 3534107 - RNA, 15 nt, Pseudomonas putida KT2440
cgaagcgcggcaagg

SEQ ID NO: 3534108 - RNA, 20 nt, Pseudomonas putida KT2440
cgaagcgcucccaggccucg

SEQ ID NO: 3534109 - RNA, 16 nt, Pseudomonas putida KT2440
cgaagcggccaaccgc

SEQ ID NO: 3534110 - RNA, 20 nt, Pseudomonas putida KT2440
cgaagcggcccccuggcccu

SEQ ID NO: 3534111 - RNA, 17 nt, Pseudomonas putida KT2440
cgaagcuaucgccagca

SEQ ID NO: 3534112 - RNA, 19 nt, Pseudomonas putida KT2440
cgaagcuaucgccagcagg

SEQ ID NO: 3534113 - RNA, 16 nt, Pseudomonas putida KT2440
cgaagcucuggucgau

SEQ ID NO: 3534114 - RNA, 22 nt, Pseudomonas putida KT2440
cgaagcugucgaacgcugccug

SEQ ID NO: 3534115 - RNA, 21 nt, Pseudomonas putida KT2440
cgaagcugucuucuuucgaca

SEQ ID NO: 3534116 - RNA, 17 nt, Pseudomonas putida KT2440
cgaaggcgauaccgcca

SEQ ID NO: 3534117 - RNA, 15 nt, Pseudomonas putida KT2440
cgaaggcgcuggcga

SEQ ID NO: 3534118 - RNA, 17 nt, Pseudomonas putida KT2440
cgaaggcgucacccgcg

SEQ ID NO: 3534119 - RNA, 14 nt, Pseudomonas putida KT2440
cgaaggcuccagca

SEQ ID NO: 3534120 - RNA, 17 nt, Pseudomonas putida KT2440
cgaaggcuccagcaccg

SEQ ID NO: 3534121 - RNA, 19 nt, Pseudomonas putida KT2440
cgaagggauguuggaauaa

SEQ ID NO: 3534122 - RNA, 12 nt, Pseudomonas putida KT2440
cgaagggccgca

SEQ ID NO: 3534123 - RNA, 13 nt, Pseudomonas putida KT2440
cgaagggccgcaa

SEQ ID NO: 3534124 - RNA, 22 nt, Pseudomonas putida KT2440
cgaagggccgcaacgcggcccu

SEQ ID NO: 3534125 - RNA, 17 nt, Pseudomonas putida KT2440
cgaagggccgccaagcg

SEQ ID NO: 3534126 - RNA, 13 nt, Pseudomonas putida KT2440
cgaagggcugccg

SEQ ID NO: 3534127 - RNA, 18 nt, Pseudomonas putida KT2440
cgaaggucuugccgugcu

SEQ ID NO: 3534128 - RNA, 15 nt, Pseudomonas putida KT2440
cgaaguacggcuugc

SEQ ID NO: 3534129 - RNA, 19 nt, Pseudomonas putida KT2440
cgaaguaggcaaacggcuc

SEQ ID NO: 3534130 - RNA, 20 nt, Pseudomonas putida KT2440
cgaagucagguaggugcuga

SEQ ID NO: 3534131 - RNA, 17 nt, Pseudomonas putida KT2440
cgaagucgaacuugacg

SEQ ID NO: 3534132 - RNA, 18 nt, Pseudomonas putida KT2440
cgaagucuguaagucguu

SEQ ID NO: 3534133 - RNA, 15 nt, Pseudomonas putida KT2440
cgaaguggaucacgg

SEQ ID NO: 3534134 - RNA, 17 nt, Pseudomonas putida KT2440
cgaaguggcggcucgcu

SEQ ID NO: 3534135 - RNA, 21 nt, Pseudomonas putida KT2440
cgaaguggcggcucgcugaac

SEQ ID NO: 3534136 - RNA, 15 nt, Pseudomonas putida KT2440
cgaaguguugccggu

SEQ ID NO: 3534137 - RNA, 14 nt, Pseudomonas putida KT2440
cgaauagcaacaca

SEQ ID NO: 3534138 - RNA, 21 nt, Pseudomonas putida KT2440
cgaauaucgccgaacgggcca

SEQ ID NO: 3534139 - RNA, 18 nt, Pseudomonas putida KT2440
cgaaucagcgccuccagg

SEQ ID NO: 3534140 - RNA, 20 nt, Pseudomonas putida KT2440
cgaauccagcaggcuugcca

SEQ ID NO: 3534141 - RNA, 13 nt, Pseudomonas putida KT2440
cgaauccugcuga

SEQ ID NO: 3534142 - RNA, 16 nt, Pseudomonas putida KT2440
cgaaucgacgcguacg

SEQ ID NO: 3534143 - RNA, 19 nt, Pseudomonas putida KT2440
cgaaucgcucaugccccgc

SEQ ID NO: 3534144 - RNA, 15 nt, Pseudomonas putida KT2440
cgaaucggguccacc

SEQ ID NO: 3534145 - RNA, 12 nt, Pseudomonas putida KT2440
cgaaucugcaug

SEQ ID NO: 3534146 - RNA, 13 nt, Pseudomonas putida KT2440
cgaaugccgcugc

SEQ ID NO: 3534147 - RNA, 18 nt, Pseudomonas putida KT2440
cgaaugccgcugcuggcg

SEQ ID NO: 3534148 - RNA, 16 nt, Pseudomonas putida KT2440
cgaaugcgacugaggc

SEQ ID NO: 3534149 - RNA, 19 nt, Pseudomonas putida KT2440
cgaaugcgcccggccaggu

SEQ ID NO: 3534150 - RNA, 23 nt, Pseudomonas putida KT2440
cgaaugcuacagaagccucaccg

SEQ ID NO: 3534151 - RNA, 14 nt, Pseudomonas putida KT2440
cgaauugacccagu

SEQ ID NO: 3534152 - RNA, 19 nt, Pseudomonas putida KT2440
cgaauuucugcaacagcuc

SEQ ID NO: 3534153 - RNA, 13 nt, Pseudomonas putida KT2440
cgacaaaaacaac

SEQ ID NO: 3534154 - RNA, 14 nt, Pseudomonas putida KT2440
cgacaaaaacaaca

SEQ ID NO: 3534155 - RNA, 12 nt, Pseudomonas putida KT2440
cgacaaaaaccu

SEQ ID NO: 3534156 - RNA, 20 nt, Pseudomonas putida KT2440
cgacaaaccgcacccggcua

SEQ ID NO: 3534157 - RNA, 18 nt, Pseudomonas putida KT2440
cgacaaacugcugaguca

SEQ ID NO: 3534158 - RNA, 14 nt, Pseudomonas putida KT2440
cgacaaaucccgca

SEQ ID NO: 3534159 - RNA, 17 nt, Pseudomonas putida KT2440
cgacaaaugcaccacgc

SEQ ID NO: 3534160 - RNA, 15 nt, Pseudomonas putida KT2440
cgacaaccccagccc

SEQ ID NO: 3534161 - RNA, 19 nt, Pseudomonas putida KT2440
cgacaaccccagcccgaag

SEQ ID NO: 3534162 - RNA, 17 nt, Pseudomonas putida KT2440
cgacaacccgcgcugcc

SEQ ID NO: 3534163 - RNA, 22 nt, Pseudomonas putida KT2440
cgacaaccgaaaaggccaacca

SEQ ID NO: 3534164 - RNA, 18 nt, Pseudomonas putida KT2440
cgacaaccggggcaggcu

SEQ ID NO: 3534165 - RNA, 23 nt, Pseudomonas putida KT2440
cgacaacgguguggccagugcca

SEQ ID NO: 3534166 - RNA, 18 nt, Pseudomonas putida KT2440
cgacaagauaacaccccc

SEQ ID NO: 3534167 - RNA, 23 nt, Pseudomonas putida KT2440
cgacaagauaacaccccccagca

SEQ ID NO: 3534168 - RNA, 12 nt, Pseudomonas putida KT2440
cgacaagccacg

SEQ ID NO: 3534169 - RNA, 22 nt, Pseudomonas putida KT2440
cgacaagccacgcaccucggcc

SEQ ID NO: 3534170 - RNA, 16 nt, Pseudomonas putida KT2440
cgacaaguucauuacc

SEQ ID NO: 3534171 - RNA, 13 nt, Pseudomonas putida KT2440
cgacaaucgccag

SEQ ID NO: 3534172 - RNA, 14 nt, Pseudomonas putida KT2440
cgacaaugccagca

SEQ ID NO: 3534173 - RNA, 18 nt, Pseudomonas putida KT2440
cgacaauuuggggcugcc

SEQ ID NO: 3534174 - RNA, 16 nt, Pseudomonas putida KT2440
cgacacaaggccgcuc

SEQ ID NO: 3534175 - RNA, 23 nt, Pseudomonas putida KT2440
cgacacaaggccgcucccacagg

SEQ ID NO: 3534176 - RNA, 13 nt, Pseudomonas putida KT2440
cgacacaccaaug

SEQ ID NO: 3534177 - RNA, 20 nt, Pseudomonas putida KT2440
cgacacaccgaucacuucca

SEQ ID NO: 3534178 - RNA, 14 nt, Pseudomonas putida KT2440
cgacacagucgucg

SEQ ID NO: 3534179 - RNA, 17 nt, Pseudomonas putida KT2440
cgacacagucgucggca

SEQ ID NO: 3534180 - RNA, 19 nt, Pseudomonas putida KT2440
cgacacagucgucggcacg

SEQ ID NO: 3534181 - RNA, 19 nt, Pseudomonas putida KT2440
cgacaccagcgcaccacug

SEQ ID NO: 3534182 - RNA, 18 nt, Pseudomonas putida KT2440
cgacaccggccuugcgca

SEQ ID NO: 3534183 - RNA, 20 nt, Pseudomonas putida KT2440
cgacaccgggauacugcgca

SEQ ID NO: 3534184 - RNA, 22 nt, Pseudomonas putida KT2440
cgacacgcgaaucgccagggcu

SEQ ID NO: 3534185 - RNA, 19 nt, Pseudomonas putida KT2440
cgacacggcugccgacagg

SEQ ID NO: 3534186 - RNA, 18 nt, Pseudomonas putida KT2440
cgacacugaucucgcgca

SEQ ID NO: 3534187 - RNA, 19 nt, Pseudomonas putida KT2440
cgacacugaucucgcgcau

SEQ ID NO: 3534188 - RNA, 22 nt, Pseudomonas putida KT2440
cgacacuuacgauuucagcggu

SEQ ID NO: 3534189 - RNA, 17 nt, Pseudomonas putida KT2440
cgacacuugguccaggg

SEQ ID NO: 3534190 - RNA, 15 nt, Pseudomonas putida KT2440
cgacagacagggccu

SEQ ID NO: 3534191 - RNA, 17 nt, Pseudomonas putida KT2440
cgacagacagggccuug

SEQ ID NO: 3534192 - RNA, 22 nt, Pseudomonas putida KT2440
cgacagcacgggcacacuggcc

SEQ ID NO: 3534193 - RNA, 17 nt, Pseudomonas putida KT2440
cgacagcaucugcacca

SEQ ID NO: 3534194 - RNA, 13 nt, Pseudomonas putida KT2440
cgacagccaccgc

SEQ ID NO: 3534195 - RNA, 16 nt, Pseudomonas putida KT2440
cgacagccaccgcgag

SEQ ID NO: 3534196 - RNA, 17 nt, Pseudomonas putida KT2440
cgacagccaccgcgagc

SEQ ID NO: 3534197 - RNA, 15 nt, Pseudomonas putida KT2440
cgacagcccgagcaa

SEQ ID NO: 3534198 - RNA, 20 nt, Pseudomonas putida KT2440
cgacagccucaaggccggca

SEQ ID NO: 3534199 - RNA, 20 nt, Pseudomonas putida KT2440
cgacagcggccagcucggcc

SEQ ID NO: 3534200 - RNA, 19 nt, Pseudomonas putida KT2440
cgacagcguugcuccagcu

SEQ ID NO: 3534201 - RNA, 23 nt, Pseudomonas putida KT2440
cgacagcguugcuccagcucaca

SEQ ID NO: 3534202 - RNA, 18 nt, Pseudomonas putida KT2440
cgacagcucaagcccugc

SEQ ID NO: 3534203 - RNA, 19 nt, Pseudomonas putida KT2440
cgacagcuugcccagcugc

SEQ ID NO: 3534204 - RNA, 23 nt, Pseudomonas putida KT2440
cgacaggcuguguggccggccau

SEQ ID NO: 3534205 - RNA, 22 nt, Pseudomonas putida KT2440
cgacaggcuugaagcugcgcuc

SEQ ID NO: 3534206 - RNA, 15 nt, Pseudomonas putida KT2440
cgacaggggcacggg

SEQ ID NO: 3534207 - RNA, 19 nt, Pseudomonas putida KT2440
cgacaggggcacggguacc

SEQ ID NO: 3534208 - RNA, 21 nt, Pseudomonas putida KT2440
cgacaggggcgcagagcgccc

SEQ ID NO: 3534209 - RNA, 18 nt, Pseudomonas putida KT2440
cgacagguaguuggccgg

SEQ ID NO: 3534210 - RNA, 22 nt, Pseudomonas putida KT2440
cgacagguaguuggccgggccu

SEQ ID NO: 3534211 - RNA, 16 nt, Pseudomonas putida KT2440
cgacagguccaccgcu

SEQ ID NO: 3534212 - RNA, 15 nt, Pseudomonas putida KT2440
cgacaggucggcgau

SEQ ID NO: 3534213 - RNA, 16 nt, Pseudomonas putida KT2440
cgacaggucggcgaug

SEQ ID NO: 3534214 - RNA, 18 nt, Pseudomonas putida KT2440
cgacaggugcggcagcuc

SEQ ID NO: 3534215 - RNA, 14 nt, Pseudomonas putida KT2440
cgacagugcccgcu

SEQ ID NO: 3534216 - RNA, 20 nt, Pseudomonas putida KT2440
cgacagugcccgcugaaaca

SEQ ID NO: 3534217 - RNA, 15 nt, Pseudomonas putida KT2440
cgacaguucaagcac

SEQ ID NO: 3534218 - RNA, 21 nt, Pseudomonas putida KT2440
cgacaguucgccacccgacgc

SEQ ID NO: 3534219 - RNA, 12 nt, Pseudomonas putida KT2440
cgacauccacgu

SEQ ID NO: 3534220 - RNA, 20 nt, Pseudomonas putida KT2440
cgacauccagcgccgccaug

SEQ ID NO: 3534221 - RNA, 22 nt, Pseudomonas putida KT2440
cgacauccagcgccgccaugca

SEQ ID NO: 3534222 - RNA, 21 nt, Pseudomonas putida KT2440
cgacaugccaaagaaggacuc

SEQ ID NO: 3534223 - RNA, 17 nt, Pseudomonas putida KT2440
cgacaugccggccacca

SEQ ID NO: 3534224 - RNA, 14 nt, Pseudomonas putida KT2440
cgaccaaaccacgg

SEQ ID NO: 3534225 - RNA, 14 nt, Pseudomonas putida KT2440
cgaccaaaggucgc

SEQ ID NO: 3534226 - RNA, 18 nt, Pseudomonas putida KT2440
cgaccaaaugagugagcu

SEQ ID NO: 3534227 - RNA, 13 nt, Pseudomonas putida KT2440
cgaccaagcgccc

SEQ ID NO: 3534228 - RNA, 15 nt, Pseudomonas putida KT2440
cgaccaagcgcccca

SEQ ID NO: 3534229 - RNA, 15 nt, Pseudomonas putida KT2440
cgaccaaggccaacu

SEQ ID NO: 3534230 - RNA, 14 nt, Pseudomonas putida KT2440
cgaccaauggcugc

SEQ ID NO: 3534231 - RNA, 21 nt, Pseudomonas putida KT2440
cgaccaauugguuaaaagcca

SEQ ID NO: 3534232 - RNA, 20 nt, Pseudomonas putida KT2440
cgaccacccggugacggcau

SEQ ID NO: 3534233 - RNA, 18 nt, Pseudomonas putida KT2440
cgaccacccucgggcgug

SEQ ID NO: 3534234 - RNA, 17 nt, Pseudomonas putida KT2440
cgaccaccgcaggugca

SEQ ID NO: 3534235 - RNA, 18 nt, Pseudomonas putida KT2440
cgaccaccgccucgaucg

SEQ ID NO: 3534236 - RNA, 15 nt, Pseudomonas putida KT2440
cgaccaccugcucgg

SEQ ID NO: 3534237 - RNA, 23 nt, Pseudomonas putida KT2440
cgaccagaacaugccacggccuu

SEQ ID NO: 3534238 - RNA, 16 nt, Pseudomonas putida KT2440
cgaccagaucagccgu

SEQ ID NO: 3534239 - RNA, 12 nt, Pseudomonas putida KT2440
cgaccagcgcca

SEQ ID NO: 3534240 - RNA, 13 nt, Pseudomonas putida KT2440
cgaccagcgccag

SEQ ID NO: 3534241 - RNA, 13 nt, Pseudomonas putida KT2440
cgaccaggcgcuc

SEQ ID NO: 3534242 - RNA, 17 nt, Pseudomonas putida KT2440
cgaccagggccuuggcc

SEQ ID NO: 3534243 - RNA, 21 nt, Pseudomonas putida KT2440
cgaccaggugguaacuggcca

SEQ ID NO: 3534244 - RNA, 18 nt, Pseudomonas putida KT2440
cgaccaguaccacagcca

SEQ ID NO: 3534245 - RNA, 15 nt, Pseudomonas putida KT2440
cgaccaguaccgcgc

SEQ ID NO: 3534246 - RNA, 17 nt, Pseudomonas putida KT2440
cgaccaguaccgcgccu

SEQ ID NO: 3534247 - RNA, 18 nt, Pseudomonas putida KT2440
cgaccaguaccgcgccuc

SEQ ID NO: 3534248 - RNA, 23 nt, Pseudomonas putida KT2440
cgaccaguaccgcgccuccagcu

SEQ ID NO: 3534249 - RNA, 18 nt, Pseudomonas putida KT2440
cgaccaguacgaacuacg

SEQ ID NO: 3534250 - RNA, 18 nt, Pseudomonas putida KT2440
cgaccauuugccauccgg

SEQ ID NO: 3534251 - RNA, 19 nt, Pseudomonas putida KT2440
cgacccaaaaauggucggg

SEQ ID NO: 3534252 - RNA, 21 nt, Pseudomonas putida KT2440
cgacccacaggcacaggccca

SEQ ID NO: 3534253 - RNA, 12 nt, Pseudomonas putida KT2440
cgacccaccaua

SEQ ID NO: 3534254 - RNA, 14 nt, Pseudomonas putida KT2440
cgacccagccaccc

SEQ ID NO: 3534255 - RNA, 16 nt, Pseudomonas putida KT2440
cgacccauuugcagca

SEQ ID NO: 3534256 - RNA, 14 nt, Pseudomonas putida KT2440
cgacccccuugcca

SEQ ID NO: 3534257 - RNA, 15 nt, Pseudomonas putida KT2440
cgacccgccgguugc

SEQ ID NO: 3534258 - RNA, 15 nt, Pseudomonas putida KT2440
cgacccgccuggugc

SEQ ID NO: 3534259 - RNA, 16 nt, Pseudomonas putida KT2440
cgacccgcgccagggu

SEQ ID NO: 3534260 - RNA, 14 nt, Pseudomonas putida KT2440
cgacccgcuggccg

SEQ ID NO: 3534261 - RNA, 17 nt, Pseudomonas putida KT2440
cgacccgcuggccggac

SEQ ID NO: 3534262 - RNA, 14 nt, Pseudomonas putida KT2440
cgacccgcuggcga

SEQ ID NO: 3534263 - RNA, 20 nt, Pseudomonas putida KT2440
cgacccggaaaauggucggg

SEQ ID NO: 3534264 - RNA, 13 nt, Pseudomonas putida KT2440
cgacccggccgcu

SEQ ID NO: 3534265 - RNA, 19 nt, Pseudomonas putida KT2440
cgacccggccgcuccagcu

SEQ ID NO: 3534266 - RNA, 15 nt, Pseudomonas putida KT2440
cgacccgggccagcc

SEQ ID NO: 3534267 - RNA, 15 nt, Pseudomonas putida KT2440
cgacccgucgcugcc

SEQ ID NO: 3534268 - RNA, 17 nt, Pseudomonas putida KT2440
cgacccugaagcccugg

SEQ ID NO: 3534269 - RNA, 17 nt, Pseudomonas putida KT2440
cgacccuguagccccgc

SEQ ID NO: 3534270 - RNA, 19 nt, Pseudomonas putida KT2440
cgacccuguagccccgcug

SEQ ID NO: 3534271 - RNA, 16 nt, Pseudomonas putida KT2440
cgaccgaaccggcgcu

SEQ ID NO: 3534272 - RNA, 22 nt, Pseudomonas putida KT2440
cgaccgauaaagagaagcugca

SEQ ID NO: 3534273 - RNA, 14 nt, Pseudomonas putida KT2440
cgaccgcaccggcc

SEQ ID NO: 3534274 - RNA, 15 nt, Pseudomonas putida KT2440
cgaccgcaccggcca

SEQ ID NO: 3534275 - RNA, 17 nt, Pseudomonas putida KT2440
cgaccgcaccggccacc

SEQ ID NO: 3534276 - RNA, 18 nt, Pseudomonas putida KT2440
cgaccgcaccggccaccg

SEQ ID NO: 3534277 - RNA, 20 nt, Pseudomonas putida KT2440
cgaccgcaccggccaccgug

SEQ ID NO: 3534278 - RNA, 17 nt, Pseudomonas putida KT2440
cgaccgcacuccccauc

SEQ ID NO: 3534279 - RNA, 12 nt, Pseudomonas putida KT2440
cgaccgccagcc

SEQ ID NO: 3534280 - RNA, 13 nt, Pseudomonas putida KT2440
cgaccgcgcgcac

SEQ ID NO: 3534281 - RNA, 15 nt, Pseudomonas putida KT2440
cgaccggagcaucgc

SEQ ID NO: 3534282 - RNA, 23 nt, Pseudomonas putida KT2440
cgaccggcguguugccgcugugc

SEQ ID NO: 3534283 - RNA, 23 nt, Pseudomonas putida KT2440
cgaccggcucaacagcaggugca

SEQ ID NO: 3534284 - RNA, 18 nt, Pseudomonas putida KT2440
cgaccgguggccugagcc

SEQ ID NO: 3534285 - RNA, 19 nt, Pseudomonas putida KT2440
cgaccgguggcgccuugau

SEQ ID NO: 3534286 - RNA, 21 nt, Pseudomonas putida KT2440
cgaccucgauuuccaccggcu

SEQ ID NO: 3534287 - RNA, 17 nt, Pseudomonas putida KT2440
cgaccucuuagcgggca

SEQ ID NO: 3534288 - RNA, 18 nt, Pseudomonas putida KT2440
cgaccucuuagcgggcaa

SEQ ID NO: 3534289 - RNA, 20 nt, Pseudomonas putida KT2440
cgaccucuucgcggguaaac

SEQ ID NO: 3534290 - RNA, 18 nt, Pseudomonas putida KT2440
cgaccugcaacgucgcca

SEQ ID NO: 3534291 - RNA, 12 nt, Pseudomonas putida KT2440
cgaccugcacaa

SEQ ID NO: 3534292 - RNA, 14 nt, Pseudomonas putida KT2440
cgaccugccacugc

SEQ ID NO: 3534293 - RNA, 18 nt, Pseudomonas putida KT2440
cgaccugccagccuucga

SEQ ID NO: 3534294 - RNA, 15 nt, Pseudomonas putida KT2440
cgaccugccagucgc

SEQ ID NO: 3534295 - RNA, 18 nt, Pseudomonas putida KT2440
cgaccugcccggcguuca

SEQ ID NO: 3534296 - RNA, 18 nt, Pseudomonas putida KT2440
cgaccugcguggugccuu

SEQ ID NO: 3534297 - RNA, 23 nt, Pseudomonas putida KT2440
cgaccuggcccgaacgcagcgcc

SEQ ID NO: 3534298 - RNA, 15 nt, Pseudomonas putida KT2440
cgaccugggccaggu

SEQ ID NO: 3534299 - RNA, 15 nt, Pseudomonas putida KT2440
cgaccugguccagcu

SEQ ID NO: 3534300 - RNA, 16 nt, Pseudomonas putida KT2440
cgaccuguguccaccc

SEQ ID NO: 3534301 - RNA, 20 nt, Pseudomonas putida KT2440
cgaccuuggacgcuggcagc

SEQ ID NO: 3534302 - RNA, 23 nt, Pseudomonas putida KT2440
cgaccuuggacgcuggcagcuug

SEQ ID NO: 3534303 - RNA, 13 nt, Pseudomonas putida KT2440
cgaccuuggcgac

SEQ ID NO: 3534304 - RNA, 23 nt, Pseudomonas putida KT2440
cgacgaaacccaguacggcgcca

SEQ ID NO: 3534305 - RNA, 14 nt, Pseudomonas putida KT2440
cgacgaacagggcc

SEQ ID NO: 3534306 - RNA, 19 nt, Pseudomonas putida KT2440
cgacgaacucaacgcaacu

SEQ ID NO: 3534307 - RNA, 19 nt, Pseudomonas putida KT2440
cgacgaaggccuuggccac

SEQ ID NO: 3534308 - RNA, 15 nt, Pseudomonas putida KT2440
cgacgaccugcacaa

SEQ ID NO: 3534309 - RNA, 16 nt, Pseudomonas putida KT2440
cgacgacuuauccgcu

SEQ ID NO: 3534310 - RNA, 22 nt, Pseudomonas putida KT2440
cgacgauacccagcgcgcgcag

SEQ ID NO: 3534311 - RNA, 23 nt, Pseudomonas putida KT2440
cgacgauacccagcgcgcgcaga

SEQ ID NO: 3534312 - RNA, 16 nt, Pseudomonas putida KT2440
cgacgauaccggcgcu

SEQ ID NO: 3534313 - RNA, 18 nt, Pseudomonas putida KT2440
cgacgaugaggcgaugca

SEQ ID NO: 3534314 - RNA, 23 nt, Pseudomonas putida KT2440
cgacgaugaugcgguccgcccuu

SEQ ID NO: 3534315 - RNA, 14 nt, Pseudomonas putida KT2440
cgacgauggacagc

SEQ ID NO: 3534316 - RNA, 18 nt, Pseudomonas putida KT2440
cgacgauggccaccagca

SEQ ID NO: 3534317 - RNA, 21 nt, Pseudomonas putida KT2440
cgacgauggccaccagcaccu

SEQ ID NO: 3534318 - RNA, 15 nt, Pseudomonas putida KT2440
cgacgcaaggccgcu

SEQ ID NO: 3534319 - RNA, 18 nt, Pseudomonas putida KT2440
cgacgcaccagguuggcc

SEQ ID NO: 3534320 - RNA, 13 nt, Pseudomonas putida KT2440
cgacgcacuucac

SEQ ID NO: 3534321 - RNA, 15 nt, Pseudomonas putida KT2440
cgacgcagagguggu

SEQ ID NO: 3534322 - RNA, 12 nt, Pseudomonas putida KT2440
cgacgcagcagc

SEQ ID NO: 3534323 - RNA, 21 nt, Pseudomonas putida KT2440
cgacgcaguuacucggcuacc

SEQ ID NO: 3534324 - RNA, 15 nt, Pseudomonas putida KT2440
cgacgcaucagggca

SEQ ID NO: 3534325 - RNA, 16 nt, Pseudomonas putida KT2440
cgacgcaucagggcau

SEQ ID NO: 3534326 - RNA, 14 nt, Pseudomonas putida KT2440
cgacgcaucugcac

SEQ ID NO: 3534327 - RNA, 23 nt, Pseudomonas putida KT2440
cgacgcauucgcgggugaacccg

SEQ ID NO: 3534328 - RNA, 20 nt, Pseudomonas putida KT2440
cgacgccaacaauagccccg

SEQ ID NO: 3534329 - RNA, 12 nt, Pseudomonas putida KT2440
cgacgccacccc

SEQ ID NO: 3534330 - RNA, 15 nt, Pseudomonas putida KT2440
cgacgccaccuucgc

SEQ ID NO: 3534331 - RNA, 17 nt, Pseudomonas putida KT2440
cgacgccccggccugca

SEQ ID NO: 3534332 - RNA, 19 nt, Pseudomonas putida KT2440
cgacgccuuggcgcagcaa

SEQ ID NO: 3534333 - RNA, 13 nt, Pseudomonas putida KT2440
cgacgcgcgcagc

SEQ ID NO: 3534334 - RNA, 14 nt, Pseudomonas putida KT2440
cgacgcggugcucg

SEQ ID NO: 3534335 - RNA, 14 nt, Pseudomonas putida KT2440
cgacgcgguggagg

SEQ ID NO: 3534336 - RNA, 17 nt, Pseudomonas putida KT2440
cgacgcugcccagcaac

SEQ ID NO: 3534337 - RNA, 13 nt, Pseudomonas putida KT2440
cgacgcugccgca

SEQ ID NO: 3534338 - RNA, 14 nt, Pseudomonas putida KT2440
cgacgcuuggcgua

SEQ ID NO: 3534339 - RNA, 21 nt, Pseudomonas putida KT2440
cgacgcuuggcguaauccagc

SEQ ID NO: 3534340 - RNA, 17 nt, Pseudomonas putida KT2440
cgacgcuuuccugguua

SEQ ID NO: 3534341 - RNA, 16 nt, Pseudomonas putida KT2440
cgacggaacggccgca

SEQ ID NO: 3534342 - RNA, 17 nt, Pseudomonas putida KT2440
cgacggaacggccgcac

SEQ ID NO: 3534343 - RNA, 23 nt, Pseudomonas putida KT2440
cgacggccuguguucaaccaccg

SEQ ID NO: 3534344 - RNA, 22 nt, Pseudomonas putida KT2440
cgacggcgcaauccgugagcca

SEQ ID NO: 3534345 - RNA, 22 nt, Pseudomonas putida KT2440
cgacggcucuugauguugaaga

SEQ ID NO: 3534346 - RNA, 14 nt, Pseudomonas putida KT2440
cgacgggcugagcc

SEQ ID NO: 3534347 - RNA, 23 nt, Pseudomonas putida KT2440
cgacggucugcguacaacaaccc

SEQ ID NO: 3534348 - RNA, 16 nt, Pseudomonas putida KT2440
cgacgucguugaaggc

SEQ ID NO: 3534349 - RNA, 17 nt, Pseudomonas putida KT2440
cgacgugucaguggucg

SEQ ID NO: 3534350 - RNA, 14 nt, Pseudomonas putida KT2440
cgacguugcgcuca

SEQ ID NO: 3534351 - RNA, 17 nt, Pseudomonas putida KT2440
cgacguuuaccugcagc

SEQ ID NO: 3534352 - RNA, 16 nt, Pseudomonas putida KT2440
cgacucacgcucguug

SEQ ID NO: 3534353 - RNA, 15 nt, Pseudomonas putida KT2440
cgacucccgcugccu

SEQ ID NO: 3534354 - RNA, 19 nt, Pseudomonas putida KT2440
cgacucccgcugccuuccg

SEQ ID NO: 3534355 - RNA, 21 nt, Pseudomonas putida KT2440
cgacuccggcaaggcauccag

SEQ ID NO: 3534356 - RNA, 15 nt, Pseudomonas putida KT2440
cgacucgaugccauc

SEQ ID NO: 3534357 - RNA, 17 nt, Pseudomonas putida KT2440
cgacucgcggccgguca

SEQ ID NO: 3534358 - RNA, 19 nt, Pseudomonas putida KT2440
cgacucuacugcccgcagc

SEQ ID NO: 3534359 - RNA, 23 nt, Pseudomonas putida KT2440
cgacugaggcaccgguucgccgc

SEQ ID NO: 3534360 - RNA, 16 nt, Pseudomonas putida KT2440
cgacugcacugccagc

SEQ ID NO: 3534361 - RNA, 18 nt, Pseudomonas putida KT2440
cgacugcacugccagcgc

SEQ ID NO: 3534362 - RNA, 15 nt, Pseudomonas putida KT2440
cgacuggaaggcgcu

SEQ ID NO: 3534363 - RNA, 14 nt, Pseudomonas putida KT2440
cgacuggcuggccu

SEQ ID NO: 3534364 - RNA, 16 nt, Pseudomonas putida KT2440
cgacuggugcucugca

SEQ ID NO: 3534365 - RNA, 13 nt, Pseudomonas putida KT2440
cgacuucaaugcc

SEQ ID NO: 3534366 - RNA, 14 nt, Pseudomonas putida KT2440
cgacuucaucaccu

SEQ ID NO: 3534367 - RNA, 15 nt, Pseudomonas putida KT2440
cgacuucgaccacgg

SEQ ID NO: 3534368 - RNA, 18 nt, Pseudomonas putida KT2440
cgacuucgaccacggccg

SEQ ID NO: 3534369 - RNA, 23 nt, Pseudomonas putida KT2440
cgacuugugcauccugcacugca

SEQ ID NO: 3534370 - RNA, 18 nt, Pseudomonas putida KT2440
cgagaaacgccagcuguu

SEQ ID NO: 3534371 - RNA, 20 nt, Pseudomonas putida KT2440
cgagaaauggcaguguggca

SEQ ID NO: 3534372 - RNA, 12 nt, Pseudomonas putida KT2440
cgagaacaggcg

SEQ ID NO: 3534373 - RNA, 14 nt, Pseudomonas putida KT2440
cgagaagguggccg

SEQ ID NO: 3534374 - RNA, 20 nt, Pseudomonas putida KT2440
cgagaaugcugcgcagcugg

SEQ ID NO: 3534375 - RNA, 16 nt, Pseudomonas putida KT2440
cgagacgaucaccagg

SEQ ID NO: 3534376 - RNA, 16 nt, Pseudomonas putida KT2440
cgagacgguggcugcc

SEQ ID NO: 3534377 - RNA, 22 nt, Pseudomonas putida KT2440
cgagagccgggcaaugauccgg

SEQ ID NO: 3534378 - RNA, 17 nt, Pseudomonas putida KT2440
cgagagcggcuucuacc

SEQ ID NO: 3534379 - RNA, 23 nt, Pseudomonas putida KT2440
cgagagcggcuucuaccgcacuu

SEQ ID NO: 3534380 - RNA, 13 nt, Pseudomonas putida KT2440
cgagaggcgcugc

SEQ ID NO: 3534381 - RNA, 19 nt, Pseudomonas putida KT2440
cgagagugcuggggccgca

SEQ ID NO: 3534382 - RNA, 21 nt, Pseudomonas putida KT2440
cgagaucagguggaucagggu

SEQ ID NO: 3534383 - RNA, 23 nt, Pseudomonas putida KT2440
cgagaucagguggaucaggguca

SEQ ID NO: 3534384 - RNA, 15 nt, Pseudomonas putida KT2440
cgagaucgacagggg

SEQ ID NO: 3534385 - RNA, 17 nt, Pseudomonas putida KT2440
cgagauguaguccaccc

SEQ ID NO: 3534386 - RNA, 16 nt, Pseudomonas putida KT2440
cgagauuugucaacaa

SEQ ID NO: 3534387 - RNA, 18 nt, Pseudomonas putida KT2440
cgagcaacuugcgcagcu

SEQ ID NO: 3534388 - RNA, 14 nt, Pseudomonas putida KT2440
cgagcaagcucgcu

SEQ ID NO: 3534389 - RNA, 20 nt, Pseudomonas putida KT2440
cgagcaagcucgcuccuaca

SEQ ID NO: 3534390 - RNA, 20 nt, Pseudomonas putida KT2440
cgagcaagcucgcuccugca

SEQ ID NO: 3534391 - RNA, 21 nt, Pseudomonas putida KT2440
cgagcacacccggcguacucu

SEQ ID NO: 3534392 - RNA, 17 nt, Pseudomonas putida KT2440
cgagcagccuggcauuu

SEQ ID NO: 3534393 - RNA, 17 nt, Pseudomonas putida KT2440
cgagcagcggcaccuac

SEQ ID NO: 3534394 - RNA, 23 nt, Pseudomonas putida KT2440
cgagcagcuuauugcgcagggug

SEQ ID NO: 3534395 - RNA, 17 nt, Pseudomonas putida KT2440
cgagcagguucaggcgc

SEQ ID NO: 3534396 - RNA, 21 nt, Pseudomonas putida KT2440
cgagcagguucaggcgcagca

SEQ ID NO: 3534397 - RNA, 22 nt, Pseudomonas putida KT2440
cgagcaucugcugcggcaggcu

SEQ ID NO: 3534398 - RNA, 15 nt, Pseudomonas putida KT2440
cgagcaucuuccagc

SEQ ID NO: 3534399 - RNA, 16 nt, Pseudomonas putida KT2440
cgagcaucuuccagcc

SEQ ID NO: 3534400 - RNA, 22 nt, Pseudomonas putida KT2440
cgagcaucuuccagccugcagc

SEQ ID NO: 3534401 - RNA, 23 nt, Pseudomonas putida KT2440
cgagcaugaggauacgacgcauc

SEQ ID NO: 3534402 - RNA, 19 nt, Pseudomonas putida KT2440
cgagcaugaucaccgccag

SEQ ID NO: 3534403 - RNA, 21 nt, Pseudomonas putida KT2440
cgagcaugaucaccgccagcg

SEQ ID NO: 3534404 - RNA, 15 nt, Pseudomonas putida KT2440
cgagcaugcggauau

SEQ ID NO: 3534405 - RNA, 22 nt, Pseudomonas putida KT2440
cgagccaauuucaacgcucgcg

SEQ ID NO: 3534406 - RNA, 17 nt, Pseudomonas putida KT2440
cgagccacucggcaauc

SEQ ID NO: 3534407 - RNA, 20 nt, Pseudomonas putida KT2440
cgagccauaugaaaaggccc

SEQ ID NO: 3534408 - RNA, 22 nt, Pseudomonas putida KT2440
cgagccauaugaaaaggcccug

SEQ ID NO: 3534409 - RNA, 18 nt, Pseudomonas putida KT2440
cgagccauugacccgcuu

SEQ ID NO: 3534410 - RNA, 21 nt, Pseudomonas putida KT2440
cgagccccauucgcugcguca

SEQ ID NO: 3534411 - RNA, 14 nt, Pseudomonas putida KT2440
cgagcccgccagca

SEQ ID NO: 3534412 - RNA, 23 nt, Pseudomonas putida KT2440
cgagcccgccagcaggccaccgg

SEQ ID NO: 3534413 - RNA, 14 nt, Pseudomonas putida KT2440
cgagcccgcgcgcg

SEQ ID NO: 3534414 - RNA, 23 nt, Pseudomonas putida KT2440
cgagcccgcgcgcgaugcgccgc

SEQ ID NO: 3534415 - RNA, 19 nt, Pseudomonas putida KT2440
cgagcccggguugaccuug

SEQ ID NO: 3534416 - RNA, 16 nt, Pseudomonas putida KT2440
cgagccgaucaggaag

SEQ ID NO: 3534417 - RNA, 18 nt, Pseudomonas putida KT2440
cgagccgaucaggaagcc

SEQ ID NO: 3534418 - RNA, 24 nt, Pseudomonas putida KT2440
cgagccgccagacuucauaggcug

SEQ ID NO: 3534419 - RNA, 14 nt, Pseudomonas putida KT2440
cgagccgcugccaa

SEQ ID NO: 3534420 - RNA, 17 nt, Pseudomonas putida KT2440
cgagccgcugccaaagu

SEQ ID NO: 3534421 - RNA, 22 nt, Pseudomonas putida KT2440
cgagccucuguuugcuggucag

SEQ ID NO: 3534422 - RNA, 15 nt, Pseudomonas putida KT2440
cgagccuugccaacg

SEQ ID NO: 3534423 - RNA, 15 nt, Pseudomonas putida KT2440
cgagccuuggccagc

SEQ ID NO: 3534424 - RNA, 16 nt, Pseudomonas putida KT2440
cgagccuuggccagcg

SEQ ID NO: 3534425 - RNA, 17 nt, Pseudomonas putida KT2440
cgagcgccugauuaccc

SEQ ID NO: 3534426 - RNA, 21 nt, Pseudomonas putida KT2440
cgagcgccugauuacccugcg

SEQ ID NO: 3534427 - RNA, 23 nt, Pseudomonas putida KT2440
cgagcgccugauuacccugcgcc

SEQ ID NO: 3534428 - RNA, 14 nt, Pseudomonas putida KT2440
cgagcgcggcgccc

SEQ ID NO: 3534429 - RNA, 18 nt, Pseudomonas putida KT2440
cgagcgcggcgcccagca

SEQ ID NO: 3534430 - RNA, 23 nt, Pseudomonas putida KT2440
cgagcgcgugcggggcaucgccg

SEQ ID NO: 3534431 - RNA, 17 nt, Pseudomonas putida KT2440
cgagcggagcugguggu

SEQ ID NO: 3534432 - RNA, 14 nt, Pseudomonas putida KT2440
cgagcggccugacu

SEQ ID NO: 3534433 - RNA, 13 nt, Pseudomonas putida KT2440
cgagcggccuugu

SEQ ID NO: 3534434 - RNA, 20 nt, Pseudomonas putida KT2440
cgagcgggugccgcagcacc

SEQ ID NO: 3534435 - RNA, 21 nt, Pseudomonas putida KT2440
cgagcgggugccgcagcaccg

SEQ ID NO: 3534436 - RNA, 16 nt, Pseudomonas putida KT2440
cgagcgguugcacggc

SEQ ID NO: 3534437 - RNA, 17 nt, Pseudomonas putida KT2440
cgagcgguugcacggcc

SEQ ID NO: 3534438 - RNA, 23 nt, Pseudomonas putida KT2440
cgagcgucucgccaaacugcugg

SEQ ID NO: 3534439 - RNA, 13 nt, Pseudomonas putida KT2440
cgagcuacagccc

SEQ ID NO: 3534440 - RNA, 20 nt, Pseudomonas putida KT2440
cgagcugaaagugccgccuc

SEQ ID NO: 3534441 - RNA, 17 nt, Pseudomonas putida KT2440
cgagcugauccgccugg

SEQ ID NO: 3534442 - RNA, 19 nt, Pseudomonas putida KT2440
cgagcugaugcucaagcgc

SEQ ID NO: 3534443 - RNA, 15 nt, Pseudomonas putida KT2440
cgagcuggagaucuu

SEQ ID NO: 3534444 - RNA, 15 nt, Pseudomonas putida KT2440
cgagcugggcacggc

SEQ ID NO: 3534445 - RNA, 14 nt, Pseudomonas putida KT2440
cgagcuugcucgcg

SEQ ID NO: 3534446 - RNA, 18 nt, Pseudomonas putida KT2440
cgagcuugcucgcgaugc

SEQ ID NO: 3534447 - RNA, 21 nt, Pseudomonas putida KT2440
cgagcuuggcguccacagcca

SEQ ID NO: 3534448 - RNA, 18 nt, Pseudomonas putida KT2440
cgagcuuuguagcucccu

SEQ ID NO: 3534449 - RNA, 19 nt, Pseudomonas putida KT2440
cgagcuuuguagcucccuc

SEQ ID NO: 3534450 - RNA, 13 nt, Pseudomonas putida KT2440
cgaggaaagggca

SEQ ID NO: 3534451 - RNA, 20 nt, Pseudomonas putida KT2440
cgaggacaacaaggacugcc

SEQ ID NO: 3534452 - RNA, 13 nt, Pseudomonas putida KT2440
cgaggaccugcgu

SEQ ID NO: 3534453 - RNA, 18 nt, Pseudomonas putida KT2440
cgaggauuuucaccuucg

SEQ ID NO: 3534454 - RNA, 20 nt, Pseudomonas putida KT2440
cgaggcaaucagcgguucga

SEQ ID NO: 3534455 - RNA, 15 nt, Pseudomonas putida KT2440
cgaggcaaucagggc

SEQ ID NO: 3534456 - RNA, 16 nt, Pseudomonas putida KT2440
cgaggcauccacaccc

SEQ ID NO: 3534457 - RNA, 17 nt, Pseudomonas putida KT2440
cgaggcauccacacccu

SEQ ID NO: 3534458 - RNA, 15 nt, Pseudomonas putida KT2440
cgaggccccagacca

SEQ ID NO: 3534459 - RNA, 21 nt, Pseudomonas putida KT2440
cgaggccgauuuggcccgcug

SEQ ID NO: 3534460 - RNA, 15 nt, Pseudomonas putida KT2440
cgaggccgcgacgau

SEQ ID NO: 3534461 - RNA, 12 nt, Pseudomonas putida KT2440
cgaggccgggca

SEQ ID NO: 3534462 - RNA, 17 nt, Pseudomonas putida KT2440
cgaggccgggcagaguc

SEQ ID NO: 3534463 - RNA, 14 nt, Pseudomonas putida KT2440
cgaggccgucguag

SEQ ID NO: 3534464 - RNA, 15 nt, Pseudomonas putida KT2440
cgaggcgccgacgau

SEQ ID NO: 3534465 - RNA, 14 nt, Pseudomonas putida KT2440
cgaggcgugaucac

SEQ ID NO: 3534466 - RNA, 20 nt, Pseudomonas putida KT2440
cgaggcguuggccaaaccgu

SEQ ID NO: 3534467 - RNA, 21 nt, Pseudomonas putida KT2440
cgaggcguuggccgaaggccg

SEQ ID NO: 3534468 - RNA, 18 nt, Pseudomonas putida KT2440
cgagggugaggugcugca

SEQ ID NO: 3534469 - RNA, 14 nt, Pseudomonas putida KT2440
cgaggguggucuug

SEQ ID NO: 3534470 - RNA, 20 nt, Pseudomonas putida KT2440
cgaggguuccaggccacggu

SEQ ID NO: 3534471 - RNA, 18 nt, Pseudomonas putida KT2440
cgagguaggccgucagca

SEQ ID NO: 3534472 - RNA, 15 nt, Pseudomonas putida KT2440
cgaggucagcaccag

SEQ ID NO: 3534473 - RNA, 23 nt, Pseudomonas putida KT2440
cgaggucagcaccagcucaucca

SEQ ID NO: 3534474 - RNA, 14 nt, Pseudomonas putida KT2440
cgaggucagcagug

SEQ ID NO: 3534475 - RNA, 23 nt, Pseudomonas putida KT2440
cgaggucaucgaagaucagcuca

SEQ ID NO: 3534476 - RNA, 20 nt, Pseudomonas putida KT2440
cgagguggauagcagcucaa

SEQ ID NO: 3534477 - RNA, 19 nt, Pseudomonas putida KT2440
cgagguggucgaggcaaag

SEQ ID NO: 3534478 - RNA, 17 nt, Pseudomonas putida KT2440
cgagguguacgcgaagg

SEQ ID NO: 3534479 - RNA, 15 nt, Pseudomonas putida KT2440
cgagguugcgcucca

SEQ ID NO: 3534480 - RNA, 16 nt, Pseudomonas putida KT2440
cgagguugcgcuccau

SEQ ID NO: 3534481 - RNA, 14 nt, Pseudomonas putida KT2440
cgaguaaagccagc

SEQ ID NO: 3534482 - RNA, 15 nt, Pseudomonas putida KT2440
cgaguacgaucagcc

SEQ ID NO: 3534483 - RNA, 15 nt, Pseudomonas putida KT2440
cgaguauccccacca

SEQ ID NO: 3534484 - RNA, 16 nt, Pseudomonas putida KT2440
cgaguauccuccagcc

SEQ ID NO: 3534485 - RNA, 19 nt, Pseudomonas putida KT2440
cgaguauccuccagcccug

SEQ ID NO: 3534486 - RNA, 18 nt, Pseudomonas putida KT2440
cgagucaacacggcugga

SEQ ID NO: 3534487 - RNA, 21 nt, Pseudomonas putida KT2440
cgagucaggcugcacaaggug

SEQ ID NO: 3534488 - RNA, 22 nt, Pseudomonas putida KT2440
cgagucaggcugcacaaggugc

SEQ ID NO: 3534489 - RNA, 11 nt, Pseudomonas putida KT2440
cgaguccccua

SEQ ID NO: 3534490 - RNA, 16 nt, Pseudomonas putida KT2440
cgaguccugccuucca

SEQ ID NO: 3534491 - RNA, 18 nt, Pseudomonas putida KT2440
cgagucgacagugaccga

SEQ ID NO: 3534492 - RNA, 14 nt, Pseudomonas putida KT2440
cgagucgccuucac

SEQ ID NO: 3534493 - RNA, 22 nt, Pseudomonas putida KT2440
cgagugaccuuggcugggucca

SEQ ID NO: 3534494 - RNA, 16 nt, Pseudomonas putida KT2440
cgagugcccgcgcagg

SEQ ID NO: 3534495 - RNA, 18 nt, Pseudomonas putida KT2440
cgagugcguagccuucag

SEQ ID NO: 3534496 - RNA, 19 nt, Pseudomonas putida KT2440
cgaguggaucaaccgacca

SEQ ID NO: 3534497 - RNA, 19 nt, Pseudomonas putida KT2440
cgaguggccgaaggcgcuc

SEQ ID NO: 3534498 - RNA, 22 nt, Pseudomonas putida KT2440
cgaguguuucaaaaaaaagggc

SEQ ID NO: 3534499 - RNA, 20 nt, Pseudomonas putida KT2440
cgaguugaacuuggcgauga

SEQ ID NO: 3534500 - RNA, 15 nt, Pseudomonas putida KT2440
cgaguugccgguggu

SEQ ID NO: 3534501 - RNA, 14 nt, Pseudomonas putida KT2440
cgaguugccuucga

SEQ ID NO: 3534502 - RNA, 20 nt, Pseudomonas putida KT2440
cgaguuuaccuccaucacca

SEQ ID NO: 3534503 - RNA, 13 nt, Pseudomonas putida KT2440
cgaguuuggccag

SEQ ID NO: 3534504 - RNA, 15 nt, Pseudomonas putida KT2440
cgaguuuggccagcc

SEQ ID NO: 3534505 - RNA, 19 nt, Pseudomonas putida KT2440
cgauaaccgaauccagguu

SEQ ID NO: 3534506 - RNA, 18 nt, Pseudomonas putida KT2440
cgauaauuaccggcuguu

SEQ ID NO: 3534507 - RNA, 17 nt, Pseudomonas putida KT2440
cgauacccagccagcca

SEQ ID NO: 3534508 - RNA, 15 nt, Pseudomonas putida KT2440
cgauacccaggcgcg

SEQ ID NO: 3534509 - RNA, 18 nt, Pseudomonas putida KT2440
cgauacccaggcgcgccu

SEQ ID NO: 3534510 - RNA, 21 nt, Pseudomonas putida KT2440
cgauacccaggcgcgccugca

SEQ ID NO: 3534511 - RNA, 19 nt, Pseudomonas putida KT2440
cgauaccgaccauuugcca

SEQ ID NO: 3534512 - RNA, 15 nt, Pseudomonas putida KT2440
cgauaccgcccaggu

SEQ ID NO: 3534513 - RNA, 17 nt, Pseudomonas putida KT2440
cgauaccuggguccagg

SEQ ID NO: 3534514 - RNA, 18 nt, Pseudomonas putida KT2440
cgauacgccgacagcggc

SEQ ID NO: 3534515 - RNA, 21 nt, Pseudomonas putida KT2440
cgauacggucuuuuccccuua

SEQ ID NO: 3534516 - RNA, 15 nt, Pseudomonas putida KT2440
cgauacuccggcaac

SEQ ID NO: 3534517 - RNA, 16 nt, Pseudomonas putida KT2440
cgauacuccggcaacc

SEQ ID NO: 3534518 - RNA, 14 nt, Pseudomonas putida KT2440
cgauagcagcaccg

SEQ ID NO: 3534519 - RNA, 16 nt, Pseudomonas putida KT2440
cgauagcgucagcagg

SEQ ID NO: 3534520 - RNA, 18 nt, Pseudomonas putida KT2440
cgauagcgugaagcggcc

SEQ ID NO: 3534521 - RNA, 20 nt, Pseudomonas putida KT2440
cgauaucggcgcggcccagu

SEQ ID NO: 3534522 - RNA, 23 nt, Pseudomonas putida KT2440
cgauaugcggggucgcuaccacg

SEQ ID NO: 3534523 - RNA, 17 nt, Pseudomonas putida KT2440
cgaucaaaugaucgcca

SEQ ID NO: 3534524 - RNA, 22 nt, Pseudomonas putida KT2440
cgaucaaaugaucgccagcggu

SEQ ID NO: 3534525 - RNA, 18 nt, Pseudomonas putida KT2440
cgaucaaugggccgauca

SEQ ID NO: 3534526 - RNA, 22 nt, Pseudomonas putida KT2440
cgaucaaugggccgaucacgaa

SEQ ID NO: 3534527 - RNA, 23 nt, Pseudomonas putida KT2440
cgaucacacccucugccaucuca

SEQ ID NO: 3534528 - RNA, 17 nt, Pseudomonas putida KT2440
cgaucacauaaggcagc

SEQ ID NO: 3534529 - RNA, 22 nt, Pseudomonas putida KT2440
cgaucacaugcggcaccgccag

SEQ ID NO: 3534530 - RNA, 13 nt, Pseudomonas putida KT2440
cgaucaccagcac

SEQ ID NO: 3534531 - RNA, 22 nt, Pseudomonas putida KT2440
cgaucaccagcaccccgaacgc

SEQ ID NO: 3534532 - RNA, 14 nt, Pseudomonas putida KT2440
cgaucaccagcccc

SEQ ID NO: 3534533 - RNA, 22 nt, Pseudomonas putida KT2440
cgaucaccgacgugugcccacu

SEQ ID NO: 3534534 - RNA, 14 nt, Pseudomonas putida KT2440
cgaucaccgcgaau

SEQ ID NO: 3534535 - RNA, 16 nt, Pseudomonas putida KT2440
cgaucaccugcggccu

SEQ ID NO: 3534536 - RNA, 15 nt, Pseudomonas putida KT2440
cgaucaccugggcga

SEQ ID NO: 3534537 - RNA, 19 nt, Pseudomonas putida KT2440
cgaucacuacaugcggccc

SEQ ID NO: 3534538 - RNA, 22 nt, Pseudomonas putida KT2440
cgaucacuccugguuggccagu

SEQ ID NO: 3534539 - RNA, 15 nt, Pseudomonas putida KT2440
cgaucacuuccaggc

SEQ ID NO: 3534540 - RNA, 17 nt, Pseudomonas putida KT2440
cgaucacuuccaggccc

SEQ ID NO: 3534541 - RNA, 14 nt, Pseudomonas putida KT2440
cgaucagacgcucc

SEQ ID NO: 3534542 - RNA, 17 nt, Pseudomonas putida KT2440
cgaucagacgcuccaga

SEQ ID NO: 3534543 - RNA, 17 nt, Pseudomonas putida KT2440
cgaucagcgagucguag

SEQ ID NO: 3534544 - RNA, 17 nt, Pseudomonas putida KT2440
cgaucagcgcacgaccc

SEQ ID NO: 3534545 - RNA, 16 nt, Pseudomonas putida KT2440
cgaucagcgccgaacc

SEQ ID NO: 3534546 - RNA, 14 nt, Pseudomonas putida KT2440
cgaucagcgccugc

SEQ ID NO: 3534547 - RNA, 19 nt, Pseudomonas putida KT2440
cgaucagcgccugcucauc

SEQ ID NO: 3534548 - RNA, 15 nt, Pseudomonas putida KT2440
cgaucagcgcggcaa

SEQ ID NO: 3534549 - RNA, 22 nt, Pseudomonas putida KT2440
cgaucagcugguuagcgucgau

SEQ ID NO: 3534550 - RNA, 22 nt, Pseudomonas putida KT2440
cgaucagcuuaacgcuuggcca

SEQ ID NO: 3534551 - RNA, 12 nt, Pseudomonas putida KT2440
cgaucagcuucu

SEQ ID NO: 3534552 - RNA, 16 nt, Pseudomonas putida KT2440
cgaucaggaagccccg

SEQ ID NO: 3534553 - RNA, 13 nt, Pseudomonas putida KT2440
cgaucaggaaggc

SEQ ID NO: 3534554 - RNA, 17 nt, Pseudomonas putida KT2440
cgaucaggaaggcacca

SEQ ID NO: 3534555 - RNA, 13 nt, Pseudomonas putida KT2440
cgaucaggcaggc

SEQ ID NO: 3534556 - RNA, 16 nt, Pseudomonas putida KT2440
cgaucaggcaggccag

SEQ ID NO: 3534557 - RNA, 19 nt, Pseudomonas putida KT2440
cgaucagggaugcuggaca

SEQ ID NO: 3534558 - RNA, 22 nt, Pseudomonas putida KT2440
cgaucaggucgacacccagcac

SEQ ID NO: 3534559 - RNA, 19 nt, Pseudomonas putida KT2440
cgaucagguucaccguacc

SEQ ID NO: 3534560 - RNA, 21 nt, Pseudomonas putida KT2440
cgaucagguugagcaccgggc

SEQ ID NO: 3534561 - RNA, 18 nt, Pseudomonas putida KT2440
cgaucagguugcccagca

SEQ ID NO: 3534562 - RNA, 19 nt, Pseudomonas putida KT2440
cgaucagguugcccagcau

SEQ ID NO: 3534563 - RNA, 16 nt, Pseudomonas putida KT2440
cgaucagguuugccgc

SEQ ID NO: 3534564 - RNA, 19 nt, Pseudomonas putida KT2440
cgaucaguaaucugccggc

SEQ ID NO: 3534565 - RNA, 23 nt, Pseudomonas putida KT2440
cgaucaguaaucugccggcgccu

SEQ ID NO: 3534566 - RNA, 20 nt, Pseudomonas putida KT2440
cgaucaguacgaugcugcgg

SEQ ID NO: 3534567 - RNA, 17 nt, Pseudomonas putida KT2440
cgaucaugcuggccagg

SEQ ID NO: 3534568 - RNA, 15 nt, Pseudomonas putida KT2440
cgaucaugucgccgu

SEQ ID NO: 3534569 - RNA, 23 nt, Pseudomonas putida KT2440
cgauccacucgucgaucuggaug

SEQ ID NO: 3534570 - RNA, 14 nt, Pseudomonas putida KT2440
cgauccaggaucac

SEQ ID NO: 3534571 - RNA, 22 nt, Pseudomonas putida KT2440
cgauccaggugcgcaccuuggc

SEQ ID NO: 3534572 - RNA, 22 nt, Pseudomonas putida KT2440
cgauccaucuucaccuugccua

SEQ ID NO: 3534573 - RNA, 15 nt, Pseudomonas putida KT2440
cgauccccugcaaua

SEQ ID NO: 3534574 - RNA, 23 nt, Pseudomonas putida KT2440
cgaucccgaugcgcuugaggcuu

SEQ ID NO: 3534575 - RNA, 20 nt, Pseudomonas putida KT2440
cgaucccuguaggagcgggu

SEQ ID NO: 3534576 - RNA, 21 nt, Pseudomonas putida KT2440
cgaucccugugggagcgggcu

SEQ ID NO: 3534577 - RNA, 15 nt, Pseudomonas putida KT2440
cgauccgcgccauca

SEQ ID NO: 3534578 - RNA, 19 nt, Pseudomonas putida KT2440
cgauccgggugcuggcucg

SEQ ID NO: 3534579 - RNA, 17 nt, Pseudomonas putida KT2440
cgauccucaucguccac

SEQ ID NO: 3534580 - RNA, 18 nt, Pseudomonas putida KT2440
cgauccucugugggagcg

SEQ ID NO: 3534581 - RNA, 16 nt, Pseudomonas putida KT2440
cgauccuguggaagcg

SEQ ID NO: 3534582 - RNA, 20 nt, Pseudomonas putida KT2440
cgaucgaaaaaccgcucccg

SEQ ID NO: 3534583 - RNA, 19 nt, Pseudomonas putida KT2440
cgaucgaaaucagccuuca

SEQ ID NO: 3534584 - RNA, 17 nt, Pseudomonas putida KT2440
cgaucgaacgcuugccc

SEQ ID NO: 3534585 - RNA, 16 nt, Pseudomonas putida KT2440
cgaucgaagcagcagc

SEQ ID NO: 3534586 - RNA, 19 nt, Pseudomonas putida KT2440
cgaucgacaaccccagccc

SEQ ID NO: 3534587 - RNA, 20 nt, Pseudomonas putida KT2440
cgaucgacaaccccagcccg

SEQ ID NO: 3534588 - RNA, 21 nt, Pseudomonas putida KT2440
cgaucgacaaccccagcccga

SEQ ID NO: 3534589 - RNA, 13 nt, Pseudomonas putida KT2440
cgaucgacuucau

SEQ ID NO: 3534590 - RNA, 20 nt, Pseudomonas putida KT2440
cgaucgacuucaucaccucc

SEQ ID NO: 3534591 - RNA, 22 nt, Pseudomonas putida KT2440
cgaucgaggcgacgaucaucgc

SEQ ID NO: 3534592 - RNA, 18 nt, Pseudomonas putida KT2440
cgaucgaugaacucaccc

SEQ ID NO: 3534593 - RNA, 16 nt, Pseudomonas putida KT2440
cgaucgccagccccag

SEQ ID NO: 3534594 - RNA, 13 nt, Pseudomonas putida KT2440
cgaucgccaggug

SEQ ID NO: 3534595 - RNA, 17 nt, Pseudomonas putida KT2440
cgaucgccauguguacg

SEQ ID NO: 3534596 - RNA, 16 nt, Pseudomonas putida KT2440
cgaucgccggcagcug

SEQ ID NO: 3534597 - RNA, 19 nt, Pseudomonas putida KT2440
cgaucggguacuccaccac

SEQ ID NO: 3534598 - RNA, 21 nt, Pseudomonas putida KT2440
cgaucggguacuccaccacca

SEQ ID NO: 3534599 - RNA, 23 nt, Pseudomonas putida KT2440
cgaucgucgacaacgcacccgcc

SEQ ID NO: 3534600 - RNA, 23 nt, Pseudomonas putida KT2440
cgaucguugguccgcgaguggua

SEQ ID NO: 3534601 - RNA, 15 nt, Pseudomonas putida KT2440
cgaucuauucgaccc

SEQ ID NO: 3534602 - RNA, 14 nt, Pseudomonas putida KT2440
cgaucuccaggugc

SEQ ID NO: 3534603 - RNA, 14 nt, Pseudomonas putida KT2440
cgaucucgccagcc

SEQ ID NO: 3534604 - RNA, 20 nt, Pseudomonas putida KT2440
cgaucucgccagccugcagc

SEQ ID NO: 3534605 - RNA, 16 nt, Pseudomonas putida KT2440
cgaucucggccagcag

SEQ ID NO: 3534606 - RNA, 15 nt, Pseudomonas putida KT2440
cgaucugcagcaccg

SEQ ID NO: 3534607 - RNA, 15 nt, Pseudomonas putida KT2440
cgaucugccugccuc

SEQ ID NO: 3534608 - RNA, 17 nt, Pseudomonas putida KT2440
cgaucuggaucacugcc

SEQ ID NO: 3534609 - RNA, 20 nt, Pseudomonas putida KT2440
cgaucuggaucacugccagc

SEQ ID NO: 3534610 - RNA, 15 nt, Pseudomonas putida KT2440
cgaucuucaggcuga

SEQ ID NO: 3534611 - RNA, 15 nt, Pseudomonas putida KT2440
cgaucuucgcccugg

SEQ ID NO: 3534612 - RNA, 14 nt, Pseudomonas putida KT2440
cgaucuucgccggc

SEQ ID NO: 3534613 - RNA, 12 nt, Pseudomonas putida KT2440
cgaucuuggcca

SEQ ID NO: 3534614 - RNA, 13 nt, Pseudomonas putida KT2440
cgaucuuggccag

SEQ ID NO: 3534615 - RNA, 21 nt, Pseudomonas putida KT2440
cgaugaagacgcucgacagca

SEQ ID NO: 3534616 - RNA, 13 nt, Pseudomonas putida KT2440
cgaugaagcaggc

SEQ ID NO: 3534617 - RNA, 14 nt, Pseudomonas putida KT2440
cgaugaaggcugcu

SEQ ID NO: 3534618 - RNA, 21 nt, Pseudomonas putida KT2440
cgaugacccuuccagcccgcc

SEQ ID NO: 3534619 - RNA, 23 nt, Pseudomonas putida KT2440
cgaugacccuuccagcccgccug

SEQ ID NO: 3534620 - RNA, 22 nt, Pseudomonas putida KT2440
cgaugacgaacucgucaccgcc

SEQ ID NO: 3534621 - RNA, 17 nt, Pseudomonas putida KT2440
cgaugagcgagcccgcg

SEQ ID NO: 3534622 - RNA, 19 nt, Pseudomonas putida KT2440
cgaugaguugucugccgaa

SEQ ID NO: 3534623 - RNA, 17 nt, Pseudomonas putida KT2440
cgaugaucgccuggccg

SEQ ID NO: 3534624 - RNA, 13 nt, Pseudomonas putida KT2440
cgaugaucugccg

SEQ ID NO: 3534625 - RNA, 19 nt, Pseudomonas putida KT2440
cgaugaugauaccgaacag

SEQ ID NO: 3534626 - RNA, 24 nt, Pseudomonas putida KT2440
cgaugaugauaccgaacagcaccg

SEQ ID NO: 3534627 - RNA, 16 nt, Pseudomonas putida KT2440
cgaugaugcgggcaaa

SEQ ID NO: 3534628 - RNA, 16 nt, Pseudomonas putida KT2440
cgaugaugcuggucgg

SEQ ID NO: 3534629 - RNA, 17 nt, Pseudomonas putida KT2440
cgaugaugugcgccggc

SEQ ID NO: 3534630 - RNA, 13 nt, Pseudomonas putida KT2440
cgaugcagggcug

SEQ ID NO: 3534631 - RNA, 12 nt, Pseudomonas putida KT2440
cgaugcccaggc

SEQ ID NO: 3534632 - RNA, 13 nt, Pseudomonas putida KT2440
cgaugcccauggc

SEQ ID NO: 3534633 - RNA, 18 nt, Pseudomonas putida KT2440
cgaugcccauggcgcagc

SEQ ID NO: 3534634 - RNA, 14 nt, Pseudomonas putida KT2440
cgaugccguacacc

SEQ ID NO: 3534635 - RNA, 15 nt, Pseudomonas putida KT2440
cgaugcgcacaccgc

SEQ ID NO: 3534636 - RNA, 14 nt, Pseudomonas putida KT2440
cgaugcgcuggcac

SEQ ID NO: 3534637 - RNA, 18 nt, Pseudomonas putida KT2440
cgaugcucgucagccccu

SEQ ID NO: 3534638 - RNA, 12 nt, Pseudomonas putida KT2440
cgaugcugcuga

SEQ ID NO: 3534639 - RNA, 13 nt, Pseudomonas putida KT2440
cgaugcugugccg

SEQ ID NO: 3534640 - RNA, 21 nt, Pseudomonas putida KT2440
cgauggaauaggucacguugu

SEQ ID NO: 3534641 - RNA, 21 nt, Pseudomonas putida KT2440
cgauggauggcaccggcuuug

SEQ ID NO: 3534642 - RNA, 14 nt, Pseudomonas putida KT2440
cgauggccaccagc

SEQ ID NO: 3534643 - RNA, 17 nt, Pseudomonas putida KT2440
cgauggccaggaacagc

SEQ ID NO: 3534644 - RNA, 17 nt, Pseudomonas putida KT2440
cgauggccccgcccagg

SEQ ID NO: 3534645 - RNA, 21 nt, Pseudomonas putida KT2440
cgauggcgcaaacccucggcc

SEQ ID NO: 3534646 - RNA, 16 nt, Pseudomonas putida KT2440
cgaugggcacuggcca

SEQ ID NO: 3534647 - RNA, 15 nt, Pseudomonas putida KT2440
cgaugggcaggccau

SEQ ID NO: 3534648 - RNA, 19 nt, Pseudomonas putida KT2440
cgaugggcaggccauucac

SEQ ID NO: 3534649 - RNA, 16 nt, Pseudomonas putida KT2440
cgaugggcugcaaagc

SEQ ID NO: 3534650 - RNA, 16 nt, Pseudomonas putida KT2440
cgaugggcuguuccag

SEQ ID NO: 3534651 - RNA, 19 nt, Pseudomonas putida KT2440
cgaugggugcaaaaccugc

SEQ ID NO: 3534652 - RNA, 22 nt, Pseudomonas putida KT2440
cgaugguacagcucacuggcca

SEQ ID NO: 3534653 - RNA, 12 nt, Pseudomonas putida KT2440
cgauggucaacc

SEQ ID NO: 3534654 - RNA, 16 nt, Pseudomonas putida KT2440
cgauggucaaccggcc

SEQ ID NO: 3534655 - RNA, 20 nt, Pseudomonas putida KT2440
cgauggucaaccggccaccg

SEQ ID NO: 3534656 - RNA, 18 nt, Pseudomonas putida KT2440
cgauggucacccgcgacc

SEQ ID NO: 3534657 - RNA, 18 nt, Pseudomonas putida KT2440
cgauggugaaggccagga

SEQ ID NO: 3534658 - RNA, 17 nt, Pseudomonas putida KT2440
cgauggugccaggggcu

SEQ ID NO: 3534659 - RNA, 22 nt, Pseudomonas putida KT2440
cgaugguggcugcacugccgca

SEQ ID NO: 3534660 - RNA, 23 nt, Pseudomonas putida KT2440
cgaugguguucugguugaacugc

SEQ ID NO: 3534661 - RNA, 15 nt, Pseudomonas putida KT2440
cgauguacggcagaa

SEQ ID NO: 3534662 - RNA, 18 nt, Pseudomonas putida KT2440
cgauguacucgaacagcu

SEQ ID NO: 3534663 - RNA, 15 nt, Pseudomonas putida KT2440
cgauguagaugccgu

SEQ ID NO: 3534664 - RNA, 21 nt, Pseudomonas putida KT2440
cgauguagaugccguucggcc

SEQ ID NO: 3534665 - RNA, 16 nt, Pseudomonas putida KT2440
cgauguccaggccgaa

SEQ ID NO: 3534666 - RNA, 17 nt, Pseudomonas putida KT2440
cgauguccaggccgaaa

SEQ ID NO: 3534667 - RNA, 22 nt, Pseudomonas putida KT2440
cgauguccucggcguucagcuc

SEQ ID NO: 3534668 - RNA, 17 nt, Pseudomonas putida KT2440
cgauguccuugcuggcc

SEQ ID NO: 3534669 - RNA, 18 nt, Pseudomonas putida KT2440
cgauguccuugcuggcca

SEQ ID NO: 3534670 - RNA, 19 nt, Pseudomonas putida KT2440
cgauguccuugcuggccac

SEQ ID NO: 3534671 - RNA, 23 nt, Pseudomonas putida KT2440
cgaugucgaauacaccgccgcau

SEQ ID NO: 3534672 - RNA, 19 nt, Pseudomonas putida KT2440
cgaugucggcgugcaccac

SEQ ID NO: 3534673 - RNA, 17 nt, Pseudomonas putida KT2440
cgaugucuuccagacca

SEQ ID NO: 3534674 - RNA, 18 nt, Pseudomonas putida KT2440
cgaugucuuccagaccag

SEQ ID NO: 3534675 - RNA, 20 nt, Pseudomonas putida KT2440
cgaugugcgcaucggcgcga

SEQ ID NO: 3534676 - RNA, 19 nt, Pseudomonas putida KT2440
cgauguguguccaccaccg

SEQ ID NO: 3534677 - RNA, 17 nt, Pseudomonas putida KT2440
cgauguuggucaccacg

SEQ ID NO: 3534678 - RNA, 15 nt, Pseudomonas putida KT2440
cgauuacaagggccu

SEQ ID NO: 3534679 - RNA, 15 nt, Pseudomonas putida KT2440
cgauuagacccagau

SEQ ID NO: 3534680 - RNA, 12 nt, Pseudomonas putida KT2440
cgauuccaaggu

SEQ ID NO: 3534681 - RNA, 18 nt, Pseudomonas putida KT2440
cgauuccagcaggggacg

SEQ ID NO: 3534682 - RNA, 18 nt, Pseudomonas putida KT2440
cgauuccuugcagcgccg

SEQ ID NO: 3534683 - RNA, 20 nt, Pseudomonas putida KT2440
cgauucugccagcuccuggc

SEQ ID NO: 3534684 - RNA, 21 nt, Pseudomonas putida KT2440
cgauucugccagcuccuggcu

SEQ ID NO: 3534685 - RNA, 19 nt, Pseudomonas putida KT2440
cgauugccugggcgagcca

SEQ ID NO: 3534686 - RNA, 23 nt, Pseudomonas putida KT2440
cgauugccugggcgagccacucg

SEQ ID NO: 3534687 - RNA, 16 nt, Pseudomonas putida KT2440
cgauugccuuccuuga

SEQ ID NO: 3534688 - RNA, 17 nt, Pseudomonas putida KT2440
cgauugcgauccgcccc

SEQ ID NO: 3534689 - RNA, 18 nt, Pseudomonas putida KT2440
cgauugcguuuccugugu

SEQ ID NO: 3534690 - RNA, 14 nt, Pseudomonas putida KT2440
cgauugcugccgac

SEQ ID NO: 3534691 - RNA, 20 nt, Pseudomonas putida KT2440
cgauugcugccgaccugcgc

SEQ ID NO: 3534692 - RNA, 15 nt, Pseudomonas putida KT2440
cgauuucaccggcuu

SEQ ID NO: 3534693 - RNA, 17 nt, Pseudomonas putida KT2440
cgauuucaccggcuucu

SEQ ID NO: 3534694 - RNA, 16 nt, Pseudomonas putida KT2440
cgauuuccaccggcuu

SEQ ID NO: 3534695 - RNA, 14 nt, Pseudomonas putida KT2440
cgauuuccagugcc

SEQ ID NO: 3534696 - RNA, 14 nt, Pseudomonas putida KT2440
cgauuucgugcacu

SEQ ID NO: 3534697 - RNA, 20 nt, Pseudomonas putida KT2440
cgauuuuuuugaaaaaaaga

SEQ ID NO: 3534698 - RNA, 16 nt, Pseudomonas putida KT2440
cgauuuuuuuguccac

SEQ ID NO: 3534699 - RNA, 18 nt, Pseudomonas putida KT2440
cgcaaaaaaugugcgcau

SEQ ID NO: 3534700 - RNA, 20 nt, Pseudomonas putida KT2440
cgcaaaaaaugugcgcauca

SEQ ID NO: 3534701 - RNA, 15 nt, Pseudomonas putida KT2440
cgcaaaaccaccagc

SEQ ID NO: 3534702 - RNA, 16 nt, Pseudomonas putida KT2440
cgcaaaaguccccguu

SEQ ID NO: 3534703 - RNA, 22 nt, Pseudomonas putida KT2440
cgcaaaccaaacgcccgcgcag

SEQ ID NO: 3534704 - RNA, 23 nt, Pseudomonas putida KT2440
cgcaaacccucggccacaucggc

SEQ ID NO: 3534705 - RNA, 19 nt, Pseudomonas putida KT2440
cgcaaacugauucacgccc

SEQ ID NO: 3534706 - RNA, 17 nt, Pseudomonas putida KT2440
cgcaaagacugccaagu

SEQ ID NO: 3534707 - RNA, 15 nt, Pseudomonas putida KT2440
cgcaaagcggcccca

SEQ ID NO: 3534708 - RNA, 16 nt, Pseudomonas putida KT2440
cgcaaagcggccccca

SEQ ID NO: 3534709 - RNA, 18 nt, Pseudomonas putida KT2440
cgcaaagcggcccccagc

SEQ ID NO: 3534710 - RNA, 19 nt, Pseudomonas putida KT2440
cgcaaagcggcccccagca

SEQ ID NO: 3534711 - RNA, 20 nt, Pseudomonas putida KT2440
cgcaaagcggcccccagcaa

SEQ ID NO: 3534712 - RNA, 16 nt, Pseudomonas putida KT2440
cgcaaauccuccugcg

SEQ ID NO: 3534713 - RNA, 16 nt, Pseudomonas putida KT2440
cgcaaaucgccgcauc

SEQ ID NO: 3534714 - RNA, 13 nt, Pseudomonas putida KT2440
cgcaaaugcaccc

SEQ ID NO: 3534715 - RNA, 16 nt, Pseudomonas putida KT2440
cgcaaaugcaccccug

SEQ ID NO: 3534716 - RNA, 21 nt, Pseudomonas putida KT2440
cgcaaaugcaccccugccacc

SEQ ID NO: 3534717 - RNA, 20 nt, Pseudomonas putida KT2440
cgcaaaugcugccaugcaag

SEQ ID NO: 3534718 - RNA, 19 nt, Pseudomonas putida KT2440
cgcaaauucucgagcugau

SEQ ID NO: 3534719 - RNA, 13 nt, Pseudomonas putida KT2440
cgcaacaaccccg

SEQ ID NO: 3534720 - RNA, 13 nt, Pseudomonas putida KT2440
cgcaacaaggcca

SEQ ID NO: 3534721 - RNA, 14 nt, Pseudomonas putida KT2440
cgcaacacauuauc

SEQ ID NO: 3534722 - RNA, 22 nt, Pseudomonas putida KT2440
cgcaacacauuauccaccaggc

SEQ ID NO: 3534723 - RNA, 16 nt, Pseudomonas putida KT2440
cgcaacaccgccagcg

SEQ ID NO: 3534724 - RNA, 15 nt, Pseudomonas putida KT2440
cgcaacaccugccgc

SEQ ID NO: 3534725 - RNA, 18 nt, Pseudomonas putida KT2440
cgcaacaccugccgcagc

SEQ ID NO: 3534726 - RNA, 13 nt, Pseudomonas putida KT2440
cgcaacagugccc

SEQ ID NO: 3534727 - RNA, 19 nt, Pseudomonas putida KT2440
cgcaacaguuuucaaugcu

SEQ ID NO: 3534728 - RNA, 22 nt, Pseudomonas putida KT2440
cgcaacaugaagccaugggcag

SEQ ID NO: 3534729 - RNA, 22 nt, Pseudomonas putida KT2440
cgcaaccgggucggcgccaggc

SEQ ID NO: 3534730 - RNA, 13 nt, Pseudomonas putida KT2440
cgcaacgaucggc

SEQ ID NO: 3534731 - RNA, 15 nt, Pseudomonas putida KT2440
cgcaacgaucggcau

SEQ ID NO: 3534732 - RNA, 19 nt, Pseudomonas putida KT2440
cgcaacgcgccauggccug

SEQ ID NO: 3534733 - RNA, 14 nt, Pseudomonas putida KT2440
cgcaacgcuuggca

SEQ ID NO: 3534734 - RNA, 14 nt, Pseudomonas putida KT2440
cgcaacgugcgccg

SEQ ID NO: 3534735 - RNA, 12 nt, Pseudomonas putida KT2440
cgcaacuccacg

SEQ ID NO: 3534736 - RNA, 22 nt, Pseudomonas putida KT2440
cgcaacucuaccucacugacag

SEQ ID NO: 3534737 - RNA, 23 nt, Pseudomonas putida KT2440
cgcaacucuaccucacugacagc

SEQ ID NO: 3534738 - RNA, 14 nt, Pseudomonas putida KT2440
cgcaacugcggccc

SEQ ID NO: 3534739 - RNA, 17 nt, Pseudomonas putida KT2440
cgcaagcagucccagca

SEQ ID NO: 3534740 - RNA, 20 nt, Pseudomonas putida KT2440
cgcaagccgcugucgguaaa

SEQ ID NO: 3534741 - RNA, 13 nt, Pseudomonas putida KT2440
cgcaagcgcgccg

SEQ ID NO: 3534742 - RNA, 18 nt, Pseudomonas putida KT2440
cgcaagcgcgccgccaca

SEQ ID NO: 3534743 - RNA, 17 nt, Pseudomonas putida KT2440
cgcaagcgggcagugca

SEQ ID NO: 3534744 - RNA, 21 nt, Pseudomonas putida KT2440
cgcaagcgguugcccgcugca

SEQ ID NO: 3534745 - RNA, 20 nt, Pseudomonas putida KT2440
cgcaagcuccagggugcgcg

SEQ ID NO: 3534746 - RNA, 14 nt, Pseudomonas putida KT2440
cgcaagcugcaccg

SEQ ID NO: 3534747 - RNA, 18 nt, Pseudomonas putida KT2440
cgcaagcugcaccgccac

SEQ ID NO: 3534748 - RNA, 21 nt, Pseudomonas putida KT2440
cgcaagcuggcgcaagccgug

SEQ ID NO: 3534749 - RNA, 20 nt, Pseudomonas putida KT2440
cgcaaggcaaagaagucgcc

SEQ ID NO: 3534750 - RNA, 14 nt, Pseudomonas putida KT2440
cgcaaggccgcggc

SEQ ID NO: 3534751 - RNA, 13 nt, Pseudomonas putida KT2440
cgcaaggcggccc

SEQ ID NO: 3534752 - RNA, 20 nt, Pseudomonas putida KT2440
cgcaaggugccaacaggcag

SEQ ID NO: 3534753 - RNA, 22 nt, Pseudomonas putida KT2440
cgcaagguggcauuggcgugcu

SEQ ID NO: 3534754 - RNA, 19 nt, Pseudomonas putida KT2440
cgcaaguagaaccacacag

SEQ ID NO: 3534755 - RNA, 19 nt, Pseudomonas putida KT2440
cgcaaucaaagcagacagc

SEQ ID NO: 3534756 - RNA, 19 nt, Pseudomonas putida KT2440
cgcaaucaccgccgcccgg

SEQ ID NO: 3534757 - RNA, 20 nt, Pseudomonas putida KT2440
cgcaauccccuccgccugcg

SEQ ID NO: 3534758 - RNA, 21 nt, Pseudomonas putida KT2440
cgcaauccccuccgccugcgg

SEQ ID NO: 3534759 - RNA, 21 nt, Pseudomonas putida KT2440
cgcaauccuugcccucgccca

SEQ ID NO: 3534760 - RNA, 13 nt, Pseudomonas putida KT2440
cgcaaucuugcca

SEQ ID NO: 3534761 - RNA, 19 nt, Pseudomonas putida KT2440
cgcaaugaaaaagccccug

SEQ ID NO: 3534762 - RNA, 19 nt, Pseudomonas putida KT2440
cgcaaugcccagcgcgccg

SEQ ID NO: 3534763 - RNA, 13 nt, Pseudomonas putida KT2440
cgcaauugccggu

SEQ ID NO: 3534764 - RNA, 15 nt, Pseudomonas putida KT2440
cgcacaaacaaccgu

SEQ ID NO: 3534765 - RNA, 13 nt, Pseudomonas putida KT2440
cgcacaccgcugg

SEQ ID NO: 3534766 - RNA, 13 nt, Pseudomonas putida KT2440
cgcacacgcucca

SEQ ID NO: 3534767 - RNA, 17 nt, Pseudomonas putida KT2440
cgcacagcaucacccgc

SEQ ID NO: 3534768 - RNA, 13 nt, Pseudomonas putida KT2440
cgcacagcugccg

SEQ ID NO: 3534769 - RNA, 16 nt, Pseudomonas putida KT2440
cgcacaggcgcagcag

SEQ ID NO: 3534770 - RNA, 19 nt, Pseudomonas putida KT2440
cgcacagguccagccgcca

SEQ ID NO: 3534771 - RNA, 14 nt, Pseudomonas putida KT2440
cgcacaucacggcg

SEQ ID NO: 3534772 - RNA, 16 nt, Pseudomonas putida KT2440
cgcacaucacggcgca

SEQ ID NO: 3534773 - RNA, 22 nt, Pseudomonas putida KT2440
cgcacaucacguuuggcagugc

SEQ ID NO: 3534774 - RNA, 15 nt, Pseudomonas putida KT2440
cgcacaugaagccgc

SEQ ID NO: 3534775 - RNA, 16 nt, Pseudomonas putida KT2440
cgcacaugaagccgcg

SEQ ID NO: 3534776 - RNA, 20 nt, Pseudomonas putida KT2440
cgcacaugaagccgcgcagg

SEQ ID NO: 3534777 - RNA, 21 nt, Pseudomonas putida KT2440
cgcacaugaagccgcgcagga

SEQ ID NO: 3534778 - RNA, 14 nt, Pseudomonas putida KT2440
cgcacaugccugca

SEQ ID NO: 3534779 - RNA, 15 nt, Pseudomonas putida KT2440
cgcaccaacuggucg

SEQ ID NO: 3534780 - RNA, 18 nt, Pseudomonas putida KT2440
cgcaccacgaucacgccc

SEQ ID NO: 3534781 - RNA, 22 nt, Pseudomonas putida KT2440
cgcaccacgaucacgcccgggc

SEQ ID NO: 3534782 - RNA, 20 nt, Pseudomonas putida KT2440
cgcaccacguccggccagca

SEQ ID NO: 3534783 - RNA, 13 nt, Pseudomonas putida KT2440
cgcaccagcucca

SEQ ID NO: 3534784 - RNA, 16 nt, Pseudomonas putida KT2440
cgcaccagcuccaaca

SEQ ID NO: 3534785 - RNA, 18 nt, Pseudomonas putida KT2440
cgcaccagggcuggcagc

SEQ ID NO: 3534786 - RNA, 14 nt, Pseudomonas putida KT2440
cgcaccagguccac

SEQ ID NO: 3534787 - RNA, 16 nt, Pseudomonas putida KT2440
cgcaccaggucgcggu

SEQ ID NO: 3534788 - RNA, 17 nt, Pseudomonas putida KT2440
cgcaccagguuggccgc

SEQ ID NO: 3534789 - RNA, 14 nt, Pseudomonas putida KT2440
cgcaccaucggcuc

SEQ ID NO: 3534790 - RNA, 14 nt, Pseudomonas putida KT2440
cgcacccaccgcag

SEQ ID NO: 3534791 - RNA, 18 nt, Pseudomonas putida KT2440
cgcacccaccgcagguca

SEQ ID NO: 3534792 - RNA, 14 nt, Pseudomonas putida KT2440
cgcacccaggccac

SEQ ID NO: 3534793 - RNA, 14 nt, Pseudomonas putida KT2440
cgcacccaggugcg

SEQ ID NO: 3534794 - RNA, 16 nt, Pseudomonas putida KT2440
cgcacccgaccacccu

SEQ ID NO: 3534795 - RNA, 15 nt, Pseudomonas putida KT2440
cgcacccgccuccgg

SEQ ID NO: 3534796 - RNA, 13 nt, Pseudomonas putida KT2440
cgcacccggcugg

SEQ ID NO: 3534797 - RNA, 17 nt, Pseudomonas putida KT2440
cgcacccggcuggucga

SEQ ID NO: 3534798 - RNA, 14 nt, Pseudomonas putida KT2440
cgcaccgcggaugc

SEQ ID NO: 3534799 - RNA, 16 nt, Pseudomonas putida KT2440
cgcaccgcggaugcgc

SEQ ID NO: 3534800 - RNA, 21 nt, Pseudomonas putida KT2440
cgcaccgcggaugcgccuggc

SEQ ID NO: 3534801 - RNA, 15 nt, Pseudomonas putida KT2440
cgcaccgcugaccac

SEQ ID NO: 3534802 - RNA, 22 nt, Pseudomonas putida KT2440
cgcaccggaguccccaccggca

SEQ ID NO: 3534803 - RNA, 22 nt, Pseudomonas putida KT2440
cgcaccgucgaugucggcgugg

SEQ ID NO: 3534804 - RNA, 17 nt, Pseudomonas putida KT2440
cgcaccgugcaccagca

SEQ ID NO: 3534805 - RNA, 22 nt, Pseudomonas putida KT2440
cgcaccgugcaccagcaccacc

SEQ ID NO: 3534806 - RNA, 20 nt, Pseudomonas putida KT2440
cgcaccuacagggauugcgc

SEQ ID NO: 3534807 - RNA, 15 nt, Pseudomonas putida KT2440
cgcaccucacaacgc

SEQ ID NO: 3534808 - RNA, 15 nt, Pseudomonas putida KT2440
cgcaccucgaccgca

SEQ ID NO: 3534809 - RNA, 15 nt, Pseudomonas putida KT2440
cgcaccucggccagu

SEQ ID NO: 3534810 - RNA, 15 nt, Pseudomonas putida KT2440
cgcaccugcccgccc

SEQ ID NO: 3534811 - RNA, 14 nt, Pseudomonas putida KT2440
cgcaccuguuucaa

SEQ ID NO: 3534812 - RNA, 15 nt, Pseudomonas putida KT2440
cgcacgaacagcggc

SEQ ID NO: 3534813 - RNA, 17 nt, Pseudomonas putida KT2440
cgcacgaagaucaccga

SEQ ID NO: 3534814 - RNA, 21 nt, Pseudomonas putida KT2440
cgcacgaauacgcucgaccag

SEQ ID NO: 3534815 - RNA, 18 nt, Pseudomonas putida KT2440
cgcacgauccccggccgg

SEQ ID NO: 3534816 - RNA, 19 nt, Pseudomonas putida KT2440
cgcacgauccccggccggu

SEQ ID NO: 3534817 - RNA, 16 nt, Pseudomonas putida KT2440
cgcacgcaggauguca

SEQ ID NO: 3534818 - RNA, 19 nt, Pseudomonas putida KT2440
cgcacgcaugcgcgacagc

SEQ ID NO: 3534819 - RNA, 20 nt, Pseudomonas putida KT2440
cgcacgcgccucuugcaccu

SEQ ID NO: 3534820 - RNA, 17 nt, Pseudomonas putida KT2440
cgcacggcaucggccga

SEQ ID NO: 3534821 - RNA, 15 nt, Pseudomonas putida KT2440
cgcacggccuccacc

SEQ ID NO: 3534822 - RNA, 22 nt, Pseudomonas putida KT2440
cgcacggccuccaccaccugca

SEQ ID NO: 3534823 - RNA, 12 nt, Pseudomonas putida KT2440
cgcacggcuucg

SEQ ID NO: 3534824 - RNA, 22 nt, Pseudomonas putida KT2440
cgcacgggucaccucaucgacc

SEQ ID NO: 3534825 - RNA, 19 nt, Pseudomonas putida KT2440
cgcacgguuuuauaccggc

SEQ ID NO: 3534826 - RNA, 18 nt, Pseudomonas putida KT2440
cgcacguacuccaccaag

SEQ ID NO: 3534827 - RNA, 15 nt, Pseudomonas putida KT2440
cgcacguagcgcccg

SEQ ID NO: 3534828 - RNA, 19 nt, Pseudomonas putida KT2440
cgcacgugggucgggaaca

SEQ ID NO: 3534829 - RNA, 23 nt, Pseudomonas putida KT2440
cgcacgugggucgggaacagcuc

SEQ ID NO: 3534830 - RNA, 13 nt, Pseudomonas putida KT2440
cgcacguuggccg

SEQ ID NO: 3534831 - RNA, 15 nt, Pseudomonas putida KT2440
cgcacguuuggagcg

SEQ ID NO: 3534832 - RNA, 16 nt, Pseudomonas putida KT2440
cgcacucaggugagcc

SEQ ID NO: 3534833 - RNA, 13 nt, Pseudomonas putida KT2440
cgcacuccccauc

SEQ ID NO: 3534834 - RNA, 14 nt, Pseudomonas putida KT2440
cgcacuccccauca

SEQ ID NO: 3534835 - RNA, 20 nt, Pseudomonas putida KT2440
cgcacuccccaucagcagcu

SEQ ID NO: 3534836 - RNA, 22 nt, Pseudomonas putida KT2440
cgcacuccccaucagcagcugc

SEQ ID NO: 3534837 - RNA, 14 nt, Pseudomonas putida KT2440
cgcacucggcaauc

SEQ ID NO: 3534838 - RNA, 15 nt, Pseudomonas putida KT2440
cgcacucggcaauca

SEQ ID NO: 3534839 - RNA, 14 nt, Pseudomonas putida KT2440
cgcacucucccgca

SEQ ID NO: 3534840 - RNA, 14 nt, Pseudomonas putida KT2440
cgcacucugcugcu

SEQ ID NO: 3534841 - RNA, 17 nt, Pseudomonas putida KT2440
cgcacucugcugcucug

SEQ ID NO: 3534842 - RNA, 18 nt, Pseudomonas putida KT2440
cgcacugaacagcgccuu

SEQ ID NO: 3534843 - RNA, 12 nt, Pseudomonas putida KT2440
cgcacugcugcc

SEQ ID NO: 3534844 - RNA, 13 nt, Pseudomonas putida KT2440
cgcacugcugccg

SEQ ID NO: 3534845 - RNA, 15 nt, Pseudomonas putida KT2440
cgcacugcugccgcc

SEQ ID NO: 3534846 - RNA, 16 nt, Pseudomonas putida KT2440
cgcacugcugccgccc

SEQ ID NO: 3534847 - RNA, 18 nt, Pseudomonas putida KT2440
cgcacugcugccgcccuc

SEQ ID NO: 3534848 - RNA, 17 nt, Pseudomonas putida KT2440
cgcacuggucaaccccu

SEQ ID NO: 3534849 - RNA, 19 nt, Pseudomonas putida KT2440
cgcacuuacuaucacgccu

SEQ ID NO: 3534850 - RNA, 24 nt, Pseudomonas putida KT2440
cgcacuuccacacccagcgcggca

SEQ ID NO: 3534851 - RNA, 17 nt, Pseudomonas putida KT2440
cgcacuucguagcgccc

SEQ ID NO: 3534852 - RNA, 19 nt, Pseudomonas putida KT2440
cgcacuugaucuugcgccc

SEQ ID NO: 3534853 - RNA, 21 nt, Pseudomonas putida KT2440
cgcacuugaucuugcgcccca

SEQ ID NO: 3534854 - RNA, 15 nt, Pseudomonas putida KT2440
cgcacuugcacuuug

SEQ ID NO: 3534855 - RNA, 12 nt, Pseudomonas putida KT2440
cgcacuugccag

SEQ ID NO: 3534856 - RNA, 12 nt, Pseudomonas putida KT2440
cgcacuuggccu

SEQ ID NO: 3534857 - RNA, 16 nt, Pseudomonas putida KT2440
cgcacuuggccugcug

SEQ ID NO: 3534858 - RNA, 18 nt, Pseudomonas putida KT2440
cgcacuuggccugcugau

SEQ ID NO: 3534859 - RNA, 15 nt, Pseudomonas putida KT2440
cgcacuuguuccagc

SEQ ID NO: 3534860 - RNA, 16 nt, Pseudomonas putida KT2440
cgcacuuguuccagcc

SEQ ID NO: 3534861 - RNA, 19 nt, Pseudomonas putida KT2440
cgcacuuguuccagccgcg

SEQ ID NO: 3534862 - RNA, 14 nt, Pseudomonas putida KT2440
cgcagaaggccccg

SEQ ID NO: 3534863 - RNA, 21 nt, Pseudomonas putida KT2440
cgcagaauauugaacaggcuc

SEQ ID NO: 3534864 - RNA, 21 nt, Pseudomonas putida KT2440
cgcagacaaaacgcugcgacu

SEQ ID NO: 3534865 - RNA, 14 nt, Pseudomonas putida KT2440
cgcagacuggguga

SEQ ID NO: 3534866 - RNA, 19 nt, Pseudomonas putida KT2440
cgcagacuucgaagugcca

SEQ ID NO: 3534867 - RNA, 14 nt, Pseudomonas putida KT2440
cgcagagcaugguc

SEQ ID NO: 3534868 - RNA, 15 nt, Pseudomonas putida KT2440
cgcagagcaugguca

SEQ ID NO: 3534869 - RNA, 19 nt, Pseudomonas putida KT2440
cgcagagcauggucaugcc

SEQ ID NO: 3534870 - RNA, 12 nt, Pseudomonas putida KT2440
cgcagagcgccc

SEQ ID NO: 3534871 - RNA, 17 nt, Pseudomonas putida KT2440
cgcagagcgcccaccaa

SEQ ID NO: 3534872 - RNA, 14 nt, Pseudomonas putida KT2440
cgcagagcgccccg

SEQ ID NO: 3534873 - RNA, 14 nt, Pseudomonas putida KT2440
cgcagagcggcccu

SEQ ID NO: 3534874 - RNA, 22 nt, Pseudomonas putida KT2440
cgcagagcggcccugagccuug

SEQ ID NO: 3534875 - RNA, 14 nt, Pseudomonas putida KT2440
cgcagagggccgcg

SEQ ID NO: 3534876 - RNA, 17 nt, Pseudomonas putida KT2440
cgcagauaaccuggcuc

SEQ ID NO: 3534877 - RNA, 13 nt, Pseudomonas putida KT2440
cgcagaucccgcu

SEQ ID NO: 3534878 - RNA, 20 nt, Pseudomonas putida KT2440
cgcagcacaagacugcugug

SEQ ID NO: 3534879 - RNA, 19 nt, Pseudomonas putida KT2440
cgcagcacaucacacagcg

SEQ ID NO: 3534880 - RNA, 14 nt, Pseudomonas putida KT2440
cgcagcacccgguc

SEQ ID NO: 3534881 - RNA, 19 nt, Pseudomonas putida KT2440
cgcagcacuuccucggcac

SEQ ID NO: 3534882 - RNA, 15 nt, Pseudomonas putida KT2440
cgcagcagcaccggc

SEQ ID NO: 3534883 - RNA, 16 nt, Pseudomonas putida KT2440
cgcagcagcaggcccg

SEQ ID NO: 3534884 - RNA, 19 nt, Pseudomonas putida KT2440
cgcagcagcaggcccgcca

SEQ ID NO: 3534885 - RNA, 18 nt, Pseudomonas putida KT2440
cgcagcagcuugaccccu

SEQ ID NO: 3534886 - RNA, 18 nt, Pseudomonas putida KT2440
cgcagcagguccagcucc

SEQ ID NO: 3534887 - RNA, 13 nt, Pseudomonas putida KT2440
cgcagccaaucgg

SEQ ID NO: 3534888 - RNA, 21 nt, Pseudomonas putida KT2440
cgcagccaaugcugaugaagc

SEQ ID NO: 3534889 - RNA, 14 nt, Pseudomonas putida KT2440
cgcagccaccagcu

SEQ ID NO: 3534890 - RNA, 23 nt, Pseudomonas putida KT2440
cgcagccauaguuuugugccacc

SEQ ID NO: 3534891 - RNA, 16 nt, Pseudomonas putida KT2440
cgcagccaugccgccg

SEQ ID NO: 3534892 - RNA, 17 nt, Pseudomonas putida KT2440
cgcagccaugccgccga

SEQ ID NO: 3534893 - RNA, 21 nt, Pseudomonas putida KT2440
cgcagccaugccgccgacgau

SEQ ID NO: 3534894 - RNA, 17 nt, Pseudomonas putida KT2440
cgcagcccaaacagcau

SEQ ID NO: 3534895 - RNA, 17 nt, Pseudomonas putida KT2440
cgcagcccacggccgcc

SEQ ID NO: 3534896 - RNA, 18 nt, Pseudomonas putida KT2440
cgcagcccacggccgcca

SEQ ID NO: 3534897 - RNA, 19 nt, Pseudomonas putida KT2440
cgcagcccacggccgccaa

SEQ ID NO: 3534898 - RNA, 15 nt, Pseudomonas putida KT2440
cgcagccccaccucg

SEQ ID NO: 3534899 - RNA, 17 nt, Pseudomonas putida KT2440
cgcagccguucuggcca

SEQ ID NO: 3534900 - RNA, 20 nt, Pseudomonas putida KT2440
cgcagccucuucggccagca

SEQ ID NO: 3534901 - RNA, 23 nt, Pseudomonas putida KT2440
cgcagccucuucggccagcaacu

SEQ ID NO: 3534902 - RNA, 17 nt, Pseudomonas putida KT2440
cgcagccuuugaaacgg

SEQ ID NO: 3534903 - RNA, 14 nt, Pseudomonas putida KT2440
cgcagcgacgaccu

SEQ ID NO: 3534904 - RNA, 16 nt, Pseudomonas putida KT2440
cgcagcgacgaccugc

SEQ ID NO: 3534905 - RNA, 19 nt, Pseudomonas putida KT2440
cgcagcgacgaccugcaca

SEQ ID NO: 3534906 - RNA, 14 nt, Pseudomonas putida KT2440
cgcagcgcagcgua

SEQ ID NO: 3534907 - RNA, 14 nt, Pseudomonas putida KT2440
cgcagcgcaugcuc

SEQ ID NO: 3534908 - RNA, 23 nt, Pseudomonas putida KT2440
cgcagcgcaugcucgcgggccug

SEQ ID NO: 3534909 - RNA, 17 nt, Pseudomonas putida KT2440
cgcagcgcuucgaucag

SEQ ID NO: 3534910 - RNA, 24 nt, Pseudomonas putida KT2440
cgcagcgcuucgaucagcgccugc

SEQ ID NO: 3534911 - RNA, 23 nt, Pseudomonas putida KT2440
cgcagcggccgaaggggcgggug

SEQ ID NO: 3534912 - RNA, 19 nt, Pseudomonas putida KT2440
cgcagcggcgucaccuucc

SEQ ID NO: 3534913 - RNA, 13 nt, Pseudomonas putida KT2440
cgcagcuccacug

SEQ ID NO: 3534914 - RNA, 14 nt, Pseudomonas putida KT2440
cgcagcuccacugg

SEQ ID NO: 3534915 - RNA, 14 nt, Pseudomonas putida KT2440
cgcagcuggcgcaa

SEQ ID NO: 3534916 - RNA, 21 nt, Pseudomonas putida KT2440
cgcagcuucaacuccaccauc

SEQ ID NO: 3534917 - RNA, 16 nt, Pseudomonas putida KT2440
cgcagcuuccaccauu

SEQ ID NO: 3534918 - RNA, 18 nt, Pseudomonas putida KT2440
cgcagcuuccgccaccac

SEQ ID NO: 3534919 - RNA, 20 nt, Pseudomonas putida KT2440
cgcagcuuccgccaccacga

SEQ ID NO: 3534920 - RNA, 13 nt, Pseudomonas putida KT2440
cgcagcuuguuga

SEQ ID NO: 3534921 - RNA, 15 nt, Pseudomonas putida KT2440
cgcaggaagaaggca

SEQ ID NO: 3534922 - RNA, 19 nt, Pseudomonas putida KT2440
cgcaggaauaacuggcccg

SEQ ID NO: 3534923 - RNA, 20 nt, Pseudomonas putida KT2440
cgcaggaauaacuggcccga

SEQ ID NO: 3534924 - RNA, 17 nt, Pseudomonas putida KT2440
cgcaggagcggccuuca

SEQ ID NO: 3534925 - RNA, 13 nt, Pseudomonas putida KT2440
cgcaggcaccgca

SEQ ID NO: 3534926 - RNA, 17 nt, Pseudomonas putida KT2440
cgcaggcaccgcacccg

SEQ ID NO: 3534927 - RNA, 13 nt, Pseudomonas putida KT2440
cgcaggcacgccc

SEQ ID NO: 3534928 - RNA, 20 nt, Pseudomonas putida KT2440
cgcaggcacgcccgcuccca

SEQ ID NO: 3534929 - RNA, 16 nt, Pseudomonas putida KT2440
cgcaggcagcgauggc

SEQ ID NO: 3534930 - RNA, 20 nt, Pseudomonas putida KT2440
cgcaggcagcgauggccgug

SEQ ID NO: 3534931 - RNA, 13 nt, Pseudomonas putida KT2440
cgcaggcagcucg

SEQ ID NO: 3534932 - RNA, 18 nt, Pseudomonas putida KT2440
cgcaggcauacaggacca

SEQ ID NO: 3534933 - RNA, 20 nt, Pseudomonas putida KT2440
cgcaggcauacaggaccagg

SEQ ID NO: 3534934 - RNA, 12 nt, Pseudomonas putida KT2440
cgcaggccagcg

SEQ ID NO: 3534935 - RNA, 15 nt, Pseudomonas putida KT2440
cgcaggcccagcagg

SEQ ID NO: 3534936 - RNA, 16 nt, Pseudomonas putida KT2440
cgcaggcccagcaggu

SEQ ID NO: 3534937 - RNA, 14 nt, Pseudomonas putida KT2440
cgcaggccgacaac

SEQ ID NO: 3534938 - RNA, 13 nt, Pseudomonas putida KT2440
cgcaggccgcagc

SEQ ID NO: 3534939 - RNA, 14 nt, Pseudomonas putida KT2440
cgcaggccgccggg

SEQ ID NO: 3534940 - RNA, 16 nt, Pseudomonas putida KT2440
cgcaggcgacgagcca

SEQ ID NO: 3534941 - RNA, 18 nt, Pseudomonas putida KT2440
cgcaggcgacgagccagu

SEQ ID NO: 3534942 - RNA, 13 nt, Pseudomonas putida KT2440
cgcaggcgcaacu

SEQ ID NO: 3534943 - RNA, 20 nt, Pseudomonas putida KT2440
cgcaggcgcaacucgcgccc

SEQ ID NO: 3534944 - RNA, 15 nt, Pseudomonas putida KT2440
cgcaggcgcaggugc

SEQ ID NO: 3534945 - RNA, 19 nt, Pseudomonas putida KT2440
cgcaggcgccgccagcugc

SEQ ID NO: 3534946 - RNA, 13 nt, Pseudomonas putida KT2440
cgcaggcgcgaca

SEQ ID NO: 3534947 - RNA, 12 nt, Pseudomonas putida KT2440
cgcaggcgcugc

SEQ ID NO: 3534948 - RNA, 14 nt, Pseudomonas putida KT2440
cgcaggcgcugcag

SEQ ID NO: 3534949 - RNA, 18 nt, Pseudomonas putida KT2440
cgcaggcgcugcagggcg

SEQ ID NO: 3534950 - RNA, 19 nt, Pseudomonas putida KT2440
cgcaggcgguuggccaugu

SEQ ID NO: 3534951 - RNA, 18 nt, Pseudomonas putida KT2440
cgcaggcuaugccgguca

SEQ ID NO: 3534952 - RNA, 22 nt, Pseudomonas putida KT2440
cgcaggcuaugccggucagcag

SEQ ID NO: 3534953 - RNA, 23 nt, Pseudomonas putida KT2440
cgcaggcuaugccggucagcagc

SEQ ID NO: 3534954 - RNA, 19 nt, Pseudomonas putida KT2440
cgcaggcucaucuaccagc

SEQ ID NO: 3534955 - RNA, 20 nt, Pseudomonas putida KT2440
cgcaggcucaucuaccagcu

SEQ ID NO: 3534956 - RNA, 15 nt, Pseudomonas putida KT2440
cgcaggcucuccacg

SEQ ID NO: 3534957 - RNA, 20 nt, Pseudomonas putida KT2440
cgcaggcucugcgccagcag

SEQ ID NO: 3534958 - RNA, 18 nt, Pseudomonas putida KT2440
cgcaggcugucgaacagg

SEQ ID NO: 3534959 - RNA, 21 nt, Pseudomonas putida KT2440
cgcaggcugucgaacaggcug

SEQ ID NO: 3534960 - RNA, 18 nt, Pseudomonas putida KT2440
cgcaggcuucaaggccac

SEQ ID NO: 3534961 - RNA, 16 nt, Pseudomonas putida KT2440
cgcaggcuuguccuug

SEQ ID NO: 3534962 - RNA, 22 nt, Pseudomonas putida KT2440
cgcaggcuuucggccacccgga

SEQ ID NO: 3534963 - RNA, 17 nt, Pseudomonas putida KT2440
cgcagggaagguggccg

SEQ ID NO: 3534964 - RNA, 22 nt, Pseudomonas putida KT2440
cgcagggaagguggccggcaac

SEQ ID NO: 3534965 - RNA, 13 nt, Pseudomonas putida KT2440
cgcagggccuugu

SEQ ID NO: 3534966 - RNA, 20 nt, Pseudomonas putida KT2440
cgcagggcgcgaaaagccug

SEQ ID NO: 3534967 - RNA, 14 nt, Pseudomonas putida KT2440
cgcaggguagcccc

SEQ ID NO: 3534968 - RNA, 15 nt, Pseudomonas putida KT2440
cgcagggucgcgccc

SEQ ID NO: 3534969 - RNA, 18 nt, Pseudomonas putida KT2440
cgcagggugugcugcugc

SEQ ID NO: 3534970 - RNA, 19 nt, Pseudomonas putida KT2440
cgcagggugugcugcugcc

SEQ ID NO: 3534971 - RNA, 16 nt, Pseudomonas putida KT2440
cgcagguacgccaugu

SEQ ID NO: 3534972 - RNA, 15 nt, Pseudomonas putida KT2440
cgcagguacucgccg

SEQ ID NO: 3534973 - RNA, 16 nt, Pseudomonas putida KT2440
cgcagguccaggcgca

SEQ ID NO: 3534974 - RNA, 13 nt, Pseudomonas putida KT2440
cgcaggucgccau

SEQ ID NO: 3534975 - RNA, 22 nt, Pseudomonas putida KT2440
cgcaggucgugcuugacccccu

SEQ ID NO: 3534976 - RNA, 19 nt, Pseudomonas putida KT2440
cgcaggucuucucggcaga

SEQ ID NO: 3534977 - RNA, 23 nt, Pseudomonas putida KT2440
cgcaggucuucucggcagacccu

SEQ ID NO: 3534978 - RNA, 13 nt, Pseudomonas putida KT2440
cgcaggucuugcc

SEQ ID NO: 3534979 - RNA, 20 nt, Pseudomonas putida KT2440
cgcaggucuugcccacuucc

SEQ ID NO: 3534980 - RNA, 19 nt, Pseudomonas putida KT2440
cgcaggugcaggcucggcc

SEQ ID NO: 3534981 - RNA, 23 nt, Pseudomonas putida KT2440
cgcaggugcgcacgcugcccagg

SEQ ID NO: 3534982 - RNA, 19 nt, Pseudomonas putida KT2440
cgcagguucgaauccugcu

SEQ ID NO: 3534983 - RNA, 21 nt, Pseudomonas putida KT2440
cgcagguucgaauccugcuga

SEQ ID NO: 3534984 - RNA, 21 nt, Pseudomonas putida KT2440
cgcagguuguucggcaggcuc

SEQ ID NO: 3534985 - RNA, 22 nt, Pseudomonas putida KT2440
cgcagucaccacacggcagccc

SEQ ID NO: 3534986 - RNA, 16 nt, Pseudomonas putida KT2440
cgcagucagccacauc

SEQ ID NO: 3534987 - RNA, 20 nt, Pseudomonas putida KT2440
cgcagucagccacauccucu

SEQ ID NO: 3534988 - RNA, 22 nt, Pseudomonas putida KT2440
cgcagucccguuggcccgccag

SEQ ID NO: 3534989 - RNA, 14 nt, Pseudomonas putida KT2440
cgcagugcagccgc

SEQ ID NO: 3534990 - RNA, 17 nt, Pseudomonas putida KT2440
cgcaguucgauguaggc

SEQ ID NO: 3534991 - RNA, 16 nt, Pseudomonas putida KT2440
cgcaguucguccaggc

SEQ ID NO: 3534992 - RNA, 21 nt, Pseudomonas putida KT2440
cgcaguucguccaggcuuucg

SEQ ID NO: 3534993 - RNA, 19 nt, Pseudomonas putida KT2440
cgcauaaccaccaccgacc

SEQ ID NO: 3534994 - RNA, 14 nt, Pseudomonas putida KT2440
cgcauacagcgcac

SEQ ID NO: 3534995 - RNA, 14 nt, Pseudomonas putida KT2440
cgcauacagcuugc

SEQ ID NO: 3534996 - RNA, 18 nt, Pseudomonas putida KT2440
cgcauagcagaacagaaa

SEQ ID NO: 3534997 - RNA, 19 nt, Pseudomonas putida KT2440
cgcauagcagaacagaaac

SEQ ID NO: 3534998 - RNA, 15 nt, Pseudomonas putida KT2440
cgcauaggccaaggu

SEQ ID NO: 3534999 - RNA, 17 nt, Pseudomonas putida KT2440
cgcauaugccccaggca

SEQ ID NO: 3535000 - RNA, 19 nt, Pseudomonas putida KT2440
cgcauaugccccaggcauu

SEQ ID NO: 3535001 - RNA, 21 nt, Pseudomonas putida KT2440
cgcaucaacgaaucauccucg

SEQ ID NO: 3535002 - RNA, 16 nt, Pseudomonas putida KT2440
cgcaucagccgcgccc

SEQ ID NO: 3535003 - RNA, 17 nt, Pseudomonas putida KT2440
cgcaucagccgcgcccu

SEQ ID NO: 3535004 - RNA, 17 nt, Pseudomonas putida KT2440
cgcaucaggcugcgccc

SEQ ID NO: 3535005 - RNA, 14 nt, Pseudomonas putida KT2440
cgcaucauccacca

SEQ ID NO: 3535006 - RNA, 23 nt, Pseudomonas putida KT2440
cgcaucauggcggugaauagcag

SEQ ID NO: 3535007 - RNA, 17 nt, Pseudomonas putida KT2440
cgcauccagcacugccu

SEQ ID NO: 3535008 - RNA, 13 nt, Pseudomonas putida KT2440
cgcauccagccag

SEQ ID NO: 3535009 - RNA, 12 nt, Pseudomonas putida KT2440
cgcauccgcacc

SEQ ID NO: 3535010 - RNA, 14 nt, Pseudomonas putida KT2440
cgcauccuccgccc

SEQ ID NO: 3535011 - RNA, 23 nt, Pseudomonas putida KT2440
cgcauccugagguauacacuggc

SEQ ID NO: 3535012 - RNA, 20 nt, Pseudomonas putida KT2440
cgcauccugcgugcugugca

SEQ ID NO: 3535013 - RNA, 17 nt, Pseudomonas putida KT2440
cgcaucgacagguccac

SEQ ID NO: 3535014 - RNA, 21 nt, Pseudomonas putida KT2440
cgcaucgaccggcaggcgcuu

SEQ ID NO: 3535015 - RNA, 18 nt, Pseudomonas putida KT2440
cgcaucgcgagcaagcuc

SEQ ID NO: 3535016 - RNA, 15 nt, Pseudomonas putida KT2440
cgcaucggccacuuc

SEQ ID NO: 3535017 - RNA, 20 nt, Pseudomonas putida KT2440
cgcaucguccuugcagggca

SEQ ID NO: 3535018 - RNA, 20 nt, Pseudomonas putida KT2440
cgcaucguuauccagcaccc

SEQ ID NO: 3535019 - RNA, 23 nt, Pseudomonas putida KT2440
cgcaucugcaccggcagcgcaau

SEQ ID NO: 3535020 - RNA, 19 nt, Pseudomonas putida KT2440
cgcaucuuuccggagaugu

SEQ ID NO: 3535021 - RNA, 22 nt, Pseudomonas putida KT2440
cgcaugaaaaagccggcaacga

SEQ ID NO: 3535022 - RNA, 15 nt, Pseudomonas putida KT2440
cgcaugaaacucgcg

SEQ ID NO: 3535023 - RNA, 22 nt, Pseudomonas putida KT2440
cgcaugaugaaguggcgcaggc

SEQ ID NO: 3535024 - RNA, 19 nt, Pseudomonas putida KT2440
cgcaugccgaugucggcgu

SEQ ID NO: 3535025 - RNA, 22 nt, Pseudomonas putida KT2440
cgcaugccgaugucggcgugca

SEQ ID NO: 3535026 - RNA, 15 nt, Pseudomonas putida KT2440
cgcaugcgcgacagc

SEQ ID NO: 3535027 - RNA, 15 nt, Pseudomonas putida KT2440
cgcaugcggccguga

SEQ ID NO: 3535028 - RNA, 18 nt, Pseudomonas putida KT2440
cgcaugcucguuguaguc

SEQ ID NO: 3535029 - RNA, 20 nt, Pseudomonas putida KT2440
cgcaugcugccaggcaaagu

SEQ ID NO: 3535030 - RNA, 18 nt, Pseudomonas putida KT2440
cgcaugcuuggcgaaggu

SEQ ID NO: 3535031 - RNA, 19 nt, Pseudomonas putida KT2440
cgcauggcguuguccagca

SEQ ID NO: 3535032 - RNA, 17 nt, Pseudomonas putida KT2440
cgcauggcucaacuggc

SEQ ID NO: 3535033 - RNA, 21 nt, Pseudomonas putida KT2440
cgcauggcucaacuggcaggg

SEQ ID NO: 3535034 - RNA, 21 nt, Pseudomonas putida KT2440
cgcauggucacguagaacagg

SEQ ID NO: 3535035 - RNA, 14 nt, Pseudomonas putida KT2440
cgcaugguccuggu

SEQ ID NO: 3535036 - RNA, 20 nt, Pseudomonas putida KT2440
cgcauuagcagguaaacccg

SEQ ID NO: 3535037 - RNA, 17 nt, Pseudomonas putida KT2440
cgcauucgcgcccgcag

SEQ ID NO: 3535038 - RNA, 22 nt, Pseudomonas putida KT2440
cgcauucgcggguaaacccggg

SEQ ID NO: 3535039 - RNA, 20 nt, Pseudomonas putida KT2440
cgcauugaucaugcccaugg

SEQ ID NO: 3535040 - RNA, 15 nt, Pseudomonas putida KT2440
cgcauugcaggccag

SEQ ID NO: 3535041 - RNA, 21 nt, Pseudomonas putida KT2440
cgcauugcaggccagcgucgu

SEQ ID NO: 3535042 - RNA, 23 nt, Pseudomonas putida KT2440
cgcauugcccgcgacgaaaccca

SEQ ID NO: 3535043 - RNA, 15 nt, Pseudomonas putida KT2440
cgcauuucacgcacg

SEQ ID NO: 3535044 - RNA, 20 nt, Pseudomonas putida KT2440
cgcauuucguccaggcucag

SEQ ID NO: 3535045 - RNA, 21 nt, Pseudomonas putida KT2440
cgcauuucguccaggcucagc

SEQ ID NO: 3535046 - RNA, 13 nt, Pseudomonas putida KT2440
cgccaaaaggccc

SEQ ID NO: 3535047 - RNA, 14 nt, Pseudomonas putida KT2440
cgccaaaccccagc

SEQ ID NO: 3535048 - RNA, 17 nt, Pseudomonas putida KT2440
cgccaaaccucaaaugc

SEQ ID NO: 3535049 - RNA, 17 nt, Pseudomonas putida KT2440
cgccaaagcgagcaugg

SEQ ID NO: 3535050 - RNA, 20 nt, Pseudomonas putida KT2440
cgccaaagugauaacgcgcc

SEQ ID NO: 3535051 - RNA, 16 nt, Pseudomonas putida KT2440
cgccaaauucgaccag

SEQ ID NO: 3535052 - RNA, 20 nt, Pseudomonas putida KT2440
cgccaaauucgaccagcagu

SEQ ID NO: 3535053 - RNA, 14 nt, Pseudomonas putida KT2440
cgccaacaccaccu

SEQ ID NO: 3535054 - RNA, 14 nt, Pseudomonas putida KT2440
cgccaacagcaccc

SEQ ID NO: 3535055 - RNA, 16 nt, Pseudomonas putida KT2440
cgccaacagcacccgc

SEQ ID NO: 3535056 - RNA, 19 nt, Pseudomonas putida KT2440
cgccaacagcacccgccca

SEQ ID NO: 3535057 - RNA, 20 nt, Pseudomonas putida KT2440
cgccaacagcacccgcccau

SEQ ID NO: 3535058 - RNA, 16 nt, Pseudomonas putida KT2440
cgccaaccccaacccg

SEQ ID NO: 3535059 - RNA, 18 nt, Pseudomonas putida KT2440
cgccaaccccacgccugu

SEQ ID NO: 3535060 - RNA, 17 nt, Pseudomonas putida KT2440
cgccaaccccuccuuca

SEQ ID NO: 3535061 - RNA, 20 nt, Pseudomonas putida KT2440
cgccaacccgaucccgacaa

SEQ ID NO: 3535062 - RNA, 22 nt, Pseudomonas putida KT2440
cgccaaccucaggccugcacug

SEQ ID NO: 3535063 - RNA, 15 nt, Pseudomonas putida KT2440
cgccaaccugaucau

SEQ ID NO: 3535064 - RNA, 17 nt, Pseudomonas putida KT2440
cgccaacgaaucagcca

SEQ ID NO: 3535065 - RNA, 18 nt, Pseudomonas putida KT2440
cgccaacgcccccgccac

SEQ ID NO: 3535066 - RNA, 19 nt, Pseudomonas putida KT2440
cgccaacuccuugcgcauc

SEQ ID NO: 3535067 - RNA, 19 nt, Pseudomonas putida KT2440
cgccaacuguuucugcucu

SEQ ID NO: 3535068 - RNA, 20 nt, Pseudomonas putida KT2440
cgccaacuguuucugcucuu

SEQ ID NO: 3535069 - RNA, 14 nt, Pseudomonas putida KT2440
cgccaacuucgccg

SEQ ID NO: 3535070 - RNA, 16 nt, Pseudomonas putida KT2440
cgccaagauccgcggc

SEQ ID NO: 3535071 - RNA, 18 nt, Pseudomonas putida KT2440
cgccaagauccgcggcau

SEQ ID NO: 3535072 - RNA, 14 nt, Pseudomonas putida KT2440
cgccaagccgccau

SEQ ID NO: 3535073 - RNA, 17 nt, Pseudomonas putida KT2440
cgccaaggccucgaaca

SEQ ID NO: 3535074 - RNA, 15 nt, Pseudomonas putida KT2440
cgccaagguccagcc

SEQ ID NO: 3535075 - RNA, 21 nt, Pseudomonas putida KT2440
cgccaauacccacgucgacuu

SEQ ID NO: 3535076 - RNA, 14 nt, Pseudomonas putida KT2440
cgccaauagcccgc

SEQ ID NO: 3535077 - RNA, 16 nt, Pseudomonas putida KT2440
cgccaaucaaccgcuu

SEQ ID NO: 3535078 - RNA, 18 nt, Pseudomonas putida KT2440
cgccaaucaccugcacau

SEQ ID NO: 3535079 - RNA, 15 nt, Pseudomonas putida KT2440
cgccaaucaucgcca

SEQ ID NO: 3535080 - RNA, 16 nt, Pseudomonas putida KT2440
cgccaaucaucgccag

SEQ ID NO: 3535081 - RNA, 17 nt, Pseudomonas putida KT2440
cgccaaucaucgccagc

SEQ ID NO: 3535082 - RNA, 18 nt, Pseudomonas putida KT2440
cgccacaacccuugcagc

SEQ ID NO: 3535083 - RNA, 17 nt, Pseudomonas putida KT2440
cgccacaccacagcugc

SEQ ID NO: 3535084 - RNA, 18 nt, Pseudomonas putida KT2440
cgccacaccacagcugca

SEQ ID NO: 3535085 - RNA, 13 nt, Pseudomonas putida KT2440
cgccacacccgcu

SEQ ID NO: 3535086 - RNA, 16 nt, Pseudomonas putida KT2440
cgccacacccgcuaca

SEQ ID NO: 3535087 - RNA, 18 nt, Pseudomonas putida KT2440
cgccacacccgcuacacc

SEQ ID NO: 3535088 - RNA, 19 nt, Pseudomonas putida KT2440
cgccacacccgcuacaccg

SEQ ID NO: 3535089 - RNA, 17 nt, Pseudomonas putida KT2440
cgccacacugucccggc

SEQ ID NO: 3535090 - RNA, 18 nt, Pseudomonas putida KT2440
cgccacacugucccggca

SEQ ID NO: 3535091 - RNA, 20 nt, Pseudomonas putida KT2440
cgccacaggugacaagcugc

SEQ ID NO: 3535092 - RNA, 17 nt, Pseudomonas putida KT2440
cgccacauagcuggcac

SEQ ID NO: 3535093 - RNA, 13 nt, Pseudomonas putida KT2440
cgccacauccagc

SEQ ID NO: 3535094 - RNA, 17 nt, Pseudomonas putida KT2440
cgccacauccagcgccu

SEQ ID NO: 3535095 - RNA, 16 nt, Pseudomonas putida KT2440
cgccacauccgcgcau

SEQ ID NO: 3535096 - RNA, 12 nt, Pseudomonas putida KT2440
cgccaccaagcc

SEQ ID NO: 3535097 - RNA, 15 nt, Pseudomonas putida KT2440
cgccaccaagcccuu

SEQ ID NO: 3535098 - RNA, 17 nt, Pseudomonas putida KT2440
cgccaccaagcccuucu

SEQ ID NO: 3535099 - RNA, 23 nt, Pseudomonas putida KT2440
cgccaccaagcccuucucgcuca

SEQ ID NO: 3535100 - RNA, 14 nt, Pseudomonas putida KT2440
cgccaccaaucugu

SEQ ID NO: 3535101 - RNA, 21 nt, Pseudomonas putida KT2440
cgccaccacgaugccugggcg

SEQ ID NO: 3535102 - RNA, 14 nt, Pseudomonas putida KT2440
cgccaccagcgccg

SEQ ID NO: 3535103 - RNA, 15 nt, Pseudomonas putida KT2440
cgccaccagcgccgc

SEQ ID NO: 3535104 - RNA, 15 nt, Pseudomonas putida KT2440
cgccaccaucgacuc

SEQ ID NO: 3535105 - RNA, 20 nt, Pseudomonas putida KT2440
cgccaccaugcucaccgcca

SEQ ID NO: 3535106 - RNA, 22 nt, Pseudomonas putida KT2440
cgccaccaugcucaccgccaac

SEQ ID NO: 3535107 - RNA, 15 nt, Pseudomonas putida KT2440
cgccaccaugcucgg

SEQ ID NO: 3535108 - RNA, 21 nt, Pseudomonas putida KT2440
cgccacccagaugcgggcccu

SEQ ID NO: 3535109 - RNA, 18 nt, Pseudomonas putida KT2440
cgccacccccgccgccag

SEQ ID NO: 3535110 - RNA, 21 nt, Pseudomonas putida KT2440
cgccacccgacgccaccuucg

SEQ ID NO: 3535111 - RNA, 16 nt, Pseudomonas putida KT2440
cgccacccucgcacca

SEQ ID NO: 3535112 - RNA, 20 nt, Pseudomonas putida KT2440
cgccaccgacauuguaggcg

SEQ ID NO: 3535113 - RNA, 17 nt, Pseudomonas putida KT2440
cgccaccgacuccggca

SEQ ID NO: 3535114 - RNA, 15 nt, Pseudomonas putida KT2440
cgccaccgccgugcc

SEQ ID NO: 3535115 - RNA, 17 nt, Pseudomonas putida KT2440
cgccaccgcgcgccagu

SEQ ID NO: 3535116 - RNA, 12 nt, Pseudomonas putida KT2440
cgccaccggcau

SEQ ID NO: 3535117 - RNA, 22 nt, Pseudomonas putida KT2440
cgccaccgggcgcgauugccuu

SEQ ID NO: 3535118 - RNA, 11 nt, Pseudomonas putida KT2440
cgccaccuucg

SEQ ID NO: 3535119 - RNA, 20 nt, Pseudomonas putida KT2440
cgccaccuuguucgagcgcc

SEQ ID NO: 3535120 - RNA, 22 nt, Pseudomonas putida KT2440
cgccaccuuguucgagcgccau

SEQ ID NO: 3535121 - RNA, 22 nt, Pseudomonas putida KT2440
cgccacgaucgacaaccccagc

SEQ ID NO: 3535122 - RNA, 17 nt, Pseudomonas putida KT2440
cgccacgcaccagggcu

SEQ ID NO: 3535123 - RNA, 23 nt, Pseudomonas putida KT2440
cgccacgcaccagggcuggcagc

SEQ ID NO: 3535124 - RNA, 14 nt, Pseudomonas putida KT2440
cgccacgccugcag

SEQ ID NO: 3535125 - RNA, 20 nt, Pseudomonas putida KT2440
cgccacggcggcauccaggc

SEQ ID NO: 3535126 - RNA, 13 nt, Pseudomonas putida KT2440
cgccacgggcggu

SEQ ID NO: 3535127 - RNA, 19 nt, Pseudomonas putida KT2440
cgccacggugccgaacagc

SEQ ID NO: 3535128 - RNA, 13 nt, Pseudomonas putida KT2440
cgccacucccaug

SEQ ID NO: 3535129 - RNA, 19 nt, Pseudomonas putida KT2440
cgccacucccauguagacc

SEQ ID NO: 3535130 - RNA, 23 nt, Pseudomonas putida KT2440
cgccacucccauguagaccacca

SEQ ID NO: 3535131 - RNA, 12 nt, Pseudomonas putida KT2440
cgccacuggcga

SEQ ID NO: 3535132 - RNA, 20 nt, Pseudomonas putida KT2440
cgccagaaaauucucccggg

SEQ ID NO: 3535133 - RNA, 16 nt, Pseudomonas putida KT2440
cgccagaaaccaagau

SEQ ID NO: 3535134 - RNA, 16 nt, Pseudomonas putida KT2440
cgccagaaccugacaa

SEQ ID NO: 3535135 - RNA, 13 nt, Pseudomonas putida KT2440
cgccagaccaccu

SEQ ID NO: 3535136 - RNA, 14 nt, Pseudomonas putida KT2440
cgccagaccaccuc

SEQ ID NO: 3535137 - RNA, 20 nt, Pseudomonas putida KT2440
cgccagaccaccucaucccc

SEQ ID NO: 3535138 - RNA, 18 nt, Pseudomonas putida KT2440
cgccagagcauggccagc

SEQ ID NO: 3535139 - RNA, 19 nt, Pseudomonas putida KT2440
cgccagauccgcagggucu

SEQ ID NO: 3535140 - RNA, 11 nt, Pseudomonas putida KT2440
cgccagcaauu

SEQ ID NO: 3535141 - RNA, 18 nt, Pseudomonas putida KT2440
cgccagcaccaucaggca

SEQ ID NO: 3535142 - RNA, 21 nt, Pseudomonas putida KT2440
cgccagcaccaucaggcacag

SEQ ID NO: 3535143 - RNA, 15 nt, Pseudomonas putida KT2440
cgccagcacgcaggc

SEQ ID NO: 3535144 - RNA, 17 nt, Pseudomonas putida KT2440
cgccagcacgcaggcca

SEQ ID NO: 3535145 - RNA, 16 nt, Pseudomonas putida KT2440
cgccagcagccgggcc

SEQ ID NO: 3535146 - RNA, 14 nt, Pseudomonas putida KT2440
cgccagcagcgcau

SEQ ID NO: 3535147 - RNA, 19 nt, Pseudomonas putida KT2440
cgccagcagcgcauggcuc

SEQ ID NO: 3535148 - RNA, 19 nt, Pseudomonas putida KT2440
cgccagcagcgcgugcugg

SEQ ID NO: 3535149 - RNA, 17 nt, Pseudomonas putida KT2440
cgccagcagcgcuccgc

SEQ ID NO: 3535150 - RNA, 22 nt, Pseudomonas putida KT2440
cgccagcagcgcuccgccaaac

SEQ ID NO: 3535151 - RNA, 22 nt, Pseudomonas putida KT2440
cgccagcagcggguuccccagc

SEQ ID NO: 3535152 - RNA, 23 nt, Pseudomonas putida KT2440
cgccagcagcggguuccccagca

SEQ ID NO: 3535153 - RNA, 16 nt, Pseudomonas putida KT2440
cgccagcagcuggucg

SEQ ID NO: 3535154 - RNA, 15 nt, Pseudomonas putida KT2440
cgccagcaggccacc

SEQ ID NO: 3535155 - RNA, 16 nt, Pseudomonas putida KT2440
cgccagcaggccaccg

SEQ ID NO: 3535156 - RNA, 18 nt, Pseudomonas putida KT2440
cgccagcaggccaccggc

SEQ ID NO: 3535157 - RNA, 20 nt, Pseudomonas putida KT2440
cgccagcaggccaccggcag

SEQ ID NO: 3535158 - RNA, 13 nt, Pseudomonas putida KT2440
cgccagcaggccg

SEQ ID NO: 3535159 - RNA, 17 nt, Pseudomonas putida KT2440
cgccagcaggccgccga

SEQ ID NO: 3535160 - RNA, 16 nt, Pseudomonas putida KT2440
cgccagcaguuucagc

SEQ ID NO: 3535161 - RNA, 19 nt, Pseudomonas putida KT2440
cgccagcaguuucagcggc

SEQ ID NO: 3535162 - RNA, 20 nt, Pseudomonas putida KT2440
cgccagcaguuucagcggcc

SEQ ID NO: 3535163 - RNA, 23 nt, Pseudomonas putida KT2440
cgccagcaguuucagcggccgcu

SEQ ID NO: 3535164 - RNA, 16 nt, Pseudomonas putida KT2440
cgccagcaucacgccg

SEQ ID NO: 3535165 - RNA, 20 nt, Pseudomonas putida KT2440
cgccagcaucacgccgcgcu

SEQ ID NO: 3535166 - RNA, 14 nt, Pseudomonas putida KT2440
cgccagcaugcugg

SEQ ID NO: 3535167 - RNA, 16 nt, Pseudomonas putida KT2440
cgccagcauggaccau

SEQ ID NO: 3535168 - RNA, 22 nt, Pseudomonas putida KT2440
cgccagccaaccgcgugcuuca

SEQ ID NO: 3535169 - RNA, 18 nt, Pseudomonas putida KT2440
cgccagccaguacggcag

SEQ ID NO: 3535170 - RNA, 19 nt, Pseudomonas putida KT2440
cgccagccaguacggcagc

SEQ ID NO: 3535171 - RNA, 18 nt, Pseudomonas putida KT2440
cgccagccccagcccggu

SEQ ID NO: 3535172 - RNA, 12 nt, Pseudomonas putida KT2440
cgccagccccgc

SEQ ID NO: 3535173 - RNA, 12 nt, Pseudomonas putida KT2440
cgccagcccgcc

SEQ ID NO: 3535174 - RNA, 23 nt, Pseudomonas putida KT2440
cgccagcccgccaagggucgaca

SEQ ID NO: 3535175 - RNA, 14 nt, Pseudomonas putida KT2440
cgccagcccgccac

SEQ ID NO: 3535176 - RNA, 20 nt, Pseudomonas putida KT2440
cgccagccgcucagccaccu

SEQ ID NO: 3535177 - RNA, 17 nt, Pseudomonas putida KT2440
cgccagccguugcgccg

SEQ ID NO: 3535178 - RNA, 18 nt, Pseudomonas putida KT2440
cgccagccugcagcgcgg

SEQ ID NO: 3535179 - RNA, 13 nt, Pseudomonas putida KT2440
cgccagcgccacc

SEQ ID NO: 3535180 - RNA, 13 nt, Pseudomonas putida KT2440
cgccagcgccugg

SEQ ID NO: 3535181 - RNA, 13 nt, Pseudomonas putida KT2440
cgccagcgcucca

SEQ ID NO: 3535182 - RNA, 18 nt, Pseudomonas putida KT2440
cgccagcgcuccagcaac

SEQ ID NO: 3535183 - RNA, 19 nt, Pseudomonas putida KT2440
cgccagcgcuccagcaacg

SEQ ID NO: 3535184 - RNA, 21 nt, Pseudomonas putida KT2440
cgccagcgcuccagcaacgga

SEQ ID NO: 3535185 - RNA, 21 nt, Pseudomonas putida KT2440
cgccagcggcaaacacacccu

SEQ ID NO: 3535186 - RNA, 13 nt, Pseudomonas putida KT2440
cgccagcggcaag

SEQ ID NO: 3535187 - RNA, 20 nt, Pseudomonas putida KT2440
cgccagcggcaguugcaggc

SEQ ID NO: 3535188 - RNA, 23 nt, Pseudomonas putida KT2440
cgccagcggcguguaguagcucc

SEQ ID NO: 3535189 - RNA, 24 nt, Pseudomonas putida KT2440
cgccagcggcguguaguagcucca

SEQ ID NO: 3535190 - RNA, 13 nt, Pseudomonas putida KT2440
cgccagcggcucg

SEQ ID NO: 3535191 - RNA, 17 nt, Pseudomonas putida KT2440
cgccagcggcucgacca

SEQ ID NO: 3535192 - RNA, 19 nt, Pseudomonas putida KT2440
cgccagcggcucgaccaag

SEQ ID NO: 3535193 - RNA, 21 nt, Pseudomonas putida KT2440
cgccagcgggcuggcauucaa

SEQ ID NO: 3535194 - RNA, 23 nt, Pseudomonas putida KT2440
cgccagcggguggucgcugcggc

SEQ ID NO: 3535195 - RNA, 16 nt, Pseudomonas putida KT2440
cgccagcgguugagau

SEQ ID NO: 3535196 - RNA, 18 nt, Pseudomonas putida KT2440
cgccagcgguugagauga

SEQ ID NO: 3535197 - RNA, 14 nt, Pseudomonas putida KT2440
cgccagcuccacca

SEQ ID NO: 3535198 - RNA, 20 nt, Pseudomonas putida KT2440
cgccagcuccgacaggcugu

SEQ ID NO: 3535199 - RNA, 22 nt, Pseudomonas putida KT2440
cgccaggaucgagaccuugccu

SEQ ID NO: 3535200 - RNA, 21 nt, Pseudomonas putida KT2440
cgccaggaucggcacgaagcc

SEQ ID NO: 3535201 - RNA, 19 nt, Pseudomonas putida KT2440
cgccaggauggcaccgauc

SEQ ID NO: 3535202 - RNA, 15 nt, Pseudomonas putida KT2440
cgccaggcagcagac

SEQ ID NO: 3535203 - RNA, 16 nt, Pseudomonas putida KT2440
cgccaggcagcagacu

SEQ ID NO: 3535204 - RNA, 14 nt, Pseudomonas putida KT2440
cgccaggcauugcu

SEQ ID NO: 3535205 - RNA, 15 nt, Pseudomonas putida KT2440
cgccaggcccaccac

SEQ ID NO: 3535206 - RNA, 18 nt, Pseudomonas putida KT2440
cgccaggcccaccaccgg

SEQ ID NO: 3535207 - RNA, 16 nt, Pseudomonas putida KT2440
cgccaggcccagcccc

SEQ ID NO: 3535208 - RNA, 20 nt, Pseudomonas putida KT2440
cgccaggcccagccccgcau

SEQ ID NO: 3535209 - RNA, 15 nt, Pseudomonas putida KT2440
cgccaggcgcaagcc

SEQ ID NO: 3535210 - RNA, 18 nt, Pseudomonas putida KT2440
cgccaggcgcaagccuuc

SEQ ID NO: 3535211 - RNA, 19 nt, Pseudomonas putida KT2440
cgccaggcgcaccgccggg

SEQ ID NO: 3535212 - RNA, 12 nt, Pseudomonas putida KT2440
cgccaggcgcag

SEQ ID NO: 3535213 - RNA, 11 nt, Pseudomonas putida KT2440
cgccaggcgcg

SEQ ID NO: 3535214 - RNA, 18 nt, Pseudomonas putida KT2440
cgccaggcggucgcccau

SEQ ID NO: 3535215 - RNA, 13 nt, Pseudomonas putida KT2440
cgccaggcguugu

SEQ ID NO: 3535216 - RNA, 22 nt, Pseudomonas putida KT2440
cgccaggcguugugggugaagu

SEQ ID NO: 3535217 - RNA, 17 nt, Pseudomonas putida KT2440
cgccaggcucuccagcc

SEQ ID NO: 3535218 - RNA, 20 nt, Pseudomonas putida KT2440
cgccaggcucuccagccgcu

SEQ ID NO: 3535219 - RNA, 15 nt, Pseudomonas putida KT2440
cgccaggcugcgcuc

SEQ ID NO: 3535220 - RNA, 19 nt, Pseudomonas putida KT2440
cgccagggcaucgaccagu

SEQ ID NO: 3535221 - RNA, 19 nt, Pseudomonas putida KT2440
cgccagggcucaagacagu

SEQ ID NO: 3535222 - RNA, 16 nt, Pseudomonas putida KT2440
cgccaggguguccugu

SEQ ID NO: 3535223 - RNA, 21 nt, Pseudomonas putida KT2440
cgccaggguugcaucgcgcac

SEQ ID NO: 3535224 - RNA, 20 nt, Pseudomonas putida KT2440
cgccaggguuugcaagcggc

SEQ ID NO: 3535225 - RNA, 21 nt, Pseudomonas putida KT2440
cgccaggguuugcaagcggcg

SEQ ID NO: 3535226 - RNA, 22 nt, Pseudomonas putida KT2440
cgccaggguuugcaagcggcga

SEQ ID NO: 3535227 - RNA, 16 nt, Pseudomonas putida KT2440
cgccagguacaguucc

SEQ ID NO: 3535228 - RNA, 19 nt, Pseudomonas putida KT2440
cgccagguauucggcaaug

SEQ ID NO: 3535229 - RNA, 22 nt, Pseudomonas putida KT2440
cgccagguccaggcugcgcgcc

SEQ ID NO: 3535230 - RNA, 16 nt, Pseudomonas putida KT2440
cgccaggucggacagg

SEQ ID NO: 3535231 - RNA, 14 nt, Pseudomonas putida KT2440
cgccaggucggcgg

SEQ ID NO: 3535232 - RNA, 21 nt, Pseudomonas putida KT2440
cgccaggugauuuccucuuca

SEQ ID NO: 3535233 - RNA, 13 nt, Pseudomonas putida KT2440
cgccaggugcuca

SEQ ID NO: 3535234 - RNA, 15 nt, Pseudomonas putida KT2440
cgccaggugcucagc

SEQ ID NO: 3535235 - RNA, 20 nt, Pseudomonas putida KT2440
cgccaggugcucagccacgc

SEQ ID NO: 3535236 - RNA, 24 nt, Pseudomonas putida KT2440
cgccaggugcucagccacgcuggc

SEQ ID NO: 3535237 - RNA, 15 nt, Pseudomonas putida KT2440
cgccagguggaagcg

SEQ ID NO: 3535238 - RNA, 19 nt, Pseudomonas putida KT2440
cgccagguggaagcgcgca

SEQ ID NO: 3535239 - RNA, 21 nt, Pseudomonas putida KT2440
cgccagguggaagcgcgcauc

SEQ ID NO: 3535240 - RNA, 17 nt, Pseudomonas putida KT2440
cgccagguuggcccuga

SEQ ID NO: 3535241 - RNA, 15 nt, Pseudomonas putida KT2440
cgccaguacgccagc

SEQ ID NO: 3535242 - RNA, 18 nt, Pseudomonas putida KT2440
cgccaguacgccagcagc

SEQ ID NO: 3535243 - RNA, 20 nt, Pseudomonas putida KT2440
cgccaguacgccagcagcgc

SEQ ID NO: 3535244 - RNA, 18 nt, Pseudomonas putida KT2440
cgccaguagcaaucaggu

SEQ ID NO: 3535245 - RNA, 21 nt, Pseudomonas putida KT2440
cgccaguagcaaucaggucau

SEQ ID NO: 3535246 - RNA, 18 nt, Pseudomonas putida KT2440
cgccagugcggugaccga

SEQ ID NO: 3535247 - RNA, 21 nt, Pseudomonas putida KT2440
cgccagugggugcuguggcgc

SEQ ID NO: 3535248 - RNA, 23 nt, Pseudomonas putida KT2440
cgccagugggugcuguggcgcac

SEQ ID NO: 3535249 - RNA, 20 nt, Pseudomonas putida KT2440
cgccaguuccacgaccguga

SEQ ID NO: 3535250 - RNA, 15 nt, Pseudomonas putida KT2440
cgccaguucgacgcu

SEQ ID NO: 3535251 - RNA, 17 nt, Pseudomonas putida KT2440
cgccaguucgcggcgca

SEQ ID NO: 3535252 - RNA, 22 nt, Pseudomonas putida KT2440
cgccaguucgcggcgcaccgcu

SEQ ID NO: 3535253 - RNA, 23 nt, Pseudomonas putida KT2440
cgccaguuguaguucccgcgcaa

SEQ ID NO: 3535254 - RNA, 18 nt, Pseudomonas putida KT2440
cgccaguuucaccugacc

SEQ ID NO: 3535255 - RNA, 17 nt, Pseudomonas putida KT2440
cgccaguuugcacuggc

SEQ ID NO: 3535256 - RNA, 22 nt, Pseudomonas putida KT2440
cgccaguuugcacuggcggggc

SEQ ID NO: 3535257 - RNA, 23 nt, Pseudomonas putida KT2440
cgccaguuugucguucuccugcg

SEQ ID NO: 3535258 - RNA, 22 nt, Pseudomonas putida KT2440
cgccauacaagaucaagccccu

SEQ ID NO: 3535259 - RNA, 14 nt, Pseudomonas putida KT2440
cgccauaggccgcc

SEQ ID NO: 3535260 - RNA, 18 nt, Pseudomonas putida KT2440
cgccauaucaggauugcc

SEQ ID NO: 3535261 - RNA, 19 nt, Pseudomonas putida KT2440
cgccaucagaggcgauggc

SEQ ID NO: 3535262 - RNA, 22 nt, Pseudomonas putida KT2440
cgccaucagaggcgauggcauc

SEQ ID NO: 3535263 - RNA, 21 nt, Pseudomonas putida KT2440
cgccaucagugcccccgccac

SEQ ID NO: 3535264 - RNA, 14 nt, Pseudomonas putida KT2440
cgccauccaccugu

SEQ ID NO: 3535265 - RNA, 19 nt, Pseudomonas putida KT2440
cgccauccccccagcccuu

SEQ ID NO: 3535266 - RNA, 14 nt, Pseudomonas putida KT2440
cgccauccgccaca

SEQ ID NO: 3535267 - RNA, 14 nt, Pseudomonas putida KT2440
cgccaucgcccacg

SEQ ID NO: 3535268 - RNA, 19 nt, Pseudomonas putida KT2440
cgccaucgccccgcgccgc

SEQ ID NO: 3535269 - RNA, 18 nt, Pseudomonas putida KT2440
cgccaucgcgcaggucga

SEQ ID NO: 3535270 - RNA, 13 nt, Pseudomonas putida KT2440
cgccaucggccuc

SEQ ID NO: 3535271 - RNA, 15 nt, Pseudomonas putida KT2440
cgccaucggccucuc

SEQ ID NO: 3535272 - RNA, 14 nt, Pseudomonas putida KT2440
cgccaucucgcaaa

SEQ ID NO: 3535273 - RNA, 22 nt, Pseudomonas putida KT2440
cgccaugagugcaggcauauca

SEQ ID NO: 3535274 - RNA, 15 nt, Pseudomonas putida KT2440
cgccaugcagcccgc

SEQ ID NO: 3535275 - RNA, 18 nt, Pseudomonas putida KT2440
cgccaugccccccgccag

SEQ ID NO: 3535276 - RNA, 19 nt, Pseudomonas putida KT2440
cgccauggccuggcggguu

SEQ ID NO: 3535277 - RNA, 22 nt, Pseudomonas putida KT2440
cgccauggucgcguuguucagc

SEQ ID NO: 3535278 - RNA, 17 nt, Pseudomonas putida KT2440
cgccaugguuuugggca

SEQ ID NO: 3535279 - RNA, 19 nt, Pseudomonas putida KT2440
cgccauguaccgggcggcc

SEQ ID NO: 3535280 - RNA, 23 nt, Pseudomonas putida KT2440
cgccauguaccgggcggccaccg

SEQ ID NO: 3535281 - RNA, 17 nt, Pseudomonas putida KT2440
cgccauguugcgcagca

SEQ ID NO: 3535282 - RNA, 20 nt, Pseudomonas putida KT2440
cgccauguugcgcagcaauc

SEQ ID NO: 3535283 - RNA, 21 nt, Pseudomonas putida KT2440
cgccauucuucuccaggugcu

SEQ ID NO: 3535284 - RNA, 16 nt, Pseudomonas putida KT2440
cgccauugcaccacgc

SEQ ID NO: 3535285 - RNA, 16 nt, Pseudomonas putida KT2440
cgccauugcccagccu

SEQ ID NO: 3535286 - RNA, 21 nt, Pseudomonas putida KT2440
cgccauugcccaguucgucca

SEQ ID NO: 3535287 - RNA, 22 nt, Pseudomonas putida KT2440
cgccauuggccgcgcgcccauc

SEQ ID NO: 3535288 - RNA, 16 nt, Pseudomonas putida KT2440
cgccauuguucgccuc

SEQ ID NO: 3535289 - RNA, 21 nt, Pseudomonas putida KT2440
cgcccaaccccagcgcguaca

SEQ ID NO: 3535290 - RNA, 20 nt, Pseudomonas putida KT2440
cgcccaaccccaggcgcaca

SEQ ID NO: 3535291 - RNA, 16 nt, Pseudomonas putida KT2440
cgcccaagccggccgg

SEQ ID NO: 3535292 - RNA, 13 nt, Pseudomonas putida KT2440
cgcccaagcggca

SEQ ID NO: 3535293 - RNA, 17 nt, Pseudomonas putida KT2440
cgcccaaggucagccag

SEQ ID NO: 3535294 - RNA, 19 nt, Pseudomonas putida KT2440
cgcccaaggucagccagac

SEQ ID NO: 3535295 - RNA, 14 nt, Pseudomonas putida KT2440
cgcccaaucgggua

SEQ ID NO: 3535296 - RNA, 20 nt, Pseudomonas putida KT2440
cgcccaaugcagccgcccgc

SEQ ID NO: 3535297 - RNA, 12 nt, Pseudomonas putida KT2440
cgcccaccacca

SEQ ID NO: 3535298 - RNA, 15 nt, Pseudomonas putida KT2440
cgcccacccaccaca

SEQ ID NO: 3535299 - RNA, 21 nt, Pseudomonas putida KT2440
cgcccacgaucucacgcgcca

SEQ ID NO: 3535300 - RNA, 22 nt, Pseudomonas putida KT2440
cgcccacgaucucacgcgccac

SEQ ID NO: 3535301 - RNA, 16 nt, Pseudomonas putida KT2440
cgcccacgccggcaac

SEQ ID NO: 3535302 - RNA, 23 nt, Pseudomonas putida KT2440
cgcccacgccggcaaccccugca

SEQ ID NO: 3535303 - RNA, 19 nt, Pseudomonas putida KT2440
cgcccacgcggguccagcg

SEQ ID NO: 3535304 - RNA, 22 nt, Pseudomonas putida KT2440
cgcccagcaacaugccggccca

SEQ ID NO: 3535305 - RNA, 16 nt, Pseudomonas putida KT2440
cgcccagcaacugcgc

SEQ ID NO: 3535306 - RNA, 20 nt, Pseudomonas putida KT2440
cgcccagcccaugaacagca

SEQ ID NO: 3535307 - RNA, 22 nt, Pseudomonas putida KT2440
cgcccagcccaugaacagcaag

SEQ ID NO: 3535308 - RNA, 16 nt, Pseudomonas putida KT2440
cgcccagcucuggagg

SEQ ID NO: 3535309 - RNA, 12 nt, Pseudomonas putida KT2440
cgcccagcugga

SEQ ID NO: 3535310 - RNA, 12 nt, Pseudomonas putida KT2440
cgcccagcuucu

SEQ ID NO: 3535311 - RNA, 18 nt, Pseudomonas putida KT2440
cgcccagcuucuccagca

SEQ ID NO: 3535312 - RNA, 15 nt, Pseudomonas putida KT2440
cgcccaggccgccga

SEQ ID NO: 3535313 - RNA, 17 nt, Pseudomonas putida KT2440
cgcccaggcgccgcagc

SEQ ID NO: 3535314 - RNA, 12 nt, Pseudomonas putida KT2440
cgcccaggcgcu

SEQ ID NO: 3535315 - RNA, 14 nt, Pseudomonas putida KT2440
cgcccaggcggcgu

SEQ ID NO: 3535316 - RNA, 21 nt, Pseudomonas putida KT2440
cgcccagggguuuccuuuggg

SEQ ID NO: 3535317 - RNA, 18 nt, Pseudomonas putida KT2440
cgcccaggucaugaucuu

SEQ ID NO: 3535318 - RNA, 22 nt, Pseudomonas putida KT2440
cgcccagguuauacgccgccga

SEQ ID NO: 3535319 - RNA, 14 nt, Pseudomonas putida KT2440
cgcccaguagcgcc

SEQ ID NO: 3535320 - RNA, 16 nt, Pseudomonas putida KT2440
cgcccagucaccguuc

SEQ ID NO: 3535321 - RNA, 22 nt, Pseudomonas putida KT2440
cgcccagucaccguucuugauc

SEQ ID NO: 3535322 - RNA, 13 nt, Pseudomonas putida KT2440
cgcccagugccug

SEQ ID NO: 3535323 - RNA, 14 nt, Pseudomonas putida KT2440
cgcccagugccuga

SEQ ID NO: 3535324 - RNA, 19 nt, Pseudomonas putida KT2440
cgcccagugccugaccggu

SEQ ID NO: 3535325 - RNA, 17 nt, Pseudomonas putida KT2440
cgcccagugcgcgcaac

SEQ ID NO: 3535326 - RNA, 14 nt, Pseudomonas putida KT2440
cgcccaguucagcu

SEQ ID NO: 3535327 - RNA, 18 nt, Pseudomonas putida KT2440
cgcccaguucagcucgcu

SEQ ID NO: 3535328 - RNA, 22 nt, Pseudomonas putida KT2440
cgcccauccaacgcauccaggc

SEQ ID NO: 3535329 - RNA, 17 nt, Pseudomonas putida KT2440
cgcccaucgcacacccu

SEQ ID NO: 3535330 - RNA, 14 nt, Pseudomonas putida KT2440
cgcccaugaugugg

SEQ ID NO: 3535331 - RNA, 22 nt, Pseudomonas putida KT2440
cgcccauggcuccacccaacga

SEQ ID NO: 3535332 - RNA, 22 nt, Pseudomonas putida KT2440
cgcccauuuccgggcaaugcag

SEQ ID NO: 3535333 - RNA, 13 nt, Pseudomonas putida KT2440
cgccccaagcggg

SEQ ID NO: 3535334 - RNA, 21 nt, Pseudomonas putida KT2440
cgccccaagcgggccaagguc

SEQ ID NO: 3535335 - RNA, 15 nt, Pseudomonas putida KT2440
cgccccacgcacauc

SEQ ID NO: 3535336 - RNA, 18 nt, Pseudomonas putida KT2440
cgccccacucgcgcagca

SEQ ID NO: 3535337 - RNA, 15 nt, Pseudomonas putida KT2440
cgccccacuuccagc

SEQ ID NO: 3535338 - RNA, 20 nt, Pseudomonas putida KT2440
cgccccagcaguucgcgcac

SEQ ID NO: 3535339 - RNA, 17 nt, Pseudomonas putida KT2440
cgccccagcgcgccagc

SEQ ID NO: 3535340 - RNA, 12 nt, Pseudomonas putida KT2440
cgccccaggccg

SEQ ID NO: 3535341 - RNA, 19 nt, Pseudomonas putida KT2440
cgccccaggccgcggccga

SEQ ID NO: 3535342 - RNA, 14 nt, Pseudomonas putida KT2440
cgccccagguggcu

SEQ ID NO: 3535343 - RNA, 14 nt, Pseudomonas putida KT2440
cgcccccacgggca

SEQ ID NO: 3535344 - RNA, 12 nt, Pseudomonas putida KT2440
cgcccccagccc

SEQ ID NO: 3535345 - RNA, 20 nt, Pseudomonas putida KT2440
cgcccccagccuugaggcug

SEQ ID NO: 3535346 - RNA, 12 nt, Pseudomonas putida KT2440
cgcccccaucgc

SEQ ID NO: 3535347 - RNA, 20 nt, Pseudomonas putida KT2440
cgcccccaugaugaccacca

SEQ ID NO: 3535348 - RNA, 19 nt, Pseudomonas putida KT2440
cgccccccaccuggcccug

SEQ ID NO: 3535349 - RNA, 22 nt, Pseudomonas putida KT2440
cgccccccaccuggcccugcuc

SEQ ID NO: 3535350 - RNA, 17 nt, Pseudomonas putida KT2440
cgccccgcaccagacca

SEQ ID NO: 3535351 - RNA, 17 nt, Pseudomonas putida KT2440
cgccccgccagcgccug

SEQ ID NO: 3535352 - RNA, 14 nt, Pseudomonas putida KT2440
cgccccgccgcauc

SEQ ID NO: 3535353 - RNA, 23 nt, Pseudomonas putida KT2440
cgccccgcgcaagcguucgagca

SEQ ID NO: 3535354 - RNA, 17 nt, Pseudomonas putida KT2440
cgccccgcgccgccauc

SEQ ID NO: 3535355 - RNA, 17 nt, Pseudomonas putida KT2440
cgccccggcaauccugg

SEQ ID NO: 3535356 - RNA, 13 nt, Pseudomonas putida KT2440
cgccccggccagu

SEQ ID NO: 3535357 - RNA, 11 nt, Pseudomonas putida KT2440
cgccccgucca

SEQ ID NO: 3535358 - RNA, 15 nt, Pseudomonas putida KT2440
cgccccgugcccgau

SEQ ID NO: 3535359 - RNA, 22 nt, Pseudomonas putida KT2440
cgccccgugcccgaucaccgcg

SEQ ID NO: 3535360 - RNA, 19 nt, Pseudomonas putida KT2440
cgccccuacgcugguucug

SEQ ID NO: 3535361 - RNA, 19 nt, Pseudomonas putida KT2440
cgccccucgucacugaccc

SEQ ID NO: 3535362 - RNA, 13 nt, Pseudomonas putida KT2440
cgccccugccagc

SEQ ID NO: 3535363 - RNA, 20 nt, Pseudomonas putida KT2440
cgccccugccagcaccagcg

SEQ ID NO: 3535364 - RNA, 18 nt, Pseudomonas putida KT2440
cgccccuuggcacggcca

SEQ ID NO: 3535365 - RNA, 20 nt, Pseudomonas putida KT2440
cgcccgaacaacaggucggc

SEQ ID NO: 3535366 - RNA, 22 nt, Pseudomonas putida KT2440
cgcccgaacaacaggucggcgc

SEQ ID NO: 3535367 - RNA, 17 nt, Pseudomonas putida KT2440
cgcccgaccgccagccc

SEQ ID NO: 3535368 - RNA, 14 nt, Pseudomonas putida KT2440
cgcccgacuggcug

SEQ ID NO: 3535369 - RNA, 14 nt, Pseudomonas putida KT2440
cgcccgaucaccga

SEQ ID NO: 3535370 - RNA, 20 nt, Pseudomonas putida KT2440
cgcccgcaacauaaggugca

SEQ ID NO: 3535371 - RNA, 20 nt, Pseudomonas putida KT2440
cgcccgcaaccucggccgca

SEQ ID NO: 3535372 - RNA, 13 nt, Pseudomonas putida KT2440
cgcccgcacagca

SEQ ID NO: 3535373 - RNA, 15 nt, Pseudomonas putida KT2440
cgcccgcaccgccgc

SEQ ID NO: 3535374 - RNA, 19 nt, Pseudomonas putida KT2440
cgcccgcagugcacgcggg

SEQ ID NO: 3535375 - RNA, 16 nt, Pseudomonas putida KT2440
cgcccgccagguagcg

SEQ ID NO: 3535376 - RNA, 22 nt, Pseudomonas putida KT2440
cgcccgccaugcaacugcauga

SEQ ID NO: 3535377 - RNA, 20 nt, Pseudomonas putida KT2440
cgcccgcccaccaccagccc

SEQ ID NO: 3535378 - RNA, 12 nt, Pseudomonas putida KT2440
cgcccgccgccc

SEQ ID NO: 3535379 - RNA, 14 nt, Pseudomonas putida KT2440
cgcccgccgcccgc

SEQ ID NO: 3535380 - RNA, 17 nt, Pseudomonas putida KT2440
cgcccgccggcacuucc

SEQ ID NO: 3535381 - RNA, 20 nt, Pseudomonas putida KT2440
cgcccgccgucaucgaaccg

SEQ ID NO: 3535382 - RNA, 20 nt, Pseudomonas putida KT2440
cgcccgccguguucccagca

SEQ ID NO: 3535383 - RNA, 13 nt, Pseudomonas putida KT2440
cgcccgccucgcc

SEQ ID NO: 3535384 - RNA, 19 nt, Pseudomonas putida KT2440
cgcccgccucgccauaagc

SEQ ID NO: 3535385 - RNA, 12 nt, Pseudomonas putida KT2440
cgcccgcgcagc

SEQ ID NO: 3535386 - RNA, 14 nt, Pseudomonas putida KT2440
cgcccgcgccgccc

SEQ ID NO: 3535387 - RNA, 12 nt, Pseudomonas putida KT2440
cgcccgcggccc

SEQ ID NO: 3535388 - RNA, 22 nt, Pseudomonas putida KT2440
cgcccgcgugagauguucacca

SEQ ID NO: 3535389 - RNA, 16 nt, Pseudomonas putida KT2440
cgcccgcucacgcagc

SEQ ID NO: 3535390 - RNA, 12 nt, Pseudomonas putida KT2440
cgcccgcuccca

SEQ ID NO: 3535391 - RNA, 20 nt, Pseudomonas putida KT2440
cgcccgcucccacaggaauc

SEQ ID NO: 3535392 - RNA, 20 nt, Pseudomonas putida KT2440
cgcccgcucccacagggacc

SEQ ID NO: 3535393 - RNA, 19 nt, Pseudomonas putida KT2440
cgcccgcucccacagguaa

SEQ ID NO: 3535394 - RNA, 20 nt, Pseudomonas putida KT2440
cgcccgcucccacaggugca

SEQ ID NO: 3535395 - RNA, 18 nt, Pseudomonas putida KT2440
cgcccggauggcggugau

SEQ ID NO: 3535396 - RNA, 22 nt, Pseudomonas putida KT2440
cgcccggauggcggugaugcgc

SEQ ID NO: 3535397 - RNA, 15 nt, Pseudomonas putida KT2440
cgcccggcaaacaca

SEQ ID NO: 3535398 - RNA, 20 nt, Pseudomonas putida KT2440
cgcccggcaaacacauccac

SEQ ID NO: 3535399 - RNA, 17 nt, Pseudomonas putida KT2440
cgcccggcagaucgagc

SEQ ID NO: 3535400 - RNA, 13 nt, Pseudomonas putida KT2440
cgcccggccaggu

SEQ ID NO: 3535401 - RNA, 15 nt, Pseudomonas putida KT2440
cgcccggccagguca

SEQ ID NO: 3535402 - RNA, 15 nt, Pseudomonas putida KT2440
cgcccggcgcagcau

SEQ ID NO: 3535403 - RNA, 21 nt, Pseudomonas putida KT2440
cgcccggcgucgaacaacggc

SEQ ID NO: 3535404 - RNA, 19 nt, Pseudomonas putida KT2440
cgcccgggaagugguuggc

SEQ ID NO: 3535405 - RNA, 17 nt, Pseudomonas putida KT2440
cgcccgggaucuggccg

SEQ ID NO: 3535406 - RNA, 18 nt, Pseudomonas putida KT2440
cgcccgggaucuggccga

SEQ ID NO: 3535407 - RNA, 13 nt, Pseudomonas putida KT2440
cgcccgggcauca

SEQ ID NO: 3535408 - RNA, 18 nt, Pseudomonas putida KT2440
cgcccgggccaggccccu

SEQ ID NO: 3535409 - RNA, 19 nt, Pseudomonas putida KT2440
cgcccgggccaggccccuu

SEQ ID NO: 3535410 - RNA, 20 nt, Pseudomonas putida KT2440
cgcccgggccaugcuuucca

SEQ ID NO: 3535411 - RNA, 18 nt, Pseudomonas putida KT2440
cgcccgguggcgcggccg

SEQ ID NO: 3535412 - RNA, 23 nt, Pseudomonas putida KT2440
cgcccgguggcgcggccgggcuu

SEQ ID NO: 3535413 - RNA, 18 nt, Pseudomonas putida KT2440
cgcccgguuuggccugac

SEQ ID NO: 3535414 - RNA, 21 nt, Pseudomonas putida KT2440
cgcccgguuuggccugacgcu

SEQ ID NO: 3535415 - RNA, 21 nt, Pseudomonas putida KT2440
cgcccguaacggucacugagc

SEQ ID NO: 3535416 - RNA, 20 nt, Pseudomonas putida KT2440
cgcccguaugcauccgccau

SEQ ID NO: 3535417 - RNA, 14 nt, Pseudomonas putida KT2440
cgcccgucuggcug

SEQ ID NO: 3535418 - RNA, 16 nt, Pseudomonas putida KT2440
cgcccgugcucacgca

SEQ ID NO: 3535419 - RNA, 18 nt, Pseudomonas putida KT2440
cgcccuagaacaggcggc

SEQ ID NO: 3535420 - RNA, 14 nt, Pseudomonas putida KT2440
cgcccuccagccgc

SEQ ID NO: 3535421 - RNA, 18 nt, Pseudomonas putida KT2440
cgcccuccagccgcgaac

SEQ ID NO: 3535422 - RNA, 15 nt, Pseudomonas putida KT2440
cgcccucgcggcggc

SEQ ID NO: 3535423 - RNA, 16 nt, Pseudomonas putida KT2440
cgcccucuucgcgggc

SEQ ID NO: 3535424 - RNA, 17 nt, Pseudomonas putida KT2440
cgcccucuucgcgggca

SEQ ID NO: 3535425 - RNA, 13 nt, Pseudomonas putida KT2440
cgcccucuugcug

SEQ ID NO: 3535426 - RNA, 21 nt, Pseudomonas putida KT2440
cgcccugagccaaggccgccc

SEQ ID NO: 3535427 - RNA, 22 nt, Pseudomonas putida KT2440
cgcccugcaaaggcaugggcca

SEQ ID NO: 3535428 - RNA, 17 nt, Pseudomonas putida KT2440
cgcccugcgccaaaacc

SEQ ID NO: 3535429 - RNA, 14 nt, Pseudomonas putida KT2440
cgcccugcgccugc

SEQ ID NO: 3535430 - RNA, 15 nt, Pseudomonas putida KT2440
cgcccugcgccugca

SEQ ID NO: 3535431 - RNA, 22 nt, Pseudomonas putida KT2440
cgcccugcggcuguucgcagca

SEQ ID NO: 3535432 - RNA, 16 nt, Pseudomonas putida KT2440
cgcccugcucauccag

SEQ ID NO: 3535433 - RNA, 16 nt, Pseudomonas putida KT2440
cgcccugcugccgcac

SEQ ID NO: 3535434 - RNA, 16 nt, Pseudomonas putida KT2440
cgcccuggcccgccgc

SEQ ID NO: 3535435 - RNA, 17 nt, Pseudomonas putida KT2440
cgcccugggcgagcagg

SEQ ID NO: 3535436 - RNA, 23 nt, Pseudomonas putida KT2440
cgcccugggcgagcaggugaccc

SEQ ID NO: 3535437 - RNA, 16 nt, Pseudomonas putida KT2440
cgcccugugggagcgg

SEQ ID NO: 3535438 - RNA, 18 nt, Pseudomonas putida KT2440
cgcccugugggagcggcc

SEQ ID NO: 3535439 - RNA, 22 nt, Pseudomonas putida KT2440
cgcccugugggagcggccuugu

SEQ ID NO: 3535440 - RNA, 12 nt, Pseudomonas putida KT2440
cgcccuucagca

SEQ ID NO: 3535441 - RNA, 22 nt, Pseudomonas putida KT2440
cgcccuucauacagcgccucca

SEQ ID NO: 3535442 - RNA, 13 nt, Pseudomonas putida KT2440
cgcccuucgcgga

SEQ ID NO: 3535443 - RNA, 21 nt, Pseudomonas putida KT2440
cgcccuugagcuucagcgcgc

SEQ ID NO: 3535444 - RNA, 11 nt, Pseudomonas putida KT2440
cgcccuugccc

SEQ ID NO: 3535445 - RNA, 18 nt, Pseudomonas putida KT2440
cgcccuugcggaccaccu

SEQ ID NO: 3535446 - RNA, 21 nt, Pseudomonas putida KT2440
cgcccuugcggaccaccuggg

SEQ ID NO: 3535447 - RNA, 19 nt, Pseudomonas putida KT2440
cgcccuuggugcaccagcu

SEQ ID NO: 3535448 - RNA, 19 nt, Pseudomonas putida KT2440
cgcccuugucagccgccgc

SEQ ID NO: 3535449 - RNA, 14 nt, Pseudomonas putida KT2440
cgcccuuucacggc

SEQ ID NO: 3535450 - RNA, 15 nt, Pseudomonas putida KT2440
cgcccuuuuucacca

SEQ ID NO: 3535451 - RNA, 15 nt, Pseudomonas putida KT2440
cgccgaaacguaguc

SEQ ID NO: 3535452 - RNA, 11 nt, Pseudomonas putida KT2440
cgccgaacagg

SEQ ID NO: 3535453 - RNA, 14 nt, Pseudomonas putida KT2440
cgccgaaccccacc

SEQ ID NO: 3535454 - RNA, 22 nt, Pseudomonas putida KT2440
cgccgaacgggccaccaaaggc

SEQ ID NO: 3535455 - RNA, 17 nt, Pseudomonas putida KT2440
cgccgaagcgcgccugg

SEQ ID NO: 3535456 - RNA, 18 nt, Pseudomonas putida KT2440
cgccgaccaagcgcccca

SEQ ID NO: 3535457 - RNA, 15 nt, Pseudomonas putida KT2440
cgccgaccagguggu

SEQ ID NO: 3535458 - RNA, 19 nt, Pseudomonas putida KT2440
cgccgaccaguaccacagc

SEQ ID NO: 3535459 - RNA, 19 nt, Pseudomonas putida KT2440
cgccgaccgaaccggcgcu

SEQ ID NO: 3535460 - RNA, 14 nt, Pseudomonas putida KT2440
cgccgaccgcgcgc

SEQ ID NO: 3535461 - RNA, 16 nt, Pseudomonas putida KT2440
cgccgaccgcgcgcac

SEQ ID NO: 3535462 - RNA, 19 nt, Pseudomonas putida KT2440
cgccgaccgcgcgcacggu

SEQ ID NO: 3535463 - RNA, 21 nt, Pseudomonas putida KT2440
cgccgacgauaccgcccaggu

SEQ ID NO: 3535464 - RNA, 14 nt, Pseudomonas putida KT2440
cgccgagaggcgcu

SEQ ID NO: 3535465 - RNA, 19 nt, Pseudomonas putida KT2440
cgccgagaggcgcugcggg

SEQ ID NO: 3535466 - RNA, 16 nt, Pseudomonas putida KT2440
cgccgagcauccgcgc

SEQ ID NO: 3535467 - RNA, 19 nt, Pseudomonas putida KT2440
cgccgagcauuacaggcag

SEQ ID NO: 3535468 - RNA, 22 nt, Pseudomonas putida KT2440
cgccgagcgcggcgcccagcaa

SEQ ID NO: 3535469 - RNA, 16 nt, Pseudomonas putida KT2440
cgccgagcugaugccg

SEQ ID NO: 3535470 - RNA, 19 nt, Pseudomonas putida KT2440
cgccgaggaauugcgccag

SEQ ID NO: 3535471 - RNA, 14 nt, Pseudomonas putida KT2440
cgccgaggcguugg

SEQ ID NO: 3535472 - RNA, 19 nt, Pseudomonas putida KT2440
cgccgaggcguuggccgaa

SEQ ID NO: 3535473 - RNA, 17 nt, Pseudomonas putida KT2440
cgccgagugcgcggaac

SEQ ID NO: 3535474 - RNA, 14 nt, Pseudomonas putida KT2440
cgccgauacccgca

SEQ ID NO: 3535475 - RNA, 20 nt, Pseudomonas putida KT2440
cgccgauaccgaacaccagu

SEQ ID NO: 3535476 - RNA, 13 nt, Pseudomonas putida KT2440
cgccgauagcagc

SEQ ID NO: 3535477 - RNA, 18 nt, Pseudomonas putida KT2440
cgccgauagcagcaccga

SEQ ID NO: 3535478 - RNA, 22 nt, Pseudomonas putida KT2440
cgccgauagcagcaccgaucag

SEQ ID NO: 3535479 - RNA, 12 nt, Pseudomonas putida KT2440
cgccgaucagcu

SEQ ID NO: 3535480 - RNA, 18 nt, Pseudomonas putida KT2440
cgccgaugaagcaggccg

SEQ ID NO: 3535481 - RNA, 20 nt, Pseudomonas putida KT2440
cgccgaugaagcaggccgag

SEQ ID NO: 3535482 - RNA, 21 nt, Pseudomonas putida KT2440
cgccgaugaguugucugccga

SEQ ID NO: 3535483 - RNA, 23 nt, Pseudomonas putida KT2440
cgccgauguagucguccugcccc

SEQ ID NO: 3535484 - RNA, 21 nt, Pseudomonas putida KT2440
cgccgauguuggucaccacgu

SEQ ID NO: 3535485 - RNA, 20 nt, Pseudomonas putida KT2440
cgccgcaaacgcugagcgau

SEQ ID NO: 3535486 - RNA, 19 nt, Pseudomonas putida KT2440
cgccgcaaccgccgcgccu

SEQ ID NO: 3535487 - RNA, 15 nt, Pseudomonas putida KT2440
cgccgcaacggccga

SEQ ID NO: 3535488 - RNA, 16 nt, Pseudomonas putida KT2440
cgccgcaacggccgaa

SEQ ID NO: 3535489 - RNA, 21 nt, Pseudomonas putida KT2440
cgccgcagcaaucugcugguu

SEQ ID NO: 3535490 - RNA, 20 nt, Pseudomonas putida KT2440
cgccgcagcaguuggccgac

SEQ ID NO: 3535491 - RNA, 21 nt, Pseudomonas putida KT2440
uagcucgcuuuccaaaccugc

SEQ ID NO: 3535492 - RNA, 11 nt, Pseudomonas putida KT2440
uagcugaccuu

SEQ ID NO: 3535493 - RNA, 14 nt, Pseudomonas putida KT2440
uagcugggcccgcc

SEQ ID NO: 3535494 - RNA, 19 nt, Pseudomonas putida KT2440
uagcuguugcgcugggcgu

SEQ ID NO: 3535495 - RNA, 14 nt, Pseudomonas putida KT2440
uagcuuggucucgu

SEQ ID NO: 3535496 - RNA, 20 nt, Pseudomonas putida KT2440
uagcuuucaggcgcagcaca

SEQ ID NO: 3535497 - RNA, 14 nt, Pseudomonas putida KT2440
uagcuuuccagcau

SEQ ID NO: 3535498 - RNA, 16 nt, Pseudomonas putida KT2440
uaggaauuucggcguu

SEQ ID NO: 3535499 - RNA, 15 nt, Pseudomonas putida KT2440
uaggacugcuucagg

SEQ ID NO: 3535500 - RNA, 17 nt, Pseudomonas putida KT2440
uaggacugcuucaggcc

SEQ ID NO: 3535501 - RNA, 21 nt, Pseudomonas putida KT2440
uaggagcgagcuugcucgcga

SEQ ID NO: 3535502 - RNA, 20 nt, Pseudomonas putida KT2440
uaggagcgggcuuacccgcg

SEQ ID NO: 3535503 - RNA, 22 nt, Pseudomonas putida KT2440
uaggagcgggcuuacccgcgaa

SEQ ID NO: 3535504 - RNA, 17 nt, Pseudomonas putida KT2440
uaggagcgggcuugccc

SEQ ID NO: 3535505 - RNA, 21 nt, Pseudomonas putida KT2440
uaggagcgggucuacccgcga

SEQ ID NO: 3535506 - RNA, 22 nt, Pseudomonas putida KT2440
uaggagcgggucuacccgcgaa

SEQ ID NO: 3535507 - RNA, 19 nt, Pseudomonas putida KT2440
uaggagcggguucacccgc

SEQ ID NO: 3535508 - RNA, 20 nt, Pseudomonas putida KT2440
uaggagcggguucacccgcg

SEQ ID NO: 3535509 - RNA, 21 nt, Pseudomonas putida KT2440
uaggagcggguucacccgcga

SEQ ID NO: 3535510 - RNA, 16 nt, Pseudomonas putida KT2440
uaggagcggguuuacc

SEQ ID NO: 3535511 - RNA, 20 nt, Pseudomonas putida KT2440
uaggagcggguuuacccgcg

SEQ ID NO: 3535512 - RNA, 21 nt, Pseudomonas putida KT2440
uaggagcggguuuacccgcga

SEQ ID NO: 3535513 - RNA, 20 nt, Pseudomonas putida KT2440
uaggaucggguuuacccgcg

SEQ ID NO: 3535514 - RNA, 21 nt, Pseudomonas putida KT2440
uaggaucggguuuacccgcga

SEQ ID NO: 3535515 - RNA, 20 nt, Pseudomonas putida KT2440
uaggcacggucgguagccug

SEQ ID NO: 3535516 - RNA, 16 nt, Pseudomonas putida KT2440
uaggcagccaccucga

SEQ ID NO: 3535517 - RNA, 20 nt, Pseudomonas putida KT2440
uaggccaccguugcgcucga

SEQ ID NO: 3535518 - RNA, 22 nt, Pseudomonas putida KT2440
uaggccgcagccaugccgccga

SEQ ID NO: 3535519 - RNA, 19 nt, Pseudomonas putida KT2440
uaggccggucccaauaaua

SEQ ID NO: 3535520 - RNA, 18 nt, Pseudomonas putida KT2440
uaggccgucagcagcagg

SEQ ID NO: 3535521 - RNA, 24 nt, Pseudomonas putida KT2440
uaggccgucagcagcaggcgcgag

SEQ ID NO: 3535522 - RNA, 22 nt, Pseudomonas putida KT2440
uaggccuuggcuucacuguuca

SEQ ID NO: 3535523 - RNA, 21 nt, Pseudomonas putida KT2440
uaggcgcggguuuacccgcga

SEQ ID NO: 3535524 - RNA, 19 nt, Pseudomonas putida KT2440
uaggcgggagagcagggcu

SEQ ID NO: 3535525 - RNA, 18 nt, Pseudomonas putida KT2440
uaggcgucuuccacgccc

SEQ ID NO: 3535526 - RNA, 22 nt, Pseudomonas putida KT2440
uaggcgucuuccacgcccaggc

SEQ ID NO: 3535527 - RNA, 18 nt, Pseudomonas putida KT2440
uaggcuccaucuccagcu

SEQ ID NO: 3535528 - RNA, 12 nt, Pseudomonas putida KT2440
uaggcugcagcc

SEQ ID NO: 3535529 - RNA, 17 nt, Pseudomonas putida KT2440
uagggaacagggcagac

SEQ ID NO: 3535530 - RNA, 12 nt, Pseudomonas putida KT2440
uagggaagcgga

SEQ ID NO: 3535531 - RNA, 23 nt, Pseudomonas putida KT2440
uagggaucaccgccagcagcugg

SEQ ID NO: 3535532 - RNA, 16 nt, Pseudomonas putida KT2440
uagggggccgcuuugc

SEQ ID NO: 3535533 - RNA, 13 nt, Pseudomonas putida KT2440
uaggguucgaugg

SEQ ID NO: 3535534 - RNA, 10 nt, Pseudomonas putida KT2440
uaggucaggu

SEQ ID NO: 3535535 - RNA, 14 nt, Pseudomonas putida KT2440
uaggucuaaccgcg

SEQ ID NO: 3535536 - RNA, 23 nt, Pseudomonas putida KT2440
uaggugguguugggcgggccgcc

SEQ ID NO: 3535537 - RNA, 17 nt, Pseudomonas putida KT2440
uaguaagccagcccugc

SEQ ID NO: 3535538 - RNA, 19 nt, Pseudomonas putida KT2440
uaguaauggccgaugaacu

SEQ ID NO: 3535539 - RNA, 16 nt, Pseudomonas putida KT2440
uaguacuccagcagcg

SEQ ID NO: 3535540 - RNA, 12 nt, Pseudomonas putida KT2440
uaguagcuccag

SEQ ID NO: 3535541 - RNA, 15 nt, Pseudomonas putida KT2440
uaguagcuccagccc

SEQ ID NO: 3535542 - RNA, 11 nt, Pseudomonas putida KT2440
uagucaagcug

SEQ ID NO: 3535543 - RNA, 14 nt, Pseudomonas putida KT2440
uagucaucuguaag

SEQ ID NO: 3535544 - RNA, 15 nt, Pseudomonas putida KT2440
uaguccagcaacucc

SEQ ID NO: 3535545 - RNA, 16 nt, Pseudomonas putida KT2440
uaguccugcagcggca

SEQ ID NO: 3535546 - RNA, 23 nt, Pseudomonas putida KT2440
uaguggcguuuuucacacgccac

SEQ ID NO: 3535547 - RNA, 15 nt, Pseudomonas putida KT2440
uaguucacuggccag

SEQ ID NO: 3535548 - RNA, 16 nt, Pseudomonas putida KT2440
uaguucaucuucuugc

SEQ ID NO: 3535549 - RNA, 14 nt, Pseudomonas putida KT2440
uaguucgugcaccc

SEQ ID NO: 3535550 - RNA, 15 nt, Pseudomonas putida KT2440
uaguugaccagcacc

SEQ ID NO: 3535551 - RNA, 17 nt, Pseudomonas putida KT2440
uaguugaccagcaccag

SEQ ID NO: 3535552 - RNA, 23 nt, Pseudomonas putida KT2440
uaguugaccagcaccagcgacug

SEQ ID NO: 3535553 - RNA, 19 nt, Pseudomonas putida KT2440
uauaagccccaugcgacca

SEQ ID NO: 3535554 - RNA, 17 nt, Pseudomonas putida KT2440
uauaagcuaccggcuag

SEQ ID NO: 3535555 - RNA, 18 nt, Pseudomonas putida KT2440
uauacagcaggcucaggg

SEQ ID NO: 3535556 - RNA, 23 nt, Pseudomonas putida KT2440
uauacgccgcguugucaggcacu

SEQ ID NO: 3535557 - RNA, 14 nt, Pseudomonas putida KT2440
uauagcccugcccu

SEQ ID NO: 3535558 - RNA, 20 nt, Pseudomonas putida KT2440
uauagugguaugauuucagg

SEQ ID NO: 3535559 - RNA, 21 nt, Pseudomonas putida KT2440
uauauuuuccugaguuagaca

SEQ ID NO: 3535560 - RNA, 18 nt, Pseudomonas putida KT2440
uaucacgcuccugcaugc

SEQ ID NO: 3535561 - RNA, 21 nt, Pseudomonas putida KT2440
uaucacgcuccugcaugccuu

SEQ ID NO: 3535562 - RNA, 15 nt, Pseudomonas putida KT2440
uaucagcgccagcac

SEQ ID NO: 3535563 - RNA, 20 nt, Pseudomonas putida KT2440
uaucaggcaugccagcagcu

SEQ ID NO: 3535564 - RNA, 21 nt, Pseudomonas putida KT2440
uaucaggcaugccagcagcug

SEQ ID NO: 3535565 - RNA, 15 nt, Pseudomonas putida KT2440
uauccacacccucgu

SEQ ID NO: 3535566 - RNA, 15 nt, Pseudomonas putida KT2440
uauccagcaccggcg

SEQ ID NO: 3535567 - RNA, 16 nt, Pseudomonas putida KT2440
uauccagcaccggcgu

SEQ ID NO: 3535568 - RNA, 20 nt, Pseudomonas putida KT2440
uauccagugcuucacugccg

SEQ ID NO: 3535569 - RNA, 12 nt, Pseudomonas putida KT2440
uauccgcuggcu

SEQ ID NO: 3535570 - RNA, 18 nt, Pseudomonas putida KT2440
uauccgcuuugcuugagu

SEQ ID NO: 3535571 - RNA, 22 nt, Pseudomonas putida KT2440
uauccuccagcccugcucgcca

SEQ ID NO: 3535572 - RNA, 20 nt, Pseudomonas putida KT2440
uauccuucugccguuugcug

SEQ ID NO: 3535573 - RNA, 19 nt, Pseudomonas putida KT2440
uaucgaauagcccaccuuc

SEQ ID NO: 3535574 - RNA, 16 nt, Pseudomonas putida KT2440
uaucgacuucggccau

SEQ ID NO: 3535575 - RNA, 21 nt, Pseudomonas putida KT2440
uaucgagcacuuccuugacca

SEQ ID NO: 3535576 - RNA, 18 nt, Pseudomonas putida KT2440
uaucgagcuacagccccu

SEQ ID NO: 3535577 - RNA, 19 nt, Pseudomonas putida KT2440
uaucgcaaauaguuuuaug

SEQ ID NO: 3535578 - RNA, 16 nt, Pseudomonas putida KT2440
uaucgccagaaaccaa

SEQ ID NO: 3535579 - RNA, 15 nt, Pseudomonas putida KT2440
uaucggcaggcugga

SEQ ID NO: 3535580 - RNA, 13 nt, Pseudomonas putida KT2440
uaucggccagcaa

SEQ ID NO: 3535581 - RNA, 20 nt, Pseudomonas putida KT2440
uaucgguguucccgcucguu

SEQ ID NO: 3535582 - RNA, 17 nt, Pseudomonas putida KT2440
uaucucaggccaguucc

SEQ ID NO: 3535583 - RNA, 21 nt, Pseudomonas putida KT2440
uaucucugguacaacaacaaa

SEQ ID NO: 3535584 - RNA, 23 nt, Pseudomonas putida KT2440
uaucugccgaugcgcgugcauuu

SEQ ID NO: 3535585 - RNA, 15 nt, Pseudomonas putida KT2440
uaugauagucaucug

SEQ ID NO: 3535586 - RNA, 14 nt, Pseudomonas putida KT2440
uaugauucgccucc

SEQ ID NO: 3535587 - RNA, 18 nt, Pseudomonas putida KT2440
uaugauucgccucccgcu

SEQ ID NO: 3535588 - RNA, 16 nt, Pseudomonas putida KT2440
uaugcagggccuuuuc

SEQ ID NO: 3535589 - RNA, 14 nt, Pseudomonas putida KT2440
uaugcagguaccag

SEQ ID NO: 3535590 - RNA, 18 nt, Pseudomonas putida KT2440
uaugccacgacaccggga

SEQ ID NO: 3535591 - RNA, 21 nt, Pseudomonas putida KT2440
uaugccgccguucaggcgccu

SEQ ID NO: 3535592 - RNA, 17 nt, Pseudomonas putida KT2440
uaugccggucagcagca

SEQ ID NO: 3535593 - RNA, 14 nt, Pseudomonas putida KT2440
uaugcucuuuccaa

SEQ ID NO: 3535594 - RNA, 14 nt, Pseudomonas putida KT2440
uauggaaauggaau

SEQ ID NO: 3535595 - RNA, 16 nt, Pseudomonas putida KT2440
uauggccgagcaggag

SEQ ID NO: 3535596 - RNA, 19 nt, Pseudomonas putida KT2440
ucgacauacagguucgggu

SEQ ID NO: 3535597 - RNA, 20 nt, Pseudomonas putida KT2440
ucgacaugcaguugagcccu

SEQ ID NO: 3535598 - RNA, 13 nt, Pseudomonas putida KT2440
ucgaccaaaaauc

SEQ ID NO: 3535599 - RNA, 17 nt, Pseudomonas putida KT2440
ucgaccaccaucgccag

SEQ ID NO: 3535600 - RNA, 16 nt, Pseudomonas putida KT2440
ucgaccacgcacagcu

SEQ ID NO: 3535601 - RNA, 22 nt, Pseudomonas putida KT2440
ucgaccacgcacagcugugugu

SEQ ID NO: 3535602 - RNA, 13 nt, Pseudomonas putida KT2440
ucgaccagcagcu

SEQ ID NO: 3535603 - RNA, 15 nt, Pseudomonas putida KT2440
ucgaccagcaguguc

SEQ ID NO: 3535604 - RNA, 18 nt, Pseudomonas putida KT2440
ucgacccagccacccggc

SEQ ID NO: 3535605 - RNA, 14 nt, Pseudomonas putida KT2440
ucgacccccuugcc

SEQ ID NO: 3535606 - RNA, 15 nt, Pseudomonas putida KT2440
ucgacccccuugcca

SEQ ID NO: 3535607 - RNA, 22 nt, Pseudomonas putida KT2440
ucgacccgccgguugcgcagcc

SEQ ID NO: 3535608 - RNA, 13 nt, Pseudomonas putida KT2440
ucgacccuggcau

SEQ ID NO: 3535609 - RNA, 22 nt, Pseudomonas putida KT2440
ucgacccuggcauagcaguccu

SEQ ID NO: 3535610 - RNA, 19 nt, Pseudomonas putida KT2440
ucgaccgcgaccaugguga

SEQ ID NO: 3535611 - RNA, 18 nt, Pseudomonas putida KT2440
ucgaccggcaggcgcuuc

SEQ ID NO: 3535612 - RNA, 18 nt, Pseudomonas putida KT2440
ucgaccgucgcuggacgc

SEQ ID NO: 3535613 - RNA, 22 nt, Pseudomonas putida KT2440
ucgaccucgauuuccaccggcu

SEQ ID NO: 3535614 - RNA, 19 nt, Pseudomonas putida KT2440
ucgaccugccacugcgcua

SEQ ID NO: 3535615 - RNA, 20 nt, Pseudomonas putida KT2440
ucgaccugcccggcguucag

SEQ ID NO: 3535616 - RNA, 14 nt, Pseudomonas putida KT2440
ucgaccugcguggu

SEQ ID NO: 3535617 - RNA, 19 nt, Pseudomonas putida KT2440
ucgaccuggcccgcuugcc

SEQ ID NO: 3535618 - RNA, 18 nt, Pseudomonas putida KT2440
ucgaccuggcucuucaac

SEQ ID NO: 3535619 - RNA, 20 nt, Pseudomonas putida KT2440
ucgacgaacacgguaccgaa

SEQ ID NO: 3535620 - RNA, 13 nt, Pseudomonas putida KT2440
ucgacgacacggc

SEQ ID NO: 3535621 - RNA, 16 nt, Pseudomonas putida KT2440
ucgacgacacggcugc

SEQ ID NO: 3535622 - RNA, 16 nt, Pseudomonas putida KT2440
ucgacgauacccagcg

SEQ ID NO: 3535623 - RNA, 19 nt, Pseudomonas putida KT2440
ucgacgauacccagcgcgc

SEQ ID NO: 3535624 - RNA, 15 nt, Pseudomonas putida KT2440
ucgacgaucgacuuc

SEQ ID NO: 3535625 - RNA, 14 nt, Pseudomonas putida KT2440
ucgacgaucgccgc

SEQ ID NO: 3535626 - RNA, 19 nt, Pseudomonas putida KT2440
ucgacgccgugguagcacc

SEQ ID NO: 3535627 - RNA, 15 nt, Pseudomonas putida KT2440
ucgacgccuuggcgc

SEQ ID NO: 3535628 - RNA, 15 nt, Pseudomonas putida KT2440
ucgacgcggacccgg

SEQ ID NO: 3535629 - RNA, 14 nt, Pseudomonas putida KT2440
ucgacgcggaccuu

SEQ ID NO: 3535630 - RNA, 15 nt, Pseudomonas putida KT2440
ucgacgcuuccuugu

SEQ ID NO: 3535631 - RNA, 18 nt, Pseudomonas putida KT2440
ucgacgggcauggcaacc

SEQ ID NO: 3535632 - RNA, 16 nt, Pseudomonas putida KT2440
ucgacguacagcagcu

SEQ ID NO: 3535633 - RNA, 23 nt, Pseudomonas putida KT2440
ucgacguacagcagcucacugaa

SEQ ID NO: 3535634 - RNA, 20 nt, Pseudomonas putida KT2440
ucgacugcacugccagcgcc

SEQ ID NO: 3535635 - RNA, 17 nt, Pseudomonas putida KT2440
ucgacuucauggucgac

SEQ ID NO: 3535636 - RNA, 14 nt, Pseudomonas putida KT2440
ucgacuugcguccg

SEQ ID NO: 3535637 - RNA, 14 nt, Pseudomonas putida KT2440
ucgagaccuugccu

SEQ ID NO: 3535638 - RNA, 20 nt, Pseudomonas putida KT2440
ucgagauguaguccaccccc

SEQ ID NO: 3535639 - RNA, 15 nt, Pseudomonas putida KT2440
ucgagauguggcccg

SEQ ID NO: 3535640 - RNA, 15 nt, Pseudomonas putida KT2440
ucgagcaccacggcg

SEQ ID NO: 3535641 - RNA, 13 nt, Pseudomonas putida KT2440
ucgagcaccggcu

SEQ ID NO: 3535642 - RNA, 17 nt, Pseudomonas putida KT2440
ucgagcaucugcugcgg

SEQ ID NO: 3535643 - RNA, 20 nt, Pseudomonas putida KT2440
ucgagcaucugcugcggcag

SEQ ID NO: 3535644 - RNA, 18 nt, Pseudomonas putida KT2440
ucgagcaugaucaccgcc

SEQ ID NO: 3535645 - RNA, 22 nt, Pseudomonas putida KT2440
ucgagcaugaucaccgccagcg

SEQ ID NO: 3535646 - RNA, 14 nt, Pseudomonas putida KT2440
ucgagccaccggca

SEQ ID NO: 3535647 - RNA, 14 nt, Pseudomonas putida KT2440
ucgagccgaacagc

SEQ ID NO: 3535648 - RNA, 16 nt, Pseudomonas putida KT2440
ucgagccgaacagcag

SEQ ID NO: 3535649 - RNA, 15 nt, Pseudomonas putida KT2440
ucgagccgaucagga

SEQ ID NO: 3535650 - RNA, 23 nt, Pseudomonas putida KT2440
ucgagccgaucaggaagccccgc

SEQ ID NO: 3535651 - RNA, 15 nt, Pseudomonas putida KT2440
ucgagccggucacga

SEQ ID NO: 3535652 - RNA, 20 nt, Pseudomonas putida KT2440
ucgagcgccaugagugcagg

SEQ ID NO: 3535653 - RNA, 13 nt, Pseudomonas putida KT2440
ucgagcgccgccc

SEQ ID NO: 3535654 - RNA, 22 nt, Pseudomonas putida KT2440
ucgagcgccugauuacccugcg

SEQ ID NO: 3535655 - RNA, 22 nt, Pseudomonas putida KT2440
ucgaggaaaagcagcuccagcg

SEQ ID NO: 3535656 - RNA, 16 nt, Pseudomonas putida KT2440
ucgaggaucagcgcag

SEQ ID NO: 3535657 - RNA, 17 nt, Pseudomonas putida KT2440
ucgaggaucagcgcaga

SEQ ID NO: 3535658 - RNA, 14 nt, Pseudomonas putida KT2440
ucgaggaugcggcu

SEQ ID NO: 3535659 - RNA, 14 nt, Pseudomonas putida KT2440
ucgaggcgcgcgcc

SEQ ID NO: 3535660 - RNA, 16 nt, Pseudomonas putida KT2440
ucgagggcuucuucuu

SEQ ID NO: 3535661 - RNA, 17 nt, Pseudomonas putida KT2440
ucgagguugcgcuccau

SEQ ID NO: 3535662 - RNA, 16 nt, Pseudomonas putida KT2440
ucgaguaucgccucga

SEQ ID NO: 3535663 - RNA, 18 nt, Pseudomonas putida KT2440
ucgauacaccacuggugc

SEQ ID NO: 3535664 - RNA, 22 nt, Pseudomonas putida KT2440
ucgauacggucuuuuccccuua

SEQ ID NO: 3535665 - RNA, 20 nt, Pseudomonas putida KT2440
ucgauacucacccgcuugcc

SEQ ID NO: 3535666 - RNA, 19 nt, Pseudomonas putida KT2440
ucgauagcagcgcuaugcc

SEQ ID NO: 3535667 - RNA, 14 nt, Pseudomonas putida KT2440
ucgauagccagccc

SEQ ID NO: 3535668 - RNA, 13 nt, Pseudomonas putida KT2440
ucgauagccugca

SEQ ID NO: 3535669 - RNA, 18 nt, Pseudomonas putida KT2440
ucgaucacgaaucggguc

SEQ ID NO: 3535670 - RNA, 18 nt, Pseudomonas putida KT2440
ucgaucagcgccugcuca

SEQ ID NO: 3535671 - RNA, 22 nt, Pseudomonas putida KT2440
ucgaucagcgccugcucaucca

SEQ ID NO: 3535672 - RNA, 21 nt, Pseudomonas putida KT2440
ucgaucaggucgacacccagc

SEQ ID NO: 3535673 - RNA, 16 nt, Pseudomonas putida KT2440
ucgauccacucgucga

SEQ ID NO: 3535674 - RNA, 16 nt, Pseudomonas putida KT2440
ucgaucccgaggucag

SEQ ID NO: 3535675 - RNA, 14 nt, Pseudomonas putida KT2440
ucgaucccggacag

SEQ ID NO: 3535676 - RNA, 19 nt, Pseudomonas putida KT2440
ucgaucccggacagcagca

SEQ ID NO: 3535677 - RNA, 19 nt, Pseudomonas putida KT2440
ucgaucccuggggccaagu

SEQ ID NO: 3535678 - RNA, 21 nt, Pseudomonas putida KT2440
ucgauccgggugcuggcucgc

SEQ ID NO: 3535679 - RNA, 16 nt, Pseudomonas putida KT2440
ucgaucgagccacuga

SEQ ID NO: 3535680 - RNA, 22 nt, Pseudomonas putida KT2440
ucgaucgcaacgugcgccgaga

SEQ ID NO: 3535681 - RNA, 19 nt, Pseudomonas putida KT2440
ucgaucgccauguguacgc

SEQ ID NO: 3535682 - RNA, 11 nt, Pseudomonas putida KT2440
ucgaucggcac

SEQ ID NO: 3535683 - RNA, 19 nt, Pseudomonas putida KT2440
ucgaucuaugcccggcuca

SEQ ID NO: 3535684 - RNA, 13 nt, Pseudomonas putida KT2440
ucgaucucacagg

SEQ ID NO: 3535685 - RNA, 19 nt, Pseudomonas putida KT2440
ucgaucuccaggugcacca

SEQ ID NO: 3535686 - RNA, 17 nt, Pseudomonas putida KT2440
ucgaucucggccagcag

SEQ ID NO: 3535687 - RNA, 21 nt, Pseudomonas putida KT2440
ucgaucucggccagcaggcca

SEQ ID NO: 3535688 - RNA, 14 nt, Pseudomonas putida KT2440
ucgaucugccugcc

SEQ ID NO: 3535689 - RNA, 21 nt, Pseudomonas putida KT2440
ucgaucugcucgcccaccgac

SEQ ID NO: 3535690 - RNA, 22 nt, Pseudomonas putida KT2440
ucgaucuggaucacugccagca

SEQ ID NO: 3535691 - RNA, 16 nt, Pseudomonas putida KT2440
ucgaucuggaugaagu

SEQ ID NO: 3535692 - RNA, 16 nt, Pseudomonas putida KT2440
ucgaucuugccuucgg

SEQ ID NO: 3535693 - RNA, 18 nt, Pseudomonas putida KT2440
ucgaugaacucacccgcc

SEQ ID NO: 3535694 - RNA, 15 nt, Pseudomonas putida KT2440
ucgaugaaggcugcu

SEQ ID NO: 3535695 - RNA, 14 nt, Pseudomonas putida KT2440
ucgaugauggcugc

SEQ ID NO: 3535696 - RNA, 16 nt, Pseudomonas putida KT2440
ucgaugcacagcucgc

SEQ ID NO: 3535697 - RNA, 17 nt, Pseudomonas putida KT2440
ucgaugccuacugcugg

SEQ ID NO: 3535698 - RNA, 12 nt, Pseudomonas putida KT2440
ucgauggccagg

SEQ ID NO: 3535699 - RNA, 17 nt, Pseudomonas putida KT2440
ucgauggccaggaacag

SEQ ID NO: 3535700 - RNA, 19 nt, Pseudomonas putida KT2440
ucgauguaggcagcugccu

SEQ ID NO: 3535701 - RNA, 20 nt, Pseudomonas putida KT2440
ucgauguaggcagcugccuu

SEQ ID NO: 3535702 - RNA, 12 nt, Pseudomonas putida KT2440
ucgccggccauu

SEQ ID NO: 3535703 - RNA, 15 nt, Pseudomonas putida KT2440
ucgccggccuuggcg

SEQ ID NO: 3535704 - RNA, 16 nt, Pseudomonas putida KT2440
ucgccggguccaccag

SEQ ID NO: 3535705 - RNA, 19 nt, Pseudomonas putida KT2440
ucgccggguccaccagccc

SEQ ID NO: 3535706 - RNA, 20 nt, Pseudomonas putida KT2440
ucgccggugugcauccagcc

SEQ ID NO: 3535707 - RNA, 13 nt, Pseudomonas putida KT2440
ucgccgguguucg

SEQ ID NO: 3535708 - RNA, 15 nt, Pseudomonas putida KT2440
ucgccguacuggcug

SEQ ID NO: 3535709 - RNA, 14 nt, Pseudomonas putida KT2440
ucgccguagcuguu

SEQ ID NO: 3535710 - RNA, 13 nt, Pseudomonas putida KT2440
ucgccgucagccu

SEQ ID NO: 3535711 - RNA, 15 nt, Pseudomonas putida KT2440
ucgccgucagccuuu

SEQ ID NO: 3535712 - RNA, 13 nt, Pseudomonas putida KT2440
ucgccgugcagca

SEQ ID NO: 3535713 - RNA, 16 nt, Pseudomonas putida KT2440
ucgccgugcagcaccg

SEQ ID NO: 3535714 - RNA, 18 nt, Pseudomonas putida KT2440
ucgccgugcagcaccgcu

SEQ ID NO: 3535715 - RNA, 17 nt, Pseudomonas putida KT2440
ucgccucagcgccaaua

SEQ ID NO: 3535716 - RNA, 14 nt, Pseudomonas putida KT2440
ucgccucccccucc

SEQ ID NO: 3535717 - RNA, 12 nt, Pseudomonas putida KT2440
ucgccucgacgc

SEQ ID NO: 3535718 - RNA, 14 nt, Pseudomonas putida KT2440
ucgccucgaucaca

SEQ ID NO: 3535719 - RNA, 16 nt, Pseudomonas putida KT2440
ucgccucgugcagcug

SEQ ID NO: 3535720 - RNA, 21 nt, Pseudomonas putida KT2440
ucgccugaacgcugcgcgggu

SEQ ID NO: 3535721 - RNA, 15 nt, Pseudomonas putida KT2440
ucgccugcuuggccg

SEQ ID NO: 3535722 - RNA, 13 nt, Pseudomonas putida KT2440
ucgccuucacugc

SEQ ID NO: 3535723 - RNA, 13 nt, Pseudomonas putida KT2440
ucgccuucagcgc

SEQ ID NO: 3535724 - RNA, 14 nt, Pseudomonas putida KT2440
ucgccuucagcgcc

SEQ ID NO: 3535725 - RNA, 18 nt, Pseudomonas putida KT2440
ucgccuugcgucggccga

SEQ ID NO: 3535726 - RNA, 19 nt, Pseudomonas putida KT2440
ucgccuugggagauagccu

SEQ ID NO: 3535727 - RNA, 15 nt, Pseudomonas putida KT2440
ucgcgaaacgcggca

SEQ ID NO: 3535728 - RNA, 22 nt, Pseudomonas putida KT2440
ucgcgaaacgcggcaaccugca

SEQ ID NO: 3535729 - RNA, 13 nt, Pseudomonas putida KT2440
ucgcgaaagggcc

SEQ ID NO: 3535730 - RNA, 18 nt, Pseudomonas putida KT2440
ucgcgaaagggccgcgac

SEQ ID NO: 3535731 - RNA, 17 nt, Pseudomonas putida KT2440
ucgcgacacaaggccgc

SEQ ID NO: 3535732 - RNA, 17 nt, Pseudomonas putida KT2440
ucgcgacgcaaggccgc

SEQ ID NO: 3535733 - RNA, 21 nt, Pseudomonas putida KT2440
ucgcgagcaagcucgcuccua

SEQ ID NO: 3535734 - RNA, 14 nt, Pseudomonas putida KT2440
ucgcgagccagauc

SEQ ID NO: 3535735 - RNA, 17 nt, Pseudomonas putida KT2440
ucgcgaggaaacccgcg

SEQ ID NO: 3535736 - RNA, 18 nt, Pseudomonas putida KT2440
ucgcgaggaaacccgcgc

SEQ ID NO: 3535737 - RNA, 16 nt, Pseudomonas putida KT2440
ucgcgagucaggcugc

SEQ ID NO: 3535738 - RNA, 13 nt, Pseudomonas putida KT2440
ucgcgaugggcug

SEQ ID NO: 3535739 - RNA, 15 nt, Pseudomonas putida KT2440
ucgcgauugaucagc

SEQ ID NO: 3535740 - RNA, 16 nt, Pseudomonas putida KT2440
ucgcgauugaucagcg

SEQ ID NO: 3535741 - RNA, 19 nt, Pseudomonas putida KT2440
ucgcgcaacaccgccagcg

SEQ ID NO: 3535742 - RNA, 14 nt, Pseudomonas putida KT2440
ucgcgcaacugccc

SEQ ID NO: 3535743 - RNA, 15 nt, Pseudomonas putida KT2440
ucgcgcaacugccca

SEQ ID NO: 3535744 - RNA, 20 nt, Pseudomonas putida KT2440
ucgcgcaacugcccaggauc

SEQ ID NO: 3535745 - RNA, 12 nt, Pseudomonas putida KT2440
ucgcgcaagccu

SEQ ID NO: 3535746 - RNA, 20 nt, Pseudomonas putida KT2440
ucgcgcaagccuuugcgccu

SEQ ID NO: 3535747 - RNA, 17 nt, Pseudomonas putida KT2440
ucgcgcagauggcagac

SEQ ID NO: 3535748 - RNA, 22 nt, Pseudomonas putida KT2440
ucgcgcagauggcagacaaguc

SEQ ID NO: 3535749 - RNA, 18 nt, Pseudomonas putida KT2440
ucgcgcagcagcucccga

SEQ ID NO: 3535750 - RNA, 22 nt, Pseudomonas putida KT2440
ucgcgcaggaaccgcgucacau

SEQ ID NO: 3535751 - RNA, 21 nt, Pseudomonas putida KT2440
ucgcgcaggcggucgauacug

SEQ ID NO: 3535752 - RNA, 14 nt, Pseudomonas putida KT2440
ucgcgcagggccuu

SEQ ID NO: 3535753 - RNA, 19 nt, Pseudomonas putida KT2440
ucgcgcagggugccggcca

SEQ ID NO: 3535754 - RNA, 18 nt, Pseudomonas putida KT2440
ucgcgcaggucgacaugc

SEQ ID NO: 3535755 - RNA, 14 nt, Pseudomonas putida KT2440
ucgcgcauccagcc

SEQ ID NO: 3535756 - RNA, 12 nt, Pseudomonas putida KT2440
ucgcgcauggcc

SEQ ID NO: 3535757 - RNA, 14 nt, Pseudomonas putida KT2440
ucgcgcauggccgc

SEQ ID NO: 3535758 - RNA, 16 nt, Pseudomonas putida KT2440
ucgcgcauggccgcuu

SEQ ID NO: 3535759 - RNA, 17 nt, Pseudomonas putida KT2440
ucgcgcauuucguccag

SEQ ID NO: 3535760 - RNA, 20 nt, Pseudomonas putida KT2440
ucgcgcauuuucaccgagcu

SEQ ID NO: 3535761 - RNA, 17 nt, Pseudomonas putida KT2440
ucgcgccaguucgacgc

SEQ ID NO: 3535762 - RNA, 21 nt, Pseudomonas putida KT2440
ucgcgccaguucgacgcugcu

SEQ ID NO: 3535763 - RNA, 20 nt, Pseudomonas putida KT2440
ucgcgcccgcagugcacgcg

SEQ ID NO: 3535764 - RNA, 20 nt, Pseudomonas putida KT2440
ucgcgcccgguggcgcggcc

SEQ ID NO: 3535765 - RNA, 19 nt, Pseudomonas putida KT2440
ucgcgccuucgcuggcgac

SEQ ID NO: 3535766 - RNA, 15 nt, Pseudomonas putida KT2440
ucgcgcucugcgccu

SEQ ID NO: 3535767 - RNA, 21 nt, Pseudomonas putida KT2440
ucgcgcucuucaucgcgguac

SEQ ID NO: 3535768 - RNA, 20 nt, Pseudomonas putida KT2440
ucgcgcugccaggccggguc

SEQ ID NO: 3535769 - RNA, 21 nt, Pseudomonas putida KT2440
ucgcgcugccaggccgggucc

SEQ ID NO: 3535770 - RNA, 16 nt, Pseudomonas putida KT2440
ucgcgcuggcacugcg

SEQ ID NO: 3535771 - RNA, 19 nt, Pseudomonas putida KT2440
ucgcgcuugcgguccugca

SEQ ID NO: 3535772 - RNA, 21 nt, Pseudomonas putida KT2440
ucgcgcuugcgguccugcacc

SEQ ID NO: 3535773 - RNA, 22 nt, Pseudomonas putida KT2440
ucgcgcuugcgguccugcacca

SEQ ID NO: 3535774 - RNA, 18 nt, Pseudomonas putida KT2440
ucgcgcuuggcaccggca

SEQ ID NO: 3535775 - RNA, 21 nt, Pseudomonas putida KT2440
ucgcgcuuggcaccggcagca

SEQ ID NO: 3535776 - RNA, 15 nt, Pseudomonas putida KT2440
ucgcggaacucggcg

SEQ ID NO: 3535777 - RNA, 18 nt, Pseudomonas putida KT2440
ucgcggaagauacccgcc

SEQ ID NO: 3535778 - RNA, 20 nt, Pseudomonas putida KT2440
ucgcggcaagcccgcuccua

SEQ ID NO: 3535779 - RNA, 15 nt, Pseudomonas putida KT2440
ucgcggcccagccca

SEQ ID NO: 3535780 - RNA, 18 nt, Pseudomonas putida KT2440
ucgcggccuacccgggcg

SEQ ID NO: 3535781 - RNA, 21 nt, Pseudomonas putida KT2440
ucgcggcgcaccgcuugcgca

SEQ ID NO: 3535782 - RNA, 22 nt, Pseudomonas putida KT2440
ucgcggcggcuaagcgccagca

SEQ ID NO: 3535783 - RNA, 20 nt, Pseudomonas putida KT2440
ucgcggcuacgcucguccag

SEQ ID NO: 3535784 - RNA, 20 nt, Pseudomonas putida KT2440
ucgcgggagacccguuccua

SEQ ID NO: 3535785 - RNA, 18 nt, Pseudomonas putida KT2440
ucgcgggcaagcccgcga

SEQ ID NO: 3535786 - RNA, 21 nt, Pseudomonas putida KT2440
ucgcgggcaagcccgcuccua

SEQ ID NO: 3535787 - RNA, 13 nt, Pseudomonas putida KT2440
ucgcgggcacgcc

SEQ ID NO: 3535788 - RNA, 16 nt, Pseudomonas putida KT2440
ucgcgggcacgcccgc

SEQ ID NO: 3535789 - RNA, 13 nt, Pseudomonas putida KT2440
ucgcgggcgugcc

SEQ ID NO: 3535790 - RNA, 13 nt, Pseudomonas putida KT2440
ucgcgggcucgcc

SEQ ID NO: 3535791 - RNA, 15 nt, Pseudomonas putida KT2440
ucgcgggcucgccca

SEQ ID NO: 3535792 - RNA, 23 nt, Pseudomonas putida KT2440
ucgcggguaaacccauuccuaca

SEQ ID NO: 3535793 - RNA, 17 nt, Pseudomonas putida KT2440
ucgcggguaaacccgcc

SEQ ID NO: 3535794 - RNA, 21 nt, Pseudomonas putida KT2440
ucgcggguaaacccgccccua

SEQ ID NO: 3535795 - RNA, 21 nt, Pseudomonas putida KT2440
ucgcggguaaacccgcuccca

SEQ ID NO: 3535796 - RNA, 21 nt, Pseudomonas putida KT2440
ucgcggguaaacccgcuccua

SEQ ID NO: 3535797 - RNA, 21 nt, Pseudomonas putida KT2440
ucgcggguaaacccgggucag

SEQ ID NO: 3535798 - RNA, 16 nt, Pseudomonas putida KT2440
ucgcgggugaacccgc

SEQ ID NO: 3535799 - RNA, 21 nt, Pseudomonas putida KT2440
ucgcgggugaacccgcuccug

SEQ ID NO: 3535800 - RNA, 20 nt, Pseudomonas putida KT2440
ucgcgggugaaccgcgccua

SEQ ID NO: 3535801 - RNA, 15 nt, Pseudomonas putida KT2440
ucgcgguccuugccg

SEQ ID NO: 3535802 - RNA, 14 nt, Pseudomonas putida KT2440
ucgcggugcagcgg

SEQ ID NO: 3535803 - RNA, 23 nt, Pseudomonas putida KT2440
ucgcgguucaucggcaaacacau

SEQ ID NO: 3535804 - RNA, 11 nt, Pseudomonas putida KT2440
ucgcgucgccc

SEQ ID NO: 3535805 - RNA, 21 nt, Pseudomonas putida KT2440
ucgcgugaggcauggaagggc

SEQ ID NO: 3535806 - RNA, 18 nt, Pseudomonas putida KT2440
ucgcguuguucagcagcg

SEQ ID NO: 3535807 - RNA, 12 nt, Pseudomonas putida KT2440
ucggccagggcc

SEQ ID NO: 3535808 - RNA, 17 nt, Pseudomonas putida KT2440
ucggccagguacucgcg

SEQ ID NO: 3535809 - RNA, 16 nt, Pseudomonas putida KT2440
ucggccaucuuuggca

SEQ ID NO: 3535810 - RNA, 16 nt, Pseudomonas putida KT2440
ucggccaugccacccc

SEQ ID NO: 3535811 - RNA, 22 nt, Pseudomonas putida KT2440
ucggccaugucguaccacacau

SEQ ID NO: 3535812 - RNA, 16 nt, Pseudomonas putida KT2440
ucggccauuugcucga

SEQ ID NO: 3535813 - RNA, 18 nt, Pseudomonas putida KT2440
ucggcccacugcacggca

SEQ ID NO: 3535814 - RNA, 16 nt, Pseudomonas putida KT2440
ucggccccucgaccac

SEQ ID NO: 3535815 - RNA, 14 nt, Pseudomonas putida KT2440
ucggccgcauccau

SEQ ID NO: 3535816 - RNA, 16 nt, Pseudomonas putida KT2440
ucggccgcauccugcg

SEQ ID NO: 3535817 - RNA, 24 nt, Pseudomonas putida KT2440
ucggccgcccucgcgcguugcagc

SEQ ID NO: 3535818 - RNA, 13 nt, Pseudomonas putida KT2440
ucggccgcuucuu

SEQ ID NO: 3535819 - RNA, 18 nt, Pseudomonas putida KT2440
ucggccucuucgcgggua

SEQ ID NO: 3535820 - RNA, 13 nt, Pseudomonas putida KT2440
ucggccugcccgg

SEQ ID NO: 3535821 - RNA, 19 nt, Pseudomonas putida KT2440
ucggccugcccgguacgca

SEQ ID NO: 3535822 - RNA, 21 nt, Pseudomonas putida KT2440
ucggccugcgcuccagcagcu

SEQ ID NO: 3535823 - RNA, 22 nt, Pseudomonas putida KT2440
ucggccuggggcaggcccggca

SEQ ID NO: 3535824 - RNA, 12 nt, Pseudomonas putida KT2440
ucggccuugcgc

SEQ ID NO: 3535825 - RNA, 13 nt, Pseudomonas putida KT2440
ucggccuuguccg

SEQ ID NO: 3535826 - RNA, 20 nt, Pseudomonas putida KT2440
ucggcgagccgccagacuuc

SEQ ID NO: 3535827 - RNA, 14 nt, Pseudomonas putida KT2440
ucggcgagccuuuc

SEQ ID NO: 3535828 - RNA, 22 nt, Pseudomonas putida KT2440
ucggcgauagguuugcguugcc

SEQ ID NO: 3535829 - RNA, 12 nt, Pseudomonas putida KT2440
ucggcgaucagc

SEQ ID NO: 3535830 - RNA, 21 nt, Pseudomonas putida KT2440
ucggcgaucagcuucaacugc

SEQ ID NO: 3535831 - RNA, 15 nt, Pseudomonas putida KT2440
ucggcgaugccgcgc

SEQ ID NO: 3535832 - RNA, 18 nt, Pseudomonas putida KT2440
ucggcgaugccgcgcgcc

SEQ ID NO: 3535833 - RNA, 13 nt, Pseudomonas putida KT2440
ucggcgaugguca

SEQ ID NO: 3535834 - RNA, 24 nt, Pseudomonas putida KT2440
ucggcgccaggaucgagaccuugc

SEQ ID NO: 3535835 - RNA, 14 nt, Pseudomonas putida KT2440
ucggcgccaggccu

SEQ ID NO: 3535836 - RNA, 13 nt, Pseudomonas putida KT2440
ucggcgccggccg

SEQ ID NO: 3535837 - RNA, 20 nt, Pseudomonas putida KT2440
ucggcgccugugaucgagcg

SEQ ID NO: 3535838 - RNA, 13 nt, Pseudomonas putida KT2440
ucggcgccuucgc

SEQ ID NO: 3535839 - RNA, 19 nt, Pseudomonas putida KT2440
ucggcgccuucgcccgacc

SEQ ID NO: 3535840 - RNA, 20 nt, Pseudomonas putida KT2440
ucggcgcgaaggucacgccc

SEQ ID NO: 3535841 - RNA, 21 nt, Pseudomonas putida KT2440
ucggcgcgcggcucggccacc

SEQ ID NO: 3535842 - RNA, 22 nt, Pseudomonas putida KT2440
ucggcgcgcggcucggccacca

SEQ ID NO: 3535843 - RNA, 16 nt, Pseudomonas putida KT2440
ucggcggccucggucc

SEQ ID NO: 3535844 - RNA, 12 nt, Pseudomonas putida KT2440
ucggcggcuucc

SEQ ID NO: 3535845 - RNA, 20 nt, Pseudomonas putida KT2440
ucggcggugccugcagcccg

SEQ ID NO: 3535846 - RNA, 23 nt, Pseudomonas putida KT2440
ucggcgguugcaccguggcagca

SEQ ID NO: 3535847 - RNA, 15 nt, Pseudomonas putida KT2440
ucggcguagcgcuug

SEQ ID NO: 3535848 - RNA, 20 nt, Pseudomonas putida KT2440
ucggcgucaacgguaacguu

SEQ ID NO: 3535849 - RNA, 14 nt, Pseudomonas putida KT2440
ucggcgucagccgc

SEQ ID NO: 3535850 - RNA, 14 nt, Pseudomonas putida KT2440
ucggcgugcggcug

SEQ ID NO: 3535851 - RNA, 20 nt, Pseudomonas putida KT2440
ucggcguggaacaacggcuc

SEQ ID NO: 3535852 - RNA, 18 nt, Pseudomonas putida KT2440
ucggcguugcggugcaga

SEQ ID NO: 3535853 - RNA, 12 nt, Pseudomonas putida KT2440
ucggcuacgccg

SEQ ID NO: 3535854 - RNA, 21 nt, Pseudomonas putida KT2440
ucggcuacgccgccgcuggcg

SEQ ID NO: 3535855 - RNA, 20 nt, Pseudomonas putida KT2440
ucggcucacgccccgugaag

SEQ ID NO: 3535856 - RNA, 21 nt, Pseudomonas putida KT2440
ucggcugaucucuucagccac

SEQ ID NO: 3535857 - RNA, 13 nt, Pseudomonas putida KT2440
ucggcuggccauu

SEQ ID NO: 3535858 - RNA, 24 nt, Pseudomonas putida KT2440
ucggcuggcugucgaaggcuugca

SEQ ID NO: 3535859 - RNA, 19 nt, Pseudomonas putida KT2440
ucggcuugaaaucauccau

SEQ ID NO: 3535860 - RNA, 14 nt, Pseudomonas putida KT2440
ucgggaacagcucu

SEQ ID NO: 3535861 - RNA, 13 nt, Pseudomonas putida KT2440
ucgggaucagcac

SEQ ID NO: 3535862 - RNA, 17 nt, Pseudomonas putida KT2440
ucgggaucagcacgccc

SEQ ID NO: 3535863 - RNA, 17 nt, Pseudomonas putida KT2440
ucgggauggcaccggca

SEQ ID NO: 3535864 - RNA, 21 nt, Pseudomonas putida KT2440
ucgggcaaggccagugccgca

SEQ ID NO: 3535865 - RNA, 18 nt, Pseudomonas putida KT2440
ucgggcacaggcccagca

SEQ ID NO: 3535866 - RNA, 20 nt, Pseudomonas putida KT2440
ucgggcacgaucagcagcaa

SEQ ID NO: 3535867 - RNA, 22 nt, Pseudomonas putida KT2440
ucgggcacuuguugguguggca

SEQ ID NO: 3535868 - RNA, 21 nt, Pseudomonas putida KT2440
ucgggccagucccuccugugc

SEQ ID NO: 3535869 - RNA, 14 nt, Pseudomonas putida KT2440
ucgggccgauggcg

SEQ ID NO: 3535870 - RNA, 22 nt, Pseudomonas putida KT2440
ucgggcgguugggcaagugcgu

SEQ ID NO: 3535871 - RNA, 20 nt, Pseudomonas putida KT2440
ucgggcuuccagucggccug

SEQ ID NO: 3535872 - RNA, 21 nt, Pseudomonas putida KT2440
ucgggcuuggcacgcuggcug

SEQ ID NO: 3535873 - RNA, 20 nt, Pseudomonas putida KT2440
ucgggcuuggcuucggcggc

SEQ ID NO: 3535874 - RNA, 12 nt, Pseudomonas putida KT2440
ucggggcugcuu

SEQ ID NO: 3535875 - RNA, 16 nt, Pseudomonas putida KT2440
ucggggcugcuuugca

SEQ ID NO: 3535876 - RNA, 16 nt, Pseudomonas putida KT2440
ucggggguucgaaucc

SEQ ID NO: 3535877 - RNA, 22 nt, Pseudomonas putida KT2440
ucggggucgcgaguucgagucu

SEQ ID NO: 3535878 - RNA, 18 nt, Pseudomonas putida KT2440
ucggguacuccaccacca

SEQ ID NO: 3535879 - RNA, 21 nt, Pseudomonas putida KT2440
ucggguaggucaccaucagcc

SEQ ID NO: 3535880 - RNA, 19 nt, Pseudomonas putida KT2440
ucggguaguccuccaacaa

SEQ ID NO: 3535881 - RNA, 19 nt, Pseudomonas putida KT2440
ucgggucaacucaggcuga

SEQ ID NO: 3535882 - RNA, 16 nt, Pseudomonas putida KT2440
ucgggucacgcuccuu

SEQ ID NO: 3535883 - RNA, 14 nt, Pseudomonas putida KT2440
ucgggucauccccg

SEQ ID NO: 3535884 - RNA, 20 nt, Pseudomonas putida KT2440
ucgggucgcugccgugcagg

SEQ ID NO: 3535885 - RNA, 16 nt, Pseudomonas putida KT2440
ucgggucuucggcguu

SEQ ID NO: 3535886 - RNA, 15 nt, Pseudomonas putida KT2440
ucggguuuacccgcg

SEQ ID NO: 3535887 - RNA, 13 nt, Pseudomonas putida KT2440
ucgguaaacaucg

SEQ ID NO: 3535888 - RNA, 12 nt, Pseudomonas putida KT2440
ucgguacccgcc

SEQ ID NO: 3535889 - RNA, 16 nt, Pseudomonas putida KT2440
ucgguacccgccagca

SEQ ID NO: 3535890 - RNA, 14 nt, Pseudomonas putida KT2440
ucgguagggaucac

SEQ ID NO: 3535891 - RNA, 14 nt, Pseudomonas putida KT2440
ucgguauccggcuc

SEQ ID NO: 3535892 - RNA, 14 nt, Pseudomonas putida KT2440
ucggucggccccuc

SEQ ID NO: 3535893 - RNA, 22 nt, Pseudomonas putida KT2440
ucggugacgaucaccagggcau

SEQ ID NO: 3535894 - RNA, 19 nt, Pseudomonas putida KT2440
ucggugauauagcaccggu

SEQ ID NO: 3535895 - RNA, 23 nt, Pseudomonas putida KT2440
ucggugcacggccguuggccagc

SEQ ID NO: 3535896 - RNA, 13 nt, Pseudomonas putida KT2440
ucggugcgcugcu

SEQ ID NO: 3535897 - RNA, 16 nt, Pseudomonas putida KT2440
ucggugcucaggcuca

SEQ ID NO: 3535898 - RNA, 15 nt, Pseudomonas putida KT2440
ucggugcugcugcca

SEQ ID NO: 3535899 - RNA, 14 nt, Pseudomonas putida KT2440
ucggugcuggcgcu

SEQ ID NO: 3535900 - RNA, 22 nt, Pseudomonas putida KT2440
ucggugcuuucugcugugucgg

SEQ ID NO: 3535901 - RNA, 18 nt, Pseudomonas putida KT2440
ucgguggcguugucagca

SEQ ID NO: 3535902 - RNA, 16 nt, Pseudomonas putida KT2440
ucgguggucaccagca

SEQ ID NO: 3535903 - RNA, 14 nt, Pseudomonas putida KT2440
ucgguggucagcuc

SEQ ID NO: 3535904 - RNA, 16 nt, Pseudomonas putida KT2440
ucgguggucagcucgu

SEQ ID NO: 3535905 - RNA, 22 nt, Pseudomonas putida KT2440
ucgguguaggguucgauccacu

SEQ ID NO: 3535906 - RNA, 19 nt, Pseudomonas putida KT2440
ucguacaucugcgccagau

SEQ ID NO: 3535907 - RNA, 19 nt, Pseudomonas putida KT2440
ucguaccgcauuguccucg

SEQ ID NO: 3535908 - RNA, 20 nt, Pseudomonas putida KT2440
ucguacgcgggcagacuucg

SEQ ID NO: 3535909 - RNA, 23 nt, Pseudomonas putida KT2440
ucguaggagcggguuuacccgcg

SEQ ID NO: 3535910 - RNA, 23 nt, Pseudomonas putida KT2440
ucguauuacccuucaucgccggg

SEQ ID NO: 3535911 - RNA, 13 nt, Pseudomonas putida KT2440
ucgucaagcucuu

SEQ ID NO: 3535912 - RNA, 14 nt, Pseudomonas putida KT2440
ucucgcacuugauc

SEQ ID NO: 3535913 - RNA, 21 nt, Pseudomonas putida KT2440
ucucgcacuugaucuugcgcc

SEQ ID NO: 3535914 - RNA, 24 nt, Pseudomonas putida KT2440
ucucgcacuugaucuugcgcccca

SEQ ID NO: 3535915 - RNA, 13 nt, Pseudomonas putida KT2440
ucucgcagcagca

SEQ ID NO: 3535916 - RNA, 15 nt, Pseudomonas putida KT2440
ucucgcagcagcacc

SEQ ID NO: 3535917 - RNA, 17 nt, Pseudomonas putida KT2440
ucucgcagcagcaccgg

SEQ ID NO: 3535918 - RNA, 18 nt, Pseudomonas putida KT2440
ucucgccaaucaaccgcu

SEQ ID NO: 3535919 - RNA, 13 nt, Pseudomonas putida KT2440
ucucgccagccug

SEQ ID NO: 3535920 - RNA, 15 nt, Pseudomonas putida KT2440
ucucgcccuugucca

SEQ ID NO: 3535921 - RNA, 17 nt, Pseudomonas putida KT2440
ucucgccucagcgccaa

SEQ ID NO: 3535922 - RNA, 13 nt, Pseudomonas putida KT2440
ucucgcgcaggcg

SEQ ID NO: 3535923 - RNA, 15 nt, Pseudomonas putida KT2440
ucucgcggugccuuc

SEQ ID NO: 3535924 - RNA, 19 nt, Pseudomonas putida KT2440
ucucgcggugccuucaggc

SEQ ID NO: 3535925 - RNA, 20 nt, Pseudomonas putida KT2440
ucucgcucagguaggcagca

SEQ ID NO: 3535926 - RNA, 18 nt, Pseudomonas putida KT2440
ucucggccagugcgugca

SEQ ID NO: 3535927 - RNA, 12 nt, Pseudomonas putida KT2440
ucucggccggag

SEQ ID NO: 3535928 - RNA, 15 nt, Pseudomonas putida KT2440
ucucgguauccggcu

SEQ ID NO: 3535929 - RNA, 15 nt, Pseudomonas putida KT2440
ucucgucacuggcug

SEQ ID NO: 3535930 - RNA, 16 nt, Pseudomonas putida KT2440
ucucgucacuggcugc

SEQ ID NO: 3535931 - RNA, 15 nt, Pseudomonas putida KT2440
ucucgucgaggcugu

SEQ ID NO: 3535932 - RNA, 13 nt, Pseudomonas putida KT2440
ucucgucguagcc

SEQ ID NO: 3535933 - RNA, 15 nt, Pseudomonas putida KT2440
ucucguucaugcccu

SEQ ID NO: 3535934 - RNA, 13 nt, Pseudomonas putida KT2440
ucucguugcgcca

SEQ ID NO: 3535935 - RNA, 15 nt, Pseudomonas putida KT2440
ucucuacgcccaugg

SEQ ID NO: 3535936 - RNA, 20 nt, Pseudomonas putida KT2440
ucucugaccggcacugcaca

SEQ ID NO: 3535937 - RNA, 13 nt, Pseudomonas putida KT2440
ucucuuccggcag

SEQ ID NO: 3535938 - RNA, 21 nt, Pseudomonas putida KT2440
ucucuucgguagacuucugcg

SEQ ID NO: 3535939 - RNA, 12 nt, Pseudomonas putida KT2440
ucucuuucaggc

SEQ ID NO: 3535940 - RNA, 17 nt, Pseudomonas putida KT2440
ucucuuugaucagcggu

SEQ ID NO: 3535941 - RNA, 19 nt, Pseudomonas putida KT2440
ucugaaaccagugaacccc

SEQ ID NO: 3535942 - RNA, 23 nt, Pseudomonas putida KT2440
ucugaaaccguuggucagcgacu

SEQ ID NO: 3535943 - RNA, 23 nt, Pseudomonas putida KT2440
ucugaaaggcguaggcacacccg

SEQ ID NO: 3535944 - RNA, 23 nt, Pseudomonas putida KT2440
ucugacaacuaucgagcauggcg

SEQ ID NO: 3535945 - RNA, 12 nt, Pseudomonas putida KT2440
ucugacagcagg

SEQ ID NO: 3535946 - RNA, 19 nt, Pseudomonas putida KT2440
ucugacagcaggaacagcg

SEQ ID NO: 3535947 - RNA, 21 nt, Pseudomonas putida KT2440
ucugaccggcacugcacagcu

SEQ ID NO: 3535948 - RNA, 22 nt, Pseudomonas putida KT2440
ucugaugcuucugcuucagcuc

SEQ ID NO: 3535949 - RNA, 20 nt, Pseudomonas putida KT2440
ucugauguaucgaacagccc

SEQ ID NO: 3535950 - RNA, 22 nt, Pseudomonas putida KT2440
ucugcaacuccucgaucaccug

SEQ ID NO: 3535951 - RNA, 14 nt, Pseudomonas putida KT2440
ucugcaacugccca

SEQ ID NO: 3535952 - RNA, 15 nt, Pseudomonas putida KT2440
ucugcaaugccgcca

SEQ ID NO: 3535953 - RNA, 23 nt, Pseudomonas putida KT2440
ucugcaccggcagcgcaaucacc

SEQ ID NO: 3535954 - RNA, 14 nt, Pseudomonas putida KT2440
ucugcaccuugccc

SEQ ID NO: 3535955 - RNA, 14 nt, Pseudomonas putida KT2440
ucugcacgcgugcc

SEQ ID NO: 3535956 - RNA, 21 nt, Pseudomonas putida KT2440
ucugcacgcgugccugguugc

SEQ ID NO: 3535957 - RNA, 18 nt, Pseudomonas putida KT2440
ucugcacucccgcugcug

SEQ ID NO: 3535958 - RNA, 15 nt, Pseudomonas putida KT2440
ucugcagcaccgacu

SEQ ID NO: 3535959 - RNA, 20 nt, Pseudomonas putida KT2440
ucugcagcagcgcgccgaac

SEQ ID NO: 3535960 - RNA, 12 nt, Pseudomonas putida KT2440
ucugcagccuga

SEQ ID NO: 3535961 - RNA, 23 nt, Pseudomonas putida KT2440
ucugcagccugacgcgccgccaa

SEQ ID NO: 3535962 - RNA, 15 nt, Pseudomonas putida KT2440
ucugcaggcacaccc

SEQ ID NO: 3535963 - RNA, 13 nt, Pseudomonas putida KT2440
ucugcauggcaua

SEQ ID NO: 3535964 - RNA, 15 nt, Pseudomonas putida KT2440
ucugcauguccagcc

SEQ ID NO: 3535965 - RNA, 20 nt, Pseudomonas putida KT2440
ucugccagaggcgcguagua

SEQ ID NO: 3535966 - RNA, 20 nt, Pseudomonas putida KT2440
ucugccagcuccuggcucag

SEQ ID NO: 3535967 - RNA, 14 nt, Pseudomonas putida KT2440
ucugccaggcacca

SEQ ID NO: 3535968 - RNA, 18 nt, Pseudomonas putida KT2440
ucugccaggcaccacaag

SEQ ID NO: 3535969 - RNA, 23 nt, Pseudomonas putida KT2440
ucugccaguccuuggccaaugcc

SEQ ID NO: 3535970 - RNA, 18 nt, Pseudomonas putida KT2440
ucugccaguucaugcagc

SEQ ID NO: 3535971 - RNA, 19 nt, Pseudomonas putida KT2440
ucugccaguugcuucugca

SEQ ID NO: 3535972 - RNA, 20 nt, Pseudomonas putida KT2440
ucugccaguugcuucugcag

SEQ ID NO: 3535973 - RNA, 19 nt, Pseudomonas putida KT2440
ucugccaucuccaaugcgu

SEQ ID NO: 3535974 - RNA, 20 nt, Pseudomonas putida KT2440
ucugccgacaaacguaccag

SEQ ID NO: 3535975 - RNA, 23 nt, Pseudomonas putida KT2440
ucugccgccgcagcaaucugcug

SEQ ID NO: 3535976 - RNA, 14 nt, Pseudomonas putida KT2440
ucugccggacaaga

SEQ ID NO: 3535977 - RNA, 22 nt, Pseudomonas putida KT2440
ucugccggcgaauccagccggc

SEQ ID NO: 3535978 - RNA, 17 nt, Pseudomonas putida KT2440
ucugccggcgccuccag

SEQ ID NO: 3535979 - RNA, 20 nt, Pseudomonas putida KT2440
ucugccggcgccuccagcaa

SEQ ID NO: 3535980 - RNA, 17 nt, Pseudomonas putida KT2440
ucugccgggccaccacc

SEQ ID NO: 3535981 - RNA, 23 nt, Pseudomonas putida KT2440
ucugccgguagugaugcaucagc

SEQ ID NO: 3535982 - RNA, 19 nt, Pseudomonas putida KT2440
ucugccguuguucggcaaa

SEQ ID NO: 3535983 - RNA, 21 nt, Pseudomonas putida KT2440
ucugccguuugcuggccugca

SEQ ID NO: 3535984 - RNA, 23 nt, Pseudomonas putida KT2440
ucugccguuugcuggccugcagc

SEQ ID NO: 3535985 - RNA, 12 nt, Pseudomonas putida KT2440
ucugccugccca

SEQ ID NO: 3535986 - RNA, 20 nt, Pseudomonas putida KT2440
ucugcgacugaauacagcca

SEQ ID NO: 3535987 - RNA, 14 nt, Pseudomonas putida KT2440
ucugcgacugcagg

SEQ ID NO: 3535988 - RNA, 15 nt, Pseudomonas putida KT2440
ucugcgacugcaggu

SEQ ID NO: 3535989 - RNA, 23 nt, Pseudomonas putida KT2440
ucugcgcaaaggcuuuggccgua

SEQ ID NO: 3535990 - RNA, 22 nt, Pseudomonas putida KT2440
ucugcgccaaagcgagcauggc

SEQ ID NO: 3535991 - RNA, 15 nt, Pseudomonas putida KT2440
ucugcgccaccggcc

SEQ ID NO: 3535992 - RNA, 20 nt, Pseudomonas putida KT2440
ucugcgccacggcgcugacc

SEQ ID NO: 3535993 - RNA, 14 nt, Pseudomonas putida KT2440
ucugcgccugcugg

SEQ ID NO: 3535994 - RNA, 23 nt, Pseudomonas putida KT2440
ucugcgccugugcaaagaacacu

SEQ ID NO: 3535995 - RNA, 17 nt, Pseudomonas putida KT2440
ucugcgugauggcagcu

SEQ ID NO: 3535996 - RNA, 23 nt, Pseudomonas putida KT2440
ucugcucgacgaaggucuugccg

SEQ ID NO: 3535997 - RNA, 22 nt, Pseudomonas putida KT2440
ucugcucgcccaccgacagccc

SEQ ID NO: 3535998 - RNA, 23 nt, Pseudomonas putida KT2440
ucugcucggcguacuccagagcc

SEQ ID NO: 3535999 - RNA, 15 nt, Pseudomonas putida KT2440
ucugcuucgcugcca

SEQ ID NO: 3536000 - RNA, 16 nt, Pseudomonas putida KT2440
ucugcuucgcugccag

SEQ ID NO: 3536001 - RNA, 15 nt, Pseudomonas putida KT2440
ucugcuugaggccca

SEQ ID NO: 3536002 - RNA, 21 nt, Pseudomonas putida KT2440
ucugcuugccugucaguuccu

SEQ ID NO: 3536003 - RNA, 17 nt, Pseudomonas putida KT2440
ucuggacaagaagcggc

SEQ ID NO: 3536004 - RNA, 20 nt, Pseudomonas putida KT2440
ucuggaggaguccagcugca

SEQ ID NO: 3536005 - RNA, 16 nt, Pseudomonas putida KT2440
ucuggaucacugccag

SEQ ID NO: 3536006 - RNA, 16 nt, Pseudomonas putida KT2440
ucuggcaccaguucca

SEQ ID NO: 3536007 - RNA, 14 nt, Pseudomonas putida KT2440
ucuggcagcuccag

SEQ ID NO: 3536008 - RNA, 16 nt, Pseudomonas putida KT2440
ucuggcccgaacagca

SEQ ID NO: 3536009 - RNA, 19 nt, Pseudomonas putida KT2440
ucuggcgcacguacuccac

SEQ ID NO: 3536010 - RNA, 16 nt, Pseudomonas putida KT2440
ucuggcgccugacacu

SEQ ID NO: 3536011 - RNA, 13 nt, Pseudomonas putida KT2440
ucuggcggaaugu

SEQ ID NO: 3536012 - RNA, 18 nt, Pseudomonas putida KT2440
ucuggcugaggaacaacu

SEQ ID NO: 3536013 - RNA, 16 nt, Pseudomonas putida KT2440
ucuggcugcaaggucc

SEQ ID NO: 3536014 - RNA, 12 nt, Pseudomonas putida KT2440
ucuggcugggcu

SEQ ID NO: 3536015 - RNA, 22 nt, Pseudomonas putida KT2440
ucugggcaaaaucgaccagggc

SEQ ID NO: 3536016 - RNA, 22 nt, Pseudomonas putida KT2440
ucugguacaacaacaaaaaaaa

SEQ ID NO: 3536017 - RNA, 15 nt, Pseudomonas putida KT2440
ugaaagcaggauggu

SEQ ID NO: 3536018 - RNA, 19 nt, Pseudomonas putida KT2440
ugaaagccuaaaggcaugc

SEQ ID NO: 3536019 - RNA, 14 nt, Pseudomonas putida KT2440
ugaaaguggccaag

SEQ ID NO: 3536020 - RNA, 21 nt, Pseudomonas putida KT2440
ugaaauagccacgcaucugca

SEQ ID NO: 3536021 - RNA, 22 nt, Pseudomonas putida KT2440
ugaaaucauccauguccauggc

SEQ ID NO: 3536022 - RNA, 16 nt, Pseudomonas putida KT2440
ugaaauccucaaccug

SEQ ID NO: 3536023 - RNA, 21 nt, Pseudomonas putida KT2440
ugaaaugcaaccgaugcccag

SEQ ID NO: 3536024 - RNA, 19 nt, Pseudomonas putida KT2440
ugaaauggcggcccagcca

SEQ ID NO: 3536025 - RNA, 17 nt, Pseudomonas putida KT2440
ugaaaugguugaagauc

SEQ ID NO: 3536026 - RNA, 18 nt, Pseudomonas putida KT2440
ugaaauuaaagguugaca

SEQ ID NO: 3536027 - RNA, 18 nt, Pseudomonas putida KT2440
ugaaauucaccugccggg

SEQ ID NO: 3536028 - RNA, 13 nt, Pseudomonas putida KT2440
ugaacaaggccug

SEQ ID NO: 3536029 - RNA, 18 nt, Pseudomonas putida KT2440
ugaacaaggccuggccca

SEQ ID NO: 3536030 - RNA, 19 nt, Pseudomonas putida KT2440
ugaacacauagaacagguu

SEQ ID NO: 3536031 - RNA, 21 nt, Pseudomonas putida KT2440
ugaacacauccucaaaggcag

SEQ ID NO: 3536032 - RNA, 16 nt, Pseudomonas putida KT2440
ugaacacgccgucgac

SEQ ID NO: 3536033 - RNA, 18 nt, Pseudomonas putida KT2440
ugaacacgcucaugaaca

SEQ ID NO: 3536034 - RNA, 22 nt, Pseudomonas putida KT2440
ugaacacgcucaugaacagcgc

SEQ ID NO: 3536035 - RNA, 13 nt, Pseudomonas putida KT2440
ugaacacugccaa

SEQ ID NO: 3536036 - RNA, 21 nt, Pseudomonas putida KT2440
ugaacagcagcgccgccaggc

SEQ ID NO: 3536037 - RNA, 16 nt, Pseudomonas putida KT2440
ugaacagcaucagcca

SEQ ID NO: 3536038 - RNA, 21 nt, Pseudomonas putida KT2440
ugaacagcaucagccaugggc

SEQ ID NO: 3536039 - RNA, 16 nt, Pseudomonas putida KT2440
ugaacagcgcccagau

SEQ ID NO: 3536040 - RNA, 22 nt, Pseudomonas putida KT2440
ugaacagcgcccagaucagcag

SEQ ID NO: 3536041 - RNA, 23 nt, Pseudomonas putida KT2440
ugaacagcgccuugaagcuggcc

SEQ ID NO: 3536042 - RNA, 13 nt, Pseudomonas putida KT2440
ugaacagcgcugc

SEQ ID NO: 3536043 - RNA, 15 nt, Pseudomonas putida KT2440
ugaacagcuucaaca

SEQ ID NO: 3536044 - RNA, 22 nt, Pseudomonas putida KT2440
ugaacaggcguacaucagccuc

SEQ ID NO: 3536045 - RNA, 21 nt, Pseudomonas putida KT2440
ugaacagguugcgcgccgcca

SEQ ID NO: 3536046 - RNA, 20 nt, Pseudomonas putida KT2440
ugaaccccaccccagcguuc

SEQ ID NO: 3536047 - RNA, 14 nt, Pseudomonas putida KT2440
ugaacccgcuccua

SEQ ID NO: 3536048 - RNA, 15 nt, Pseudomonas putida KT2440
ugaacccgcuccuac

SEQ ID NO: 3536049 - RNA, 21 nt, Pseudomonas putida KT2440
ugaacccgcuccuacaacggc

SEQ ID NO: 3536050 - RNA, 20 nt, Pseudomonas putida KT2440
ugaacccgcuccuacacagg

SEQ ID NO: 3536051 - RNA, 19 nt, Pseudomonas putida KT2440
ugaacccgugcaucugcuc

SEQ ID NO: 3536052 - RNA, 17 nt, Pseudomonas putida KT2440
ugaaccggcuguuggcc

SEQ ID NO: 3536053 - RNA, 20 nt, Pseudomonas putida KT2440
ugaaccugaccuugcugcuc

SEQ ID NO: 3536054 - RNA, 24 nt, Pseudomonas putida KT2440
ugaacgaaaacgaaacgccaggca

SEQ ID NO: 3536055 - RNA, 13 nt, Pseudomonas putida KT2440
ugaacgaggacug

SEQ ID NO: 3536056 - RNA, 15 nt, Pseudomonas putida KT2440
ugaacgaggacugca

SEQ ID NO: 3536057 - RNA, 22 nt, Pseudomonas putida KT2440
ugaacgaucagggaugcuggac

SEQ ID NO: 3536058 - RNA, 18 nt, Pseudomonas putida KT2440
ugaacgaugcccgggccu

SEQ ID NO: 3536059 - RNA, 21 nt, Pseudomonas putida KT2440
ugaacgcaaggguaauggcga

SEQ ID NO: 3536060 - RNA, 23 nt, Pseudomonas putida KT2440
ugaacggcggguggaaauuggcc

SEQ ID NO: 3536061 - RNA, 20 nt, Pseudomonas putida KT2440
ugaacggcuguuccucgcca

SEQ ID NO: 3536062 - RNA, 16 nt, Pseudomonas putida KT2440
ugaacugcaacuugcc

SEQ ID NO: 3536063 - RNA, 12 nt, Pseudomonas putida KT2440
ugaacugcucuc

SEQ ID NO: 3536064 - RNA, 17 nt, Pseudomonas putida KT2440
ugaacugggcauccagc

SEQ ID NO: 3536065 - RNA, 21 nt, Pseudomonas putida KT2440
ugaacugggcauccagcuugc

SEQ ID NO: 3536066 - RNA, 12 nt, Pseudomonas putida KT2440
ugaacuuccagu

SEQ ID NO: 3536067 - RNA, 14 nt, Pseudomonas putida KT2440
ugaacuugaucgcg

SEQ ID NO: 3536068 - RNA, 13 nt, Pseudomonas putida KT2440
ugaacuuggccuc

SEQ ID NO: 3536069 - RNA, 17 nt, Pseudomonas putida KT2440
ugaacuuggccuccagc

SEQ ID NO: 3536070 - RNA, 22 nt, Pseudomonas putida KT2440
ugaacuuggcgaugaugugcgc

SEQ ID NO: 3536071 - RNA, 22 nt, Pseudomonas putida KT2440
ugaacuuguacagcgugcgcuc

SEQ ID NO: 3536072 - RNA, 17 nt, Pseudomonas putida KT2440
ugaagaacaccugcagc

SEQ ID NO: 3536073 - RNA, 18 nt, Pseudomonas putida KT2440
ugaagaacaccugcagcg

SEQ ID NO: 3536074 - RNA, 13 nt, Pseudomonas putida KT2440
ugaagaagcuccc

SEQ ID NO: 3536075 - RNA, 20 nt, Pseudomonas putida KT2440
ugaagacgcucgacagcaac

SEQ ID NO: 3536076 - RNA, 17 nt, Pseudomonas putida KT2440
ugaagaggccagugagc

SEQ ID NO: 3536077 - RNA, 19 nt, Pseudomonas putida KT2440
ugaagaggccagugagccu

SEQ ID NO: 3536078 - RNA, 20 nt, Pseudomonas putida KT2440
ugaagauauugguccagcca

SEQ ID NO: 3536079 - RNA, 18 nt, Pseudomonas putida KT2440
ugaagaugguuuccagcu

SEQ ID NO: 3536080 - RNA, 21 nt, Pseudomonas putida KT2440
ugaagaugguuuccagcuccg

SEQ ID NO: 3536081 - RNA, 13 nt, Pseudomonas putida KT2440
ugaagccacgcuc

SEQ ID NO: 3536082 - RNA, 22 nt, Pseudomonas putida KT2440
ugaagcgaaaccuaaacugugg

SEQ ID NO: 3536083 - RNA, 15 nt, Pseudomonas putida KT2440
ugaagcgagagcuuc

SEQ ID NO: 3536084 - RNA, 19 nt, Pseudomonas putida KT2440
ugaagcgcgggucuuccac

SEQ ID NO: 3536085 - RNA, 14 nt, Pseudomonas putida KT2440
ugaagcgguugacc

SEQ ID NO: 3536086 - RNA, 15 nt, Pseudomonas putida KT2440
ugaagcucgaucugc

SEQ ID NO: 3536087 - RNA, 12 nt, Pseudomonas putida KT2440
ugaagcucucca

SEQ ID NO: 3536088 - RNA, 13 nt, Pseudomonas putida KT2440
ugaagcucuccag

SEQ ID NO: 3536089 - RNA, 14 nt, Pseudomonas putida KT2440
ugaagcucuccagc

SEQ ID NO: 3536090 - RNA, 16 nt, Pseudomonas putida KT2440
ugaagcucuccagcag

SEQ ID NO: 3536091 - RNA, 13 nt, Pseudomonas putida KT2440
ugaagcugcgcuc

SEQ ID NO: 3536092 - RNA, 16 nt, Pseudomonas putida KT2440
ugaagcugcgcucgau

SEQ ID NO: 3536093 - RNA, 21 nt, Pseudomonas putida KT2440
ugaagcuuggggccgcucugc

SEQ ID NO: 3536094 - RNA, 16 nt, Pseudomonas putida KT2440
ugaaggacaucaccag

SEQ ID NO: 3536095 - RNA, 16 nt, Pseudomonas putida KT2440
ugaaggcauugcggcc

SEQ ID NO: 3536096 - RNA, 14 nt, Pseudomonas putida KT2440
ugaaggccggcauc

SEQ ID NO: 3536097 - RNA, 22 nt, Pseudomonas putida KT2440
ugaaggcgaaugagaggcgggu

SEQ ID NO: 3536098 - RNA, 18 nt, Pseudomonas putida KT2440
ugaaggggcaaaguucgc

SEQ ID NO: 3536099 - RNA, 14 nt, Pseudomonas putida KT2440
ugaaguacucggca

SEQ ID NO: 3536100 - RNA, 14 nt, Pseudomonas putida KT2440
ugaaguacuuggcg

SEQ ID NO: 3536101 - RNA, 16 nt, Pseudomonas putida KT2440
ugaaguaguccccauc

SEQ ID NO: 3536102 - RNA, 20 nt, Pseudomonas putida KT2440
ugaaguauaaaggucuuuug

SEQ ID NO: 3536103 - RNA, 14 nt, Pseudomonas putida KT2440
ugaagucaaccaac

SEQ ID NO: 3536104 - RNA, 20 nt, Pseudomonas putida KT2440
ugaagucgcacaugaagccg

SEQ ID NO: 3536105 - RNA, 17 nt, Pseudomonas putida KT2440
ugaagucgguggucacc

SEQ ID NO: 3536106 - RNA, 17 nt, Pseudomonas putida KT2440
ugaagugccaaggcuuu

SEQ ID NO: 3536107 - RNA, 13 nt, Pseudomonas putida KT2440
ugaauacaaagga

SEQ ID NO: 3536108 - RNA, 14 nt, Pseudomonas putida KT2440
ugaauacaccagcu

SEQ ID NO: 3536109 - RNA, 15 nt, Pseudomonas putida KT2440
ugaauacagccaaug

SEQ ID NO: 3536110 - RNA, 21 nt, Pseudomonas putida KT2440
ugaauagcaggccgcauuucg

SEQ ID NO: 3536111 - RNA, 17 nt, Pseudomonas putida KT2440
ugaaucagcggcaggcu

SEQ ID NO: 3536112 - RNA, 19 nt, Pseudomonas putida KT2440
ugaaucagcggcaggcugg

SEQ ID NO: 3536113 - RNA, 20 nt, Pseudomonas putida KT2440
ugaaucagcggcaggcuggc

SEQ ID NO: 3536114 - RNA, 20 nt, Pseudomonas putida KT2440
ugaaucuugcgcgccagcgc

SEQ ID NO: 3536115 - RNA, 18 nt, Pseudomonas putida KT2440
ugaaugccgccauccucg

SEQ ID NO: 3536116 - RNA, 19 nt, Pseudomonas putida KT2440
ugaaugccgccauccucgg

SEQ ID NO: 3536117 - RNA, 22 nt, Pseudomonas putida KT2440
ugaaugccgccauccucggcca

SEQ ID NO: 3536118 - RNA, 14 nt, Pseudomonas putida KT2440
ugaauucuggcuua

SEQ ID NO: 3536119 - RNA, 15 nt, Pseudomonas putida KT2440
ugaauuggagcugaa

SEQ ID NO: 3536120 - RNA, 12 nt, Pseudomonas putida KT2440
ugaauuggccgg

SEQ ID NO: 3536121 - RNA, 12 nt, Pseudomonas putida KT2440
ugaauuuucuug

SEQ ID NO: 3536122 - RNA, 18 nt, Pseudomonas putida KT2440
ugagcacggcuucgacgc

SEQ ID NO: 3536123 - RNA, 21 nt, Pseudomonas putida KT2440
ugagcagcgguggcaaaucga

SEQ ID NO: 3536124 - RNA, 20 nt, Pseudomonas putida KT2440
ugagcagggugccgccaugu

SEQ ID NO: 3536125 - RNA, 19 nt, Pseudomonas putida KT2440
ugagcaggucgaacagccc

SEQ ID NO: 3536126 - RNA, 14 nt, Pseudomonas putida KT2440
ugagcaucggcguu

SEQ ID NO: 3536127 - RNA, 22 nt, Pseudomonas putida KT2440
ugagcaucggcguugcggugca

SEQ ID NO: 3536128 - RNA, 14 nt, Pseudomonas putida KT2440
ugagcauggcaaac

SEQ ID NO: 3536129 - RNA, 16 nt, Pseudomonas putida KT2440
ugagcauggcaaacag

SEQ ID NO: 3536130 - RNA, 18 nt, Pseudomonas putida KT2440
ugagcauggcaaacagca

SEQ ID NO: 3536131 - RNA, 20 nt, Pseudomonas putida KT2440
ugagcauggcaaacagcacc

SEQ ID NO: 3536132 - RNA, 14 nt, Pseudomonas putida KT2440
ugagccaaggccgc

SEQ ID NO: 3536133 - RNA, 18 nt, Pseudomonas putida KT2440
ugagccaaggccgcccag

SEQ ID NO: 3536134 - RNA, 19 nt, Pseudomonas putida KT2440
ugagccaggagaacaccca

SEQ ID NO: 3536135 - RNA, 17 nt, Pseudomonas putida KT2440
ugagccaggcuacccac

SEQ ID NO: 3536136 - RNA, 17 nt, Pseudomonas putida KT2440
ugagccagggcgcuguc

SEQ ID NO: 3536137 - RNA, 13 nt, Pseudomonas putida KT2440
ugagccaguucac

SEQ ID NO: 3536138 - RNA, 21 nt, Pseudomonas putida KT2440
ugagccaugccguaagccgca

SEQ ID NO: 3536139 - RNA, 18 nt, Pseudomonas putida KT2440
ugagcccaaccucugaug

SEQ ID NO: 3536140 - RNA, 18 nt, Pseudomonas putida KT2440
ugagccguccggcaaucu

SEQ ID NO: 3536141 - RNA, 13 nt, Pseudomonas putida KT2440
ugagccugcaggg

SEQ ID NO: 3536142 - RNA, 17 nt, Pseudomonas putida KT2440
ugagccugcagggccuc

SEQ ID NO: 3536143 - RNA, 21 nt, Pseudomonas putida KT2440
ugagccuucacugugcagggg

SEQ ID NO: 3536144 - RNA, 23 nt, Pseudomonas putida KT2440
ugagccuugucaguucugcucag

SEQ ID NO: 3536145 - RNA, 14 nt, Pseudomonas putida KT2440
ugagccuugugcug

SEQ ID NO: 3536146 - RNA, 15 nt, Pseudomonas putida KT2440
ugagcgacgcugccg

SEQ ID NO: 3536147 - RNA, 18 nt, Pseudomonas putida KT2440
ugagcgacgcugccgcac

SEQ ID NO: 3536148 - RNA, 19 nt, Pseudomonas putida KT2440
ugagcgagcucaaccagcu

SEQ ID NO: 3536149 - RNA, 16 nt, Pseudomonas putida KT2440
ugagcgaugcgcuggc

SEQ ID NO: 3536150 - RNA, 15 nt, Pseudomonas putida KT2440
ugagcgccgcgauga

SEQ ID NO: 3536151 - RNA, 13 nt, Pseudomonas putida KT2440
ugagcggcucgcg

SEQ ID NO: 3536152 - RNA, 15 nt, Pseudomonas putida KT2440
ugagcucuacaccua

SEQ ID NO: 3536153 - RNA, 17 nt, Pseudomonas putida KT2440
ugagcuggccguccagc

SEQ ID NO: 3536154 - RNA, 20 nt, Pseudomonas putida KT2440
ugagcuguuucaugcugcga

SEQ ID NO: 3536155 - RNA, 13 nt, Pseudomonas putida KT2440
ugagcuuagcgcg

SEQ ID NO: 3536156 - RNA, 15 nt, Pseudomonas putida KT2440
ugagcuucagcgcgc

SEQ ID NO: 3536157 - RNA, 19 nt, Pseudomonas putida KT2440
ugagcuugacuuccagcuu

SEQ ID NO: 3536158 - RNA, 22 nt, Pseudomonas putida KT2440
ugaggaacaacuugguccgguc

SEQ ID NO: 3536159 - RNA, 11 nt, Pseudomonas putida KT2440
ugaggaaguga

SEQ ID NO: 3536160 - RNA, 21 nt, Pseudomonas putida KT2440
ugaggcacaaaaaagcccggc

SEQ ID NO: 3536161 - RNA, 22 nt, Pseudomonas putida KT2440
ugaggcaugugcugucccggca

SEQ ID NO: 3536162 - RNA, 19 nt, Pseudomonas putida KT2440
ugaggccgaacaccgccag

SEQ ID NO: 3536163 - RNA, 20 nt, Pseudomonas putida KT2440
ugaggccgccauugaugccg

SEQ ID NO: 3536164 - RNA, 14 nt, Pseudomonas putida KT2440
ugagggaaggcuug

SEQ ID NO: 3536165 - RNA, 18 nt, Pseudomonas putida KT2440
ugagggccucuucgcggg

SEQ ID NO: 3536166 - RNA, 14 nt, Pseudomonas putida KT2440
ugagggcgccgacc

SEQ ID NO: 3536167 - RNA, 16 nt, Pseudomonas putida KT2440
ugagggcguuccagcc

SEQ ID NO: 3536168 - RNA, 13 nt, Pseudomonas putida KT2440
ugagguccgccuc

SEQ ID NO: 3536169 - RNA, 18 nt, Pseudomonas putida KT2440
ugaggugccauagcacca

SEQ ID NO: 3536170 - RNA, 19 nt, Pseudomonas putida KT2440
ugaggugccauagcaccag

SEQ ID NO: 3536171 - RNA, 20 nt, Pseudomonas putida KT2440
ugaggugccauagcaccagc

SEQ ID NO: 3536172 - RNA, 15 nt, Pseudomonas putida KT2440
ugaggugcucgacga

SEQ ID NO: 3536173 - RNA, 13 nt, Pseudomonas putida KT2440
ugagguucugcuc

SEQ ID NO: 3536174 - RNA, 17 nt, Pseudomonas putida KT2440
ugagguuugccaaggca

SEQ ID NO: 3536175 - RNA, 15 nt, Pseudomonas putida KT2440
ugagucagcuugugc

SEQ ID NO: 3536176 - RNA, 15 nt, Pseudomonas putida KT2440
ugagucaggcgcccu

SEQ ID NO: 3536177 - RNA, 15 nt, Pseudomonas putida KT2440
ugagugcaggcauau

SEQ ID NO: 3536178 - RNA, 13 nt, Pseudomonas putida KT2440
ugagugcaugcug

SEQ ID NO: 3536179 - RNA, 22 nt, Pseudomonas putida KT2440
ugaguucccaggcagccuccag

SEQ ID NO: 3536180 - RNA, 18 nt, Pseudomonas putida KT2440
ugaguucgcuaagguggu

SEQ ID NO: 3536181 - RNA, 19 nt, Pseudomonas putida KT2440
ugauaacgcgccgcugccu

SEQ ID NO: 3536182 - RNA, 14 nt, Pseudomonas putida KT2440
ugauaauugggcau

SEQ ID NO: 3536183 - RNA, 16 nt, Pseudomonas putida KT2440
ugauacacccgcucca

SEQ ID NO: 3536184 - RNA, 16 nt, Pseudomonas putida KT2440
ugauaccgaacagcac

SEQ ID NO: 3536185 - RNA, 16 nt, Pseudomonas putida KT2440
ugauacgcccauccaa

SEQ ID NO: 3536186 - RNA, 20 nt, Pseudomonas putida KT2440
ugauacgcgacaguucgcca

SEQ ID NO: 3536187 - RNA, 17 nt, Pseudomonas putida KT2440
ugauacggggaggccgu

SEQ ID NO: 3536188 - RNA, 16 nt, Pseudomonas putida KT2440
ugauacuucugaccaa

SEQ ID NO: 3536189 - RNA, 22 nt, Pseudomonas putida KT2440
ugauagcgcuuuuccaguuccu

SEQ ID NO: 3536190 - RNA, 20 nt, Pseudomonas putida KT2440
ugauauuugccacucaggcg

SEQ ID NO: 3536191 - RNA, 18 nt, Pseudomonas putida KT2440
ugaucaagcccgcucgcc

SEQ ID NO: 3536192 - RNA, 20 nt, Pseudomonas putida KT2440
ugaucaagguuucagcagcg

SEQ ID NO: 3536193 - RNA, 13 nt, Pseudomonas putida KT2440
ugaucaauccucu

SEQ ID NO: 3536194 - RNA, 18 nt, Pseudomonas putida KT2440
ugaucagcgacaccgcca

SEQ ID NO: 3536195 - RNA, 17 nt, Pseudomonas putida KT2440
ugaucagcugccacucu

SEQ ID NO: 3536196 - RNA, 21 nt, Pseudomonas putida KT2440
ugaucagcuggucgaggcggc

SEQ ID NO: 3536197 - RNA, 17 nt, Pseudomonas putida KT2440
ugaucaggaaggcgucg

SEQ ID NO: 3536198 - RNA, 21 nt, Pseudomonas putida KT2440
ugaucaggcccugcugcuucu

SEQ ID NO: 3536199 - RNA, 12 nt, Pseudomonas putida KT2440
ugaucagggaca

SEQ ID NO: 3536200 - RNA, 15 nt, Pseudomonas putida KT2440
ugaucagguaccccu

SEQ ID NO: 3536201 - RNA, 18 nt, Pseudomonas putida KT2440
ugaucagguuacuggcca

SEQ ID NO: 3536202 - RNA, 19 nt, Pseudomonas putida KT2440
ugaucagguuacuggccaa

SEQ ID NO: 3536203 - RNA, 21 nt, Pseudomonas putida KT2440
ugaucagguuacuggccaauu

SEQ ID NO: 3536204 - RNA, 15 nt, Pseudomonas putida KT2440
ugaucaucagcgccg

SEQ ID NO: 3536205 - RNA, 22 nt, Pseudomonas putida KT2440
ugaucauccacaaucagcacug

SEQ ID NO: 3536206 - RNA, 20 nt, Pseudomonas putida KT2440
ugaucauccccagcauggcc

SEQ ID NO: 3536207 - RNA, 19 nt, Pseudomonas putida KT2440
ugaucaugcccauggccag

SEQ ID NO: 3536208 - RNA, 20 nt, Pseudomonas putida KT2440
ugaucauguccuugcugcgc

SEQ ID NO: 3536209 - RNA, 13 nt, Pseudomonas putida KT2440
ugauccaccucuc

SEQ ID NO: 3536210 - RNA, 19 nt, Pseudomonas putida KT2440
ugauccagucagacuccuu

SEQ ID NO: 3536211 - RNA, 21 nt, Pseudomonas putida KT2440
ugaucccuacccccuccucca

SEQ ID NO: 3536212 - RNA, 22 nt, Pseudomonas putida KT2440
ugaucccuacccccuccuccag

SEQ ID NO: 3536213 - RNA, 15 nt, Pseudomonas putida KT2440
ugauccgccuggccc

SEQ ID NO: 3536214 - RNA, 12 nt, Pseudomonas putida KT2440
ugauccggcacu

SEQ ID NO: 3536215 - RNA, 22 nt, Pseudomonas putida KT2440
ugauccggcacuccagcgagug

SEQ ID NO: 3536216 - RNA, 19 nt, Pseudomonas putida KT2440
ugaucgaagcgacagcggc

SEQ ID NO: 3536217 - RNA, 12 nt, Pseudomonas putida KT2440
ugaucgccgccg

SEQ ID NO: 3536218 - RNA, 14 nt, Pseudomonas putida KT2440
ugaucgccuggccg

SEQ ID NO: 3536219 - RNA, 18 nt, Pseudomonas putida KT2440
ugaucgccuggccggccg

SEQ ID NO: 3536220 - RNA, 14 nt, Pseudomonas putida KT2440
ugaucgcgcuggca

SEQ ID NO: 3536221 - RNA, 12 nt, Pseudomonas putida KT2440
ugaucgcggcaa

SEQ ID NO: 3536222 - RNA, 23 nt, Pseudomonas putida KT2440
ugaucgcggcguugucagccuuc

SEQ ID NO: 3536223 - RNA, 14 nt, Pseudomonas putida KT2440
ugaucgcguuaccc

SEQ ID NO: 3536224 - RNA, 12 nt, Pseudomonas putida KT2440
ugaucggcuggc

SEQ ID NO: 3536225 - RNA, 13 nt, Pseudomonas putida KT2440
ugaucggcuggcc

SEQ ID NO: 3536226 - RNA, 15 nt, Pseudomonas putida KT2440
ugaucggcuggccau

SEQ ID NO: 3536227 - RNA, 15 nt, Pseudomonas putida KT2440
ugaucucgcgcuggc

SEQ ID NO: 3536228 - RNA, 13 nt, Pseudomonas putida KT2440
ugcaccagcacca

SEQ ID NO: 3536229 - RNA, 17 nt, Pseudomonas putida KT2440
ugcaccagcuugugccg

SEQ ID NO: 3536230 - RNA, 16 nt, Pseudomonas putida KT2440
ugcaccaggaagcugg

SEQ ID NO: 3536231 - RNA, 18 nt, Pseudomonas putida KT2440
ugcaccaggaagcuggga

SEQ ID NO: 3536232 - RNA, 21 nt, Pseudomonas putida KT2440
ugcaccaggcccagccgggcc

SEQ ID NO: 3536233 - RNA, 13 nt, Pseudomonas putida KT2440
ugcaccaggucca

SEQ ID NO: 3536234 - RNA, 16 nt, Pseudomonas putida KT2440
ugcaccaguuccuggc

SEQ ID NO: 3536235 - RNA, 19 nt, Pseudomonas putida KT2440
ugcaccaguuccuggcgcu

SEQ ID NO: 3536236 - RNA, 16 nt, Pseudomonas putida KT2440
ugcaccaugauguucu

SEQ ID NO: 3536237 - RNA, 20 nt, Pseudomonas putida KT2440
ugcacccagcguauagccac

SEQ ID NO: 3536238 - RNA, 17 nt, Pseudomonas putida KT2440
ugcaccccgauccauuu

SEQ ID NO: 3536239 - RNA, 15 nt, Pseudomonas putida KT2440
ugcaccccugccacc

SEQ ID NO: 3536240 - RNA, 11 nt, Pseudomonas putida KT2440
ugcacccgcgc

SEQ ID NO: 3536241 - RNA, 16 nt, Pseudomonas putida KT2440
ugcacccgcgcgcccg

SEQ ID NO: 3536242 - RNA, 23 nt, Pseudomonas putida KT2440
ugcacccgugcagggcugcgaua

SEQ ID NO: 3536243 - RNA, 18 nt, Pseudomonas putida KT2440
ugcacccgugccugccug

SEQ ID NO: 3536244 - RNA, 17 nt, Pseudomonas putida KT2440
ugcacccucuuccuugu

SEQ ID NO: 3536245 - RNA, 18 nt, Pseudomonas putida KT2440
ugcaccgaagcaccacug

SEQ ID NO: 3536246 - RNA, 19 nt, Pseudomonas putida KT2440
ugcaccgaagcaccacugg

SEQ ID NO: 3536247 - RNA, 23 nt, Pseudomonas putida KT2440
ugcaccggccucuucgcgggcaa

SEQ ID NO: 3536248 - RNA, 14 nt, Pseudomonas putida KT2440
ugcaccggccuugc

SEQ ID NO: 3536249 - RNA, 18 nt, Pseudomonas putida KT2440
ugcaccgguucgccccca

SEQ ID NO: 3536250 - RNA, 23 nt, Pseudomonas putida KT2440
ugcaccgucuggaagucgcgagu

SEQ ID NO: 3536251 - RNA, 21 nt, Pseudomonas putida KT2440
ugcaccguuuaccaaggcggu

SEQ ID NO: 3536252 - RNA, 22 nt, Pseudomonas putida KT2440
ugcaccucauagaucagcaucg

SEQ ID NO: 3536253 - RNA, 19 nt, Pseudomonas putida KT2440
ugcaccucggaugccacgc

SEQ ID NO: 3536254 - RNA, 23 nt, Pseudomonas putida KT2440
ugcaccugguaggucacuucagu

SEQ ID NO: 3536255 - RNA, 15 nt, Pseudomonas putida KT2440
ugcaccuuguuaccc

SEQ ID NO: 3536256 - RNA, 14 nt, Pseudomonas putida KT2440
ugcacgccacgccc

SEQ ID NO: 3536257 - RNA, 16 nt, Pseudomonas putida KT2440
ugcacgcgugccuggu

SEQ ID NO: 3536258 - RNA, 16 nt, Pseudomonas putida KT2440
ugcacgcuuucgccga

SEQ ID NO: 3536259 - RNA, 21 nt, Pseudomonas putida KT2440
ugcacggacgucgcgcuggcc

SEQ ID NO: 3536260 - RNA, 21 nt, Pseudomonas putida KT2440
ugcacggcaaaguccagcauc

SEQ ID NO: 3536261 - RNA, 21 nt, Pseudomonas putida KT2440
ugcacggcagcaaucgccgcc

SEQ ID NO: 3536262 - RNA, 18 nt, Pseudomonas putida KT2440
ugcacggccguuggccag

SEQ ID NO: 3536263 - RNA, 19 nt, Pseudomonas putida KT2440
ugcacggccguuggccagc

SEQ ID NO: 3536264 - RNA, 16 nt, Pseudomonas putida KT2440
ugcacggccugcaucc

SEQ ID NO: 3536265 - RNA, 20 nt, Pseudomonas putida KT2440
ugcacgucauaguuguggca

SEQ ID NO: 3536266 - RNA, 18 nt, Pseudomonas putida KT2440
ugcacgucgcgcagggcc

SEQ ID NO: 3536267 - RNA, 21 nt, Pseudomonas putida KT2440
ugcacgucgcugucuucugcc

SEQ ID NO: 3536268 - RNA, 22 nt, Pseudomonas putida KT2440
ugcacuaucugcguuucgcugg

SEQ ID NO: 3536269 - RNA, 17 nt, Pseudomonas putida KT2440
ugcacucccgcugcugc

SEQ ID NO: 3536270 - RNA, 17 nt, Pseudomonas putida KT2440
ugcacugaagauuuuca

SEQ ID NO: 3536271 - RNA, 16 nt, Pseudomonas putida KT2440
ugcacugcaacaccgg

SEQ ID NO: 3536272 - RNA, 19 nt, Pseudomonas putida KT2440
ugcacugccagcgccucac

SEQ ID NO: 3536273 - RNA, 18 nt, Pseudomonas putida KT2440
ugcacugccuggcucagg

SEQ ID NO: 3536274 - RNA, 19 nt, Pseudomonas putida KT2440
ugcacugccuggcucaggc

SEQ ID NO: 3536275 - RNA, 14 nt, Pseudomonas putida KT2440
ugcacuggcaggcc

SEQ ID NO: 3536276 - RNA, 23 nt, Pseudomonas putida KT2440
ugcacuggcggggcuuuuucauu

SEQ ID NO: 3536277 - RNA, 17 nt, Pseudomonas putida KT2440
ugcacugggcgauggcg

SEQ ID NO: 3536278 - RNA, 22 nt, Pseudomonas putida KT2440
ugcacuucgauacccagccagc

SEQ ID NO: 3536279 - RNA, 20 nt, Pseudomonas putida KT2440
ugcacuugcgguguccauuc

SEQ ID NO: 3536280 - RNA, 23 nt, Pseudomonas putida KT2440
ugcagaaagugcguuggcugcug

SEQ ID NO: 3536281 - RNA, 14 nt, Pseudomonas putida KT2440
ugcagaaccgccag

SEQ ID NO: 3536282 - RNA, 16 nt, Pseudomonas putida KT2440
ugcagaaccgccagca

SEQ ID NO: 3536283 - RNA, 23 nt, Pseudomonas putida KT2440
ugcagaacguacuggccgcugaa

SEQ ID NO: 3536284 - RNA, 22 nt, Pseudomonas putida KT2440
ugcagaccugugggagcgggca

SEQ ID NO: 3536285 - RNA, 21 nt, Pseudomonas putida KT2440
ugcagacgccgucaagccuaa

SEQ ID NO: 3536286 - RNA, 21 nt, Pseudomonas putida KT2440
ugcagagcucagcgugacgau

SEQ ID NO: 3536287 - RNA, 15 nt, Pseudomonas putida KT2440
ugcagaucaccagcu

SEQ ID NO: 3536288 - RNA, 15 nt, Pseudomonas putida KT2440
ugcagauccaggugc

SEQ ID NO: 3536289 - RNA, 14 nt, Pseudomonas putida KT2440
ugcagaugggggga

SEQ ID NO: 3536290 - RNA, 20 nt, Pseudomonas putida KT2440
ugcagauggggggauuugag

SEQ ID NO: 3536291 - RNA, 19 nt, Pseudomonas putida KT2440
ugcagauugcccuguggcu

SEQ ID NO: 3536292 - RNA, 15 nt, Pseudomonas putida KT2440
ugcagcaacaccgcg

SEQ ID NO: 3536293 - RNA, 21 nt, Pseudomonas putida KT2440
ugcagcaacgccuuggccugc

SEQ ID NO: 3536294 - RNA, 15 nt, Pseudomonas putida KT2440
ugcagcaagcuggca

SEQ ID NO: 3536295 - RNA, 22 nt, Pseudomonas putida KT2440
ugcagcacaggucucgaacgcu

SEQ ID NO: 3536296 - RNA, 17 nt, Pseudomonas putida KT2440
ugcagcaccgacuggcg

SEQ ID NO: 3536297 - RNA, 20 nt, Pseudomonas putida KT2440
ugcagcaccgcuucacccuc

SEQ ID NO: 3536298 - RNA, 21 nt, Pseudomonas putida KT2440
ugcagcaccgcuucacccucg

SEQ ID NO: 3536299 - RNA, 19 nt, Pseudomonas putida KT2440
ugcagcaccuccaccuuca

SEQ ID NO: 3536300 - RNA, 16 nt, Pseudomonas putida KT2440
ugcagcacuucgauca

SEQ ID NO: 3536301 - RNA, 18 nt, Pseudomonas putida KT2440
ugcagcacuucgaucagg

SEQ ID NO: 3536302 - RNA, 23 nt, Pseudomonas putida KT2440
ugcagcagcgcgccgaacuugcc

SEQ ID NO: 3536303 - RNA, 14 nt, Pseudomonas putida KT2440
ugcagcaggccgcu

SEQ ID NO: 3536304 - RNA, 15 nt, Pseudomonas putida KT2440
ugcagcaggccgcug

SEQ ID NO: 3536305 - RNA, 18 nt, Pseudomonas putida KT2440
ugcagcagguaguucaug

SEQ ID NO: 3536306 - RNA, 17 nt, Pseudomonas putida KT2440
ugcagcagugccagcaa

SEQ ID NO: 3536307 - RNA, 18 nt, Pseudomonas putida KT2440
ugcagcagugccagcaac

SEQ ID NO: 3536308 - RNA, 19 nt, Pseudomonas putida KT2440
ugcagcagugccagcaaca

SEQ ID NO: 3536309 - RNA, 24 nt, Pseudomonas putida KT2440
ugcagcagugccagcaacaagcug

SEQ ID NO: 3536310 - RNA, 23 nt, Pseudomonas putida KT2440
ugcagccaccacgucacgcacca

SEQ ID NO: 3536311 - RNA, 19 nt, Pseudomonas putida KT2440
ugcagccauagccaguagc

SEQ ID NO: 3536312 - RNA, 19 nt, Pseudomonas putida KT2440
ugcagcccauucgcgggua

SEQ ID NO: 3536313 - RNA, 18 nt, Pseudomonas putida KT2440
ugcagccccuucuauuaa

SEQ ID NO: 3536314 - RNA, 12 nt, Pseudomonas putida KT2440
ugcagcccgcag

SEQ ID NO: 3536315 - RNA, 20 nt, Pseudomonas putida KT2440
ugcagcccggcaaacuccac

SEQ ID NO: 3536316 - RNA, 21 nt, Pseudomonas putida KT2440
ugcagcccggcaaacuccacu

SEQ ID NO: 3536317 - RNA, 13 nt, Pseudomonas putida KT2440
ugcagcccuucgc

SEQ ID NO: 3536318 - RNA, 18 nt, Pseudomonas putida KT2440
ugcagcccuucgcaggca

SEQ ID NO: 3536319 - RNA, 20 nt, Pseudomonas putida KT2440
ugcagcccuucgcaggcacg

SEQ ID NO: 3536320 - RNA, 22 nt, Pseudomonas putida KT2440
ugcagcccuucgcaggcacgcc

SEQ ID NO: 3536321 - RNA, 18 nt, Pseudomonas putida KT2440
ugcagcccuucgccggca

SEQ ID NO: 3536322 - RNA, 19 nt, Pseudomonas putida KT2440
ugcagcccuucgcgggcac

SEQ ID NO: 3536323 - RNA, 18 nt, Pseudomonas putida KT2440
ugcagcccuucgcgggug

SEQ ID NO: 3536324 - RNA, 18 nt, Pseudomonas putida KT2440
ugcagccgcacccaggcc

SEQ ID NO: 3536325 - RNA, 22 nt, Pseudomonas putida KT2440
ugcagccgcacccaggccacga

SEQ ID NO: 3536326 - RNA, 16 nt, Pseudomonas putida KT2440
ugcagccgcaccugcc

SEQ ID NO: 3536327 - RNA, 17 nt, Pseudomonas putida KT2440
ugcagccgcaccugccc

SEQ ID NO: 3536328 - RNA, 22 nt, Pseudomonas putida KT2440
ugcagccgcguccacaaacccc

SEQ ID NO: 3536329 - RNA, 18 nt, Pseudomonas putida KT2440
ugcagccggccccugcuc

SEQ ID NO: 3536330 - RNA, 20 nt, Pseudomonas putida KT2440
ugcagccugacgcgccgcca

SEQ ID NO: 3536331 - RNA, 18 nt, Pseudomonas putida KT2440
ugcagcgaacacugacug

SEQ ID NO: 3536332 - RNA, 11 nt, Pseudomonas putida KT2440
ugccacccaag

SEQ ID NO: 3536333 - RNA, 17 nt, Pseudomonas putida KT2440
ugccacccacaggcacg

SEQ ID NO: 3536334 - RNA, 22 nt, Pseudomonas putida KT2440
ugccacccacaggcacgacuga

SEQ ID NO: 3536335 - RNA, 15 nt, Pseudomonas putida KT2440
ugccacccaugccac

SEQ ID NO: 3536336 - RNA, 17 nt, Pseudomonas putida KT2440
ugccacccaugccaccc

SEQ ID NO: 3536337 - RNA, 21 nt, Pseudomonas putida KT2440
ugccaccccgcaaagcccugc

SEQ ID NO: 3536338 - RNA, 22 nt, Pseudomonas putida KT2440
ugccaccccgcaaagcccugcc

SEQ ID NO: 3536339 - RNA, 18 nt, Pseudomonas putida KT2440
ugccacccgaacaaaacc

SEQ ID NO: 3536340 - RNA, 15 nt, Pseudomonas putida KT2440
ugccaccuucagcgg

SEQ ID NO: 3536341 - RNA, 14 nt, Pseudomonas putida KT2440
ugccaccuuccagg

SEQ ID NO: 3536342 - RNA, 15 nt, Pseudomonas putida KT2440
ugccacgacaccggg

SEQ ID NO: 3536343 - RNA, 18 nt, Pseudomonas putida KT2440
ugccacgacaccgggaua

SEQ ID NO: 3536344 - RNA, 13 nt, Pseudomonas putida KT2440
ugccacgcaccac

SEQ ID NO: 3536345 - RNA, 16 nt, Pseudomonas putida KT2440
ugccacgcaugccuau

SEQ ID NO: 3536346 - RNA, 20 nt, Pseudomonas putida KT2440
ugccacgcccgcugcaugcu

SEQ ID NO: 3536347 - RNA, 21 nt, Pseudomonas putida KT2440
ugccacgcccgcugcaugcuc

SEQ ID NO: 3536348 - RNA, 13 nt, Pseudomonas putida KT2440
ugccacucagcgg

SEQ ID NO: 3536349 - RNA, 19 nt, Pseudomonas putida KT2440
ugccacucuucaccauggg

SEQ ID NO: 3536350 - RNA, 20 nt, Pseudomonas putida KT2440
ugccacugcgcuacgaccca

SEQ ID NO: 3536351 - RNA, 19 nt, Pseudomonas putida KT2440
ugccacuggucgccucgac

SEQ ID NO: 3536352 - RNA, 21 nt, Pseudomonas putida KT2440
ugccagaaaaguuggccaugu

SEQ ID NO: 3536353 - RNA, 23 nt, Pseudomonas putida KT2440
ugccagagaauuucuccccagca

SEQ ID NO: 3536354 - RNA, 14 nt, Pseudomonas putida KT2440
ugccagcagcuggc

SEQ ID NO: 3536355 - RNA, 17 nt, Pseudomonas putida KT2440
ugccagcagcuggcuug

SEQ ID NO: 3536356 - RNA, 14 nt, Pseudomonas putida KT2440
ugccagcaguucgc

SEQ ID NO: 3536357 - RNA, 15 nt, Pseudomonas putida KT2440
ugccagccccgcaca

SEQ ID NO: 3536358 - RNA, 22 nt, Pseudomonas putida KT2440
ugccagcccggcggccagcacg

SEQ ID NO: 3536359 - RNA, 17 nt, Pseudomonas putida KT2440
ugccagccgcaaccggg

SEQ ID NO: 3536360 - RNA, 16 nt, Pseudomonas putida KT2440
ugccagccgcccaagc

SEQ ID NO: 3536361 - RNA, 18 nt, Pseudomonas putida KT2440
ugccagcgaggcaaucag

SEQ ID NO: 3536362 - RNA, 14 nt, Pseudomonas putida KT2440
ugccagcgccaauc

SEQ ID NO: 3536363 - RNA, 19 nt, Pseudomonas putida KT2440
ugccagcgucuuuggccug

SEQ ID NO: 3536364 - RNA, 22 nt, Pseudomonas putida KT2440
ugccagcgucuuuggccugcuu

SEQ ID NO: 3536365 - RNA, 23 nt, Pseudomonas putida KT2440
ugccagcgugaaccggcuguugg

SEQ ID NO: 3536366 - RNA, 22 nt, Pseudomonas putida KT2440
ugccagcguguuccaucaccgg

SEQ ID NO: 3536367 - RNA, 21 nt, Pseudomonas putida KT2440
ugccagcguucucgcucaggu

SEQ ID NO: 3536368 - RNA, 18 nt, Pseudomonas putida KT2440
ugccagcuaucucccagc

SEQ ID NO: 3536369 - RNA, 15 nt, Pseudomonas putida KT2440
ugccagcuccuggcu

SEQ ID NO: 3536370 - RNA, 23 nt, Pseudomonas putida KT2440
ugccagcugcgcugccugcuggc

SEQ ID NO: 3536371 - RNA, 16 nt, Pseudomonas putida KT2440
ugccagcuuggucagg

SEQ ID NO: 3536372 - RNA, 19 nt, Pseudomonas putida KT2440
ugccagcuuggucagggca

SEQ ID NO: 3536373 - RNA, 23 nt, Pseudomonas putida KT2440
ugccagcuuggucagggcaaagc

SEQ ID NO: 3536374 - RNA, 23 nt, Pseudomonas putida KT2440
ugccaggcaccacaagaacugcg

SEQ ID NO: 3536375 - RNA, 13 nt, Pseudomonas putida KT2440
ugccaggccaaac

SEQ ID NO: 3536376 - RNA, 24 nt, Pseudomonas putida KT2440
ugccaggccgcacgcgccucuugc

SEQ ID NO: 3536377 - RNA, 16 nt, Pseudomonas putida KT2440
ugccaggccggguccu

SEQ ID NO: 3536378 - RNA, 20 nt, Pseudomonas putida KT2440
ugccaggcucaggccuucgc

SEQ ID NO: 3536379 - RNA, 20 nt, Pseudomonas putida KT2440
ugccaggcuuggcgugcggc

SEQ ID NO: 3536380 - RNA, 16 nt, Pseudomonas putida KT2440
ugccagggugccagac

SEQ ID NO: 3536381 - RNA, 17 nt, Pseudomonas putida KT2440
ugccagggugccagacc

SEQ ID NO: 3536382 - RNA, 24 nt, Pseudomonas putida KT2440
ugccaggucaccgcccagcuucuc

SEQ ID NO: 3536383 - RNA, 20 nt, Pseudomonas putida KT2440
ugccagguccgagugcucga

SEQ ID NO: 3536384 - RNA, 23 nt, Pseudomonas putida KT2440
ugccaguaaggcuugcucaaggu

SEQ ID NO: 3536385 - RNA, 21 nt, Pseudomonas putida KT2440
ugccaguccuuggccaaugcc

SEQ ID NO: 3536386 - RNA, 19 nt, Pseudomonas putida KT2440
ugccagucgcacaggucca

SEQ ID NO: 3536387 - RNA, 22 nt, Pseudomonas putida KT2440
ugccagugucaguugcucgccc

SEQ ID NO: 3536388 - RNA, 16 nt, Pseudomonas putida KT2440
ugccaguguucgaacg

SEQ ID NO: 3536389 - RNA, 19 nt, Pseudomonas putida KT2440
ugccaguucaugcagcgug

SEQ ID NO: 3536390 - RNA, 19 nt, Pseudomonas putida KT2440
ugccaguugaucaccgucg

SEQ ID NO: 3536391 - RNA, 15 nt, Pseudomonas putida KT2440
ugccauacagccaga

SEQ ID NO: 3536392 - RNA, 20 nt, Pseudomonas putida KT2440
ugccauagcaccagcgggcc

SEQ ID NO: 3536393 - RNA, 13 nt, Pseudomonas putida KT2440
ugccaucagggcg

SEQ ID NO: 3536394 - RNA, 17 nt, Pseudomonas putida KT2440
ugccaucagggcgaugc

SEQ ID NO: 3536395 - RNA, 22 nt, Pseudomonas putida KT2440
ugccauccaccgcgccagccug

SEQ ID NO: 3536396 - RNA, 23 nt, Pseudomonas putida KT2440
ugccauccaccgcgccagccugg

SEQ ID NO: 3536397 - RNA, 19 nt, Pseudomonas putida KT2440
ugccauccaccgcgguguc

SEQ ID NO: 3536398 - RNA, 19 nt, Pseudomonas putida KT2440
ugccauccucggccaggcc

SEQ ID NO: 3536399 - RNA, 21 nt, Pseudomonas putida KT2440
ugccauccucggccaggccca

SEQ ID NO: 3536400 - RNA, 14 nt, Pseudomonas putida KT2440
ugccauccuugaag

SEQ ID NO: 3536401 - RNA, 18 nt, Pseudomonas putida KT2440
ugccaucgaguaucgccu

SEQ ID NO: 3536402 - RNA, 18 nt, Pseudomonas putida KT2440
ugccaucucgccaagcau

SEQ ID NO: 3536403 - RNA, 15 nt, Pseudomonas putida KT2440
ugccaugcgcugcag

SEQ ID NO: 3536404 - RNA, 14 nt, Pseudomonas putida KT2440
ugccauucaucgua

SEQ ID NO: 3536405 - RNA, 15 nt, Pseudomonas putida KT2440
ugccauucucgccgc

SEQ ID NO: 3536406 - RNA, 17 nt, Pseudomonas putida KT2440
ugccauucucgccgccg

SEQ ID NO: 3536407 - RNA, 15 nt, Pseudomonas putida KT2440
ugccauucuugucca

SEQ ID NO: 3536408 - RNA, 15 nt, Pseudomonas putida KT2440
ugccauugaucaccu

SEQ ID NO: 3536409 - RNA, 16 nt, Pseudomonas putida KT2440
ugccauugcaccaccc

SEQ ID NO: 3536410 - RNA, 20 nt, Pseudomonas putida KT2440
ugccauugcaccacccccag

SEQ ID NO: 3536411 - RNA, 22 nt, Pseudomonas putida KT2440
ugccauugcaccacccccagcg

SEQ ID NO: 3536412 - RNA, 18 nt, Pseudomonas putida KT2440
ugccauuucuucagcagg

SEQ ID NO: 3536413 - RNA, 19 nt, Pseudomonas putida KT2440
ugccauuucuucagcagga

SEQ ID NO: 3536414 - RNA, 16 nt, Pseudomonas putida KT2440
ugcccaaacgccaaca

SEQ ID NO: 3536415 - RNA, 22 nt, Pseudomonas putida KT2440
ugcccaaacgccaacagcaccc

SEQ ID NO: 3536416 - RNA, 18 nt, Pseudomonas putida KT2440
ugcccaaagcccgugccg

SEQ ID NO: 3536417 - RNA, 23 nt, Pseudomonas putida KT2440
ugcccaaagcccgugccgcauca

SEQ ID NO: 3536418 - RNA, 20 nt, Pseudomonas putida KT2440
ugcccaagcgcuccgccaau

SEQ ID NO: 3536419 - RNA, 17 nt, Pseudomonas putida KT2440
ugcccaaguacaccggc

SEQ ID NO: 3536420 - RNA, 18 nt, Pseudomonas putida KT2440
ugcccaaguacaccggca

SEQ ID NO: 3536421 - RNA, 23 nt, Pseudomonas putida KT2440
ugcccaaguaguguucgccguug

SEQ ID NO: 3536422 - RNA, 14 nt, Pseudomonas putida KT2440
ugcccaaugccgug

SEQ ID NO: 3536423 - RNA, 20 nt, Pseudomonas putida KT2440
ugcccaaugccgugauggua

SEQ ID NO: 3536424 - RNA, 22 nt, Pseudomonas putida KT2440
ugcccacauagcgcacuugcac

SEQ ID NO: 3536425 - RNA, 23 nt, Pseudomonas putida KT2440
ugcccaccaagggugucaacagg

SEQ ID NO: 3536426 - RNA, 19 nt, Pseudomonas putida KT2440
ugcccacccaaccgcgcca

SEQ ID NO: 3536427 - RNA, 22 nt, Pseudomonas putida KT2440
ugcccaccgcauugcaggccag

SEQ ID NO: 3536428 - RNA, 20 nt, Pseudomonas putida KT2440
ugcccaccgcguuggccagg

SEQ ID NO: 3536429 - RNA, 14 nt, Pseudomonas putida KT2440
ugcccaccgcugca

SEQ ID NO: 3536430 - RNA, 12 nt, Pseudomonas putida KT2440
ugcccacugcag

SEQ ID NO: 3536431 - RNA, 13 nt, Pseudomonas putida KT2440
ugcccacugcguu

SEQ ID NO: 3536432 - RNA, 23 nt, Pseudomonas putida KT2440
ugcccacugcguucaucgaacug

SEQ ID NO: 3536433 - RNA, 19 nt, Pseudomonas putida KT2440
ugcccagaucacuuccacc

SEQ ID NO: 3536434 - RNA, 21 nt, Pseudomonas putida KT2440
ugcccagcagguacaccgccu

SEQ ID NO: 3536435 - RNA, 16 nt, Pseudomonas putida KT2440
ugcccagcgccaccgg

SEQ ID NO: 3536436 - RNA, 20 nt, Pseudomonas putida KT2440
ugcccugcagcuucccggcc

SEQ ID NO: 3536437 - RNA, 21 nt, Pseudomonas putida KT2440
ugcccugcagcuucccggccu

SEQ ID NO: 3536438 - RNA, 23 nt, Pseudomonas putida KT2440
ugcccugcagcuucccggccugg

SEQ ID NO: 3536439 - RNA, 23 nt, Pseudomonas putida KT2440
ugcccuguuucuucaaggccgcc

SEQ ID NO: 3536440 - RNA, 12 nt, Pseudomonas putida KT2440
ugcccuucacug

SEQ ID NO: 3536441 - RNA, 20 nt, Pseudomonas putida KT2440
ugcccuucaugcgcccuggc

SEQ ID NO: 3536442 - RNA, 20 nt, Pseudomonas putida KT2440
ugcccuucugcgccaaagcg

SEQ ID NO: 3536443 - RNA, 13 nt, Pseudomonas putida KT2440
ugcccuugccgcc

SEQ ID NO: 3536444 - RNA, 19 nt, Pseudomonas putida KT2440
ugccgaacgauucugccag

SEQ ID NO: 3536445 - RNA, 13 nt, Pseudomonas putida KT2440
ugccgaagcccag

SEQ ID NO: 3536446 - RNA, 15 nt, Pseudomonas putida KT2440
ugccgacagccaccg

SEQ ID NO: 3536447 - RNA, 15 nt, Pseudomonas putida KT2440
ugccgacuccaacug

SEQ ID NO: 3536448 - RNA, 14 nt, Pseudomonas putida KT2440
ugccgaggcgccga

SEQ ID NO: 3536449 - RNA, 16 nt, Pseudomonas putida KT2440
ugccgaggcgccgacg

SEQ ID NO: 3536450 - RNA, 16 nt, Pseudomonas putida KT2440
ugccgagguucuucca

SEQ ID NO: 3536451 - RNA, 14 nt, Pseudomonas putida KT2440
ugccgaucagcacg

SEQ ID NO: 3536452 - RNA, 20 nt, Pseudomonas putida KT2440
ugccgaucagcacgccgccg

SEQ ID NO: 3536453 - RNA, 21 nt, Pseudomonas putida KT2440
ugccgaucagguugcccagca

SEQ ID NO: 3536454 - RNA, 21 nt, Pseudomonas putida KT2440
ugccgaucuucgcccugggcg

SEQ ID NO: 3536455 - RNA, 16 nt, Pseudomonas putida KT2440
ugccgaugaugcgggc

SEQ ID NO: 3536456 - RNA, 16 nt, Pseudomonas putida KT2440
ugccgaugcgcgugca

SEQ ID NO: 3536457 - RNA, 23 nt, Pseudomonas putida KT2440
ugccgcaccagguccaccagcag

SEQ ID NO: 3536458 - RNA, 16 nt, Pseudomonas putida KT2440
ugccgcagcaccgucg

SEQ ID NO: 3536459 - RNA, 16 nt, Pseudomonas putida KT2440
ugccgcagccccgcca

SEQ ID NO: 3536460 - RNA, 16 nt, Pseudomonas putida KT2440
ugccgcagucccgcca

SEQ ID NO: 3536461 - RNA, 14 nt, Pseudomonas putida KT2440
ugccgcaucagccg

SEQ ID NO: 3536462 - RNA, 15 nt, Pseudomonas putida KT2440
ugccgcaucagccgg

SEQ ID NO: 3536463 - RNA, 16 nt, Pseudomonas putida KT2440
ugccgccaaccagcuc

SEQ ID NO: 3536464 - RNA, 22 nt, Pseudomonas putida KT2440
ugccgccaaccagcucaccggc

SEQ ID NO: 3536465 - RNA, 17 nt, Pseudomonas putida KT2440
ugccgccagccccgcca

SEQ ID NO: 3536466 - RNA, 13 nt, Pseudomonas putida KT2440
ugccgccauccuc

SEQ ID NO: 3536467 - RNA, 15 nt, Pseudomonas putida KT2440
ugccgcccaucaccg

SEQ ID NO: 3536468 - RNA, 18 nt, Pseudomonas putida KT2440
ugccgcccaucaccggca

SEQ ID NO: 3536469 - RNA, 13 nt, Pseudomonas putida KT2440
ugccgccccucca

SEQ ID NO: 3536470 - RNA, 18 nt, Pseudomonas putida KT2440
ugccgccccuccacccac

SEQ ID NO: 3536471 - RNA, 21 nt, Pseudomonas putida KT2440
ugccgccgcagcaaucugcug

SEQ ID NO: 3536472 - RNA, 18 nt, Pseudomonas putida KT2440
ugccgccgcugccagcag

SEQ ID NO: 3536473 - RNA, 14 nt, Pseudomonas putida KT2440
ugccgccgggccug

SEQ ID NO: 3536474 - RNA, 18 nt, Pseudomonas putida KT2440
ugccgccguucaggcgcc

SEQ ID NO: 3536475 - RNA, 19 nt, Pseudomonas putida KT2440
ugccgccugggucaggcgu

SEQ ID NO: 3536476 - RNA, 12 nt, Pseudomonas putida KT2440
ugccgccugugu

SEQ ID NO: 3536477 - RNA, 18 nt, Pseudomonas putida KT2440
ugccgccuucuccagcuc

SEQ ID NO: 3536478 - RNA, 19 nt, Pseudomonas putida KT2440
ugccgccuucuccagcucg

SEQ ID NO: 3536479 - RNA, 17 nt, Pseudomonas putida KT2440
ugccgccuuggcagccu

SEQ ID NO: 3536480 - RNA, 21 nt, Pseudomonas putida KT2440
ugccgcgcccgcaaccucggc

SEQ ID NO: 3536481 - RNA, 13 nt, Pseudomonas putida KT2440
ugccgcgccgccg

SEQ ID NO: 3536482 - RNA, 22 nt, Pseudomonas putida KT2440
ugccgcggaaauaccagacgca

SEQ ID NO: 3536483 - RNA, 15 nt, Pseudomonas putida KT2440
ugccgcggguggcuu

SEQ ID NO: 3536484 - RNA, 15 nt, Pseudomonas putida KT2440
ugccgcgugcgaugu

SEQ ID NO: 3536485 - RNA, 17 nt, Pseudomonas putida KT2440
ugccgcguucacaucgc

SEQ ID NO: 3536486 - RNA, 18 nt, Pseudomonas putida KT2440
ugccgcguuccuuucuca

SEQ ID NO: 3536487 - RNA, 23 nt, Pseudomonas putida KT2440
ugccgcucaccaccaucuugcgu

SEQ ID NO: 3536488 - RNA, 16 nt, Pseudomonas putida KT2440
ugccgcucaucgaggc

SEQ ID NO: 3536489 - RNA, 14 nt, Pseudomonas putida KT2440
ugccgcugcgcggu

SEQ ID NO: 3536490 - RNA, 22 nt, Pseudomonas putida KT2440
ugccgcuggcuuccucacggca

SEQ ID NO: 3536491 - RNA, 14 nt, Pseudomonas putida KT2440
ugccgcuucgcgga

SEQ ID NO: 3536492 - RNA, 16 nt, Pseudomonas putida KT2440
ugccgcuuuggcagca

SEQ ID NO: 3536493 - RNA, 19 nt, Pseudomonas putida KT2440
ugccgcuuuggcagcagcc

SEQ ID NO: 3536494 - RNA, 21 nt, Pseudomonas putida KT2440
ugccggaacguuuccagcaac

SEQ ID NO: 3536495 - RNA, 15 nt, Pseudomonas putida KT2440
ugccggaguggaaga

SEQ ID NO: 3536496 - RNA, 17 nt, Pseudomonas putida KT2440
ugccggcacagcccagc

SEQ ID NO: 3536497 - RNA, 12 nt, Pseudomonas putida KT2440
ugccggcaccgu

SEQ ID NO: 3536498 - RNA, 17 nt, Pseudomonas putida KT2440
ugccggcagcgagcgcu

SEQ ID NO: 3536499 - RNA, 13 nt, Pseudomonas putida KT2440
ugccggcagcucg

SEQ ID NO: 3536500 - RNA, 17 nt, Pseudomonas putida KT2440
ugccggcauaacggcug

SEQ ID NO: 3536501 - RNA, 23 nt, Pseudomonas putida KT2440
ugccggcauaacggcuggcgcau

SEQ ID NO: 3536502 - RNA, 13 nt, Pseudomonas putida KT2440
ugccggccagcgg

SEQ ID NO: 3536503 - RNA, 14 nt, Pseudomonas putida KT2440
ugccggccagcggc

SEQ ID NO: 3536504 - RNA, 14 nt, Pseudomonas putida KT2440
ugccggcccaaggc

SEQ ID NO: 3536505 - RNA, 15 nt, Pseudomonas putida KT2440
ugccggcccaaggca

SEQ ID NO: 3536506 - RNA, 18 nt, Pseudomonas putida KT2440
ugccggcccaaggcacca

SEQ ID NO: 3536507 - RNA, 19 nt, Pseudomonas putida KT2440
ugccggccgcuucauauca

SEQ ID NO: 3536508 - RNA, 12 nt, Pseudomonas putida KT2440
ugccggccucuu

SEQ ID NO: 3536509 - RNA, 20 nt, Pseudomonas putida KT2440
ugccggccucuucgcggccu

SEQ ID NO: 3536510 - RNA, 21 nt, Pseudomonas putida KT2440
ugccggccucuucgcgggcaa

SEQ ID NO: 3536511 - RNA, 20 nt, Pseudomonas putida KT2440
ugccggccucuucgcgggua

SEQ ID NO: 3536512 - RNA, 20 nt, Pseudomonas putida KT2440
ugccggccucuucgcgggug

SEQ ID NO: 3536513 - RNA, 12 nt, Pseudomonas putida KT2440
ugccggccuuga

SEQ ID NO: 3536514 - RNA, 23 nt, Pseudomonas putida KT2440
ugccggcgaauccagccggcccg

SEQ ID NO: 3536515 - RNA, 15 nt, Pseudomonas putida KT2440
ugccggcgagcgcgu

SEQ ID NO: 3536516 - RNA, 19 nt, Pseudomonas putida KT2440
ugccgggccaccaccgcgu

SEQ ID NO: 3536517 - RNA, 14 nt, Pseudomonas putida KT2440
ugccgggccagggu

SEQ ID NO: 3536518 - RNA, 21 nt, Pseudomonas putida KT2440
ugccgggcuuuuuugugccuc

SEQ ID NO: 3536519 - RNA, 14 nt, Pseudomonas putida KT2440
ugccggguaguucu

SEQ ID NO: 3536520 - RNA, 14 nt, Pseudomonas putida KT2440
ugccgggucggccu

SEQ ID NO: 3536521 - RNA, 19 nt, Pseudomonas putida KT2440
ugccgggucggccugcucg

SEQ ID NO: 3536522 - RNA, 16 nt, Pseudomonas putida KT2440
ugccgggugcaucggc

SEQ ID NO: 3536523 - RNA, 17 nt, Pseudomonas putida KT2440
ugccgggugcaucggca

SEQ ID NO: 3536524 - RNA, 13 nt, Pseudomonas putida KT2440
ugccgguagugau

SEQ ID NO: 3536525 - RNA, 22 nt, Pseudomonas putida KT2440
ugccgguagugaugcaucagcu

SEQ ID NO: 3536526 - RNA, 14 nt, Pseudomonas putida KT2440
ugccggucagcagc

SEQ ID NO: 3536527 - RNA, 15 nt, Pseudomonas putida KT2440
ugccggucagcagca

SEQ ID NO: 3536528 - RNA, 13 nt, Pseudomonas putida KT2440
ugccggucggccu

SEQ ID NO: 3536529 - RNA, 14 nt, Pseudomonas putida KT2440
ugccggucggccug

SEQ ID NO: 3536530 - RNA, 16 nt, Pseudomonas putida KT2440
ugccggugcgcgggcg

SEQ ID NO: 3536531 - RNA, 19 nt, Pseudomonas putida KT2440
ugccgguggugaaaugguu

SEQ ID NO: 3536532 - RNA, 21 nt, Pseudomonas putida KT2440
ugccgguguaguugaccgacg

SEQ ID NO: 3536533 - RNA, 18 nt, Pseudomonas putida KT2440
ugccgguguucgcgggug

SEQ ID NO: 3536534 - RNA, 18 nt, Pseudomonas putida KT2440
ugccgguuuuugccgcga

SEQ ID NO: 3536535 - RNA, 21 nt, Pseudomonas putida KT2440
ugccguaggugaucagcuugc

SEQ ID NO: 3536536 - RNA, 18 nt, Pseudomonas putida KT2440
ugccguaguaagccagcc

SEQ ID NO: 3536537 - RNA, 21 nt, Pseudomonas putida KT2440
ugccgucaaaaaucucgacga

SEQ ID NO: 3536538 - RNA, 13 nt, Pseudomonas putida KT2440
ugccgucagccga

SEQ ID NO: 3536539 - RNA, 21 nt, Pseudomonas putida KT2440
ugccguccagguccaggccag

SEQ ID NO: 3536540 - RNA, 12 nt, Pseudomonas putida KT2440
ugccguccgcug

SEQ ID NO: 3536541 - RNA, 22 nt, Pseudomonas putida KT2440
ugccguccgcugccuuccaacc

SEQ ID NO: 3536542 - RNA, 21 nt, Pseudomonas putida KT2440
ugcgcacgcgcuuuuccagca

SEQ ID NO: 3536543 - RNA, 14 nt, Pseudomonas putida KT2440
ugcgcacggaaggc

SEQ ID NO: 3536544 - RNA, 23 nt, Pseudomonas putida KT2440
ugcgcacggaaggcaucgaacuc

SEQ ID NO: 3536545 - RNA, 16 nt, Pseudomonas putida KT2440
ugcgcacguaggcggg

SEQ ID NO: 3536546 - RNA, 22 nt, Pseudomonas putida KT2440
ugcgcacguuggccggguuuac

SEQ ID NO: 3536547 - RNA, 13 nt, Pseudomonas putida KT2440
ugcgcagagccac

SEQ ID NO: 3536548 - RNA, 12 nt, Pseudomonas putida KT2440
ugcgcagcagca

SEQ ID NO: 3536549 - RNA, 15 nt, Pseudomonas putida KT2440
ugcgcagcagcaggc

SEQ ID NO: 3536550 - RNA, 14 nt, Pseudomonas putida KT2440
ugcgcagcccuccc

SEQ ID NO: 3536551 - RNA, 15 nt, Pseudomonas putida KT2440
ugcgcagcccuguca

SEQ ID NO: 3536552 - RNA, 23 nt, Pseudomonas putida KT2440
ugcgcagcuggucgagcaaggca

SEQ ID NO: 3536553 - RNA, 20 nt, Pseudomonas putida KT2440
ugcgcaggcgccgccagcug

SEQ ID NO: 3536554 - RNA, 23 nt, Pseudomonas putida KT2440
ugcgcagguacacgggcaugcca

SEQ ID NO: 3536555 - RNA, 12 nt, Pseudomonas putida KT2440
ugcgcagguaua

SEQ ID NO: 3536556 - RNA, 13 nt, Pseudomonas putida KT2440
ugcgcaguaccug

SEQ ID NO: 3536557 - RNA, 14 nt, Pseudomonas putida KT2440
ugcgcauaucccuc

SEQ ID NO: 3536558 - RNA, 13 nt, Pseudomonas putida KT2440
ugcgcaucaccuc

SEQ ID NO: 3536559 - RNA, 14 nt, Pseudomonas putida KT2440
ugcgcaugcccgcg

SEQ ID NO: 3536560 - RNA, 12 nt, Pseudomonas putida KT2440
ugcgcaugcgcg

SEQ ID NO: 3536561 - RNA, 21 nt, Pseudomonas putida KT2440
ugcgcaugcgcgccauggccu

SEQ ID NO: 3536562 - RNA, 13 nt, Pseudomonas putida KT2440
ugcgcauggccgc

SEQ ID NO: 3536563 - RNA, 20 nt, Pseudomonas putida KT2440
ugcgccaaaaccuguuccag

SEQ ID NO: 3536564 - RNA, 23 nt, Pseudomonas putida KT2440
ugcgccaaaaccuguuccagccc

SEQ ID NO: 3536565 - RNA, 16 nt, Pseudomonas putida KT2440
ugcgccaaagcgagca

SEQ ID NO: 3536566 - RNA, 22 nt, Pseudomonas putida KT2440
ugcgccacacccgcuacaccgg

SEQ ID NO: 3536567 - RNA, 21 nt, Pseudomonas putida KT2440
ugcgccaccucggcgaaaagc

SEQ ID NO: 3536568 - RNA, 20 nt, Pseudomonas putida KT2440
ugcgccagcaguuucagcgg

SEQ ID NO: 3536569 - RNA, 21 nt, Pseudomonas putida KT2440
ugcgccagcaguuucagcggc

SEQ ID NO: 3536570 - RNA, 20 nt, Pseudomonas putida KT2440
ugcgccaggaucaacugccg

SEQ ID NO: 3536571 - RNA, 19 nt, Pseudomonas putida KT2440
ugcgccaggcaucccauuc

SEQ ID NO: 3536572 - RNA, 13 nt, Pseudomonas putida KT2440
ugcgccaggcauu

SEQ ID NO: 3536573 - RNA, 22 nt, Pseudomonas putida KT2440
ugcgccaggcauuccccgguca

SEQ ID NO: 3536574 - RNA, 13 nt, Pseudomonas putida KT2440
ugcgccaggcgca

SEQ ID NO: 3536575 - RNA, 22 nt, Pseudomonas putida KT2440
ugcgccaguggcacccacagcg

SEQ ID NO: 3536576 - RNA, 15 nt, Pseudomonas putida KT2440
ugcgccaguggguug

SEQ ID NO: 3536577 - RNA, 22 nt, Pseudomonas putida KT2440
ugcgccaguuguaguucccgcg

SEQ ID NO: 3536578 - RNA, 15 nt, Pseudomonas putida KT2440
ugcgccaucagaggc

SEQ ID NO: 3536579 - RNA, 22 nt, Pseudomonas putida KT2440
ugcgccaucagaggcgauggca

SEQ ID NO: 3536580 - RNA, 15 nt, Pseudomonas putida KT2440
ugcgccccacuucca

SEQ ID NO: 3536581 - RNA, 22 nt, Pseudomonas putida KT2440
ugcgccccacuuccagcgacaa

SEQ ID NO: 3536582 - RNA, 23 nt, Pseudomonas putida KT2440
ugcgccccccauagcaggaacac

SEQ ID NO: 3536583 - RNA, 22 nt, Pseudomonas putida KT2440
ugcgccccgcucgccuggccau

SEQ ID NO: 3536584 - RNA, 19 nt, Pseudomonas putida KT2440
ugcgccccgguacgacgca

SEQ ID NO: 3536585 - RNA, 15 nt, Pseudomonas putida KT2440
ugcgccccguccaca

SEQ ID NO: 3536586 - RNA, 20 nt, Pseudomonas putida KT2440
ugcgccccguccacagcgau

SEQ ID NO: 3536587 - RNA, 19 nt, Pseudomonas putida KT2440
ugcgccccucaucaaacca

SEQ ID NO: 3536588 - RNA, 15 nt, Pseudomonas putida KT2440
ugcgcccgaucaccg

SEQ ID NO: 3536589 - RNA, 18 nt, Pseudomonas putida KT2440
ugcgcccggcaaacacau

SEQ ID NO: 3536590 - RNA, 15 nt, Pseudomonas putida KT2440
ugcgcccggccaggu

SEQ ID NO: 3536591 - RNA, 17 nt, Pseudomonas putida KT2440
ugcgcccggccagguca

SEQ ID NO: 3536592 - RNA, 22 nt, Pseudomonas putida KT2440
ugcgcccggcgcugaucagcug

SEQ ID NO: 3536593 - RNA, 11 nt, Pseudomonas putida KT2440
ugcgcccugcu

SEQ ID NO: 3536594 - RNA, 18 nt, Pseudomonas putida KT2440
ugcgccgagaccuguggu

SEQ ID NO: 3536595 - RNA, 20 nt, Pseudomonas putida KT2440
ugcgccgcucgcccagcagc

SEQ ID NO: 3536596 - RNA, 15 nt, Pseudomonas putida KT2440
ugcgccgcucugccc

SEQ ID NO: 3536597 - RNA, 18 nt, Pseudomonas putida KT2440
ugcgccgcucugcccgcg

SEQ ID NO: 3536598 - RNA, 14 nt, Pseudomonas putida KT2440
ugcgccggccaagu

SEQ ID NO: 3536599 - RNA, 17 nt, Pseudomonas putida KT2440
ugcgccggcuugccuuc

SEQ ID NO: 3536600 - RNA, 18 nt, Pseudomonas putida KT2440
ugcgccgggacagcacca

SEQ ID NO: 3536601 - RNA, 14 nt, Pseudomonas putida KT2440
ugcgccgucaccag

SEQ ID NO: 3536602 - RNA, 16 nt, Pseudomonas putida KT2440
ugcgccgucaccagcg

SEQ ID NO: 3536603 - RNA, 16 nt, Pseudomonas putida KT2440
ugcgccgucgccuccc

SEQ ID NO: 3536604 - RNA, 13 nt, Pseudomonas putida KT2440
ugcgccguggccg

SEQ ID NO: 3536605 - RNA, 14 nt, Pseudomonas putida KT2440
ugcgccucaugcag

SEQ ID NO: 3536606 - RNA, 15 nt, Pseudomonas putida KT2440
ugcgccucaugcagc

SEQ ID NO: 3536607 - RNA, 16 nt, Pseudomonas putida KT2440
ugcgccucaugcagca

SEQ ID NO: 3536608 - RNA, 13 nt, Pseudomonas putida KT2440
ugcgccuccagca

SEQ ID NO: 3536609 - RNA, 16 nt, Pseudomonas putida KT2440
ugcgccuccagcagcg

SEQ ID NO: 3536610 - RNA, 13 nt, Pseudomonas putida KT2440
ugcgccucgcagg

SEQ ID NO: 3536611 - RNA, 12 nt, Pseudomonas putida KT2440
ugcgccugaccg

SEQ ID NO: 3536612 - RNA, 18 nt, Pseudomonas putida KT2440
ugcgccugcaaacgcagg

SEQ ID NO: 3536613 - RNA, 22 nt, Pseudomonas putida KT2440
ugcgccugcaguucgcugcgca

SEQ ID NO: 3536614 - RNA, 16 nt, Pseudomonas putida KT2440
ugcgccugccgggcca

SEQ ID NO: 3536615 - RNA, 17 nt, Pseudomonas putida KT2440
ugcgccugccgggccag

SEQ ID NO: 3536616 - RNA, 19 nt, Pseudomonas putida KT2440
ugcgccugcgggugccgug

SEQ ID NO: 3536617 - RNA, 17 nt, Pseudomonas putida KT2440
ugcgccugcugguacag

SEQ ID NO: 3536618 - RNA, 20 nt, Pseudomonas putida KT2440
ugcgccugcugguacagccg

SEQ ID NO: 3536619 - RNA, 21 nt, Pseudomonas putida KT2440
ugcgccugcugguacagccgg

SEQ ID NO: 3536620 - RNA, 14 nt, Pseudomonas putida KT2440
ugcgccuggcccgc

SEQ ID NO: 3536621 - RNA, 22 nt, Pseudomonas putida KT2440
ugcgccuggcccgcagcgcuuc

SEQ ID NO: 3536622 - RNA, 23 nt, Pseudomonas putida KT2440
ugcgccugggaaaccgugucggg

SEQ ID NO: 3536623 - RNA, 12 nt, Pseudomonas putida KT2440
ugcgccugugca

SEQ ID NO: 3536624 - RNA, 15 nt, Pseudomonas putida KT2440
ugcgccuugcuuggc

SEQ ID NO: 3536625 - RNA, 18 nt, Pseudomonas putida KT2440
ugcgccuugcuuggcagc

SEQ ID NO: 3536626 - RNA, 21 nt, Pseudomonas putida KT2440
ugcgccuuuuccaccagcccu

SEQ ID NO: 3536627 - RNA, 20 nt, Pseudomonas putida KT2440
ugcgcgaaguggauauccag

SEQ ID NO: 3536628 - RNA, 22 nt, Pseudomonas putida KT2440
ugcgcgaucgcuuguaggagcg

SEQ ID NO: 3536629 - RNA, 19 nt, Pseudomonas putida KT2440
ugcgcgauucggggaugau

SEQ ID NO: 3536630 - RNA, 17 nt, Pseudomonas putida KT2440
ugcgcgcauccagcagg

SEQ ID NO: 3536631 - RNA, 12 nt, Pseudomonas putida KT2440
ugcgcgccagcg

SEQ ID NO: 3536632 - RNA, 16 nt, Pseudomonas putida KT2440
ugcgcgccgccaggcg

SEQ ID NO: 3536633 - RNA, 20 nt, Pseudomonas putida KT2440
ugcgcgccguugcacgucau

SEQ ID NO: 3536634 - RNA, 14 nt, Pseudomonas putida KT2440
ugcgcgcgcgacag

SEQ ID NO: 3536635 - RNA, 18 nt, Pseudomonas putida KT2440
ugcgcgcgcgacagcacg

SEQ ID NO: 3536636 - RNA, 18 nt, Pseudomonas putida KT2440
ugcgcgcgcgguucacca

SEQ ID NO: 3536637 - RNA, 21 nt, Pseudomonas putida KT2440
ugcgcgcgcgguucaccagca

SEQ ID NO: 3536638 - RNA, 15 nt, Pseudomonas putida KT2440
ugcgcggaacagguu

SEQ ID NO: 3536639 - RNA, 13 nt, Pseudomonas putida KT2440
ugcgcggccacua

SEQ ID NO: 3536640 - RNA, 14 nt, Pseudomonas putida KT2440
ugcgcggccguggu

SEQ ID NO: 3536641 - RNA, 13 nt, Pseudomonas putida KT2440
ugcgcggcucgcu

SEQ ID NO: 3536642 - RNA, 19 nt, Pseudomonas putida KT2440
ugcgcgguaaacgggaagu

SEQ ID NO: 3536643 - RNA, 17 nt, Pseudomonas putida KT2440
ugcgcguauccuugccc

SEQ ID NO: 3536644 - RNA, 18 nt, Pseudomonas putida KT2440
ugcgcguauccuugccca

SEQ ID NO: 3536645 - RNA, 12 nt, Pseudomonas putida KT2440
ugcgcucaacca

SEQ ID NO: 3536646 - RNA, 13 nt, Pseudomonas putida KT2440
ugcgcucaaccag

SEQ ID NO: 3536647 - RNA, 15 nt, Pseudomonas putida KT2440
ugcgcucaaccagcc

SEQ ID NO: 3536648 - RNA, 20 nt, Pseudomonas putida KT2440
ugcgucgcgaaagggccgca

SEQ ID NO: 3536649 - RNA, 21 nt, Pseudomonas putida KT2440
ugcgucgcgaugggcugcaaa

SEQ ID NO: 3536650 - RNA, 20 nt, Pseudomonas putida KT2440
ugcgucggccgaugucuuug

SEQ ID NO: 3536651 - RNA, 15 nt, Pseudomonas putida KT2440
ugcgugaaacgcagc

SEQ ID NO: 3536652 - RNA, 16 nt, Pseudomonas putida KT2440
ugcgugaacacugcca

SEQ ID NO: 3536653 - RNA, 23 nt, Pseudomonas putida KT2440
ugcgugauuugaacuugcgcauc

SEQ ID NO: 3536654 - RNA, 16 nt, Pseudomonas putida KT2440
ugcgugcaacgccuug

SEQ ID NO: 3536655 - RNA, 17 nt, Pseudomonas putida KT2440
ugcgugcaguguguugc

SEQ ID NO: 3536656 - RNA, 22 nt, Pseudomonas putida KT2440
ugcgugccucagccaggcugag

SEQ ID NO: 3536657 - RNA, 17 nt, Pseudomonas putida KT2440
ugcgugccuugccuggg

SEQ ID NO: 3536658 - RNA, 20 nt, Pseudomonas putida KT2440
ugcgugccuugccugggccg

SEQ ID NO: 3536659 - RNA, 19 nt, Pseudomonas putida KT2440
ugcguggccuguaccgacc

SEQ ID NO: 3536660 - RNA, 23 nt, Pseudomonas putida KT2440
ugcguugaccugcugggucagcg

SEQ ID NO: 3536661 - RNA, 20 nt, Pseudomonas putida KT2440
ugcguugcagccccagccuc

SEQ ID NO: 3536662 - RNA, 19 nt, Pseudomonas putida KT2440
ugcguuguucgaucagccg

SEQ ID NO: 3536663 - RNA, 18 nt, Pseudomonas putida KT2440
ugcguuuaccggcaccgc

SEQ ID NO: 3536664 - RNA, 16 nt, Pseudomonas putida KT2440
ugcguuucuucauccc

SEQ ID NO: 3536665 - RNA, 15 nt, Pseudomonas putida KT2440
ugcguuuuaaaagaa

SEQ ID NO: 3536666 - RNA, 14 nt, Pseudomonas putida KT2440
ugcuaauuucaggu

SEQ ID NO: 3536667 - RNA, 16 nt, Pseudomonas putida KT2440
ugcuaauuucagguuu

SEQ ID NO: 3536668 - RNA, 13 nt, Pseudomonas putida KT2440
ugcuacgccgccg

SEQ ID NO: 3536669 - RNA, 23 nt, Pseudomonas putida KT2440
ugcuauaucucugguacaacaac

SEQ ID NO: 3536670 - RNA, 22 nt, Pseudomonas putida KT2440
ugcucaaccggugcaacugcca

SEQ ID NO: 3536671 - RNA, 18 nt, Pseudomonas putida KT2440
ugcucaacuucccucugc

SEQ ID NO: 3536672 - RNA, 20 nt, Pseudomonas putida KT2440
ugcucaacuucccucugccu

SEQ ID NO: 3536673 - RNA, 21 nt, Pseudomonas putida KT2440
ugcucaacuucccucugccug

SEQ ID NO: 3536674 - RNA, 17 nt, Pseudomonas putida KT2440
ugcucaagcgccagggc

SEQ ID NO: 3536675 - RNA, 23 nt, Pseudomonas putida KT2440
ugcucaaggcacuugggaucgau

SEQ ID NO: 3536676 - RNA, 18 nt, Pseudomonas putida KT2440
ugcucaaucaaccagccc

SEQ ID NO: 3536677 - RNA, 20 nt, Pseudomonas putida KT2440
ugcucacgcacgaucucccg

SEQ ID NO: 3536678 - RNA, 17 nt, Pseudomonas putida KT2440
ugcucacugaccaccug

SEQ ID NO: 3536679 - RNA, 22 nt, Pseudomonas putida KT2440
ugcucagcugggcguuuccagg

SEQ ID NO: 3536680 - RNA, 13 nt, Pseudomonas putida KT2440
ugcucaggaacau

SEQ ID NO: 3536681 - RNA, 13 nt, Pseudomonas putida KT2440
ugcucaggcgcuc

SEQ ID NO: 3536682 - RNA, 17 nt, Pseudomonas putida KT2440
ugcucaggcgggcagcg

SEQ ID NO: 3536683 - RNA, 20 nt, Pseudomonas putida KT2440
ugcucaucgcggccgaaggc

SEQ ID NO: 3536684 - RNA, 18 nt, Pseudomonas putida KT2440
ugcucaucggcgccggcc

SEQ ID NO: 3536685 - RNA, 16 nt, Pseudomonas putida KT2440
ugcucaucugcgccag

SEQ ID NO: 3536686 - RNA, 12 nt, Pseudomonas putida KT2440
ugcucaugcgcg

SEQ ID NO: 3536687 - RNA, 18 nt, Pseudomonas putida KT2440
ugcucaugggucaacagg

SEQ ID NO: 3536688 - RNA, 12 nt, Pseudomonas putida KT2440
ugcuccaacccc

SEQ ID NO: 3536689 - RNA, 14 nt, Pseudomonas putida KT2440
ugcuccaaccccag

SEQ ID NO: 3536690 - RNA, 15 nt, Pseudomonas putida KT2440
ugcuccaagugccgu

SEQ ID NO: 3536691 - RNA, 19 nt, Pseudomonas putida KT2440
ugcuccacaaucucgcccu

SEQ ID NO: 3536692 - RNA, 17 nt, Pseudomonas putida KT2440
ugcuccaccaaggcuga

SEQ ID NO: 3536693 - RNA, 17 nt, Pseudomonas putida KT2440
ugcuccacccgugcagg

SEQ ID NO: 3536694 - RNA, 11 nt, Pseudomonas putida KT2440
ugcuccagcac

SEQ ID NO: 3536695 - RNA, 22 nt, Pseudomonas putida KT2440
ugcuccagcguguucaaugccc

SEQ ID NO: 3536696 - RNA, 17 nt, Pseudomonas putida KT2440
ugcuccagcuccaggcg

SEQ ID NO: 3536697 - RNA, 20 nt, Pseudomonas putida KT2440
ugcuccaggccugcggcagc

SEQ ID NO: 3536698 - RNA, 22 nt, Pseudomonas putida KT2440
ugcuccaggccugcggcagcca

SEQ ID NO: 3536699 - RNA, 13 nt, Pseudomonas putida KT2440
ugcuccaugggca

SEQ ID NO: 3536700 - RNA, 22 nt, Pseudomonas putida KT2440
ugcucccacaggggaucgcgca

SEQ ID NO: 3536701 - RNA, 21 nt, Pseudomonas putida KT2440
ugcucccagaaaggccgcugu

SEQ ID NO: 3536702 - RNA, 23 nt, Pseudomonas putida KT2440
ugcucccagaaaggccgcugugc

SEQ ID NO: 3536703 - RNA, 19 nt, Pseudomonas putida KT2440
ugcuccccaaccaccuccc

SEQ ID NO: 3536704 - RNA, 21 nt, Pseudomonas putida KT2440
ugcucccgcaggggcugcgca

SEQ ID NO: 3536705 - RNA, 22 nt, Pseudomonas putida KT2440
ugcucccgcaggggcugcgcaa

SEQ ID NO: 3536706 - RNA, 18 nt, Pseudomonas putida KT2440
ugcuccgcgaggcucuug

SEQ ID NO: 3536707 - RNA, 11 nt, Pseudomonas putida KT2440
ugcuccggccg

SEQ ID NO: 3536708 - RNA, 14 nt, Pseudomonas putida KT2440
ugcuccggccggcc

SEQ ID NO: 3536709 - RNA, 16 nt, Pseudomonas putida KT2440
ugcuccggcgacagcu

SEQ ID NO: 3536710 - RNA, 24 nt, Pseudomonas putida KT2440
ugcuccuugagguagucgauccag

SEQ ID NO: 3536711 - RNA, 20 nt, Pseudomonas putida KT2440
ugcucgaacucuuccagcuc

SEQ ID NO: 3536712 - RNA, 21 nt, Pseudomonas putida KT2440
ugcucgaacucuuccagcucg

SEQ ID NO: 3536713 - RNA, 17 nt, Pseudomonas putida KT2440
ugcucgacaagccgcug

SEQ ID NO: 3536714 - RNA, 14 nt, Pseudomonas putida KT2440
ugcucgaggaagcu

SEQ ID NO: 3536715 - RNA, 19 nt, Pseudomonas putida KT2440
ugcucgaugcgcacggcau

SEQ ID NO: 3536716 - RNA, 16 nt, Pseudomonas putida KT2440
ugcucgcagacuucga

SEQ ID NO: 3536717 - RNA, 15 nt, Pseudomonas putida KT2440
ugcucgccaucuggc

SEQ ID NO: 3536718 - RNA, 12 nt, Pseudomonas putida KT2440
ugcucgccggcc

SEQ ID NO: 3536719 - RNA, 19 nt, Pseudomonas putida KT2440
ugcucgccugcuuggcacc

SEQ ID NO: 3536720 - RNA, 18 nt, Pseudomonas putida KT2440
ugcucgcgcaugaucgcu

SEQ ID NO: 3536721 - RNA, 13 nt, Pseudomonas putida KT2440
ugcucgcgcuuga

SEQ ID NO: 3536722 - RNA, 16 nt, Pseudomonas putida KT2440
ugcucgcgggccugga

SEQ ID NO: 3536723 - RNA, 19 nt, Pseudomonas putida KT2440
ugcucgcucaggcucuuga

SEQ ID NO: 3536724 - RNA, 20 nt, Pseudomonas putida KT2440
ugcucgcucaggcucuugaa

SEQ ID NO: 3536725 - RNA, 14 nt, Pseudomonas putida KT2440
ugcucgcugccacg

SEQ ID NO: 3536726 - RNA, 16 nt, Pseudomonas putida KT2440
ugcucgcugcugccuu

SEQ ID NO: 3536727 - RNA, 17 nt, Pseudomonas putida KT2440
ugcucgcugcugccuuc

SEQ ID NO: 3536728 - RNA, 14 nt, Pseudomonas putida KT2440
ugcucgcuggcuug

SEQ ID NO: 3536729 - RNA, 13 nt, Pseudomonas putida KT2440
ugcucggcaccac

SEQ ID NO: 3536730 - RNA, 11 nt, Pseudomonas putida KT2440
ugcucggccag

SEQ ID NO: 3536731 - RNA, 13 nt, Pseudomonas putida KT2440
ugcucggccuugc

SEQ ID NO: 3536732 - RNA, 17 nt, Pseudomonas putida KT2440
ugcucggcgaugccgcg

SEQ ID NO: 3536733 - RNA, 15 nt, Pseudomonas putida KT2440
ugcucgggguuggug

SEQ ID NO: 3536734 - RNA, 20 nt, Pseudomonas putida KT2440
ugcucggugcugcugccauc

SEQ ID NO: 3536735 - RNA, 14 nt, Pseudomonas putida KT2440
ugcucgucagcccc

SEQ ID NO: 3536736 - RNA, 17 nt, Pseudomonas putida KT2440
ugcucguccaguuccag

SEQ ID NO: 3536737 - RNA, 19 nt, Pseudomonas putida KT2440
ugcucguccaucaccgcca

SEQ ID NO: 3536738 - RNA, 15 nt, Pseudomonas putida KT2440
ugcucgucucuggcc

SEQ ID NO: 3536739 - RNA, 22 nt, Pseudomonas putida KT2440
ugcucugcaggcacacccggac

SEQ ID NO: 3536740 - RNA, 18 nt, Pseudomonas putida KT2440
ugcucuucaaccaguuca

SEQ ID NO: 3536741 - RNA, 13 nt, Pseudomonas putida KT2440
ugcucuucaccug

SEQ ID NO: 3536742 - RNA, 19 nt, Pseudomonas putida KT2440
ugcucuucgauccgcgcca

SEQ ID NO: 3536743 - RNA, 15 nt, Pseudomonas putida KT2440
ugcugaccaccgugc

SEQ ID NO: 3536744 - RNA, 14 nt, Pseudomonas putida KT2440
ugcugacccggaau

SEQ ID NO: 3536745 - RNA, 13 nt, Pseudomonas putida KT2440
ugcugacgacgcg

SEQ ID NO: 3536746 - RNA, 22 nt, Pseudomonas putida KT2440
ugcugagaucucugugggagcg

SEQ ID NO: 3536747 - RNA, 21 nt, Pseudomonas putida KT2440
ugcugaugauauuugccacuc

SEQ ID NO: 3536748 - RNA, 14 nt, Pseudomonas putida KT2440
ugcugcaacagcuc

SEQ ID NO: 3536749 - RNA, 19 nt, Pseudomonas putida KT2440
ugcugcaacagcucaucca

SEQ ID NO: 3536750 - RNA, 16 nt, Pseudomonas putida KT2440
ugcugcaacagcucca

SEQ ID NO: 3536751 - RNA, 20 nt, Pseudomonas putida KT2440
ugcugcagaaccgccagcac

SEQ ID NO: 3536752 - RNA, 18 nt, Pseudomonas putida KT2440
ugcugcagcacugccugc

SEQ ID NO: 3536753 - RNA, 14 nt, Pseudomonas putida KT2440
uggaauaccaccuc

SEQ ID NO: 3536754 - RNA, 19 nt, Pseudomonas putida KT2440
uggaaugcacauuccgcac

SEQ ID NO: 3536755 - RNA, 17 nt, Pseudomonas putida KT2440
uggaauuauuggccagc

SEQ ID NO: 3536756 - RNA, 16 nt, Pseudomonas putida KT2440
uggaauucgcugcgca

SEQ ID NO: 3536757 - RNA, 15 nt, Pseudomonas putida KT2440
uggacaaucucggca

SEQ ID NO: 3536758 - RNA, 15 nt, Pseudomonas putida KT2440
uggacagcaauucca

SEQ ID NO: 3536759 - RNA, 12 nt, Pseudomonas putida KT2440
uggacagcagcu

SEQ ID NO: 3536760 - RNA, 23 nt, Pseudomonas putida KT2440
uggacagcagcuugaacaacggc

SEQ ID NO: 3536761 - RNA, 15 nt, Pseudomonas putida KT2440
uggacagcggcagca

SEQ ID NO: 3536762 - RNA, 23 nt, Pseudomonas putida KT2440
uggacagcggcagcaucgaccug

SEQ ID NO: 3536763 - RNA, 23 nt, Pseudomonas putida KT2440
uggaccgacuucaaaaccagaug

SEQ ID NO: 3536764 - RNA, 23 nt, Pseudomonas putida KT2440
uggacgccgcaccgucgaugucg

SEQ ID NO: 3536765 - RNA, 22 nt, Pseudomonas putida KT2440
uggacggccggugguaauuggc

SEQ ID NO: 3536766 - RNA, 23 nt, Pseudomonas putida KT2440
uggacugggaaaccuccggcauc

SEQ ID NO: 3536767 - RNA, 14 nt, Pseudomonas putida KT2440
uggacugugggagc

SEQ ID NO: 3536768 - RNA, 21 nt, Pseudomonas putida KT2440
uggacuucaucgcgggccagg

SEQ ID NO: 3536769 - RNA, 15 nt, Pseudomonas putida KT2440
uggacuugccuuggc

SEQ ID NO: 3536770 - RNA, 22 nt, Pseudomonas putida KT2440
uggagagguacacccccagguu

SEQ ID NO: 3536771 - RNA, 23 nt, Pseudomonas putida KT2440
uggagaucgucguaggagcgggu

SEQ ID NO: 3536772 - RNA, 20 nt, Pseudomonas putida KT2440
uggagaucuugucgaccugg

SEQ ID NO: 3536773 - RNA, 14 nt, Pseudomonas putida KT2440
uggagcggccuugu

SEQ ID NO: 3536774 - RNA, 22 nt, Pseudomonas putida KT2440
uggagcguuauaccggcccuga

SEQ ID NO: 3536775 - RNA, 23 nt, Pseudomonas putida KT2440
uggagcguuauaccggcccugau

SEQ ID NO: 3536776 - RNA, 14 nt, Pseudomonas putida KT2440
uggaggaguccagc

SEQ ID NO: 3536777 - RNA, 16 nt, Pseudomonas putida KT2440
uggaggcugggcguga

SEQ ID NO: 3536778 - RNA, 17 nt, Pseudomonas putida KT2440
uggaguacgggcacacc

SEQ ID NO: 3536779 - RNA, 22 nt, Pseudomonas putida KT2440
uggagucgacacgcuuuucagg

SEQ ID NO: 3536780 - RNA, 14 nt, Pseudomonas putida KT2440
uggaguugcucgag

SEQ ID NO: 3536781 - RNA, 17 nt, Pseudomonas putida KT2440
uggaguugucacuccag

SEQ ID NO: 3536782 - RNA, 14 nt, Pseudomonas putida KT2440
uggauagagcaucc

SEQ ID NO: 3536783 - RNA, 18 nt, Pseudomonas putida KT2440
uggauagaguacucggcu

SEQ ID NO: 3536784 - RNA, 19 nt, Pseudomonas putida KT2440
uggauagaguacucggcua

SEQ ID NO: 3536785 - RNA, 18 nt, Pseudomonas putida KT2440
uggauagcagcucaacca

SEQ ID NO: 3536786 - RNA, 17 nt, Pseudomonas putida KT2440
uggauaugcuccauguu

SEQ ID NO: 3536787 - RNA, 22 nt, Pseudomonas putida KT2440
uggaucaccaccgucgaagccc

SEQ ID NO: 3536788 - RNA, 21 nt, Pseudomonas putida KT2440
uggaucacugccagcaccugg

SEQ ID NO: 3536789 - RNA, 14 nt, Pseudomonas putida KT2440
uggaucagccgcgc

SEQ ID NO: 3536790 - RNA, 19 nt, Pseudomonas putida KT2440
uggaucccacgcccggcca

SEQ ID NO: 3536791 - RNA, 16 nt, Pseudomonas putida KT2440
uggauccgccaccaac

SEQ ID NO: 3536792 - RNA, 15 nt, Pseudomonas putida KT2440
uggaucgccaggcug

SEQ ID NO: 3536793 - RNA, 12 nt, Pseudomonas putida KT2440
uggaucggcgug

SEQ ID NO: 3536794 - RNA, 17 nt, Pseudomonas putida KT2440
uggaucguggccggcau

SEQ ID NO: 3536795 - RNA, 11 nt, Pseudomonas putida KT2440
uggaucuugcu

SEQ ID NO: 3536796 - RNA, 20 nt, Pseudomonas putida KT2440
uggaugaucggcuggccauu

SEQ ID NO: 3536797 - RNA, 15 nt, Pseudomonas putida KT2440
uggaugcgggcuuuc

SEQ ID NO: 3536798 - RNA, 20 nt, Pseudomonas putida KT2440
uggauggcaccggcuuugcc

SEQ ID NO: 3536799 - RNA, 18 nt, Pseudomonas putida KT2440
uggauggucacgccaucc

SEQ ID NO: 3536800 - RNA, 22 nt, Pseudomonas putida KT2440
uggauggugcgcucguaggcug

SEQ ID NO: 3536801 - RNA, 18 nt, Pseudomonas putida KT2440
uggauuccucgcgcuugc

SEQ ID NO: 3536802 - RNA, 15 nt, Pseudomonas putida KT2440
uggcaaacagcacca

SEQ ID NO: 3536803 - RNA, 18 nt, Pseudomonas putida KT2440
uggcaaacagcaccagcc

SEQ ID NO: 3536804 - RNA, 16 nt, Pseudomonas putida KT2440
uggcaaacgccuguuu

SEQ ID NO: 3536805 - RNA, 19 nt, Pseudomonas putida KT2440
uggcaaacgccuguuucuc

SEQ ID NO: 3536806 - RNA, 12 nt, Pseudomonas putida KT2440
uggcaaagcgca

SEQ ID NO: 3536807 - RNA, 16 nt, Pseudomonas putida KT2440
uggcaagggcggaggc

SEQ ID NO: 3536808 - RNA, 12 nt, Pseudomonas putida KT2440
uggcaaucagcg

SEQ ID NO: 3536809 - RNA, 18 nt, Pseudomonas putida KT2440
uggcaaucccccgcucau

SEQ ID NO: 3536810 - RNA, 17 nt, Pseudomonas putida KT2440
uggcaaucgccuggcgc

SEQ ID NO: 3536811 - RNA, 13 nt, Pseudomonas putida KT2440
uggcaaucuucuu

SEQ ID NO: 3536812 - RNA, 20 nt, Pseudomonas putida KT2440
uggcaaugcaacucggcgcg

SEQ ID NO: 3536813 - RNA, 21 nt, Pseudomonas putida KT2440
uggcaaugcaacucggcgcgu

SEQ ID NO: 3536814 - RNA, 17 nt, Pseudomonas putida KT2440
uggcaauuggcuuccag

SEQ ID NO: 3536815 - RNA, 18 nt, Pseudomonas putida KT2440
uggcaauuggcuuccagg

SEQ ID NO: 3536816 - RNA, 22 nt, Pseudomonas putida KT2440
uggcacaggcuacgcagcaccc

SEQ ID NO: 3536817 - RNA, 21 nt, Pseudomonas putida KT2440
uggcacccacagcgccugcug

SEQ ID NO: 3536818 - RNA, 22 nt, Pseudomonas putida KT2440
uggcacccacagcgccugcugc

SEQ ID NO: 3536819 - RNA, 19 nt, Pseudomonas putida KT2440
uggcacccacgcgcuugga

SEQ ID NO: 3536820 - RNA, 15 nt, Pseudomonas putida KT2440
uggcacccucaccaa

SEQ ID NO: 3536821 - RNA, 20 nt, Pseudomonas putida KT2440
uggcacccucaccaacugcc

SEQ ID NO: 3536822 - RNA, 14 nt, Pseudomonas putida KT2440
uggcaccgccgccc

SEQ ID NO: 3536823 - RNA, 16 nt, Pseudomonas putida KT2440
uggcaccgccgcccac

SEQ ID NO: 3536824 - RNA, 12 nt, Pseudomonas putida KT2440
uggcaccggcag

SEQ ID NO: 3536825 - RNA, 13 nt, Pseudomonas putida KT2440
uggcaccggcagc

SEQ ID NO: 3536826 - RNA, 18 nt, Pseudomonas putida KT2440
uggcaccggcagcagcaa

SEQ ID NO: 3536827 - RNA, 14 nt, Pseudomonas putida KT2440
uggcaccggcgcca

SEQ ID NO: 3536828 - RNA, 13 nt, Pseudomonas putida KT2440
uggcacgccuuca

SEQ ID NO: 3536829 - RNA, 20 nt, Pseudomonas putida KT2440
uggcacgccuucagcagccg

SEQ ID NO: 3536830 - RNA, 15 nt, Pseudomonas putida KT2440
uggcacggccagcca

SEQ ID NO: 3536831 - RNA, 22 nt, Pseudomonas putida KT2440
uggcacugcccaagccauccac

SEQ ID NO: 3536832 - RNA, 17 nt, Pseudomonas putida KT2440
uggcacuggcgcgaugc

SEQ ID NO: 3536833 - RNA, 20 nt, Pseudomonas putida KT2440
uggcagcaccgggcgggugc

SEQ ID NO: 3536834 - RNA, 18 nt, Pseudomonas putida KT2440
uggcagcagccucggccu

SEQ ID NO: 3536835 - RNA, 22 nt, Pseudomonas putida KT2440
uggcagccacgauagcgucagc

SEQ ID NO: 3536836 - RNA, 20 nt, Pseudomonas putida KT2440
uggcagcccccccagcaacg

SEQ ID NO: 3536837 - RNA, 18 nt, Pseudomonas putida KT2440
uggcagccgcccuugagc

SEQ ID NO: 3536838 - RNA, 16 nt, Pseudomonas putida KT2440
uggcagcuaccacccc

SEQ ID NO: 3536839 - RNA, 15 nt, Pseudomonas putida KT2440
uggcagcuccagcca

SEQ ID NO: 3536840 - RNA, 16 nt, Pseudomonas putida KT2440
uggcagcuccagccag

SEQ ID NO: 3536841 - RNA, 23 nt, Pseudomonas putida KT2440
uggcagcucugcgacugaauaca

SEQ ID NO: 3536842 - RNA, 16 nt, Pseudomonas putida KT2440
uggcagcugcagugcu

SEQ ID NO: 3536843 - RNA, 18 nt, Pseudomonas putida KT2440
uggcagcugcagugcugg

SEQ ID NO: 3536844 - RNA, 20 nt, Pseudomonas putida KT2440
uggcagcuucucgcggcgaa

SEQ ID NO: 3536845 - RNA, 16 nt, Pseudomonas putida KT2440
uggcagcuugcccugc

SEQ ID NO: 3536846 - RNA, 12 nt, Pseudomonas putida KT2440
uggcaggcaguu

SEQ ID NO: 3536847 - RNA, 14 nt, Pseudomonas putida KT2440
uggcaggcaguucg

SEQ ID NO: 3536848 - RNA, 20 nt, Pseudomonas putida KT2440
uggcaggcucagggcagcaa

SEQ ID NO: 3536849 - RNA, 21 nt, Pseudomonas putida KT2440
uggcaggcucagggcagcaac

SEQ ID NO: 3536850 - RNA, 15 nt, Pseudomonas putida KT2440
uggcaguaccacacg

SEQ ID NO: 3536851 - RNA, 15 nt, Pseudomonas putida KT2440
uggcagugaucuggc

SEQ ID NO: 3536852 - RNA, 13 nt, Pseudomonas putida KT2440
uggcaguguggca

SEQ ID NO: 3536853 - RNA, 15 nt, Pseudomonas putida KT2440
uggcaucaaugcaau

SEQ ID NO: 3536854 - RNA, 19 nt, Pseudomonas putida KT2440
uggcauccacacgcugcug

SEQ ID NO: 3536855 - RNA, 13 nt, Pseudomonas putida KT2440
uggcauccggcag

SEQ ID NO: 3536856 - RNA, 12 nt, Pseudomonas putida KT2440
uggcaucgcugc

SEQ ID NO: 3536857 - RNA, 13 nt, Pseudomonas putida KT2440
uggcaucgcugcc

SEQ ID NO: 3536858 - RNA, 13 nt, Pseudomonas putida KT2440
uggccuccagcaa

SEQ ID NO: 3536859 - RNA, 18 nt, Pseudomonas putida KT2440
uggccucggcgaucgcca

SEQ ID NO: 3536860 - RNA, 22 nt, Pseudomonas putida KT2440
uggccucggcgaucgccaggug

SEQ ID NO: 3536861 - RNA, 22 nt, Pseudomonas putida KT2440
uggccucgucgcgguccuugcc

SEQ ID NO: 3536862 - RNA, 19 nt, Pseudomonas putida KT2440
uggccucuggcuuggcugc

SEQ ID NO: 3536863 - RNA, 20 nt, Pseudomonas putida KT2440
uggccucuucgcgggcaagc

SEQ ID NO: 3536864 - RNA, 17 nt, Pseudomonas putida KT2440
uggccucuucucgggca

SEQ ID NO: 3536865 - RNA, 16 nt, Pseudomonas putida KT2440
uggccugcaugcucau

SEQ ID NO: 3536866 - RNA, 16 nt, Pseudomonas putida KT2440
uggccugcucacccga

SEQ ID NO: 3536867 - RNA, 14 nt, Pseudomonas putida KT2440
uggccuguccaggc

SEQ ID NO: 3536868 - RNA, 22 nt, Pseudomonas putida KT2440
uggccuguccaggcaaucacug

SEQ ID NO: 3536869 - RNA, 17 nt, Pseudomonas putida KT2440
uggccuucaucgcugcg

SEQ ID NO: 3536870 - RNA, 14 nt, Pseudomonas putida KT2440
uggccuuccuugcc

SEQ ID NO: 3536871 - RNA, 19 nt, Pseudomonas putida KT2440
uggccuucucuuccgccag

SEQ ID NO: 3536872 - RNA, 19 nt, Pseudomonas putida KT2440
uggccuugaucaggcccug

SEQ ID NO: 3536873 - RNA, 23 nt, Pseudomonas putida KT2440
uggccuugaucaggcccugcugc

SEQ ID NO: 3536874 - RNA, 14 nt, Pseudomonas putida KT2440
uggccuugcccgaa

SEQ ID NO: 3536875 - RNA, 20 nt, Pseudomonas putida KT2440
uggccuuggacaccaggcug

SEQ ID NO: 3536876 - RNA, 22 nt, Pseudomonas putida KT2440
uggccuuggacaccaggcuggu

SEQ ID NO: 3536877 - RNA, 19 nt, Pseudomonas putida KT2440
uggccuuguugccacccag

SEQ ID NO: 3536878 - RNA, 17 nt, Pseudomonas putida KT2440
uggccuuucugcuucca

SEQ ID NO: 3536879 - RNA, 15 nt, Pseudomonas putida KT2440
uggccuuuucgcggg

SEQ ID NO: 3536880 - RNA, 23 nt, Pseudomonas putida KT2440
uggcgaaccgcuguucugcccgg

SEQ ID NO: 3536881 - RNA, 18 nt, Pseudomonas putida KT2440
uggcgaagaccgccgccc

SEQ ID NO: 3536882 - RNA, 20 nt, Pseudomonas putida KT2440
uggcgaagaccgccgcccag

SEQ ID NO: 3536883 - RNA, 22 nt, Pseudomonas putida KT2440
uggcgaagaccgccgcccaggu

SEQ ID NO: 3536884 - RNA, 19 nt, Pseudomonas putida KT2440
uggcgaaggcugccuggcc

SEQ ID NO: 3536885 - RNA, 19 nt, Pseudomonas putida KT2440
uggcgaaucagcaugccca

SEQ ID NO: 3536886 - RNA, 13 nt, Pseudomonas putida KT2440
uggcgaccggcgu

SEQ ID NO: 3536887 - RNA, 23 nt, Pseudomonas putida KT2440
uggcgaccggcguguugccgcug

SEQ ID NO: 3536888 - RNA, 23 nt, Pseudomonas putida KT2440
uggcgacgaguuuaccuccauca

SEQ ID NO: 3536889 - RNA, 18 nt, Pseudomonas putida KT2440
uggcgacgugcccagauc

SEQ ID NO: 3536890 - RNA, 16 nt, Pseudomonas putida KT2440
uggcgagaauacccau

SEQ ID NO: 3536891 - RNA, 14 nt, Pseudomonas putida KT2440
uggcgagcccggcg

SEQ ID NO: 3536892 - RNA, 14 nt, Pseudomonas putida KT2440
uggcgaucccugua

SEQ ID NO: 3536893 - RNA, 17 nt, Pseudomonas putida KT2440
uggcgaucgaacaacug

SEQ ID NO: 3536894 - RNA, 20 nt, Pseudomonas putida KT2440
uggcgaucgaacaacugucc

SEQ ID NO: 3536895 - RNA, 22 nt, Pseudomonas putida KT2440
uggcgaucgaacaacuguccug

SEQ ID NO: 3536896 - RNA, 13 nt, Pseudomonas putida KT2440
uggcgaucgaacg

SEQ ID NO: 3536897 - RNA, 16 nt, Pseudomonas putida KT2440
uggcgaugaacacgcc

SEQ ID NO: 3536898 - RNA, 18 nt, Pseudomonas putida KT2440
uggcgauugggccgcaca

SEQ ID NO: 3536899 - RNA, 14 nt, Pseudomonas putida KT2440
uggcgcaaacccuc

SEQ ID NO: 3536900 - RNA, 15 nt, Pseudomonas putida KT2440
uggcgcaaucuugcc

SEQ ID NO: 3536901 - RNA, 19 nt, Pseudomonas putida KT2440
uggcgcacagggcgaugcc

SEQ ID NO: 3536902 - RNA, 13 nt, Pseudomonas putida KT2440
uggcgcaccagcg

SEQ ID NO: 3536903 - RNA, 16 nt, Pseudomonas putida KT2440
uggcgcaccgagcgcu

SEQ ID NO: 3536904 - RNA, 14 nt, Pseudomonas putida KT2440
uggcgcacuuguuc

SEQ ID NO: 3536905 - RNA, 22 nt, Pseudomonas putida KT2440
uggcgcagcagguccagcuccg

SEQ ID NO: 3536906 - RNA, 15 nt, Pseudomonas putida KT2440
uggcgcaggccgcug

SEQ ID NO: 3536907 - RNA, 21 nt, Pseudomonas putida KT2440
uggcgcaguucguccaggcuu

SEQ ID NO: 3536908 - RNA, 16 nt, Pseudomonas putida KT2440
uggcgcaucuuccagc

SEQ ID NO: 3536909 - RNA, 14 nt, Pseudomonas putida KT2440
uggcgcauggccug

SEQ ID NO: 3536910 - RNA, 14 nt, Pseudomonas putida KT2440
uggcgccagggcau

SEQ ID NO: 3536911 - RNA, 18 nt, Pseudomonas putida KT2440
uggcgcccggcgcuggug

SEQ ID NO: 3536912 - RNA, 21 nt, Pseudomonas putida KT2440
uggcgcccggggcaaugccga

SEQ ID NO: 3536913 - RNA, 17 nt, Pseudomonas putida KT2440
uggcgccugcggcauca

SEQ ID NO: 3536914 - RNA, 21 nt, Pseudomonas putida KT2440
uggcgccugcggcaucagggc

SEQ ID NO: 3536915 - RNA, 20 nt, Pseudomonas putida KT2440
uggcgccuugauuaccagcg

SEQ ID NO: 3536916 - RNA, 17 nt, Pseudomonas putida KT2440
uggcgcgaccaucaccg

SEQ ID NO: 3536917 - RNA, 20 nt, Pseudomonas putida KT2440
uggcgcgaccaucaccgcca

SEQ ID NO: 3536918 - RNA, 17 nt, Pseudomonas putida KT2440
uggcgcgaugcgguugc

SEQ ID NO: 3536919 - RNA, 15 nt, Pseudomonas putida KT2440
uggcgcgccuugggc

SEQ ID NO: 3536920 - RNA, 22 nt, Pseudomonas putida KT2440
uggcgcgccuugggcaacaccg

SEQ ID NO: 3536921 - RNA, 19 nt, Pseudomonas putida KT2440
uggcgcggugauggcgcau

SEQ ID NO: 3536922 - RNA, 14 nt, Pseudomonas putida KT2440
uggcgcuccuccag

SEQ ID NO: 3536923 - RNA, 17 nt, Pseudomonas putida KT2440
uggcgcugaucaucgac

SEQ ID NO: 3536924 - RNA, 12 nt, Pseudomonas putida KT2440
uggcgcuggauc

SEQ ID NO: 3536925 - RNA, 20 nt, Pseudomonas putida KT2440
uggcgcuggaucuugcugaa

SEQ ID NO: 3536926 - RNA, 15 nt, Pseudomonas putida KT2440
uggcgcuggucaauc

SEQ ID NO: 3536927 - RNA, 17 nt, Pseudomonas putida KT2440
uggcgcuugaucagccu

SEQ ID NO: 3536928 - RNA, 15 nt, Pseudomonas putida KT2440
uggcgcuuuccagcu

SEQ ID NO: 3536929 - RNA, 23 nt, Pseudomonas putida KT2440
uggcggaucagcgcguccagcaa

SEQ ID NO: 3536930 - RNA, 21 nt, Pseudomonas putida KT2440
uggcggaucugacggcgcugc

SEQ ID NO: 3536931 - RNA, 22 nt, Pseudomonas putida KT2440
uggcggaucugacggcgcugcu

SEQ ID NO: 3536932 - RNA, 15 nt, Pseudomonas putida KT2440
uggcggcaacgguga

SEQ ID NO: 3536933 - RNA, 18 nt, Pseudomonas putida KT2440
uggcggcagcaacgguga

SEQ ID NO: 3536934 - RNA, 16 nt, Pseudomonas putida KT2440
uggcggcaggcgcagc

SEQ ID NO: 3536935 - RNA, 17 nt, Pseudomonas putida KT2440
uggcggcauacaccacc

SEQ ID NO: 3536936 - RNA, 15 nt, Pseudomonas putida KT2440
uggcggccagcgcau

SEQ ID NO: 3536937 - RNA, 19 nt, Pseudomonas putida KT2440
uggcggccagcgcaucggc

SEQ ID NO: 3536938 - RNA, 12 nt, Pseudomonas putida KT2440
uggcggccgcag

SEQ ID NO: 3536939 - RNA, 15 nt, Pseudomonas putida KT2440
uggcggccgcagccc

SEQ ID NO: 3536940 - RNA, 13 nt, Pseudomonas putida KT2440
uggcggcgccugc

SEQ ID NO: 3536941 - RNA, 18 nt, Pseudomonas putida KT2440
uggcggcgccuucagguu

SEQ ID NO: 3536942 - RNA, 13 nt, Pseudomonas putida KT2440
uggcggcugcccg

SEQ ID NO: 3536943 - RNA, 14 nt, Pseudomonas putida KT2440
uggcggcugcccgu

SEQ ID NO: 3536944 - RNA, 16 nt, Pseudomonas putida KT2440
uggcgggcaaacuggc

SEQ ID NO: 3536945 - RNA, 17 nt, Pseudomonas putida KT2440
uggcgggcaaacuggcg

SEQ ID NO: 3536946 - RNA, 21 nt, Pseudomonas putida KT2440
uggcgguaaacguggucagcc

SEQ ID NO: 3536947 - RNA, 20 nt, Pseudomonas putida KT2440
uggcgguauucacaccugcc

SEQ ID NO: 3536948 - RNA, 13 nt, Pseudomonas putida KT2440
uggcgguccaccg

SEQ ID NO: 3536949 - RNA, 14 nt, Pseudomonas putida KT2440
uggcggugagaugu

SEQ ID NO: 3536950 - RNA, 19 nt, Pseudomonas putida KT2440
uggcgguugaccagggcgu

SEQ ID NO: 3536951 - RNA, 21 nt, Pseudomonas putida KT2440
uggcguaauccagcugcugga

SEQ ID NO: 3536952 - RNA, 16 nt, Pseudomonas putida KT2440
uggcgucauccugcgc

SEQ ID NO: 3536953 - RNA, 13 nt, Pseudomonas putida KT2440
uggcgucgaugau

SEQ ID NO: 3536954 - RNA, 19 nt, Pseudomonas putida KT2440
uggcgucgaugaucaccug

SEQ ID NO: 3536955 - RNA, 19 nt, Pseudomonas putida KT2440
uggcgugacggauacaucg

SEQ ID NO: 3536956 - RNA, 22 nt, Pseudomonas putida KT2440
uggcgugcacgcuugagcgcgc

SEQ ID NO: 3536957 - RNA, 14 nt, Pseudomonas putida KT2440
uggcguugagccgc

SEQ ID NO: 3536958 - RNA, 17 nt, Pseudomonas putida KT2440
uggcguugcgaaggcga

SEQ ID NO: 3536959 - RNA, 13 nt, Pseudomonas putida KT2440
uggcguugcucaa

SEQ ID NO: 3536960 - RNA, 14 nt, Pseudomonas putida KT2440
uggcguugucagca

SEQ ID NO: 3536961 - RNA, 16 nt, Pseudomonas putida KT2440
uggcguuguccagcag

SEQ ID NO: 3536962 - RNA, 23 nt, Pseudomonas putida KT2440
uggcguuuuucacacgccacuaa

SEQ ID NO: 3536963 - RNA, 20 nt, Pseudomonas putida KT2440
ugggcgucaaccaaugucga

SEQ ID NO: 3536964 - RNA, 21 nt, Pseudomonas putida KT2440
ugggcgucgauaaaagggucu

SEQ ID NO: 3536965 - RNA, 13 nt, Pseudomonas putida KT2440
ugggcgugccagg

SEQ ID NO: 3536966 - RNA, 19 nt, Pseudomonas putida KT2440
ugggcgugccaggcuuggc

SEQ ID NO: 3536967 - RNA, 15 nt, Pseudomonas putida KT2440
ugggcguucugacaa

SEQ ID NO: 3536968 - RNA, 19 nt, Pseudomonas putida KT2440
ugggcucagccgccacaug

SEQ ID NO: 3536969 - RNA, 17 nt, Pseudomonas putida KT2440
ugggcuguuccagcagc

SEQ ID NO: 3536970 - RNA, 18 nt, Pseudomonas putida KT2440
ugggcuguuccagcagcg

SEQ ID NO: 3536971 - RNA, 12 nt, Pseudomonas putida KT2440
ugggcuguucgc

SEQ ID NO: 3536972 - RNA, 15 nt, Pseudomonas putida KT2440
ugggcuucaugcugc

SEQ ID NO: 3536973 - RNA, 16 nt, Pseudomonas putida KT2440
ugggcuucaugcugcu

SEQ ID NO: 3536974 - RNA, 19 nt, Pseudomonas putida KT2440
ugggcuucaugcugcugca

SEQ ID NO: 3536975 - RNA, 20 nt, Pseudomonas putida KT2440
ugggcuucaugcugcugcag

SEQ ID NO: 3536976 - RNA, 22 nt, Pseudomonas putida KT2440
ugggcuucaugcugcugcagca

SEQ ID NO: 3536977 - RNA, 13 nt, Pseudomonas putida KT2440
ugggcuucgagca

SEQ ID NO: 3536978 - RNA, 13 nt, Pseudomonas putida KT2440
ugggcuugauccg

SEQ ID NO: 3536979 - RNA, 15 nt, Pseudomonas putida KT2440
ugggcuuggcagcac

SEQ ID NO: 3536980 - RNA, 19 nt, Pseudomonas putida KT2440
ugggcuuugaaagguuuau

SEQ ID NO: 3536981 - RNA, 20 nt, Pseudomonas putida KT2440
ugggcuuuucguuggccagc

SEQ ID NO: 3536982 - RNA, 14 nt, Pseudomonas putida KT2440
uggggacggcagcc

SEQ ID NO: 3536983 - RNA, 12 nt, Pseudomonas putida KT2440
uggggcaggccc

SEQ ID NO: 3536984 - RNA, 16 nt, Pseudomonas putida KT2440
uggggccaaguggcug

SEQ ID NO: 3536985 - RNA, 15 nt, Pseudomonas putida KT2440
uggggccaggcuuuc

SEQ ID NO: 3536986 - RNA, 17 nt, Pseudomonas putida KT2440
uggggccgcgucgcggc

SEQ ID NO: 3536987 - RNA, 19 nt, Pseudomonas putida KT2440
uggggccgcucugcggccc

SEQ ID NO: 3536988 - RNA, 18 nt, Pseudomonas putida KT2440
uggggccgcugugggagu

SEQ ID NO: 3536989 - RNA, 16 nt, Pseudomonas putida KT2440
uggggccgcuuggcgg

SEQ ID NO: 3536990 - RNA, 18 nt, Pseudomonas putida KT2440
uggggccgcuuggcggcc

SEQ ID NO: 3536991 - RNA, 17 nt, Pseudomonas putida KT2440
uggggccugccgguaca

SEQ ID NO: 3536992 - RNA, 14 nt, Pseudomonas putida KT2440
uggggcugccuugc

SEQ ID NO: 3536993 - RNA, 19 nt, Pseudomonas putida KT2440
uggggcugccuugcagccc

SEQ ID NO: 3536994 - RNA, 19 nt, Pseudomonas putida KT2440
uggggcugcuuugcagccc

SEQ ID NO: 3536995 - RNA, 15 nt, Pseudomonas putida KT2440
ugggggaucucuucg

SEQ ID NO: 3536996 - RNA, 14 nt, Pseudomonas putida KT2440
ugggggugaagccc

SEQ ID NO: 3536997 - RNA, 15 nt, Pseudomonas putida KT2440
ugggggugaagcccu

SEQ ID NO: 3536998 - RNA, 23 nt, Pseudomonas putida KT2440
ugggggugaagcccugcugcugg

SEQ ID NO: 3536999 - RNA, 17 nt, Pseudomonas putida KT2440
ugggguauuugcagugg

SEQ ID NO: 3537000 - RNA, 11 nt, Pseudomonas putida KT2440
uggggugagcg

SEQ ID NO: 3537001 - RNA, 22 nt, Pseudomonas putida KT2440
uggguaucguucuccagcuccu

SEQ ID NO: 3537002 - RNA, 18 nt, Pseudomonas putida KT2440
uggguauugucggucagg

SEQ ID NO: 3537003 - RNA, 12 nt, Pseudomonas putida KT2440
uggguccaggca

SEQ ID NO: 3537004 - RNA, 14 nt, Pseudomonas putida KT2440
uggguccaggcaca

SEQ ID NO: 3537005 - RNA, 22 nt, Pseudomonas putida KT2440
uggguccaggcacaccgagcca

SEQ ID NO: 3537006 - RNA, 18 nt, Pseudomonas putida KT2440
uggguccugcgccaggca

SEQ ID NO: 3537007 - RNA, 23 nt, Pseudomonas putida KT2440
ugggucgccacgccggucgggca

SEQ ID NO: 3537008 - RNA, 18 nt, Pseudomonas putida KT2440
ugggucgggaacagcucu

SEQ ID NO: 3537009 - RNA, 20 nt, Pseudomonas putida KT2440
ugggucgggaacagcucugg

SEQ ID NO: 3537010 - RNA, 20 nt, Pseudomonas putida KT2440
ugggugaccaccagcaacau

SEQ ID NO: 3537011 - RNA, 22 nt, Pseudomonas putida KT2440
ugggugcacagguuagggucga

SEQ ID NO: 3537012 - RNA, 21 nt, Pseudomonas putida KT2440
ugggugucggcauacagcucc

SEQ ID NO: 3537013 - RNA, 14 nt, Pseudomonas putida KT2440
ugggugucuucugu

SEQ ID NO: 3537014 - RNA, 19 nt, Pseudomonas putida KT2440
uggguuacggcggccugcu

SEQ ID NO: 3537015 - RNA, 21 nt, Pseudomonas putida KT2440
uggguuacggcggccugcugc

SEQ ID NO: 3537016 - RNA, 22 nt, Pseudomonas putida KT2440
uggguuuuaaccggcccugaag

SEQ ID NO: 3537017 - RNA, 20 nt, Pseudomonas putida KT2440
uggguuuuuuuaugggcagc

SEQ ID NO: 3537018 - RNA, 23 nt, Pseudomonas putida KT2440
uggguuuuuuuaugggcagcacc

SEQ ID NO: 3537019 - RNA, 20 nt, Pseudomonas putida KT2440
ugguaacgggcaaaguccau

SEQ ID NO: 3537020 - RNA, 14 nt, Pseudomonas putida KT2440
ugguaauuggccgg

SEQ ID NO: 3537021 - RNA, 13 nt, Pseudomonas putida KT2440
ugguacagccggc

SEQ ID NO: 3537022 - RNA, 20 nt, Pseudomonas putida KT2440
ugguacagcucacgcagcca

SEQ ID NO: 3537023 - RNA, 19 nt, Pseudomonas putida KT2440
ugguacagcucacuggcca

SEQ ID NO: 3537024 - RNA, 20 nt, Pseudomonas putida KT2440
ugguaccgucgaucagcuuc

SEQ ID NO: 3537025 - RNA, 18 nt, Pseudomonas putida KT2440
ugguagugauaaugggca

SEQ ID NO: 3537026 - RNA, 14 nt, Pseudomonas putida KT2440
ugguaguuccuguc

SEQ ID NO: 3537027 - RNA, 18 nt, Pseudomonas putida KT2440
ugguaugaugcgcggcau

SEQ ID NO: 3537028 - RNA, 15 nt, Pseudomonas putida KT2440
ugguaugauuucagg

SEQ ID NO: 3537029 - RNA, 17 nt, Pseudomonas putida KT2440
ugguaugauuucagggu

SEQ ID NO: 3537030 - RNA, 17 nt, Pseudomonas putida KT2440
ugguauugcgcgucucu

SEQ ID NO: 3537031 - RNA, 19 nt, Pseudomonas putida KT2440
ugguauugggcuugaacga

SEQ ID NO: 3537032 - RNA, 23 nt, Pseudomonas putida KT2440
uggucaacagcccggugaaguca

SEQ ID NO: 3537033 - RNA, 21 nt, Pseudomonas putida KT2440
uggucaccacguugcgcuuga

SEQ ID NO: 3537034 - RNA, 15 nt, Pseudomonas putida KT2440
uggucacccagcgcu

SEQ ID NO: 3537035 - RNA, 12 nt, Pseudomonas putida KT2440
uggucaccggga

SEQ ID NO: 3537036 - RNA, 16 nt, Pseudomonas putida KT2440
uggucacgcucggcca

SEQ ID NO: 3537037 - RNA, 15 nt, Pseudomonas putida KT2440
uggucacggccaccc

SEQ ID NO: 3537038 - RNA, 22 nt, Pseudomonas putida KT2440
uggucacguagaacaggccugc

SEQ ID NO: 3537039 - RNA, 19 nt, Pseudomonas putida KT2440
uggucagauaacccuuggc

SEQ ID NO: 3537040 - RNA, 15 nt, Pseudomonas putida KT2440
uggucagcaucaccg

SEQ ID NO: 3537041 - RNA, 16 nt, Pseudomonas putida KT2440
uggucagcgcuucgcu

SEQ ID NO: 3537042 - RNA, 16 nt, Pseudomonas putida KT2440
uggucauccaggcugg

SEQ ID NO: 3537043 - RNA, 21 nt, Pseudomonas putida KT2440
uggucauccaggcuggccagc

SEQ ID NO: 3537044 - RNA, 23 nt, Pseudomonas putida KT2440
uggucaugccauccucggccagg

SEQ ID NO: 3537045 - RNA, 17 nt, Pseudomonas putida KT2440
uggucauugaaggccag

SEQ ID NO: 3537046 - RNA, 18 nt, Pseudomonas putida KT2440
uggucauugaaggccagu

SEQ ID NO: 3537047 - RNA, 23 nt, Pseudomonas putida KT2440
ugguccagaaaauaugcuguugg

SEQ ID NO: 3537048 - RNA, 19 nt, Pseudomonas putida KT2440
ugguccagcguucggccag

SEQ ID NO: 3537049 - RNA, 18 nt, Pseudomonas putida KT2440
ugguccagcuucaccuca

SEQ ID NO: 3537050 - RNA, 13 nt, Pseudomonas putida KT2440
ugguccagggcca

SEQ ID NO: 3537051 - RNA, 14 nt, Pseudomonas putida KT2440
ugguccccuucguc

SEQ ID NO: 3537052 - RNA, 19 nt, Pseudomonas putida KT2440
ugguccgaggucagcacca

SEQ ID NO: 3537053 - RNA, 19 nt, Pseudomonas putida KT2440
ugguccgggcccaugccac

SEQ ID NO: 3537054 - RNA, 15 nt, Pseudomonas putida KT2440
ugguccgugagaaag

SEQ ID NO: 3537055 - RNA, 14 nt, Pseudomonas putida KT2440
ugguccugaugagu

SEQ ID NO: 3537056 - RNA, 15 nt, Pseudomonas putida KT2440
ugguccuugcacagu

SEQ ID NO: 3537057 - RNA, 13 nt, Pseudomonas putida KT2440
uggucgaagccga

SEQ ID NO: 3537058 - RNA, 16 nt, Pseudomonas putida KT2440
uggucgccgccaccca

SEQ ID NO: 3537059 - RNA, 19 nt, Pseudomonas putida KT2440
uggucgccgugcagcaccg

SEQ ID NO: 3537060 - RNA, 22 nt, Pseudomonas putida KT2440
uggucgccucgacgcagacaaa

SEQ ID NO: 3537061 - RNA, 20 nt, Pseudomonas putida KT2440
uggucgcggcaaagaucgcc

SEQ ID NO: 3537062 - RNA, 16 nt, Pseudomonas putida KT2440
uggucgcggcgcuggc

SEQ ID NO: 3537063 - RNA, 18 nt, Pseudomonas putida KT2440
uggucgcggcgcuggccg

SEQ ID NO: 3537064 - RNA, 23 nt, Pseudomonas putida KT2440
uggucgcgggccagcccauccag

SEQ ID NO: 3537065 - RNA, 20 nt, Pseudomonas putida KT2440
uggucgcgucgcccagacgg

SEQ ID NO: 3537066 - RNA, 18 nt, Pseudomonas putida KT2440
uggucgcugcggcacacc

SEQ ID NO: 3537067 - RNA, 13 nt, Pseudomonas putida KT2440
uggucuagagauc

SEQ ID NO: 3537068 - RNA, 22 nt, Pseudomonas putida KT2440
ugucaccgguaucgaugcacag

SEQ ID NO: 3537069 - RNA, 23 nt, Pseudomonas putida KT2440
ugucacgcgccagguuggcaaac

SEQ ID NO: 3537070 - RNA, 16 nt, Pseudomonas putida KT2440
ugucagcagcuucagc

SEQ ID NO: 3537071 - RNA, 20 nt, Pseudomonas putida KT2440
ugucagcagcuucagccagg

SEQ ID NO: 3537072 - RNA, 18 nt, Pseudomonas putida KT2440
ugucagccgccgcugcga

SEQ ID NO: 3537073 - RNA, 17 nt, Pseudomonas putida KT2440
ugucagcgccagcggcu

SEQ ID NO: 3537074 - RNA, 18 nt, Pseudomonas putida KT2440
ugucagcggcgcagcgcu

SEQ ID NO: 3537075 - RNA, 15 nt, Pseudomonas putida KT2440
ugucaggggugccuu

SEQ ID NO: 3537076 - RNA, 18 nt, Pseudomonas putida KT2440
ugucaggugguaguccuu

SEQ ID NO: 3537077 - RNA, 23 nt, Pseudomonas putida KT2440
ugucaggugguaguccuugccgc

SEQ ID NO: 3537078 - RNA, 20 nt, Pseudomonas putida KT2440
ugucauccacaucacugcug

SEQ ID NO: 3537079 - RNA, 21 nt, Pseudomonas putida KT2440
ugucauccacaucacugcugu

SEQ ID NO: 3537080 - RNA, 21 nt, Pseudomonas putida KT2440
ugucauccugcguggcgguga

SEQ ID NO: 3537081 - RNA, 14 nt, Pseudomonas putida KT2440
ugucaucugaggcc

SEQ ID NO: 3537082 - RNA, 18 nt, Pseudomonas putida KT2440
ugucaucugaggcccgaa

SEQ ID NO: 3537083 - RNA, 21 nt, Pseudomonas putida KT2440
ugucauugcccaagcgcuccg

SEQ ID NO: 3537084 - RNA, 16 nt, Pseudomonas putida KT2440
uguccaaauugggcug

SEQ ID NO: 3537085 - RNA, 21 nt, Pseudomonas putida KT2440
uguccacaccaaagucagcca

SEQ ID NO: 3537086 - RNA, 22 nt, Pseudomonas putida KT2440
uguccacaccaaagucagccag

SEQ ID NO: 3537087 - RNA, 18 nt, Pseudomonas putida KT2440
uguccacccccgcuccua

SEQ ID NO: 3537088 - RNA, 19 nt, Pseudomonas putida KT2440
uguccacccccgcuccuac

SEQ ID NO: 3537089 - RNA, 20 nt, Pseudomonas putida KT2440
uguccacccccgcuccuacg

SEQ ID NO: 3537090 - RNA, 20 nt, Pseudomonas putida KT2440
uguccagcaagggccugugc

SEQ ID NO: 3537091 - RNA, 13 nt, Pseudomonas putida KT2440
uguccagcagcag

SEQ ID NO: 3537092 - RNA, 14 nt, Pseudomonas putida KT2440
uguccagcagcagc

SEQ ID NO: 3537093 - RNA, 22 nt, Pseudomonas putida KT2440
uguccagcccgauuucgugcac

SEQ ID NO: 3537094 - RNA, 14 nt, Pseudomonas putida KT2440
uguccagcgucugc

SEQ ID NO: 3537095 - RNA, 16 nt, Pseudomonas putida KT2440
ugucccgcccugagcc

SEQ ID NO: 3537096 - RNA, 11 nt, Pseudomonas putida KT2440
ugucccggcac

SEQ ID NO: 3537097 - RNA, 12 nt, Pseudomonas putida KT2440
uguccgccgccg

SEQ ID NO: 3537098 - RNA, 22 nt, Pseudomonas putida KT2440
uguccggcaugugcacuggcag

SEQ ID NO: 3537099 - RNA, 19 nt, Pseudomonas putida KT2440
uguccggcgugaaauccuc

SEQ ID NO: 3537100 - RNA, 17 nt, Pseudomonas putida KT2440
uguccucggcguucagc

SEQ ID NO: 3537101 - RNA, 23 nt, Pseudomonas putida KT2440
uguccugauguucggugcucagg

SEQ ID NO: 3537102 - RNA, 19 nt, Pseudomonas putida KT2440
uguccugcaacugggcaau

SEQ ID NO: 3537103 - RNA, 11 nt, Pseudomonas putida KT2440
uguccugcugc

SEQ ID NO: 3537104 - RNA, 16 nt, Pseudomonas putida KT2440
uguccuggaucagccg

SEQ ID NO: 3537105 - RNA, 17 nt, Pseudomonas putida KT2440
uguccuugcacuccccc

SEQ ID NO: 3537106 - RNA, 16 nt, Pseudomonas putida KT2440
uguccuuggcccagcc

SEQ ID NO: 3537107 - RNA, 19 nt, Pseudomonas putida KT2440
uguccuuggcccagccauc

SEQ ID NO: 3537108 - RNA, 19 nt, Pseudomonas putida KT2440
uguccuuguugaccccggg

SEQ ID NO: 3537109 - RNA, 21 nt, Pseudomonas putida KT2440
ugucgaacagcugaucgccgu

SEQ ID NO: 3537110 - RNA, 15 nt, Pseudomonas putida KT2440
ugucgaaccccugau

SEQ ID NO: 3537111 - RNA, 21 nt, Pseudomonas putida KT2440
ugucgaagcgcaccucggcca

SEQ ID NO: 3537112 - RNA, 22 nt, Pseudomonas putida KT2440
ugucgacgaugcuuuugauggu

SEQ ID NO: 3537113 - RNA, 23 nt, Pseudomonas putida KT2440
ugucgacgaugcuuuugaugguc

SEQ ID NO: 3537114 - RNA, 18 nt, Pseudomonas putida KT2440
ugucgacguacagcagcu

SEQ ID NO: 3537115 - RNA, 17 nt, Pseudomonas putida KT2440
ugucgaguacgaucagc

SEQ ID NO: 3537116 - RNA, 18 nt, Pseudomonas putida KT2440
ugucgauacucacccgcu

SEQ ID NO: 3537117 - RNA, 15 nt, Pseudomonas putida KT2440
ugucgaucagcggcu

SEQ ID NO: 3537118 - RNA, 15 nt, Pseudomonas putida KT2440
ugucgaugccugcua

SEQ ID NO: 3537119 - RNA, 21 nt, Pseudomonas putida KT2440
ugucgcugccgccaaccagcu

SEQ ID NO: 3537120 - RNA, 19 nt, Pseudomonas putida KT2440
ugucgcuggguacuggcuu

SEQ ID NO: 3537121 - RNA, 14 nt, Pseudomonas putida KT2440
ugucgcuguugcgc

SEQ ID NO: 3537122 - RNA, 17 nt, Pseudomonas putida KT2440
ugucggaagccugcauc

SEQ ID NO: 3537123 - RNA, 14 nt, Pseudomonas putida KT2440
ugucggagcgggcu

SEQ ID NO: 3537124 - RNA, 15 nt, Pseudomonas putida KT2440
ugucggcagccaggg

SEQ ID NO: 3537125 - RNA, 13 nt, Pseudomonas putida KT2440
ugucggccagauc

SEQ ID NO: 3537126 - RNA, 14 nt, Pseudomonas putida KT2440
ugucggccagggcc

SEQ ID NO: 3537127 - RNA, 18 nt, Pseudomonas putida KT2440
ugucggcgaaggcuggcc

SEQ ID NO: 3537128 - RNA, 22 nt, Pseudomonas putida KT2440
ugucggcgcggaugugacgcug

SEQ ID NO: 3537129 - RNA, 15 nt, Pseudomonas putida KT2440
ugucgggcaguucga

SEQ ID NO: 3537130 - RNA, 21 nt, Pseudomonas putida KT2440
ugucgguaaacaauucccagc

SEQ ID NO: 3537131 - RNA, 23 nt, Pseudomonas putida KT2440
ugucggucauggucaacagcccg

SEQ ID NO: 3537132 - RNA, 17 nt, Pseudomonas putida KT2440
ugucgguggcggccagc

SEQ ID NO: 3537133 - RNA, 16 nt, Pseudomonas putida KT2440
ugucgguggugaucac

SEQ ID NO: 3537134 - RNA, 21 nt, Pseudomonas putida KT2440
ugucuccgaacgccuuggccu

SEQ ID NO: 3537135 - RNA, 19 nt, Pseudomonas putida KT2440
ugucucgcccaugggcuuu

SEQ ID NO: 3537136 - RNA, 15 nt, Pseudomonas putida KT2440
ugucugacagcagga

SEQ ID NO: 3537137 - RNA, 16 nt, Pseudomonas putida KT2440
ugucugcgccugcugg

SEQ ID NO: 3537138 - RNA, 12 nt, Pseudomonas putida KT2440
ugucugugcccg

SEQ ID NO: 3537139 - RNA, 12 nt, Pseudomonas putida KT2440
ugucuuccaggg

SEQ ID NO: 3537140 - RNA, 18 nt, Pseudomonas putida KT2440
ugucuuccaguuccaucc

SEQ ID NO: 3537141 - RNA, 20 nt, Pseudomonas putida KT2440
ugucuuccaguuccauccag

SEQ ID NO: 3537142 - RNA, 15 nt, Pseudomonas putida KT2440
ugucuuccggcaggu

SEQ ID NO: 3537143 - RNA, 15 nt, Pseudomonas putida KT2440
ugucuuccggcauga

SEQ ID NO: 3537144 - RNA, 17 nt, Pseudomonas putida KT2440
ugucuuuacgcauugcc

SEQ ID NO: 3537145 - RNA, 14 nt, Pseudomonas putida KT2440
ugugaaacaccaca

SEQ ID NO: 3537146 - RNA, 15 nt, Pseudomonas putida KT2440
ugugaaacaccacac

SEQ ID NO: 3537147 - RNA, 21 nt, Pseudomonas putida KT2440
ugugaaacgaguggaucaacc

SEQ ID NO: 3537148 - RNA, 21 nt, Pseudomonas putida KT2440
ugugacgcuggucggccaccc

SEQ ID NO: 3537149 - RNA, 13 nt, Pseudomonas putida KT2440
ugugacugaugau

SEQ ID NO: 3537150 - RNA, 16 nt, Pseudomonas putida KT2440
ugugaucccgcgaggu

SEQ ID NO: 3537151 - RNA, 22 nt, Pseudomonas putida KT2440
ugugaugcagccagccucuucu

SEQ ID NO: 3537152 - RNA, 18 nt, Pseudomonas putida KT2440
ugugcacccgugccugcc

SEQ ID NO: 3537153 - RNA, 23 nt, Pseudomonas putida KT2440
ugugcacccgugccugccugcaa

SEQ ID NO: 3537154 - RNA, 15 nt, Pseudomonas putida KT2440
ugugcagcacuucga

SEQ ID NO: 3537155 - RNA, 24 nt, Pseudomonas putida KT2440
ugugcaggggcugccuugcagccc

SEQ ID NO: 3537156 - RNA, 21 nt, Pseudomonas putida KT2440
ugugcaguucgcacagcucga

SEQ ID NO: 3537157 - RNA, 14 nt, Pseudomonas putida KT2440
ugugcauccagccc

SEQ ID NO: 3537158 - RNA, 18 nt, Pseudomonas putida KT2440
ugugcaugcgccccccau

SEQ ID NO: 3537159 - RNA, 19 nt, Pseudomonas putida KT2440
ugugccaccuucagcgggu

SEQ ID NO: 3537160 - RNA, 23 nt, Pseudomonas putida KT2440
ugugccaccuucagcgggucgag

SEQ ID NO: 3537161 - RNA, 16 nt, Pseudomonas putida KT2440
ugugccacuucauggg

SEQ ID NO: 3537162 - RNA, 17 nt, Pseudomonas putida KT2440
ugugcccgacaccggcc

SEQ ID NO: 3537163 - RNA, 22 nt, Pseudomonas putida KT2440
ugugcccgcgaaucguccugga

SEQ ID NO: 3537164 - RNA, 19 nt, Pseudomonas putida KT2440
ugugcccugaucgccucca

SEQ ID NO: 3537165 - RNA, 18 nt, Pseudomonas putida KT2440
ugugccgagugccaacaa

SEQ ID NO: 3537166 - RNA, 23 nt, Pseudomonas putida KT2440
ugugccggccucuucgcggguaa

SEQ ID NO: 3537167 - RNA, 21 nt, Pseudomonas putida KT2440
ugugcggccaaugcacgccug

SEQ ID NO: 3537168 - RNA, 15 nt, Pseudomonas putida KT2440
ugugcggguucuccc

SEQ ID NO: 3537169 - RNA, 14 nt, Pseudomonas putida KT2440
ugugcgugaacacu

SEQ ID NO: 3537170 - RNA, 18 nt, Pseudomonas putida KT2440
ugugcgugaacacugcca

SEQ ID NO: 3537171 - RNA, 14 nt, Pseudomonas putida KT2440
ugugcuccagcucc

SEQ ID NO: 3537172 - RNA, 16 nt, Pseudomonas putida KT2440
ugugcuccagcuccag

SEQ ID NO: 3537173 - RNA, 16 nt, Pseudomonas putida KT2440
uuacccaccagcucca

SEQ ID NO: 3537174 - RNA, 18 nt, Pseudomonas putida KT2440
uuacccgcgaacaccggc

SEQ ID NO: 3537175 - RNA, 19 nt, Pseudomonas putida KT2440
uuacccgcgaacaggcccu

SEQ ID NO: 3537176 - RNA, 18 nt, Pseudomonas putida KT2440
uuacccgcgaagaagccg

SEQ ID NO: 3537177 - RNA, 22 nt, Pseudomonas putida KT2440
uuacccgcgaagaggccggcaa

SEQ ID NO: 3537178 - RNA, 20 nt, Pseudomonas putida KT2440
uuacccgcgaagaggccggu

SEQ ID NO: 3537179 - RNA, 23 nt, Pseudomonas putida KT2440
uuacccgcgaagcguuuacugcu

SEQ ID NO: 3537180 - RNA, 22 nt, Pseudomonas putida KT2440
uuacccuguacccgcuggcuga

SEQ ID NO: 3537181 - RNA, 14 nt, Pseudomonas putida KT2440
uuacgcaggcucca

SEQ ID NO: 3537182 - RNA, 17 nt, Pseudomonas putida KT2440
uuacgcauugccgacuc

SEQ ID NO: 3537183 - RNA, 14 nt, Pseudomonas putida KT2440
uuacgccagaaggu

SEQ ID NO: 3537184 - RNA, 15 nt, Pseudomonas putida KT2440
uuacgccaggcguug

SEQ ID NO: 3537185 - RNA, 12 nt, Pseudomonas putida KT2440
uuacgcccggga

SEQ ID NO: 3537186 - RNA, 13 nt, Pseudomonas putida KT2440
uuacgcggcagca

SEQ ID NO: 3537187 - RNA, 16 nt, Pseudomonas putida KT2440
uuacgcggcagcagca

SEQ ID NO: 3537188 - RNA, 21 nt, Pseudomonas putida KT2440
uuacgcugggcgugccaggcu

SEQ ID NO: 3537189 - RNA, 19 nt, Pseudomonas putida KT2440
uuacguaagucaggccgau

SEQ ID NO: 3537190 - RNA, 19 nt, Pseudomonas putida KT2440
uuacuagauggcugaaauc

SEQ ID NO: 3537191 - RNA, 11 nt, Pseudomonas putida KT2440
uuacucccaca

SEQ ID NO: 3537192 - RNA, 14 nt, Pseudomonas putida KT2440
uuacucccacagcg

SEQ ID NO: 3537193 - RNA, 22 nt, Pseudomonas putida KT2440
uuacucuuuugcauaucuacuc

SEQ ID NO: 3537194 - RNA, 19 nt, Pseudomonas putida KT2440
uuacugguggacacugccg

SEQ ID NO: 3537195 - RNA, 13 nt, Pseudomonas putida KT2440
uuacuguuugagc

SEQ ID NO: 3537196 - RNA, 20 nt, Pseudomonas putida KT2440
uuacuugcacaucccagaac

SEQ ID NO: 3537197 - RNA, 16 nt, Pseudomonas putida KT2440
uuagacaauucugaag

SEQ ID NO: 3537198 - RNA, 21 nt, Pseudomonas putida KT2440
uuagcgucgaugcggccacag

SEQ ID NO: 3537199 - RNA, 14 nt, Pseudomonas putida KT2440
uuaggcgagaucga

SEQ ID NO: 3537200 - RNA, 22 nt, Pseudomonas putida KT2440
uuagguagcggggccgcuuugu

SEQ ID NO: 3537201 - RNA, 18 nt, Pseudomonas putida KT2440
uuaguauggaaauggaau

SEQ ID NO: 3537202 - RNA, 18 nt, Pseudomonas putida KT2440
uuaguuuaacggauagaa

SEQ ID NO: 3537203 - RNA, 14 nt, Pseudomonas putida KT2440
uuauacgccgccga

SEQ ID NO: 3537204 - RNA, 15 nt, Pseudomonas putida KT2440
uuauagcuuuuuugg

SEQ ID NO: 3537205 - RNA, 11 nt, Pseudomonas putida KT2440
uuauccagcac

SEQ ID NO: 3537206 - RNA, 21 nt, Pseudomonas putida KT2440
uuauccgcgaguaaagccagc

SEQ ID NO: 3537207 - RNA, 22 nt, Pseudomonas putida KT2440
uuauccgcgaguaaagccagca

SEQ ID NO: 3537208 - RNA, 21 nt, Pseudomonas putida KT2440
uuauccgcuggcuuguccuug

SEQ ID NO: 3537209 - RNA, 20 nt, Pseudomonas putida KT2440
uuaucgagcuacagccccuu

SEQ ID NO: 3537210 - RNA, 16 nt, Pseudomonas putida KT2440
uuaucugggguggggu

SEQ ID NO: 3537211 - RNA, 22 nt, Pseudomonas putida KT2440
uuauggaugccaauuuccauac

SEQ ID NO: 3537212 - RNA, 16 nt, Pseudomonas putida KT2440
uuauucgaugcaggca

SEQ ID NO: 3537213 - RNA, 16 nt, Pseudomonas putida KT2440
uucaaaaaaaagggca

SEQ ID NO: 3537214 - RNA, 19 nt, Pseudomonas putida KT2440
uucaaagccugcuccagca

SEQ ID NO: 3537215 - RNA, 19 nt, Pseudomonas putida KT2440
uucaacagcuucuugcacc

SEQ ID NO: 3537216 - RNA, 13 nt, Pseudomonas putida KT2440
uucaacccuaccc

SEQ ID NO: 3537217 - RNA, 23 nt, Pseudomonas putida KT2440
uucaaccgcacccgcaagcgccg

SEQ ID NO: 3537218 - RNA, 19 nt, Pseudomonas putida KT2440
uucaacucggacaaccaag

SEQ ID NO: 3537219 - RNA, 23 nt, Pseudomonas putida KT2440
uucaagaggagugcuucauagcc

SEQ ID NO: 3537220 - RNA, 14 nt, Pseudomonas putida KT2440
uucaagcaccgcgc

SEQ ID NO: 3537221 - RNA, 17 nt, Pseudomonas putida KT2440
uucaaggccgccaccuc

SEQ ID NO: 3537222 - RNA, 20 nt, Pseudomonas putida KT2440
uucaaggcguaccugccccc

SEQ ID NO: 3537223 - RNA, 23 nt, Pseudomonas putida KT2440
uucaaggcguaccugccccccca

SEQ ID NO: 3537224 - RNA, 12 nt, Pseudomonas putida KT2440
uucaaugaguua

SEQ ID NO: 3537225 - RNA, 18 nt, Pseudomonas putida KT2440
uucacaccggccuuggcc

SEQ ID NO: 3537226 - RNA, 22 nt, Pseudomonas putida KT2440
uucacagcguugcagaaacucg

SEQ ID NO: 3537227 - RNA, 18 nt, Pseudomonas putida KT2440
uucaccagccaggcacag

SEQ ID NO: 3537228 - RNA, 13 nt, Pseudomonas putida KT2440
uucaccccguggc

SEQ ID NO: 3537229 - RNA, 17 nt, Pseudomonas putida KT2440
uucacccucgcgcagca

SEQ ID NO: 3537230 - RNA, 16 nt, Pseudomonas putida KT2440
uucaccguugccgcca

SEQ ID NO: 3537231 - RNA, 17 nt, Pseudomonas putida KT2440
uucaccuccaguugcca

SEQ ID NO: 3537232 - RNA, 15 nt, Pseudomonas putida KT2440
uucacgcaagcgccu

SEQ ID NO: 3537233 - RNA, 17 nt, Pseudomonas putida KT2440
uucacgcaagcgccuga

SEQ ID NO: 3537234 - RNA, 14 nt, Pseudomonas putida KT2440
uucacgcaggcgca

SEQ ID NO: 3537235 - RNA, 23 nt, Pseudomonas putida KT2440
uucacgggucaggugcggggcaa

SEQ ID NO: 3537236 - RNA, 12 nt, Pseudomonas putida KT2440
uucacucaacca

SEQ ID NO: 3537237 - RNA, 20 nt, Pseudomonas putida KT2440
uucacuggccagcagggccg

SEQ ID NO: 3537238 - RNA, 22 nt, Pseudomonas putida KT2440
uucacuguggucauccaggcug

SEQ ID NO: 3537239 - RNA, 22 nt, Pseudomonas putida KT2440
uucagauuacgcgucaucugcg

SEQ ID NO: 3537240 - RNA, 17 nt, Pseudomonas putida KT2440
uucagcaagaccagaaa

SEQ ID NO: 3537241 - RNA, 18 nt, Pseudomonas putida KT2440
uucagcaccuucuugccc

SEQ ID NO: 3537242 - RNA, 10 nt, Pseudomonas putida KT2440
uucagcagcc

SEQ ID NO: 3537243 - RNA, 21 nt, Pseudomonas putida KT2440
uucagcagcgaagggcucaac

SEQ ID NO: 3537244 - RNA, 13 nt, Pseudomonas putida KT2440
uucagcagcgccu

SEQ ID NO: 3537245 - RNA, 19 nt, Pseudomonas putida KT2440
uucagccaccgcacucugc

SEQ ID NO: 3537246 - RNA, 20 nt, Pseudomonas putida KT2440
uucagcccuugcugcagcag

SEQ ID NO: 3537247 - RNA, 15 nt, Pseudomonas putida KT2440
uucagccguucaccu

SEQ ID NO: 3537248 - RNA, 13 nt, Pseudomonas putida KT2440
uucagccuuggcc

SEQ ID NO: 3537249 - RNA, 20 nt, Pseudomonas putida KT2440
uucagcgccugccuggcccu

SEQ ID NO: 3537250 - RNA, 16 nt, Pseudomonas putida KT2440
uucagcucggccaccc

SEQ ID NO: 3537251 - RNA, 18 nt, Pseudomonas putida KT2440
uucagcucggccacccgc

SEQ ID NO: 3537252 - RNA, 14 nt, Pseudomonas putida KT2440
uucaggcacagcac

SEQ ID NO: 3537253 - RNA, 19 nt, Pseudomonas putida KT2440
uucaggcacggcaccagca

SEQ ID NO: 3537254 - RNA, 21 nt, Pseudomonas putida KT2440
uucagggucgggcacaggccc

SEQ ID NO: 3537255 - RNA, 16 nt, Pseudomonas putida KT2440
uucagguacagcagcu

SEQ ID NO: 3537256 - RNA, 17 nt, Pseudomonas putida KT2440
uucaggucgaugauggc

SEQ ID NO: 3537257 - RNA, 24 nt, Pseudomonas putida KT2440
uucaggugcuucggcucuucgccu

SEQ ID NO: 3537258 - RNA, 14 nt, Pseudomonas putida KT2440
uucagguguuccag

SEQ ID NO: 3537259 - RNA, 16 nt, Pseudomonas putida KT2440
uucagguucacuucca

SEQ ID NO: 3537260 - RNA, 23 nt, Pseudomonas putida KT2440
uucaguaaaaacgccaucggccu

SEQ ID NO: 3537261 - RNA, 12 nt, Pseudomonas putida KT2440
uucauaccccuc

SEQ ID NO: 3537262 - RNA, 22 nt, Pseudomonas putida KT2440
uucauccacauaggccagcucc

SEQ ID NO: 3537263 - RNA, 15 nt, Pseudomonas putida KT2440
uucaucgaacugcaa

SEQ ID NO: 3537264 - RNA, 21 nt, Pseudomonas putida KT2440
uucaucgaacugcaagcucga

SEQ ID NO: 3537265 - RNA, 20 nt, Pseudomonas putida KT2440
uucaucgcugacuuccagca

SEQ ID NO: 3537266 - RNA, 19 nt, Pseudomonas putida KT2440
uucaucgguuuuuccaugc

SEQ ID NO: 3537267 - RNA, 22 nt, Pseudomonas putida KT2440
uucaugcacaacgcgcgggcaa

SEQ ID NO: 3537268 - RNA, 15 nt, Pseudomonas putida KT2440
uucaugguguccggc

SEQ ID NO: 3537269 - RNA, 12 nt, Pseudomonas putida KT2440
uucauugccaac

SEQ ID NO: 3537270 - RNA, 18 nt, Pseudomonas putida KT2440
uucauugcgaaucugcau

SEQ ID NO: 3537271 - RNA, 12 nt, Pseudomonas putida KT2440
uuccaaaccugc

SEQ ID NO: 3537272 - RNA, 14 nt, Pseudomonas putida KT2440
uuccaaguuggcuc

SEQ ID NO: 3537273 - RNA, 20 nt, Pseudomonas putida KT2440
uuccacacggcgguucugcg

SEQ ID NO: 3537274 - RNA, 24 nt, Pseudomonas putida KT2440
uuccacacggcgguucugcgcacg

SEQ ID NO: 3537275 - RNA, 20 nt, Pseudomonas putida KT2440
uuccacagguaccaggcugc

SEQ ID NO: 3537276 - RNA, 17 nt, Pseudomonas putida KT2440
uuccaccacauccucuu

SEQ ID NO: 3537277 - RNA, 16 nt, Pseudomonas putida KT2440
uuccaccggcuugccc

SEQ ID NO: 3537278 - RNA, 16 nt, Pseudomonas putida KT2440
uucgcucacaaagccc

SEQ ID NO: 3537279 - RNA, 17 nt, Pseudomonas putida KT2440
uucgcugcgucaggcca

SEQ ID NO: 3537280 - RNA, 13 nt, Pseudomonas putida KT2440
uucgcugcgugac

SEQ ID NO: 3537281 - RNA, 11 nt, Pseudomonas putida KT2440
uucgcuggggc

SEQ ID NO: 3537282 - RNA, 14 nt, Pseudomonas putida KT2440
uucgcuguacagca

SEQ ID NO: 3537283 - RNA, 19 nt, Pseudomonas putida KT2440
uucgcuuucaccuugcugg

SEQ ID NO: 3537284 - RNA, 22 nt, Pseudomonas putida KT2440
uucggaaaacuccugcuggucg

SEQ ID NO: 3537285 - RNA, 20 nt, Pseudomonas putida KT2440
uucggcaacauucaccagcc

SEQ ID NO: 3537286 - RNA, 17 nt, Pseudomonas putida KT2440
uucggcagcacccgcuu

SEQ ID NO: 3537287 - RNA, 22 nt, Pseudomonas putida KT2440
uucggcagcacccgcuuggcca

SEQ ID NO: 3537288 - RNA, 23 nt, Pseudomonas putida KT2440
uucggcagcacccgcuuggccac

SEQ ID NO: 3537289 - RNA, 13 nt, Pseudomonas putida KT2440
uucggcaggcucu

SEQ ID NO: 3537290 - RNA, 22 nt, Pseudomonas putida KT2440
uucggccacgguguauccagcc

SEQ ID NO: 3537291 - RNA, 23 nt, Pseudomonas putida KT2440
uucggccagcacuacgccggcca

SEQ ID NO: 3537292 - RNA, 12 nt, Pseudomonas putida KT2440
uucggccagcag

SEQ ID NO: 3537293 - RNA, 23 nt, Pseudomonas putida KT2440
uucggccagcaguucgucgagca

SEQ ID NO: 3537294 - RNA, 21 nt, Pseudomonas putida KT2440
uucggcgcacccggcuggucg

SEQ ID NO: 3537295 - RNA, 17 nt, Pseudomonas putida KT2440
uucggcggccugcagcu

SEQ ID NO: 3537296 - RNA, 14 nt, Pseudomonas putida KT2440
uucggcggcgguac

SEQ ID NO: 3537297 - RNA, 16 nt, Pseudomonas putida KT2440
uucggcgggguuuuuu

SEQ ID NO: 3537298 - RNA, 20 nt, Pseudomonas putida KT2440
uucggcgguugcaccguggc

SEQ ID NO: 3537299 - RNA, 19 nt, Pseudomonas putida KT2440
uucggcguacugcacgcuu

SEQ ID NO: 3537300 - RNA, 20 nt, Pseudomonas putida KT2440
uucgguaaugcccgcaggug

SEQ ID NO: 3537301 - RNA, 16 nt, Pseudomonas putida KT2440
uucggugcucaggcuc

SEQ ID NO: 3537302 - RNA, 14 nt, Pseudomonas putida KT2440
uucggugugcucca

SEQ ID NO: 3537303 - RNA, 18 nt, Pseudomonas putida KT2440
uucggugugcuccagcuc

SEQ ID NO: 3537304 - RNA, 20 nt, Pseudomonas putida KT2440
uucggugugcuccagcucca

SEQ ID NO: 3537305 - RNA, 12 nt, Pseudomonas putida KT2440
uucguccaggcu

SEQ ID NO: 3537306 - RNA, 13 nt, Pseudomonas putida KT2440
uucguccaggcuc

SEQ ID NO: 3537307 - RNA, 13 nt, Pseudomonas putida KT2440
uucguccaggcuu

SEQ ID NO: 3537308 - RNA, 22 nt, Pseudomonas putida KT2440
uucgucgaccgccgccuggcuc

SEQ ID NO: 3537309 - RNA, 17 nt, Pseudomonas putida KT2440
uucgucgauguccagcg

SEQ ID NO: 3537310 - RNA, 22 nt, Pseudomonas putida KT2440
uucuagcuuggucucguugcuu

SEQ ID NO: 3537311 - RNA, 11 nt, Pseudomonas putida KT2440
uucucacugau

SEQ ID NO: 3537312 - RNA, 14 nt, Pseudomonas putida KT2440
uucuccagcguccc

SEQ ID NO: 3537313 - RNA, 16 nt, Pseudomonas putida KT2440
uucuccggcagguuga

SEQ ID NO: 3537314 - RNA, 18 nt, Pseudomonas putida KT2440
uucuccugugccggccuc

SEQ ID NO: 3537315 - RNA, 21 nt, Pseudomonas putida KT2440
uucuccuuggacagcaauucc

SEQ ID NO: 3537316 - RNA, 16 nt, Pseudomonas putida KT2440
uucucgagcggccuga

SEQ ID NO: 3537317 - RNA, 19 nt, Pseudomonas putida KT2440
uucucgagcugaugcucaa

SEQ ID NO: 3537318 - RNA, 19 nt, Pseudomonas putida KT2440
uucucgcucagguaggcag

SEQ ID NO: 3537319 - RNA, 13 nt, Pseudomonas putida KT2440
uucucggcugccu

SEQ ID NO: 3537320 - RNA, 17 nt, Pseudomonas putida KT2440
uucucgguauccggcuc

SEQ ID NO: 3537321 - RNA, 15 nt, Pseudomonas putida KT2440
uucucguuagaaauc

SEQ ID NO: 3537322 - RNA, 18 nt, Pseudomonas putida KT2440
uucugaccaauccagccc

SEQ ID NO: 3537323 - RNA, 19 nt, Pseudomonas putida KT2440
uucugccagcuccuggcuc

SEQ ID NO: 3537324 - RNA, 16 nt, Pseudomonas putida KT2440
uucugccccuggccca

SEQ ID NO: 3537325 - RNA, 14 nt, Pseudomonas putida KT2440
uucugcuugaggcc

SEQ ID NO: 3537326 - RNA, 14 nt, Pseudomonas putida KT2440
uucuguggaaaacc

SEQ ID NO: 3537327 - RNA, 14 nt, Pseudomonas putida KT2440
uucuguuugugcca

SEQ ID NO: 3537328 - RNA, 15 nt, Pseudomonas putida KT2440
uucuucaacuccugc

SEQ ID NO: 3537329 - RNA, 21 nt, Pseudomonas putida KT2440
uucuucacaccggccuuggcc

SEQ ID NO: 3537330 - RNA, 14 nt, Pseudomonas putida KT2440
uucuucagcaggaa

SEQ ID NO: 3537331 - RNA, 20 nt, Pseudomonas putida KT2440
uucuucauauccgcuuugcu

SEQ ID NO: 3537332 - RNA, 22 nt, Pseudomonas putida KT2440
uucuucgguggcguugucagca

SEQ ID NO: 3537333 - RNA, 24 nt, Pseudomonas putida KT2440
uucuucggugucggccagcugcgc

SEQ ID NO: 3537334 - RNA, 16 nt, Pseudomonas putida KT2440
uucuucgucaguccau

SEQ ID NO: 3537335 - RNA, 16 nt, Pseudomonas putida KT2440
uucuucuuuaagcccc

SEQ ID NO: 3537336 - RNA, 14 nt, Pseudomonas putida KT2440
uucuugaagaagcu

SEQ ID NO: 3537337 - RNA, 20 nt, Pseudomonas putida KT2440
uucuugaagcguucagucag

SEQ ID NO: 3537338 - RNA, 15 nt, Pseudomonas putida KT2440
uucuugucuccgaac

SEQ ID NO: 3537339 - RNA, 13 nt, Pseudomonas putida KT2440
uucuuucagguaa

SEQ ID NO: 3537340 - RNA, 20 nt, Pseudomonas putida KT2440
uucuuucgacaugcaguuga

SEQ ID NO: 3537341 - RNA, 23 nt, Pseudomonas putida KT2440
uucuuugaaaguggccaagccac

SEQ ID NO: 3537342 - RNA, 14 nt, Pseudomonas putida KT2440
uucuuugcaagccu

SEQ ID NO: 3537343 - RNA, 18 nt, Pseudomonas putida KT2440
uugaaaaaaggcccuucg

SEQ ID NO: 3537344 - RNA, 13 nt, Pseudomonas putida KT2440
uugaaaccggcaa

SEQ ID NO: 3537345 - RNA, 18 nt, Pseudomonas putida KT2440
uugaaacggucagcggca

SEQ ID NO: 3537346 - RNA, 20 nt, Pseudomonas putida KT2440
uugaaacugccccuguucca

SEQ ID NO: 3537347 - RNA, 13 nt, Pseudomonas putida KT2440
uugaaagacugcu

SEQ ID NO: 3537348 - RNA, 16 nt, Pseudomonas putida KT2440
uugaacagcagcgccg

SEQ ID NO: 3537349 - RNA, 19 nt, Pseudomonas putida KT2440
uugaacccgugcaucugcu

SEQ ID NO: 3537350 - RNA, 20 nt, Pseudomonas putida KT2440
uugaacccgugcaucugcuc

SEQ ID NO: 3537351 - RNA, 17 nt, Pseudomonas putida KT2440
uugaacgacaaccccca

SEQ ID NO: 3537352 - RNA, 14 nt, Pseudomonas putida KT2440
uugaagaagcuccc

SEQ ID NO: 3537353 - RNA, 17 nt, Pseudomonas putida KT2440
uugaagcccggccgcgc

SEQ ID NO: 3537354 - RNA, 23 nt, Pseudomonas putida KT2440
uugaagcgaaaccuaaacugugg

SEQ ID NO: 3537355 - RNA, 23 nt, Pseudomonas putida KT2440
uugaagguauggccuuucugcuu

SEQ ID NO: 3537356 - RNA, 22 nt, Pseudomonas putida KT2440
uugaccgugaucaucagcgccg

SEQ ID NO: 3537357 - RNA, 23 nt, Pseudomonas putida KT2440
uugacgggugaccaggcccagca

SEQ ID NO: 3537358 - RNA, 18 nt, Pseudomonas putida KT2440
uugacggugaauuccuug

SEQ ID NO: 3537359 - RNA, 19 nt, Pseudomonas putida KT2440
uugacggugaauuccuugc

SEQ ID NO: 3537360 - RNA, 13 nt, Pseudomonas putida KT2440
uugacguccagcu

SEQ ID NO: 3537361 - RNA, 16 nt, Pseudomonas putida KT2440
uugacguuggccgcca

SEQ ID NO: 3537362 - RNA, 14 nt, Pseudomonas putida KT2440
uugacuaccaggua

SEQ ID NO: 3537363 - RNA, 17 nt, Pseudomonas putida KT2440
uugagacauucaccgcc

SEQ ID NO: 3537364 - RNA, 21 nt, Pseudomonas putida KT2440
uugagcaccgggcacuuggca

SEQ ID NO: 3537365 - RNA, 17 nt, Pseudomonas putida KT2440
uugagcagcagcccuuc

SEQ ID NO: 3537366 - RNA, 22 nt, Pseudomonas putida KT2440
uugagcaggucgaacagccccc

SEQ ID NO: 3537367 - RNA, 22 nt, Pseudomonas putida KT2440
uugagcgaaacccggcgcagcg

SEQ ID NO: 3537368 - RNA, 17 nt, Pseudomonas putida KT2440
uugagcuucagcgcgcc

SEQ ID NO: 3537369 - RNA, 16 nt, Pseudomonas putida KT2440
uugaggcacaaaaaag

SEQ ID NO: 3537370 - RNA, 23 nt, Pseudomonas putida KT2440
uugaggcacaaaaaagcccggca

SEQ ID NO: 3537371 - RNA, 12 nt, Pseudomonas putida KT2440
uugaggcggucg

SEQ ID NO: 3537372 - RNA, 16 nt, Pseudomonas putida KT2440
uugagguccgccucga

SEQ ID NO: 3537373 - RNA, 13 nt, Pseudomonas putida KT2440
uugauaccugcuu

SEQ ID NO: 3537374 - RNA, 15 nt, Pseudomonas putida KT2440
uugauauccagcacc

SEQ ID NO: 3537375 - RNA, 17 nt, Pseudomonas putida KT2440
uugaucaacugacgcag

SEQ ID NO: 3537376 - RNA, 15 nt, Pseudomonas putida KT2440
uugaucaccuccacu

SEQ ID NO: 3537377 - RNA, 19 nt, Pseudomonas putida KT2440
uugaucacguggcugaugc

SEQ ID NO: 3537378 - RNA, 14 nt, Pseudomonas putida KT2440
uugaucagcgccuc

SEQ ID NO: 3537379 - RNA, 21 nt, Pseudomonas putida KT2440
uugaucaggcccggcugaaac

SEQ ID NO: 3537380 - RNA, 18 nt, Pseudomonas putida KT2440
uugaucaggcccugcugc

SEQ ID NO: 3537381 - RNA, 20 nt, Pseudomonas putida KT2440
uugaucagguuacuggccaa

SEQ ID NO: 3537382 - RNA, 15 nt, Pseudomonas putida KT2440
uugauccagcccuuc

SEQ ID NO: 3537383 - RNA, 13 nt, Pseudomonas putida KT2440
uugcugcugccag

SEQ ID NO: 3537384 - RNA, 22 nt, Pseudomonas putida KT2440
uugcuggcgacgcugcccagca

SEQ ID NO: 3537385 - RNA, 18 nt, Pseudomonas putida KT2440
uugcugguguggcgccag

SEQ ID NO: 3537386 - RNA, 14 nt, Pseudomonas putida KT2440
uugcuguugcugca

SEQ ID NO: 3537387 - RNA, 23 nt, Pseudomonas putida KT2440
uugcuguuggggaggaacuguuu

SEQ ID NO: 3537388 - RNA, 16 nt, Pseudomonas putida KT2440
uugcuugacuauuucu

SEQ ID NO: 3537389 - RNA, 18 nt, Pseudomonas putida KT2440
uugcuugacuauuucuag

SEQ ID NO: 3537390 - RNA, 12 nt, Pseudomonas putida KT2440
uugcuuggcagc

SEQ ID NO: 3537391 - RNA, 17 nt, Pseudomonas putida KT2440
uuggaaauguucaacag

SEQ ID NO: 3537392 - RNA, 17 nt, Pseudomonas putida KT2440
uuggacagcgcccggcg

SEQ ID NO: 3537393 - RNA, 23 nt, Pseudomonas putida KT2440
uuggacgccgcaccgucgauguc

SEQ ID NO: 3537394 - RNA, 17 nt, Pseudomonas putida KT2440
uuggagcguugcaggcg

SEQ ID NO: 3537395 - RNA, 22 nt, Pseudomonas putida KT2440
uuggaggggcugcuuugcagcc

SEQ ID NO: 3537396 - RNA, 22 nt, Pseudomonas putida KT2440
uuggauacugcccgucaguuug

SEQ ID NO: 3537397 - RNA, 19 nt, Pseudomonas putida KT2440
uuggcaacaauguaccggg

SEQ ID NO: 3537398 - RNA, 18 nt, Pseudomonas putida KT2440
uuggcaccggcagcagca

SEQ ID NO: 3537399 - RNA, 14 nt, Pseudomonas putida KT2440
uuggcaccuaucgc

SEQ ID NO: 3537400 - RNA, 18 nt, Pseudomonas putida KT2440
uuggcacguugcugccug

SEQ ID NO: 3537401 - RNA, 19 nt, Pseudomonas putida KT2440
uuggcagcaccgcugccag

SEQ ID NO: 3537402 - RNA, 12 nt, Pseudomonas putida KT2440
uuggcagcagcc

SEQ ID NO: 3537403 - RNA, 17 nt, Pseudomonas putida KT2440
uuggcagcgcugcaagc

SEQ ID NO: 3537404 - RNA, 14 nt, Pseudomonas putida KT2440
uuggcagugccaug

SEQ ID NO: 3537405 - RNA, 15 nt, Pseudomonas putida KT2440
uuggcagugccaugu

SEQ ID NO: 3537406 - RNA, 17 nt, Pseudomonas putida KT2440
uuggcaucgcugcccgg

SEQ ID NO: 3537407 - RNA, 14 nt, Pseudomonas putida KT2440
uuggccaaugccag

SEQ ID NO: 3537408 - RNA, 15 nt, Pseudomonas putida KT2440
uuggccaaugccagg

SEQ ID NO: 3537409 - RNA, 18 nt, Pseudomonas putida KT2440
uuggccaccaccagcaac

SEQ ID NO: 3537410 - RNA, 14 nt, Pseudomonas putida KT2440
uuggccaccucauc

SEQ ID NO: 3537411 - RNA, 16 nt, Pseudomonas putida KT2440
uuggccacgaaaugca

SEQ ID NO: 3537412 - RNA, 14 nt, Pseudomonas putida KT2440
uuggccacgcccaa

SEQ ID NO: 3537413 - RNA, 17 nt, Pseudomonas putida KT2440
uuggccacgcccaaccc

SEQ ID NO: 3537414 - RNA, 14 nt, Pseudomonas putida KT2440
uuggccagcagggc

SEQ ID NO: 3537415 - RNA, 21 nt, Pseudomonas putida KT2440
uuggccagcagggccggcccu

SEQ ID NO: 3537416 - RNA, 21 nt, Pseudomonas putida KT2440
uuggccagcaggucaggcccu

SEQ ID NO: 3537417 - RNA, 21 nt, Pseudomonas putida KT2440
uuggcccgacaaagaagcgcc

SEQ ID NO: 3537418 - RNA, 17 nt, Pseudomonas putida KT2440
uuggccgacuggcgcac

SEQ ID NO: 3537419 - RNA, 16 nt, Pseudomonas putida KT2440
uuggccgccagcggca

SEQ ID NO: 3537420 - RNA, 23 nt, Pseudomonas putida KT2440
uuggccggcaggcccggcccuuu

SEQ ID NO: 3537421 - RNA, 12 nt, Pseudomonas putida KT2440
uuggccgggccu

SEQ ID NO: 3537422 - RNA, 14 nt, Pseudomonas putida KT2440
uuggccgggccuuu

SEQ ID NO: 3537423 - RNA, 21 nt, Pseudomonas putida KT2440
uuggccggguuuacaccaccg

SEQ ID NO: 3537424 - RNA, 14 nt, Pseudomonas putida KT2440
uuggccuucccuuc

SEQ ID NO: 3537425 - RNA, 11 nt, Pseudomonas putida KT2440
uuggcgaaugc

SEQ ID NO: 3537426 - RNA, 19 nt, Pseudomonas putida KT2440
uuggcgcgacauguucagc

SEQ ID NO: 3537427 - RNA, 21 nt, Pseudomonas putida KT2440
uuggcgcgacauguucagcuu

SEQ ID NO: 3537428 - RNA, 13 nt, Pseudomonas putida KT2440
uuggcggcaggcg

SEQ ID NO: 3537429 - RNA, 16 nt, Pseudomonas putida KT2440
uuggcggcccuaucgc

SEQ ID NO: 3537430 - RNA, 15 nt, Pseudomonas putida KT2440
uuggcggugagaugu

SEQ ID NO: 3537431 - RNA, 15 nt, Pseudomonas putida KT2440
uuggcguccacagcc

SEQ ID NO: 3537432 - RNA, 14 nt, Pseudomonas putida KT2440
uuggcguccaggua

SEQ ID NO: 3537433 - RNA, 18 nt, Pseudomonas putida KT2440
uuggcgucggcaccggcg

SEQ ID NO: 3537434 - RNA, 20 nt, Pseudomonas putida KT2440
uuggcucuguggauuucaau

SEQ ID NO: 3537435 - RNA, 18 nt, Pseudomonas putida KT2440
uuggcugccggccucgag

SEQ ID NO: 3537436 - RNA, 20 nt, Pseudomonas putida KT2440
uuggcuuacaacaggaacag

SEQ ID NO: 3537437 - RNA, 13 nt, Pseudomonas putida KT2440
uuggcuucgccgg

SEQ ID NO: 3537438 - RNA, 20 nt, Pseudomonas putida KT2440
uuggcuucggcggcuuucag

SEQ ID NO: 3537439 - RNA, 19 nt, Pseudomonas putida KT2440
uuggcuucuucgcgggcau

SEQ ID NO: 3537440 - RNA, 15 nt, Pseudomonas putida KT2440
uuggcuuguccagcc

SEQ ID NO: 3537441 - RNA, 13 nt, Pseudomonas putida KT2440
uuggcuuugccgg

SEQ ID NO: 3537442 - RNA, 15 nt, Pseudomonas putida KT2440
uugggaagcgggcua

SEQ ID NO: 3537443 - RNA, 13 nt, Pseudomonas putida KT2440
uugggcccgccau

SEQ ID NO: 3537444 - RNA, 21 nt, Pseudomonas putida KT2440
uugggcggcgugaccagcccg

SEQ ID NO: 3537445 - RNA, 21 nt, Pseudomonas putida KT2440
uugggcugggcgucaaccaau

SEQ ID NO: 3537446 - RNA, 22 nt, Pseudomonas putida KT2440
uugggcuucaugcacaacgcgc

SEQ ID NO: 3537447 - RNA, 19 nt, Pseudomonas putida KT2440
uugggguccuguuugccga

SEQ ID NO: 3537448 - RNA, 17 nt, Pseudomonas putida KT2440
uugggguuuggugguug

SEQ ID NO: 3537449 - RNA, 21 nt, Pseudomonas putida KT2440
uuggguagugcauuucgucga

SEQ ID NO: 3537450 - RNA, 13 nt, Pseudomonas putida KT2440
uuggucagggcaa

SEQ ID NO: 3537451 - RNA, 13 nt, Pseudomonas putida KT2440
uugguccagggcc

SEQ ID NO: 3537452 - RNA, 23 nt, Pseudomonas putida KT2440
uugguccgggucugauugggccc

SEQ ID NO: 3537453 - RNA, 21 nt, Pseudomonas putida KT2440
uuggucgugcauguagccaau

SEQ ID NO: 3537454 - RNA, 19 nt, Pseudomonas putida KT2440
uuggucuguacaaaagauc

SEQ ID NO: 3537455 - RNA, 16 nt, Pseudomonas putida KT2440
uuggugcaugcaagca

SEQ ID NO: 3537456 - RNA, 20 nt, Pseudomonas putida KT2440
uuggugcgccuccagcagcg

SEQ ID NO: 3537457 - RNA, 14 nt, Pseudomonas putida KT2440
uuggugcgcgcauc

SEQ ID NO: 3537458 - RNA, 13 nt, Pseudomonas putida KT2440
uugguguggcagc

SEQ ID NO: 3537459 - RNA, 12 nt, Pseudomonas putida KT2440
uugguuaaaagc

SEQ ID NO: 3537460 - RNA, 17 nt, Pseudomonas putida KT2440
uugguuggcggagccag

SEQ ID NO: 3537461 - RNA, 11 nt, Pseudomonas putida KT2440
uugguuugccu

SEQ ID NO: 3537462 - RNA, 19 nt, Pseudomonas putida KT2440
uuguaagccaugaucagcg

SEQ ID NO: 3537463 - RNA, 14 nt, Pseudomonas putida KT2440
uuguagcccaccac

SEQ ID NO: 3537464 - RNA, 14 nt, Pseudomonas putida KT2440
uuguagcucaggua

SEQ ID NO: 3537465 - RNA, 18 nt, Pseudomonas putida KT2440
uuguaggagcggguuuac

SEQ ID NO: 3537466 - RNA, 20 nt, Pseudomonas putida KT2440
uuguaggagcugauucagca

SEQ ID NO: 3537467 - RNA, 13 nt, Pseudomonas putida KT2440
uuguaggcggcaa

SEQ ID NO: 3537468 - RNA, 22 nt, Pseudomonas putida KT2440
uuguaguucuuggucagcauca

SEQ ID NO: 3537469 - RNA, 17 nt, Pseudomonas putida KT2440
uuguauuggccaagaau

SEQ ID NO: 3537470 - RNA, 14 nt, Pseudomonas putida KT2440
uugucaaaugcccc

SEQ ID NO: 3537471 - RNA, 13 nt, Pseudomonas putida KT2440
uugucaccccguu

SEQ ID NO: 3537472 - RNA, 23 nt, Pseudomonas putida KT2440
uugucagcaaccggacggguuuc

SEQ ID NO: 3537473 - RNA, 13 nt, Pseudomonas putida KT2440
uugucauugccca

SEQ ID NO: 3537474 - RNA, 23 nt, Pseudomonas putida KT2440
uugucauugcccaagcgcuccgc

SEQ ID NO: 3537475 - RNA, 22 nt, Pseudomonas putida KT2440
uugucccaggccaucagcagcu

SEQ ID NO: 3537476 - RNA, 23 nt, Pseudomonas putida KT2440
uuguccuggaucagccgcgccau

SEQ ID NO: 3537477 - RNA, 20 nt, Pseudomonas putida KT2440
uuguccuuguugaccccggg

SEQ ID NO: 3537478 - RNA, 12 nt, Pseudomonas putida KT2440
uugucgaacagc

SEQ ID NO: 3537479 - RNA, 13 nt, Pseudomonas putida KT2440
uugucgaacagca

SEQ ID NO: 3537480 - RNA, 20 nt, Pseudomonas putida KT2440
uugucgaacagcauccagcg

SEQ ID NO: 3537481 - RNA, 22 nt, Pseudomonas putida KT2440
uugucgaagcgcaccucggcca

SEQ ID NO: 3537482 - RNA, 23 nt, Pseudomonas putida KT2440
uugucgacagugaauuccuugcu

SEQ ID NO: 3537483 - RNA, 12 nt, Pseudomonas putida KT2440
uugucgaccugg

SEQ ID NO: 3537484 - RNA, 16 nt, Pseudomonas putida KT2440
uugucgaccuggcucu

SEQ ID NO: 3537485 - RNA, 19 nt, Pseudomonas putida KT2440
uugucgacugcacugccag

SEQ ID NO: 3537486 - RNA, 18 nt, Pseudomonas putida KT2440
uugucgaugccugcuaau

SEQ ID NO: 3537487 - RNA, 16 nt, Pseudomonas putida KT2440
uugucggcgcgcggcu

SEQ ID NO: 3537488 - RNA, 23 nt, Pseudomonas putida KT2440
uugucuccgaacgccuuggccuc

SEQ ID NO: 3537489 - RNA, 14 nt, Pseudomonas putida KT2440
uuuuauaaagagac

SEQ ID NO: 3537490 - RNA, 21 nt, Pseudomonas putida KT2440
uuuucauaccgagaaugaaac

SEQ ID NO: 3537491 - RNA, 14 nt, Pseudomonas putida KT2440
uuuuccaacuccac

SEQ ID NO: 3537492 - RNA, 22 nt, Pseudomonas putida KT2440
uuuucgucaagguugcucaggg

SEQ ID NO: 3537493 - RNA, 14 nt, Pseudomonas putida KT2440
uuuucuaaguccuu

SEQ ID NO: 3537494 - RNA, 16 nt, Pseudomonas putida KT2440
uuuucuauugcucagu

SEQ ID NO: 3537495 - RNA, 20 nt, Pseudomonas putida KT2440
uuuucuuuacaacccagacu

SEQ ID NO: 3537496 - RNA, 19 nt, Pseudomonas putida KT2440
uuuugaagucgagcgccgc

SEQ ID NO: 3537497 - RNA, 14 nt, Pseudomonas putida KT2440
uuuugaauuuuuua

SEQ ID NO: 3537498 - RNA, 14 nt, Pseudomonas putida KT2440
uuuuggauuuuuug

SEQ ID NO: 3537499 - RNA, 13 nt, Pseudomonas putida KT2440
uuuuggcucaggu

SEQ ID NO: 3537500 - RNA, 19 nt, Pseudomonas putida KT2440
uuuugugccggacucaccc

SEQ ID NO: 3537501 - RNA, 13 nt, Pseudomonas putida KT2440
uuuugugccugug

SEQ ID NO: 3537502 - RNA, 11 nt, Pseudomonas putida KT2440
uuuuugugccu

SEQ ID NO: 3537503 - RNA, 16 nt, Pseudomonas putida KT2440
ggcaggcgcagcugcc

SEQ ID NO: 3537504 - RNA, 19 nt, Pseudomonas putida KT2440
ggcaggcgguccagcaagc

SEQ ID NO: 3537505 - RNA, 20 nt, Pseudomonas putida KT2440
ggcaggcucagggcagcaac

SEQ ID NO: 3537506 - RNA, 14 nt, Pseudomonas putida KT2440
ggcagggcacacuu

SEQ ID NO: 3537507 - RNA, 18 nt, Pseudomonas putida KT2440
ggcagggugaucgcgcug

SEQ ID NO: 3537508 - RNA, 20 nt, Pseudomonas putida KT2440
ggcaggguucgcuguccuga

SEQ ID NO: 3537509 - RNA, 18 nt, Pseudomonas putida KT2440
ggcaggucagcgagcggg

SEQ ID NO: 3537510 - RNA, 16 nt, Pseudomonas putida KT2440
ggcaggucauuggcgc

SEQ ID NO: 3537511 - RNA, 15 nt, Pseudomonas putida KT2440
ggcaggucgacccgc

SEQ ID NO: 3537512 - RNA, 16 nt, Pseudomonas putida KT2440
ggcaggucgacccgcg

SEQ ID NO: 3537513 - RNA, 19 nt, Pseudomonas putida KT2440
ggcaggucgaugaucgccg

SEQ ID NO: 3537514 - RNA, 18 nt, Pseudomonas putida KT2440
ggcagguucgaccacugc

SEQ ID NO: 3537515 - RNA, 19 nt, Pseudomonas putida KT2440
ggcagguucgaccacugca

SEQ ID NO: 3537516 - RNA, 19 nt, Pseudomonas putida KT2440
ggcagguugaugugcaggu

SEQ ID NO: 3537517 - RNA, 18 nt, Pseudomonas putida KT2440
ggcaguacauagaacagc

SEQ ID NO: 3537518 - RNA, 19 nt, Pseudomonas putida KT2440
ggcaguacauagaacagca

SEQ ID NO: 3537519 - RNA, 20 nt, Pseudomonas putida KT2440
ggcaguacauagaacagcau

SEQ ID NO: 3537520 - RNA, 22 nt, Pseudomonas putida KT2440
ggcaguagaaaguccaucugcu

SEQ ID NO: 3537521 - RNA, 20 nt, Pseudomonas putida KT2440
ggcagucacccaccggcucc

SEQ ID NO: 3537522 - RNA, 19 nt, Pseudomonas putida KT2440
ggcagucagggucucggcc

SEQ ID NO: 3537523 - RNA, 20 nt, Pseudomonas putida KT2440
ggcaguccugcaacucggcc

SEQ ID NO: 3537524 - RNA, 21 nt, Pseudomonas putida KT2440
ggcaguccugcaacucggccu

SEQ ID NO: 3537525 - RNA, 22 nt, Pseudomonas putida KT2440
ggcaguccugcaacucggccuu

SEQ ID NO: 3537526 - RNA, 19 nt, Pseudomonas putida KT2440
ggcagucuucaagcucgaa

SEQ ID NO: 3537527 - RNA, 23 nt, Pseudomonas putida KT2440
ggcagucuucaagcucgaagcgc

SEQ ID NO: 3537528 - RNA, 11 nt, Pseudomonas putida KT2440
ggcagugaacu

SEQ ID NO: 3537529 - RNA, 21 nt, Pseudomonas putida KT2440
ggcagugcaauaccagccugg

SEQ ID NO: 3537530 - RNA, 22 nt, Pseudomonas putida KT2440
ggcagugcacccgcgaguucau

SEQ ID NO: 3537531 - RNA, 13 nt, Pseudomonas putida KT2440
ggcagugccugga

SEQ ID NO: 3537532 - RNA, 20 nt, Pseudomonas putida KT2440
ggcaguguacauggccgcca

SEQ ID NO: 3537533 - RNA, 16 nt, Pseudomonas putida KT2440
ggcaguguggcaaggg

SEQ ID NO: 3537534 - RNA, 19 nt, Pseudomonas putida KT2440
ggcaguucgagcgccugau

SEQ ID NO: 3537535 - RNA, 18 nt, Pseudomonas putida KT2440
ggcauaacggcuggcgca

SEQ ID NO: 3537536 - RNA, 17 nt, Pseudomonas putida KT2440
ggcauacaggaccaggc

SEQ ID NO: 3537537 - RNA, 18 nt, Pseudomonas putida KT2440
ggcauaccaucuucugca

SEQ ID NO: 3537538 - RNA, 20 nt, Pseudomonas putida KT2440
ggcauaccgcaacaccugcc

SEQ ID NO: 3537539 - RNA, 21 nt, Pseudomonas putida KT2440
ggcauacgaggccgucguagg

SEQ ID NO: 3537540 - RNA, 22 nt, Pseudomonas putida KT2440
ggcauagauggcugucugcagc

SEQ ID NO: 3537541 - RNA, 15 nt, Pseudomonas putida KT2440
ggcauagcgcucgcg

SEQ ID NO: 3537542 - RNA, 14 nt, Pseudomonas putida KT2440
ggcauaggcuguca

SEQ ID NO: 3537543 - RNA, 21 nt, Pseudomonas putida KT2440
ggcauaguccaggaagcaggc

SEQ ID NO: 3537544 - RNA, 13 nt, Pseudomonas putida KT2440
ggcaucacgcugg

SEQ ID NO: 3537545 - RNA, 16 nt, Pseudomonas putida KT2440
ggcaucacgcuggcca

SEQ ID NO: 3537546 - RNA, 18 nt, Pseudomonas putida KT2440
ggcaucacgucacagcca

SEQ ID NO: 3537547 - RNA, 20 nt, Pseudomonas putida KT2440
ggcaucacuacccaggccaa

SEQ ID NO: 3537548 - RNA, 15 nt, Pseudomonas putida KT2440
ggcaucagcgcaccc

SEQ ID NO: 3537549 - RNA, 15 nt, Pseudomonas putida KT2440
ggcaucagggcccgg

SEQ ID NO: 3537550 - RNA, 16 nt, Pseudomonas putida KT2440
ggcaucauccugcugg

SEQ ID NO: 3537551 - RNA, 19 nt, Pseudomonas putida KT2440
ggcaucaugauggucacgc

SEQ ID NO: 3537552 - RNA, 13 nt, Pseudomonas putida KT2440
ggcauccacaccg

SEQ ID NO: 3537553 - RNA, 18 nt, Pseudomonas putida KT2440
ggcauccacaccguacug

SEQ ID NO: 3537554 - RNA, 19 nt, Pseudomonas putida KT2440
ggcauccacacgcugcugc

SEQ ID NO: 3537555 - RNA, 13 nt, Pseudomonas putida KT2440
ggcauccaccugc

SEQ ID NO: 3537556 - RNA, 21 nt, Pseudomonas putida KT2440
ggcauccagcucggcaaggcg

SEQ ID NO: 3537557 - RNA, 19 nt, Pseudomonas putida KT2440
ggcauccgccucauccucg

SEQ ID NO: 3537558 - RNA, 14 nt, Pseudomonas putida KT2440
ggcauccggcagcu

SEQ ID NO: 3537559 - RNA, 17 nt, Pseudomonas putida KT2440
ggcaucgaacgccgccu

SEQ ID NO: 3537560 - RNA, 18 nt, Pseudomonas putida KT2440
ggcaucgccaacagaggc

SEQ ID NO: 3537561 - RNA, 20 nt, Pseudomonas putida KT2440
ggcaucgccaacagaggccu

SEQ ID NO: 3537562 - RNA, 16 nt, Pseudomonas putida KT2440
ggcaucgccuccagcg

SEQ ID NO: 3537563 - RNA, 15 nt, Pseudomonas putida KT2440
ggcaucgcugccggg

SEQ ID NO: 3537564 - RNA, 13 nt, Pseudomonas putida KT2440
ggcaucggcgccc

SEQ ID NO: 3537565 - RNA, 14 nt, Pseudomonas putida KT2440
ggcaucggcgccuu

SEQ ID NO: 3537566 - RNA, 12 nt, Pseudomonas putida KT2440
ggcaugaacaca

SEQ ID NO: 3537567 - RNA, 16 nt, Pseudomonas putida KT2440
ggcaugaauaaccugg

SEQ ID NO: 3537568 - RNA, 21 nt, Pseudomonas putida KT2440
ggcaugacaaacgccagcaug

SEQ ID NO: 3537569 - RNA, 22 nt, Pseudomonas putida KT2440
ggcaugacaaacgccagcaugc

SEQ ID NO: 3537570 - RNA, 15 nt, Pseudomonas putida KT2440
ggcaugagccuggcc

SEQ ID NO: 3537571 - RNA, 15 nt, Pseudomonas putida KT2440
ggcaugcagcggcca

SEQ ID NO: 3537572 - RNA, 17 nt, Pseudomonas putida KT2440
ggcaugcagcggccagu

SEQ ID NO: 3537573 - RNA, 18 nt, Pseudomonas putida KT2440
ggcaugcaggaggucagc

SEQ ID NO: 3537574 - RNA, 23 nt, Pseudomonas putida KT2440
ggcaugccauugcaccaccccca

SEQ ID NO: 3537575 - RNA, 19 nt, Pseudomonas putida KT2440
ggcaugcccaguucgcgug

SEQ ID NO: 3537576 - RNA, 19 nt, Pseudomonas putida KT2440
ggcaugccccucgaacagc

SEQ ID NO: 3537577 - RNA, 14 nt, Pseudomonas putida KT2440
ggcaugcccgcccc

SEQ ID NO: 3537578 - RNA, 22 nt, Pseudomonas putida KT2440
ggcaugcccgccccugccagca

SEQ ID NO: 3537579 - RNA, 18 nt, Pseudomonas putida KT2440
ggcaugcgucuggcggcc

SEQ ID NO: 3537580 - RNA, 24 nt, Pseudomonas putida KT2440
ggcaugcuccaugguagauaagag

SEQ ID NO: 3537581 - RNA, 15 nt, Pseudomonas putida KT2440
ggcaugggccagggu

SEQ ID NO: 3537582 - RNA, 15 nt, Pseudomonas putida KT2440
ggcaugguggaaguc

SEQ ID NO: 3537583 - RNA, 20 nt, Pseudomonas putida KT2440
ggcauuuuucgaacagcucu

SEQ ID NO: 3537584 - RNA, 15 nt, Pseudomonas putida KT2440
ggccaaaccguccag

SEQ ID NO: 3537585 - RNA, 17 nt, Pseudomonas putida KT2440
ggccaaccacccgggca

SEQ ID NO: 3537586 - RNA, 17 nt, Pseudomonas putida KT2440
ggccaaccacgccugcg

SEQ ID NO: 3537587 - RNA, 20 nt, Pseudomonas putida KT2440
ggccaacggcaucacgcugg

SEQ ID NO: 3537588 - RNA, 13 nt, Pseudomonas putida KT2440
ggccaacucccca

SEQ ID NO: 3537589 - RNA, 18 nt, Pseudomonas putida KT2440
ggccaagccgcugccaca

SEQ ID NO: 3537590 - RNA, 14 nt, Pseudomonas putida KT2440
ggccaaggcggcga

SEQ ID NO: 3537591 - RNA, 19 nt, Pseudomonas putida KT2440
ggccaaggguuugccaggc

SEQ ID NO: 3537592 - RNA, 20 nt, Pseudomonas putida KT2440
ggccaaggucagcaagccgc

SEQ ID NO: 3537593 - RNA, 17 nt, Pseudomonas putida KT2440
ggccaaggucuccagca

SEQ ID NO: 3537594 - RNA, 16 nt, Pseudomonas putida KT2440
ggccaagguugccacc

SEQ ID NO: 3537595 - RNA, 18 nt, Pseudomonas putida KT2440
ggccaaguacggccagca

SEQ ID NO: 3537596 - RNA, 16 nt, Pseudomonas putida KT2440
ggccaauaccgcugca

SEQ ID NO: 3537597 - RNA, 17 nt, Pseudomonas putida KT2440
ggccaauaucuggugca

SEQ ID NO: 3537598 - RNA, 14 nt, Pseudomonas putida KT2440
ggccaaugccagga

SEQ ID NO: 3537599 - RNA, 13 nt, Pseudomonas putida KT2440
ggccaaugcugcc

SEQ ID NO: 3537600 - RNA, 15 nt, Pseudomonas putida KT2440
ggccaauggcaggua

SEQ ID NO: 3537601 - RNA, 21 nt, Pseudomonas putida KT2440
ggccaauggccgggauggcag

SEQ ID NO: 3537602 - RNA, 22 nt, Pseudomonas putida KT2440
ggccacacugcucagugcuggc

SEQ ID NO: 3537603 - RNA, 13 nt, Pseudomonas putida KT2440
ggccacagcgcca

SEQ ID NO: 3537604 - RNA, 17 nt, Pseudomonas putida KT2440
ggccaccacccgcuggg

SEQ ID NO: 3537605 - RNA, 22 nt, Pseudomonas putida KT2440
ggccaccaccgcguacagcugc

SEQ ID NO: 3537606 - RNA, 13 nt, Pseudomonas putida KT2440
ggccaccacggua

SEQ ID NO: 3537607 - RNA, 14 nt, Pseudomonas putida KT2440
ggccaccacgguac

SEQ ID NO: 3537608 - RNA, 19 nt, Pseudomonas putida KT2440
ggccaccacuucuggcugg

SEQ ID NO: 3537609 - RNA, 14 nt, Pseudomonas putida KT2440
ggccaccagcaccu

SEQ ID NO: 3537610 - RNA, 15 nt, Pseudomonas putida KT2440
ggccaccagcaccug

SEQ ID NO: 3537611 - RNA, 15 nt, Pseudomonas putida KT2440
ggccaccaggccuuu

SEQ ID NO: 3537612 - RNA, 18 nt, Pseudomonas putida KT2440
ggccaccaugaacagcac

SEQ ID NO: 3537613 - RNA, 19 nt, Pseudomonas putida KT2440
ggccaccauguacugcaga

SEQ ID NO: 3537614 - RNA, 14 nt, Pseudomonas putida KT2440
ggccacccgcguuu

SEQ ID NO: 3537615 - RNA, 18 nt, Pseudomonas putida KT2440
ggccacccggaccagcgc

SEQ ID NO: 3537616 - RNA, 15 nt, Pseudomonas putida KT2440
ggccacccuccgggu

SEQ ID NO: 3537617 - RNA, 20 nt, Pseudomonas putida KT2440
ggccacccuccgggucaggc

SEQ ID NO: 3537618 - RNA, 17 nt, Pseudomonas putida KT2440
ggccaccgccucggcua

SEQ ID NO: 3537619 - RNA, 17 nt, Pseudomonas putida KT2440
ggccaccggcagcaccu

SEQ ID NO: 3537620 - RNA, 23 nt, Pseudomonas putida KT2440
ggccaccuggucgaaugcgugca

SEQ ID NO: 3537621 - RNA, 13 nt, Pseudomonas putida KT2440
ggccaccuugugc

SEQ ID NO: 3537622 - RNA, 23 nt, Pseudomonas putida KT2440
ggccacgaauuucaaggcgccga

SEQ ID NO: 3537623 - RNA, 14 nt, Pseudomonas putida KT2440
ggccacgcccaacc

SEQ ID NO: 3537624 - RNA, 23 nt, Pseudomonas putida KT2440
ggccacgcccaaccccagcgcgu

SEQ ID NO: 3537625 - RNA, 14 nt, Pseudomonas putida KT2440
ggccacgccgccuu

SEQ ID NO: 3537626 - RNA, 15 nt, Pseudomonas putida KT2440
ggccacgcgcgccuu

SEQ ID NO: 3537627 - RNA, 14 nt, Pseudomonas putida KT2440
ggccacgcugcggc

SEQ ID NO: 3537628 - RNA, 18 nt, Pseudomonas putida KT2440
ggccacggaucaccacgu

SEQ ID NO: 3537629 - RNA, 20 nt, Pseudomonas putida KT2440
ggccacggcaauggcccgcu

SEQ ID NO: 3537630 - RNA, 14 nt, Pseudomonas putida KT2440
ggccacggccgagu

SEQ ID NO: 3537631 - RNA, 21 nt, Pseudomonas putida KT2440
ggccacgguagccagucugcu

SEQ ID NO: 3537632 - RNA, 14 nt, Pseudomonas putida KT2440
ggccacgguccagu

SEQ ID NO: 3537633 - RNA, 19 nt, Pseudomonas putida KT2440
ggccacgguguauccagcc

SEQ ID NO: 3537634 - RNA, 22 nt, Pseudomonas putida KT2440
ggccacgguguauccagcccgg

SEQ ID NO: 3537635 - RNA, 17 nt, Pseudomonas putida KT2440
ggccacggugucggaca

SEQ ID NO: 3537636 - RNA, 17 nt, Pseudomonas putida KT2440
ggccacguugaucgucg

SEQ ID NO: 3537637 - RNA, 19 nt, Pseudomonas putida KT2440
ggccacguugaucgucggc

SEQ ID NO: 3537638 - RNA, 21 nt, Pseudomonas putida KT2440
ggccacguugaucgucggccc

SEQ ID NO: 3537639 - RNA, 14 nt, Pseudomonas putida KT2440
ggccacugcgcagu

SEQ ID NO: 3537640 - RNA, 19 nt, Pseudomonas putida KT2440
ggccacugguacagcucac

SEQ ID NO: 3537641 - RNA, 14 nt, Pseudomonas putida KT2440
ggccacuucgcgag

SEQ ID NO: 3537642 - RNA, 15 nt, Pseudomonas putida KT2440
ggccagaccuugcgc

SEQ ID NO: 3537643 - RNA, 20 nt, Pseudomonas putida KT2440
ggccagaccuugcgcacggc

SEQ ID NO: 3537644 - RNA, 12 nt, Pseudomonas putida KT2440
ggccagagcgcg

SEQ ID NO: 3537645 - RNA, 19 nt, Pseudomonas putida KT2440
ggccagcacaaccacugca

SEQ ID NO: 3537646 - RNA, 17 nt, Pseudomonas putida KT2440
ggccagcacgaacagca

SEQ ID NO: 3537647 - RNA, 18 nt, Pseudomonas putida KT2440
ggccagcacgaacagcaa

SEQ ID NO: 3537648 - RNA, 20 nt, Pseudomonas putida KT2440
ggccagcacggccagcaccg

SEQ ID NO: 3537649 - RNA, 18 nt, Pseudomonas putida KT2440
ggccagcacuacgccggc

SEQ ID NO: 3537650 - RNA, 14 nt, Pseudomonas putida KT2440
ggccagcagccccc

SEQ ID NO: 3537651 - RNA, 17 nt, Pseudomonas putida KT2440
ggccagcagccccccuu

SEQ ID NO: 3537652 - RNA, 21 nt, Pseudomonas putida KT2440
ggccagcaggccauacagggc

SEQ ID NO: 3537653 - RNA, 23 nt, Pseudomonas putida KT2440
ggccagcaggccauacagggccu

SEQ ID NO: 3537654 - RNA, 14 nt, Pseudomonas putida KT2440
ggccagcaggcccg

SEQ ID NO: 3537655 - RNA, 17 nt, Pseudomonas putida KT2440
ggccagcaggucagcac

SEQ ID NO: 3537656 - RNA, 20 nt, Pseudomonas putida KT2440
ggccagcaggucaggcccuu

SEQ ID NO: 3537657 - RNA, 19 nt, Pseudomonas putida KT2440
ggccagcagguugaacagg

SEQ ID NO: 3537658 - RNA, 18 nt, Pseudomonas putida KT2440
ggccagcaguucgucgag

SEQ ID NO: 3537659 - RNA, 20 nt, Pseudomonas putida KT2440
ggccagcaguucgucgagca

SEQ ID NO: 3537660 - RNA, 19 nt, Pseudomonas putida KT2440
ggccagccagguauggcca

SEQ ID NO: 3537661 - RNA, 16 nt, Pseudomonas putida KT2440
ggccagccccagcggc

SEQ ID NO: 3537662 - RNA, 12 nt, Pseudomonas putida KT2440
ggccagccgagc

SEQ ID NO: 3537663 - RNA, 17 nt, Pseudomonas putida KT2440
ggccagccgaggggugu

SEQ ID NO: 3537664 - RNA, 18 nt, Pseudomonas putida KT2440
ggccagccgccgccgagu

SEQ ID NO: 3537665 - RNA, 19 nt, Pseudomonas putida KT2440
ggccagccgccgccgagug

SEQ ID NO: 3537666 - RNA, 16 nt, Pseudomonas putida KT2440
ggccagccgcgccagg

SEQ ID NO: 3537667 - RNA, 19 nt, Pseudomonas putida KT2440
ggccagccgcgccaggucg

SEQ ID NO: 3537668 - RNA, 14 nt, Pseudomonas putida KT2440
ggccagccggcagc

SEQ ID NO: 3537669 - RNA, 16 nt, Pseudomonas putida KT2440
ggccagccggcagcaa

SEQ ID NO: 3537670 - RNA, 15 nt, Pseudomonas putida KT2440
ggccagccggcgcug

SEQ ID NO: 3537671 - RNA, 21 nt, Pseudomonas putida KT2440
ggccagccggcgcuggacagc

SEQ ID NO: 3537672 - RNA, 13 nt, Pseudomonas putida KT2440
ggccagccguugu

SEQ ID NO: 3537673 - RNA, 15 nt, Pseudomonas putida KT2440
ggccagcgacccuga

SEQ ID NO: 3537674 - RNA, 21 nt, Pseudomonas putida KT2440
ggccagcgauaaaccagcagc

SEQ ID NO: 3537675 - RNA, 13 nt, Pseudomonas putida KT2440
ggccagcgcacag

SEQ ID NO: 3537676 - RNA, 17 nt, Pseudomonas putida KT2440
ggccagcgcacagcugc

SEQ ID NO: 3537677 - RNA, 19 nt, Pseudomonas putida KT2440
ggccagcgcacagcugccg

SEQ ID NO: 3537678 - RNA, 13 nt, Pseudomonas putida KT2440
ggccagcgcaucg

SEQ ID NO: 3537679 - RNA, 17 nt, Pseudomonas putida KT2440
ggccagcgccugcaggc

SEQ ID NO: 3537680 - RNA, 20 nt, Pseudomonas putida KT2440
ggccagcgccugcugccagg

SEQ ID NO: 3537681 - RNA, 20 nt, Pseudomonas putida KT2440
ggccagcgcgcugagcaggu

SEQ ID NO: 3537682 - RNA, 22 nt, Pseudomonas putida KT2440
ggccagcgcgguagcugccgcg

SEQ ID NO: 3537683 - RNA, 21 nt, Pseudomonas putida KT2440
ggccagcggcacgucacugca

SEQ ID NO: 3537684 - RNA, 20 nt, Pseudomonas putida KT2440
ggccagcgucagggucucgc

SEQ ID NO: 3537685 - RNA, 21 nt, Pseudomonas putida KT2440
ggccagcguggccgccaacag

SEQ ID NO: 3537686 - RNA, 22 nt, Pseudomonas putida KT2440
ggccagcguuuguaaguaggcg

SEQ ID NO: 3537687 - RNA, 15 nt, Pseudomonas putida KT2440
ggccagcucauccag

SEQ ID NO: 3537688 - RNA, 18 nt, Pseudomonas putida KT2440
ggccagcucauccagccg

SEQ ID NO: 3537689 - RNA, 19 nt, Pseudomonas putida KT2440
ggccagcucauccagccgc

SEQ ID NO: 3537690 - RNA, 21 nt, Pseudomonas putida KT2440
ggccagcucauccagccgcgu

SEQ ID NO: 3537691 - RNA, 22 nt, Pseudomonas putida KT2440
ggccagcucggcaguggcggug

SEQ ID NO: 3537692 - RNA, 14 nt, Pseudomonas putida KT2440
ggccagcucggccg

SEQ ID NO: 3537693 - RNA, 15 nt, Pseudomonas putida KT2440
ggccagcugcugcgg

SEQ ID NO: 3537694 - RNA, 18 nt, Pseudomonas putida KT2440
ggccagcugcugcggcac

SEQ ID NO: 3537695 - RNA, 16 nt, Pseudomonas putida KT2440
ggccagcuucgacgaa

SEQ ID NO: 3537696 - RNA, 16 nt, Pseudomonas putida KT2440
ggccagcuucucggca

SEQ ID NO: 3537697 - RNA, 16 nt, Pseudomonas putida KT2440
ggccaggaacagcgcc

SEQ ID NO: 3537698 - RNA, 16 nt, Pseudomonas putida KT2440
ggccaggccccuuggc

SEQ ID NO: 3537699 - RNA, 14 nt, Pseudomonas putida KT2440
ggccaggcucgacg

SEQ ID NO: 3537700 - RNA, 17 nt, Pseudomonas putida KT2440
ggccaggcucgacggcg

SEQ ID NO: 3537701 - RNA, 23 nt, Pseudomonas putida KT2440
ggccagggauuccuuggucaggu

SEQ ID NO: 3537702 - RNA, 14 nt, Pseudomonas putida KT2440
ggccagggcaaaca

SEQ ID NO: 3537703 - RNA, 18 nt, Pseudomonas putida KT2440
ggccagggcaucggacag

SEQ ID NO: 3537704 - RNA, 15 nt, Pseudomonas putida KT2440
ggccagggcccgccg

SEQ ID NO: 3537705 - RNA, 16 nt, Pseudomonas putida KT2440
ggccagggcccgccgc

SEQ ID NO: 3537706 - RNA, 19 nt, Pseudomonas putida KT2440
ggccagggcccgccgcgcg

SEQ ID NO: 3537707 - RNA, 19 nt, Pseudomonas putida KT2440
ggccaggguacgauagggc

SEQ ID NO: 3537708 - RNA, 21 nt, Pseudomonas putida KT2440
ggccaggguacgauagggcgg

SEQ ID NO: 3537709 - RNA, 17 nt, Pseudomonas putida KT2440
ggccagguacaggcaaa

SEQ ID NO: 3537710 - RNA, 22 nt, Pseudomonas putida KT2440
ggccaguaaggaucgcgcagca

SEQ ID NO: 3537711 - RNA, 15 nt, Pseudomonas putida KT2440
ggccaguaccagcag

SEQ ID NO: 3537712 - RNA, 22 nt, Pseudomonas putida KT2440
ggccaguaccuucuggcuggag

SEQ ID NO: 3537713 - RNA, 19 nt, Pseudomonas putida KT2440
ggccagugagccucacaca

SEQ ID NO: 3537714 - RNA, 14 nt, Pseudomonas putida KT2440
ggccaguugcccca

SEQ ID NO: 3537715 - RNA, 16 nt, Pseudomonas putida KT2440
ggccaguugccccagg

SEQ ID NO: 3537716 - RNA, 13 nt, Pseudomonas putida KT2440
ggccaguuguccg

SEQ ID NO: 3537717 - RNA, 20 nt, Pseudomonas putida KT2440
ggccauacagggccuggcgc

SEQ ID NO: 3537718 - RNA, 20 nt, Pseudomonas putida KT2440
ggccauaccuucggggaugu

SEQ ID NO: 3537719 - RNA, 18 nt, Pseudomonas putida KT2440
ggccauagcccucggcaa

SEQ ID NO: 3537720 - RNA, 18 nt, Pseudomonas putida KT2440
ggccauaguugaccagca

SEQ ID NO: 3537721 - RNA, 19 nt, Pseudomonas putida KT2440
ggccauaguugaccagcac

SEQ ID NO: 3537722 - RNA, 17 nt, Pseudomonas putida KT2440
ggccauauugcugagcc

SEQ ID NO: 3537723 - RNA, 18 nt, Pseudomonas putida KT2440
ggccauauugcugagcca

SEQ ID NO: 3537724 - RNA, 20 nt, Pseudomonas putida KT2440
ggccauauugcugagccagu

SEQ ID NO: 3537725 - RNA, 19 nt, Pseudomonas putida KT2440
ggccaucaauaccggcaug

SEQ ID NO: 3537726 - RNA, 18 nt, Pseudomonas putida KT2440
ggccaucacuucacgggu

SEQ ID NO: 3537727 - RNA, 16 nt, Pseudomonas putida KT2440
ggccaucagcaagccg

SEQ ID NO: 3537728 - RNA, 15 nt, Pseudomonas putida KT2440
ggccaucaucugcug

SEQ ID NO: 3537729 - RNA, 14 nt, Pseudomonas putida KT2440
ggccaucgacccgc

SEQ ID NO: 3537730 - RNA, 21 nt, Pseudomonas putida KT2440
ggccaucgacccgcugcccgu

SEQ ID NO: 3537731 - RNA, 13 nt, Pseudomonas putida KT2440
ggccaugccaccc

SEQ ID NO: 3537732 - RNA, 15 nt, Pseudomonas putida KT2440
ggccaugcccuugcc

SEQ ID NO: 3537733 - RNA, 22 nt, Pseudomonas putida KT2440
ggccauggugcacgccagccag

SEQ ID NO: 3537734 - RNA, 13 nt, Pseudomonas putida KT2440
ggccaugugcucg

SEQ ID NO: 3537735 - RNA, 22 nt, Pseudomonas putida KT2440
ggccauucgcgggcaugcccgc

SEQ ID NO: 3537736 - RNA, 15 nt, Pseudomonas putida KT2440
ggccauuuccggccc

SEQ ID NO: 3537737 - RNA, 23 nt, Pseudomonas putida KT2440
ggccauuucgcggcgcagggccu

SEQ ID NO: 3537738 - RNA, 21 nt, Pseudomonas putida KT2440
ggcccaacgaaaaaggcccug

SEQ ID NO: 3537739 - RNA, 13 nt, Pseudomonas putida KT2440
ggcccacagugcu

SEQ ID NO: 3537740 - RNA, 17 nt, Pseudomonas putida KT2440
ggcccacagugcuucca

SEQ ID NO: 3537741 - RNA, 15 nt, Pseudomonas putida KT2440
ggcccaccagucugc

SEQ ID NO: 3537742 - RNA, 16 nt, Pseudomonas putida KT2440
ggcccacgccuuccac

SEQ ID NO: 3537743 - RNA, 23 nt, Pseudomonas putida KT2440
ggcccacgcucuguaucgaacag

SEQ ID NO: 3537744 - RNA, 17 nt, Pseudomonas putida KT2440
ggcccacggcguccagg

SEQ ID NO: 3537745 - RNA, 18 nt, Pseudomonas putida KT2440
ggcccacggcguccaggc

SEQ ID NO: 3537746 - RNA, 19 nt, Pseudomonas putida KT2440
ggcccacggcguccaggcc

SEQ ID NO: 3537747 - RNA, 13 nt, Pseudomonas putida KT2440
ggcccagcaacag

SEQ ID NO: 3537748 - RNA, 21 nt, Pseudomonas putida KT2440
ggcccagcaggugcccaagcg

SEQ ID NO: 3537749 - RNA, 16 nt, Pseudomonas putida KT2440
ggcccagccaccgacg

SEQ ID NO: 3537750 - RNA, 12 nt, Pseudomonas putida KT2440
ggcccagccgcg

SEQ ID NO: 3537751 - RNA, 11 nt, Pseudomonas putida KT2440
ggcccaguucc

SEQ ID NO: 3537752 - RNA, 21 nt, Pseudomonas putida KT2440
ggcccaguucggacaggcgcu

SEQ ID NO: 3537753 - RNA, 23 nt, Pseudomonas putida KT2440
ggcccaguucuccggcagguuga

SEQ ID NO: 3537754 - RNA, 21 nt, Pseudomonas putida KT2440
ggcccaucgcauaugccccag

SEQ ID NO: 3537755 - RNA, 23 nt, Pseudomonas putida KT2440
ggcccaucgcauaugccccaggc

SEQ ID NO: 3537756 - RNA, 14 nt, Pseudomonas putida KT2440
ggcccaugaucgcg

SEQ ID NO: 3537757 - RNA, 16 nt, Pseudomonas putida KT2440
ggcccaugucgaucag

SEQ ID NO: 3537758 - RNA, 20 nt, Pseudomonas putida KT2440
ggcccaugucgaucagcggc

SEQ ID NO: 3537759 - RNA, 14 nt, Pseudomonas putida KT2440
ggcccauuccgggu

SEQ ID NO: 3537760 - RNA, 21 nt, Pseudomonas putida KT2440
ggcccauuccgggucgccagu

SEQ ID NO: 3537761 - RNA, 17 nt, Pseudomonas putida KT2440
ggcccauucgcgggcaa

SEQ ID NO: 3537762 - RNA, 21 nt, Pseudomonas putida KT2440
ggcccauuucgcgggucaggg

SEQ ID NO: 3537763 - RNA, 15 nt, Pseudomonas putida KT2440
ggccccaccaggcac

SEQ ID NO: 3537764 - RNA, 18 nt, Pseudomonas putida KT2440
ggccccagacaaucaccu

SEQ ID NO: 3537765 - RNA, 16 nt, Pseudomonas putida KT2440
ggccccaggccaucca

SEQ ID NO: 3537766 - RNA, 17 nt, Pseudomonas putida KT2440
ggccccaggccauccag

SEQ ID NO: 3537767 - RNA, 12 nt, Pseudomonas putida KT2440
ggccccagggau

SEQ ID NO: 3537768 - RNA, 21 nt, Pseudomonas putida KT2440
ggccccagggaucgaugcccu

SEQ ID NO: 3537769 - RNA, 14 nt, Pseudomonas putida KT2440
ggccccagggggca

SEQ ID NO: 3537770 - RNA, 17 nt, Pseudomonas putida KT2440
ggccccagggggcagcu

SEQ ID NO: 3537771 - RNA, 22 nt, Pseudomonas putida KT2440
ggccccauuucaauuuccggcu

SEQ ID NO: 3537772 - RNA, 17 nt, Pseudomonas putida KT2440
ggccccccagccagcag

SEQ ID NO: 3537773 - RNA, 19 nt, Pseudomonas putida KT2440
ggccccccagccagcagau

SEQ ID NO: 3537774 - RNA, 17 nt, Pseudomonas putida KT2440
ggccccgauacagcgcg

SEQ ID NO: 3537775 - RNA, 14 nt, Pseudomonas putida KT2440
ggccccggccaggc

SEQ ID NO: 3537776 - RNA, 15 nt, Pseudomonas putida KT2440
ggccccggccaggcc

SEQ ID NO: 3537777 - RNA, 21 nt, Pseudomonas putida KT2440
ggccccggcgccgccaggcag

SEQ ID NO: 3537778 - RNA, 13 nt, Pseudomonas putida KT2440
ggccccucgacca

SEQ ID NO: 3537779 - RNA, 15 nt, Pseudomonas putida KT2440
ggccccugcaacagg

SEQ ID NO: 3537780 - RNA, 19 nt, Pseudomonas putida KT2440
ggccccugugggagcgggg

SEQ ID NO: 3537781 - RNA, 21 nt, Pseudomonas putida KT2440
ggccccugugggagcgggggc

SEQ ID NO: 3537782 - RNA, 22 nt, Pseudomonas putida KT2440
ggccccugugggagcgggggcg

SEQ ID NO: 3537783 - RNA, 18 nt, Pseudomonas putida KT2440
ggcccgaacgcagcgccg

SEQ ID NO: 3537784 - RNA, 13 nt, Pseudomonas putida KT2440
ggcccgagccccc

SEQ ID NO: 3537785 - RNA, 19 nt, Pseudomonas putida KT2440
ggcccgagcccccgcugcu

SEQ ID NO: 3537786 - RNA, 18 nt, Pseudomonas putida KT2440
ggcccgaugaucaggccg

SEQ ID NO: 3537787 - RNA, 22 nt, Pseudomonas putida KT2440
ggcccgaugggcgucgccugca

SEQ ID NO: 3537788 - RNA, 15 nt, Pseudomonas putida KT2440
ggcccgcaagggucu

SEQ ID NO: 3537789 - RNA, 23 nt, Pseudomonas putida KT2440
ggcccgccaccgccucgcccagg

SEQ ID NO: 3537790 - RNA, 21 nt, Pseudomonas putida KT2440
ggcccgccauucuucuccagg

SEQ ID NO: 3537791 - RNA, 13 nt, Pseudomonas putida KT2440
ggcccgcccagcu

SEQ ID NO: 3537792 - RNA, 16 nt, Pseudomonas putida KT2440
ggcccgcccagcuggc

SEQ ID NO: 3537793 - RNA, 17 nt, Pseudomonas putida KT2440
ggcccgcccagcuggcu

SEQ ID NO: 3537794 - RNA, 18 nt, Pseudomonas putida KT2440
ggcccgcccagcuggcuc

SEQ ID NO: 3537795 - RNA, 23 nt, Pseudomonas putida KT2440
ggcccgccccuuuagcaggcaag

SEQ ID NO: 3537796 - RNA, 20 nt, Pseudomonas putida KT2440
ggcccgccgccaccagcgcc

SEQ ID NO: 3537797 - RNA, 15 nt, Pseudomonas putida KT2440
ggcccgccgcgcggc

SEQ ID NO: 3537798 - RNA, 19 nt, Pseudomonas putida KT2440
ggcccgccgcgcggcuugc

SEQ ID NO: 3537799 - RNA, 22 nt, Pseudomonas putida KT2440
ggcccgcuauccucgaucgcca

SEQ ID NO: 3537800 - RNA, 12 nt, Pseudomonas putida KT2440
ggcccgcugcgc

SEQ ID NO: 3537801 - RNA, 16 nt, Pseudomonas putida KT2440
ggcccgcuugcgcggu

SEQ ID NO: 3537802 - RNA, 20 nt, Pseudomonas putida KT2440
ggcccggcugaaaccgcgaa

SEQ ID NO: 3537803 - RNA, 18 nt, Pseudomonas putida KT2440
ggcccggucccgcugccg

SEQ ID NO: 3537804 - RNA, 15 nt, Pseudomonas putida KT2440
ggcccgucaggcaaa

SEQ ID NO: 3537805 - RNA, 17 nt, Pseudomonas putida KT2440
ggcccgugguuggagcg

SEQ ID NO: 3537806 - RNA, 19 nt, Pseudomonas putida KT2440
ggcccgugguuggagcgca

SEQ ID NO: 3537807 - RNA, 21 nt, Pseudomonas putida KT2440
ggcccgugguuggagcgcagg

SEQ ID NO: 3537808 - RNA, 17 nt, Pseudomonas putida KT2440
ggcccuauggggugagc

SEQ ID NO: 3537809 - RNA, 18 nt, Pseudomonas putida KT2440
ggcccucaagggcgcuga

SEQ ID NO: 3537810 - RNA, 21 nt, Pseudomonas putida KT2440
ggcccuccccguuuggcagcu

SEQ ID NO: 3537811 - RNA, 18 nt, Pseudomonas putida KT2440
ggcccucgguggcucucc

SEQ ID NO: 3537812 - RNA, 23 nt, Pseudomonas putida KT2440
ggcccugaacuuggccuccagca

SEQ ID NO: 3537813 - RNA, 15 nt, Pseudomonas putida KT2440
ggcccugaaggccgc

SEQ ID NO: 3537814 - RNA, 15 nt, Pseudomonas putida KT2440
ggcccugaccgcggu

SEQ ID NO: 3537815 - RNA, 15 nt, Pseudomonas putida KT2440
ggcccugacgccagc

SEQ ID NO: 3537816 - RNA, 18 nt, Pseudomonas putida KT2440
ggcccugacgccagcgcu

SEQ ID NO: 3537817 - RNA, 21 nt, Pseudomonas putida KT2440
ggcccugcucacgcagcucgg

SEQ ID NO: 3537818 - RNA, 13 nt, Pseudomonas putida KT2440
ggcccugcugcuu

SEQ ID NO: 3537819 - RNA, 16 nt, Pseudomonas putida KT2440
ggcccugcuggccaau

SEQ ID NO: 3537820 - RNA, 12 nt, Pseudomonas putida KT2440
ggcccuggagcg

SEQ ID NO: 3537821 - RNA, 16 nt, Pseudomonas putida KT2440
ggcccuguacauccag

SEQ ID NO: 3537822 - RNA, 24 nt, Pseudomonas putida KT2440
ggcccuguacauccagcuccagca

SEQ ID NO: 3537823 - RNA, 17 nt, Pseudomonas putida KT2440
ggcccuguagagcgccu

SEQ ID NO: 3537824 - RNA, 18 nt, Pseudomonas putida KT2440
ggcccuguagagcgccuu

SEQ ID NO: 3537825 - RNA, 14 nt, Pseudomonas putida KT2440
ggcccugugccggg

SEQ ID NO: 3537826 - RNA, 21 nt, Pseudomonas putida KT2440
ggcccugugcuuugagcaggc

SEQ ID NO: 3537827 - RNA, 24 nt, Pseudomonas putida KT2440
ggcccugugcuuugagcaggcgcu

SEQ ID NO: 3537828 - RNA, 20 nt, Pseudomonas putida KT2440
ggcccuguguaggagcgggu

SEQ ID NO: 3537829 - RNA, 23 nt, Pseudomonas putida KT2440
ggcccuuaaggucaaucagggau

SEQ ID NO: 3537830 - RNA, 15 nt, Pseudomonas putida KT2440
ggcccuucgcgggca

SEQ ID NO: 3537831 - RNA, 15 nt, Pseudomonas putida KT2440
ggcccuucuccgccu

SEQ ID NO: 3537832 - RNA, 22 nt, Pseudomonas putida KT2440
ggcccuuucgcgggagacccgu

SEQ ID NO: 3537833 - RNA, 18 nt, Pseudomonas putida KT2440
ggcccuuucgcgggcgcg

SEQ ID NO: 3537834 - RNA, 16 nt, Pseudomonas putida KT2440
ggcccuuucgcgggua

SEQ ID NO: 3537835 - RNA, 23 nt, Pseudomonas putida KT2440
ggcccuuucgcggguaaacccgc

SEQ ID NO: 3537836 - RNA, 17 nt, Pseudomonas putida KT2440
ggcccuuucgcggguga

SEQ ID NO: 3537837 - RNA, 23 nt, Pseudomonas putida KT2440
ggccgaaaaaaucaugcgcuggc

SEQ ID NO: 3537838 - RNA, 15 nt, Pseudomonas putida KT2440
ggccgaaaccagccc

SEQ ID NO: 3537839 - RNA, 18 nt, Pseudomonas putida KT2440
ggccgaaaccagccccuu

SEQ ID NO: 3537840 - RNA, 19 nt, Pseudomonas putida KT2440
ggccgaaacgcgacagggc

SEQ ID NO: 3537841 - RNA, 19 nt, Pseudomonas putida KT2440
ggccgaacaccgccagccc

SEQ ID NO: 3537842 - RNA, 13 nt, Pseudomonas putida KT2440
ggccgaagcgguc

SEQ ID NO: 3537843 - RNA, 15 nt, Pseudomonas putida KT2440
ggccgaaggccagcc

SEQ ID NO: 3537844 - RNA, 17 nt, Pseudomonas putida KT2440
ggccgaaggccguggca

SEQ ID NO: 3537845 - RNA, 23 nt, Pseudomonas putida KT2440
ggccgaaguggcggcucgcugaa

SEQ ID NO: 3537846 - RNA, 22 nt, Pseudomonas putida KT2440
ggccgacaaaacugagcaagaa

SEQ ID NO: 3537847 - RNA, 18 nt, Pseudomonas putida KT2440
ggccgacucuucaccagc

SEQ ID NO: 3537848 - RNA, 14 nt, Pseudomonas putida KT2440
ggccgacuggcgca

SEQ ID NO: 3537849 - RNA, 13 nt, Pseudomonas putida KT2440
ggccgagcaggag

SEQ ID NO: 3537850 - RNA, 15 nt, Pseudomonas putida KT2440
ggccgagcaggagcu

SEQ ID NO: 3537851 - RNA, 16 nt, Pseudomonas putida KT2440
ggccgagcgcgagcgu

SEQ ID NO: 3537852 - RNA, 13 nt, Pseudomonas putida KT2440
ggccgaucaccag

SEQ ID NO: 3537853 - RNA, 16 nt, Pseudomonas putida KT2440
ggccgaucaccagcac

SEQ ID NO: 3537854 - RNA, 12 nt, Pseudomonas putida KT2440
ggccgaucacga

SEQ ID NO: 3537855 - RNA, 21 nt, Pseudomonas putida KT2440
ggccgaucaguacgaugcugc

SEQ ID NO: 3537856 - RNA, 17 nt, Pseudomonas putida KT2440
ggccgaugggcaggcca

SEQ ID NO: 3537857 - RNA, 18 nt, Pseudomonas putida KT2440
ggccgaugggcaggccau

SEQ ID NO: 3537858 - RNA, 23 nt, Pseudomonas putida KT2440
ggccgauuuggcccgcugcgccg

SEQ ID NO: 3537859 - RNA, 14 nt, Pseudomonas putida KT2440
ggccgcaaagcggc

SEQ ID NO: 3537860 - RNA, 19 nt, Pseudomonas putida KT2440
ggccgcaaagcggccccag

SEQ ID NO: 3537861 - RNA, 21 nt, Pseudomonas putida KT2440
ggccgcaaagcggcccccagc

SEQ ID NO: 3537862 - RNA, 15 nt, Pseudomonas putida KT2440
ggccgcaacgcggcc

SEQ ID NO: 3537863 - RNA, 16 nt, Pseudomonas putida KT2440
ggccgcaacgcggccc

SEQ ID NO: 3537864 - RNA, 20 nt, Pseudomonas putida KT2440
ggccgcaacgcggcccuggg

SEQ ID NO: 3537865 - RNA, 16 nt, Pseudomonas putida KT2440
ggccgcaaggcggccc

SEQ ID NO: 3537866 - RNA, 16 nt, Pseudomonas putida KT2440
ggccgcacaaggccgc

SEQ ID NO: 3537867 - RNA, 23 nt, Pseudomonas putida KT2440
ggccgcacgcgccucuugcaccu

SEQ ID NO: 3537868 - RNA, 21 nt, Pseudomonas putida KT2440
ggccgcagagcggcccugagc

SEQ ID NO: 3537869 - RNA, 23 nt, Pseudomonas putida KT2440
ggccgcagccucuucggccagca

SEQ ID NO: 3537870 - RNA, 16 nt, Pseudomonas putida KT2440
ggccgcauauacgccg

SEQ ID NO: 3537871 - RNA, 16 nt, Pseudomonas putida KT2440
ggccgcauccaugccg

SEQ ID NO: 3537872 - RNA, 15 nt, Pseudomonas putida KT2440
ggccgccaacagcgc

SEQ ID NO: 3537873 - RNA, 14 nt, Pseudomonas putida KT2440
ggccgccaagcggc

SEQ ID NO: 3537874 - RNA, 16 nt, Pseudomonas putida KT2440
ggccgccaagcggccc

SEQ ID NO: 3537875 - RNA, 18 nt, Pseudomonas putida KT2440
ggccgccaagcggcccca

SEQ ID NO: 3537876 - RNA, 20 nt, Pseudomonas putida KT2440
ggccgccaaggcgaugcuuu

SEQ ID NO: 3537877 - RNA, 15 nt, Pseudomonas putida KT2440
ggccgccacaugcug

SEQ ID NO: 3537878 - RNA, 23 nt, Pseudomonas putida KT2440
ggccgccagacaacuggccaggg

SEQ ID NO: 3537879 - RNA, 13 nt, Pseudomonas putida KT2440
ggccgccagcggc

SEQ ID NO: 3537880 - RNA, 14 nt, Pseudomonas putida KT2440
ggccgccagcggca

SEQ ID NO: 3537881 - RNA, 15 nt, Pseudomonas putida KT2440
ggccgccagcggcag

SEQ ID NO: 3537882 - RNA, 16 nt, Pseudomonas putida KT2440
ggccgccagcggcagu

SEQ ID NO: 3537883 - RNA, 14 nt, Pseudomonas putida KT2440
ggccgccaggaugg

SEQ ID NO: 3537884 - RNA, 22 nt, Pseudomonas putida KT2440
ggccgccauugaugccgaaggc

SEQ ID NO: 3537885 - RNA, 16 nt, Pseudomonas putida KT2440
ggccgcccucgcgcgu

SEQ ID NO: 3537886 - RNA, 22 nt, Pseudomonas putida KT2440
ggccgcccucuucgcgggcacg

SEQ ID NO: 3537887 - RNA, 13 nt, Pseudomonas putida KT2440
ggccgcccugcgg

SEQ ID NO: 3537888 - RNA, 19 nt, Pseudomonas putida KT2440
ggccgccgaacaggccggc

SEQ ID NO: 3537889 - RNA, 21 nt, Pseudomonas putida KT2440
ggccgccgccagaccaccuca

SEQ ID NO: 3537890 - RNA, 21 nt, Pseudomonas putida KT2440
ggccgccugaccugugcugaa

SEQ ID NO: 3537891 - RNA, 13 nt, Pseudomonas putida KT2440
ggccgccuugcgg

SEQ ID NO: 3537892 - RNA, 20 nt, Pseudomonas putida KT2440
ggccgccuugcggccccgga

SEQ ID NO: 3537893 - RNA, 23 nt, Pseudomonas putida KT2440
ggccgccuuggcuuccugcuggc

SEQ ID NO: 3537894 - RNA, 15 nt, Pseudomonas putida KT2440
ggccgcgaagcggcc

SEQ ID NO: 3537895 - RNA, 16 nt, Pseudomonas putida KT2440
ggccgcgaagcggccc

SEQ ID NO: 3537896 - RNA, 17 nt, Pseudomonas putida KT2440
ggccgcgaagcggcccc

SEQ ID NO: 3537897 - RNA, 20 nt, Pseudomonas putida KT2440
ggccgcgacgcggcccuggg

SEQ ID NO: 3537898 - RNA, 18 nt, Pseudomonas putida KT2440
ggccgcgcaauugccggu

SEQ ID NO: 3537899 - RNA, 15 nt, Pseudomonas putida KT2440
ggccgcgcagccuuu

SEQ ID NO: 3537900 - RNA, 14 nt, Pseudomonas putida KT2440
ggccgcgcagcggc

SEQ ID NO: 3537901 - RNA, 16 nt, Pseudomonas putida KT2440
ggccgcgcagcggccc

SEQ ID NO: 3537902 - RNA, 16 nt, Pseudomonas putida KT2440
ggccgcgcaggcggcu

SEQ ID NO: 3537903 - RNA, 21 nt, Pseudomonas putida KT2440
ggccgcgcgcccaucugcacg

SEQ ID NO: 3537904 - RNA, 21 nt, Pseudomonas putida KT2440
ggccgcgcgggugcgagaggc

SEQ ID NO: 3537905 - RNA, 18 nt, Pseudomonas putida KT2440
ggccgcggcugaacacgc

SEQ ID NO: 3537906 - RNA, 17 nt, Pseudomonas putida KT2440
ggccgcgucgcggcccc

SEQ ID NO: 3537907 - RNA, 20 nt, Pseudomonas putida KT2440
ggccgcguugcggcccuucg

SEQ ID NO: 3537908 - RNA, 18 nt, Pseudomonas putida KT2440
ggccgcuacgcgccccuu

SEQ ID NO: 3537909 - RNA, 15 nt, Pseudomonas putida KT2440
ggccgcuaggcggcc

SEQ ID NO: 3537910 - RNA, 17 nt, Pseudomonas putida KT2440
ggccgcuaggcggcccc

SEQ ID NO: 3537911 - RNA, 14 nt, Pseudomonas putida KT2440
ggccgcuccagcuc

SEQ ID NO: 3537912 - RNA, 13 nt, Pseudomonas putida KT2440
ggccgcugugcca

SEQ ID NO: 3537913 - RNA, 15 nt, Pseudomonas putida KT2440
ggccgcugugggagu

SEQ ID NO: 3537914 - RNA, 16 nt, Pseudomonas putida KT2440
ggccgcuuccaggaac

SEQ ID NO: 3537915 - RNA, 15 nt, Pseudomonas putida KT2440
ggccgcuucgcggau

SEQ ID NO: 3537916 - RNA, 19 nt, Pseudomonas putida KT2440
ggccgcuugcaaccgacgc

SEQ ID NO: 3537917 - RNA, 15 nt, Pseudomonas putida KT2440
ggccgcuugcugauc

SEQ ID NO: 3537918 - RNA, 15 nt, Pseudomonas putida KT2440
ggccgcuuggcggcc

SEQ ID NO: 3537919 - RNA, 16 nt, Pseudomonas putida KT2440
ggccgcuuugcggccc

SEQ ID NO: 3537920 - RNA, 19 nt, Pseudomonas putida KT2440
ggccgcuuugugcugcgaa

SEQ ID NO: 3537921 - RNA, 13 nt, Pseudomonas putida KT2440
ggccggacgacgc

SEQ ID NO: 3537922 - RNA, 21 nt, Pseudomonas putida KT2440
ggccggagaacaugaaaguga

SEQ ID NO: 3537923 - RNA, 22 nt, Pseudomonas putida KT2440
ggccggauagagcccggcgcag

SEQ ID NO: 3537924 - RNA, 23 nt, Pseudomonas putida KT2440
ggccggauagagcccggcgcagc

SEQ ID NO: 3537925 - RNA, 22 nt, Pseudomonas putida KT2440
ggccggcacagacaccgcaaau

SEQ ID NO: 3537926 - RNA, 17 nt, Pseudomonas putida KT2440
ggccggcacagaccgca

SEQ ID NO: 3537927 - RNA, 20 nt, Pseudomonas putida KT2440
ggccggcacaggcccaaaca

SEQ ID NO: 3537928 - RNA, 14 nt, Pseudomonas putida KT2440
ggccggcacaggcu

SEQ ID NO: 3537929 - RNA, 15 nt, Pseudomonas putida KT2440
ggccggcaccgacag

SEQ ID NO: 3537930 - RNA, 19 nt, Pseudomonas putida KT2440
ggccggcaccgacagcaac

SEQ ID NO: 3537931 - RNA, 16 nt, Pseudomonas putida KT2440
ggccggcacugaccac

SEQ ID NO: 3537932 - RNA, 13 nt, Pseudomonas putida KT2440
ggccggcagccag

SEQ ID NO: 3537933 - RNA, 23 nt, Pseudomonas putida KT2440
ggccggcagccagggccugaccg

SEQ ID NO: 3537934 - RNA, 20 nt, Pseudomonas putida KT2440
ggccggcccauucgcgggua

SEQ ID NO: 3537935 - RNA, 19 nt, Pseudomonas putida KT2440
ggccggccccacgcaguug

SEQ ID NO: 3537936 - RNA, 16 nt, Pseudomonas putida KT2440
ggccggcccugccggc

SEQ ID NO: 3537937 - RNA, 18 nt, Pseudomonas putida KT2440
ggccggcccugcuggcca

SEQ ID NO: 3537938 - RNA, 20 nt, Pseudomonas putida KT2440
ggccggcccuuucgcgggua

SEQ ID NO: 3537939 - RNA, 12 nt, Pseudomonas putida KT2440
ggccggccgggc

SEQ ID NO: 3537940 - RNA, 18 nt, Pseudomonas putida KT2440
ggccggcgcagauggugg

SEQ ID NO: 3537941 - RNA, 13 nt, Pseudomonas putida KT2440
ggccggcucgaac

SEQ ID NO: 3537942 - RNA, 15 nt, Pseudomonas putida KT2440
ggccggcucgaacug

SEQ ID NO: 3537943 - RNA, 23 nt, Pseudomonas putida KT2440
ggccggcucuaucuucaggcauc

SEQ ID NO: 3537944 - RNA, 15 nt, Pseudomonas putida KT2440
ggccgggauggcagu

SEQ ID NO: 3537945 - RNA, 16 nt, Pseudomonas putida KT2440
ggccgggauggcaguu

SEQ ID NO: 3537946 - RNA, 15 nt, Pseudomonas putida KT2440
ggccgggcucggccg

SEQ ID NO: 3537947 - RNA, 12 nt, Pseudomonas putida KT2440
ggccggggaugc

SEQ ID NO: 3537948 - RNA, 15 nt, Pseudomonas putida KT2440
ggccggggcaaccug

SEQ ID NO: 3537949 - RNA, 22 nt, Pseudomonas putida KT2440
ggccggggccgcuuggcggccc

SEQ ID NO: 3537950 - RNA, 14 nt, Pseudomonas putida KT2440
ggccggguccugca

SEQ ID NO: 3537951 - RNA, 16 nt, Pseudomonas putida KT2440
ggccgggucgaccugg

SEQ ID NO: 3537952 - RNA, 20 nt, Pseudomonas putida KT2440
ggccgggucgauagccagcc

SEQ ID NO: 3537953 - RNA, 21 nt, Pseudomonas putida KT2440
ggccggguuguggcuggcguc

SEQ ID NO: 3537954 - RNA, 23 nt, Pseudomonas putida KT2440
ggccggguuguggcuggcgucga

SEQ ID NO: 3537955 - RNA, 17 nt, Pseudomonas putida KT2440
ggccgguaccggauagc

SEQ ID NO: 3537956 - RNA, 15 nt, Pseudomonas putida KT2440
ggccgguacugccca

SEQ ID NO: 3537957 - RNA, 20 nt, Pseudomonas putida KT2440
ggccgguagcucgcuuucca

SEQ ID NO: 3537958 - RNA, 19 nt, Pseudomonas putida KT2440
ggccggucguuacccacca

SEQ ID NO: 3537959 - RNA, 13 nt, Pseudomonas putida KT2440
ggccgguggcuuc

SEQ ID NO: 3537960 - RNA, 19 nt, Pseudomonas putida KT2440
ggccguaaaguccgugccc

SEQ ID NO: 3537961 - RNA, 21 nt, Pseudomonas putida KT2440
ggccguaggccagguacaggc

SEQ ID NO: 3537962 - RNA, 13 nt, Pseudomonas putida KT2440
ggccgucaccgcu

SEQ ID NO: 3537963 - RNA, 22 nt, Pseudomonas putida KT2440
ggccgucaccgcugccgaucag

SEQ ID NO: 3537964 - RNA, 19 nt, Pseudomonas putida KT2440
ggccgucagcagcaggcgc

SEQ ID NO: 3537965 - RNA, 13 nt, Pseudomonas putida KT2440
ggccguccagcug

SEQ ID NO: 3537966 - RNA, 15 nt, Pseudomonas putida KT2440
ggccguccagcugag

SEQ ID NO: 3537967 - RNA, 20 nt, Pseudomonas putida KT2440
ggccguccagcugagcgcca

SEQ ID NO: 3537968 - RNA, 13 nt, Pseudomonas putida KT2440
ggccgucgcggcu

SEQ ID NO: 3537969 - RNA, 14 nt, Pseudomonas putida KT2440
ggccgugacgccgu

SEQ ID NO: 3537970 - RNA, 14 nt, Pseudomonas putida KT2440
ggccgugcaggcgg

SEQ ID NO: 3537971 - RNA, 23 nt, Pseudomonas putida KT2440
ggccguggugauguucucaucga

SEQ ID NO: 3537972 - RNA, 17 nt, Pseudomonas putida KT2440
ggccguugaaggcgaau

SEQ ID NO: 3537973 - RNA, 18 nt, Pseudomonas putida KT2440
ggccguugaucagcgaca

SEQ ID NO: 3537974 - RNA, 23 nt, Pseudomonas putida KT2440
ggccguuucacgccucaugaucu

SEQ ID NO: 3537975 - RNA, 22 nt, Pseudomonas putida KT2440
ggccuagcaaggccuccaggua

SEQ ID NO: 3537976 - RNA, 12 nt, Pseudomonas putida KT2440
ggccuaggacac

SEQ ID NO: 3537977 - RNA, 21 nt, Pseudomonas putida KT2440
ggccuaguucggcaccuuucu

SEQ ID NO: 3537978 - RNA, 15 nt, Pseudomonas putida KT2440
ggccuauucgcgggu

SEQ ID NO: 3537979 - RNA, 23 nt, Pseudomonas putida KT2440
ggccuauucgcggguaaacccgc

SEQ ID NO: 3537980 - RNA, 15 nt, Pseudomonas putida KT2440
ggccucaagccucgc

SEQ ID NO: 3537981 - RNA, 18 nt, Pseudomonas putida KT2440
ggccucacauucaccgcc

SEQ ID NO: 3537982 - RNA, 23 nt, Pseudomonas putida KT2440
ggccuccaccaccugcaggguca

SEQ ID NO: 3537983 - RNA, 11 nt, Pseudomonas putida KT2440
ggccuccagca

SEQ ID NO: 3537984 - RNA, 12 nt, Pseudomonas putida KT2440
ggccuccaggua

SEQ ID NO: 3537985 - RNA, 11 nt, Pseudomonas putida KT2440
ggccuccucgc

SEQ ID NO: 3537986 - RNA, 14 nt, Pseudomonas putida KT2440
ggccuccucgcggg

SEQ ID NO: 3537987 - RNA, 16 nt, Pseudomonas putida KT2440
ggccuccucgcgggca

SEQ ID NO: 3537988 - RNA, 23 nt, Pseudomonas putida KT2440
ggccuccucgcgggcaaacccgc

SEQ ID NO: 3537989 - RNA, 21 nt, Pseudomonas putida KT2440
ggccuccuugauguacuccug

SEQ ID NO: 3537990 - RNA, 15 nt, Pseudomonas putida KT2440
ggccucgaacauggc

SEQ ID NO: 3537991 - RNA, 16 nt, Pseudomonas putida KT2440
ggccucgaacauggcc

SEQ ID NO: 3537992 - RNA, 21 nt, Pseudomonas putida KT2440
ggccucgaggaaugacucgcg

SEQ ID NO: 3537993 - RNA, 16 nt, Pseudomonas putida KT2440
ggccucgauagcagcg

SEQ ID NO: 3537994 - RNA, 21 nt, Pseudomonas putida KT2440
ggccucgaugcggucuuccag

SEQ ID NO: 3537995 - RNA, 18 nt, Pseudomonas putida KT2440
ggccucggcgaucgccag

SEQ ID NO: 3537996 - RNA, 20 nt, Pseudomonas putida KT2440
ggccucggcgaucgccaggu

SEQ ID NO: 3537997 - RNA, 19 nt, Pseudomonas putida KT2440
ggccucgguacccgccagc

SEQ ID NO: 3537998 - RNA, 14 nt, Pseudomonas putida KT2440
ggccucgucgcggu

SEQ ID NO: 3537999 - RNA, 21 nt, Pseudomonas putida KT2440
ggccucgucgcgguccuugcc

SEQ ID NO: 3538000 - RNA, 20 nt, Pseudomonas putida KT2440
ggccucuggcuuggcugcgu

SEQ ID NO: 3538001 - RNA, 15 nt, Pseudomonas putida KT2440
ggccucuucacggcu

SEQ ID NO: 3538002 - RNA, 16 nt, Pseudomonas putida KT2440
ggccucuucaggcaau

SEQ ID NO: 3538003 - RNA, 20 nt, Pseudomonas putida KT2440
ggccucuucaggcaauggcg

SEQ ID NO: 3538004 - RNA, 16 nt, Pseudomonas putida KT2440
ggccucuucgcggccu

SEQ ID NO: 3538005 - RNA, 17 nt, Pseudomonas putida KT2440
ggccucuucgcggccuu

SEQ ID NO: 3538006 - RNA, 16 nt, Pseudomonas putida KT2440
ggccucuucgcgggca

SEQ ID NO: 3538007 - RNA, 23 nt, Pseudomonas putida KT2440
ggccucuucgcgggcaagcccgc

SEQ ID NO: 3538008 - RNA, 16 nt, Pseudomonas putida KT2440
ggccucuucgcgggua

SEQ ID NO: 3538009 - RNA, 19 nt, Pseudomonas putida KT2440
ggccucuucgcggguaaac

SEQ ID NO: 3538010 - RNA, 23 nt, Pseudomonas putida KT2440
ggccucuucgcggguaaacccgc

SEQ ID NO: 3538011 - RNA, 12 nt, Pseudomonas putida KT2440
ggccugagccgg

SEQ ID NO: 3538012 - RNA, 22 nt, Pseudomonas putida KT2440
ggccugagccggucggagagac

SEQ ID NO: 3538013 - RNA, 14 nt, Pseudomonas putida KT2440
ggccugauccucac

SEQ ID NO: 3538014 - RNA, 22 nt, Pseudomonas putida KT2440
ggccugcaagccggcgaacagc

SEQ ID NO: 3538015 - RNA, 23 nt, Pseudomonas putida KT2440
ggccugcaagccggcgaacagca

SEQ ID NO: 3538016 - RNA, 11 nt, Pseudomonas putida KT2440
ggccugcacaa

SEQ ID NO: 3538017 - RNA, 22 nt, Pseudomonas putida KT2440
ggccugcacuaccucgcucagg

SEQ ID NO: 3538018 - RNA, 12 nt, Pseudomonas putida KT2440
ggccugcacugc

SEQ ID NO: 3538019 - RNA, 13 nt, Pseudomonas putida KT2440
ggccugcaggcag

SEQ ID NO: 3538020 - RNA, 14 nt, Pseudomonas putida KT2440
ggccugcaggcagc

SEQ ID NO: 3538021 - RNA, 16 nt, Pseudomonas putida KT2440
ggccugcaggcagcau

SEQ ID NO: 3538022 - RNA, 22 nt, Pseudomonas putida KT2440
ggccugcauccacaccagcggc

SEQ ID NO: 3538023 - RNA, 12 nt, Pseudomonas putida KT2440
ggccugcauuca

SEQ ID NO: 3538024 - RNA, 16 nt, Pseudomonas putida KT2440
ggccugcccgguacgc

SEQ ID NO: 3538025 - RNA, 18 nt, Pseudomonas putida KT2440
ggccugcggccaggccgg

SEQ ID NO: 3538026 - RNA, 14 nt, Pseudomonas putida KT2440
ggccugcucgcugg

SEQ ID NO: 3538027 - RNA, 12 nt, Pseudomonas putida KT2440
ggccugcugccg

SEQ ID NO: 3538028 - RNA, 18 nt, Pseudomonas putida KT2440
ggccugcuugaucaggcc

SEQ ID NO: 3538029 - RNA, 18 nt, Pseudomonas putida KT2440
ggccuggaugcggucgcc

SEQ ID NO: 3538030 - RNA, 16 nt, Pseudomonas putida KT2440
ggccuggaugcguugc

SEQ ID NO: 3538031 - RNA, 17 nt, Pseudomonas putida KT2440
ggccuggaugcguugcu

SEQ ID NO: 3538032 - RNA, 11 nt, Pseudomonas putida KT2440
ggccuggccaa

SEQ ID NO: 3538033 - RNA, 20 nt, Pseudomonas putida KT2440
ggccuggcggguuuccucgg

SEQ ID NO: 3538034 - RNA, 23 nt, Pseudomonas putida KT2440
ggccugggcuucuaccugagcuu

SEQ ID NO: 3538035 - RNA, 16 nt, Pseudomonas putida KT2440
ggccuggggcaggccc

SEQ ID NO: 3538036 - RNA, 23 nt, Pseudomonas putida KT2440
ggccuggggcaggcccggcaggu

SEQ ID NO: 3538037 - RNA, 16 nt, Pseudomonas putida KT2440
ggccugggucagcugg

SEQ ID NO: 3538038 - RNA, 17 nt, Pseudomonas putida KT2440
ggccugggucagcuggu

SEQ ID NO: 3538039 - RNA, 14 nt, Pseudomonas putida KT2440
ggccugucacgccu

SEQ ID NO: 3538040 - RNA, 13 nt, Pseudomonas putida KT2440
ggccuguccaggc

SEQ ID NO: 3538041 - RNA, 11 nt, Pseudomonas putida KT2440
ggccugugccg

SEQ ID NO: 3538042 - RNA, 13 nt, Pseudomonas putida KT2440
ggccugugccgaa

SEQ ID NO: 3538043 - RNA, 13 nt, Pseudomonas putida KT2440
ggccugugccggc

SEQ ID NO: 3538044 - RNA, 16 nt, Pseudomonas putida KT2440
ggccugugccgggcca

SEQ ID NO: 3538045 - RNA, 20 nt, Pseudomonas putida KT2440
ggccuguggguaacccugcu

SEQ ID NO: 3538046 - RNA, 17 nt, Pseudomonas putida KT2440
ggccuguugcgcacugc

SEQ ID NO: 3538047 - RNA, 19 nt, Pseudomonas putida KT2440
ggccuucaaccucacuggc

SEQ ID NO: 3538048 - RNA, 12 nt, Pseudomonas putida KT2440
ggccuucaagcu

SEQ ID NO: 3538049 - RNA, 22 nt, Pseudomonas putida KT2440
ggccuucaagcuccccagcaac

SEQ ID NO: 3538050 - RNA, 16 nt, Pseudomonas putida KT2440
ggccuucagggccggu

SEQ ID NO: 3538051 - RNA, 15 nt, Pseudomonas putida KT2440
ggccuuccagcugcg

SEQ ID NO: 3538052 - RNA, 15 nt, Pseudomonas putida KT2440
ggccuucccgccugg

SEQ ID NO: 3538053 - RNA, 21 nt, Pseudomonas putida KT2440
ggccuucccgccuggcgccug

SEQ ID NO: 3538054 - RNA, 17 nt, Pseudomonas putida KT2440
ggccuuccuugcccagc

SEQ ID NO: 3538055 - RNA, 15 nt, Pseudomonas putida KT2440
ggccuucgaagaaca

SEQ ID NO: 3538056 - RNA, 14 nt, Pseudomonas putida KT2440
ggccuugaccagca

SEQ ID NO: 3538057 - RNA, 14 nt, Pseudomonas putida KT2440
ggccuugaccagcu

SEQ ID NO: 3538058 - RNA, 20 nt, Pseudomonas putida KT2440
ggccuugaccucgaccaggc

SEQ ID NO: 3538059 - RNA, 21 nt, Pseudomonas putida KT2440
ggccuugaccucgaccaggcg

SEQ ID NO: 3538060 - RNA, 17 nt, Pseudomonas putida KT2440
ggccuugaucaggcccu

SEQ ID NO: 3538061 - RNA, 21 nt, Pseudomonas putida KT2440
ggccuugaucgcugcuacgcc

SEQ ID NO: 3538062 - RNA, 17 nt, Pseudomonas putida KT2440
ggccuugccgcuggcga

SEQ ID NO: 3538063 - RNA, 14 nt, Pseudomonas putida KT2440
ggccuugcgcuggg

SEQ ID NO: 3538064 - RNA, 15 nt, Pseudomonas putida KT2440
ggccuugcucaauuu

SEQ ID NO: 3538065 - RNA, 14 nt, Pseudomonas putida KT2440
ggccuugcuccagu

SEQ ID NO: 3538066 - RNA, 17 nt, Pseudomonas putida KT2440
ggccuugcuccaguuca

SEQ ID NO: 3538067 - RNA, 13 nt, Pseudomonas putida KT2440
ggccuuggccagc

SEQ ID NO: 3538068 - RNA, 16 nt, Pseudomonas putida KT2440
ggccuuggccagcuca

SEQ ID NO: 3538069 - RNA, 23 nt, Pseudomonas putida KT2440
ggccuuggccagcucauccagcc

SEQ ID NO: 3538070 - RNA, 21 nt, Pseudomonas putida KT2440
ggccuuguuauccaggcuggc

SEQ ID NO: 3538071 - RNA, 19 nt, Pseudomonas putida KT2440
ggccuuucagcgcccagaa

SEQ ID NO: 3538072 - RNA, 18 nt, Pseudomonas putida KT2440
ggccuuuucauauggcuc

SEQ ID NO: 3538073 - RNA, 14 nt, Pseudomonas putida KT2440
ggcgaaagccagca

SEQ ID NO: 3538074 - RNA, 21 nt, Pseudomonas putida KT2440
ggcgaaauggcgaaucagcau

SEQ ID NO: 3538075 - RNA, 23 nt, Pseudomonas putida KT2440
ggcgaacacagcggccuugacca

SEQ ID NO: 3538076 - RNA, 12 nt, Pseudomonas putida KT2440
ggcgaacagcaa

SEQ ID NO: 3538077 - RNA, 13 nt, Pseudomonas putida KT2440
ggcgaaccaggug

SEQ ID NO: 3538078 - RNA, 22 nt, Pseudomonas putida KT2440
ggcgaacgccugcagggccugg

SEQ ID NO: 3538079 - RNA, 17 nt, Pseudomonas putida KT2440
ggcgaagacggcagauc

SEQ ID NO: 3538080 - RNA, 20 nt, Pseudomonas putida KT2440
ggcgaagacggcagaucagg

SEQ ID NO: 3538081 - RNA, 12 nt, Pseudomonas putida KT2440
ggcgaagcccgu

SEQ ID NO: 3538082 - RNA, 13 nt, Pseudomonas putida KT2440
ggcgaagcguuca

SEQ ID NO: 3538083 - RNA, 15 nt, Pseudomonas putida KT2440
ggcgaauacgcucag

SEQ ID NO: 3538084 - RNA, 21 nt, Pseudomonas putida KT2440
ggcgaaucagcaugcccagcg

SEQ ID NO: 3538085 - RNA, 15 nt, Pseudomonas putida KT2440
ggcgaauccagcagg

SEQ ID NO: 3538086 - RNA, 22 nt, Pseudomonas putida KT2440
ggcgaauccagccggcccggcu

SEQ ID NO: 3538087 - RNA, 19 nt, Pseudomonas putida KT2440
ggcgaaugcgcccggccag

SEQ ID NO: 3538088 - RNA, 14 nt, Pseudomonas putida KT2440
ggcgaauggcaggu

SEQ ID NO: 3538089 - RNA, 15 nt, Pseudomonas putida KT2440
ggcgaauggcaggug

SEQ ID NO: 3538090 - RNA, 16 nt, Pseudomonas putida KT2440
ggcgacaauggcgcgg

SEQ ID NO: 3538091 - RNA, 23 nt, Pseudomonas putida KT2440
ggcgacacuugguccagggccau

SEQ ID NO: 3538092 - RNA, 17 nt, Pseudomonas putida KT2440
ggcgacagggcgaagau

SEQ ID NO: 3538093 - RNA, 19 nt, Pseudomonas putida KT2440
ggcgaccaaaggucgccuu

SEQ ID NO: 3538094 - RNA, 14 nt, Pseudomonas putida KT2440
ggcgacgagccagu

SEQ ID NO: 3538095 - RNA, 24 nt, Pseudomonas putida KT2440
ggcgacgaguuuaccuccaucacc

SEQ ID NO: 3538096 - RNA, 15 nt, Pseudomonas putida KT2440
ggcgacgcacuucac

SEQ ID NO: 3538097 - RNA, 22 nt, Pseudomonas putida KT2440
ggcgacgcaucugcacuuucac

SEQ ID NO: 3538098 - RNA, 17 nt, Pseudomonas putida KT2440
ggcgacgcggugcucga

SEQ ID NO: 3538099 - RNA, 16 nt, Pseudomonas putida KT2440
ggcgacggcgagguga

SEQ ID NO: 3538100 - RNA, 13 nt, Pseudomonas putida KT2440
ggcgacuucggcg

SEQ ID NO: 3538101 - RNA, 14 nt, Pseudomonas putida KT2440
ggcgacuucgugcg

SEQ ID NO: 3538102 - RNA, 14 nt, Pseudomonas putida KT2440
ggcgagaaggcgug

SEQ ID NO: 3538103 - RNA, 12 nt, Pseudomonas putida KT2440
ggcgagccacuc

SEQ ID NO: 3538104 - RNA, 22 nt, Pseudomonas putida KT2440
ggcgagcgcaggaacaggcuga

SEQ ID NO: 3538105 - RNA, 17 nt, Pseudomonas putida KT2440
ggcgagcgcgcaggcgg

SEQ ID NO: 3538106 - RNA, 19 nt, Pseudomonas putida KT2440
ggcgagcgcgcaggcgguu

SEQ ID NO: 3538107 - RNA, 13 nt, Pseudomonas putida KT2440
ggcgaggacagca

SEQ ID NO: 3538108 - RNA, 14 nt, Pseudomonas putida KT2440
ggcgaggacagcau

SEQ ID NO: 3538109 - RNA, 12 nt, Pseudomonas putida KT2440
ggcgagguagcu

SEQ ID NO: 3538110 - RNA, 16 nt, Pseudomonas putida KT2440
ggcgaguagaagcuug

SEQ ID NO: 3538111 - RNA, 13 nt, Pseudomonas putida KT2440
ggcgaguagauca

SEQ ID NO: 3538112 - RNA, 20 nt, Pseudomonas putida KT2440
ggcgaguagaucaucagcgc

SEQ ID NO: 3538113 - RNA, 23 nt, Pseudomonas putida KT2440
ggcgagugcauuacgucagcuac

SEQ ID NO: 3538114 - RNA, 13 nt, Pseudomonas putida KT2440
ggcgaucagcgcg

SEQ ID NO: 3538115 - RNA, 14 nt, Pseudomonas putida KT2440
ggcgaucaggcagg

SEQ ID NO: 3538116 - RNA, 20 nt, Pseudomonas putida KT2440
ggcgaucaggcaggccagca

SEQ ID NO: 3538117 - RNA, 12 nt, Pseudomonas putida KT2440
ggcgaucgccag

SEQ ID NO: 3538118 - RNA, 16 nt, Pseudomonas putida KT2440
ggcgaucggcuggucc

SEQ ID NO: 3538119 - RNA, 18 nt, Pseudomonas putida KT2440
ggcgaucugaaucuucgg

SEQ ID NO: 3538120 - RNA, 12 nt, Pseudomonas putida KT2440
ggcgaugaaagc

SEQ ID NO: 3538121 - RNA, 17 nt, Pseudomonas putida KT2440
ggcgaugaucgcggcgu

SEQ ID NO: 3538122 - RNA, 21 nt, Pseudomonas putida KT2440
ggcgaugcaucaauggcuggg

SEQ ID NO: 3538123 - RNA, 14 nt, Pseudomonas putida KT2440
ggcgaugccgcgcg

SEQ ID NO: 3538124 - RNA, 20 nt, Pseudomonas putida KT2440
ggcgaugccgcgcgcccgcu

SEQ ID NO: 3538125 - RNA, 15 nt, Pseudomonas putida KT2440
ggcgauggucaaccg

SEQ ID NO: 3538126 - RNA, 14 nt, Pseudomonas putida KT2440
ggcgcaaaaguccc

SEQ ID NO: 3538127 - RNA, 21 nt, Pseudomonas putida KT2440
ggcgcaaauugcccggccagc

SEQ ID NO: 3538128 - RNA, 20 nt, Pseudomonas putida KT2440
ggcgcaacucagcgcagcuu

SEQ ID NO: 3538129 - RNA, 11 nt, Pseudomonas putida KT2440
ggcgcaagccg

SEQ ID NO: 3538130 - RNA, 14 nt, Pseudomonas putida KT2440
ggcgcaauaucgag

SEQ ID NO: 3538131 - RNA, 20 nt, Pseudomonas putida KT2440
ggcgcaaugaaaaagccccu

SEQ ID NO: 3538132 - RNA, 19 nt, Pseudomonas putida KT2440
ggcgcacagaacaccacca

SEQ ID NO: 3538133 - RNA, 16 nt, Pseudomonas putida KT2440
ggcgcaccagcggcuu

SEQ ID NO: 3538134 - RNA, 16 nt, Pseudomonas putida KT2440
ggcgcaccgagcgcuc

SEQ ID NO: 3538135 - RNA, 21 nt, Pseudomonas putida KT2440
ggcgcaccgagcgcucgcgaa

SEQ ID NO: 3538136 - RNA, 15 nt, Pseudomonas putida KT2440
ggcgcaccgccgggu

SEQ ID NO: 3538137 - RNA, 18 nt, Pseudomonas putida KT2440
ggcgcacguacuccacca

SEQ ID NO: 3538138 - RNA, 19 nt, Pseudomonas putida KT2440
ggcgcacucucgucaccug

SEQ ID NO: 3538139 - RNA, 16 nt, Pseudomonas putida KT2440
ggcgcagagcgccccg

SEQ ID NO: 3538140 - RNA, 20 nt, Pseudomonas putida KT2440
ggcgcagcaaggucgccgcc

SEQ ID NO: 3538141 - RNA, 23 nt, Pseudomonas putida KT2440
ggcgcagcauaugcuggucgccg

SEQ ID NO: 3538142 - RNA, 17 nt, Pseudomonas putida KT2440
ggcgcagcgcaugcucg

SEQ ID NO: 3538143 - RNA, 15 nt, Pseudomonas putida KT2440
ggcgcaggcagcaca

SEQ ID NO: 3538144 - RNA, 18 nt, Pseudomonas putida KT2440
ggcgcaggccgcuggccg

SEQ ID NO: 3538145 - RNA, 12 nt, Pseudomonas putida KT2440
ggcgcaggcugu

SEQ ID NO: 3538146 - RNA, 18 nt, Pseudomonas putida KT2440
ggcgcagggugucggugg

SEQ ID NO: 3538147 - RNA, 23 nt, Pseudomonas putida KT2440
ggcgcagggugucgguggcggcc

SEQ ID NO: 3538148 - RNA, 20 nt, Pseudomonas putida KT2440
ggcgcagggugugcugcugc

SEQ ID NO: 3538149 - RNA, 19 nt, Pseudomonas putida KT2440
ggcgcaggugcagccagcc

SEQ ID NO: 3538150 - RNA, 21 nt, Pseudomonas putida KT2440
ggcgcaguggucauagucacc

SEQ ID NO: 3538151 - RNA, 16 nt, Pseudomonas putida KT2440
ggcgcaguucguccag

SEQ ID NO: 3538152 - RNA, 16 nt, Pseudomonas putida KT2440
ggcgcauccucggugc

SEQ ID NO: 3538153 - RNA, 22 nt, Pseudomonas putida KT2440
ggcgcauccucggugcgcggua

SEQ ID NO: 3538154 - RNA, 15 nt, Pseudomonas putida KT2440
ggcgcaucgacgggc

SEQ ID NO: 3538155 - RNA, 16 nt, Pseudomonas putida KT2440
ggcgcaucuuccagca

SEQ ID NO: 3538156 - RNA, 19 nt, Pseudomonas putida KT2440
ggcgcaugacuuccaggua

SEQ ID NO: 3538157 - RNA, 17 nt, Pseudomonas putida KT2440
ggcgcaugcauaagcca

SEQ ID NO: 3538158 - RNA, 16 nt, Pseudomonas putida KT2440
ggcgccaaacgccagg

SEQ ID NO: 3538159 - RNA, 19 nt, Pseudomonas putida KT2440
ggcgccaaucaucgccagc

SEQ ID NO: 3538160 - RNA, 23 nt, Pseudomonas putida KT2440
ggcgccaaucaucgccagcagcg

SEQ ID NO: 3538161 - RNA, 22 nt, Pseudomonas putida KT2440
ggcgccacccagaacagccaca

SEQ ID NO: 3538162 - RNA, 23 nt, Pseudomonas putida KT2440
ggcgccaccggucgccuguagga

SEQ ID NO: 3538163 - RNA, 12 nt, Pseudomonas putida KT2440
ggcgccagcagu

SEQ ID NO: 3538164 - RNA, 14 nt, Pseudomonas putida KT2440
ggcgccagcagugc

SEQ ID NO: 3538165 - RNA, 16 nt, Pseudomonas putida KT2440
ggcgccauaggcuugc

SEQ ID NO: 3538166 - RNA, 14 nt, Pseudomonas putida KT2440
ggcgccaugccccc

SEQ ID NO: 3538167 - RNA, 17 nt, Pseudomonas putida KT2440
ggcgccauuggugcccu

SEQ ID NO: 3538168 - RNA, 13 nt, Pseudomonas putida KT2440
ggcgcccagcaac

SEQ ID NO: 3538169 - RNA, 16 nt, Pseudomonas putida KT2440
ggcgcccugcaaaggc

SEQ ID NO: 3538170 - RNA, 14 nt, Pseudomonas putida KT2440
ggcgcccugcgcca

SEQ ID NO: 3538171 - RNA, 15 nt, Pseudomonas putida KT2440
ggcgccgacccugua

SEQ ID NO: 3538172 - RNA, 18 nt, Pseudomonas putida KT2440
ggcgccgagcgcggcgcc

SEQ ID NO: 3538173 - RNA, 22 nt, Pseudomonas putida KT2440
ggcgccgagcgcggcgcccagc

SEQ ID NO: 3538174 - RNA, 23 nt, Pseudomonas putida KT2440
ggcgccgagcgcggcgcccagca

SEQ ID NO: 3538175 - RNA, 21 nt, Pseudomonas putida KT2440
ggcgccgaucauugcugcggu

SEQ ID NO: 3538176 - RNA, 15 nt, Pseudomonas putida KT2440
ggcgccgaugccguc

SEQ ID NO: 3538177 - RNA, 12 nt, Pseudomonas putida KT2440
ggcgccgccagc

SEQ ID NO: 3538178 - RNA, 16 nt, Pseudomonas putida KT2440
ggcgccgccaggcagc

SEQ ID NO: 3538179 - RNA, 17 nt, Pseudomonas putida KT2440
ggcgccgccaggcagca

SEQ ID NO: 3538180 - RNA, 22 nt, Pseudomonas putida KT2440
ggcgccgccgaacucuggcaac

SEQ ID NO: 3538181 - RNA, 13 nt, Pseudomonas putida KT2440
ggcgccgcgagua

SEQ ID NO: 3538182 - RNA, 13 nt, Pseudomonas putida KT2440
ggcgccggccgca

SEQ ID NO: 3538183 - RNA, 15 nt, Pseudomonas putida KT2440
ggcgccguugcccuu

SEQ ID NO: 3538184 - RNA, 13 nt, Pseudomonas putida KT2440
ggcgccuccagca

SEQ ID NO: 3538185 - RNA, 13 nt, Pseudomonas putida KT2440
ggcgccugccggg

SEQ ID NO: 3538186 - RNA, 21 nt, Pseudomonas putida KT2440
ggcgccugccgggucaaggcc

SEQ ID NO: 3538187 - RNA, 15 nt, Pseudomonas putida KT2440
ggcgcgaaaagccug

SEQ ID NO: 3538188 - RNA, 19 nt, Pseudomonas putida KT2440
ggcgcgaaaagccugcacc

SEQ ID NO: 3538189 - RNA, 17 nt, Pseudomonas putida KT2440
ggcgcgaaggucacgcc

SEQ ID NO: 3538190 - RNA, 19 nt, Pseudomonas putida KT2440
ggcgcgaauuuccggguuc

SEQ ID NO: 3538191 - RNA, 17 nt, Pseudomonas putida KT2440
ggcgcgaccaucaccgc

SEQ ID NO: 3538192 - RNA, 18 nt, Pseudomonas putida KT2440
ggcgcgaccaucaccgcc

SEQ ID NO: 3538193 - RNA, 22 nt, Pseudomonas putida KT2440
ggcgcgaccaucaccgccagca

SEQ ID NO: 3538194 - RNA, 21 nt, Pseudomonas putida KT2440
ggcgcgaucacgcacugguca

SEQ ID NO: 3538195 - RNA, 22 nt, Pseudomonas putida KT2440
ggcgcgaucaucgaagccagua

SEQ ID NO: 3538196 - RNA, 22 nt, Pseudomonas putida KT2440
ggcgcgcaacagcaaggcaucg

SEQ ID NO: 3538197 - RNA, 16 nt, Pseudomonas putida KT2440
ggcgcgcagcgcacuu

SEQ ID NO: 3538198 - RNA, 23 nt, Pseudomonas putida KT2440
ggcgcgcccgcgaagaggccggc

SEQ ID NO: 3538199 - RNA, 13 nt, Pseudomonas putida KT2440
ggcgcgcccgcuc

SEQ ID NO: 3538200 - RNA, 16 nt, Pseudomonas putida KT2440
ggcgcgcccgcuccca

SEQ ID NO: 3538201 - RNA, 22 nt, Pseudomonas putida KT2440
ggcgcgcccuccuuggguaucg

SEQ ID NO: 3538202 - RNA, 17 nt, Pseudomonas putida KT2440
ggcgcgccuggcucgau

SEQ ID NO: 3538203 - RNA, 19 nt, Pseudomonas putida KT2440
ggcgcgcgcauccacaggc

SEQ ID NO: 3538204 - RNA, 15 nt, Pseudomonas putida KT2440
ggcgcgcgccugggu

SEQ ID NO: 3538205 - RNA, 13 nt, Pseudomonas putida KT2440
ggcgcgcgcgacc

SEQ ID NO: 3538206 - RNA, 19 nt, Pseudomonas putida KT2440
ggcgcgcggcucggccacc

SEQ ID NO: 3538207 - RNA, 14 nt, Pseudomonas putida KT2440
ggcgcgcuggcgca

SEQ ID NO: 3538208 - RNA, 22 nt, Pseudomonas putida KT2440
ggcgcggcagcaugaacagcgc

SEQ ID NO: 3538209 - RNA, 21 nt, Pseudomonas putida KT2440
ggcgcggcccaguuucgccag

SEQ ID NO: 3538210 - RNA, 22 nt, Pseudomonas putida KT2440
ggcgcggcccuguguaggagcg

SEQ ID NO: 3538211 - RNA, 13 nt, Pseudomonas putida KT2440
ggcgcggccgggc

SEQ ID NO: 3538212 - RNA, 14 nt, Pseudomonas putida KT2440
ggcgcgggcacccu

SEQ ID NO: 3538213 - RNA, 15 nt, Pseudomonas putida KT2440
ggcgcgggcacccug

SEQ ID NO: 3538214 - RNA, 20 nt, Pseudomonas putida KT2440
ggcgcgggcacccuggcggu

SEQ ID NO: 3538215 - RNA, 20 nt, Pseudomonas putida KT2440
ggcgcggguuuacccgcgaa

SEQ ID NO: 3538216 - RNA, 20 nt, Pseudomonas putida KT2440
ggcgcggguuugcccgcgag

SEQ ID NO: 3538217 - RNA, 16 nt, Pseudomonas putida KT2440
ggcgcggugaggcaac

SEQ ID NO: 3538218 - RNA, 23 nt, Pseudomonas putida KT2440
ggcgcggugauggcgcauggccu

SEQ ID NO: 3538219 - RNA, 22 nt, Pseudomonas putida KT2440
ggcgcggugccggcagcucgcg

SEQ ID NO: 3538220 - RNA, 21 nt, Pseudomonas putida KT2440
ggcgcguaguacuccagcagc

SEQ ID NO: 3538221 - RNA, 23 nt, Pseudomonas putida KT2440
ggcgcgucagccguugaccaggu

SEQ ID NO: 3538222 - RNA, 16 nt, Pseudomonas putida KT2440
ggcgcgucccccggua

SEQ ID NO: 3538223 - RNA, 22 nt, Pseudomonas putida KT2440
ggcgcgugccgcaugugccagg

SEQ ID NO: 3538224 - RNA, 21 nt, Pseudomonas putida KT2440
ggcgcguguagcccgcugaag

SEQ ID NO: 3538225 - RNA, 16 nt, Pseudomonas putida KT2440
ggcgcgugucaggagg

SEQ ID NO: 3538226 - RNA, 23 nt, Pseudomonas putida KT2440
ggcgcgugucaggagggccguag

SEQ ID NO: 3538227 - RNA, 17 nt, Pseudomonas putida KT2440
ggcgcgugugcaggugg

SEQ ID NO: 3538228 - RNA, 15 nt, Pseudomonas putida KT2440
ggcgcguuucgaucu

SEQ ID NO: 3538229 - RNA, 22 nt, Pseudomonas putida KT2440
ggcgcguuucgaucucgccaau

SEQ ID NO: 3538230 - RNA, 22 nt, Pseudomonas putida KT2440
ggcgcucaaggucacggcuguc

SEQ ID NO: 3538231 - RNA, 14 nt, Pseudomonas putida KT2440
ggcgcuccagcagg

SEQ ID NO: 3538232 - RNA, 15 nt, Pseudomonas putida KT2440
ggcgcuccagcaggg

SEQ ID NO: 3538233 - RNA, 14 nt, Pseudomonas putida KT2440
ggcgcuccaucaug

SEQ ID NO: 3538234 - RNA, 15 nt, Pseudomonas putida KT2440
ggcgcucgcgguuca

SEQ ID NO: 3538235 - RNA, 13 nt, Pseudomonas putida KT2440
ggcgcugaaacug

SEQ ID NO: 3538236 - RNA, 17 nt, Pseudomonas putida KT2440
ggcgcugaccaacaggc

SEQ ID NO: 3538237 - RNA, 20 nt, Pseudomonas putida KT2440
ggcgcugaccaacaggcugg

SEQ ID NO: 3538238 - RNA, 16 nt, Pseudomonas putida KT2440
ggcgcugaucagcugg

SEQ ID NO: 3538239 - RNA, 16 nt, Pseudomonas putida KT2440
ggcgcuggacagcggc

SEQ ID NO: 3538240 - RNA, 14 nt, Pseudomonas putida KT2440
ggcgcuggccaggc

SEQ ID NO: 3538241 - RNA, 13 nt, Pseudomonas putida KT2440
ggcgcuggcgcca

SEQ ID NO: 3538242 - RNA, 19 nt, Pseudomonas putida KT2440
ggcgcuggcgccagccgcc

SEQ ID NO: 3538243 - RNA, 22 nt, Pseudomonas putida KT2440
ggcgcuggcgggcaaacuggcg

SEQ ID NO: 3538244 - RNA, 13 nt, Pseudomonas putida KT2440
ggcgcugggcuua

SEQ ID NO: 3538245 - RNA, 19 nt, Pseudomonas putida KT2440
ggcgcuguaggggcgggcc

SEQ ID NO: 3538246 - RNA, 21 nt, Pseudomonas putida KT2440
ggcgcuguccagcgcaucaac

SEQ ID NO: 3538247 - RNA, 22 nt, Pseudomonas putida KT2440
ggcgcuucagguaagucagcga

SEQ ID NO: 3538248 - RNA, 14 nt, Pseudomonas putida KT2440
ggcgcuugaagaag

SEQ ID NO: 3538249 - RNA, 16 nt, Pseudomonas putida KT2440
ggcgcuugaucagccu

SEQ ID NO: 3538250 - RNA, 19 nt, Pseudomonas putida KT2440
ggcgcuugaucugccaggc

SEQ ID NO: 3538251 - RNA, 20 nt, Pseudomonas putida KT2440
ggcgcuugaucugccaggca

SEQ ID NO: 3538252 - RNA, 20 nt, Pseudomonas putida KT2440
ggcgcuuggaaauguucaac

SEQ ID NO: 3538253 - RNA, 15 nt, Pseudomonas putida KT2440
ggcgcuuucacuggc

SEQ ID NO: 3538254 - RNA, 15 nt, Pseudomonas putida KT2440
ggcgcuuugcgcccc

SEQ ID NO: 3538255 - RNA, 19 nt, Pseudomonas putida KT2440
ggcgcuuuucuucgcugcu

SEQ ID NO: 3538256 - RNA, 20 nt, Pseudomonas putida KT2440
ggcgcuuuucuucgcugcug

SEQ ID NO: 3538257 - RNA, 23 nt, Pseudomonas putida KT2440
ggcgcuuuucuucgcugcugugc

SEQ ID NO: 3538258 - RNA, 18 nt, Pseudomonas putida KT2440
ggcggaacggugaacggc

SEQ ID NO: 3538259 - RNA, 15 nt, Pseudomonas putida KT2440
ggcggaacuggcccu

SEQ ID NO: 3538260 - RNA, 14 nt, Pseudomonas putida KT2440
ggcggagauuggcc

SEQ ID NO: 3538261 - RNA, 21 nt, Pseudomonas putida KT2440
ggcggagauuggccagcaggc

SEQ ID NO: 3538262 - RNA, 21 nt, Pseudomonas putida KT2440
ggcggaggcuucgaugauccc

SEQ ID NO: 3538263 - RNA, 13 nt, Pseudomonas putida KT2440
ggcggaucagcgc

SEQ ID NO: 3538264 - RNA, 17 nt, Pseudomonas putida KT2440
ggcggaucagcgcgucc

SEQ ID NO: 3538265 - RNA, 21 nt, Pseudomonas putida KT2440
ggcggaucugacggcgcugcu

SEQ ID NO: 3538266 - RNA, 18 nt, Pseudomonas putida KT2440
ggcggauguucuugaccu

SEQ ID NO: 3538267 - RNA, 18 nt, Pseudomonas putida KT2440
ggcggauguuggccacga

SEQ ID NO: 3538268 - RNA, 20 nt, Pseudomonas putida KT2440
ggcggcaagggcgaaccagg

SEQ ID NO: 3538269 - RNA, 16 nt, Pseudomonas putida KT2440
ggcggcaauguugaag

SEQ ID NO: 3538270 - RNA, 18 nt, Pseudomonas putida KT2440
ggcggcagcgcgggcaga

SEQ ID NO: 3538271 - RNA, 20 nt, Pseudomonas putida KT2440
ggcggcauccaggcgggcga

SEQ ID NO: 3538272 - RNA, 21 nt, Pseudomonas putida KT2440
ggcggccaaggcguggcuugc

SEQ ID NO: 3538273 - RNA, 23 nt, Pseudomonas putida KT2440
ggcggccacggcaauggcccgcu

SEQ ID NO: 3538274 - RNA, 19 nt, Pseudomonas putida KT2440
ggcggccagcacgaacagc

SEQ ID NO: 3538275 - RNA, 11 nt, Pseudomonas putida KT2440
ggcggccagcg

SEQ ID NO: 3538276 - RNA, 12 nt, Pseudomonas putida KT2440
ggcggcccagcc

SEQ ID NO: 3538277 - RNA, 18 nt, Pseudomonas putida KT2440
ggcggcccuaucgcgacg

SEQ ID NO: 3538278 - RNA, 17 nt, Pseudomonas putida KT2440
ggcggccgcagccccac

SEQ ID NO: 3538279 - RNA, 19 nt, Pseudomonas putida KT2440
ggcggccucgugucgcgaa

SEQ ID NO: 3538280 - RNA, 23 nt, Pseudomonas putida KT2440
ggcggcgaugcaucaauggcugg

SEQ ID NO: 3538281 - RNA, 16 nt, Pseudomonas putida KT2440
ggcggcgcagcgcacg

SEQ ID NO: 3538282 - RNA, 14 nt, Pseudomonas putida KT2440
ggcggcgcgagaac

SEQ ID NO: 3538283 - RNA, 22 nt, Pseudomonas putida KT2440
ggcggcgguugucgucgaccgc

SEQ ID NO: 3538284 - RNA, 15 nt, Pseudomonas putida KT2440
ggcggcgugaccagc

SEQ ID NO: 3538285 - RNA, 17 nt, Pseudomonas putida KT2440
ggcggcgugaccagccc

SEQ ID NO: 3538286 - RNA, 23 nt, Pseudomonas putida KT2440
ggcggcgugaccagcccggccca

SEQ ID NO: 3538287 - RNA, 17 nt, Pseudomonas putida KT2440
ggcggcgugagcaucgg

SEQ ID NO: 3538288 - RNA, 18 nt, Pseudomonas putida KT2440
ggcggcgugagcaucggc

SEQ ID NO: 3538289 - RNA, 15 nt, Pseudomonas putida KT2440
ggcggcuaagcgcca

SEQ ID NO: 3538290 - RNA, 17 nt, Pseudomonas putida KT2440
ggcggcuaagcgccagc

SEQ ID NO: 3538291 - RNA, 20 nt, Pseudomonas putida KT2440
ggcggcuaagcgccagcaac

SEQ ID NO: 3538292 - RNA, 18 nt, Pseudomonas putida KT2440
ggcggcucuugcagcgag

SEQ ID NO: 3538293 - RNA, 13 nt, Pseudomonas putida KT2440
ggcggcugagccg

SEQ ID NO: 3538294 - RNA, 18 nt, Pseudomonas putida KT2440
ggcggcugagccggcugg

SEQ ID NO: 3538295 - RNA, 17 nt, Pseudomonas putida KT2440
ggcggcugucgcagaag

SEQ ID NO: 3538296 - RNA, 19 nt, Pseudomonas putida KT2440
ggcggcuuccagggcuggu

SEQ ID NO: 3538297 - RNA, 16 nt, Pseudomonas putida KT2440
ggcggcuuucagcgcc

SEQ ID NO: 3538298 - RNA, 14 nt, Pseudomonas putida KT2440
ggcgggcaaacugg

SEQ ID NO: 3538299 - RNA, 18 nt, Pseudomonas putida KT2440
ggcgggcaaacuggcgcc

SEQ ID NO: 3538300 - RNA, 19 nt, Pseudomonas putida KT2440
ggcgggcaaacuggcgccc

SEQ ID NO: 3538301 - RNA, 12 nt, Pseudomonas putida KT2440
ggcgggccgccg

SEQ ID NO: 3538302 - RNA, 15 nt, Pseudomonas putida KT2440
ggcgggccgccgaac

SEQ ID NO: 3538303 - RNA, 12 nt, Pseudomonas putida KT2440
ggcgggccugcu

SEQ ID NO: 3538304 - RNA, 13 nt, Pseudomonas putida KT2440
ggcgggcggagau

SEQ ID NO: 3538305 - RNA, 17 nt, Pseudomonas putida KT2440
ggcgggucagguggcug

SEQ ID NO: 3538306 - RNA, 18 nt, Pseudomonas putida KT2440
ggcgggugggugcagcug

SEQ ID NO: 3538307 - RNA, 22 nt, Pseudomonas putida KT2440
ggcgguaaacguggucagccac

SEQ ID NO: 3538308 - RNA, 23 nt, Pseudomonas putida KT2440
ggcgguaaacguggucagccacg

SEQ ID NO: 3538309 - RNA, 22 nt, Pseudomonas putida KT2440
ggcgguacuggaagagcaggaa

SEQ ID NO: 3538310 - RNA, 23 nt, Pseudomonas putida KT2440
ggcgguacuggaagagcaggaag

SEQ ID NO: 3538311 - RNA, 21 nt, Pseudomonas putida KT2440
ggcgguaugggugaugcuggu

SEQ ID NO: 3538312 - RNA, 19 nt, Pseudomonas putida KT2440
ggcgguauucacaccugcc

SEQ ID NO: 3538313 - RNA, 14 nt, Pseudomonas putida KT2440
ggcgguccagcaag

SEQ ID NO: 3538314 - RNA, 21 nt, Pseudomonas putida KT2440
ggcgguccuucaugccgaacg

SEQ ID NO: 3538315 - RNA, 12 nt, Pseudomonas putida KT2440
ggcggucguagc

SEQ ID NO: 3538316 - RNA, 16 nt, Pseudomonas putida KT2440
ggcggugacacugcca

SEQ ID NO: 3538317 - RNA, 13 nt, Pseudomonas putida KT2440
ggcggugacccgu

SEQ ID NO: 3538318 - RNA, 21 nt, Pseudomonas putida KT2440
ggcggugaucguacgccggcg

SEQ ID NO: 3538319 - RNA, 16 nt, Pseudomonas putida KT2440
ggcggugcacggccug

SEQ ID NO: 3538320 - RNA, 16 nt, Pseudomonas putida KT2440
ggcggugcgcacgaag

SEQ ID NO: 3538321 - RNA, 16 nt, Pseudomonas putida KT2440
ggcgguguagaacggc

SEQ ID NO: 3538322 - RNA, 20 nt, Pseudomonas putida KT2440
ggcgguguagaacggcagca

SEQ ID NO: 3538323 - RNA, 22 nt, Pseudomonas putida KT2440
ggcgguguagaacggcagcagg

SEQ ID NO: 3538324 - RNA, 19 nt, Pseudomonas putida KT2440
ggcgguguaucuccaugcu

SEQ ID NO: 3538325 - RNA, 17 nt, Pseudomonas putida KT2440
ggcgguugggcaagugc

SEQ ID NO: 3538326 - RNA, 18 nt, Pseudomonas putida KT2440
ggcgguugucgaccuggc

SEQ ID NO: 3538327 - RNA, 16 nt, Pseudomonas putida KT2440
ggcgguugucgucgac

SEQ ID NO: 3538328 - RNA, 15 nt, Pseudomonas putida KT2440
ggcguaaacccaggu

SEQ ID NO: 3538329 - RNA, 15 nt, Pseudomonas putida KT2440
ggcguaauccagcug

SEQ ID NO: 3538330 - RNA, 15 nt, Pseudomonas putida KT2440
ggcguaccugccccc

SEQ ID NO: 3538331 - RNA, 18 nt, Pseudomonas putida KT2440
ggcguaccugccccccca

SEQ ID NO: 3538332 - RNA, 14 nt, Pseudomonas putida KT2440
ggcguaccuggcug

SEQ ID NO: 3538333 - RNA, 16 nt, Pseudomonas putida KT2440
ggcguacucucgucga

SEQ ID NO: 3538334 - RNA, 16 nt, Pseudomonas putida KT2440
ggcguagcacaagggc

SEQ ID NO: 3538335 - RNA, 14 nt, Pseudomonas putida KT2440
ggcguagcagguac

SEQ ID NO: 3538336 - RNA, 22 nt, Pseudomonas putida KT2440
ggcguaggccugcgaaaggcgc

SEQ ID NO: 3538337 - RNA, 19 nt, Pseudomonas putida KT2440
ggcguauuugaccagcccg

SEQ ID NO: 3538338 - RNA, 22 nt, Pseudomonas putida KT2440
ggcguauuugaccagcccgcug

SEQ ID NO: 3538339 - RNA, 19 nt, Pseudomonas putida KT2440
ggcgucacccgcgccacca

SEQ ID NO: 3538340 - RNA, 18 nt, Pseudomonas putida KT2440
ggcgucaguucgacgcgg

SEQ ID NO: 3538341 - RNA, 22 nt, Pseudomonas putida KT2440
ggcgucaucacccgggaacagc

SEQ ID NO: 3538342 - RNA, 19 nt, Pseudomonas putida KT2440
ggcgucauccugcgcggcc

SEQ ID NO: 3538343 - RNA, 21 nt, Pseudomonas putida KT2440
ggcgucauccugcgcggccac

SEQ ID NO: 3538344 - RNA, 22 nt, Pseudomonas putida KT2440
ggcgucauccugcgcggccacu

SEQ ID NO: 3538345 - RNA, 12 nt, Pseudomonas putida KT2440
ggcguccacagc

SEQ ID NO: 3538346 - RNA, 13 nt, Pseudomonas putida KT2440
ggcguccagcagu

SEQ ID NO: 3538347 - RNA, 19 nt, Pseudomonas putida KT2440
ggcgucccggccagcgacc

SEQ ID NO: 3538348 - RNA, 17 nt, Pseudomonas putida KT2440
ggcgucgaacacggcgu

SEQ ID NO: 3538349 - RNA, 20 nt, Pseudomonas putida KT2440
ggcgucgacgaugaugcggu

SEQ ID NO: 3538350 - RNA, 21 nt, Pseudomonas putida KT2440
ggcgucgacgaugaugcgguc

SEQ ID NO: 3538351 - RNA, 15 nt, Pseudomonas putida KT2440
ggcgucggcaccggc

SEQ ID NO: 3538352 - RNA, 17 nt, Pseudomonas putida KT2440
ggcgucggcaccggcga

SEQ ID NO: 3538353 - RNA, 13 nt, Pseudomonas putida KT2440
ggcgucggcgacg

SEQ ID NO: 3538354 - RNA, 12 nt, Pseudomonas putida KT2440
ggcgucggcgcg

SEQ ID NO: 3538355 - RNA, 16 nt, Pseudomonas putida KT2440
ggcgucggucagcgag

SEQ ID NO: 3538356 - RNA, 16 nt, Pseudomonas putida KT2440
ggcgucggucgccccc

SEQ ID NO: 3538357 - RNA, 14 nt, Pseudomonas putida KT2440
ggcgucguacaggc

SEQ ID NO: 3538358 - RNA, 15 nt, Pseudomonas putida KT2440
ggcgucuuccaggug

SEQ ID NO: 3538359 - RNA, 23 nt, Pseudomonas putida KT2440
ggcgugaaaaaagcgugaaugca

SEQ ID NO: 3538360 - RNA, 14 nt, Pseudomonas putida KT2440
ggcgugaaauccuc

SEQ ID NO: 3538361 - RNA, 16 nt, Pseudomonas putida KT2440
ggcgugaaauccucaa

SEQ ID NO: 3538362 - RNA, 17 nt, Pseudomonas putida KT2440
ggcgugagcaucggcgu

SEQ ID NO: 3538363 - RNA, 14 nt, Pseudomonas putida KT2440
ggcgugaucacccg

SEQ ID NO: 3538364 - RNA, 21 nt, Pseudomonas putida KT2440
ggcgugcacgcuugagcgcgc

SEQ ID NO: 3538365 - RNA, 16 nt, Pseudomonas putida KT2440
ggcgugccaggcuugg

SEQ ID NO: 3538366 - RNA, 13 nt, Pseudomonas putida KT2440
ggcgugcccgcga

SEQ ID NO: 3538367 - RNA, 15 nt, Pseudomonas putida KT2440
ggcgugcccgcgaac

SEQ ID NO: 3538368 - RNA, 18 nt, Pseudomonas putida KT2440
ggcgugcccgcgaagggc

SEQ ID NO: 3538369 - RNA, 23 nt, Pseudomonas putida KT2440
ggcgugcccgcgaagggccgcaa

SEQ ID NO: 3538370 - RNA, 22 nt, Pseudomonas putida KT2440
ggcgugcccggcaaucgccagg

SEQ ID NO: 3538371 - RNA, 16 nt, Pseudomonas putida KT2440
ggcgugccgucgagca

SEQ ID NO: 3538372 - RNA, 18 nt, Pseudomonas putida KT2440
ggcgugccgucgagcagg

SEQ ID NO: 3538373 - RNA, 23 nt, Pseudomonas putida KT2440
ggcgugcgcugcauggcggcacc

SEQ ID NO: 3538374 - RNA, 13 nt, Pseudomonas putida KT2440
ggcgugcuccaca

SEQ ID NO: 3538375 - RNA, 17 nt, Pseudomonas putida KT2440
ggcguggauuaugccgg

SEQ ID NO: 3538376 - RNA, 14 nt, Pseudomonas putida KT2440
ggcguggcgagcug

SEQ ID NO: 3538377 - RNA, 21 nt, Pseudomonas putida KT2440
ggcguggcugcguucaggcag

SEQ ID NO: 3538378 - RNA, 18 nt, Pseudomonas putida KT2440
ggcguggugaauggcgag

SEQ ID NO: 3538379 - RNA, 21 nt, Pseudomonas putida KT2440
ggcguggugaauggcgagccc

SEQ ID NO: 3538380 - RNA, 16 nt, Pseudomonas putida KT2440
ggcguguccagcaggu

SEQ ID NO: 3538381 - RNA, 18 nt, Pseudomonas putida KT2440
ggcguguugccgcugugc

SEQ ID NO: 3538382 - RNA, 14 nt, Pseudomonas putida KT2440
ggcguuccagccag

SEQ ID NO: 3538383 - RNA, 15 nt, Pseudomonas putida KT2440
ggcguucgucaagcu

SEQ ID NO: 3538384 - RNA, 21 nt, Pseudomonas putida KT2440
ggcguugagccgccaacccgu

SEQ ID NO: 3538385 - RNA, 23 nt, Pseudomonas putida KT2440
ggcguugaucuguugcugcaggu

SEQ ID NO: 3538386 - RNA, 16 nt, Pseudomonas putida KT2440
ggcguugccuucgcga

SEQ ID NO: 3538387 - RNA, 12 nt, Pseudomonas putida KT2440
ggcguuggcagu

SEQ ID NO: 3538388 - RNA, 13 nt, Pseudomonas putida KT2440
ggcguuggccaaa

SEQ ID NO: 3538389 - RNA, 14 nt, Pseudomonas putida KT2440
ggcguuggcugccg

SEQ ID NO: 3538390 - RNA, 15 nt, Pseudomonas putida KT2440
ggcguugucagccuu

SEQ ID NO: 3538391 - RNA, 23 nt, Pseudomonas putida KT2440
ggcguuucuucgaggaugcggcu

SEQ ID NO: 3538392 - RNA, 21 nt, Pseudomonas putida KT2440
ggcuaaaaccgguucagucgg

SEQ ID NO: 3538393 - RNA, 16 nt, Pseudomonas putida KT2440
ggcuaauggcgcgccu

SEQ ID NO: 3538394 - RNA, 23 nt, Pseudomonas putida KT2440
ggcuaccccgaugcgcugaucgu

SEQ ID NO: 3538395 - RNA, 18 nt, Pseudomonas putida KT2440
ggcuaccgcugcgcacca

SEQ ID NO: 3538396 - RNA, 23 nt, Pseudomonas putida KT2440
ggcuacgaucaaaugaucgccag

SEQ ID NO: 3538397 - RNA, 13 nt, Pseudomonas putida KT2440
ggcuagaugcugg

SEQ ID NO: 3538398 - RNA, 16 nt, Pseudomonas putida KT2440
ggcuaucggacgauga

SEQ ID NO: 3538399 - RNA, 17 nt, Pseudomonas putida KT2440
ggcuaucggccagcaaa

SEQ ID NO: 3538400 - RNA, 16 nt, Pseudomonas putida KT2440
ggcuaucucaggccag

SEQ ID NO: 3538401 - RNA, 19 nt, Pseudomonas putida KT2440
ggcuaucucaggccaguuc

SEQ ID NO: 3538402 - RNA, 13 nt, Pseudomonas putida KT2440
ggcuaugccgguc

SEQ ID NO: 3538403 - RNA, 13 nt, Pseudomonas putida KT2440
ggcucaacgccag

SEQ ID NO: 3538404 - RNA, 16 nt, Pseudomonas putida KT2440
ggcucaacuacccuga

SEQ ID NO: 3538405 - RNA, 17 nt, Pseudomonas putida KT2440
ggcucaauagcggcggu

SEQ ID NO: 3538406 - RNA, 18 nt, Pseudomonas putida KT2440
ggcucacacccaggcucg

SEQ ID NO: 3538407 - RNA, 16 nt, Pseudomonas putida KT2440
ggcucacccaccagcc

SEQ ID NO: 3538408 - RNA, 14 nt, Pseudomonas putida KT2440
ggcucaccgcagcc

SEQ ID NO: 3538409 - RNA, 20 nt, Pseudomonas putida KT2440
ggcucaccgcagcccagcgc

SEQ ID NO: 3538410 - RNA, 21 nt, Pseudomonas putida KT2440
ggcucagcagguugaacagca

SEQ ID NO: 3538411 - RNA, 11 nt, Pseudomonas putida KT2440
ggcucagcccg

SEQ ID NO: 3538412 - RNA, 15 nt, Pseudomonas putida KT2440
ggcucagccgccaca

SEQ ID NO: 3538413 - RNA, 16 nt, Pseudomonas putida KT2440
ggcucagccgccacau

SEQ ID NO: 3538414 - RNA, 17 nt, Pseudomonas putida KT2440
ggcucagccgccacaug

SEQ ID NO: 3538415 - RNA, 15 nt, Pseudomonas putida KT2440
ggcucagcucgucga

SEQ ID NO: 3538416 - RNA, 15 nt, Pseudomonas putida KT2440
ggcucagggcagcaa

SEQ ID NO: 3538417 - RNA, 19 nt, Pseudomonas putida KT2440
ggcucagggccgcagagcg

SEQ ID NO: 3538418 - RNA, 14 nt, Pseudomonas putida KT2440
ggcucagucccagu

SEQ ID NO: 3538419 - RNA, 15 nt, Pseudomonas putida KT2440
ggcucaguggcugca

SEQ ID NO: 3538420 - RNA, 17 nt, Pseudomonas putida KT2440
ggcucaugcgccagggc

SEQ ID NO: 3538421 - RNA, 21 nt, Pseudomonas putida KT2440
ggcucaugcgccagggcugau

SEQ ID NO: 3538422 - RNA, 13 nt, Pseudomonas putida KT2440
ggcuccaaagcca

SEQ ID NO: 3538423 - RNA, 19 nt, Pseudomonas putida KT2440
ggcuccaaagccagcgcua

SEQ ID NO: 3538424 - RNA, 21 nt, Pseudomonas putida KT2440
ggcuccaaccguacccuuccu

SEQ ID NO: 3538425 - RNA, 22 nt, Pseudomonas putida KT2440
ggcuccacccaacgaacggaac

SEQ ID NO: 3538426 - RNA, 22 nt, Pseudomonas putida KT2440
ggcuccaccgaaaucagcaacg

SEQ ID NO: 3538427 - RNA, 20 nt, Pseudomonas putida KT2440
ggcuccaccugcuccagcac

SEQ ID NO: 3538428 - RNA, 13 nt, Pseudomonas putida KT2440
ggcuccacugcaa

SEQ ID NO: 3538429 - RNA, 13 nt, Pseudomonas putida KT2440
ggcuccaggcaca

SEQ ID NO: 3538430 - RNA, 22 nt, Pseudomonas putida KT2440
ggcuccaggugaaucagcggca

SEQ ID NO: 3538431 - RNA, 14 nt, Pseudomonas putida KT2440
ggcuccaucuccag

SEQ ID NO: 3538432 - RNA, 14 nt, Pseudomonas putida KT2440
ggcucccccuccac

SEQ ID NO: 3538433 - RNA, 20 nt, Pseudomonas putida KT2440
ggcuccggcguguccagcag

SEQ ID NO: 3538434 - RNA, 21 nt, Pseudomonas putida KT2440
ggcuccuucucgaacagcugg

SEQ ID NO: 3538435 - RNA, 21 nt, Pseudomonas putida KT2440
ggcucgaaucaagccugcgca

SEQ ID NO: 3538436 - RNA, 18 nt, Pseudomonas putida KT2440
ggcucgacacgcuugcga

SEQ ID NO: 3538437 - RNA, 19 nt, Pseudomonas putida KT2440
ggcucgacacgcuugcgaa

SEQ ID NO: 3538438 - RNA, 23 nt, Pseudomonas putida KT2440
ggcucgacacgcuugcgaaggag

SEQ ID NO: 3538439 - RNA, 16 nt, Pseudomonas putida KT2440
ggcucgaccaagccug

SEQ ID NO: 3538440 - RNA, 13 nt, Pseudomonas putida KT2440
ggcucgacggcgc

SEQ ID NO: 3538441 - RNA, 13 nt, Pseudomonas putida KT2440
ggcucgaugcugc

SEQ ID NO: 3538442 - RNA, 22 nt, Pseudomonas putida KT2440
ggcucgcagccaaugcugauga

SEQ ID NO: 3538443 - RNA, 16 nt, Pseudomonas putida KT2440
ggcucgccauugaugc

SEQ ID NO: 3538444 - RNA, 22 nt, Pseudomonas putida KT2440
ggcucgccauugaugcucagga

SEQ ID NO: 3538445 - RNA, 20 nt, Pseudomonas putida KT2440
ggcucgcccacacggcaagc

SEQ ID NO: 3538446 - RNA, 17 nt, Pseudomonas putida KT2440
ggcucgcccucgcggcg

SEQ ID NO: 3538447 - RNA, 14 nt, Pseudomonas putida KT2440
ggcucgcucaggcg

SEQ ID NO: 3538448 - RNA, 21 nt, Pseudomonas putida KT2440
ggcucgcucaggcgcagcgca

SEQ ID NO: 3538449 - RNA, 15 nt, Pseudomonas putida KT2440
ggcucgcugaacacg

SEQ ID NO: 3538450 - RNA, 14 nt, Pseudomonas putida KT2440
ggcucgcugcccca

SEQ ID NO: 3538451 - RNA, 13 nt, Pseudomonas putida KT2440
ggcucggccacca

SEQ ID NO: 3538452 - RNA, 18 nt, Pseudomonas putida KT2440
ggcucggccaccacuucu

SEQ ID NO: 3538453 - RNA, 23 nt, Pseudomonas putida KT2440
ggcucggcugggcuuugggagca

SEQ ID NO: 3538454 - RNA, 18 nt, Pseudomonas putida KT2440
ggcucggggccgaugggc

SEQ ID NO: 3538455 - RNA, 16 nt, Pseudomonas putida KT2440
ggcucggugugcaccu

SEQ ID NO: 3538456 - RNA, 14 nt, Pseudomonas putida KT2440
ggcucgucacugcc

SEQ ID NO: 3538457 - RNA, 18 nt, Pseudomonas putida KT2440
ggcucgucgaacagcaug

SEQ ID NO: 3538458 - RNA, 23 nt, Pseudomonas putida KT2440
ggcucuccauugcgccugucacg

SEQ ID NO: 3538459 - RNA, 20 nt, Pseudomonas putida KT2440
ggcucugcuccagcugcucg

SEQ ID NO: 3538460 - RNA, 23 nt, Pseudomonas putida KT2440
ggcucugcuugagcgcagcgacg

SEQ ID NO: 3538461 - RNA, 23 nt, Pseudomonas putida KT2440
ggcucugggcaaaaucgaccagg

SEQ ID NO: 3538462 - RNA, 21 nt, Pseudomonas putida KT2440
ggcucuguuucugccccuggc

SEQ ID NO: 3538463 - RNA, 20 nt, Pseudomonas putida KT2440
ggcucuucaacaccagcaug

SEQ ID NO: 3538464 - RNA, 16 nt, Pseudomonas putida KT2440
ggcugaaaccgcgaau

SEQ ID NO: 3538465 - RNA, 22 nt, Pseudomonas putida KT2440
ggcugaacuuccaggucggggu

SEQ ID NO: 3538466 - RNA, 19 nt, Pseudomonas putida KT2440
ggcugaauccuagcuucuu

SEQ ID NO: 3538467 - RNA, 13 nt, Pseudomonas putida KT2440
ggcugaccggcac

SEQ ID NO: 3538468 - RNA, 12 nt, Pseudomonas putida KT2440
ggcugacgccag

SEQ ID NO: 3538469 - RNA, 20 nt, Pseudomonas putida KT2440
ggcugacgccaguuggucaa

SEQ ID NO: 3538470 - RNA, 14 nt, Pseudomonas putida KT2440
ggcugagcagacca

SEQ ID NO: 3538471 - RNA, 16 nt, Pseudomonas putida KT2440
ggcugagcagaccagc

SEQ ID NO: 3538472 - RNA, 15 nt, Pseudomonas putida KT2440
ggcugagccggcugg

SEQ ID NO: 3538473 - RNA, 19 nt, Pseudomonas putida KT2440
ggcugagccggcuggcguc

SEQ ID NO: 3538474 - RNA, 12 nt, Pseudomonas putida KT2440
ggcugaggaaca

SEQ ID NO: 3538475 - RNA, 14 nt, Pseudomonas putida KT2440
ggcugaucaccgcc

SEQ ID NO: 3538476 - RNA, 22 nt, Pseudomonas putida KT2440
ggcugaucaccgccgccaccga

SEQ ID NO: 3538477 - RNA, 15 nt, Pseudomonas putida KT2440
ggcugaugcgcuggc

SEQ ID NO: 3538478 - RNA, 22 nt, Pseudomonas putida KT2440
ggcugauguugaugugcggcgc

SEQ ID NO: 3538479 - RNA, 15 nt, Pseudomonas putida KT2440
ggcugauugagcagc

SEQ ID NO: 3538480 - RNA, 20 nt, Pseudomonas putida KT2440
ggcugcaaagcagccccggc

SEQ ID NO: 3538481 - RNA, 16 nt, Pseudomonas putida KT2440
ggcugcaaagcgggca

SEQ ID NO: 3538482 - RNA, 17 nt, Pseudomonas putida KT2440
ggcugcaaagcgggcaa

SEQ ID NO: 3538483 - RNA, 20 nt, Pseudomonas putida KT2440
ggcugcaagguccaggcgug

SEQ ID NO: 3538484 - RNA, 18 nt, Pseudomonas putida KT2440
ggcugcaaugcagccccu

SEQ ID NO: 3538485 - RNA, 19 nt, Pseudomonas putida KT2440
ggcugcaaugcagccccuu

SEQ ID NO: 3538486 - RNA, 15 nt, Pseudomonas putida KT2440
ggcugcacugccgca

SEQ ID NO: 3538487 - RNA, 13 nt, Pseudomonas putida KT2440
ggcugcacuggca

SEQ ID NO: 3538488 - RNA, 10 nt, Pseudomonas putida KT2440
ggcugcagca

SEQ ID NO: 3538489 - RNA, 14 nt, Pseudomonas putida KT2440
ggcugcagcgaaca

SEQ ID NO: 3538490 - RNA, 19 nt, Pseudomonas putida KT2440
ggcugcaggucggccagcu

SEQ ID NO: 3538491 - RNA, 18 nt, Pseudomonas putida KT2440
ggcugcaguagucgccag

SEQ ID NO: 3538492 - RNA, 21 nt, Pseudomonas putida KT2440
ggcugcaguagucgccaggcc

SEQ ID NO: 3538493 - RNA, 16 nt, Pseudomonas putida KT2440
ggcugcauccacccac

SEQ ID NO: 3538494 - RNA, 16 nt, Pseudomonas putida KT2440
ggcugcauugcagccc

SEQ ID NO: 3538495 - RNA, 12 nt, Pseudomonas putida KT2440
ggcugccacggc

SEQ ID NO: 3538496 - RNA, 20 nt, Pseudomonas putida KT2440
ggcugccacgggcauagccc

SEQ ID NO: 3538497 - RNA, 19 nt, Pseudomonas putida KT2440
ggcugcccucgggcagccu

SEQ ID NO: 3538498 - RNA, 15 nt, Pseudomonas putida KT2440
ggcugccgccgaaca

SEQ ID NO: 3538499 - RNA, 23 nt, Pseudomonas putida KT2440
ggcugccguccaacgggcggaac

SEQ ID NO: 3538500 - RNA, 17 nt, Pseudomonas putida KT2440
ggcugccuacccaggca

SEQ ID NO: 3538501 - RNA, 20 nt, Pseudomonas putida KT2440
ggcugccuggcccgcuacga

SEQ ID NO: 3538502 - RNA, 20 nt, Pseudomonas putida KT2440
ggcugccuugcagcccuucg

SEQ ID NO: 3538503 - RNA, 16 nt, Pseudomonas putida KT2440
ggcugcgacggcgaau

SEQ ID NO: 3538504 - RNA, 22 nt, Pseudomonas putida KT2440
ggcugcgauagaacuccaccag

SEQ ID NO: 3538505 - RNA, 15 nt, Pseudomonas putida KT2440
ggcugcgcccgcaca

SEQ ID NO: 3538506 - RNA, 23 nt, Pseudomonas putida KT2440
ggcugcgccgccuccaccgggau

SEQ ID NO: 3538507 - RNA, 15 nt, Pseudomonas putida KT2440
ggcugcgcgcccagg

SEQ ID NO: 3538508 - RNA, 12 nt, Pseudomonas putida KT2440
ggcugcgcggca

SEQ ID NO: 3538509 - RNA, 15 nt, Pseudomonas putida KT2440
ggcugcgcggcagcc

SEQ ID NO: 3538510 - RNA, 18 nt, Pseudomonas putida KT2440
ggcugcgcggcagcccuu

SEQ ID NO: 3538511 - RNA, 20 nt, Pseudomonas putida KT2440
ggcugcgcggcagcccuucg

SEQ ID NO: 3538512 - RNA, 14 nt, Pseudomonas putida KT2440
ggcugcgugccugc

SEQ ID NO: 3538513 - RNA, 20 nt, Pseudomonas putida KT2440
ggcugcgugccugcugcucg

SEQ ID NO: 3538514 - RNA, 20 nt, Pseudomonas putida KT2440
ggcugcguucaggcaggaac

SEQ ID NO: 3538515 - RNA, 17 nt, Pseudomonas putida KT2440
ggcugcuucucgcucag

SEQ ID NO: 3538516 - RNA, 18 nt, Pseudomonas putida KT2440
ggcugcuuugcagcccuu

SEQ ID NO: 3538517 - RNA, 20 nt, Pseudomonas putida KT2440
ggcugcuuugcagcccuucg

SEQ ID NO: 3538518 - RNA, 17 nt, Pseudomonas putida KT2440
ggcuggacaccucccgc

SEQ ID NO: 3538519 - RNA, 21 nt, Pseudomonas putida KT2440
ggcuggacaccucccgcgcau

SEQ ID NO: 3538520 - RNA, 19 nt, Pseudomonas putida KT2440
ggcuggacuaacaggugcu

SEQ ID NO: 3538521 - RNA, 18 nt, Pseudomonas putida KT2440
ggcuggacucgccgagaa

SEQ ID NO: 3538522 - RNA, 22 nt, Pseudomonas putida KT2440
ggcuggacucgccgagaaaugg

SEQ ID NO: 3538523 - RNA, 22 nt, Pseudomonas putida KT2440
ggcuggagagguacacccccag

SEQ ID NO: 3538524 - RNA, 12 nt, Pseudomonas putida KT2440
ggcuggcaaccc

SEQ ID NO: 3538525 - RNA, 20 nt, Pseudomonas putida KT2440
ggcuggcacccgcaggacgg

SEQ ID NO: 3538526 - RNA, 17 nt, Pseudomonas putida KT2440
ggcuggcacgugacugg

SEQ ID NO: 3538527 - RNA, 13 nt, Pseudomonas putida KT2440
ggcuggcacucca

SEQ ID NO: 3538528 - RNA, 17 nt, Pseudomonas putida KT2440
ggcuggcagcacgauca

SEQ ID NO: 3538529 - RNA, 18 nt, Pseudomonas putida KT2440
ggcuggcagcacgaucag

SEQ ID NO: 3538530 - RNA, 12 nt, Pseudomonas putida KT2440
ggcuggcagccg

SEQ ID NO: 3538531 - RNA, 14 nt, Pseudomonas putida KT2440
ggcuggcagccggc

SEQ ID NO: 3538532 - RNA, 15 nt, Pseudomonas putida KT2440
ggcuggcagccggcg

SEQ ID NO: 3538533 - RNA, 20 nt, Pseudomonas putida KT2440
ggcuggcagcugcagugcug

SEQ ID NO: 3538534 - RNA, 21 nt, Pseudomonas putida KT2440
ggcuggcagcugcagugcugg

SEQ ID NO: 3538535 - RNA, 20 nt, Pseudomonas putida KT2440
ggcuggccaccaugaacagc

SEQ ID NO: 3538536 - RNA, 13 nt, Pseudomonas putida KT2440
ggcuggccagcaa

SEQ ID NO: 3538537 - RNA, 23 nt, Pseudomonas putida KT2440
ggcuggccagcaagugccccugg

SEQ ID NO: 3538538 - RNA, 13 nt, Pseudomonas putida KT2440
ggcuggcgcaugc

SEQ ID NO: 3538539 - RNA, 12 nt, Pseudomonas putida KT2440
ggcuggcgcuuc

SEQ ID NO: 3538540 - RNA, 13 nt, Pseudomonas putida KT2440
ggcuggcgcuucc

SEQ ID NO: 3538541 - RNA, 15 nt, Pseudomonas putida KT2440
ggcuggcggggacga

SEQ ID NO: 3538542 - RNA, 18 nt, Pseudomonas putida KT2440
ggcuggcugucgaaggcu

SEQ ID NO: 3538543 - RNA, 17 nt, Pseudomonas putida KT2440
ggcugggcgcggcgggc

SEQ ID NO: 3538544 - RNA, 21 nt, Pseudomonas putida KT2440
ggcugggggcgcuuugcgccc

SEQ ID NO: 3538545 - RNA, 17 nt, Pseudomonas putida KT2440
ggcugguauugccuggc

SEQ ID NO: 3538546 - RNA, 20 nt, Pseudomonas putida KT2440
ggcugguccgggcccaugcc

SEQ ID NO: 3538547 - RNA, 13 nt, Pseudomonas putida KT2440
ggcuggugaacca

SEQ ID NO: 3538548 - RNA, 15 nt, Pseudomonas putida KT2440
ggcugguggcggcau

SEQ ID NO: 3538549 - RNA, 17 nt, Pseudomonas putida KT2440
ggcuggugucggccagg

SEQ ID NO: 3538550 - RNA, 16 nt, Pseudomonas putida KT2440
ggcugguuaugagccu

SEQ ID NO: 3538551 - RNA, 15 nt, Pseudomonas putida KT2440
ggcuguaccggccuc

SEQ ID NO: 3538552 - RNA, 14 nt, Pseudomonas putida KT2440
ggcuguccagcaag

SEQ ID NO: 3538553 - RNA, 15 nt, Pseudomonas putida KT2440
ggcugucccaugcug

SEQ ID NO: 3538554 - RNA, 15 nt, Pseudomonas putida KT2440
ggcugucgaacaggc

SEQ ID NO: 3538555 - RNA, 18 nt, Pseudomonas putida KT2440
ggcugucgaaggcuugca

SEQ ID NO: 3538556 - RNA, 12 nt, Pseudomonas putida KT2440
ggcugucgagca

SEQ ID NO: 3538557 - RNA, 14 nt, Pseudomonas putida KT2440
ggcugucgccuaca

SEQ ID NO: 3538558 - RNA, 12 nt, Pseudomonas putida KT2440
ggcugucuggga

SEQ ID NO: 3538559 - RNA, 12 nt, Pseudomonas putida KT2440
ggcugugcaccc

SEQ ID NO: 3538560 - RNA, 19 nt, Pseudomonas putida KT2440
ggcuguuccagcagcgaca

SEQ ID NO: 3538561 - RNA, 16 nt, Pseudomonas putida KT2440
ggcuguucgucggccu

SEQ ID NO: 3538562 - RNA, 13 nt, Pseudomonas putida KT2440
ggcuguugcgguu

SEQ ID NO: 3538563 - RNA, 18 nt, Pseudomonas putida KT2440
ggcuuacaucggcgacga

SEQ ID NO: 3538564 - RNA, 20 nt, Pseudomonas putida KT2440
ggcuuacccgcgaagaggcc

SEQ ID NO: 3538565 - RNA, 16 nt, Pseudomonas putida KT2440
ggcuuacuuggucacc

SEQ ID NO: 3538566 - RNA, 12 nt, Pseudomonas putida KT2440
gggcaaucgcca

SEQ ID NO: 3538567 - RNA, 22 nt, Pseudomonas putida KT2440
gggcaaucgccaaggucccguu

SEQ ID NO: 3538568 - RNA, 16 nt, Pseudomonas putida KT2440
gggcaaugaguccggu

SEQ ID NO: 3538569 - RNA, 15 nt, Pseudomonas putida KT2440
gggcaaugcaggcag

SEQ ID NO: 3538570 - RNA, 17 nt, Pseudomonas putida KT2440
gggcaauggccacacgc

SEQ ID NO: 3538571 - RNA, 15 nt, Pseudomonas putida KT2440
gggcaauguccagcc

SEQ ID NO: 3538572 - RNA, 18 nt, Pseudomonas putida KT2440
gggcaauguccaggugcu

SEQ ID NO: 3538573 - RNA, 20 nt, Pseudomonas putida KT2440
gggcaauguucgcugccagc

SEQ ID NO: 3538574 - RNA, 19 nt, Pseudomonas putida KT2440
gggcacacuucgccgugcu

SEQ ID NO: 3538575 - RNA, 14 nt, Pseudomonas putida KT2440
gggcacaggcccag

SEQ ID NO: 3538576 - RNA, 12 nt, Pseudomonas putida KT2440
gggcacaggccg

SEQ ID NO: 3538577 - RNA, 16 nt, Pseudomonas putida KT2440
gggcaccggccaccag

SEQ ID NO: 3538578 - RNA, 22 nt, Pseudomonas putida KT2440
gggcaccggccaccaggcgcgg

SEQ ID NO: 3538579 - RNA, 15 nt, Pseudomonas putida KT2440
gggcacgaucagcag

SEQ ID NO: 3538580 - RNA, 22 nt, Pseudomonas putida KT2440
gggcacgccaaucaccugcaca

SEQ ID NO: 3538581 - RNA, 17 nt, Pseudomonas putida KT2440
gggcacgcccgcuccca

SEQ ID NO: 3538582 - RNA, 13 nt, Pseudomonas putida KT2440
gggcacggcugcc

SEQ ID NO: 3538583 - RNA, 17 nt, Pseudomonas putida KT2440
gggcacgggccagcgcg

SEQ ID NO: 3538584 - RNA, 21 nt, Pseudomonas putida KT2440
gggcacuggcugauagccgcc

SEQ ID NO: 3538585 - RNA, 23 nt, Pseudomonas putida KT2440
gggcagcaccgcguaucaggcau

SEQ ID NO: 3538586 - RNA, 23 nt, Pseudomonas putida KT2440
gggcagcaucaccacgcccuggc

SEQ ID NO: 3538587 - RNA, 22 nt, Pseudomonas putida KT2440
gggcagccacgcuccagucgug

SEQ ID NO: 3538588 - RNA, 17 nt, Pseudomonas putida KT2440
gggcagcgggcucgccc

SEQ ID NO: 3538589 - RNA, 13 nt, Pseudomonas putida KT2440
gggcaggccccug

SEQ ID NO: 3538590 - RNA, 23 nt, Pseudomonas putida KT2440
gggcaggcugauggauuccucgc

SEQ ID NO: 3538591 - RNA, 17 nt, Pseudomonas putida KT2440
gggcagggugucgacga

SEQ ID NO: 3538592 - RNA, 15 nt, Pseudomonas putida KT2440
gggcaggucgacccg

SEQ ID NO: 3538593 - RNA, 14 nt, Pseudomonas putida KT2440
gggcagugcaauac

SEQ ID NO: 3538594 - RNA, 17 nt, Pseudomonas putida KT2440
gggcaguucgaugcgaa

SEQ ID NO: 3538595 - RNA, 17 nt, Pseudomonas putida KT2440
gggcauccgucgacuca

SEQ ID NO: 3538596 - RNA, 22 nt, Pseudomonas putida KT2440
gggcaucggcgugcugcgucuc

SEQ ID NO: 3538597 - RNA, 18 nt, Pseudomonas putida KT2440
gggcaugagccuggccgg

SEQ ID NO: 3538598 - RNA, 19 nt, Pseudomonas putida KT2440
gggcaugagccuggccggu

SEQ ID NO: 3538599 - RNA, 20 nt, Pseudomonas putida KT2440
gggcaugcccgcucccacag

SEQ ID NO: 3538600 - RNA, 15 nt, Pseudomonas putida KT2440
gggcauggccgcccu

SEQ ID NO: 3538601 - RNA, 16 nt, Pseudomonas putida KT2440
gggccaaguggcugga

SEQ ID NO: 3538602 - RNA, 16 nt, Pseudomonas putida KT2440
gggccaccaggccuuu

SEQ ID NO: 3538603 - RNA, 18 nt, Pseudomonas putida KT2440
gggccaccaggccuuuga

SEQ ID NO: 3538604 - RNA, 17 nt, Pseudomonas putida KT2440
gggccagccgcgccagg

SEQ ID NO: 3538605 - RNA, 18 nt, Pseudomonas putida KT2440
gggccagccgcgccaggu

SEQ ID NO: 3538606 - RNA, 17 nt, Pseudomonas putida KT2440
gggccaguccaggccaa

SEQ ID NO: 3538607 - RNA, 17 nt, Pseudomonas putida KT2440
gggccauucgcgggcau

SEQ ID NO: 3538608 - RNA, 13 nt, Pseudomonas putida KT2440
gggcccagccacc

SEQ ID NO: 3538609 - RNA, 18 nt, Pseudomonas putida KT2440
gggccccaccaggcaccg

SEQ ID NO: 3538610 - RNA, 13 nt, Pseudomonas putida KT2440
gggccccaggcgg

SEQ ID NO: 3538611 - RNA, 18 nt, Pseudomonas putida KT2440
gggccccuucaaggggcc

SEQ ID NO: 3538612 - RNA, 14 nt, Pseudomonas putida KT2440
gggcccgcagggcc

SEQ ID NO: 3538613 - RNA, 13 nt, Pseudomonas putida KT2440
gggcccgcccagc

SEQ ID NO: 3538614 - RNA, 14 nt, Pseudomonas putida KT2440
gggcccgcccagcu

SEQ ID NO: 3538615 - RNA, 18 nt, Pseudomonas putida KT2440
gggcccucaacccucgcc

SEQ ID NO: 3538616 - RNA, 18 nt, Pseudomonas putida KT2440
gggccgaaaggugcagca

SEQ ID NO: 3538617 - RNA, 21 nt, Pseudomonas putida KT2440
gggccgcaaagcggccccagu

SEQ ID NO: 3538618 - RNA, 19 nt, Pseudomonas putida KT2440
gggccgcaaagcggccccc

SEQ ID NO: 3538619 - RNA, 21 nt, Pseudomonas putida KT2440
gggccgcaacgcggccccggc

SEQ ID NO: 3538620 - RNA, 18 nt, Pseudomonas putida KT2440
gggccgcaacgcggcccu

SEQ ID NO: 3538621 - RNA, 12 nt, Pseudomonas putida KT2440
gggccgcaaggc

SEQ ID NO: 3538622 - RNA, 20 nt, Pseudomonas putida KT2440
gggccgccaagcggccccaa

SEQ ID NO: 3538623 - RNA, 20 nt, Pseudomonas putida KT2440
gggccgccaagcggccccag

SEQ ID NO: 3538624 - RNA, 14 nt, Pseudomonas putida KT2440
gggccgcccuuucg

SEQ ID NO: 3538625 - RNA, 17 nt, Pseudomonas putida KT2440
gggccgccguggugccg

SEQ ID NO: 3538626 - RNA, 16 nt, Pseudomonas putida KT2440
gggccgcgacgcggcc

SEQ ID NO: 3538627 - RNA, 12 nt, Pseudomonas putida KT2440
gggccgcgcagc

SEQ ID NO: 3538628 - RNA, 16 nt, Pseudomonas putida KT2440
gggccgcgcagccuuu

SEQ ID NO: 3538629 - RNA, 18 nt, Pseudomonas putida KT2440
gggccgcgcagccuuuga

SEQ ID NO: 3538630 - RNA, 15 nt, Pseudomonas putida KT2440
gggccgcgcagcggc

SEQ ID NO: 3538631 - RNA, 13 nt, Pseudomonas putida KT2440
gggccgcgcaggc

SEQ ID NO: 3538632 - RNA, 19 nt, Pseudomonas putida KT2440
gggccgcguugcggcccuu

SEQ ID NO: 3538633 - RNA, 20 nt, Pseudomonas putida KT2440
gggccgcuacgcgccccuuu

SEQ ID NO: 3538634 - RNA, 14 nt, Pseudomonas putida KT2440
gggccgcuguggga

SEQ ID NO: 3538635 - RNA, 20 nt, Pseudomonas putida KT2440
gggccgcuuggcggcccauu

SEQ ID NO: 3538636 - RNA, 20 nt, Pseudomonas putida KT2440
gggccgcuuugcggccccuu

SEQ ID NO: 3538637 - RNA, 18 nt, Pseudomonas putida KT2440
gggccggcacaggcuuac

SEQ ID NO: 3538638 - RNA, 13 nt, Pseudomonas putida KT2440
gggccggcgcccu

SEQ ID NO: 3538639 - RNA, 22 nt, Pseudomonas putida KT2440
gggccggugggcaacagcugcg

SEQ ID NO: 3538640 - RNA, 15 nt, Pseudomonas putida KT2440
gggccgugcaggcgg

SEQ ID NO: 3538641 - RNA, 18 nt, Pseudomonas putida KT2440
gggccguuacucccacag

SEQ ID NO: 3538642 - RNA, 17 nt, Pseudomonas putida KT2440
gggccugaccgcccagc

SEQ ID NO: 3538643 - RNA, 20 nt, Pseudomonas putida KT2440
gggccugacgugcgcggggc

SEQ ID NO: 3538644 - RNA, 22 nt, Pseudomonas putida KT2440
gggccugcacgaucgaccgggu

SEQ ID NO: 3538645 - RNA, 10 nt, Pseudomonas putida KT2440
gggccugugc

SEQ ID NO: 3538646 - RNA, 11 nt, Pseudomonas putida KT2440
gggccugugcc

SEQ ID NO: 3538647 - RNA, 16 nt, Pseudomonas putida KT2440
gggccugugccgggcc

SEQ ID NO: 3538648 - RNA, 19 nt, Pseudomonas putida KT2440
gggccuuccccgugauauc

SEQ ID NO: 3538649 - RNA, 16 nt, Pseudomonas putida KT2440
gggccuuuucggucau

SEQ ID NO: 3538650 - RNA, 17 nt, Pseudomonas putida KT2440
gggccuuuuucguuggg

SEQ ID NO: 3538651 - RNA, 16 nt, Pseudomonas putida KT2440
gggcgaaauggcgaau

SEQ ID NO: 3538652 - RNA, 13 nt, Pseudomonas putida KT2440
gggcgaaccaggu

SEQ ID NO: 3538653 - RNA, 22 nt, Pseudomonas putida KT2440
gggcgaagcccguggcccucag

SEQ ID NO: 3538654 - RNA, 14 nt, Pseudomonas putida KT2440
gggcgacagacagg

SEQ ID NO: 3538655 - RNA, 18 nt, Pseudomonas putida KT2440
gggcgacagacagggccu

SEQ ID NO: 3538656 - RNA, 19 nt, Pseudomonas putida KT2440
gggcgagcaggugacccug

SEQ ID NO: 3538657 - RNA, 18 nt, Pseudomonas putida KT2440
gggcgagcgcgcaggcgg

SEQ ID NO: 3538658 - RNA, 17 nt, Pseudomonas putida KT2440
gggcgaggacagcaucu

SEQ ID NO: 3538659 - RNA, 13 nt, Pseudomonas putida KT2440
gggcgaucuccug

SEQ ID NO: 3538660 - RNA, 15 nt, Pseudomonas putida KT2440
gggcgaucuccugca

SEQ ID NO: 3538661 - RNA, 16 nt, Pseudomonas putida KT2440
gggcgaugaucgccuu

SEQ ID NO: 3538662 - RNA, 14 nt, Pseudomonas putida KT2440
gggcgauugccagg

SEQ ID NO: 3538663 - RNA, 19 nt, Pseudomonas putida KT2440
gggcgcaaugcgccccggc

SEQ ID NO: 3538664 - RNA, 15 nt, Pseudomonas putida KT2440
gggcgcagagcgccc

SEQ ID NO: 3538665 - RNA, 13 nt, Pseudomonas putida KT2440
gggcgcccggcag

SEQ ID NO: 3538666 - RNA, 22 nt, Pseudomonas putida KT2440
gggcgcgauugccuuccuugaa

SEQ ID NO: 3538667 - RNA, 20 nt, Pseudomonas putida KT2440
gggcgcgcccgcucccacag

SEQ ID NO: 3538668 - RNA, 22 nt, Pseudomonas putida KT2440
gggcgcguguagcccgcugaag

SEQ ID NO: 3538669 - RNA, 14 nt, Pseudomonas putida KT2440
gggcgcugaagcca

SEQ ID NO: 3538670 - RNA, 22 nt, Pseudomonas putida KT2440
gggcgcuugcccgcgaauggcc

SEQ ID NO: 3538671 - RNA, 23 nt, Pseudomonas putida KT2440
gggcgcuuggucggcgccccuuu

SEQ ID NO: 3538672 - RNA, 19 nt, Pseudomonas putida KT2440
ggguaaacccauuccuaca

SEQ ID NO: 3538673 - RNA, 20 nt, Pseudomonas putida KT2440
ggguaaacccauuccuacag

SEQ ID NO: 3538674 - RNA, 19 nt, Pseudomonas putida KT2440
ggguaaacccgcuccuaca

SEQ ID NO: 3538675 - RNA, 20 nt, Pseudomonas putida KT2440
ggguaaacccgcuccuacaa

SEQ ID NO: 3538676 - RNA, 20 nt, Pseudomonas putida KT2440
ggguaaacccgcuccuacag

SEQ ID NO: 3538677 - RNA, 20 nt, Pseudomonas putida KT2440
ggguaaacccgcuccuacau

SEQ ID NO: 3538678 - RNA, 20 nt, Pseudomonas putida KT2440
ggguaaacccgcuccuacga

SEQ ID NO: 3538679 - RNA, 20 nt, Pseudomonas putida KT2440
ggguaaacccgcuccuacgg

SEQ ID NO: 3538680 - RNA, 23 nt, Pseudomonas putida KT2440
ggguaaacccgcuccuacuacgg

SEQ ID NO: 3538681 - RNA, 14 nt, Pseudomonas putida KT2440
ggguaaccgccuga

SEQ ID NO: 3538682 - RNA, 16 nt, Pseudomonas putida KT2440
ggguaagccggcggcc

SEQ ID NO: 3538683 - RNA, 18 nt, Pseudomonas putida KT2440
ggguaaucaguaccaggc

SEQ ID NO: 3538684 - RNA, 14 nt, Pseudomonas putida KT2440
ggguaauggcgaag

SEQ ID NO: 3538685 - RNA, 16 nt, Pseudomonas putida KT2440
ggguaauggcgcugga

SEQ ID NO: 3538686 - RNA, 18 nt, Pseudomonas putida KT2440
ggguacgauagggcggug

SEQ ID NO: 3538687 - RNA, 17 nt, Pseudomonas putida KT2440
ggguacgcaccuugccc

SEQ ID NO: 3538688 - RNA, 14 nt, Pseudomonas putida KT2440
ggguacuccaccac

SEQ ID NO: 3538689 - RNA, 10 nt, Pseudomonas putida KT2440
ggguacugcu

SEQ ID NO: 3538690 - RNA, 23 nt, Pseudomonas putida KT2440
ggguagaccuucuggcagccgcc

SEQ ID NO: 3538691 - RNA, 21 nt, Pseudomonas putida KT2440
ggguagaucauuaccugcagg

SEQ ID NO: 3538692 - RNA, 20 nt, Pseudomonas putida KT2440
ggguagccagcccaggcugg

SEQ ID NO: 3538693 - RNA, 21 nt, Pseudomonas putida KT2440
ggguagcgucaacugccaggc

SEQ ID NO: 3538694 - RNA, 14 nt, Pseudomonas putida KT2440
ggguaggccccagg

SEQ ID NO: 3538695 - RNA, 13 nt, Pseudomonas putida KT2440
ggguaguccucca

SEQ ID NO: 3538696 - RNA, 17 nt, Pseudomonas putida KT2440
ggguaugccacgacacc

SEQ ID NO: 3538697 - RNA, 20 nt, Pseudomonas putida KT2440
ggguaugccacgacaccggg

SEQ ID NO: 3538698 - RNA, 13 nt, Pseudomonas putida KT2440
gggucaagcugga

SEQ ID NO: 3538699 - RNA, 20 nt, Pseudomonas putida KT2440
gggucacggcugaagaagcu

SEQ ID NO: 3538700 - RNA, 17 nt, Pseudomonas putida KT2440
gggucagcagcaccgcc

SEQ ID NO: 3538701 - RNA, 13 nt, Pseudomonas putida KT2440
gggucagcggggu

SEQ ID NO: 3538702 - RNA, 13 nt, Pseudomonas putida KT2440
gggucagcuccuc

SEQ ID NO: 3538703 - RNA, 17 nt, Pseudomonas putida KT2440
gggucagcuccucugcc

SEQ ID NO: 3538704 - RNA, 19 nt, Pseudomonas putida KT2440
gggucaggaaccgcuccca

SEQ ID NO: 3538705 - RNA, 21 nt, Pseudomonas putida KT2440
gggucaggucgcugugcggcg

SEQ ID NO: 3538706 - RNA, 16 nt, Pseudomonas putida KT2440
gggucaggugcggggc

SEQ ID NO: 3538707 - RNA, 16 nt, Pseudomonas putida KT2440
gggucaguucagccag

SEQ ID NO: 3538708 - RNA, 19 nt, Pseudomonas putida KT2440
gggucaguucagccagggu

SEQ ID NO: 3538709 - RNA, 12 nt, Pseudomonas putida KT2440
gggucaugccac

SEQ ID NO: 3538710 - RNA, 16 nt, Pseudomonas putida KT2440
gggucaugccaccgcc

SEQ ID NO: 3538711 - RNA, 22 nt, Pseudomonas putida KT2440
gggucccugguucgaguccagg

SEQ ID NO: 3538712 - RNA, 24 nt, Pseudomonas putida KT2440
ggguccugcgccaggcauugcucg

SEQ ID NO: 3538713 - RNA, 13 nt, Pseudomonas putida KT2440
gggucgacaccag

SEQ ID NO: 3538714 - RNA, 22 nt, Pseudomonas putida KT2440
gggucgacaccaggaucaggua

SEQ ID NO: 3538715 - RNA, 19 nt, Pseudomonas putida KT2440
gggucgaccugggccaggu

SEQ ID NO: 3538716 - RNA, 18 nt, Pseudomonas putida KT2440
gggucgagguggagacca

SEQ ID NO: 3538717 - RNA, 15 nt, Pseudomonas putida KT2440
gggucgauagccagc

SEQ ID NO: 3538718 - RNA, 23 nt, Pseudomonas putida KT2440
gggucgcugccgugcaggucagc

SEQ ID NO: 3538719 - RNA, 18 nt, Pseudomonas putida KT2440
gggucgguggcaugcucc

SEQ ID NO: 3538720 - RNA, 20 nt, Pseudomonas putida KT2440
gggucguucggugcacggcc

SEQ ID NO: 3538721 - RNA, 17 nt, Pseudomonas putida KT2440
gggucucgcggcuggug

SEQ ID NO: 3538722 - RNA, 14 nt, Pseudomonas putida KT2440
gggucugcccggcc

SEQ ID NO: 3538723 - RNA, 18 nt, Pseudomonas putida KT2440
gggucugcccggccagca

SEQ ID NO: 3538724 - RNA, 14 nt, Pseudomonas putida KT2440
gggucugugcagcg

SEQ ID NO: 3538725 - RNA, 14 nt, Pseudomonas putida KT2440
gggucuuccaccac

SEQ ID NO: 3538726 - RNA, 18 nt, Pseudomonas putida KT2440
gggucuugccggucacug

SEQ ID NO: 3538727 - RNA, 19 nt, Pseudomonas putida KT2440
gggucuuuucuucgcccuu

SEQ ID NO: 3538728 - RNA, 19 nt, Pseudomonas putida KT2440
gggugaacccgcuccuaca

SEQ ID NO: 3538729 - RNA, 20 nt, Pseudomonas putida KT2440
gggugaacccgcuccuacaa

SEQ ID NO: 3538730 - RNA, 20 nt, Pseudomonas putida KT2440
gggugaacccgcuccuacac

SEQ ID NO: 3538731 - RNA, 20 nt, Pseudomonas putida KT2440
gggugaacccgcuccuacga

SEQ ID NO: 3538732 - RNA, 20 nt, Pseudomonas putida KT2440
gggugaacccgcuccuacgg

SEQ ID NO: 3538733 - RNA, 21 nt, Pseudomonas putida KT2440
gggugaacccgcuccugcagg

SEQ ID NO: 3538734 - RNA, 21 nt, Pseudomonas putida KT2440
gggugaagaagaacuccucca

SEQ ID NO: 3538735 - RNA, 13 nt, Pseudomonas putida KT2440
gggugaccaccag

SEQ ID NO: 3538736 - RNA, 12 nt, Pseudomonas putida KT2440
gggugaccaggc

SEQ ID NO: 3538737 - RNA, 16 nt, Pseudomonas putida KT2440
gggugaggaugaggga

SEQ ID NO: 3538738 - RNA, 17 nt, Pseudomonas putida KT2440
gggugaucgcgcuggca

SEQ ID NO: 3538739 - RNA, 15 nt, Pseudomonas putida KT2440
gggugcaucggcacc

SEQ ID NO: 3538740 - RNA, 13 nt, Pseudomonas putida KT2440
gggugccagacca

SEQ ID NO: 3538741 - RNA, 15 nt, Pseudomonas putida KT2440
gggugccgacguggu

SEQ ID NO: 3538742 - RNA, 18 nt, Pseudomonas putida KT2440
gggugccgcggauguggu

SEQ ID NO: 3538743 - RNA, 21 nt, Pseudomonas putida KT2440
gggugccgcggauguggugga

SEQ ID NO: 3538744 - RNA, 19 nt, Pseudomonas putida KT2440
gggugccggccagcggcau

SEQ ID NO: 3538745 - RNA, 19 nt, Pseudomonas putida KT2440
gggugcuccaccaaggcug

SEQ ID NO: 3538746 - RNA, 21 nt, Pseudomonas putida KT2440
ggguggaaauuggcgagcagg

SEQ ID NO: 3538747 - RNA, 21 nt, Pseudomonas putida KT2440
ggguggagauuggucggcagg

SEQ ID NO: 3538748 - RNA, 21 nt, Pseudomonas putida KT2440
ggguggucgcugcggcacacc

SEQ ID NO: 3538749 - RNA, 15 nt, Pseudomonas putida KT2440
ggguggugucgcugu

SEQ ID NO: 3538750 - RNA, 17 nt, Pseudomonas putida KT2440
gggugucaacaggcugg

SEQ ID NO: 3538751 - RNA, 13 nt, Pseudomonas putida KT2440
ggguguggccaau

SEQ ID NO: 3538752 - RNA, 23 nt, Pseudomonas putida KT2440
ggguguugcuugucccaggccau

SEQ ID NO: 3538753 - RNA, 20 nt, Pseudomonas putida KT2440
ggguguuggacacaggccgu

SEQ ID NO: 3538754 - RNA, 17 nt, Pseudomonas putida KT2440
ggguuaccuugaucugu

SEQ ID NO: 3538755 - RNA, 18 nt, Pseudomonas putida KT2440
ggguucacccgcgaaugc

SEQ ID NO: 3538756 - RNA, 20 nt, Pseudomonas putida KT2440
ggguucgccaugacguugca

SEQ ID NO: 3538757 - RNA, 21 nt, Pseudomonas putida KT2440
ggguugcaauaccgugcuugc

SEQ ID NO: 3538758 - RNA, 20 nt, Pseudomonas putida KT2440
ggguugcaucgcgcacuugc

SEQ ID NO: 3538759 - RNA, 14 nt, Pseudomonas putida KT2440
ggguuggcauggcc

SEQ ID NO: 3538760 - RNA, 20 nt, Pseudomonas putida KT2440
ggguuggcgucggcaccggc

SEQ ID NO: 3538761 - RNA, 20 nt, Pseudomonas putida KT2440
ggguuuacccgcgaacaggc

SEQ ID NO: 3538762 - RNA, 21 nt, Pseudomonas putida KT2440
ggguuuacccgcgaagaagcc

SEQ ID NO: 3538763 - RNA, 17 nt, Pseudomonas putida KT2440
ggguuuacccgcgaagc

SEQ ID NO: 3538764 - RNA, 18 nt, Pseudomonas putida KT2440
ggguuuacccgcgaauac

SEQ ID NO: 3538765 - RNA, 18 nt, Pseudomonas putida KT2440
ggguuuacccgcgaaugg

SEQ ID NO: 3538766 - RNA, 22 nt, Pseudomonas putida KT2440
ggguuuauuucucuuccuggcu

SEQ ID NO: 3538767 - RNA, 14 nt, Pseudomonas putida KT2440
ggguuugcagcuca

SEQ ID NO: 3538768 - RNA, 19 nt, Pseudomonas putida KT2440
ggguuuuuugugccugugu

SEQ ID NO: 3538769 - RNA, 17 nt, Pseudomonas putida KT2440
gguaaaaaucaugcagu

SEQ ID NO: 3538770 - RNA, 14 nt, Pseudomonas putida KT2440
gguaaaacagccuu

SEQ ID NO: 3538771 - RNA, 19 nt, Pseudomonas putida KT2440
gguaaacccauuccuacag

SEQ ID NO: 3538772 - RNA, 19 nt, Pseudomonas putida KT2440
gguaaacccgcgccuacag

SEQ ID NO: 3538773 - RNA, 13 nt, Pseudomonas putida KT2440
gguaaacccgcuc

SEQ ID NO: 3538774 - RNA, 20 nt, Pseudomonas putida KT2440
gguaaacccgcuccuacaag

SEQ ID NO: 3538775 - RNA, 19 nt, Pseudomonas putida KT2440
gguaaacccgcuccuacag

SEQ ID NO: 3538776 - RNA, 20 nt, Pseudomonas putida KT2440
gguaaacccgcuccuacagg

SEQ ID NO: 3538777 - RNA, 24 nt, Pseudomonas putida KT2440
ggucagcagcaccgccaccaugcu

SEQ ID NO: 3538778 - RNA, 13 nt, Pseudomonas putida KT2440
ggucagcaucacc

SEQ ID NO: 3538779 - RNA, 16 nt, Pseudomonas putida KT2440
ggucagcauccagcca

SEQ ID NO: 3538780 - RNA, 22 nt, Pseudomonas putida KT2440
ggucagccacgucgccagcggc

SEQ ID NO: 3538781 - RNA, 18 nt, Pseudomonas putida KT2440
ggucagccagaugcgccg

SEQ ID NO: 3538782 - RNA, 13 nt, Pseudomonas putida KT2440
ggucagccaggcg

SEQ ID NO: 3538783 - RNA, 15 nt, Pseudomonas putida KT2440
ggucagcgacugcca

SEQ ID NO: 3538784 - RNA, 17 nt, Pseudomonas putida KT2440
ggucagcggaccaggug

SEQ ID NO: 3538785 - RNA, 15 nt, Pseudomonas putida KT2440
ggucagcguugccga

SEQ ID NO: 3538786 - RNA, 23 nt, Pseudomonas putida KT2440
ggucagcguugccgaugaccugc

SEQ ID NO: 3538787 - RNA, 14 nt, Pseudomonas putida KT2440
ggucagcucgauca

SEQ ID NO: 3538788 - RNA, 12 nt, Pseudomonas putida KT2440
ggucagcuggcc

SEQ ID NO: 3538789 - RNA, 14 nt, Pseudomonas putida KT2440
ggucagcuggccuu

SEQ ID NO: 3538790 - RNA, 12 nt, Pseudomonas putida KT2440
ggucaggcguau

SEQ ID NO: 3538791 - RNA, 14 nt, Pseudomonas putida KT2440
ggucagggcgauga

SEQ ID NO: 3538792 - RNA, 15 nt, Pseudomonas putida KT2440
ggucaggucaaagcg

SEQ ID NO: 3538793 - RNA, 11 nt, Pseudomonas putida KT2440
ggucagguccg

SEQ ID NO: 3538794 - RNA, 12 nt, Pseudomonas putida KT2440
ggucagguggcu

SEQ ID NO: 3538795 - RNA, 21 nt, Pseudomonas putida KT2440
ggucagucgagucgacaguga

SEQ ID NO: 3538796 - RNA, 14 nt, Pseudomonas putida KT2440
ggucaguucagcca

SEQ ID NO: 3538797 - RNA, 16 nt, Pseudomonas putida KT2440
ggucaguucagccagg

SEQ ID NO: 3538798 - RNA, 23 nt, Pseudomonas putida KT2440
ggucauacuccagcgucaccacc

SEQ ID NO: 3538799 - RNA, 17 nt, Pseudomonas putida KT2440
ggucaucaccaccccca

SEQ ID NO: 3538800 - RNA, 18 nt, Pseudomonas putida KT2440
ggucaucaccacccccag

SEQ ID NO: 3538801 - RNA, 19 nt, Pseudomonas putida KT2440
ggucaucagauggcccggu

SEQ ID NO: 3538802 - RNA, 13 nt, Pseudomonas putida KT2440
ggucauccagcag

SEQ ID NO: 3538803 - RNA, 21 nt, Pseudomonas putida KT2440
ggucauccaggcuggccagca

SEQ ID NO: 3538804 - RNA, 21 nt, Pseudomonas putida KT2440
ggucauccaguggcgugugug

SEQ ID NO: 3538805 - RNA, 18 nt, Pseudomonas putida KT2440
ggucaucgaagaucagca

SEQ ID NO: 3538806 - RNA, 22 nt, Pseudomonas putida KT2440
ggucauggcgcgccaugccccu

SEQ ID NO: 3538807 - RNA, 13 nt, Pseudomonas putida KT2440
gguccaccagcag

SEQ ID NO: 3538808 - RNA, 16 nt, Pseudomonas putida KT2440
gguccagcaaccgggu

SEQ ID NO: 3538809 - RNA, 20 nt, Pseudomonas putida KT2440
gguccagcaagcucaucacc

SEQ ID NO: 3538810 - RNA, 17 nt, Pseudomonas putida KT2440
gguccagccacgaaucg

SEQ ID NO: 3538811 - RNA, 20 nt, Pseudomonas putida KT2440
gguccagcguucggccagca

SEQ ID NO: 3538812 - RNA, 12 nt, Pseudomonas putida KT2440
gguccaggcaca

SEQ ID NO: 3538813 - RNA, 12 nt, Pseudomonas putida KT2440
gguccaggccag

SEQ ID NO: 3538814 - RNA, 14 nt, Pseudomonas putida KT2440
gguccaggccagcu

SEQ ID NO: 3538815 - RNA, 24 nt, Pseudomonas putida KT2440
gguccccauagcuuuccagcaugu

SEQ ID NO: 3538816 - RNA, 23 nt, Pseudomonas putida KT2440
gguccccggccgugucgaacugg

SEQ ID NO: 3538817 - RNA, 23 nt, Pseudomonas putida KT2440
gguccccuucgucgauguccagc

SEQ ID NO: 3538818 - RNA, 14 nt, Pseudomonas putida KT2440
ggucccgcccucca

SEQ ID NO: 3538819 - RNA, 23 nt, Pseudomonas putida KT2440
ggucccgcccuccagccgcgaac

SEQ ID NO: 3538820 - RNA, 20 nt, Pseudomonas putida KT2440
ggucccugacucgaccgccg

SEQ ID NO: 3538821 - RNA, 16 nt, Pseudomonas putida KT2440
gguccgagugcucgau

SEQ ID NO: 3538822 - RNA, 20 nt, Pseudomonas putida KT2440
gguccgagugcucgaucaga

SEQ ID NO: 3538823 - RNA, 20 nt, Pseudomonas putida KT2440
gguccggaaacucacgcgcc

SEQ ID NO: 3538824 - RNA, 16 nt, Pseudomonas putida KT2440
gguccgguaacuggcc

SEQ ID NO: 3538825 - RNA, 18 nt, Pseudomonas putida KT2440
gguccuguuugccgaggu

SEQ ID NO: 3538826 - RNA, 17 nt, Pseudomonas putida KT2440
gguccuugaacggcauu

SEQ ID NO: 3538827 - RNA, 22 nt, Pseudomonas putida KT2440
gguccuugaacggcauuuccag

SEQ ID NO: 3538828 - RNA, 20 nt, Pseudomonas putida KT2440
gguccuuguaagagcggccu

SEQ ID NO: 3538829 - RNA, 13 nt, Pseudomonas putida KT2440
ggucgaacagccc

SEQ ID NO: 3538830 - RNA, 20 nt, Pseudomonas putida KT2440
ggucgaaccaguacugggcg

SEQ ID NO: 3538831 - RNA, 19 nt, Pseudomonas putida KT2440
ggucgaagcucagguagcg

SEQ ID NO: 3538832 - RNA, 20 nt, Pseudomonas putida KT2440
ggucgacaccaggaucaggu

SEQ ID NO: 3538833 - RNA, 13 nt, Pseudomonas putida KT2440
ggucgacaggggc

SEQ ID NO: 3538834 - RNA, 17 nt, Pseudomonas putida KT2440
ggucgaccggagcaucg

SEQ ID NO: 3538835 - RNA, 15 nt, Pseudomonas putida KT2440
ggucgaccugggcca

SEQ ID NO: 3538836 - RNA, 18 nt, Pseudomonas putida KT2440
ggucgacgauacccagcg

SEQ ID NO: 3538837 - RNA, 12 nt, Pseudomonas putida KT2440
ggucgagccagg

SEQ ID NO: 3538838 - RNA, 12 nt, Pseudomonas putida KT2440
ggucgagcugcc

SEQ ID NO: 3538839 - RNA, 19 nt, Pseudomonas putida KT2440
ggucgaggcggcugucgca

SEQ ID NO: 3538840 - RNA, 20 nt, Pseudomonas putida KT2440
ggucgaucuucagcgcaucg

SEQ ID NO: 3538841 - RNA, 14 nt, Pseudomonas putida KT2440
ggucgaucuucgcc

SEQ ID NO: 3538842 - RNA, 19 nt, Pseudomonas putida KT2440
ggucgaugauggucgcgac

SEQ ID NO: 3538843 - RNA, 15 nt, Pseudomonas putida KT2440
ggucgccaaccccac

SEQ ID NO: 3538844 - RNA, 14 nt, Pseudomonas putida KT2440
ggucgccgacggca

SEQ ID NO: 3538845 - RNA, 22 nt, Pseudomonas putida KT2440
ggucgccgcuguucagcccuug

SEQ ID NO: 3538846 - RNA, 16 nt, Pseudomonas putida KT2440
ggucgcgacgauggac

SEQ ID NO: 3538847 - RNA, 22 nt, Pseudomonas putida KT2440
ggucgcgacgauggacagccca

SEQ ID NO: 3538848 - RNA, 15 nt, Pseudomonas putida KT2440
ggucgcgggccagcc

SEQ ID NO: 3538849 - RNA, 17 nt, Pseudomonas putida KT2440
ggucgcgggccagccca

SEQ ID NO: 3538850 - RNA, 19 nt, Pseudomonas putida KT2440
ggucgcggugcagcgggau

SEQ ID NO: 3538851 - RNA, 17 nt, Pseudomonas putida KT2440
ggucgcgucgcccagac

SEQ ID NO: 3538852 - RNA, 21 nt, Pseudomonas putida KT2440
ggucgcgugccgccaguucgc

SEQ ID NO: 3538853 - RNA, 20 nt, Pseudomonas putida KT2440
ggucgcguuguucagcagcg

SEQ ID NO: 3538854 - RNA, 12 nt, Pseudomonas putida KT2440
ggucgcucaacu

SEQ ID NO: 3538855 - RNA, 23 nt, Pseudomonas putida KT2440
ggucgcucaacuccauggccagg

SEQ ID NO: 3538856 - RNA, 13 nt, Pseudomonas putida KT2440
ggucgcugccgug

SEQ ID NO: 3538857 - RNA, 18 nt, Pseudomonas putida KT2440
ggucggaaggggccgcaa

SEQ ID NO: 3538858 - RNA, 14 nt, Pseudomonas putida KT2440
ggucggccagcucg

SEQ ID NO: 3538859 - RNA, 16 nt, Pseudomonas putida KT2440
ggucggccugcacuac

SEQ ID NO: 3538860 - RNA, 17 nt, Pseudomonas putida KT2440
ggucggcguagccguuu

SEQ ID NO: 3538861 - RNA, 14 nt, Pseudomonas putida KT2440
ggucggcgucagcg

SEQ ID NO: 3538862 - RNA, 15 nt, Pseudomonas putida KT2440
ggucggcguccacug

SEQ ID NO: 3538863 - RNA, 18 nt, Pseudomonas putida KT2440
ggucggcucgucgaacag

SEQ ID NO: 3538864 - RNA, 19 nt, Pseudomonas putida KT2440
ggucgggaauugcagcccg

SEQ ID NO: 3538865 - RNA, 18 nt, Pseudomonas putida KT2440
ggucgguagggaucaccg

SEQ ID NO: 3538866 - RNA, 21 nt, Pseudomonas putida KT2440
ggucggugauauagcaccggu

SEQ ID NO: 3538867 - RNA, 15 nt, Pseudomonas putida KT2440
ggucgguggucagcu

SEQ ID NO: 3538868 - RNA, 14 nt, Pseudomonas putida KT2440
ggucguagcgucuc

SEQ ID NO: 3538869 - RNA, 20 nt, Pseudomonas putida KT2440
ggucgugcgcgaucagcgca

SEQ ID NO: 3538870 - RNA, 15 nt, Pseudomonas putida KT2440
ggucguugaucggcu

SEQ ID NO: 3538871 - RNA, 16 nt, Pseudomonas putida KT2440
ggucguugaugcgcuu

SEQ ID NO: 3538872 - RNA, 19 nt, Pseudomonas putida KT2440
ggucucacaggcgcugaaa

SEQ ID NO: 3538873 - RNA, 22 nt, Pseudomonas putida KT2440
ggucucccagcgcuguccccca

SEQ ID NO: 3538874 - RNA, 14 nt, Pseudomonas putida KT2440
ggucuccgugcuca

SEQ ID NO: 3538875 - RNA, 16 nt, Pseudomonas putida KT2440
ggucucgaacgcugug

SEQ ID NO: 3538876 - RNA, 21 nt, Pseudomonas putida KT2440
ggucucgaucuaugcccggcu

SEQ ID NO: 3538877 - RNA, 14 nt, Pseudomonas putida KT2440
ggucugagcgucau

SEQ ID NO: 3538878 - RNA, 15 nt, Pseudomonas putida KT2440
ggucugauugggccc

SEQ ID NO: 3538879 - RNA, 17 nt, Pseudomonas putida KT2440
ggucugcccggccagca

SEQ ID NO: 3538880 - RNA, 18 nt, Pseudomonas putida KT2440
ggucugcgcuucaagcag

SEQ ID NO: 3538881 - RNA, 23 nt, Pseudomonas putida KT2440
ggucugcgcuucaagcagguaac

SEQ ID NO: 3538882 - RNA, 16 nt, Pseudomonas putida KT2440
ggucuggcgcaggaag

SEQ ID NO: 3538883 - RNA, 14 nt, Pseudomonas putida KT2440
gguggccggcacug

SEQ ID NO: 3538884 - RNA, 19 nt, Pseudomonas putida KT2440
gguggccggcacugaccac

SEQ ID NO: 3538885 - RNA, 14 nt, Pseudomonas putida KT2440
gguggccugagccg

SEQ ID NO: 3538886 - RNA, 15 nt, Pseudomonas putida KT2440
gguggcgauccacag

SEQ ID NO: 3538887 - RNA, 22 nt, Pseudomonas putida KT2440
gguggcgccuugauuaccagcg

SEQ ID NO: 3538888 - RNA, 23 nt, Pseudomonas putida KT2440
gguggcgcugaccaacaggcugg

SEQ ID NO: 3538889 - RNA, 13 nt, Pseudomonas putida KT2440
gguggcggcagca

SEQ ID NO: 3538890 - RNA, 13 nt, Pseudomonas putida KT2440
gguggcguggcug

SEQ ID NO: 3538891 - RNA, 19 nt, Pseudomonas putida KT2440
gguggcucacaucaucgcc

SEQ ID NO: 3538892 - RNA, 14 nt, Pseudomonas putida KT2440
gguggcugcacugc

SEQ ID NO: 3538893 - RNA, 17 nt, Pseudomonas putida KT2440
gguggcugccacgggca

SEQ ID NO: 3538894 - RNA, 20 nt, Pseudomonas putida KT2440
ggugggcaacagcugcgcga

SEQ ID NO: 3538895 - RNA, 14 nt, Pseudomonas putida KT2440
gguggggugucugg

SEQ ID NO: 3538896 - RNA, 15 nt, Pseudomonas putida KT2440
gguggguguccugca

SEQ ID NO: 3538897 - RNA, 19 nt, Pseudomonas putida KT2440
ggugguaucugccgaugcg

SEQ ID NO: 3538898 - RNA, 15 nt, Pseudomonas putida KT2440
gguggucagccaggc

SEQ ID NO: 3538899 - RNA, 13 nt, Pseudomonas putida KT2440
ggugguuggacac

SEQ ID NO: 3538900 - RNA, 18 nt, Pseudomonas putida KT2440
ggugguuuauccggcaca

SEQ ID NO: 3538901 - RNA, 19 nt, Pseudomonas putida KT2440
ggugguuuauccggcacag

SEQ ID NO: 3538902 - RNA, 14 nt, Pseudomonas putida KT2440
ggugguuuugcgug

SEQ ID NO: 3538903 - RNA, 13 nt, Pseudomonas putida KT2440
gguguagcgcagu

SEQ ID NO: 3538904 - RNA, 15 nt, Pseudomonas putida KT2440
gguguaucggccagu

SEQ ID NO: 3538905 - RNA, 20 nt, Pseudomonas putida KT2440
ggugucaacaggcuggccga

SEQ ID NO: 3538906 - RNA, 13 nt, Pseudomonas putida KT2440
gguguccggcaug

SEQ ID NO: 3538907 - RNA, 17 nt, Pseudomonas putida KT2440
ggugucgaacaccaccg

SEQ ID NO: 3538908 - RNA, 18 nt, Pseudomonas putida KT2440
ggugucgauacucacccg

SEQ ID NO: 3538909 - RNA, 22 nt, Pseudomonas putida KT2440
ggugucggacagguuggcgccc

SEQ ID NO: 3538910 - RNA, 16 nt, Pseudomonas putida KT2440
ggugucggccagggcc

SEQ ID NO: 3538911 - RNA, 19 nt, Pseudomonas putida KT2440
ggugucgguggcggccagc

SEQ ID NO: 3538912 - RNA, 21 nt, Pseudomonas putida KT2440
ggugucguucgaacuccgcga

SEQ ID NO: 3538913 - RNA, 16 nt, Pseudomonas putida KT2440
ggugucuuccggcaug

SEQ ID NO: 3538914 - RNA, 21 nt, Pseudomonas putida KT2440
ggugugcaccugguaggucac

SEQ ID NO: 3538915 - RNA, 19 nt, Pseudomonas putida KT2440
ggugugcagcaacaccgcg

SEQ ID NO: 3538916 - RNA, 18 nt, Pseudomonas putida KT2440
ggugugcgccgucaccag

SEQ ID NO: 3538917 - RNA, 20 nt, Pseudomonas putida KT2440
ggugugcgccgucaccagcg

SEQ ID NO: 3538918 - RNA, 16 nt, Pseudomonas putida KT2440
gguguggcagcucugc

SEQ ID NO: 3538919 - RNA, 14 nt, Pseudomonas putida KT2440
gguguggcgccagg

SEQ ID NO: 3538920 - RNA, 19 nt, Pseudomonas putida KT2440
gguguucaccacgcccugc

SEQ ID NO: 3538921 - RNA, 22 nt, Pseudomonas putida KT2440
gguguucaugcccaccgcugca

SEQ ID NO: 3538922 - RNA, 14 nt, Pseudomonas putida KT2440
gguguuccagcacg

SEQ ID NO: 3538923 - RNA, 14 nt, Pseudomonas putida KT2440
gguguucgcgggcg

SEQ ID NO: 3538924 - RNA, 13 nt, Pseudomonas putida KT2440
gguguucuucagg

SEQ ID NO: 3538925 - RNA, 13 nt, Pseudomonas putida KT2440
gguguuggcggug

SEQ ID NO: 3538926 - RNA, 16 nt, Pseudomonas putida KT2440
gguuaaaagccaacug

SEQ ID NO: 3538927 - RNA, 20 nt, Pseudomonas putida KT2440
gguuaaaagccaacugcucu

SEQ ID NO: 3538928 - RNA, 15 nt, Pseudomonas putida KT2440
gguuacgcaccagcu

SEQ ID NO: 3538929 - RNA, 19 nt, Pseudomonas putida KT2440
gguuacgugcaggcgcaca

SEQ ID NO: 3538930 - RNA, 16 nt, Pseudomonas putida KT2440
gguuauacgccgccga

SEQ ID NO: 3538931 - RNA, 23 nt, Pseudomonas putida KT2440
gguucaagcacuacaucuaccug

SEQ ID NO: 3538932 - RNA, 16 nt, Pseudomonas putida KT2440
gguucaagggcagggu

SEQ ID NO: 3538933 - RNA, 20 nt, Pseudomonas putida KT2440
gguucacccgcgaagaggcc

SEQ ID NO: 3538934 - RNA, 23 nt, Pseudomonas putida KT2440
gguucacccgcgaagcaggcgac

SEQ ID NO: 3538935 - RNA, 21 nt, Pseudomonas putida KT2440
gguucaccguacccaggugau

SEQ ID NO: 3538936 - RNA, 18 nt, Pseudomonas putida KT2440
gguucagguacagcagcu

SEQ ID NO: 3538937 - RNA, 21 nt, Pseudomonas putida KT2440
gguucgaccaccgcaggugca

SEQ ID NO: 3538938 - RNA, 13 nt, Pseudomonas putida KT2440
gguucgaccacug

SEQ ID NO: 3538939 - RNA, 21 nt, Pseudomonas putida KT2440
gguucgaccacugcaggugca

SEQ ID NO: 3538940 - RNA, 18 nt, Pseudomonas putida KT2440
gguucgacucccgcugcc

SEQ ID NO: 3538941 - RNA, 12 nt, Pseudomonas putida KT2440
gguucgauccac

SEQ ID NO: 3538942 - RNA, 18 nt, Pseudomonas putida KT2440
gguucgaugggcaugccg

SEQ ID NO: 3538943 - RNA, 16 nt, Pseudomonas putida KT2440
gguucgcccccacggg

SEQ ID NO: 3538944 - RNA, 20 nt, Pseudomonas putida KT2440
gguucggcucacugaccagg

SEQ ID NO: 3538945 - RNA, 15 nt, Pseudomonas putida KT2440
gguucucgcgaaccg

SEQ ID NO: 3538946 - RNA, 19 nt, Pseudomonas putida KT2440
gguucucuucacucaacca

SEQ ID NO: 3538947 - RNA, 21 nt, Pseudomonas putida KT2440
gguucugaaucuggcucugca

SEQ ID NO: 3538948 - RNA, 18 nt, Pseudomonas putida KT2440
gguucuucgccugcagca

SEQ ID NO: 3538949 - RNA, 19 nt, Pseudomonas putida KT2440
gguucuugccgagcagcgc

SEQ ID NO: 3538950 - RNA, 12 nt, Pseudomonas putida KT2440
gguugaaacgua

SEQ ID NO: 3538951 - RNA, 18 nt, Pseudomonas putida KT2440
gguugaacagcagcgccg

SEQ ID NO: 3538952 - RNA, 15 nt, Pseudomonas putida KT2440
gguugacaagcaaaa

SEQ ID NO: 3538953 - RNA, 19 nt, Pseudomonas putida KT2440
gguugaccacgaugcccau

SEQ ID NO: 3538954 - RNA, 17 nt, Pseudomonas putida KT2440
gguugaccgagaacagg

SEQ ID NO: 3538955 - RNA, 17 nt, Pseudomonas putida KT2440
gguugaccuuguccugc

SEQ ID NO: 3538956 - RNA, 16 nt, Pseudomonas putida KT2440
gguugaucaacugugc

SEQ ID NO: 3538957 - RNA, 16 nt, Pseudomonas putida KT2440
gguugauccagcccuu

SEQ ID NO: 3538958 - RNA, 15 nt, Pseudomonas putida KT2440
gguugaugugcaggu

SEQ ID NO: 3538959 - RNA, 18 nt, Pseudomonas putida KT2440
gguugcaauaccgugcuu

SEQ ID NO: 3538960 - RNA, 19 nt, Pseudomonas putida KT2440
gguugcaccguggcagcaa

SEQ ID NO: 3538961 - RNA, 22 nt, Pseudomonas putida KT2440
gguugccaccagcaucaacagg

SEQ ID NO: 3538962 - RNA, 17 nt, Pseudomonas putida KT2440
gguugcccaugcacagc

SEQ ID NO: 3538963 - RNA, 20 nt, Pseudomonas putida KT2440
gguugcccggcgagcgcagg

SEQ ID NO: 3538964 - RNA, 17 nt, Pseudomonas putida KT2440
gguugccgccagccccg

SEQ ID NO: 3538965 - RNA, 13 nt, Pseudomonas putida KT2440
gguugccugugcu

SEQ ID NO: 3538966 - RNA, 17 nt, Pseudomonas putida KT2440
gguugcguugaccugcu

SEQ ID NO: 3538967 - RNA, 16 nt, Pseudomonas putida KT2440
gguugcucaggcgcuc

SEQ ID NO: 3538968 - RNA, 15 nt, Pseudomonas putida KT2440
gguugcuccagcgug

SEQ ID NO: 3538969 - RNA, 16 nt, Pseudomonas putida KT2440
gguuggacagcgcccg

SEQ ID NO: 3538970 - RNA, 21 nt, Pseudomonas putida KT2440
gguuggcaaacucgucgcugg

SEQ ID NO: 3538971 - RNA, 24 nt, Pseudomonas putida KT2440
gguuggccauguugucgaagcgca

SEQ ID NO: 3538972 - RNA, 21 nt, Pseudomonas putida KT2440
gguuggugccaucaccgcccg

SEQ ID NO: 3538973 - RNA, 20 nt, Pseudomonas putida KT2440
gguuggugcgccuccagcag

SEQ ID NO: 3538974 - RNA, 20 nt, Pseudomonas putida KT2440
gguuuacccgcgaaagggcc

SEQ ID NO: 3538975 - RNA, 18 nt, Pseudomonas putida KT2440
gguuuacccgcgaacagg

SEQ ID NO: 3538976 - RNA, 20 nt, Pseudomonas putida KT2440
gguuuacccgcgaagaagcc

SEQ ID NO: 3538977 - RNA, 20 nt, Pseudomonas putida KT2440
gguuuacccgcgaaggggcc

SEQ ID NO: 3538978 - RNA, 19 nt, Pseudomonas putida KT2440
gguuuauccggcacagaau

SEQ ID NO: 3538979 - RNA, 14 nt, Pseudomonas putida KT2440
gguuucacccuugg

SEQ ID NO: 3538980 - RNA, 16 nt, Pseudomonas putida KT2440
gguuuccagcccuucc

SEQ ID NO: 3538981 - RNA, 13 nt, Pseudomonas putida KT2440
gguuugacgcugc

SEQ ID NO: 3538982 - RNA, 18 nt, Pseudomonas putida KT2440
gguuugccaggcgcagug

SEQ ID NO: 3538983 - RNA, 18 nt, Pseudomonas putida KT2440
gguuugcccgcgaagagg

SEQ ID NO: 3538984 - RNA, 16 nt, Pseudomonas putida KT2440
gguuugcccgcgagga

SEQ ID NO: 3538985 - RNA, 19 nt, Pseudomonas putida KT2440
gguuugcguugaugcguga

SEQ ID NO: 3538986 - RNA, 14 nt, Pseudomonas putida KT2440
gguuugcuccgcga

SEQ ID NO: 3538987 - RNA, 18 nt, Pseudomonas putida KT2440
gguuuggcagcaccgggc

SEQ ID NO: 3538988 - RNA, 18 nt, Pseudomonas putida KT2440
guacgcgaaggcggucgc

SEQ ID NO: 3538989 - RNA, 14 nt, Pseudomonas putida KT2440
guacgcucuggucg

SEQ ID NO: 3538990 - RNA, 17 nt, Pseudomonas putida KT2440
guacgcuggccaaggcc

SEQ ID NO: 3538991 - RNA, 16 nt, Pseudomonas putida KT2440
guacggcagaacggcu

SEQ ID NO: 3538992 - RNA, 17 nt, Pseudomonas putida KT2440
guacggcagaacggcuu

SEQ ID NO: 3538993 - RNA, 15 nt, Pseudomonas putida KT2440
guacggcccaugucg

SEQ ID NO: 3538994 - RNA, 15 nt, Pseudomonas putida KT2440
guacggcgaauaauu

SEQ ID NO: 3538995 - RNA, 13 nt, Pseudomonas putida KT2440
guacgggcacacc

SEQ ID NO: 3538996 - RNA, 20 nt, Pseudomonas putida KT2440
guacgggcacaccuggugcg

SEQ ID NO: 3538997 - RNA, 17 nt, Pseudomonas putida KT2440
guacucaggggcauugc

SEQ ID NO: 3538998 - RNA, 14 nt, Pseudomonas putida KT2440
guacuccaccacca

SEQ ID NO: 3538999 - RNA, 13 nt, Pseudomonas putida KT2440
guacuccacuucc

SEQ ID NO: 3539000 - RNA, 14 nt, Pseudomonas putida KT2440
guacuccacuucca

SEQ ID NO: 3539001 - RNA, 14 nt, Pseudomonas putida KT2440
guacuccagcagcg

SEQ ID NO: 3539002 - RNA, 16 nt, Pseudomonas putida KT2440
guacuccagcagcgca

SEQ ID NO: 3539003 - RNA, 14 nt, Pseudomonas putida KT2440
guacucgaccacug

SEQ ID NO: 3539004 - RNA, 23 nt, Pseudomonas putida KT2440
guacucgaggucggagaucgagu

SEQ ID NO: 3539005 - RNA, 14 nt, Pseudomonas putida KT2440
guacucggccgggc

SEQ ID NO: 3539006 - RNA, 22 nt, Pseudomonas putida KT2440
guacucugucacccgcugcacg

SEQ ID NO: 3539007 - RNA, 16 nt, Pseudomonas putida KT2440
guacugaucccuaccc

SEQ ID NO: 3539008 - RNA, 19 nt, Pseudomonas putida KT2440
guacugcgucuuguaguuc

SEQ ID NO: 3539009 - RNA, 11 nt, Pseudomonas putida KT2440
guacuggcugc

SEQ ID NO: 3539010 - RNA, 16 nt, Pseudomonas putida KT2440
guacuggcugcacugg

SEQ ID NO: 3539011 - RNA, 19 nt, Pseudomonas putida KT2440
guacuggcuucgaugaagg

SEQ ID NO: 3539012 - RNA, 16 nt, Pseudomonas putida KT2440
guacugggcguccuuc

SEQ ID NO: 3539013 - RNA, 17 nt, Pseudomonas putida KT2440
guacuuauaagcagcaa

SEQ ID NO: 3539014 - RNA, 15 nt, Pseudomonas putida KT2440
guacuucggaucgau

SEQ ID NO: 3539015 - RNA, 16 nt, Pseudomonas putida KT2440
guacuuggcgccgccc

SEQ ID NO: 3539016 - RNA, 16 nt, Pseudomonas putida KT2440
guacuugugugccugc

SEQ ID NO: 3539017 - RNA, 14 nt, Pseudomonas putida KT2440
guagaacaaccggg

SEQ ID NO: 3539018 - RNA, 19 nt, Pseudomonas putida KT2440
guagaacggcagcaggcca

SEQ ID NO: 3539019 - RNA, 19 nt, Pseudomonas putida KT2440
guagacaugaggcccuccc

SEQ ID NO: 3539020 - RNA, 17 nt, Pseudomonas putida KT2440
guagaccuucuggcagc

SEQ ID NO: 3539021 - RNA, 20 nt, Pseudomonas putida KT2440
guagacgaagccgaaucgcu

SEQ ID NO: 3539022 - RNA, 13 nt, Pseudomonas putida KT2440
guagauauugacc

SEQ ID NO: 3539023 - RNA, 17 nt, Pseudomonas putida KT2440
guagaucaucagcgcca

SEQ ID NO: 3539024 - RNA, 21 nt, Pseudomonas putida KT2440
guagaucgccggcagcacguc

SEQ ID NO: 3539025 - RNA, 19 nt, Pseudomonas putida KT2440
guagaucugcucuucgccg

SEQ ID NO: 3539026 - RNA, 17 nt, Pseudomonas putida KT2440
guagcacaagggccagg

SEQ ID NO: 3539027 - RNA, 19 nt, Pseudomonas putida KT2440
guagcacaagggccagguc

SEQ ID NO: 3539028 - RNA, 20 nt, Pseudomonas putida KT2440
guagcacgggcgcugaagcc

SEQ ID NO: 3539029 - RNA, 22 nt, Pseudomonas putida KT2440
guagcacgggcgcugaagccag

SEQ ID NO: 3539030 - RNA, 17 nt, Pseudomonas putida KT2440
guagcaggaucugcugc

SEQ ID NO: 3539031 - RNA, 13 nt, Pseudomonas putida KT2440
guagccaccugau

SEQ ID NO: 3539032 - RNA, 22 nt, Pseudomonas putida KT2440
guagccaccugauguacaagga

SEQ ID NO: 3539033 - RNA, 14 nt, Pseudomonas putida KT2440
guagccacgcugcc

SEQ ID NO: 3539034 - RNA, 15 nt, Pseudomonas putida KT2440
guagccacgcugcca

SEQ ID NO: 3539035 - RNA, 12 nt, Pseudomonas putida KT2440
guagccaggcau

SEQ ID NO: 3539036 - RNA, 14 nt, Pseudomonas putida KT2440
guagcccaccaccu

SEQ ID NO: 3539037 - RNA, 16 nt, Pseudomonas putida KT2440
guagcccgggcagccg

SEQ ID NO: 3539038 - RNA, 24 nt, Pseudomonas putida KT2440
guagccgaaguugcccgaaccuug

SEQ ID NO: 3539039 - RNA, 19 nt, Pseudomonas putida KT2440
guagccgugcggccaaagc

SEQ ID NO: 3539040 - RNA, 13 nt, Pseudomonas putida KT2440
guagccguggcug

SEQ ID NO: 3539041 - RNA, 23 nt, Pseudomonas putida KT2440
guagccuucuucggucagcuggu

SEQ ID NO: 3539042 - RNA, 19 nt, Pseudomonas putida KT2440
guagcgcagaucccgcucg

SEQ ID NO: 3539043 - RNA, 21 nt, Pseudomonas putida KT2440
guagcgcccacaaguccgaac

SEQ ID NO: 3539044 - RNA, 17 nt, Pseudomonas putida KT2440
guagcgcccggacaacu

SEQ ID NO: 3539045 - RNA, 22 nt, Pseudomonas putida KT2440
guagcgcccuugaacagacccc

SEQ ID NO: 3539046 - RNA, 18 nt, Pseudomonas putida KT2440
guagcggcggcaauggcg

SEQ ID NO: 3539047 - RNA, 15 nt, Pseudomonas putida KT2440
guagcggggccgcuu

SEQ ID NO: 3539048 - RNA, 16 nt, Pseudomonas putida KT2440
guagcggucguugauc

SEQ ID NO: 3539049 - RNA, 15 nt, Pseudomonas putida KT2440
guagcgguggcguug

SEQ ID NO: 3539050 - RNA, 21 nt, Pseudomonas putida KT2440
guagcgguggcguugccuucg

SEQ ID NO: 3539051 - RNA, 21 nt, Pseudomonas putida KT2440
guagcucagguagaccugcgu

SEQ ID NO: 3539052 - RNA, 22 nt, Pseudomonas putida KT2440
guagcugggcccgcccagcugg

SEQ ID NO: 3539053 - RNA, 23 nt, Pseudomonas putida KT2440
guagcugucacccuuggucagga

SEQ ID NO: 3539054 - RNA, 23 nt, Pseudomonas putida KT2440
guagcugucggucagccagaugc

SEQ ID NO: 3539055 - RNA, 20 nt, Pseudomonas putida KT2440
guaggaacgcuaaguaguug

SEQ ID NO: 3539056 - RNA, 13 nt, Pseudomonas putida KT2440
guaggagcgggcu

SEQ ID NO: 3539057 - RNA, 20 nt, Pseudomonas putida KT2440
guaggagcgggcuugcccgc

SEQ ID NO: 3539058 - RNA, 12 nt, Pseudomonas putida KT2440
guaggagcgggu

SEQ ID NO: 3539059 - RNA, 20 nt, Pseudomonas putida KT2440
guaggagcgggucuacccgc

SEQ ID NO: 3539060 - RNA, 22 nt, Pseudomonas putida KT2440
guaggagcgggucuacccgcga

SEQ ID NO: 3539061 - RNA, 22 nt, Pseudomonas putida KT2440
guaggagcggguucacccgcga

SEQ ID NO: 3539062 - RNA, 22 nt, Pseudomonas putida KT2440
guaggagcggguuuacccgcga

SEQ ID NO: 3539063 - RNA, 20 nt, Pseudomonas putida KT2440
guaggcacggucgguagccu

SEQ ID NO: 3539064 - RNA, 21 nt, Pseudomonas putida KT2440
guaggcacucggucggcuggc

SEQ ID NO: 3539065 - RNA, 15 nt, Pseudomonas putida KT2440
guaggcccagcccag

SEQ ID NO: 3539066 - RNA, 13 nt, Pseudomonas putida KT2440
guaggccgcagcc

SEQ ID NO: 3539067 - RNA, 17 nt, Pseudomonas putida KT2440
guaggccgucagcagca

SEQ ID NO: 3539068 - RNA, 20 nt, Pseudomonas putida KT2440
guaggccgucagcagcaggc

SEQ ID NO: 3539069 - RNA, 19 nt, Pseudomonas putida KT2440
guaggccugcgaaaggcgc

SEQ ID NO: 3539070 - RNA, 20 nt, Pseudomonas putida KT2440
guaggcgcggguuuacccgc

SEQ ID NO: 3539071 - RNA, 22 nt, Pseudomonas putida KT2440
guaggcgcggguuuacccgcga

SEQ ID NO: 3539072 - RNA, 22 nt, Pseudomonas putida KT2440
guaggcgcggguuugcccgcga

SEQ ID NO: 3539073 - RNA, 15 nt, Pseudomonas putida KT2440
guaggcgucuuccac

SEQ ID NO: 3539074 - RNA, 19 nt, Pseudomonas putida KT2440
guaggcgucuuccacgccc

SEQ ID NO: 3539075 - RNA, 14 nt, Pseudomonas putida KT2440
guagggaaauccuc

SEQ ID NO: 3539076 - RNA, 22 nt, Pseudomonas putida KT2440
guagggaucaccgccagcagcu

SEQ ID NO: 3539077 - RNA, 20 nt, Pseudomonas putida KT2440
guaggggcggauuugcccgc

SEQ ID NO: 3539078 - RNA, 19 nt, Pseudomonas putida KT2440
guagguaucacgcuccugc

SEQ ID NO: 3539079 - RNA, 17 nt, Pseudomonas putida KT2440
guaggucaccaucagcc

SEQ ID NO: 3539080 - RNA, 18 nt, Pseudomonas putida KT2440
guagguuauuggccaggu

SEQ ID NO: 3539081 - RNA, 20 nt, Pseudomonas putida KT2440
guagguuuucggcuggagcu

SEQ ID NO: 3539082 - RNA, 16 nt, Pseudomonas putida KT2440
guaguacuccagcagc

SEQ ID NO: 3539083 - RNA, 16 nt, Pseudomonas putida KT2440
guagucgauccaggug

SEQ ID NO: 3539084 - RNA, 15 nt, Pseudomonas putida KT2440
guagucgcucaggcg

SEQ ID NO: 3539085 - RNA, 15 nt, Pseudomonas putida KT2440
guaguggaacccacu

SEQ ID NO: 3539086 - RNA, 15 nt, Pseudomonas putida KT2440
guaguucaucuucuu

SEQ ID NO: 3539087 - RNA, 12 nt, Pseudomonas putida KT2440
guaguucucgac

SEQ ID NO: 3539088 - RNA, 17 nt, Pseudomonas putida KT2440
guaguucucgacagcca

SEQ ID NO: 3539089 - RNA, 23 nt, Pseudomonas putida KT2440
guaguucucgacagccaccugcc

SEQ ID NO: 3539090 - RNA, 14 nt, Pseudomonas putida KT2440
guauaaaggucuuu

SEQ ID NO: 3539091 - RNA, 21 nt, Pseudomonas putida KT2440
guauaggccccgaaugcacgg

SEQ ID NO: 3539092 - RNA, 23 nt, Pseudomonas putida KT2440
guauagguccagcucuggucacc

SEQ ID NO: 3539093 - RNA, 20 nt, Pseudomonas putida KT2440
gucaggccauggugcacgcc

SEQ ID NO: 3539094 - RNA, 20 nt, Pseudomonas putida KT2440
gucaggcguuuuuccaugcg

SEQ ID NO: 3539095 - RNA, 15 nt, Pseudomonas putida KT2440
gucaggcucagcagg

SEQ ID NO: 3539096 - RNA, 13 nt, Pseudomonas putida KT2440
gucaggcugcaca

SEQ ID NO: 3539097 - RNA, 17 nt, Pseudomonas putida KT2440
gucaggcugcacaaggu

SEQ ID NO: 3539098 - RNA, 16 nt, Pseudomonas putida KT2440
gucaggggugccuucg

SEQ ID NO: 3539099 - RNA, 19 nt, Pseudomonas putida KT2440
gucagggucucgcggcugg

SEQ ID NO: 3539100 - RNA, 23 nt, Pseudomonas putida KT2440
gucagggucucgcggcugguguc

SEQ ID NO: 3539101 - RNA, 22 nt, Pseudomonas putida KT2440
gucagguacucgcccgccaggu

SEQ ID NO: 3539102 - RNA, 17 nt, Pseudomonas putida KT2440
gucaggucgcuaucggc

SEQ ID NO: 3539103 - RNA, 16 nt, Pseudomonas putida KT2440
gucaggugcggggcaa

SEQ ID NO: 3539104 - RNA, 19 nt, Pseudomonas putida KT2440
gucaggugcggggcaaacu

SEQ ID NO: 3539105 - RNA, 14 nt, Pseudomonas putida KT2440
gucaguucggcggc

SEQ ID NO: 3539106 - RNA, 17 nt, Pseudomonas putida KT2440
gucaguuugacggugaa

SEQ ID NO: 3539107 - RNA, 22 nt, Pseudomonas putida KT2440
gucauaccacacguugguacgc

SEQ ID NO: 3539108 - RNA, 13 nt, Pseudomonas putida KT2440
gucauaguucugg

SEQ ID NO: 3539109 - RNA, 16 nt, Pseudomonas putida KT2440
gucauaguucuggcug

SEQ ID NO: 3539110 - RNA, 21 nt, Pseudomonas putida KT2440
gucaucaauauccagccuucc

SEQ ID NO: 3539111 - RNA, 22 nt, Pseudomonas putida KT2440
gucaucaccacccccagcgacc

SEQ ID NO: 3539112 - RNA, 19 nt, Pseudomonas putida KT2440
gucaucacccgggaacagc

SEQ ID NO: 3539113 - RNA, 23 nt, Pseudomonas putida KT2440
gucaucacccgggaacagcagca

SEQ ID NO: 3539114 - RNA, 20 nt, Pseudomonas putida KT2440
gucauccacaucacugcugu

SEQ ID NO: 3539115 - RNA, 12 nt, Pseudomonas putida KT2440
gucauccagcag

SEQ ID NO: 3539116 - RNA, 13 nt, Pseudomonas putida KT2440
gucauccagcagc

SEQ ID NO: 3539117 - RNA, 22 nt, Pseudomonas putida KT2440
gucauccaggaaaagguagugc

SEQ ID NO: 3539118 - RNA, 20 nt, Pseudomonas putida KT2440
gucauccaggcuggccagca

SEQ ID NO: 3539119 - RNA, 21 nt, Pseudomonas putida KT2440
gucauccgccaggcucuccag

SEQ ID NO: 3539120 - RNA, 19 nt, Pseudomonas putida KT2440
gucauccggcgcggccugc

SEQ ID NO: 3539121 - RNA, 15 nt, Pseudomonas putida KT2440
gucauccucaccggc

SEQ ID NO: 3539122 - RNA, 18 nt, Pseudomonas putida KT2440
gucauccucaccggcaaa

SEQ ID NO: 3539123 - RNA, 23 nt, Pseudomonas putida KT2440
gucauccugcgcggccacuacca

SEQ ID NO: 3539124 - RNA, 16 nt, Pseudomonas putida KT2440
gucauccugcguggcg

SEQ ID NO: 3539125 - RNA, 17 nt, Pseudomonas putida KT2440
gucaucgaacaccucuc

SEQ ID NO: 3539126 - RNA, 20 nt, Pseudomonas putida KT2440
gucaucgaacaguuugcuuu

SEQ ID NO: 3539127 - RNA, 19 nt, Pseudomonas putida KT2440
gucaucgacuucaaugccc

SEQ ID NO: 3539128 - RNA, 18 nt, Pseudomonas putida KT2440
gucaucgauccccaguuc

SEQ ID NO: 3539129 - RNA, 19 nt, Pseudomonas putida KT2440
gucaugcaggucaucgaac

SEQ ID NO: 3539130 - RNA, 17 nt, Pseudomonas putida KT2440
gucaugcgggaagccau

SEQ ID NO: 3539131 - RNA, 18 nt, Pseudomonas putida KT2440
gucaugcgguacagcacu

SEQ ID NO: 3539132 - RNA, 20 nt, Pseudomonas putida KT2440
gucauggcaccaaucgagau

SEQ ID NO: 3539133 - RNA, 14 nt, Pseudomonas putida KT2440
gucauggcgcgcca

SEQ ID NO: 3539134 - RNA, 17 nt, Pseudomonas putida KT2440
gucauggcgcgccaugc

SEQ ID NO: 3539135 - RNA, 22 nt, Pseudomonas putida KT2440
gucaugggaccgcuguuaccag

SEQ ID NO: 3539136 - RNA, 16 nt, Pseudomonas putida KT2440
gucaugucggcagcca

SEQ ID NO: 3539137 - RNA, 16 nt, Pseudomonas putida KT2440
gucauugaaggccagu

SEQ ID NO: 3539138 - RNA, 17 nt, Pseudomonas putida KT2440
guccaacgggcggaacu

SEQ ID NO: 3539139 - RNA, 20 nt, Pseudomonas putida KT2440
guccaaggcggugcauucug

SEQ ID NO: 3539140 - RNA, 22 nt, Pseudomonas putida KT2440
guccaauagccauuccggcugc

SEQ ID NO: 3539141 - RNA, 14 nt, Pseudomonas putida KT2440
guccaccagcaggc

SEQ ID NO: 3539142 - RNA, 12 nt, Pseudomonas putida KT2440
guccaccgcgca

SEQ ID NO: 3539143 - RNA, 13 nt, Pseudomonas putida KT2440
guccaccgcgcaa

SEQ ID NO: 3539144 - RNA, 22 nt, Pseudomonas putida KT2440
guccaccgcgccaucaaggccg

SEQ ID NO: 3539145 - RNA, 15 nt, Pseudomonas putida KT2440
guccacgcgcaggcc

SEQ ID NO: 3539146 - RNA, 18 nt, Pseudomonas putida KT2440
guccacugcacccgugca

SEQ ID NO: 3539147 - RNA, 16 nt, Pseudomonas putida KT2440
guccagacgccgcagu

SEQ ID NO: 3539148 - RNA, 18 nt, Pseudomonas putida KT2440
guccagacgccgcaguga

SEQ ID NO: 3539149 - RNA, 15 nt, Pseudomonas putida KT2440
guccagcaagcucau

SEQ ID NO: 3539150 - RNA, 17 nt, Pseudomonas putida KT2440
guccagcaagggccugu

SEQ ID NO: 3539151 - RNA, 21 nt, Pseudomonas putida KT2440
guccagcaagggccugugccg

SEQ ID NO: 3539152 - RNA, 19 nt, Pseudomonas putida KT2440
guccagcacacugagcacc

SEQ ID NO: 3539153 - RNA, 20 nt, Pseudomonas putida KT2440
guccagcacacugagcacca

SEQ ID NO: 3539154 - RNA, 12 nt, Pseudomonas putida KT2440
guccagcagcag

SEQ ID NO: 3539155 - RNA, 18 nt, Pseudomonas putida KT2440
guccagcaggccauauug

SEQ ID NO: 3539156 - RNA, 16 nt, Pseudomonas putida KT2440
guccagcaucagcaca

SEQ ID NO: 3539157 - RNA, 13 nt, Pseudomonas putida KT2440
guccagccacaau

SEQ ID NO: 3539158 - RNA, 15 nt, Pseudomonas putida KT2440
guccagccccaaggu

SEQ ID NO: 3539159 - RNA, 20 nt, Pseudomonas putida KT2440
guccagccccgcaccgcgga

SEQ ID NO: 3539160 - RNA, 19 nt, Pseudomonas putida KT2440
guccagcguucggccagca

SEQ ID NO: 3539161 - RNA, 20 nt, Pseudomonas putida KT2440
guccagcguucggccagcac

SEQ ID NO: 3539162 - RNA, 21 nt, Pseudomonas putida KT2440
guccagcguucggccagcacu

SEQ ID NO: 3539163 - RNA, 11 nt, Pseudomonas putida KT2440
guccagcuccg

SEQ ID NO: 3539164 - RNA, 20 nt, Pseudomonas putida KT2440
guccagcucgcgcagggcau

SEQ ID NO: 3539165 - RNA, 15 nt, Pseudomonas putida KT2440
guccagcucgucgag

SEQ ID NO: 3539166 - RNA, 17 nt, Pseudomonas putida KT2440
guccagcucgucgagca

SEQ ID NO: 3539167 - RNA, 18 nt, Pseudomonas putida KT2440
guccagcucuggucaccu

SEQ ID NO: 3539168 - RNA, 17 nt, Pseudomonas putida KT2440
guccagcugagcgccau

SEQ ID NO: 3539169 - RNA, 15 nt, Pseudomonas putida KT2440
guccaggauacccau

SEQ ID NO: 3539170 - RNA, 17 nt, Pseudomonas putida KT2440
guccaggcaaucacuga

SEQ ID NO: 3539171 - RNA, 13 nt, Pseudomonas putida KT2440
guccaggccagcu

SEQ ID NO: 3539172 - RNA, 24 nt, Pseudomonas putida KT2440
guccaggcccgccagagcauggcc

SEQ ID NO: 3539173 - RNA, 12 nt, Pseudomonas putida KT2440
guccaggcugcg

SEQ ID NO: 3539174 - RNA, 14 nt, Pseudomonas putida KT2440
guccaggcugcgca

SEQ ID NO: 3539175 - RNA, 15 nt, Pseudomonas putida KT2440
guccagggcagguca

SEQ ID NO: 3539176 - RNA, 16 nt, Pseudomonas putida KT2440
guccaggguggcguug

SEQ ID NO: 3539177 - RNA, 13 nt, Pseudomonas putida KT2440
guccagguagcgc

SEQ ID NO: 3539178 - RNA, 15 nt, Pseudomonas putida KT2440
guccagguagcgcuc

SEQ ID NO: 3539179 - RNA, 17 nt, Pseudomonas putida KT2440
guccagguaguacggca

SEQ ID NO: 3539180 - RNA, 16 nt, Pseudomonas putida KT2440
guccagguugagcaca

SEQ ID NO: 3539181 - RNA, 16 nt, Pseudomonas putida KT2440
guccaguauccauggg

SEQ ID NO: 3539182 - RNA, 22 nt, Pseudomonas putida KT2440
guccagucaggccguagcgcug

SEQ ID NO: 3539183 - RNA, 18 nt, Pseudomonas putida KT2440
guccaguucaaugccagc

SEQ ID NO: 3539184 - RNA, 21 nt, Pseudomonas putida KT2440
guccaguucaaugccagcagu

SEQ ID NO: 3539185 - RNA, 16 nt, Pseudomonas putida KT2440
guccaguuccggcagg

SEQ ID NO: 3539186 - RNA, 15 nt, Pseudomonas putida KT2440
guccaguucgcgcaa

SEQ ID NO: 3539187 - RNA, 16 nt, Pseudomonas putida KT2440
guccaucaccggcgag

SEQ ID NO: 3539188 - RNA, 17 nt, Pseudomonas putida KT2440
guccaucaggugcagca

SEQ ID NO: 3539189 - RNA, 19 nt, Pseudomonas putida KT2440
guccaucuugcugcucugc

SEQ ID NO: 3539190 - RNA, 20 nt, Pseudomonas putida KT2440
guccaucuugcugcucugca

SEQ ID NO: 3539191 - RNA, 18 nt, Pseudomonas putida KT2440
guccauguaggagcgggu

SEQ ID NO: 3539192 - RNA, 19 nt, Pseudomonas putida KT2440
guccauguaggagcggguu

SEQ ID NO: 3539193 - RNA, 16 nt, Pseudomonas putida KT2440
guccauugagcacuca

SEQ ID NO: 3539194 - RNA, 15 nt, Pseudomonas putida KT2440
gucccagcaccgcga

SEQ ID NO: 3539195 - RNA, 13 nt, Pseudomonas putida KT2440
guccccaaccggg

SEQ ID NO: 3539196 - RNA, 15 nt, Pseudomonas putida KT2440
guccccaaccggguu

SEQ ID NO: 3539197 - RNA, 13 nt, Pseudomonas putida KT2440
guccccaccggca

SEQ ID NO: 3539198 - RNA, 23 nt, Pseudomonas putida KT2440
gucgcagguucgaauccugcuga

SEQ ID NO: 3539199 - RNA, 22 nt, Pseudomonas putida KT2440
gucgcaucgacagguccaccgc

SEQ ID NO: 3539200 - RNA, 20 nt, Pseudomonas putida KT2440
gucgccaaauucgaccagca

SEQ ID NO: 3539201 - RNA, 13 nt, Pseudomonas putida KT2440
gucgccaacccca

SEQ ID NO: 3539202 - RNA, 20 nt, Pseudomonas putida KT2440
gucgccacaccacagcugca

SEQ ID NO: 3539203 - RNA, 19 nt, Pseudomonas putida KT2440
gucgccacauaguaggcaa

SEQ ID NO: 3539204 - RNA, 19 nt, Pseudomonas putida KT2440
gucgccacgccggucgggc

SEQ ID NO: 3539205 - RNA, 13 nt, Pseudomonas putida KT2440
gucgccacgcggg

SEQ ID NO: 3539206 - RNA, 16 nt, Pseudomonas putida KT2440
gucgccagguuggccc

SEQ ID NO: 3539207 - RNA, 19 nt, Pseudomonas putida KT2440
gucgcccaguuccaugucg

SEQ ID NO: 3539208 - RNA, 19 nt, Pseudomonas putida KT2440
gucgccccgccagcgccug

SEQ ID NO: 3539209 - RNA, 21 nt, Pseudomonas putida KT2440
gucgcccgcaacaccaggaca

SEQ ID NO: 3539210 - RNA, 14 nt, Pseudomonas putida KT2440
gucgcccgcccagc

SEQ ID NO: 3539211 - RNA, 17 nt, Pseudomonas putida KT2440
gucgcccgcccagccca

SEQ ID NO: 3539212 - RNA, 19 nt, Pseudomonas putida KT2440
gucgcccgcccagcccaug

SEQ ID NO: 3539213 - RNA, 16 nt, Pseudomonas putida KT2440
gucgccgacggcaugg

SEQ ID NO: 3539214 - RNA, 15 nt, Pseudomonas putida KT2440
gucgccgauacccgc

SEQ ID NO: 3539215 - RNA, 21 nt, Pseudomonas putida KT2440
gucgccgcggguaccaccugg

SEQ ID NO: 3539216 - RNA, 18 nt, Pseudomonas putida KT2440
gucgccgcuguucagccc

SEQ ID NO: 3539217 - RNA, 17 nt, Pseudomonas putida KT2440
gucgccggugugcaucc

SEQ ID NO: 3539218 - RNA, 16 nt, Pseudomonas putida KT2440
gucgccgugcagcacc

SEQ ID NO: 3539219 - RNA, 18 nt, Pseudomonas putida KT2440
gucgccgugcagcaccgc

SEQ ID NO: 3539220 - RNA, 21 nt, Pseudomonas putida KT2440
gucgccuacaagggugaagua

SEQ ID NO: 3539221 - RNA, 13 nt, Pseudomonas putida KT2440
gucgccugggcau

SEQ ID NO: 3539222 - RNA, 20 nt, Pseudomonas putida KT2440
gucgccuguaggagcggguu

SEQ ID NO: 3539223 - RNA, 22 nt, Pseudomonas putida KT2440
gucgccuucguacaucggguaa

SEQ ID NO: 3539224 - RNA, 20 nt, Pseudomonas putida KT2440
gucgccuuugugcuuucugg

SEQ ID NO: 3539225 - RNA, 15 nt, Pseudomonas putida KT2440
gucgccuuuuuucca

SEQ ID NO: 3539226 - RNA, 14 nt, Pseudomonas putida KT2440
gucgcgaaagggcc

SEQ ID NO: 3539227 - RNA, 22 nt, Pseudomonas putida KT2440
gucgcgacgauggacagcccaa

SEQ ID NO: 3539228 - RNA, 23 nt, Pseudomonas putida KT2440
gucgcgagccucuguuugcuggu

SEQ ID NO: 3539229 - RNA, 18 nt, Pseudomonas putida KT2440
gucgcgauugaucagcgc

SEQ ID NO: 3539230 - RNA, 17 nt, Pseudomonas putida KT2440
gucgcgcagauggcaga

SEQ ID NO: 3539231 - RNA, 14 nt, Pseudomonas putida KT2440
gucgcgcagggccu

SEQ ID NO: 3539232 - RNA, 20 nt, Pseudomonas putida KT2440
gucgcggcaaagaucgccca

SEQ ID NO: 3539233 - RNA, 14 nt, Pseudomonas putida KT2440
gucgcggccccagg

SEQ ID NO: 3539234 - RNA, 21 nt, Pseudomonas putida KT2440
gucgcggccuacccgggcgca

SEQ ID NO: 3539235 - RNA, 16 nt, Pseudomonas putida KT2440
gucgcgggccagccca

SEQ ID NO: 3539236 - RNA, 20 nt, Pseudomonas putida KT2440
gucgcguucuuucucccagg

SEQ ID NO: 3539237 - RNA, 17 nt, Pseudomonas putida KT2440
gucgcuacugccgucgu

SEQ ID NO: 3539238 - RNA, 15 nt, Pseudomonas putida KT2440
gucgcuaucggcagg

SEQ ID NO: 3539239 - RNA, 19 nt, Pseudomonas putida KT2440
gucgcucaacuccauggcc

SEQ ID NO: 3539240 - RNA, 23 nt, Pseudomonas putida KT2440
gucgcucaacuccauggccaggg

SEQ ID NO: 3539241 - RNA, 21 nt, Pseudomonas putida KT2440
gucgcugauuucgucaccgau

SEQ ID NO: 3539242 - RNA, 20 nt, Pseudomonas putida KT2440
gucgcugcggcacaccacgc

SEQ ID NO: 3539243 - RNA, 15 nt, Pseudomonas putida KT2440
gucgcuggacgcugu

SEQ ID NO: 3539244 - RNA, 12 nt, Pseudomonas putida KT2440
gucgcuggagcg

SEQ ID NO: 3539245 - RNA, 17 nt, Pseudomonas putida KT2440
gucgcuggccagcuucu

SEQ ID NO: 3539246 - RNA, 21 nt, Pseudomonas putida KT2440
gucgcugguccacgguucugg

SEQ ID NO: 3539247 - RNA, 17 nt, Pseudomonas putida KT2440
gucgcuguugcgcaccu

SEQ ID NO: 3539248 - RNA, 20 nt, Pseudomonas putida KT2440
gucgcuucuuugcgauccag

SEQ ID NO: 3539249 - RNA, 19 nt, Pseudomonas putida KT2440
gucgcuuuggggggcgaca

SEQ ID NO: 3539250 - RNA, 18 nt, Pseudomonas putida KT2440
gucggcaaccauggcuuc

SEQ ID NO: 3539251 - RNA, 16 nt, Pseudomonas putida KT2440
gucggcaaccgagauc

SEQ ID NO: 3539252 - RNA, 18 nt, Pseudomonas putida KT2440
gucggcaaucugcucgac

SEQ ID NO: 3539253 - RNA, 17 nt, Pseudomonas putida KT2440
gucggcaccggcgacgc

SEQ ID NO: 3539254 - RNA, 16 nt, Pseudomonas putida KT2440
gucggcacgcgccagc

SEQ ID NO: 3539255 - RNA, 19 nt, Pseudomonas putida KT2440
gucggcacgcgccagcagc

SEQ ID NO: 3539256 - RNA, 12 nt, Pseudomonas putida KT2440
gucggcaugcac

SEQ ID NO: 3539257 - RNA, 22 nt, Pseudomonas putida KT2440
gucggcaugcacuuccaggaag

SEQ ID NO: 3539258 - RNA, 16 nt, Pseudomonas putida KT2440
gucggccaccuggucg

SEQ ID NO: 3539259 - RNA, 19 nt, Pseudomonas putida KT2440
gucggccagaucggccagc

SEQ ID NO: 3539260 - RNA, 22 nt, Pseudomonas putida KT2440
gucggccagcucggcaguggcg

SEQ ID NO: 3539261 - RNA, 13 nt, Pseudomonas putida KT2440
gucggccucgaua

SEQ ID NO: 3539262 - RNA, 15 nt, Pseudomonas putida KT2440
gucggccucgauagc

SEQ ID NO: 3539263 - RNA, 18 nt, Pseudomonas putida KT2440
gucggccugcucgcuggc

SEQ ID NO: 3539264 - RNA, 11 nt, Pseudomonas putida KT2440
gucggccuggg

SEQ ID NO: 3539265 - RNA, 24 nt, Pseudomonas putida KT2440
gucggccugggucagcugguucug

SEQ ID NO: 3539266 - RNA, 15 nt, Pseudomonas putida KT2440
gucggcgcgcggcuc

SEQ ID NO: 3539267 - RNA, 18 nt, Pseudomonas putida KT2440
gucggcgcuggacaggua

SEQ ID NO: 3539268 - RNA, 12 nt, Pseudomonas putida KT2440
gucggcguagcc

SEQ ID NO: 3539269 - RNA, 22 nt, Pseudomonas putida KT2440
gucggcguagccguuugaagcc

SEQ ID NO: 3539270 - RNA, 17 nt, Pseudomonas putida KT2440
gucggcguagcgcuuga

SEQ ID NO: 3539271 - RNA, 17 nt, Pseudomonas putida KT2440
gucggcgucagcguggu

SEQ ID NO: 3539272 - RNA, 20 nt, Pseudomonas putida KT2440
gucggcgucagcgugguagu

SEQ ID NO: 3539273 - RNA, 14 nt, Pseudomonas putida KT2440
gucggcgugcacca

SEQ ID NO: 3539274 - RNA, 16 nt, Pseudomonas putida KT2440
gucggcucaacaccau

SEQ ID NO: 3539275 - RNA, 22 nt, Pseudomonas putida KT2440
gucggcucgucgaacagcauga

SEQ ID NO: 3539276 - RNA, 18 nt, Pseudomonas putida KT2440
gucgggaauugcagcccg

SEQ ID NO: 3539277 - RNA, 19 nt, Pseudomonas putida KT2440
gucgggaauugcagcccgc

SEQ ID NO: 3539278 - RNA, 13 nt, Pseudomonas putida KT2440
gucgggcacaggc

SEQ ID NO: 3539279 - RNA, 14 nt, Pseudomonas putida KT2440
gucggggccggaga

SEQ ID NO: 3539280 - RNA, 22 nt, Pseudomonas putida KT2440
gucggggugaggggauucgaac

SEQ ID NO: 3539281 - RNA, 19 nt, Pseudomonas putida KT2440
gucggguuggucgccagga

SEQ ID NO: 3539282 - RNA, 11 nt, Pseudomonas putida KT2440
gucgguacugg

SEQ ID NO: 3539283 - RNA, 14 nt, Pseudomonas putida KT2440
gucgguagggauca

SEQ ID NO: 3539284 - RNA, 14 nt, Pseudomonas putida KT2440
gucgguaugcgccc

SEQ ID NO: 3539285 - RNA, 15 nt, Pseudomonas putida KT2440
gucggucagguagcc

SEQ ID NO: 3539286 - RNA, 22 nt, Pseudomonas putida KT2440
gucguaggagcggguucacccg

SEQ ID NO: 3539287 - RNA, 14 nt, Pseudomonas putida KT2440
gucguaggcgcggg

SEQ ID NO: 3539288 - RNA, 20 nt, Pseudomonas putida KT2440
gucgucagcuuccgcugccg

SEQ ID NO: 3539289 - RNA, 17 nt, Pseudomonas putida KT2440
gucgucagggucuuccg

SEQ ID NO: 3539290 - RNA, 20 nt, Pseudomonas putida KT2440
gucguccacgcgcaggccac

SEQ ID NO: 3539291 - RNA, 14 nt, Pseudomonas putida KT2440
gucguccagcucgc

SEQ ID NO: 3539292 - RNA, 22 nt, Pseudomonas putida KT2440
gucguccucgaacucaugcucc

SEQ ID NO: 3539293 - RNA, 16 nt, Pseudomonas putida KT2440
gucguccuggguaauc

SEQ ID NO: 3539294 - RNA, 23 nt, Pseudomonas putida KT2440
gucgucgaccgcgaccaugguga

SEQ ID NO: 3539295 - RNA, 18 nt, Pseudomonas putida KT2440
gucgugccggaacaaccc

SEQ ID NO: 3539296 - RNA, 19 nt, Pseudomonas putida KT2440
gucguggccuucgcgggcu

SEQ ID NO: 3539297 - RNA, 20 nt, Pseudomonas putida KT2440
gucguggccuucgcgggcuc

SEQ ID NO: 3539298 - RNA, 14 nt, Pseudomonas putida KT2440
gucguggcgaacac

SEQ ID NO: 3539299 - RNA, 13 nt, Pseudomonas putida KT2440
gucgugugcugcg

SEQ ID NO: 3539300 - RNA, 20 nt, Pseudomonas putida KT2440
gucguuacccaccagcucca

SEQ ID NO: 3539301 - RNA, 17 nt, Pseudomonas putida KT2440
gucguuacccagguaga

SEQ ID NO: 3539302 - RNA, 17 nt, Pseudomonas putida KT2440
gucguucggcaucgacg

SEQ ID NO: 3539303 - RNA, 15 nt, Pseudomonas putida KT2440
gugauagaccugcaa

SEQ ID NO: 3539304 - RNA, 23 nt, Pseudomonas putida KT2440
gugaucaacaaaccgacccugcu

SEQ ID NO: 3539305 - RNA, 23 nt, Pseudomonas putida KT2440
gugaucagugcggucaggccaag

SEQ ID NO: 3539306 - RNA, 19 nt, Pseudomonas putida KT2440
gugaucaucacacucgccc

SEQ ID NO: 3539307 - RNA, 14 nt, Pseudomonas putida KT2440
gugaucauccccag

SEQ ID NO: 3539308 - RNA, 15 nt, Pseudomonas putida KT2440
gugaucaugccgacg

SEQ ID NO: 3539309 - RNA, 13 nt, Pseudomonas putida KT2440
gugaucccgcgag

SEQ ID NO: 3539310 - RNA, 19 nt, Pseudomonas putida KT2440
gugaucgacagguucgaau

SEQ ID NO: 3539311 - RNA, 14 nt, Pseudomonas putida KT2440
gugaucgcaucauc

SEQ ID NO: 3539312 - RNA, 15 nt, Pseudomonas putida KT2440
gugaucgcaucaucc

SEQ ID NO: 3539313 - RNA, 16 nt, Pseudomonas putida KT2440
gugaucuggcgcagcg

SEQ ID NO: 3539314 - RNA, 16 nt, Pseudomonas putida KT2440
gugaugaucagggaca

SEQ ID NO: 3539315 - RNA, 14 nt, Pseudomonas putida KT2440
gugaugccgugguu

SEQ ID NO: 3539316 - RNA, 18 nt, Pseudomonas putida KT2440
gugaugcgguaaccggaa

SEQ ID NO: 3539317 - RNA, 23 nt, Pseudomonas putida KT2440
gugaugcgguaaccggaauagaa

SEQ ID NO: 3539318 - RNA, 17 nt, Pseudomonas putida KT2440
gugauggcgcauggccu

SEQ ID NO: 3539319 - RNA, 23 nt, Pseudomonas putida KT2440
gugauggcgcauggccuggucga

SEQ ID NO: 3539320 - RNA, 19 nt, Pseudomonas putida KT2440
gugaugguaucugccagca

SEQ ID NO: 3539321 - RNA, 16 nt, Pseudomonas putida KT2440
gugauggucaccuugu

SEQ ID NO: 3539322 - RNA, 21 nt, Pseudomonas putida KT2440
gugauucaagacaguggaaac

SEQ ID NO: 3539323 - RNA, 21 nt, Pseudomonas putida KT2440
gugauuugaacuugcgcauca

SEQ ID NO: 3539324 - RNA, 15 nt, Pseudomonas putida KT2440
gugcaaacacccagc

SEQ ID NO: 3539325 - RNA, 18 nt, Pseudomonas putida KT2440
gugcaacagcgccuggcg

SEQ ID NO: 3539326 - RNA, 21 nt, Pseudomonas putida KT2440
gugcaacugguucuccagguu

SEQ ID NO: 3539327 - RNA, 23 nt, Pseudomonas putida KT2440
gugcaagggauaucaggcccugg

SEQ ID NO: 3539328 - RNA, 15 nt, Pseudomonas putida KT2440
gugcacaagcugcug

SEQ ID NO: 3539329 - RNA, 19 nt, Pseudomonas putida KT2440
gugcacaagcugcugauaa

SEQ ID NO: 3539330 - RNA, 19 nt, Pseudomonas putida KT2440
gugcacagcguccaguuca

SEQ ID NO: 3539331 - RNA, 19 nt, Pseudomonas putida KT2440
gugcacagguuagggucga

SEQ ID NO: 3539332 - RNA, 23 nt, Pseudomonas putida KT2440
gugcaccaacgccgauagccagc

SEQ ID NO: 3539333 - RNA, 14 nt, Pseudomonas putida KT2440
gugcacccacuggc

SEQ ID NO: 3539334 - RNA, 16 nt, Pseudomonas putida KT2440
gugcacccaucggcgc

SEQ ID NO: 3539335 - RNA, 17 nt, Pseudomonas putida KT2440
gugcacgacgucgucga

SEQ ID NO: 3539336 - RNA, 13 nt, Pseudomonas putida KT2440
gugcacgccagcc

SEQ ID NO: 3539337 - RNA, 21 nt, Pseudomonas putida KT2440
gugcacgccagccaguacggc

SEQ ID NO: 3539338 - RNA, 18 nt, Pseudomonas putida KT2440
gugcacgggccgauugcc

SEQ ID NO: 3539339 - RNA, 13 nt, Pseudomonas putida KT2440
gugcacugccugg

SEQ ID NO: 3539340 - RNA, 15 nt, Pseudomonas putida KT2440
gugcacugccuggcu

SEQ ID NO: 3539341 - RNA, 16 nt, Pseudomonas putida KT2440
gugcacugccuggcuc

SEQ ID NO: 3539342 - RNA, 12 nt, Pseudomonas putida KT2440
gugcacuggcag

SEQ ID NO: 3539343 - RNA, 19 nt, Pseudomonas putida KT2440
gugcacuggcaggccuugu

SEQ ID NO: 3539344 - RNA, 14 nt, Pseudomonas putida KT2440
gugcacuuucgcgg

SEQ ID NO: 3539345 - RNA, 20 nt, Pseudomonas putida KT2440
gugcacuuucgcggcccagc

SEQ ID NO: 3539346 - RNA, 18 nt, Pseudomonas putida KT2440
gugcagaacguacuggcc

SEQ ID NO: 3539347 - RNA, 14 nt, Pseudomonas putida KT2440
gugcagcaacaccg

SEQ ID NO: 3539348 - RNA, 22 nt, Pseudomonas putida KT2440
gugcagcacuucgaucaggcag

SEQ ID NO: 3539349 - RNA, 20 nt, Pseudomonas putida KT2440
gugcagcgacggcgaaguca

SEQ ID NO: 3539350 - RNA, 19 nt, Pseudomonas putida KT2440
gugcagcgcucgcugccgg

SEQ ID NO: 3539351 - RNA, 17 nt, Pseudomonas putida KT2440
gugcaggcgcaggcucu

SEQ ID NO: 3539352 - RNA, 22 nt, Pseudomonas putida KT2440
gugcaggcgcaggcucuccacg

SEQ ID NO: 3539353 - RNA, 14 nt, Pseudomonas putida KT2440
gugcagggcguugc

SEQ ID NO: 3539354 - RNA, 20 nt, Pseudomonas putida KT2440
gugcagggggguaaggcugg

SEQ ID NO: 3539355 - RNA, 21 nt, Pseudomonas putida KT2440
gugcagggggguaaggcuggc

SEQ ID NO: 3539356 - RNA, 15 nt, Pseudomonas putida KT2440
gugcaggucagcguu

SEQ ID NO: 3539357 - RNA, 18 nt, Pseudomonas putida KT2440
gugcaggugcacuguugc

SEQ ID NO: 3539358 - RNA, 16 nt, Pseudomonas putida KT2440
gugcagguggauguug

SEQ ID NO: 3539359 - RNA, 19 nt, Pseudomonas putida KT2440
gugcagguggauguugaug

SEQ ID NO: 3539360 - RNA, 14 nt, Pseudomonas putida KT2440
gugcagguucgacc

SEQ ID NO: 3539361 - RNA, 18 nt, Pseudomonas putida KT2440
gugcagguucgaccaccg

SEQ ID NO: 3539362 - RNA, 20 nt, Pseudomonas putida KT2440
gugcagguugauccagcccu

SEQ ID NO: 3539363 - RNA, 16 nt, Pseudomonas putida KT2440
gugcauccaacgcugc

SEQ ID NO: 3539364 - RNA, 16 nt, Pseudomonas putida KT2440
gugcauccugcacugc

SEQ ID NO: 3539365 - RNA, 13 nt, Pseudomonas putida KT2440
gugcaugcgcacg

SEQ ID NO: 3539366 - RNA, 15 nt, Pseudomonas putida KT2440
gugcaugcgcacggu

SEQ ID NO: 3539367 - RNA, 14 nt, Pseudomonas putida KT2440
gugcaugcgccccc

SEQ ID NO: 3539368 - RNA, 16 nt, Pseudomonas putida KT2440
gugcaugggccaggga

SEQ ID NO: 3539369 - RNA, 20 nt, Pseudomonas putida KT2440
gugcauguccugaagcaggg

SEQ ID NO: 3539370 - RNA, 23 nt, Pseudomonas putida KT2440
gugcauguccugaagcaggggcu

SEQ ID NO: 3539371 - RNA, 20 nt, Pseudomonas putida KT2440
gugcauucugccaugauccg

SEQ ID NO: 3539372 - RNA, 15 nt, Pseudomonas putida KT2440
gugcauuggcaaacg

SEQ ID NO: 3539373 - RNA, 15 nt, Pseudomonas putida KT2440
gugccaacaggcagc

SEQ ID NO: 3539374 - RNA, 17 nt, Pseudomonas putida KT2440
gugccaacaggcagcau

SEQ ID NO: 3539375 - RNA, 14 nt, Pseudomonas putida KT2440
gugccacccaaggc

SEQ ID NO: 3539376 - RNA, 19 nt, Pseudomonas putida KT2440
gugccacccaaggcaucca

SEQ ID NO: 3539377 - RNA, 12 nt, Pseudomonas putida KT2440
gugccaccgaug

SEQ ID NO: 3539378 - RNA, 21 nt, Pseudomonas putida KT2440
gugccaccgauggugugguag

SEQ ID NO: 3539379 - RNA, 14 nt, Pseudomonas putida KT2440
gugccagaaccagg

SEQ ID NO: 3539380 - RNA, 15 nt, Pseudomonas putida KT2440
gugccagaaccagga

SEQ ID NO: 3539381 - RNA, 22 nt, Pseudomonas putida KT2440
gugccagagaauuucuccccag

SEQ ID NO: 3539382 - RNA, 19 nt, Pseudomonas putida KT2440
gugccagcgccaaucgcau

SEQ ID NO: 3539383 - RNA, 16 nt, Pseudomonas putida KT2440
gugccagcggccacuu

SEQ ID NO: 3539384 - RNA, 14 nt, Pseudomonas putida KT2440
gugccaggcucagg

SEQ ID NO: 3539385 - RNA, 16 nt, Pseudomonas putida KT2440
gugccaggcucaggcc

SEQ ID NO: 3539386 - RNA, 17 nt, Pseudomonas putida KT2440
gugccaggcucaggccu

SEQ ID NO: 3539387 - RNA, 20 nt, Pseudomonas putida KT2440
gugccaggugauaguccagc

SEQ ID NO: 3539388 - RNA, 23 nt, Pseudomonas putida KT2440
gugccaggugauaguccagcaac

SEQ ID NO: 3539389 - RNA, 17 nt, Pseudomonas putida KT2440
gugccagguguuugggc

SEQ ID NO: 3539390 - RNA, 13 nt, Pseudomonas putida KT2440
gugccauagcacc

SEQ ID NO: 3539391 - RNA, 20 nt, Pseudomonas putida KT2440
gugccaucagggcgaugcgc

SEQ ID NO: 3539392 - RNA, 18 nt, Pseudomonas putida KT2440
gugccauccaccgcgcca

SEQ ID NO: 3539393 - RNA, 16 nt, Pseudomonas putida KT2440
gugcccaccagugagg

SEQ ID NO: 3539394 - RNA, 12 nt, Pseudomonas putida KT2440
gugcccaccgca

SEQ ID NO: 3539395 - RNA, 17 nt, Pseudomonas putida KT2440
gugcccacugcagccau

SEQ ID NO: 3539396 - RNA, 14 nt, Pseudomonas putida KT2440
gugcccagaucacu

SEQ ID NO: 3539397 - RNA, 20 nt, Pseudomonas putida KT2440
gugcccaugaucuugcugcc

SEQ ID NO: 3539398 - RNA, 13 nt, Pseudomonas putida KT2440
gugccccuugagc

SEQ ID NO: 3539399 - RNA, 16 nt, Pseudomonas putida KT2440
gugcccgaucaccgcg

SEQ ID NO: 3539400 - RNA, 18 nt, Pseudomonas putida KT2440
gugcccgaucaccgcgaa

SEQ ID NO: 3539401 - RNA, 19 nt, Pseudomonas putida KT2440
gugcccgaucaccgcgaau

SEQ ID NO: 3539402 - RNA, 13 nt, Pseudomonas putida KT2440
gugcccgccaggc

SEQ ID NO: 3539403 - RNA, 14 nt, Pseudomonas putida KT2440
gugcccgccaggcg

SEQ ID NO: 3539404 - RNA, 20 nt, Pseudomonas putida KT2440
gugcccgcgaagggcugccg

SEQ ID NO: 3539405 - RNA, 18 nt, Pseudomonas putida KT2440
gugcccgcgaaggggccg

SEQ ID NO: 3539406 - RNA, 18 nt, Pseudomonas putida KT2440
gugcccgcgaguccucca

SEQ ID NO: 3539407 - RNA, 20 nt, Pseudomonas putida KT2440
gugcccgcgaguccuccaac

SEQ ID NO: 3539408 - RNA, 15 nt, Pseudomonas putida KT2440
gugcccuugaacggc

SEQ ID NO: 3539409 - RNA, 12 nt, Pseudomonas putida KT2440
gugccgaacagc

SEQ ID NO: 3539410 - RNA, 13 nt, Pseudomonas putida KT2440
gugccgaagucau

SEQ ID NO: 3539411 - RNA, 21 nt, Pseudomonas putida KT2440
gugccgaauugacccagucag

SEQ ID NO: 3539412 - RNA, 20 nt, Pseudomonas putida KT2440
gugccgagugccaacaaucu

SEQ ID NO: 3539413 - RNA, 14 nt, Pseudomonas putida KT2440
gugccgcagucccg

SEQ ID NO: 3539414 - RNA, 15 nt, Pseudomonas putida KT2440
gugccgcaucagccg

SEQ ID NO: 3539415 - RNA, 16 nt, Pseudomonas putida KT2440
gugccgcaucagccgg

SEQ ID NO: 3539416 - RNA, 14 nt, Pseudomonas putida KT2440
gugccgccaguucg

SEQ ID NO: 3539417 - RNA, 12 nt, Pseudomonas putida KT2440
gugccgccaugu

SEQ ID NO: 3539418 - RNA, 18 nt, Pseudomonas putida KT2440
gugccgccugggucaggc

SEQ ID NO: 3539419 - RNA, 19 nt, Pseudomonas putida KT2440
gugccgccugggucaggcg

SEQ ID NO: 3539420 - RNA, 16 nt, Pseudomonas putida KT2440
gugccgcgccagcucc

SEQ ID NO: 3539421 - RNA, 19 nt, Pseudomonas putida KT2440
gugccgcggauguggugga

SEQ ID NO: 3539422 - RNA, 17 nt, Pseudomonas putida KT2440
gugccgcugcgcgguaa

SEQ ID NO: 3539423 - RNA, 23 nt, Pseudomonas putida KT2440
gugccggcagcgagcgcuggauc

SEQ ID NO: 3539424 - RNA, 21 nt, Pseudomonas putida KT2440
gugccggcagcucgcgcugcg

SEQ ID NO: 3539425 - RNA, 18 nt, Pseudomonas putida KT2440
gugccggccagcggcaug

SEQ ID NO: 3539426 - RNA, 22 nt, Pseudomonas putida KT2440
gugccggccucuucgcgggcaa

SEQ ID NO: 3539427 - RNA, 17 nt, Pseudomonas putida KT2440
gugccggguccaguucc

SEQ ID NO: 3539428 - RNA, 13 nt, Pseudomonas putida KT2440
gugccgguggggu

SEQ ID NO: 3539429 - RNA, 15 nt, Pseudomonas putida KT2440
gugccgguggggugu

SEQ ID NO: 3539430 - RNA, 20 nt, Pseudomonas putida KT2440
gugccguacauagcaggauc

SEQ ID NO: 3539431 - RNA, 13 nt, Pseudomonas putida KT2440
gugccgugcaggg

SEQ ID NO: 3539432 - RNA, 16 nt, Pseudomonas putida KT2440
gugccucacgcaugcc

SEQ ID NO: 3539433 - RNA, 13 nt, Pseudomonas putida KT2440
gugccucagccag

SEQ ID NO: 3539434 - RNA, 15 nt, Pseudomonas putida KT2440
gugccucgcccaggu

SEQ ID NO: 3539435 - RNA, 13 nt, Pseudomonas putida KT2440
gugccucugcugc

SEQ ID NO: 3539436 - RNA, 23 nt, Pseudomonas putida KT2440
gugccucugcugcggauacagcg

SEQ ID NO: 3539437 - RNA, 16 nt, Pseudomonas putida KT2440
gugccugcagcccggc

SEQ ID NO: 3539438 - RNA, 18 nt, Pseudomonas putida KT2440
gugccugcagcccggcaa

SEQ ID NO: 3539439 - RNA, 15 nt, Pseudomonas putida KT2440
gugccugcugcucgc

SEQ ID NO: 3539440 - RNA, 17 nt, Pseudomonas putida KT2440
gugccuggcgugcuguu

SEQ ID NO: 3539441 - RNA, 14 nt, Pseudomonas putida KT2440
gugccugggucagc

SEQ ID NO: 3539442 - RNA, 13 nt, Pseudomonas putida KT2440
gugccuggguggu

SEQ ID NO: 3539443 - RNA, 22 nt, Pseudomonas putida KT2440
gugccugucgucagcucaggcc

SEQ ID NO: 3539444 - RNA, 22 nt, Pseudomonas putida KT2440
gugccugugagaucgagcgccg

SEQ ID NO: 3539445 - RNA, 16 nt, Pseudomonas putida KT2440
gugccuugaucaaugc

SEQ ID NO: 3539446 - RNA, 19 nt, Pseudomonas putida KT2440
gugccuugccugggccggu

SEQ ID NO: 3539447 - RNA, 16 nt, Pseudomonas putida KT2440
gugccuuggcggcgga

SEQ ID NO: 3539448 - RNA, 22 nt, Pseudomonas putida KT2440
gugccuuggcggcggaucggcg

SEQ ID NO: 3539449 - RNA, 15 nt, Pseudomonas putida KT2440
gugcgaaguuggucc

SEQ ID NO: 3539450 - RNA, 18 nt, Pseudomonas putida KT2440
gugcgagaggcgcuuuuc

SEQ ID NO: 3539451 - RNA, 14 nt, Pseudomonas putida KT2440
gugcgcauuucacg

SEQ ID NO: 3539452 - RNA, 20 nt, Pseudomonas putida KT2440
gugcgcauuucacgcacggc

SEQ ID NO: 3539453 - RNA, 13 nt, Pseudomonas putida KT2440
gugcgcccggcaa

SEQ ID NO: 3539454 - RNA, 19 nt, Pseudomonas putida KT2440
gugcgcccggcaaacacau

SEQ ID NO: 3539455 - RNA, 16 nt, Pseudomonas putida KT2440
gugcgcccggcgcuga

SEQ ID NO: 3539456 - RNA, 17 nt, Pseudomonas putida KT2440
gugcgccuccagcagcg

SEQ ID NO: 3539457 - RNA, 17 nt, Pseudomonas putida KT2440
gugcgccugcaaacgca

SEQ ID NO: 3539458 - RNA, 19 nt, Pseudomonas putida KT2440
gugcgccuuuuccaccagc

SEQ ID NO: 3539459 - RNA, 16 nt, Pseudomonas putida KT2440
gugcgcucaggcgugg

SEQ ID NO: 3539460 - RNA, 17 nt, Pseudomonas putida KT2440
gugcgcucaggcgugga

SEQ ID NO: 3539461 - RNA, 15 nt, Pseudomonas putida KT2440
gugcggauaccgcug

SEQ ID NO: 3539462 - RNA, 17 nt, Pseudomonas putida KT2440
gugcggcagcucgccgu

SEQ ID NO: 3539463 - RNA, 22 nt, Pseudomonas putida KT2440
gugcggcccucgguggcucucc

SEQ ID NO: 3539464 - RNA, 14 nt, Pseudomonas putida KT2440
gugcggcggcacug

SEQ ID NO: 3539465 - RNA, 20 nt, Pseudomonas putida KT2440
gugcggcugggccccaggcg

SEQ ID NO: 3539466 - RNA, 20 nt, Pseudomonas putida KT2440
gugcggcuuuagccgugaag

SEQ ID NO: 3539467 - RNA, 19 nt, Pseudomonas putida KT2440
gugcgggcuuguccgcgaa

SEQ ID NO: 3539468 - RNA, 16 nt, Pseudomonas putida KT2440
gugcguucaccggcac

SEQ ID NO: 3539469 - RNA, 18 nt, Pseudomonas putida KT2440
gugcguucaccggcaccu

SEQ ID NO: 3539470 - RNA, 17 nt, Pseudomonas putida KT2440
gugcguuggcugcugaa

SEQ ID NO: 3539471 - RNA, 14 nt, Pseudomonas putida KT2440
gugcuaaugcucuu

SEQ ID NO: 3539472 - RNA, 21 nt, Pseudomonas putida KT2440
gugcuaccaaccuccagguca

SEQ ID NO: 3539473 - RNA, 12 nt, Pseudomonas putida KT2440
gugcucagcaca

SEQ ID NO: 3539474 - RNA, 18 nt, Pseudomonas putida KT2440
gugcucagccacgcuggc

SEQ ID NO: 3539475 - RNA, 16 nt, Pseudomonas putida KT2440
gugcucagcggcaccu

SEQ ID NO: 3539476 - RNA, 13 nt, Pseudomonas putida KT2440
gugcucaggcuca

SEQ ID NO: 3539477 - RNA, 15 nt, Pseudomonas putida KT2440
gugcucaggcucagc

SEQ ID NO: 3539478 - RNA, 16 nt, Pseudomonas putida KT2440
gugcucaggcucagcu

SEQ ID NO: 3539479 - RNA, 19 nt, Pseudomonas putida KT2440
gugcucaggcucagcucca

SEQ ID NO: 3539480 - RNA, 14 nt, Pseudomonas putida KT2440
gugcuccagcucca

SEQ ID NO: 3539481 - RNA, 16 nt, Pseudomonas putida KT2440
gugcuccagcuccagg

SEQ ID NO: 3539482 - RNA, 21 nt, Pseudomonas putida KT2440
gugcucgaacucuuccagcuc

SEQ ID NO: 3539483 - RNA, 14 nt, Pseudomonas putida KT2440
gugcucgaggaagc

SEQ ID NO: 3539484 - RNA, 18 nt, Pseudomonas putida KT2440
gugcucgccucacagcgc

SEQ ID NO: 3539485 - RNA, 20 nt, Pseudomonas putida KT2440
gugcucgccucacagcgccg

SEQ ID NO: 3539486 - RNA, 21 nt, Pseudomonas putida KT2440
gugcucggcacugcuauccgc

SEQ ID NO: 3539487 - RNA, 22 nt, Pseudomonas putida KT2440
gugcucggcaugcaugcguugc

SEQ ID NO: 3539488 - RNA, 16 nt, Pseudomonas putida KT2440
gugcucguccaguucc

SEQ ID NO: 3539489 - RNA, 16 nt, Pseudomonas putida KT2440
gugcucugcaggcaca

SEQ ID NO: 3539490 - RNA, 12 nt, Pseudomonas putida KT2440
gugcucugccgc

SEQ ID NO: 3539491 - RNA, 22 nt, Pseudomonas putida KT2440
gugcugaccaccgugcuguguu

SEQ ID NO: 3539492 - RNA, 15 nt, Pseudomonas putida KT2440
gugcugaugcccaaa

SEQ ID NO: 3539493 - RNA, 13 nt, Pseudomonas putida KT2440
gugcugcagaccc

SEQ ID NO: 3539494 - RNA, 13 nt, Pseudomonas putida KT2440
gugcuggcccuuu

SEQ ID NO: 3539495 - RNA, 19 nt, Pseudomonas putida KT2440
gugcuggcgcucaauggca

SEQ ID NO: 3539496 - RNA, 22 nt, Pseudomonas putida KT2440
gugcuggcguguugucgugugc

SEQ ID NO: 3539497 - RNA, 18 nt, Pseudomonas putida KT2440
gugcugggcaugagccug

SEQ ID NO: 3539498 - RNA, 16 nt, Pseudomonas putida KT2440
gugcuggggccgcaaa

SEQ ID NO: 3539499 - RNA, 17 nt, Pseudomonas putida KT2440
gugcuggggccgcaaag

SEQ ID NO: 3539500 - RNA, 16 nt, Pseudomonas putida KT2440
gugcugguggccacgc

SEQ ID NO: 3539501 - RNA, 23 nt, Pseudomonas putida KT2440
gugcuguaugauucgccucccgc

SEQ ID NO: 3539502 - RNA, 15 nt, Pseudomonas putida KT2440
gugcugucacccuug

SEQ ID NO: 3539503 - RNA, 14 nt, Pseudomonas putida KT2440
gugcugugcacugc

SEQ ID NO: 3539504 - RNA, 16 nt, Pseudomonas putida KT2440
gugcugugcacugcga

SEQ ID NO: 3539505 - RNA, 14 nt, Pseudomonas putida KT2440
gugcuguggcgcac

SEQ ID NO: 3539506 - RNA, 14 nt, Pseudomonas putida KT2440
gugcuucgcccagu

SEQ ID NO: 3539507 - RNA, 18 nt, Pseudomonas putida KT2440
gugcuucgcccagugccu

SEQ ID NO: 3539508 - RNA, 16 nt, Pseudomonas putida KT2440
gugcuugcaccgacaa

SEQ ID NO: 3539509 - RNA, 23 nt, Pseudomonas putida KT2440
gugcuugcgggcaaggucgaugc

SEQ ID NO: 3539510 - RNA, 18 nt, Pseudomonas putida KT2440
gugcuugugcucccacag

SEQ ID NO: 3539511 - RNA, 16 nt, Pseudomonas putida KT2440
guggaaaucgccugcu

SEQ ID NO: 3539512 - RNA, 23 nt, Pseudomonas putida KT2440
guggaaaucgccugcuuggccga

SEQ ID NO: 3539513 - RNA, 17 nt, Pseudomonas putida KT2440
guggaaauuggccagca

SEQ ID NO: 3539514 - RNA, 19 nt, Pseudomonas putida KT2440
guguaggagcggguuuacc

SEQ ID NO: 3539515 - RNA, 15 nt, Pseudomonas putida KT2440
guguagucgguggug

SEQ ID NO: 3539516 - RNA, 15 nt, Pseudomonas putida KT2440
guguauccaccccca

SEQ ID NO: 3539517 - RNA, 16 nt, Pseudomonas putida KT2440
guguauccagcccggc

SEQ ID NO: 3539518 - RNA, 13 nt, Pseudomonas putida KT2440
guguauccauacu

SEQ ID NO: 3539519 - RNA, 21 nt, Pseudomonas putida KT2440
gugucacauugguguggguga

SEQ ID NO: 3539520 - RNA, 18 nt, Pseudomonas putida KT2440
gugucagcguacacugca

SEQ ID NO: 3539521 - RNA, 20 nt, Pseudomonas putida KT2440
gugucagcguacacugcagg

SEQ ID NO: 3539522 - RNA, 15 nt, Pseudomonas putida KT2440
gugucaguugcucgc

SEQ ID NO: 3539523 - RNA, 13 nt, Pseudomonas putida KT2440
guguccacccccg

SEQ ID NO: 3539524 - RNA, 23 nt, Pseudomonas putida KT2440
guguccgccgccgucagguucaa

SEQ ID NO: 3539525 - RNA, 15 nt, Pseudomonas putida KT2440
guguccggcaugugc

SEQ ID NO: 3539526 - RNA, 23 nt, Pseudomonas putida KT2440
gugucggccagcugcgcacgcag

SEQ ID NO: 3539527 - RNA, 14 nt, Pseudomonas putida KT2440
gugucuuccggcau

SEQ ID NO: 3539528 - RNA, 19 nt, Pseudomonas putida KT2440
gugugacccaguucgcgga

SEQ ID NO: 3539529 - RNA, 20 nt, Pseudomonas putida KT2440
gugugacccaguucgcggau

SEQ ID NO: 3539530 - RNA, 13 nt, Pseudomonas putida KT2440
gugugcaggugga

SEQ ID NO: 3539531 - RNA, 22 nt, Pseudomonas putida KT2440
gugugcauuuucggcaaggcga

SEQ ID NO: 3539532 - RNA, 14 nt, Pseudomonas putida KT2440
gugugcccaccgca

SEQ ID NO: 3539533 - RNA, 23 nt, Pseudomonas putida KT2440
gugugcgaaaaccccggcucggu

SEQ ID NO: 3539534 - RNA, 19 nt, Pseudomonas putida KT2440
gugugcgccgucaccagcg

SEQ ID NO: 3539535 - RNA, 13 nt, Pseudomonas putida KT2440
gugugcucacggu

SEQ ID NO: 3539536 - RNA, 16 nt, Pseudomonas putida KT2440
gugugcuccagcucca

SEQ ID NO: 3539537 - RNA, 21 nt, Pseudomonas putida KT2440
gugugcuccagcuccaggcga

SEQ ID NO: 3539538 - RNA, 14 nt, Pseudomonas putida KT2440
guguggaaacccgc

SEQ ID NO: 3539539 - RNA, 18 nt, Pseudomonas putida KT2440
guguggaaacccgcauca

SEQ ID NO: 3539540 - RNA, 22 nt, Pseudomonas putida KT2440
guguggcaaauagaugcaggug

SEQ ID NO: 3539541 - RNA, 14 nt, Pseudomonas putida KT2440
guguuacgccaggc

SEQ ID NO: 3539542 - RNA, 15 nt, Pseudomonas putida KT2440
guguuacgccaggcg

SEQ ID NO: 3539543 - RNA, 15 nt, Pseudomonas putida KT2440
guguuagcgcggacc

SEQ ID NO: 3539544 - RNA, 17 nt, Pseudomonas putida KT2440
guguucccagcacccca

SEQ ID NO: 3539545 - RNA, 20 nt, Pseudomonas putida KT2440
guguucgaacgggcauuuuu

SEQ ID NO: 3539546 - RNA, 21 nt, Pseudomonas putida KT2440
guguucgccguuguucacggu

SEQ ID NO: 3539547 - RNA, 16 nt, Pseudomonas putida KT2440
guguucgcgaacugca

SEQ ID NO: 3539548 - RNA, 13 nt, Pseudomonas putida KT2440
guguucgcgggca

SEQ ID NO: 3539549 - RNA, 17 nt, Pseudomonas putida KT2440
guguucgcgggcaagcc

SEQ ID NO: 3539550 - RNA, 20 nt, Pseudomonas putida KT2440
guguucgcgggcaugcccgc

SEQ ID NO: 3539551 - RNA, 17 nt, Pseudomonas putida KT2440
guguucugguugaacug

SEQ ID NO: 3539552 - RNA, 15 nt, Pseudomonas putida KT2440
guguugccacccggc

SEQ ID NO: 3539553 - RNA, 16 nt, Pseudomonas putida KT2440
guguuguugcaaccag

SEQ ID NO: 3539554 - RNA, 19 nt, Pseudomonas putida KT2440
guguuguugcaaccaggcg

SEQ ID NO: 3539555 - RNA, 23 nt, Pseudomonas putida KT2440
guguuucaaaaaaaagggcaucu

SEQ ID NO: 3539556 - RNA, 18 nt, Pseudomonas putida KT2440
guguuucgcccccggcgg

SEQ ID NO: 3539557 - RNA, 12 nt, Pseudomonas putida KT2440
guuaagcgccac

SEQ ID NO: 3539558 - RNA, 17 nt, Pseudomonas putida KT2440
guuacaauaccgacaag

SEQ ID NO: 3539559 - RNA, 22 nt, Pseudomonas putida KT2440
guuacccaacagaccaccugcc

SEQ ID NO: 3539560 - RNA, 15 nt, Pseudomonas putida KT2440
guuacccaccagcuc

SEQ ID NO: 3539561 - RNA, 17 nt, Pseudomonas putida KT2440
guuacccaccagcucca

SEQ ID NO: 3539562 - RNA, 21 nt, Pseudomonas putida KT2440
guuaccucccgcacauuucac

SEQ ID NO: 3539563 - RNA, 15 nt, Pseudomonas putida KT2440
guuacgcaccagcuc

SEQ ID NO: 3539564 - RNA, 17 nt, Pseudomonas putida KT2440
guuacgcaccagcucca

SEQ ID NO: 3539565 - RNA, 13 nt, Pseudomonas putida KT2440
guuacgccaggcg

SEQ ID NO: 3539566 - RNA, 18 nt, Pseudomonas putida KT2440
guuacggacccuaucggc

SEQ ID NO: 3539567 - RNA, 16 nt, Pseudomonas putida KT2440
guuacggcggccugcu

SEQ ID NO: 3539568 - RNA, 17 nt, Pseudomonas putida KT2440
guuacuguuccagcgua

SEQ ID NO: 3539569 - RNA, 17 nt, Pseudomonas putida KT2440
guuagcgucgaugcggc

SEQ ID NO: 3539570 - RNA, 19 nt, Pseudomonas putida KT2440
guuaggcgagaucgacagg

SEQ ID NO: 3539571 - RNA, 18 nt, Pseudomonas putida KT2440
guuaguucgugcacccca

SEQ ID NO: 3539572 - RNA, 17 nt, Pseudomonas putida KT2440
guuauccaggcuggcgc

SEQ ID NO: 3539573 - RNA, 12 nt, Pseudomonas putida KT2440
guuauccaggua

SEQ ID NO: 3539574 - RNA, 15 nt, Pseudomonas putida KT2440
guuauccugcagcac

SEQ ID NO: 3539575 - RNA, 20 nt, Pseudomonas putida KT2440
guuauuuuuuaacaaggcac

SEQ ID NO: 3539576 - RNA, 21 nt, Pseudomonas putida KT2440
guuauuuuuuaacaaggcacg

SEQ ID NO: 3539577 - RNA, 21 nt, Pseudomonas putida KT2440
guucaaggaaggcaaucgcgc

SEQ ID NO: 3539578 - RNA, 17 nt, Pseudomonas putida KT2440
guucaagggcaggguga

SEQ ID NO: 3539579 - RNA, 15 nt, Pseudomonas putida KT2440
guucaaggucaucgc

SEQ ID NO: 3539580 - RNA, 16 nt, Pseudomonas putida KT2440
guucaaugccagcagu

SEQ ID NO: 3539581 - RNA, 21 nt, Pseudomonas putida KT2440
guucacacucagccgcugcgc

SEQ ID NO: 3539582 - RNA, 19 nt, Pseudomonas putida KT2440
guucacagccggcaaauca

SEQ ID NO: 3539583 - RNA, 18 nt, Pseudomonas putida KT2440
guucacaucgcccuucug

SEQ ID NO: 3539584 - RNA, 12 nt, Pseudomonas putida KT2440
guucaccagcag

SEQ ID NO: 3539585 - RNA, 18 nt, Pseudomonas putida KT2440
guucacccacacccgcgc

SEQ ID NO: 3539586 - RNA, 20 nt, Pseudomonas putida KT2440
guucacccgcgaaagggccg

SEQ ID NO: 3539587 - RNA, 22 nt, Pseudomonas putida KT2440
guucacccgcgaagaggccgga

SEQ ID NO: 3539588 - RNA, 21 nt, Pseudomonas putida KT2440
guucacccgcgaagcaggcga

SEQ ID NO: 3539589 - RNA, 14 nt, Pseudomonas putida KT2440
guucacccgcgaau

SEQ ID NO: 3539590 - RNA, 19 nt, Pseudomonas putida KT2440
guucaccguguuguucgcc

SEQ ID NO: 3539591 - RNA, 20 nt, Pseudomonas putida KT2440
guucacgggucaccacggga

SEQ ID NO: 3539592 - RNA, 12 nt, Pseudomonas putida KT2440
guucacuguugc

SEQ ID NO: 3539593 - RNA, 20 nt, Pseudomonas putida KT2440
guucacuguugccgccacca

SEQ ID NO: 3539594 - RNA, 18 nt, Pseudomonas putida KT2440
guucagccaacggcguga

SEQ ID NO: 3539595 - RNA, 18 nt, Pseudomonas putida KT2440
guucagcccuugcugcag

SEQ ID NO: 3539596 - RNA, 12 nt, Pseudomonas putida KT2440
guucaggccggu

SEQ ID NO: 3539597 - RNA, 18 nt, Pseudomonas putida KT2440
guucaggcgcagcacgcc

SEQ ID NO: 3539598 - RNA, 19 nt, Pseudomonas putida KT2440
guucaggcgcccugcgcca

SEQ ID NO: 3539599 - RNA, 16 nt, Pseudomonas putida KT2440
guucagggcaauagcc

SEQ ID NO: 3539600 - RNA, 17 nt, Pseudomonas putida KT2440
guucaggucgcgcugca

SEQ ID NO: 3539601 - RNA, 19 nt, Pseudomonas putida KT2440
guucagguguuccagcacg

SEQ ID NO: 3539602 - RNA, 13 nt, Pseudomonas putida KT2440
guucagucagugc

SEQ ID NO: 3539603 - RNA, 16 nt, Pseudomonas putida KT2440
guucagugaucaugcc

SEQ ID NO: 3539604 - RNA, 15 nt, Pseudomonas putida KT2440
guucauccagaucgg

SEQ ID NO: 3539605 - RNA, 14 nt, Pseudomonas putida KT2440
guucaucgaacugc

SEQ ID NO: 3539606 - RNA, 15 nt, Pseudomonas putida KT2440
guucaucgaacugca

SEQ ID NO: 3539607 - RNA, 15 nt, Pseudomonas putida KT2440
guucaucggcaaaca

SEQ ID NO: 3539608 - RNA, 16 nt, Pseudomonas putida KT2440
guucaucggcaaacac

SEQ ID NO: 3539609 - RNA, 18 nt, Pseudomonas putida KT2440
guucaucggcaaacacau

SEQ ID NO: 3539610 - RNA, 23 nt, Pseudomonas putida KT2440
guucaucuucuugcaguucuuga

SEQ ID NO: 3539611 - RNA, 17 nt, Pseudomonas putida KT2440
guucauuguucuggcca

SEQ ID NO: 3539612 - RNA, 18 nt, Pseudomonas putida KT2440
guuccaagcgucggccac

SEQ ID NO: 3539613 - RNA, 15 nt, Pseudomonas putida KT2440
guuccagcagcgaca

SEQ ID NO: 3539614 - RNA, 17 nt, Pseudomonas putida KT2440
guuccagccaggcgucg

SEQ ID NO: 3539615 - RNA, 19 nt, Pseudomonas putida KT2440
guuccagccgcgccacucc

SEQ ID NO: 3539616 - RNA, 20 nt, Pseudomonas putida KT2440
guuccagccgcgccacuccc

SEQ ID NO: 3539617 - RNA, 21 nt, Pseudomonas putida KT2440
guuccagccgcgccacuccca

SEQ ID NO: 3539618 - RNA, 23 nt, Pseudomonas putida KT2440
guuccagccguccucgacccagu

SEQ ID NO: 3539619 - RNA, 14 nt, Pseudomonas putida KT2440
guugaucucuucgg

SEQ ID NO: 3539620 - RNA, 20 nt, Pseudomonas putida KT2440
guugaucuguugcugcaggu

SEQ ID NO: 3539621 - RNA, 20 nt, Pseudomonas putida KT2440
guugaugaaauccaccagcu

SEQ ID NO: 3539622 - RNA, 16 nt, Pseudomonas putida KT2440
guugaugaucugcucc

SEQ ID NO: 3539623 - RNA, 20 nt, Pseudomonas putida KT2440
guugcaacgcagcgcgugcu

SEQ ID NO: 3539624 - RNA, 22 nt, Pseudomonas putida KT2440
guugcaagccuucgucgcuggc

SEQ ID NO: 3539625 - RNA, 20 nt, Pseudomonas putida KT2440
guugcaccucggaugccacg

SEQ ID NO: 3539626 - RNA, 14 nt, Pseudomonas putida KT2440
guugcagaaacucg

SEQ ID NO: 3539627 - RNA, 17 nt, Pseudomonas putida KT2440
guugcaggauuugcccg

SEQ ID NO: 3539628 - RNA, 14 nt, Pseudomonas putida KT2440
guugcaggcgagcu

SEQ ID NO: 3539629 - RNA, 16 nt, Pseudomonas putida KT2440
guugcaggucggcacg

SEQ ID NO: 3539630 - RNA, 19 nt, Pseudomonas putida KT2440
guugcagucguuguccagg

SEQ ID NO: 3539631 - RNA, 11 nt, Pseudomonas putida KT2440
guugccaaugc

SEQ ID NO: 3539632 - RNA, 14 nt, Pseudomonas putida KT2440
guugccaccagcau

SEQ ID NO: 3539633 - RNA, 20 nt, Pseudomonas putida KT2440
guugcccagcaugcgcuuga

SEQ ID NO: 3539634 - RNA, 14 nt, Pseudomonas putida KT2440
guugcccgcugcau

SEQ ID NO: 3539635 - RNA, 18 nt, Pseudomonas putida KT2440
guugcccggcgagcgcag

SEQ ID NO: 3539636 - RNA, 22 nt, Pseudomonas putida KT2440
guugcccggguacagccccugc

SEQ ID NO: 3539637 - RNA, 15 nt, Pseudomonas putida KT2440
guugccgccagcccc

SEQ ID NO: 3539638 - RNA, 21 nt, Pseudomonas putida KT2440
guugccgccagccccgccaac

SEQ ID NO: 3539639 - RNA, 20 nt, Pseudomonas putida KT2440
guugccuguaggcgcggguu

SEQ ID NO: 3539640 - RNA, 18 nt, Pseudomonas putida KT2440
guugccugugagaucgag

SEQ ID NO: 3539641 - RNA, 12 nt, Pseudomonas putida KT2440
guugccugugcu

SEQ ID NO: 3539642 - RNA, 18 nt, Pseudomonas putida KT2440
guugccuucgaucggcgc

SEQ ID NO: 3539643 - RNA, 23 nt, Pseudomonas putida KT2440
guugccuucgaucggcgcgccug

SEQ ID NO: 3539644 - RNA, 16 nt, Pseudomonas putida KT2440
guugccuucgcgaccg

SEQ ID NO: 3539645 - RNA, 20 nt, Pseudomonas putida KT2440
guugcgaugggcugcaaagc

SEQ ID NO: 3539646 - RNA, 16 nt, Pseudomonas putida KT2440
guugcgcagcagcagg

SEQ ID NO: 3539647 - RNA, 19 nt, Pseudomonas putida KT2440
guugcgcagcagcaggccc

SEQ ID NO: 3539648 - RNA, 19 nt, Pseudomonas putida KT2440
guugcgcagccggccuugc

SEQ ID NO: 3539649 - RNA, 21 nt, Pseudomonas putida KT2440
guugcgcagguacacgggcau

SEQ ID NO: 3539650 - RNA, 15 nt, Pseudomonas putida KT2440
guugcgcaucaccuc

SEQ ID NO: 3539651 - RNA, 16 nt, Pseudomonas putida KT2440
guugcgcaucaccucg

SEQ ID NO: 3539652 - RNA, 19 nt, Pseudomonas putida KT2440
guugcgccaggcaucccau

SEQ ID NO: 3539653 - RNA, 19 nt, Pseudomonas putida KT2440
guugcgcccggcgucgaac

SEQ ID NO: 3539654 - RNA, 23 nt, Pseudomonas putida KT2440
guugcgcucaaccgaccugcaac

SEQ ID NO: 3539655 - RNA, 18 nt, Pseudomonas putida KT2440
guugcgcuccauccaguc

SEQ ID NO: 3539656 - RNA, 21 nt, Pseudomonas putida KT2440
guugcggaacauacgcaucag

SEQ ID NO: 3539657 - RNA, 22 nt, Pseudomonas putida KT2440
guugcggaacucuggcgugaag

SEQ ID NO: 3539658 - RNA, 14 nt, Pseudomonas putida KT2440
guugcgggucagcu

SEQ ID NO: 3539659 - RNA, 23 nt, Pseudomonas putida KT2440
guugcgugccucgcccaggucaa

SEQ ID NO: 3539660 - RNA, 14 nt, Pseudomonas putida KT2440
guugcguugcagcu

SEQ ID NO: 3539661 - RNA, 14 nt, Pseudomonas putida KT2440
guugcuggccuugg

SEQ ID NO: 3539662 - RNA, 20 nt, Pseudomonas putida KT2440
guugcuggcgacgcugccca

SEQ ID NO: 3539663 - RNA, 17 nt, Pseudomonas putida KT2440
guugcuggcgaucggcu

SEQ ID NO: 3539664 - RNA, 16 nt, Pseudomonas putida KT2440
guugcuggcgccagcg

SEQ ID NO: 3539665 - RNA, 17 nt, Pseudomonas putida KT2440
guugcuggcgccagcga

SEQ ID NO: 3539666 - RNA, 17 nt, Pseudomonas putida KT2440
guugcuguuggggagga

SEQ ID NO: 3539667 - RNA, 22 nt, Pseudomonas putida KT2440
guuggcaaacucgucgcugguc

SEQ ID NO: 3539668 - RNA, 14 nt, Pseudomonas putida KT2440
guuggcaaucugcu

SEQ ID NO: 3539669 - RNA, 21 nt, Pseudomonas putida KT2440
guuggcauggaaggcguccuc

SEQ ID NO: 3539670 - RNA, 23 nt, Pseudomonas putida KT2440
guuggccaaaccguccagguagc

SEQ ID NO: 3539671 - RNA, 19 nt, Pseudomonas putida KT2440
guuggccaccaucgccggc

SEQ ID NO: 3539672 - RNA, 16 nt, Pseudomonas putida KT2440
guuggccaggucgacc

SEQ ID NO: 3539673 - RNA, 22 nt, Pseudomonas putida KT2440
guuggccaucugguugcuggcg

SEQ ID NO: 3539674 - RNA, 14 nt, Pseudomonas putida KT2440
guuggccgaaggcc

SEQ ID NO: 3539675 - RNA, 16 nt, Pseudomonas putida KT2440
guuggccggcauggcg

SEQ ID NO: 3539676 - RNA, 17 nt, Pseudomonas putida KT2440
guuggcgcuuccuggcc

SEQ ID NO: 3539677 - RNA, 15 nt, Pseudomonas putida KT2440
guuggcggugagaug

SEQ ID NO: 3539678 - RNA, 15 nt, Pseudomonas putida KT2440
guuggcguccagcag

SEQ ID NO: 3539679 - RNA, 21 nt, Pseudomonas putida KT2440
guuggcguccagcagugccau

SEQ ID NO: 3539680 - RNA, 20 nt, Pseudomonas putida KT2440
guuggcgucggcaccggcga

SEQ ID NO: 3539681 - RNA, 15 nt, Pseudomonas putida KT2440
guuggcucuguggau

SEQ ID NO: 3539682 - RNA, 22 nt, Pseudomonas putida KT2440
guuggcuuuuaaccaauugguc

SEQ ID NO: 3539683 - RNA, 17 nt, Pseudomonas putida KT2440
guugggcgggccgccga

SEQ ID NO: 3539684 - RNA, 18 nt, Pseudomonas putida KT2440
guugggcgggccgccgaa

SEQ ID NO: 3539685 - RNA, 22 nt, Pseudomonas putida KT2440
guugggcgggccgccgaacagg

SEQ ID NO: 3539686 - RNA, 22 nt, Pseudomonas putida KT2440
guuggguuggcacguugcugcc

SEQ ID NO: 3539687 - RNA, 19 nt, Pseudomonas putida KT2440
guugguaucgaucaggaag

SEQ ID NO: 3539688 - RNA, 20 nt, Pseudomonas putida KT2440
guuggucaaagaacguggac

SEQ ID NO: 3539689 - RNA, 22 nt, Pseudomonas putida KT2440
guuggucgccaggaucaccucg

SEQ ID NO: 3539690 - RNA, 21 nt, Pseudomonas putida KT2440
guuggucuagagaucugcagg

SEQ ID NO: 3539691 - RNA, 19 nt, Pseudomonas putida KT2440
guuggugcgccuccagcag

SEQ ID NO: 3539692 - RNA, 13 nt, Pseudomonas putida KT2440
guuggugggcaac

SEQ ID NO: 3539693 - RNA, 16 nt, Pseudomonas putida KT2440
guugguggugcgcccg

SEQ ID NO: 3539694 - RNA, 21 nt, Pseudomonas putida KT2440
guugguguccuugucggcgaa

SEQ ID NO: 3539695 - RNA, 19 nt, Pseudomonas putida KT2440
guuguaaacaaagccccgg

SEQ ID NO: 3539696 - RNA, 21 nt, Pseudomonas putida KT2440
guuguaaagaaaagccgcugg

SEQ ID NO: 3539697 - RNA, 23 nt, Pseudomonas putida KT2440
guuguaaagaaaagccgcuggcc

SEQ ID NO: 3539698 - RNA, 23 nt, Pseudomonas putida KT2440
guuguaguucuuggucagcauca

SEQ ID NO: 3539699 - RNA, 23 nt, Pseudomonas putida KT2440
guugucaggcacuaagcgaaaca

SEQ ID NO: 3539700 - RNA, 13 nt, Pseudomonas putida KT2440
guugucauggcua

SEQ ID NO: 3539701 - RNA, 23 nt, Pseudomonas putida KT2440
guuguccaccgcgcaacgcgcca

SEQ ID NO: 3539702 - RNA, 15 nt, Pseudomonas putida KT2440
guugucccgcccuga

SEQ ID NO: 3539703 - RNA, 17 nt, Pseudomonas putida KT2440
guugucccgcccugagc

SEQ ID NO: 3539704 - RNA, 13 nt, Pseudomonas putida KT2440
guugucgcugggu

SEQ ID NO: 3539705 - RNA, 23 nt, Pseudomonas putida KT2440
guugugcacuuucuugacccgcu

SEQ ID NO: 3539706 - RNA, 13 nt, Pseudomonas putida KT2440
guugugcuggccc

SEQ ID NO: 3539707 - RNA, 16 nt, Pseudomonas putida KT2440
guugugcuggcccuuu

SEQ ID NO: 3539708 - RNA, 23 nt, Pseudomonas putida KT2440
guuguggcuggcgucgaugauca

SEQ ID NO: 3539709 - RNA, 17 nt, Pseudomonas putida KT2440
guuguggcuguucaggc

SEQ ID NO: 3539710 - RNA, 15 nt, Pseudomonas putida KT2440
guuguucacggucag

SEQ ID NO: 3539711 - RNA, 13 nt, Pseudomonas putida KT2440
guuguucagcagc

SEQ ID NO: 3539712 - RNA, 14 nt, Pseudomonas putida KT2440
guuguucagcagcg

SEQ ID NO: 3539713 - RNA, 14 nt, Pseudomonas putida KT2440
guuguucgaucagc

SEQ ID NO: 3539714 - RNA, 20 nt, Pseudomonas putida KT2440
guuguucgucgagcaccacg

SEQ ID NO: 3539715 - RNA, 18 nt, Pseudomonas putida KT2440
guuguugggcagccacgc

SEQ ID NO: 3539716 - RNA, 23 nt, Pseudomonas putida KT2440
guuguugggcagccacgcuccag

SEQ ID NO: 3539717 - RNA, 17 nt, Pseudomonas putida KT2440
guuguuguuccaucaug

SEQ ID NO: 3539718 - RNA, 19 nt, Pseudomonas putida KT2440
guuuaaaccgcgaagcagg

SEQ ID NO: 3539719 - RNA, 12 nt, Pseudomonas putida KT2440
guuuaaaccuuc

SEQ ID NO: 3539720 - RNA, 20 nt, Pseudomonas putida KT2440
guuuacccgcgaaagggcca

SEQ ID NO: 3539721 - RNA, 20 nt, Pseudomonas putida KT2440
guuuacccgcgaaagggccg

SEQ ID NO: 3539722 - RNA, 20 nt, Pseudomonas putida KT2440
guuuacccgcgaagaggcca

SEQ ID NO: 3539723 - RNA, 19 nt, Pseudomonas putida KT2440
uaaggaucgcgcagcagcu

SEQ ID NO: 3539724 - RNA, 12 nt, Pseudomonas putida KT2440
uaaggcuggcuu

SEQ ID NO: 3539725 - RNA, 19 nt, Pseudomonas putida KT2440
uaaggcuugcucaaggugu

SEQ ID NO: 3539726 - RNA, 20 nt, Pseudomonas putida KT2440
uaaguuugcccagcgcugca

SEQ ID NO: 3539727 - RNA, 14 nt, Pseudomonas putida KT2440
uaauagucacucag

SEQ ID NO: 3539728 - RNA, 15 nt, Pseudomonas putida KT2440
uaaucaggcugucca

SEQ ID NO: 3539729 - RNA, 19 nt, Pseudomonas putida KT2440
uaaucaggcuguccacacc

SEQ ID NO: 3539730 - RNA, 19 nt, Pseudomonas putida KT2440
uaaucguucugcuugucca

SEQ ID NO: 3539731 - RNA, 20 nt, Pseudomonas putida KT2440
uaaugggcaauguccagccc

SEQ ID NO: 3539732 - RNA, 17 nt, Pseudomonas putida KT2440
uaauuggccggcaggcc

SEQ ID NO: 3539733 - RNA, 18 nt, Pseudomonas putida KT2440
uacaaacggcuuggcugc

SEQ ID NO: 3539734 - RNA, 14 nt, Pseudomonas putida KT2440
uacaaaucaguaag

SEQ ID NO: 3539735 - RNA, 15 nt, Pseudomonas putida KT2440
uacaacaggaacagc

SEQ ID NO: 3539736 - RNA, 16 nt, Pseudomonas putida KT2440
uacaacaggaacagcg

SEQ ID NO: 3539737 - RNA, 18 nt, Pseudomonas putida KT2440
uacaacgcagccggcacc

SEQ ID NO: 3539738 - RNA, 12 nt, Pseudomonas putida KT2440
uacaacugccac

SEQ ID NO: 3539739 - RNA, 16 nt, Pseudomonas putida KT2440
uacaacugccacccuc

SEQ ID NO: 3539740 - RNA, 18 nt, Pseudomonas putida KT2440
uacaacugcuccaggcag

SEQ ID NO: 3539741 - RNA, 16 nt, Pseudomonas putida KT2440
uacaagaucaagcccc

SEQ ID NO: 3539742 - RNA, 14 nt, Pseudomonas putida KT2440
uacaagccggcgcu

SEQ ID NO: 3539743 - RNA, 17 nt, Pseudomonas putida KT2440
uacaagggccugugccg

SEQ ID NO: 3539744 - RNA, 14 nt, Pseudomonas putida KT2440
uacaagggugaagu

SEQ ID NO: 3539745 - RNA, 20 nt, Pseudomonas putida KT2440
uacaauaccgacaaguucau

SEQ ID NO: 3539746 - RNA, 21 nt, Pseudomonas putida KT2440
uacacagcccaaggcuggcca

SEQ ID NO: 3539747 - RNA, 23 nt, Pseudomonas putida KT2440
uacacagcccaaggcuggccaga

SEQ ID NO: 3539748 - RNA, 19 nt, Pseudomonas putida KT2440
uacacaucggucggccccu

SEQ ID NO: 3539749 - RNA, 22 nt, Pseudomonas putida KT2440
uacaccaccgguaggacaaaaa

SEQ ID NO: 3539750 - RNA, 23 nt, Pseudomonas putida KT2440
uacacccccagguuauccacagg

SEQ ID NO: 3539751 - RNA, 18 nt, Pseudomonas putida KT2440
uacaccccgaccaaggcc

SEQ ID NO: 3539752 - RNA, 22 nt, Pseudomonas putida KT2440
uacaccccgaccaaggccaacu

SEQ ID NO: 3539753 - RNA, 11 nt, Pseudomonas putida KT2440
uacaccgccuc

SEQ ID NO: 3539754 - RNA, 20 nt, Pseudomonas putida KT2440
uacaccggcagcaccggcaa

SEQ ID NO: 3539755 - RNA, 22 nt, Pseudomonas putida KT2440
uacacgccuuaguucacccaca

SEQ ID NO: 3539756 - RNA, 14 nt, Pseudomonas putida KT2440
uacacgggacaggc

SEQ ID NO: 3539757 - RNA, 16 nt, Pseudomonas putida KT2440
uacacugcaggagcgg

SEQ ID NO: 3539758 - RNA, 18 nt, Pseudomonas putida KT2440
uacagaccgccgggccca

SEQ ID NO: 3539759 - RNA, 21 nt, Pseudomonas putida KT2440
uacagaugucuggcaucaaug

SEQ ID NO: 3539760 - RNA, 15 nt, Pseudomonas putida KT2440
uacagcacaccuucc

SEQ ID NO: 3539761 - RNA, 20 nt, Pseudomonas putida KT2440
uacagcaccccguccagccc

SEQ ID NO: 3539762 - RNA, 16 nt, Pseudomonas putida KT2440
uacagcagcucacuga

SEQ ID NO: 3539763 - RNA, 13 nt, Pseudomonas putida KT2440
uacagccagaaag

SEQ ID NO: 3539764 - RNA, 14 nt, Pseudomonas putida KT2440
uacagccagaaagc

SEQ ID NO: 3539765 - RNA, 16 nt, Pseudomonas putida KT2440
uacagccagaaagcca

SEQ ID NO: 3539766 - RNA, 12 nt, Pseudomonas putida KT2440
uacagccagcaa

SEQ ID NO: 3539767 - RNA, 16 nt, Pseudomonas putida KT2440
uacagcggccugugca

SEQ ID NO: 3539768 - RNA, 14 nt, Pseudomonas putida KT2440
uacagcucacuggc

SEQ ID NO: 3539769 - RNA, 15 nt, Pseudomonas putida KT2440
uacagcucacuggcc

SEQ ID NO: 3539770 - RNA, 17 nt, Pseudomonas putida KT2440
uacagcucacuggccaa

SEQ ID NO: 3539771 - RNA, 13 nt, Pseudomonas putida KT2440
uacagcucccgcg

SEQ ID NO: 3539772 - RNA, 22 nt, Pseudomonas putida KT2440
uacagcucccgcgcaugcugcc

SEQ ID NO: 3539773 - RNA, 23 nt, Pseudomonas putida KT2440
uacagcucccgcgcaugcugcca

SEQ ID NO: 3539774 - RNA, 14 nt, Pseudomonas putida KT2440
uacagcucgaucuc

SEQ ID NO: 3539775 - RNA, 17 nt, Pseudomonas putida KT2440
uacagcugcucaccaug

SEQ ID NO: 3539776 - RNA, 16 nt, Pseudomonas putida KT2440
uacagcuugccagcgu

SEQ ID NO: 3539777 - RNA, 22 nt, Pseudomonas putida KT2440
uacaggaaucugucagccuuuc

SEQ ID NO: 3539778 - RNA, 17 nt, Pseudomonas putida KT2440
uacaggauggccgcagg

SEQ ID NO: 3539779 - RNA, 16 nt, Pseudomonas putida KT2440
uacaggcaaccgcauc

SEQ ID NO: 3539780 - RNA, 19 nt, Pseudomonas putida KT2440
uacaggccccacaacggcc

SEQ ID NO: 3539781 - RNA, 23 nt, Pseudomonas putida KT2440
uacaggcgcgugugcagguggau

SEQ ID NO: 3539782 - RNA, 14 nt, Pseudomonas putida KT2440
uacagggguagcgu

SEQ ID NO: 3539783 - RNA, 22 nt, Pseudomonas putida KT2440
uacagguucuugcggugcaugc

SEQ ID NO: 3539784 - RNA, 13 nt, Pseudomonas putida KT2440
uacagguugcggc

SEQ ID NO: 3539785 - RNA, 20 nt, Pseudomonas putida KT2440
uacauccagcuccagcacca

SEQ ID NO: 3539786 - RNA, 23 nt, Pseudomonas putida KT2440
uacaugaucggguucuuccaagu

SEQ ID NO: 3539787 - RNA, 16 nt, Pseudomonas putida KT2440
uacaugcgaacgcagg

SEQ ID NO: 3539788 - RNA, 21 nt, Pseudomonas putida KT2440
uacaugcgaacgcaggcgcga

SEQ ID NO: 3539789 - RNA, 15 nt, Pseudomonas putida KT2440
uacauggaucgcauu

SEQ ID NO: 3539790 - RNA, 19 nt, Pseudomonas putida KT2440
uacauguuggucagcgccu

SEQ ID NO: 3539791 - RNA, 14 nt, Pseudomonas putida KT2440
uaccaacgcagcau

SEQ ID NO: 3539792 - RNA, 15 nt, Pseudomonas putida KT2440
uaccaacgcagcaug

SEQ ID NO: 3539793 - RNA, 23 nt, Pseudomonas putida KT2440
uaccaccgcauccgcaccccaag

SEQ ID NO: 3539794 - RNA, 15 nt, Pseudomonas putida KT2440
uaccaccugggcgcu

SEQ ID NO: 3539795 - RNA, 16 nt, Pseudomonas putida KT2440
uaccacgccgcugcca

SEQ ID NO: 3539796 - RNA, 20 nt, Pseudomonas putida KT2440
uaccacguuauccagcugca

SEQ ID NO: 3539797 - RNA, 16 nt, Pseudomonas putida KT2440
uaccagacgcaggcaa

SEQ ID NO: 3539798 - RNA, 13 nt, Pseudomonas putida KT2440
uaccagagagcug

SEQ ID NO: 3539799 - RNA, 23 nt, Pseudomonas putida KT2440
uaccagcaccaucagagcgccag

SEQ ID NO: 3539800 - RNA, 19 nt, Pseudomonas putida KT2440
uaccagcgccccgccgcau

SEQ ID NO: 3539801 - RNA, 20 nt, Pseudomonas putida KT2440
uaccagcuugugaucccgcg

SEQ ID NO: 3539802 - RNA, 17 nt, Pseudomonas putida KT2440
uaccauccaucaccaug

SEQ ID NO: 3539803 - RNA, 19 nt, Pseudomonas putida KT2440
uaccauccaucaccauggc

SEQ ID NO: 3539804 - RNA, 23 nt, Pseudomonas putida KT2440
uaccaugaaaaacaacaaccaau

SEQ ID NO: 3539805 - RNA, 14 nt, Pseudomonas putida KT2440
uaccauuuuccuuu

SEQ ID NO: 3539806 - RNA, 15 nt, Pseudomonas putida KT2440
uacccaacagaccac

SEQ ID NO: 3539807 - RNA, 12 nt, Pseudomonas putida KT2440
uacccaagcaca

SEQ ID NO: 3539808 - RNA, 13 nt, Pseudomonas putida KT2440
uacccaauaaaaa

SEQ ID NO: 3539809 - RNA, 23 nt, Pseudomonas putida KT2440
uacccaccagauucgccaaggcc

SEQ ID NO: 3539810 - RNA, 23 nt, Pseudomonas putida KT2440
uacccacgccauguaccgggcgg

SEQ ID NO: 3539811 - RNA, 16 nt, Pseudomonas putida KT2440
uacccaggugaugcag

SEQ ID NO: 3539812 - RNA, 19 nt, Pseudomonas putida KT2440
uacccaggugaugcaggca

SEQ ID NO: 3539813 - RNA, 20 nt, Pseudomonas putida KT2440
uacccaggugaugcaggcaa

SEQ ID NO: 3539814 - RNA, 18 nt, Pseudomonas putida KT2440
uaccccacaaccccugca

SEQ ID NO: 3539815 - RNA, 12 nt, Pseudomonas putida KT2440
uaccccaggcaa

SEQ ID NO: 3539816 - RNA, 17 nt, Pseudomonas putida KT2440
uaccccaggcaaaaaaa

SEQ ID NO: 3539817 - RNA, 15 nt, Pseudomonas putida KT2440
uaccccccugcacca

SEQ ID NO: 3539818 - RNA, 15 nt, Pseudomonas putida KT2440
uaccccgaugcgcug

SEQ ID NO: 3539819 - RNA, 22 nt, Pseudomonas putida KT2440
uaccccguugcgcagcagcagg

SEQ ID NO: 3539820 - RNA, 23 nt, Pseudomonas putida KT2440
uaccccuccggccccggugcauc

SEQ ID NO: 3539821 - RNA, 23 nt, Pseudomonas putida KT2440
uaccccuccugaccaacuuuuca

SEQ ID NO: 3539822 - RNA, 23 nt, Pseudomonas putida KT2440
uaccccucgacgccuuggcgcag

SEQ ID NO: 3539823 - RNA, 21 nt, Pseudomonas putida KT2440
uaccccugcgccuguuuucca

SEQ ID NO: 3539824 - RNA, 22 nt, Pseudomonas putida KT2440
uacccgcgaaagggccgggccu

SEQ ID NO: 3539825 - RNA, 20 nt, Pseudomonas putida KT2440
uacccgcgaagaggccggca

SEQ ID NO: 3539826 - RNA, 20 nt, Pseudomonas putida KT2440
uacccgcgaaugggccgcca

SEQ ID NO: 3539827 - RNA, 20 nt, Pseudomonas putida KT2440
uacccgcguuggcagcacca

SEQ ID NO: 3539828 - RNA, 20 nt, Pseudomonas putida KT2440
uacucggccagguacucgcg

SEQ ID NO: 3539829 - RNA, 19 nt, Pseudomonas putida KT2440
uacucggccgggcguagca

SEQ ID NO: 3539830 - RNA, 19 nt, Pseudomonas putida KT2440
uacucggcgcucaagcgug

SEQ ID NO: 3539831 - RNA, 22 nt, Pseudomonas putida KT2440
uacucggcuacgaaccgagcgg

SEQ ID NO: 3539832 - RNA, 15 nt, Pseudomonas putida KT2440
uacucuucgcgggcu

SEQ ID NO: 3539833 - RNA, 18 nt, Pseudomonas putida KT2440
uacugagucggccucgau

SEQ ID NO: 3539834 - RNA, 19 nt, Pseudomonas putida KT2440
uacugcagaacauggccga

SEQ ID NO: 3539835 - RNA, 20 nt, Pseudomonas putida KT2440
uacugcagaacauggccgag

SEQ ID NO: 3539836 - RNA, 17 nt, Pseudomonas putida KT2440
uacugcugggucagcac

SEQ ID NO: 3539837 - RNA, 15 nt, Pseudomonas putida KT2440
uacugcuucaugaag

SEQ ID NO: 3539838 - RNA, 22 nt, Pseudomonas putida KT2440
uacugcuucaugaagucagcca

SEQ ID NO: 3539839 - RNA, 18 nt, Pseudomonas putida KT2440
uacuggaagagcaggaag

SEQ ID NO: 3539840 - RNA, 18 nt, Pseudomonas putida KT2440
uacuggccaauugcgcca

SEQ ID NO: 3539841 - RNA, 23 nt, Pseudomonas putida KT2440
uacuggccaauugcgccaucaga

SEQ ID NO: 3539842 - RNA, 15 nt, Pseudomonas putida KT2440
uacuggccauccagu

SEQ ID NO: 3539843 - RNA, 23 nt, Pseudomonas putida KT2440
uacuggcuucgaugaaggcugcu

SEQ ID NO: 3539844 - RNA, 19 nt, Pseudomonas putida KT2440
uacuggucgcgugccgcca

SEQ ID NO: 3539845 - RNA, 14 nt, Pseudomonas putida KT2440
uacuuauaagcagc

SEQ ID NO: 3539846 - RNA, 16 nt, Pseudomonas putida KT2440
uacuuauaagcagcaa

SEQ ID NO: 3539847 - RNA, 13 nt, Pseudomonas putida KT2440
uacuugcugcagg

SEQ ID NO: 3539848 - RNA, 17 nt, Pseudomonas putida KT2440
uacuuggcaguaccugc

SEQ ID NO: 3539849 - RNA, 18 nt, Pseudomonas putida KT2440
uacuuggccaucagcugu

SEQ ID NO: 3539850 - RNA, 16 nt, Pseudomonas putida KT2440
uacuuggccugggcuu

SEQ ID NO: 3539851 - RNA, 15 nt, Pseudomonas putida KT2440
uagaaaguccaucug

SEQ ID NO: 3539852 - RNA, 17 nt, Pseudomonas putida KT2440
uagaaaguccaucugcu

SEQ ID NO: 3539853 - RNA, 18 nt, Pseudomonas putida KT2440
uagaaaguccaucugcuu

SEQ ID NO: 3539854 - RNA, 19 nt, Pseudomonas putida KT2440
uagaacaagucgcgcacca

SEQ ID NO: 3539855 - RNA, 21 nt, Pseudomonas putida KT2440
uagaacagauccaucggcguc

SEQ ID NO: 3539856 - RNA, 24 nt, Pseudomonas putida KT2440
uagaacagauccaucggcgucgcu

SEQ ID NO: 3539857 - RNA, 14 nt, Pseudomonas putida KT2440
uagaaccacuccag

SEQ ID NO: 3539858 - RNA, 15 nt, Pseudomonas putida KT2440
uagaacggcagcagg

SEQ ID NO: 3539859 - RNA, 15 nt, Pseudomonas putida KT2440
uagaacuccaccagc

SEQ ID NO: 3539860 - RNA, 16 nt, Pseudomonas putida KT2440
uagaacuccaccagcc

SEQ ID NO: 3539861 - RNA, 15 nt, Pseudomonas putida KT2440
uagaacucggcgagc

SEQ ID NO: 3539862 - RNA, 22 nt, Pseudomonas putida KT2440
gccuugcaggaagcggcgcuuu

SEQ ID NO: 3539863 - RNA, 15 nt, Pseudomonas putida KT2440
gccuugccaacggca

SEQ ID NO: 3539864 - RNA, 20 nt, Pseudomonas putida KT2440
gccuugccaacggcacucga

SEQ ID NO: 3539865 - RNA, 15 nt, Pseudomonas putida KT2440
gccuugcccagcucc

SEQ ID NO: 3539866 - RNA, 22 nt, Pseudomonas putida KT2440
gccuugcccagcuccagcaccu

SEQ ID NO: 3539867 - RNA, 14 nt, Pseudomonas putida KT2440
gccuugcccugcag

SEQ ID NO: 3539868 - RNA, 16 nt, Pseudomonas putida KT2440
gccuugcgagccuggg

SEQ ID NO: 3539869 - RNA, 22 nt, Pseudomonas putida KT2440
gccuugcgcucgacgcgcgcag

SEQ ID NO: 3539870 - RNA, 13 nt, Pseudomonas putida KT2440
gccuugcggcaag

SEQ ID NO: 3539871 - RNA, 16 nt, Pseudomonas putida KT2440
gccuugcggccccgga

SEQ ID NO: 3539872 - RNA, 20 nt, Pseudomonas putida KT2440
gccuugcucguguuagcugg

SEQ ID NO: 3539873 - RNA, 14 nt, Pseudomonas putida KT2440
gccuugcuuggcag

SEQ ID NO: 3539874 - RNA, 15 nt, Pseudomonas putida KT2440
gccuugcuuggcagc

SEQ ID NO: 3539875 - RNA, 18 nt, Pseudomonas putida KT2440
gccuugcuuggcagcggc

SEQ ID NO: 3539876 - RNA, 19 nt, Pseudomonas putida KT2440
gccuugcuuggcagcggcu

SEQ ID NO: 3539877 - RNA, 23 nt, Pseudomonas putida KT2440
gccuugcuuggcagcggcuggcg

SEQ ID NO: 3539878 - RNA, 17 nt, Pseudomonas putida KT2440
gccuuggagcgcgcccc

SEQ ID NO: 3539879 - RNA, 16 nt, Pseudomonas putida KT2440
gccuuggccgcuggcc

SEQ ID NO: 3539880 - RNA, 20 nt, Pseudomonas putida KT2440
gccuuggccgcuggcccuuc

SEQ ID NO: 3539881 - RNA, 18 nt, Pseudomonas putida KT2440
gccuuggccuggcgaguc

SEQ ID NO: 3539882 - RNA, 14 nt, Pseudomonas putida KT2440
gccuuggcgcagca

SEQ ID NO: 3539883 - RNA, 15 nt, Pseudomonas putida KT2440
gccuuggcuacgcaa

SEQ ID NO: 3539884 - RNA, 22 nt, Pseudomonas putida KT2440
gccuugggcaacaccgccagaa

SEQ ID NO: 3539885 - RNA, 20 nt, Pseudomonas putida KT2440
gccuuguaauacggcgccga

SEQ ID NO: 3539886 - RNA, 22 nt, Pseudomonas putida KT2440
gccuugucagcagcuucagcca

SEQ ID NO: 3539887 - RNA, 15 nt, Pseudomonas putida KT2440
gccuugucggcacgc

SEQ ID NO: 3539888 - RNA, 17 nt, Pseudomonas putida KT2440
gccuugucggcacgcgc

SEQ ID NO: 3539889 - RNA, 20 nt, Pseudomonas putida KT2440
gccuugugcggcccaaucgc

SEQ ID NO: 3539890 - RNA, 14 nt, Pseudomonas putida KT2440
gccuugugggagcg

SEQ ID NO: 3539891 - RNA, 17 nt, Pseudomonas putida KT2440
gccuugugggagcggga

SEQ ID NO: 3539892 - RNA, 20 nt, Pseudomonas putida KT2440
gccuuguuccacgcgcaggc

SEQ ID NO: 3539893 - RNA, 16 nt, Pseudomonas putida KT2440
gccuuuacgcccggga

SEQ ID NO: 3539894 - RNA, 20 nt, Pseudomonas putida KT2440
gccuuuccgcacucagguga

SEQ ID NO: 3539895 - RNA, 13 nt, Pseudomonas putida KT2440
gccuuucugcucg

SEQ ID NO: 3539896 - RNA, 20 nt, Pseudomonas putida KT2440
gccuuucugcuucgcugcca

SEQ ID NO: 3539897 - RNA, 16 nt, Pseudomonas putida KT2440
gccuuucuuaugccug

SEQ ID NO: 3539898 - RNA, 17 nt, Pseudomonas putida KT2440
gccuuugaaaccggcaa

SEQ ID NO: 3539899 - RNA, 22 nt, Pseudomonas putida KT2440
gccuuugauuacuugacgauga

SEQ ID NO: 3539900 - RNA, 22 nt, Pseudomonas putida KT2440
gccuuugccccugaucauccac

SEQ ID NO: 3539901 - RNA, 13 nt, Pseudomonas putida KT2440
gccuuugcgccuu

SEQ ID NO: 3539902 - RNA, 17 nt, Pseudomonas putida KT2440
gccuuugugcuuucugg

SEQ ID NO: 3539903 - RNA, 22 nt, Pseudomonas putida KT2440
gccuuuucacacauaucagcca

SEQ ID NO: 3539904 - RNA, 18 nt, Pseudomonas putida KT2440
gccuuuuccaccagcccu

SEQ ID NO: 3539905 - RNA, 12 nt, Pseudomonas putida KT2440
gccuuuucgcgg

SEQ ID NO: 3539906 - RNA, 14 nt, Pseudomonas putida KT2440
gccuuuuucguugg

SEQ ID NO: 3539907 - RNA, 23 nt, Pseudomonas putida KT2440
gcgaaaaacagcaguuugcugcg

SEQ ID NO: 3539908 - RNA, 19 nt, Pseudomonas putida KT2440
gcgaaaaccccggcucggu

SEQ ID NO: 3539909 - RNA, 21 nt, Pseudomonas putida KT2440
gcgaaaagccugcaccaguuc

SEQ ID NO: 3539910 - RNA, 16 nt, Pseudomonas putida KT2440
gcgaaacacagcaggc

SEQ ID NO: 3539911 - RNA, 18 nt, Pseudomonas putida KT2440
gcgaaacacagcaggcca

SEQ ID NO: 3539912 - RNA, 20 nt, Pseudomonas putida KT2440
gcgaaacacagcaggccaag

SEQ ID NO: 3539913 - RNA, 14 nt, Pseudomonas putida KT2440
gcgaaacaccagca

SEQ ID NO: 3539914 - RNA, 17 nt, Pseudomonas putida KT2440
gcgaaacaccagcaaca

SEQ ID NO: 3539915 - RNA, 22 nt, Pseudomonas putida KT2440
gcgaaagcaagguagcggcggc

SEQ ID NO: 3539916 - RNA, 13 nt, Pseudomonas putida KT2440
gcgaaagccagca

SEQ ID NO: 3539917 - RNA, 15 nt, Pseudomonas putida KT2440
gcgaaagccagcagu

SEQ ID NO: 3539918 - RNA, 13 nt, Pseudomonas putida KT2440
gcgaaaggcgcuc

SEQ ID NO: 3539919 - RNA, 16 nt, Pseudomonas putida KT2440
gcgaaagggccagcac

SEQ ID NO: 3539920 - RNA, 17 nt, Pseudomonas putida KT2440
gcgaaagggccggcccu

SEQ ID NO: 3539921 - RNA, 16 nt, Pseudomonas putida KT2440
gcgaaagggccgggcc

SEQ ID NO: 3539922 - RNA, 19 nt, Pseudomonas putida KT2440
gcgaaagggccgggccugc

SEQ ID NO: 3539923 - RNA, 23 nt, Pseudomonas putida KT2440
gcgaaaugauccccggcgacggc

SEQ ID NO: 3539924 - RNA, 17 nt, Pseudomonas putida KT2440
gcgaaauggcgaaucag

SEQ ID NO: 3539925 - RNA, 13 nt, Pseudomonas putida KT2440
gcgaacacagcgg

SEQ ID NO: 3539926 - RNA, 16 nt, Pseudomonas putida KT2440
gcgaacacagcggccu

SEQ ID NO: 3539927 - RNA, 21 nt, Pseudomonas putida KT2440
gcgaacaccggcagagccggu

SEQ ID NO: 3539928 - RNA, 23 nt, Pseudomonas putida KT2440
gcgaacaccggcagagccggugc

SEQ ID NO: 3539929 - RNA, 22 nt, Pseudomonas putida KT2440
gcgaacacgaaaaagccagcgu

SEQ ID NO: 3539930 - RNA, 14 nt, Pseudomonas putida KT2440
gcgaacagcacugc

SEQ ID NO: 3539931 - RNA, 15 nt, Pseudomonas putida KT2440
gcgaacagcacugcc

SEQ ID NO: 3539932 - RNA, 19 nt, Pseudomonas putida KT2440
gcgaacaggcccugacagg

SEQ ID NO: 3539933 - RNA, 16 nt, Pseudomonas putida KT2440
gcgaacaucugcucgg

SEQ ID NO: 3539934 - RNA, 14 nt, Pseudomonas putida KT2440
gcgaaccccaguug

SEQ ID NO: 3539935 - RNA, 17 nt, Pseudomonas putida KT2440
gcgaacggacaacaccg

SEQ ID NO: 3539936 - RNA, 16 nt, Pseudomonas putida KT2440
gcgaacugcagagccu

SEQ ID NO: 3539937 - RNA, 16 nt, Pseudomonas putida KT2440
gcgaacuguacugacu

SEQ ID NO: 3539938 - RNA, 22 nt, Pseudomonas putida KT2440
gcgaagaagccggcaucgccaa

SEQ ID NO: 3539939 - RNA, 16 nt, Pseudomonas putida KT2440
gcgaagaccgccgccc

SEQ ID NO: 3539940 - RNA, 19 nt, Pseudomonas putida KT2440
gcgaagacggcagaucagg

SEQ ID NO: 3539941 - RNA, 14 nt, Pseudomonas putida KT2440
gcgaagaggccagc

SEQ ID NO: 3539942 - RNA, 19 nt, Pseudomonas putida KT2440
gcgaagaggcccgaacaga

SEQ ID NO: 3539943 - RNA, 17 nt, Pseudomonas putida KT2440
gcgaagaggccggcacu

SEQ ID NO: 3539944 - RNA, 19 nt, Pseudomonas putida KT2440
gcgaagagggcgacaccgg

SEQ ID NO: 3539945 - RNA, 14 nt, Pseudomonas putida KT2440
gcgaagcagccacc

SEQ ID NO: 3539946 - RNA, 17 nt, Pseudomonas putida KT2440
gcgaagcaggcgacgca

SEQ ID NO: 3539947 - RNA, 13 nt, Pseudomonas putida KT2440
gcgaagcaggcug

SEQ ID NO: 3539948 - RNA, 15 nt, Pseudomonas putida KT2440
gcgaagcaggcugcg

SEQ ID NO: 3539949 - RNA, 22 nt, Pseudomonas putida KT2440
gcgaagcccaguucgcgggcaa

SEQ ID NO: 3539950 - RNA, 17 nt, Pseudomonas putida KT2440
gcgaagcggccaaccgc

SEQ ID NO: 3539951 - RNA, 14 nt, Pseudomonas putida KT2440
gcgaaggcugccug

SEQ ID NO: 3539952 - RNA, 17 nt, Pseudomonas putida KT2440
gcgaagggcugccgcgc

SEQ ID NO: 3539953 - RNA, 17 nt, Pseudomonas putida KT2440
gcgaaggggccggcaca

SEQ ID NO: 3539954 - RNA, 20 nt, Pseudomonas putida KT2440
gcgaaggggccggcccugcc

SEQ ID NO: 3539955 - RNA, 16 nt, Pseudomonas putida KT2440
gcgaagguaaccuggu

SEQ ID NO: 3539956 - RNA, 21 nt, Pseudomonas putida KT2440
gcgaagucacaccaucggccg

SEQ ID NO: 3539957 - RNA, 20 nt, Pseudomonas putida KT2440
gcgaaguugaagcgccggua

SEQ ID NO: 3539958 - RNA, 20 nt, Pseudomonas putida KT2440
gcgaauacgagggugaaccc

SEQ ID NO: 3539959 - RNA, 20 nt, Pseudomonas putida KT2440
gcgaauacgauagcggcggc

SEQ ID NO: 3539960 - RNA, 21 nt, Pseudomonas putida KT2440
gcgaauacgguagcggcggca

SEQ ID NO: 3539961 - RNA, 17 nt, Pseudomonas putida KT2440
gcgaauacgguaguggc

SEQ ID NO: 3539962 - RNA, 14 nt, Pseudomonas putida KT2440
gcgaauagcaacac

SEQ ID NO: 3539963 - RNA, 16 nt, Pseudomonas putida KT2440
gcgaauagcaacacau

SEQ ID NO: 3539964 - RNA, 21 nt, Pseudomonas putida KT2440
gcgaauaguagaagcagauca

SEQ ID NO: 3539965 - RNA, 14 nt, Pseudomonas putida KT2440
gcgaaucagcaugc

SEQ ID NO: 3539966 - RNA, 22 nt, Pseudomonas putida KT2440
gcgaaucagcgccuccagggcg

SEQ ID NO: 3539967 - RNA, 17 nt, Pseudomonas putida KT2440
gcgaggaggccggggau

SEQ ID NO: 3539968 - RNA, 18 nt, Pseudomonas putida KT2440
gcgaggcaaucagggcau

SEQ ID NO: 3539969 - RNA, 12 nt, Pseudomonas putida KT2440
gcgaggccccag

SEQ ID NO: 3539970 - RNA, 21 nt, Pseudomonas putida KT2440
gcgaggcccgaacuggccggu

SEQ ID NO: 3539971 - RNA, 15 nt, Pseudomonas putida KT2440
gcgaggcgggccgca

SEQ ID NO: 3539972 - RNA, 13 nt, Pseudomonas putida KT2440
gcgaggcucuuga

SEQ ID NO: 3539973 - RNA, 14 nt, Pseudomonas putida KT2440
gcgagguacggcaa

SEQ ID NO: 3539974 - RNA, 21 nt, Pseudomonas putida KT2440
gcgagguacggcaagguacug

SEQ ID NO: 3539975 - RNA, 16 nt, Pseudomonas putida KT2440
gcgagguagcugucgg

SEQ ID NO: 3539976 - RNA, 19 nt, Pseudomonas putida KT2440
gcgagguaggccgucagca

SEQ ID NO: 3539977 - RNA, 23 nt, Pseudomonas putida KT2440
gcgagguaggccgucagcagcag

SEQ ID NO: 3539978 - RNA, 17 nt, Pseudomonas putida KT2440
gcgaguaaagccagcag

SEQ ID NO: 3539979 - RNA, 18 nt, Pseudomonas putida KT2440
gcgaguagaucaucagcg

SEQ ID NO: 3539980 - RNA, 21 nt, Pseudomonas putida KT2440
gcgaguagaucaucagcgcca

SEQ ID NO: 3539981 - RNA, 11 nt, Pseudomonas putida KT2440
gcgaguauccu

SEQ ID NO: 3539982 - RNA, 17 nt, Pseudomonas putida KT2440
gcgaguauccuccagcc

SEQ ID NO: 3539983 - RNA, 19 nt, Pseudomonas putida KT2440
gcgaguauccuccagcccu

SEQ ID NO: 3539984 - RNA, 20 nt, Pseudomonas putida KT2440
gcgagucgaucgacacaccg

SEQ ID NO: 3539985 - RNA, 14 nt, Pseudomonas putida KT2440
gcgagugaugcggu

SEQ ID NO: 3539986 - RNA, 16 nt, Pseudomonas putida KT2440
gcgauaaaccagcagc

SEQ ID NO: 3539987 - RNA, 20 nt, Pseudomonas putida KT2440
gcgauaaaccagcagcgccu

SEQ ID NO: 3539988 - RNA, 20 nt, Pseudomonas putida KT2440
gcgauaaugggucaacggcu

SEQ ID NO: 3539989 - RNA, 23 nt, Pseudomonas putida KT2440
gcgauaccccgcugccugcgcuu

SEQ ID NO: 3539990 - RNA, 16 nt, Pseudomonas putida KT2440
gcgauacgccgacagc

SEQ ID NO: 3539991 - RNA, 19 nt, Pseudomonas putida KT2440
gcgauagaacuccaccagc

SEQ ID NO: 3539992 - RNA, 22 nt, Pseudomonas putida KT2440
gcgauagaacuccaccagccca

SEQ ID NO: 3539993 - RNA, 22 nt, Pseudomonas putida KT2440
gcgauagccuguggggcaacug

SEQ ID NO: 3539994 - RNA, 16 nt, Pseudomonas putida KT2440
gcgauagggaucaccu

SEQ ID NO: 3539995 - RNA, 18 nt, Pseudomonas putida KT2440
gcgauaucagcgccagca

SEQ ID NO: 3539996 - RNA, 18 nt, Pseudomonas putida KT2440
gcgaucaacgcaggcuca

SEQ ID NO: 3539997 - RNA, 13 nt, Pseudomonas putida KT2440
gcgaucaccagcc

SEQ ID NO: 3539998 - RNA, 15 nt, Pseudomonas putida KT2440
gcgaucacgcaggcc

SEQ ID NO: 3539999 - RNA, 16 nt, Pseudomonas putida KT2440
gcgaucacgcaggccc

SEQ ID NO: 3540000 - RNA, 16 nt, Pseudomonas putida KT2440
gcgaucagcgcgguga

SEQ ID NO: 3540001 - RNA, 22 nt, Pseudomonas putida KT2440
gcgaucagcgcggugaccagcg

SEQ ID NO: 3540002 - RNA, 19 nt, Pseudomonas putida KT2440
gcgaucaggcaggccagca

SEQ ID NO: 3540003 - RNA, 13 nt, Pseudomonas putida KT2440
gcgaucagggugu

SEQ ID NO: 3540004 - RNA, 21 nt, Pseudomonas putida KT2440
gcgauccaucuucaccuugcc

SEQ ID NO: 3540005 - RNA, 17 nt, Pseudomonas putida KT2440
gcgauccgccccauagc

SEQ ID NO: 3540006 - RNA, 22 nt, Pseudomonas putida KT2440
gcgaucgaugaacucacccgcc

SEQ ID NO: 3540007 - RNA, 22 nt, Pseudomonas putida KT2440
gcgaucggcagcgaucagcgca

SEQ ID NO: 3540008 - RNA, 17 nt, Pseudomonas putida KT2440
gcgaucggcuuucauug

SEQ ID NO: 3540009 - RNA, 17 nt, Pseudomonas putida KT2440
gcgaucuggucgaagcu

SEQ ID NO: 3540010 - RNA, 20 nt, Pseudomonas putida KT2440
gcgaugaaagccuaaaggca

SEQ ID NO: 3540011 - RNA, 22 nt, Pseudomonas putida KT2440
gcgaugaagacgcucgacagca

SEQ ID NO: 3540012 - RNA, 16 nt, Pseudomonas putida KT2440
gcgaugacccggccuu

SEQ ID NO: 3540013 - RNA, 19 nt, Pseudomonas putida KT2440
gcgaugaucgagccgauca

SEQ ID NO: 3540014 - RNA, 20 nt, Pseudomonas putida KT2440
gcgaugaucgagccgaucag

SEQ ID NO: 3540015 - RNA, 13 nt, Pseudomonas putida KT2440
gcgaugaucgccu

SEQ ID NO: 3540016 - RNA, 14 nt, Pseudomonas putida KT2440
gcgaugaucgccug

SEQ ID NO: 3540017 - RNA, 22 nt, Pseudomonas putida KT2440
gcgaugaucgccuggccggccg

SEQ ID NO: 3540018 - RNA, 11 nt, Pseudomonas putida KT2440
gcgaugaugau

SEQ ID NO: 3540019 - RNA, 21 nt, Pseudomonas putida KT2440
gcgaugaugauaccgaacagc

SEQ ID NO: 3540020 - RNA, 22 nt, Pseudomonas putida KT2440
gcgaugaugauaccgaacagca

SEQ ID NO: 3540021 - RNA, 18 nt, Pseudomonas putida KT2440
gcgaugaugugcgccggc

SEQ ID NO: 3540022 - RNA, 13 nt, Pseudomonas putida KT2440
gcgaugcacgcca

SEQ ID NO: 3540023 - RNA, 22 nt, Pseudomonas putida KT2440
gcgaugcacgccagcaucaccc

SEQ ID NO: 3540024 - RNA, 22 nt, Pseudomonas putida KT2440
gcgaugcgcacaccgcuggugg

SEQ ID NO: 3540025 - RNA, 14 nt, Pseudomonas putida KT2440
gcgaugcgccgcgc

SEQ ID NO: 3540026 - RNA, 19 nt, Pseudomonas putida KT2440
gcgaugcgccgcgcgggcg

SEQ ID NO: 3540027 - RNA, 23 nt, Pseudomonas putida KT2440
gcgaugcgccgcgcgggcggcgc

SEQ ID NO: 3540028 - RNA, 14 nt, Pseudomonas putida KT2440
gcgaugcgcuggca

SEQ ID NO: 3540029 - RNA, 19 nt, Pseudomonas putida KT2440
gcgaugcgguugcaggacu

SEQ ID NO: 3540030 - RNA, 13 nt, Pseudomonas putida KT2440
gcgaugcugucgg

SEQ ID NO: 3540031 - RNA, 16 nt, Pseudomonas putida KT2440
gcgauggauggcaccg

SEQ ID NO: 3540032 - RNA, 19 nt, Pseudomonas putida KT2440
gcgauggcggaucagcgcg

SEQ ID NO: 3540033 - RNA, 23 nt, Pseudomonas putida KT2440
gcgauggcggaucagcgcgucca

SEQ ID NO: 3540034 - RNA, 14 nt, Pseudomonas putida KT2440
gcgauggcguccuu

SEQ ID NO: 3540035 - RNA, 14 nt, Pseudomonas putida KT2440
gcgauggcgucgac

SEQ ID NO: 3540036 - RNA, 13 nt, Pseudomonas putida KT2440
gcgaugggcugca

SEQ ID NO: 3540037 - RNA, 18 nt, Pseudomonas putida KT2440
gcgaugggcugcaaagca

SEQ ID NO: 3540038 - RNA, 18 nt, Pseudomonas putida KT2440
gcgauggucugcuccagu

SEQ ID NO: 3540039 - RNA, 17 nt, Pseudomonas putida KT2440
gcgauguaucagcgccu

SEQ ID NO: 3540040 - RNA, 14 nt, Pseudomonas putida KT2440
gcgauguugaucag

SEQ ID NO: 3540041 - RNA, 21 nt, Pseudomonas putida KT2440
gcgauguuggccgagucggug

SEQ ID NO: 3540042 - RNA, 17 nt, Pseudomonas putida KT2440
gcgauugaucagcgccu

SEQ ID NO: 3540043 - RNA, 16 nt, Pseudomonas putida KT2440
gcgauugcccagcguu

SEQ ID NO: 3540044 - RNA, 22 nt, Pseudomonas putida KT2440
gcgauugcccagcguucggguc

SEQ ID NO: 3540045 - RNA, 13 nt, Pseudomonas putida KT2440
gcgauugcggccu

SEQ ID NO: 3540046 - RNA, 21 nt, Pseudomonas putida KT2440
gcgauugcggccuagcaaggc

SEQ ID NO: 3540047 - RNA, 18 nt, Pseudomonas putida KT2440
gcgcaaaaaacgccgcaa

SEQ ID NO: 3540048 - RNA, 19 nt, Pseudomonas putida KT2440
gcgcaaaaccaccagccgu

SEQ ID NO: 3540049 - RNA, 19 nt, Pseudomonas putida KT2440
gcgcaaacugauucacgcc

SEQ ID NO: 3540050 - RNA, 21 nt, Pseudomonas putida KT2440
gcgcaaacugauucacgcccu

SEQ ID NO: 3540051 - RNA, 22 nt, Pseudomonas putida KT2440
gcgcaaacugauucacgcccuu

SEQ ID NO: 3540052 - RNA, 13 nt, Pseudomonas putida KT2440
gcgcaaaggcggg

SEQ ID NO: 3540053 - RNA, 19 nt, Pseudomonas putida KT2440
gcgcaaaggcuuuggccgu

SEQ ID NO: 3540054 - RNA, 22 nt, Pseudomonas putida KT2440
gcgcaaaggcuuuggccguagc

SEQ ID NO: 3540055 - RNA, 14 nt, Pseudomonas putida KT2440
gcgcaaaucgccaa

SEQ ID NO: 3540056 - RNA, 14 nt, Pseudomonas putida KT2440
gcgcaaaucgccgc

SEQ ID NO: 3540057 - RNA, 21 nt, Pseudomonas putida KT2440
gcgcaaaucuuguaggcgcgg

SEQ ID NO: 3540058 - RNA, 21 nt, Pseudomonas putida KT2440
gcgcaacaaggccaaccacgc

SEQ ID NO: 3540059 - RNA, 14 nt, Pseudomonas putida KT2440
gcgcaacaccgcca

SEQ ID NO: 3540060 - RNA, 15 nt, Pseudomonas putida KT2440
gcgcaacagugcccc

SEQ ID NO: 3540061 - RNA, 17 nt, Pseudomonas putida KT2440
gcgcaacagugccccuu

SEQ ID NO: 3540062 - RNA, 15 nt, Pseudomonas putida KT2440
gcgcaaccgauagcg

SEQ ID NO: 3540063 - RNA, 14 nt, Pseudomonas putida KT2440
gcgcaacgcgccau

SEQ ID NO: 3540064 - RNA, 14 nt, Pseudomonas putida KT2440
gcgcaacugcccag

SEQ ID NO: 3540065 - RNA, 14 nt, Pseudomonas putida KT2440
gcgcaagcaggugc

SEQ ID NO: 3540066 - RNA, 13 nt, Pseudomonas putida KT2440
gcgcaagccgggu

SEQ ID NO: 3540067 - RNA, 17 nt, Pseudomonas putida KT2440
gcgcaagccgugccugg

SEQ ID NO: 3540068 - RNA, 14 nt, Pseudomonas putida KT2440
gcgcaagccuuugc

SEQ ID NO: 3540069 - RNA, 19 nt, Pseudomonas putida KT2440
gcgcaagcgguugcccgcu

SEQ ID NO: 3540070 - RNA, 19 nt, Pseudomonas putida KT2440
gcgcaaggacgacguggua

SEQ ID NO: 3540071 - RNA, 14 nt, Pseudomonas putida KT2440
gcgcaaggcauuca

SEQ ID NO: 3540072 - RNA, 22 nt, Pseudomonas putida KT2440
gcgcagggugccggccagcggc

SEQ ID NO: 3540073 - RNA, 20 nt, Pseudomonas putida KT2440
gcgcagggugucgguggcgg

SEQ ID NO: 3540074 - RNA, 21 nt, Pseudomonas putida KT2440
gcgcagggugucgguggcggc

SEQ ID NO: 3540075 - RNA, 19 nt, Pseudomonas putida KT2440
gcgcagggugugcugcugc

SEQ ID NO: 3540076 - RNA, 22 nt, Pseudomonas putida KT2440
gcgcagggugugcugcugccaa

SEQ ID NO: 3540077 - RNA, 16 nt, Pseudomonas putida KT2440
gcgcaggguguucagg

SEQ ID NO: 3540078 - RNA, 15 nt, Pseudomonas putida KT2440
gcgcagguaggggug

SEQ ID NO: 3540079 - RNA, 13 nt, Pseudomonas putida KT2440
gcgcaggucgugc

SEQ ID NO: 3540080 - RNA, 16 nt, Pseudomonas putida KT2440
gcgcaggugcagccag

SEQ ID NO: 3540081 - RNA, 23 nt, Pseudomonas putida KT2440
gcgcagguuggugcaauugcagu

SEQ ID NO: 3540082 - RNA, 23 nt, Pseudomonas putida KT2440
gcgcaguacaggcugccgccgaa

SEQ ID NO: 3540083 - RNA, 20 nt, Pseudomonas putida KT2440
gcgcaguaccuguggcagcg

SEQ ID NO: 3540084 - RNA, 22 nt, Pseudomonas putida KT2440
gcgcaguaccuguggcagcggc

SEQ ID NO: 3540085 - RNA, 19 nt, Pseudomonas putida KT2440
gcgcaguggucauagucac

SEQ ID NO: 3540086 - RNA, 22 nt, Pseudomonas putida KT2440
gcgcaguucgauguaggcagcu

SEQ ID NO: 3540087 - RNA, 16 nt, Pseudomonas putida KT2440
gcgcauaggcaaugau

SEQ ID NO: 3540088 - RNA, 13 nt, Pseudomonas putida KT2440
gcgcauaggccaa

SEQ ID NO: 3540089 - RNA, 13 nt, Pseudomonas putida KT2440
gcgcaucaagcgg

SEQ ID NO: 3540090 - RNA, 15 nt, Pseudomonas putida KT2440
gcgcaucagccgcgc

SEQ ID NO: 3540091 - RNA, 17 nt, Pseudomonas putida KT2440
gcgcaucagccgcgccc

SEQ ID NO: 3540092 - RNA, 18 nt, Pseudomonas putida KT2440
gcgcaucagccgcgcccu

SEQ ID NO: 3540093 - RNA, 18 nt, Pseudomonas putida KT2440
gcgcaucaggcugcgccc

SEQ ID NO: 3540094 - RNA, 13 nt, Pseudomonas putida KT2440
gcgcaucauccac

SEQ ID NO: 3540095 - RNA, 14 nt, Pseudomonas putida KT2440
gcgcauccacaggc

SEQ ID NO: 3540096 - RNA, 12 nt, Pseudomonas putida KT2440
gcgcauccagca

SEQ ID NO: 3540097 - RNA, 14 nt, Pseudomonas putida KT2440
gcgcauccagcagg

SEQ ID NO: 3540098 - RNA, 20 nt, Pseudomonas putida KT2440
gcgcaucccuuguaggagcu

SEQ ID NO: 3540099 - RNA, 14 nt, Pseudomonas putida KT2440
gcgcauccuccgcc

SEQ ID NO: 3540100 - RNA, 19 nt, Pseudomonas putida KT2440
gcgcauccuccgcccugcc

SEQ ID NO: 3540101 - RNA, 13 nt, Pseudomonas putida KT2440
gcgcaucgaccgg

SEQ ID NO: 3540102 - RNA, 21 nt, Pseudomonas putida KT2440
gcgcaucgggccgauggcgca

SEQ ID NO: 3540103 - RNA, 20 nt, Pseudomonas putida KT2440
gcgcaugaaggacaucacca

SEQ ID NO: 3540104 - RNA, 22 nt, Pseudomonas putida KT2440
gcgcaugacuuccagguagcgu

SEQ ID NO: 3540105 - RNA, 24 nt, Pseudomonas putida KT2440
gcgcaugaugaaguggcgcaggcu

SEQ ID NO: 3540106 - RNA, 18 nt, Pseudomonas putida KT2440
gcgcaugcucgcgggccu

SEQ ID NO: 3540107 - RNA, 14 nt, Pseudomonas putida KT2440
gcgcaugcugccag

SEQ ID NO: 3540108 - RNA, 18 nt, Pseudomonas putida KT2440
gcgcaugcugccaggcaa

SEQ ID NO: 3540109 - RNA, 11 nt, Pseudomonas putida KT2440
gcgcauggccg

SEQ ID NO: 3540110 - RNA, 16 nt, Pseudomonas putida KT2440
gcgcauggccgcuucc

SEQ ID NO: 3540111 - RNA, 11 nt, Pseudomonas putida KT2440
gcgcauggccu

SEQ ID NO: 3540112 - RNA, 16 nt, Pseudomonas putida KT2440
gcgcauguucaggucg

SEQ ID NO: 3540113 - RNA, 22 nt, Pseudomonas putida KT2440
gcgcauugauagcggcagcgac

SEQ ID NO: 3540114 - RNA, 15 nt, Pseudomonas putida KT2440
gcgcauugaucgccg

SEQ ID NO: 3540115 - RNA, 15 nt, Pseudomonas putida KT2440
gcgcauuucguccag

SEQ ID NO: 3540116 - RNA, 18 nt, Pseudomonas putida KT2440
gcgcauuucguccaggcu

SEQ ID NO: 3540117 - RNA, 23 nt, Pseudomonas putida KT2440
gcgcauuucguccaggcucagcu

SEQ ID NO: 3540118 - RNA, 17 nt, Pseudomonas putida KT2440
gcgcauuuucaccgagc

SEQ ID NO: 3540119 - RNA, 20 nt, Pseudomonas putida KT2440
gcgcauuuucaccgagcugc

SEQ ID NO: 3540120 - RNA, 21 nt, Pseudomonas putida KT2440
gcgccaaaaccuguuccagcc

SEQ ID NO: 3540121 - RNA, 21 nt, Pseudomonas putida KT2440
gcgccaaaccucaaaugcgcc

SEQ ID NO: 3540122 - RNA, 20 nt, Pseudomonas putida KT2440
gcgccaaacgccagggccgg

SEQ ID NO: 3540123 - RNA, 22 nt, Pseudomonas putida KT2440
gcgccaaaggcgcgucccccgg

SEQ ID NO: 3540124 - RNA, 16 nt, Pseudomonas putida KT2440
gcgccaauaccgcgca

SEQ ID NO: 3540125 - RNA, 17 nt, Pseudomonas putida KT2440
gcgccaauaccgcgcau

SEQ ID NO: 3540126 - RNA, 16 nt, Pseudomonas putida KT2440
gcgccaaucaucgcca

SEQ ID NO: 3540127 - RNA, 19 nt, Pseudomonas putida KT2440
gcgccaaucaucgccagca

SEQ ID NO: 3540128 - RNA, 21 nt, Pseudomonas putida KT2440
gcgccaaucaucgccagcagc

SEQ ID NO: 3540129 - RNA, 22 nt, Pseudomonas putida KT2440
gcgccaccagccccaaucccaa

SEQ ID NO: 3540130 - RNA, 12 nt, Pseudomonas putida KT2440
gcgccaccaucu

SEQ ID NO: 3540131 - RNA, 14 nt, Pseudomonas putida KT2440
gcgccacccagaac

SEQ ID NO: 3540132 - RNA, 14 nt, Pseudomonas putida KT2440
gcgccacccaggca

SEQ ID NO: 3540133 - RNA, 13 nt, Pseudomonas putida KT2440
gcgccaccggcag

SEQ ID NO: 3540134 - RNA, 13 nt, Pseudomonas putida KT2440
gcgccaccgggcg

SEQ ID NO: 3540135 - RNA, 15 nt, Pseudomonas putida KT2440
gcgccaccgggcgcg

SEQ ID NO: 3540136 - RNA, 21 nt, Pseudomonas putida KT2440
gcgccaccgggcgcgauugcc

SEQ ID NO: 3540137 - RNA, 16 nt, Pseudomonas putida KT2440
gcgccaccucggcgaa

SEQ ID NO: 3540138 - RNA, 14 nt, Pseudomonas putida KT2440
gcgccacgccgcca

SEQ ID NO: 3540139 - RNA, 16 nt, Pseudomonas putida KT2440
gcgccacgccgccaga

SEQ ID NO: 3540140 - RNA, 19 nt, Pseudomonas putida KT2440
gcgccagacgcgcgcuggc

SEQ ID NO: 3540141 - RNA, 20 nt, Pseudomonas putida KT2440
gcgccagcaacgcagccagg

SEQ ID NO: 3540142 - RNA, 22 nt, Pseudomonas putida KT2440
gcgccagcaacgcagccaggau

SEQ ID NO: 3540143 - RNA, 17 nt, Pseudomonas putida KT2440
gcgccagcacgcaggcc

SEQ ID NO: 3540144 - RNA, 13 nt, Pseudomonas putida KT2440
gcgccagcagccg

SEQ ID NO: 3540145 - RNA, 15 nt, Pseudomonas putida KT2440
gcgccagcagccggg

SEQ ID NO: 3540146 - RNA, 13 nt, Pseudomonas putida KT2440
gcgccagcagcgc

SEQ ID NO: 3540147 - RNA, 14 nt, Pseudomonas putida KT2440
gcgccagcagcgcg

SEQ ID NO: 3540148 - RNA, 16 nt, Pseudomonas putida KT2440
gcgccagcagguccag

SEQ ID NO: 3540149 - RNA, 17 nt, Pseudomonas putida KT2440
gcgccagcagguccagu

SEQ ID NO: 3540150 - RNA, 13 nt, Pseudomonas putida KT2440
gcgccagcagugc

SEQ ID NO: 3540151 - RNA, 23 nt, Pseudomonas putida KT2440
gcgccagcaguuucagcggccgc

SEQ ID NO: 3540152 - RNA, 14 nt, Pseudomonas putida KT2440
gcgccagccauucc

SEQ ID NO: 3540153 - RNA, 16 nt, Pseudomonas putida KT2440
gcgccagccgccacga

SEQ ID NO: 3540154 - RNA, 12 nt, Pseudomonas putida KT2440
gcgccagccgcu

SEQ ID NO: 3540155 - RNA, 16 nt, Pseudomonas putida KT2440
gcgccagccgcucagc

SEQ ID NO: 3540156 - RNA, 13 nt, Pseudomonas putida KT2440
gcgccagcggcca

SEQ ID NO: 3540157 - RNA, 16 nt, Pseudomonas putida KT2440
gcgccagcggcucgau

SEQ ID NO: 3540158 - RNA, 23 nt, Pseudomonas putida KT2440
gcgccagcggguggucgcugcgg

SEQ ID NO: 3540159 - RNA, 13 nt, Pseudomonas putida KT2440
gcgccagcuccac

SEQ ID NO: 3540160 - RNA, 15 nt, Pseudomonas putida KT2440
gcgccagcuccacac

SEQ ID NO: 3540161 - RNA, 19 nt, Pseudomonas putida KT2440
gcgccaggaguucugcaca

SEQ ID NO: 3540162 - RNA, 20 nt, Pseudomonas putida KT2440
gcgccaggaguucugcacag

SEQ ID NO: 3540163 - RNA, 21 nt, Pseudomonas putida KT2440
gcgccaggaguucugcacagc

SEQ ID NO: 3540164 - RNA, 15 nt, Pseudomonas putida KT2440
gcgccaggaucaacu

SEQ ID NO: 3540165 - RNA, 21 nt, Pseudomonas putida KT2440
gcgccaggcauugcucgauua

SEQ ID NO: 3540166 - RNA, 21 nt, Pseudomonas putida KT2440
gcgccaggccuuucagcgccc

SEQ ID NO: 3540167 - RNA, 14 nt, Pseudomonas putida KT2440
gcgccaggcgcagg

SEQ ID NO: 3540168 - RNA, 13 nt, Pseudomonas putida KT2440
gcgccaggguugc

SEQ ID NO: 3540169 - RNA, 21 nt, Pseudomonas putida KT2440
gcgccaggguugcaucgcgca

SEQ ID NO: 3540170 - RNA, 22 nt, Pseudomonas putida KT2440
gcgccaggguugcaucgcgcac

SEQ ID NO: 3540171 - RNA, 12 nt, Pseudomonas putida KT2440
gcgccaggucgg

SEQ ID NO: 3540172 - RNA, 14 nt, Pseudomonas putida KT2440
gcgccaggucggac

SEQ ID NO: 3540173 - RNA, 18 nt, Pseudomonas putida KT2440
gcgccaggucggcggggc

SEQ ID NO: 3540174 - RNA, 16 nt, Pseudomonas putida KT2440
gcgccaguacgccagc

SEQ ID NO: 3540175 - RNA, 19 nt, Pseudomonas putida KT2440
gcgccaguacgccagcagc

SEQ ID NO: 3540176 - RNA, 20 nt, Pseudomonas putida KT2440
gcgccaguucgacgcugcug

SEQ ID NO: 3540177 - RNA, 22 nt, Pseudomonas putida KT2440
gcgccaguucgcggcgcaccgc

SEQ ID NO: 3540178 - RNA, 22 nt, Pseudomonas putida KT2440
gcgccggguuacccaucugcuc

SEQ ID NO: 3540179 - RNA, 19 nt, Pseudomonas putida KT2440
gcgccgguagcggcugggc

SEQ ID NO: 3540180 - RNA, 22 nt, Pseudomonas putida KT2440
gcgccgguagcggcugggcgcg

SEQ ID NO: 3540181 - RNA, 19 nt, Pseudomonas putida KT2440
gcgccgguauucgcgagcc

SEQ ID NO: 3540182 - RNA, 18 nt, Pseudomonas putida KT2440
gcgccgucaccagcguca

SEQ ID NO: 3540183 - RNA, 12 nt, Pseudomonas putida KT2440
gcgccgucgccu

SEQ ID NO: 3540184 - RNA, 16 nt, Pseudomonas putida KT2440
gcgccgucgccucccc

SEQ ID NO: 3540185 - RNA, 23 nt, Pseudomonas putida KT2440
gcgccgugcuacggccgugcagg

SEQ ID NO: 3540186 - RNA, 21 nt, Pseudomonas putida KT2440
gcgccguggccgccaugaucu

SEQ ID NO: 3540187 - RNA, 16 nt, Pseudomonas putida KT2440
gcgccuacagcggccu

SEQ ID NO: 3540188 - RNA, 16 nt, Pseudomonas putida KT2440
gcgccuacaggcaacc

SEQ ID NO: 3540189 - RNA, 21 nt, Pseudomonas putida KT2440
gcgccuacaggcaaccgcauc

SEQ ID NO: 3540190 - RNA, 17 nt, Pseudomonas putida KT2440
gcgccuacaggccccac

SEQ ID NO: 3540191 - RNA, 18 nt, Pseudomonas putida KT2440
gcgccuacgacgauugcg

SEQ ID NO: 3540192 - RNA, 16 nt, Pseudomonas putida KT2440
gcgccuacgacggccu

SEQ ID NO: 3540193 - RNA, 21 nt, Pseudomonas putida KT2440
gcgccuaucagaucgagcgcc

SEQ ID NO: 3540194 - RNA, 22 nt, Pseudomonas putida KT2440
gcgccuaucagaucgagcgccc

SEQ ID NO: 3540195 - RNA, 13 nt, Pseudomonas putida KT2440
gcgccuaucaggc

SEQ ID NO: 3540196 - RNA, 18 nt, Pseudomonas putida KT2440
gcgccuaucaggccuucg

SEQ ID NO: 3540197 - RNA, 14 nt, Pseudomonas putida KT2440
gcgccuccagcagg

SEQ ID NO: 3540198 - RNA, 22 nt, Pseudomonas putida KT2440
gcgccucgaucccgccgccaga

SEQ ID NO: 3540199 - RNA, 15 nt, Pseudomonas putida KT2440
gcgccucgcagguaa

SEQ ID NO: 3540200 - RNA, 14 nt, Pseudomonas putida KT2440
gcgccucgcccuug

SEQ ID NO: 3540201 - RNA, 15 nt, Pseudomonas putida KT2440
gcgccucgcggugca

SEQ ID NO: 3540202 - RNA, 20 nt, Pseudomonas putida KT2440
gcgccucgcggugcaacaug

SEQ ID NO: 3540203 - RNA, 23 nt, Pseudomonas putida KT2440
gcgccugaaagcguauugccaga

SEQ ID NO: 3540204 - RNA, 14 nt, Pseudomonas putida KT2440
gcgccugaacagca

SEQ ID NO: 3540205 - RNA, 17 nt, Pseudomonas putida KT2440
gcgccugacgcagugca

SEQ ID NO: 3540206 - RNA, 22 nt, Pseudomonas putida KT2440
gcgccugacgcagugcagccgc

SEQ ID NO: 3540207 - RNA, 22 nt, Pseudomonas putida KT2440
gcgccugauuacccugcgccag

SEQ ID NO: 3540208 - RNA, 17 nt, Pseudomonas putida KT2440
gcgccugcaccuggcug

SEQ ID NO: 3540209 - RNA, 15 nt, Pseudomonas putida KT2440
gcgccugcagcgcgu

SEQ ID NO: 3540210 - RNA, 18 nt, Pseudomonas putida KT2440
gcgccugcaggcccaggu

SEQ ID NO: 3540211 - RNA, 19 nt, Pseudomonas putida KT2440
gcgccugccacgaugguca

SEQ ID NO: 3540212 - RNA, 15 nt, Pseudomonas putida KT2440
gcgccugccggguca

SEQ ID NO: 3540213 - RNA, 18 nt, Pseudomonas putida KT2440
gcgccugccuggcccucu

SEQ ID NO: 3540214 - RNA, 18 nt, Pseudomonas putida KT2440
gcgccugcgccagugccu

SEQ ID NO: 3540215 - RNA, 13 nt, Pseudomonas putida KT2440
gcgccugcggcau

SEQ ID NO: 3540216 - RNA, 15 nt, Pseudomonas putida KT2440
gcgccugcggcauca

SEQ ID NO: 3540217 - RNA, 17 nt, Pseudomonas putida KT2440
gcgccugcgggugccgu

SEQ ID NO: 3540218 - RNA, 15 nt, Pseudomonas putida KT2440
gcgccugcucaucca

SEQ ID NO: 3540219 - RNA, 16 nt, Pseudomonas putida KT2440
gcgccugcucauccac

SEQ ID NO: 3540220 - RNA, 12 nt, Pseudomonas putida KT2440
gcgccugcugcc

SEQ ID NO: 3540221 - RNA, 17 nt, Pseudomonas putida KT2440
gcgccugcugccaggcc

SEQ ID NO: 3540222 - RNA, 16 nt, Pseudomonas putida KT2440
gcgccuggccugcaga

SEQ ID NO: 3540223 - RNA, 14 nt, Pseudomonas putida KT2440
gcgccuggcgcagu

SEQ ID NO: 3540224 - RNA, 13 nt, Pseudomonas putida KT2440
gcgccuggcucga

SEQ ID NO: 3540225 - RNA, 13 nt, Pseudomonas putida KT2440
gcgccuggucgcc

SEQ ID NO: 3540226 - RNA, 22 nt, Pseudomonas putida KT2440
gcgccugugagaucgagcgccg

SEQ ID NO: 3540227 - RNA, 21 nt, Pseudomonas putida KT2440
gcgccugugaucgagcgccgc

SEQ ID NO: 3540228 - RNA, 23 nt, Pseudomonas putida KT2440
gcgccuucauaggcggccacggc

SEQ ID NO: 3540229 - RNA, 18 nt, Pseudomonas putida KT2440
gcgccuucgcccgaccgc

SEQ ID NO: 3540230 - RNA, 15 nt, Pseudomonas putida KT2440
gcgccuugcgcacgc

SEQ ID NO: 3540231 - RNA, 16 nt, Pseudomonas putida KT2440
gcgccuugcuuggcag

SEQ ID NO: 3540232 - RNA, 22 nt, Pseudomonas putida KT2440
gcgccuugggcaacaccgccag

SEQ ID NO: 3540233 - RNA, 15 nt, Pseudomonas putida KT2440
gcgccuugucggcac

SEQ ID NO: 3540234 - RNA, 19 nt, Pseudomonas putida KT2440
gcgcgaaaagccugcacca

SEQ ID NO: 3540235 - RNA, 21 nt, Pseudomonas putida KT2440
gcgcgaaaagccugcaccagu

SEQ ID NO: 3540236 - RNA, 21 nt, Pseudomonas putida KT2440
gcgcgaaacccucacgcgcca

SEQ ID NO: 3540237 - RNA, 15 nt, Pseudomonas putida KT2440
gcgcgaacagggccu

SEQ ID NO: 3540238 - RNA, 18 nt, Pseudomonas putida KT2440
gcgcgaacagggccucga

SEQ ID NO: 3540239 - RNA, 22 nt, Pseudomonas putida KT2440
gcgcgaaguggauauccagcga

SEQ ID NO: 3540240 - RNA, 19 nt, Pseudomonas putida KT2440
gcgcgaaucagcgccucca

SEQ ID NO: 3540241 - RNA, 15 nt, Pseudomonas putida KT2440
gcgcgaauuuccggg

SEQ ID NO: 3540242 - RNA, 16 nt, Pseudomonas putida KT2440
gcgcgaauuuccgggu

SEQ ID NO: 3540243 - RNA, 17 nt, Pseudomonas putida KT2440
gcgcgacagcacgggca

SEQ ID NO: 3540244 - RNA, 22 nt, Pseudomonas putida KT2440
gcgcgacagcaucaucaggccg

SEQ ID NO: 3540245 - RNA, 21 nt, Pseudomonas putida KT2440
gcgcgacauguucagcuugua

SEQ ID NO: 3540246 - RNA, 23 nt, Pseudomonas putida KT2440
gcgcgaccaucaccgccagcaug

SEQ ID NO: 3540247 - RNA, 15 nt, Pseudomonas putida KT2440
gcgcgacgcagcagc

SEQ ID NO: 3540248 - RNA, 20 nt, Pseudomonas putida KT2440
gcgcgacuccugugggagcg

SEQ ID NO: 3540249 - RNA, 18 nt, Pseudomonas putida KT2440
gcgcgagagcgacgcgcu

SEQ ID NO: 3540250 - RNA, 18 nt, Pseudomonas putida KT2440
gcgcgagcugggcacggc

SEQ ID NO: 3540251 - RNA, 19 nt, Pseudomonas putida KT2440
gcgcgauagggaucaccuc

SEQ ID NO: 3540252 - RNA, 20 nt, Pseudomonas putida KT2440
gcgcgauagggaucaccucg

SEQ ID NO: 3540253 - RNA, 14 nt, Pseudomonas putida KT2440
gcgcgaucaccagc

SEQ ID NO: 3540254 - RNA, 16 nt, Pseudomonas putida KT2440
gcgcgaucaccagccc

SEQ ID NO: 3540255 - RNA, 18 nt, Pseudomonas putida KT2440
gcgcgaucaccagccccu

SEQ ID NO: 3540256 - RNA, 13 nt, Pseudomonas putida KT2440
gcgcgaucagcgc

SEQ ID NO: 3540257 - RNA, 18 nt, Pseudomonas putida KT2440
gcgcgaucagcgcacgac

SEQ ID NO: 3540258 - RNA, 17 nt, Pseudomonas putida KT2440
gcgcgaucaucgaagcc

SEQ ID NO: 3540259 - RNA, 18 nt, Pseudomonas putida KT2440
gcgcgaucaucgaagcca

SEQ ID NO: 3540260 - RNA, 13 nt, Pseudomonas putida KT2440
gcgcgaugcgccg

SEQ ID NO: 3540261 - RNA, 21 nt, Pseudomonas putida KT2440
gcgcgaugcgguugcaggacu

SEQ ID NO: 3540262 - RNA, 18 nt, Pseudomonas putida KT2440
gcgcgauucguagcgguu

SEQ ID NO: 3540263 - RNA, 13 nt, Pseudomonas putida KT2440
gcgcgcaacagca

SEQ ID NO: 3540264 - RNA, 16 nt, Pseudomonas putida KT2440
gcgcgcauccacaggc

SEQ ID NO: 3540265 - RNA, 19 nt, Pseudomonas putida KT2440
gcgcgcauccacaggcgcc

SEQ ID NO: 3540266 - RNA, 17 nt, Pseudomonas putida KT2440
gcgcgcauccagcaggg

SEQ ID NO: 3540267 - RNA, 15 nt, Pseudomonas putida KT2440
gcgcgccacgcacca

SEQ ID NO: 3540268 - RNA, 14 nt, Pseudomonas putida KT2440
gcgcgccagcaggu

SEQ ID NO: 3540269 - RNA, 12 nt, Pseudomonas putida KT2440
gcgcgccagcgc

SEQ ID NO: 3540270 - RNA, 15 nt, Pseudomonas putida KT2440
gcgcgccagggcaac

SEQ ID NO: 3540271 - RNA, 16 nt, Pseudomonas putida KT2440
gcgcgccagggcaacg

SEQ ID NO: 3540272 - RNA, 18 nt, Pseudomonas putida KT2440
gcgcgccagggcaacggc

SEQ ID NO: 3540273 - RNA, 14 nt, Pseudomonas putida KT2440
gcgcgccaguucgc

SEQ ID NO: 3540274 - RNA, 18 nt, Pseudomonas putida KT2440
gcgcgccaguucgcggcg

SEQ ID NO: 3540275 - RNA, 13 nt, Pseudomonas putida KT2440
gcgcgcccaccgg

SEQ ID NO: 3540276 - RNA, 15 nt, Pseudomonas putida KT2440
gcgcgcccaggccca

SEQ ID NO: 3540277 - RNA, 15 nt, Pseudomonas putida KT2440
gcgcgcccaucugca

SEQ ID NO: 3540278 - RNA, 14 nt, Pseudomonas putida KT2440
gcgcgcccgcggcc

SEQ ID NO: 3540279 - RNA, 20 nt, Pseudomonas putida KT2440
gcgcgcccgcggcccacagu

SEQ ID NO: 3540280 - RNA, 18 nt, Pseudomonas putida KT2440
gcgcgcccugcucaucca

SEQ ID NO: 3540281 - RNA, 21 nt, Pseudomonas putida KT2440
gcgcgcccugcucauccagca

SEQ ID NO: 3540282 - RNA, 14 nt, Pseudomonas putida KT2440
gcgcgccgccacau

SEQ ID NO: 3540283 - RNA, 19 nt, Pseudomonas putida KT2440
gcgcugaccaacaggcugg

SEQ ID NO: 3540284 - RNA, 18 nt, Pseudomonas putida KT2440
gcgcugaccaaggcaaag

SEQ ID NO: 3540285 - RNA, 15 nt, Pseudomonas putida KT2440
gcgcugaccauaccu

SEQ ID NO: 3540286 - RNA, 15 nt, Pseudomonas putida KT2440
gcgcugaccgggacg

SEQ ID NO: 3540287 - RNA, 21 nt, Pseudomonas putida KT2440
gcgcugacgaacaacgccacc

SEQ ID NO: 3540288 - RNA, 15 nt, Pseudomonas putida KT2440
gcgcugacgcagggc

SEQ ID NO: 3540289 - RNA, 18 nt, Pseudomonas putida KT2440
gcgcugacucagcggccu

SEQ ID NO: 3540290 - RNA, 19 nt, Pseudomonas putida KT2440
gcgcugacucagcggccuu

SEQ ID NO: 3540291 - RNA, 16 nt, Pseudomonas putida KT2440
gcgcugacugccaggc

SEQ ID NO: 3540292 - RNA, 14 nt, Pseudomonas putida KT2440
gcgcugagcgacag

SEQ ID NO: 3540293 - RNA, 18 nt, Pseudomonas putida KT2440
gcgcugauaccgaacuug

SEQ ID NO: 3540294 - RNA, 19 nt, Pseudomonas putida KT2440
gcgcugaucaagcccgcuc

SEQ ID NO: 3540295 - RNA, 18 nt, Pseudomonas putida KT2440
gcgcugaucagcuggucg

SEQ ID NO: 3540296 - RNA, 21 nt, Pseudomonas putida KT2440
gcgcugaucaucgacaggugc

SEQ ID NO: 3540297 - RNA, 22 nt, Pseudomonas putida KT2440
gcgcugaucgaaagcugcgcac

SEQ ID NO: 3540298 - RNA, 20 nt, Pseudomonas putida KT2440
gcgcugauucaacgccccag

SEQ ID NO: 3540299 - RNA, 20 nt, Pseudomonas putida KT2440
gcgcugcaagcgcaccugca

SEQ ID NO: 3540300 - RNA, 22 nt, Pseudomonas putida KT2440
gcgcugcaagcgcaccugcagg

SEQ ID NO: 3540301 - RNA, 15 nt, Pseudomonas putida KT2440
gcgcugcaaucaccg

SEQ ID NO: 3540302 - RNA, 21 nt, Pseudomonas putida KT2440
gcgcugcaccgaaggccgccg

SEQ ID NO: 3540303 - RNA, 18 nt, Pseudomonas putida KT2440
gcgcugcagcgucgccuc

SEQ ID NO: 3540304 - RNA, 14 nt, Pseudomonas putida KT2440
gcgcugcagcuccu

SEQ ID NO: 3540305 - RNA, 13 nt, Pseudomonas putida KT2440
gcgcugcauggcg

SEQ ID NO: 3540306 - RNA, 13 nt, Pseudomonas putida KT2440
gcgcugccaggcc

SEQ ID NO: 3540307 - RNA, 15 nt, Pseudomonas putida KT2440
gcgcugccaggccgg

SEQ ID NO: 3540308 - RNA, 16 nt, Pseudomonas putida KT2440
gcgcugccaggccggg

SEQ ID NO: 3540309 - RNA, 19 nt, Pseudomonas putida KT2440
gcgcugccucgucggacag

SEQ ID NO: 3540310 - RNA, 14 nt, Pseudomonas putida KT2440
gcgcugccugcugg

SEQ ID NO: 3540311 - RNA, 19 nt, Pseudomonas putida KT2440
gcgcugccugcuggcggcu

SEQ ID NO: 3540312 - RNA, 23 nt, Pseudomonas putida KT2440
gcgcugcgcaaggacgacguggu

SEQ ID NO: 3540313 - RNA, 17 nt, Pseudomonas putida KT2440
gcgcugcggguggcgua

SEQ ID NO: 3540314 - RNA, 14 nt, Pseudomonas putida KT2440
gcgcugcguuggcc

SEQ ID NO: 3540315 - RNA, 15 nt, Pseudomonas putida KT2440
gcgcugcugggcguc

SEQ ID NO: 3540316 - RNA, 16 nt, Pseudomonas putida KT2440
gcgcuggacagcggca

SEQ ID NO: 3540317 - RNA, 16 nt, Pseudomonas putida KT2440
gcgcuggacagguaga

SEQ ID NO: 3540318 - RNA, 14 nt, Pseudomonas putida KT2440
gcgcuggaucuugc

SEQ ID NO: 3540319 - RNA, 21 nt, Pseudomonas putida KT2440
gcgcuggaucuugcugaacag

SEQ ID NO: 3540320 - RNA, 16 nt, Pseudomonas putida KT2440
gcgcuggccaauggca

SEQ ID NO: 3540321 - RNA, 13 nt, Pseudomonas putida KT2440
gcgcuggccacga

SEQ ID NO: 3540322 - RNA, 15 nt, Pseudomonas putida KT2440
gcgcuggcccuugcc

SEQ ID NO: 3540323 - RNA, 17 nt, Pseudomonas putida KT2440
gcgcugggcgguaccca

SEQ ID NO: 3540324 - RNA, 15 nt, Pseudomonas putida KT2440
gcgcugggcguccag

SEQ ID NO: 3540325 - RNA, 20 nt, Pseudomonas putida KT2440
gcgcugggcguccagguagc

SEQ ID NO: 3540326 - RNA, 23 nt, Pseudomonas putida KT2440
gcgcugguaaaguucuucuuuaa

SEQ ID NO: 3540327 - RNA, 23 nt, Pseudomonas putida KT2440
gcgcuggucggcaaucugcucga

SEQ ID NO: 3540328 - RNA, 16 nt, Pseudomonas putida KT2440
gcgcuggugcaggcgu

SEQ ID NO: 3540329 - RNA, 17 nt, Pseudomonas putida KT2440
gcgcugguuuaucagca

SEQ ID NO: 3540330 - RNA, 21 nt, Pseudomonas putida KT2440
gcgcuguaaacgguaggaacg

SEQ ID NO: 3540331 - RNA, 13 nt, Pseudomonas putida KT2440
gcgcuguccagcg

SEQ ID NO: 3540332 - RNA, 14 nt, Pseudomonas putida KT2440
gcgcuguccagcgc

SEQ ID NO: 3540333 - RNA, 16 nt, Pseudomonas putida KT2440
gcgcuguccagcgcau

SEQ ID NO: 3540334 - RNA, 21 nt, Pseudomonas putida KT2440
gcgcuguccagcgcaucaacg

SEQ ID NO: 3540335 - RNA, 13 nt, Pseudomonas putida KT2440
gcgcuguggcgcc

SEQ ID NO: 3540336 - RNA, 18 nt, Pseudomonas putida KT2440
gcgcuguggcgcccggcg

SEQ ID NO: 3540337 - RNA, 22 nt, Pseudomonas putida KT2440
gcgcuucacgucuggcaccagu

SEQ ID NO: 3540338 - RNA, 23 nt, Pseudomonas putida KT2440
gcgcuucagggucgggcacaggc

SEQ ID NO: 3540339 - RNA, 14 nt, Pseudomonas putida KT2440
gcgcuuccuuccug

SEQ ID NO: 3540340 - RNA, 20 nt, Pseudomonas putida KT2440
gcgcuucgaucagcgccugc

SEQ ID NO: 3540341 - RNA, 15 nt, Pseudomonas putida KT2440
gcgcuucgaucgccg

SEQ ID NO: 3540342 - RNA, 16 nt, Pseudomonas putida KT2440
gcgcuucgaucgccgg

SEQ ID NO: 3540343 - RNA, 18 nt, Pseudomonas putida KT2440
gcgcuucgaucgccggca

SEQ ID NO: 3540344 - RNA, 19 nt, Pseudomonas putida KT2440
gcgcuugagcaggucgaac

SEQ ID NO: 3540345 - RNA, 16 nt, Pseudomonas putida KT2440
gcgcuugagcguggca

SEQ ID NO: 3540346 - RNA, 19 nt, Pseudomonas putida KT2440
gcgcuugaggugccauagc

SEQ ID NO: 3540347 - RNA, 14 nt, Pseudomonas putida KT2440
gcgcuugcaccagg

SEQ ID NO: 3540348 - RNA, 17 nt, Pseudomonas putida KT2440
gcgcuugcccgcgaaug

SEQ ID NO: 3540349 - RNA, 21 nt, Pseudomonas putida KT2440
gcgcuuggaaauguucaacag

SEQ ID NO: 3540350 - RNA, 23 nt, Pseudomonas putida KT2440
gcgcuuggaaauguucaacagcc

SEQ ID NO: 3540351 - RNA, 13 nt, Pseudomonas putida KT2440
gcgcuuggcaccg

SEQ ID NO: 3540352 - RNA, 22 nt, Pseudomonas putida KT2440
gcgcuuggcaccggcagcagca

SEQ ID NO: 3540353 - RNA, 22 nt, Pseudomonas putida KT2440
gcgcuuugcaccccuuuuucuc

SEQ ID NO: 3540354 - RNA, 18 nt, Pseudomonas putida KT2440
gcgcuuugcgccccuuuc

SEQ ID NO: 3540355 - RNA, 15 nt, Pseudomonas putida KT2440
gcgcuuugugcacaa

SEQ ID NO: 3540356 - RNA, 23 nt, Pseudomonas putida KT2440
gcgcuuuucaccuccaguugcca

SEQ ID NO: 3540357 - RNA, 19 nt, Pseudomonas putida KT2440
gcgcuuuucuucgcugcug

SEQ ID NO: 3540358 - RNA, 21 nt, Pseudomonas putida KT2440
gcggaaauaccagacgcaggc

SEQ ID NO: 3540359 - RNA, 13 nt, Pseudomonas putida KT2440
gcggaacaauugc

SEQ ID NO: 3540360 - RNA, 23 nt, Pseudomonas putida KT2440
gcggaacauacgcaucagcgcag

SEQ ID NO: 3540361 - RNA, 13 nt, Pseudomonas putida KT2440
gcggaacucgccc

SEQ ID NO: 3540362 - RNA, 15 nt, Pseudomonas putida KT2440
gcggaacuggcccug

SEQ ID NO: 3540363 - RNA, 15 nt, Pseudomonas putida KT2440
gcggaacuggcugac

SEQ ID NO: 3540364 - RNA, 14 nt, Pseudomonas putida KT2440
gcggaagauacccg

SEQ ID NO: 3540365 - RNA, 18 nt, Pseudomonas putida KT2440
gcggaagcucuccagggu

SEQ ID NO: 3540366 - RNA, 22 nt, Pseudomonas putida KT2440
gcggaaggcgucacgcagggcc

SEQ ID NO: 3540367 - RNA, 22 nt, Pseudomonas putida KT2440
gcggaaguucacacucagccgc

SEQ ID NO: 3540368 - RNA, 23 nt, Pseudomonas putida KT2440
gcggaaguucacacucagccgcu

SEQ ID NO: 3540369 - RNA, 17 nt, Pseudomonas putida KT2440
gcggaccaccugggcca

SEQ ID NO: 3540370 - RNA, 14 nt, Pseudomonas putida KT2440
gcggaccaggugca

SEQ ID NO: 3540371 - RNA, 20 nt, Pseudomonas putida KT2440
gcggagauuggccagcaggc

SEQ ID NO: 3540372 - RNA, 17 nt, Pseudomonas putida KT2440
gcggagccagccacaga

SEQ ID NO: 3540373 - RNA, 14 nt, Pseudomonas putida KT2440
gcggauacagcgcc

SEQ ID NO: 3540374 - RNA, 15 nt, Pseudomonas putida KT2440
gcggauacagcgccc

SEQ ID NO: 3540375 - RNA, 15 nt, Pseudomonas putida KT2440
gcggauagcgcgcca

SEQ ID NO: 3540376 - RNA, 16 nt, Pseudomonas putida KT2440
gcggaucagcgcgucc

SEQ ID NO: 3540377 - RNA, 19 nt, Pseudomonas putida KT2440
gcggaucaucggcacgccc

SEQ ID NO: 3540378 - RNA, 21 nt, Pseudomonas putida KT2440
gcggaucaucggcacgcccag

SEQ ID NO: 3540379 - RNA, 17 nt, Pseudomonas putida KT2440
gcggaucaucuccauga

SEQ ID NO: 3540380 - RNA, 13 nt, Pseudomonas putida KT2440
gcggaucgccgcc

SEQ ID NO: 3540381 - RNA, 20 nt, Pseudomonas putida KT2440
gcggaucgcgccuucgcugg

SEQ ID NO: 3540382 - RNA, 15 nt, Pseudomonas putida KT2440
gcggaucggcguggu

SEQ ID NO: 3540383 - RNA, 18 nt, Pseudomonas putida KT2440
gcggaucgugacggucug

SEQ ID NO: 3540384 - RNA, 21 nt, Pseudomonas putida KT2440
gcggaucugacggcgcugcug

SEQ ID NO: 3540385 - RNA, 12 nt, Pseudomonas putida KT2440
gcggaugagccu

SEQ ID NO: 3540386 - RNA, 17 nt, Pseudomonas putida KT2440
gcggauguuggccacga

SEQ ID NO: 3540387 - RNA, 16 nt, Pseudomonas putida KT2440
gcggcaaagaucgccc

SEQ ID NO: 3540388 - RNA, 23 nt, Pseudomonas putida KT2440
gcggcgacaaccgaaaaggccaa

SEQ ID NO: 3540389 - RNA, 14 nt, Pseudomonas putida KT2440
gcggcgacagggcg

SEQ ID NO: 3540390 - RNA, 20 nt, Pseudomonas putida KT2440
gcggcgacaggugccccuug

SEQ ID NO: 3540391 - RNA, 18 nt, Pseudomonas putida KT2440
gcggcgaucaacgcaggc

SEQ ID NO: 3540392 - RNA, 12 nt, Pseudomonas putida KT2440
gcggcgaucagc

SEQ ID NO: 3540393 - RNA, 15 nt, Pseudomonas putida KT2440
gcggcgaucagcgcg

SEQ ID NO: 3540394 - RNA, 16 nt, Pseudomonas putida KT2440
gcggcgcaccgcuugc

SEQ ID NO: 3540395 - RNA, 11 nt, Pseudomonas putida KT2440
gcggcgcagcg

SEQ ID NO: 3540396 - RNA, 14 nt, Pseudomonas putida KT2440
gcggcgcagcgcac

SEQ ID NO: 3540397 - RNA, 13 nt, Pseudomonas putida KT2440
gcggcgcccagca

SEQ ID NO: 3540398 - RNA, 15 nt, Pseudomonas putida KT2440
gcggcgcccagcaac

SEQ ID NO: 3540399 - RNA, 16 nt, Pseudomonas putida KT2440
gcggcgcccagcaaca

SEQ ID NO: 3540400 - RNA, 22 nt, Pseudomonas putida KT2440
gcggcgcccaguacuucgcgug

SEQ ID NO: 3540401 - RNA, 13 nt, Pseudomonas putida KT2440
gcggcgccuucag

SEQ ID NO: 3540402 - RNA, 20 nt, Pseudomonas putida KT2440
gcggcgcgaaucagcgccuc

SEQ ID NO: 3540403 - RNA, 22 nt, Pseudomonas putida KT2440
gcggcgcgaucaucgaagccag

SEQ ID NO: 3540404 - RNA, 13 nt, Pseudomonas putida KT2440
gcggcgcggcccu

SEQ ID NO: 3540405 - RNA, 14 nt, Pseudomonas putida KT2440
gcggcgcgggcgca

SEQ ID NO: 3540406 - RNA, 19 nt, Pseudomonas putida KT2440
gcggcgcuggccgguggcc

SEQ ID NO: 3540407 - RNA, 23 nt, Pseudomonas putida KT2440
gcggcgcuugaucugccaggcac

SEQ ID NO: 3540408 - RNA, 21 nt, Pseudomonas putida KT2440
gcggcgcuuuucuucgcugcu

SEQ ID NO: 3540409 - RNA, 13 nt, Pseudomonas putida KT2440
gcggcggccgagg

SEQ ID NO: 3540410 - RNA, 19 nt, Pseudomonas putida KT2440
gcggcggcuaagcgccagc

SEQ ID NO: 3540411 - RNA, 15 nt, Pseudomonas putida KT2440
gcggcgguggccgcg

SEQ ID NO: 3540412 - RNA, 19 nt, Pseudomonas putida KT2440
gcggcgguugucgucgacc

SEQ ID NO: 3540413 - RNA, 23 nt, Pseudomonas putida KT2440
gcggcguauacccggucagggug

SEQ ID NO: 3540414 - RNA, 15 nt, Pseudomonas putida KT2440
gcggcgucaccggcc

SEQ ID NO: 3540415 - RNA, 15 nt, Pseudomonas putida KT2440
gcggcgugaccagcc

SEQ ID NO: 3540416 - RNA, 15 nt, Pseudomonas putida KT2440
gcggcgugcgcccgg

SEQ ID NO: 3540417 - RNA, 19 nt, Pseudomonas putida KT2440
gcggcgugcgcccggcaaa

SEQ ID NO: 3540418 - RNA, 14 nt, Pseudomonas putida KT2440
gcggcguggccuca

SEQ ID NO: 3540419 - RNA, 21 nt, Pseudomonas putida KT2440
gcggcguguaguagcuccagc

SEQ ID NO: 3540420 - RNA, 23 nt, Pseudomonas putida KT2440
gcggcguguaguagcuccagccc

SEQ ID NO: 3540421 - RNA, 12 nt, Pseudomonas putida KT2440
gcggcuacgcuc

SEQ ID NO: 3540422 - RNA, 13 nt, Pseudomonas putida KT2440
gcggcuacgcucg

SEQ ID NO: 3540423 - RNA, 21 nt, Pseudomonas putida KT2440
gcggcuccgaccgguggccug

SEQ ID NO: 3540424 - RNA, 20 nt, Pseudomonas putida KT2440
gcggcuccggcguguccagc

SEQ ID NO: 3540425 - RNA, 13 nt, Pseudomonas putida KT2440
gcggcucgcucag

SEQ ID NO: 3540426 - RNA, 22 nt, Pseudomonas putida KT2440
gcggcucucgaaguagcgcucu

SEQ ID NO: 3540427 - RNA, 15 nt, Pseudomonas putida KT2440
gcggcucuugcagcg

SEQ ID NO: 3540428 - RNA, 14 nt, Pseudomonas putida KT2440
gcggcugaauccua

SEQ ID NO: 3540429 - RNA, 21 nt, Pseudomonas putida KT2440
gcggcugaccuguucgcgcaa

SEQ ID NO: 3540430 - RNA, 14 nt, Pseudomonas putida KT2440
gcggcugacgaagc

SEQ ID NO: 3540431 - RNA, 12 nt, Pseudomonas putida KT2440
gcggcugagccg

SEQ ID NO: 3540432 - RNA, 13 nt, Pseudomonas putida KT2440
gcggcugagccgg

SEQ ID NO: 3540433 - RNA, 19 nt, Pseudomonas putida KT2440
gcggcugccuacccaggca

SEQ ID NO: 3540434 - RNA, 18 nt, Pseudomonas putida KT2440
gcggcugcgacggcgaau

SEQ ID NO: 3540435 - RNA, 20 nt, Pseudomonas putida KT2440
gcggcugggccccaggcggu

SEQ ID NO: 3540436 - RNA, 17 nt, Pseudomonas putida KT2440
gcggcugggcgcggcgg

SEQ ID NO: 3540437 - RNA, 19 nt, Pseudomonas putida KT2440
gcggcugggucacccaggu

SEQ ID NO: 3540438 - RNA, 17 nt, Pseudomonas putida KT2440
gcggcugggugccauca

SEQ ID NO: 3540439 - RNA, 16 nt, Pseudomonas putida KT2440
gcggcuguccagcaag

SEQ ID NO: 3540440 - RNA, 16 nt, Pseudomonas putida KT2440
gcggcuguucgcagca

SEQ ID NO: 3540441 - RNA, 19 nt, Pseudomonas putida KT2440
gcggcuuccagggcugguu

SEQ ID NO: 3540442 - RNA, 22 nt, Pseudomonas putida KT2440
gcggcuuuagccgugaagaggc

SEQ ID NO: 3540443 - RNA, 13 nt, Pseudomonas putida KT2440
gcggcuuucagcg

SEQ ID NO: 3540444 - RNA, 13 nt, Pseudomonas putida KT2440
gcgggaagcccgu

SEQ ID NO: 3540445 - RNA, 19 nt, Pseudomonas putida KT2440
gcgggaaguuaccgcccgc

SEQ ID NO: 3540446 - RNA, 12 nt, Pseudomonas putida KT2440
gcgggaccagca

SEQ ID NO: 3540447 - RNA, 16 nt, Pseudomonas putida KT2440
gcgggagucgaaccug

SEQ ID NO: 3540448 - RNA, 22 nt, Pseudomonas putida KT2440
gcgggauuugccgucgcgccca

SEQ ID NO: 3540449 - RNA, 18 nt, Pseudomonas putida KT2440
gcgggcaaacccgcgccu

SEQ ID NO: 3540450 - RNA, 17 nt, Pseudomonas putida KT2440
gcgggcaaacuggcgcc

SEQ ID NO: 3540451 - RNA, 22 nt, Pseudomonas putida KT2440
gcgggcaaacuggcgcccggca

SEQ ID NO: 3540452 - RNA, 20 nt, Pseudomonas putida KT2440
gcgggcaaauccgccccuac

SEQ ID NO: 3540453 - RNA, 22 nt, Pseudomonas putida KT2440
gcgggcaacugcgccugggaaa

SEQ ID NO: 3540454 - RNA, 20 nt, Pseudomonas putida KT2440
gcgggcaagcccgcacccac

SEQ ID NO: 3540455 - RNA, 19 nt, Pseudomonas putida KT2440
gcgggcaagcccgcgaaga

SEQ ID NO: 3540456 - RNA, 20 nt, Pseudomonas putida KT2440
gcgggcaagcccgcuccgac

SEQ ID NO: 3540457 - RNA, 20 nt, Pseudomonas putida KT2440
gcgggcaaggucgaugcugc

SEQ ID NO: 3540458 - RNA, 17 nt, Pseudomonas putida KT2440
gcgggcacaggccgcgc

SEQ ID NO: 3540459 - RNA, 14 nt, Pseudomonas putida KT2440
gcgggcacgcccgc

SEQ ID NO: 3540460 - RNA, 15 nt, Pseudomonas putida KT2440
gcgggcacgcccgcu

SEQ ID NO: 3540461 - RNA, 21 nt, Pseudomonas putida KT2440
gcgggcacgcccgcucccaca

SEQ ID NO: 3540462 - RNA, 22 nt, Pseudomonas putida KT2440
gcgggcagacuucggucuggcc

SEQ ID NO: 3540463 - RNA, 13 nt, Pseudomonas putida KT2440
gcgggcaugcccg

SEQ ID NO: 3540464 - RNA, 15 nt, Pseudomonas putida KT2440
gcgggcaugcccgcu

SEQ ID NO: 3540465 - RNA, 16 nt, Pseudomonas putida KT2440
gcgggcaugcccgcuc

SEQ ID NO: 3540466 - RNA, 20 nt, Pseudomonas putida KT2440
gcgggcaugcccgcucccac

SEQ ID NO: 3540467 - RNA, 16 nt, Pseudomonas putida KT2440
gcgggccaccaggccu

SEQ ID NO: 3540468 - RNA, 16 nt, Pseudomonas putida KT2440
gcgggccagcccaucc

SEQ ID NO: 3540469 - RNA, 17 nt, Pseudomonas putida KT2440
gcgggccgccgaacagg

SEQ ID NO: 3540470 - RNA, 19 nt, Pseudomonas putida KT2440
gcgggccguaguggcgccg

SEQ ID NO: 3540471 - RNA, 17 nt, Pseudomonas putida KT2440
gcgggccugcuggcgaa

SEQ ID NO: 3540472 - RNA, 19 nt, Pseudomonas putida KT2440
gcgggccuggagcaaggcg

SEQ ID NO: 3540473 - RNA, 22 nt, Pseudomonas putida KT2440
gcgggcgauugccagggugcca

SEQ ID NO: 3540474 - RNA, 12 nt, Pseudomonas putida KT2440
gcgggcgcgccc

SEQ ID NO: 3540475 - RNA, 19 nt, Pseudomonas putida KT2440
gcgggcgcgcccgcgaaga

SEQ ID NO: 3540476 - RNA, 15 nt, Pseudomonas putida KT2440
gcgggcgcgcccgcu

SEQ ID NO: 3540477 - RNA, 20 nt, Pseudomonas putida KT2440
gcgggcguaccuggcugcug

SEQ ID NO: 3540478 - RNA, 15 nt, Pseudomonas putida KT2440
gcgggcgucuuccag

SEQ ID NO: 3540479 - RNA, 20 nt, Pseudomonas putida KT2440
gcgggcgugcccgcgaaugc

SEQ ID NO: 3540480 - RNA, 21 nt, Pseudomonas putida KT2440
gcgggcguuguguugcugggc

SEQ ID NO: 3540481 - RNA, 12 nt, Pseudomonas putida KT2440
gcgggcucgccc

SEQ ID NO: 3540482 - RNA, 14 nt, Pseudomonas putida KT2440
gcgggcucgcccgc

SEQ ID NO: 3540483 - RNA, 19 nt, Pseudomonas putida KT2440
gcgggcucgcccgcgaaga

SEQ ID NO: 3540484 - RNA, 14 nt, Pseudomonas putida KT2440
gcgggcugaggaag

SEQ ID NO: 3540485 - RNA, 20 nt, Pseudomonas putida KT2440
gcgggcuggcauucaacgcc

SEQ ID NO: 3540486 - RNA, 14 nt, Pseudomonas putida KT2440
gcgggcuugcccgc

SEQ ID NO: 3540487 - RNA, 17 nt, Pseudomonas putida KT2440
gcgggcuugcccgcgaa

SEQ ID NO: 3540488 - RNA, 20 nt, Pseudomonas putida KT2440
gcgggcuugcccgcgaaugg

SEQ ID NO: 3540489 - RNA, 19 nt, Pseudomonas putida KT2440
gcgggcuuguccgcgaagc

SEQ ID NO: 3540490 - RNA, 20 nt, Pseudomonas putida KT2440
gcgggcuuuuucguuugcgc

SEQ ID NO: 3540491 - RNA, 21 nt, Pseudomonas putida KT2440
gcgggcuuuuuuuugccugga

SEQ ID NO: 3540492 - RNA, 17 nt, Pseudomonas putida KT2440
gcggggauucaacagcg

SEQ ID NO: 3540493 - RNA, 23 nt, Pseudomonas putida KT2440
gcgguguaucuccaugcugcugc

SEQ ID NO: 3540494 - RNA, 17 nt, Pseudomonas putida KT2440
gcgguuaagaaggcgaa

SEQ ID NO: 3540495 - RNA, 17 nt, Pseudomonas putida KT2440
gcgguucgaccaauggc

SEQ ID NO: 3540496 - RNA, 12 nt, Pseudomonas putida KT2440
gcgguucgaccg

SEQ ID NO: 3540497 - RNA, 14 nt, Pseudomonas putida KT2440
gcgguucugcgcac

SEQ ID NO: 3540498 - RNA, 14 nt, Pseudomonas putida KT2440
gcgguugaccaggg

SEQ ID NO: 3540499 - RNA, 19 nt, Pseudomonas putida KT2440
gcgguugccaagcacggcg

SEQ ID NO: 3540500 - RNA, 23 nt, Pseudomonas putida KT2440
gcgguugccaagcacggcgccga

SEQ ID NO: 3540501 - RNA, 16 nt, Pseudomonas putida KT2440
gcgguugcccgcugca

SEQ ID NO: 3540502 - RNA, 22 nt, Pseudomonas putida KT2440
gcgguuggugcgccuccagcag

SEQ ID NO: 3540503 - RNA, 23 nt, Pseudomonas putida KT2440
gcgguuguagaucgccggcagca

SEQ ID NO: 3540504 - RNA, 14 nt, Pseudomonas putida KT2440
gcgguugucgaccu

SEQ ID NO: 3540505 - RNA, 14 nt, Pseudomonas putida KT2440
gcgguuugcucuga

SEQ ID NO: 3540506 - RNA, 17 nt, Pseudomonas putida KT2440
gcgguuuucgcaacgcu

SEQ ID NO: 3540507 - RNA, 22 nt, Pseudomonas putida KT2440
gcgguuuuugggggagcgggcg

SEQ ID NO: 3540508 - RNA, 16 nt, Pseudomonas putida KT2440
gcguaaacccagguac

SEQ ID NO: 3540509 - RNA, 14 nt, Pseudomonas putida KT2440
gcguaaagcgcccc

SEQ ID NO: 3540510 - RNA, 17 nt, Pseudomonas putida KT2440
gcguaaagcgccccagg

SEQ ID NO: 3540511 - RNA, 14 nt, Pseudomonas putida KT2440
gcguaaggccggga

SEQ ID NO: 3540512 - RNA, 16 nt, Pseudomonas putida KT2440
gcguaauagcugguga

SEQ ID NO: 3540513 - RNA, 18 nt, Pseudomonas putida KT2440
gcguacacugcaggagcg

SEQ ID NO: 3540514 - RNA, 21 nt, Pseudomonas putida KT2440
gcguacagcgacaugccggcc

SEQ ID NO: 3540515 - RNA, 22 nt, Pseudomonas putida KT2440
gcguacagcgacaugccggcca

SEQ ID NO: 3540516 - RNA, 18 nt, Pseudomonas putida KT2440
gcguacgaauacggucga

SEQ ID NO: 3540517 - RNA, 16 nt, Pseudomonas putida KT2440
gcguacugcauguacu

SEQ ID NO: 3540518 - RNA, 14 nt, Pseudomonas putida KT2440
gcguagcagguacg

SEQ ID NO: 3540519 - RNA, 22 nt, Pseudomonas putida KT2440
gcguagcagguacgcgcaggca

SEQ ID NO: 3540520 - RNA, 14 nt, Pseudomonas putida KT2440
gcguaggcacaccc

SEQ ID NO: 3540521 - RNA, 21 nt, Pseudomonas putida KT2440
gcguaguacuccagcagcgca

SEQ ID NO: 3540522 - RNA, 12 nt, Pseudomonas putida KT2440
gcguagugcagg

SEQ ID NO: 3540523 - RNA, 15 nt, Pseudomonas putida KT2440
gcguagugcaggcgc

SEQ ID NO: 3540524 - RNA, 23 nt, Pseudomonas putida KT2440
gcguauccacauacugcuucugc

SEQ ID NO: 3540525 - RNA, 19 nt, Pseudomonas putida KT2440
gcguauucgcccagcgcuc

SEQ ID NO: 3540526 - RNA, 13 nt, Pseudomonas putida KT2440
gcguauugcuggu

SEQ ID NO: 3540527 - RNA, 17 nt, Pseudomonas putida KT2440
gcguauuuuugcgccag

SEQ ID NO: 3540528 - RNA, 11 nt, Pseudomonas putida KT2440
gcgucaaaguu

SEQ ID NO: 3540529 - RNA, 22 nt, Pseudomonas putida KT2440
gcgucaaccgaacccgcuggcg

SEQ ID NO: 3540530 - RNA, 13 nt, Pseudomonas putida KT2440
gcgucaacucauc

SEQ ID NO: 3540531 - RNA, 20 nt, Pseudomonas putida KT2440
gcgucaacugccaggcuggc

SEQ ID NO: 3540532 - RNA, 19 nt, Pseudomonas putida KT2440
gcgucaagagcgacuggug

SEQ ID NO: 3540533 - RNA, 23 nt, Pseudomonas putida KT2440
gcgucacaucgguuucgccggug

SEQ ID NO: 3540534 - RNA, 13 nt, Pseudomonas putida KT2440
gcgucacccgcgc

SEQ ID NO: 3540535 - RNA, 15 nt, Pseudomonas putida KT2440
gcgucacccgcgcca

SEQ ID NO: 3540536 - RNA, 18 nt, Pseudomonas putida KT2440
gcgucacccgcgccacca

SEQ ID NO: 3540537 - RNA, 21 nt, Pseudomonas putida KT2440
gcgucacccgcgccaccagcc

SEQ ID NO: 3540538 - RNA, 16 nt, Pseudomonas putida KT2440
gcgucacgcagggcca

SEQ ID NO: 3540539 - RNA, 16 nt, Pseudomonas putida KT2440
gcgucagcaccggcag

SEQ ID NO: 3540540 - RNA, 15 nt, Pseudomonas putida KT2440
gcgucagcagggcca

SEQ ID NO: 3540541 - RNA, 22 nt, Pseudomonas putida KT2440
gcgucagcgugguaguugucca

SEQ ID NO: 3540542 - RNA, 20 nt, Pseudomonas putida KT2440
gcgucagcucaagcgcuccc

SEQ ID NO: 3540543 - RNA, 22 nt, Pseudomonas putida KT2440
gcgucagcucaagcgcuccccg

SEQ ID NO: 3540544 - RNA, 16 nt, Pseudomonas putida KT2440
gcgucagggucucgcg

SEQ ID NO: 3540545 - RNA, 18 nt, Pseudomonas putida KT2440
gcgucagggucucgcggc

SEQ ID NO: 3540546 - RNA, 19 nt, Pseudomonas putida KT2440
gcgucagggucucgcggcu

SEQ ID NO: 3540547 - RNA, 20 nt, Pseudomonas putida KT2440
gcgucaucaucagcaggcag

SEQ ID NO: 3540548 - RNA, 19 nt, Pseudomonas putida KT2440
gcgucauccugcgcggcca

SEQ ID NO: 3540549 - RNA, 19 nt, Pseudomonas putida KT2440
gcgucaugcgguacagcac

SEQ ID NO: 3540550 - RNA, 15 nt, Pseudomonas putida KT2440
gcguccacugcaccc

SEQ ID NO: 3540551 - RNA, 18 nt, Pseudomonas putida KT2440
gcguccagcaacagcugc

SEQ ID NO: 3540552 - RNA, 12 nt, Pseudomonas putida KT2440
gcguccagcagu

SEQ ID NO: 3540553 - RNA, 16 nt, Pseudomonas putida KT2440
gcguccagcagugcca

SEQ ID NO: 3540554 - RNA, 20 nt, Pseudomonas putida KT2440
gcguccaggcccgccagagc

SEQ ID NO: 3540555 - RNA, 14 nt, Pseudomonas putida KT2440
gcguccagggcagg

SEQ ID NO: 3540556 - RNA, 17 nt, Pseudomonas putida KT2440
gcguccagggcagguca

SEQ ID NO: 3540557 - RNA, 18 nt, Pseudomonas putida KT2440
gcguccaguucaaugcca

SEQ ID NO: 3540558 - RNA, 19 nt, Pseudomonas putida KT2440
gcguccaguucaaugccag

SEQ ID NO: 3540559 - RNA, 20 nt, Pseudomonas putida KT2440
gcguccaguucaaugccagc

SEQ ID NO: 3540560 - RNA, 15 nt, Pseudomonas putida KT2440
gcguccauggcgccg

SEQ ID NO: 3540561 - RNA, 22 nt, Pseudomonas putida KT2440
gcgucccccgguaccagcaggc

SEQ ID NO: 3540562 - RNA, 19 nt, Pseudomonas putida KT2440
gcguccccggguccaccuc

SEQ ID NO: 3540563 - RNA, 16 nt, Pseudomonas putida KT2440
gcguccgucgccggcc

SEQ ID NO: 3540564 - RNA, 18 nt, Pseudomonas putida KT2440
gcguccuggacccgcagc

SEQ ID NO: 3540565 - RNA, 16 nt, Pseudomonas putida KT2440
gcguccuucagguaga

SEQ ID NO: 3540566 - RNA, 15 nt, Pseudomonas putida KT2440
gcguccuugacgggg

SEQ ID NO: 3540567 - RNA, 22 nt, Pseudomonas putida KT2440
gcgucgaacaacggcagcgaca

SEQ ID NO: 3540568 - RNA, 23 nt, Pseudomonas putida KT2440
gcgucgaacaacggcagcgacag

SEQ ID NO: 3540569 - RNA, 20 nt, Pseudomonas putida KT2440
gcgucgaacacggcguggug

SEQ ID NO: 3540570 - RNA, 15 nt, Pseudomonas putida KT2440
gcgucgacucuuccc

SEQ ID NO: 3540571 - RNA, 18 nt, Pseudomonas putida KT2440
gcgucgaugcggccacag

SEQ ID NO: 3540572 - RNA, 14 nt, Pseudomonas putida KT2440
gcgucgcccagacg

SEQ ID NO: 3540573 - RNA, 12 nt, Pseudomonas putida KT2440
gcgucgccugca

SEQ ID NO: 3540574 - RNA, 23 nt, Pseudomonas putida KT2440
gcgucgcgaaagggccgcaaggc

SEQ ID NO: 3540575 - RNA, 19 nt, Pseudomonas putida KT2440
gcgucgcgaucacgcaggc

SEQ ID NO: 3540576 - RNA, 21 nt, Pseudomonas putida KT2440
gcgucgcgaucacgcaggccc

SEQ ID NO: 3540577 - RNA, 15 nt, Pseudomonas putida KT2440
gcgucgcgaugggcu

SEQ ID NO: 3540578 - RNA, 17 nt, Pseudomonas putida KT2440
gcgucgcgcgcccaggc

SEQ ID NO: 3540579 - RNA, 18 nt, Pseudomonas putida KT2440
gcgucgcuucaucggcug

SEQ ID NO: 3540580 - RNA, 21 nt, Pseudomonas putida KT2440
gcgucggccaccuggucgaau

SEQ ID NO: 3540581 - RNA, 15 nt, Pseudomonas putida KT2440
gcgucggucgcuggu

SEQ ID NO: 3540582 - RNA, 16 nt, Pseudomonas putida KT2440
gcgucggucgcugguu

SEQ ID NO: 3540583 - RNA, 14 nt, Pseudomonas putida KT2440
gcgucguacaggcc

SEQ ID NO: 3540584 - RNA, 15 nt, Pseudomonas putida KT2440
gcgucguacaggccu

SEQ ID NO: 3540585 - RNA, 19 nt, Pseudomonas putida KT2440
gcgucguggccuucgcggg

SEQ ID NO: 3540586 - RNA, 18 nt, Pseudomonas putida KT2440
gcgucguuggggucgacc

SEQ ID NO: 3540587 - RNA, 21 nt, Pseudomonas putida KT2440
gcgucguuggggucgaccgga

SEQ ID NO: 3540588 - RNA, 21 nt, Pseudomonas putida KT2440
gcgucucgaugcaauccgcca

SEQ ID NO: 3540589 - RNA, 12 nt, Pseudomonas putida KT2440
gcgucucgccgc

SEQ ID NO: 3540590 - RNA, 20 nt, Pseudomonas putida KT2440
gcgucucuuccuccaucucg

SEQ ID NO: 3540591 - RNA, 22 nt, Pseudomonas putida KT2440
gcgucucuuucaggcacagcac

SEQ ID NO: 3540592 - RNA, 14 nt, Pseudomonas putida KT2440
gcgucugacuggca

SEQ ID NO: 3540593 - RNA, 17 nt, Pseudomonas putida KT2440
gcgucugauagccaggg

SEQ ID NO: 3540594 - RNA, 14 nt, Pseudomonas putida KT2440
gcgucugccgcagc

SEQ ID NO: 3540595 - RNA, 20 nt, Pseudomonas putida KT2440
gcgucugccgcagccccgcc

SEQ ID NO: 3540596 - RNA, 15 nt, Pseudomonas putida KT2440
gcgucuggacccacg

SEQ ID NO: 3540597 - RNA, 18 nt, Pseudomonas putida KT2440
gcgucuggucgcuuucca

SEQ ID NO: 3540598 - RNA, 15 nt, Pseudomonas putida KT2440
gccaccgacuccggc

SEQ ID NO: 3540599 - RNA, 18 nt, Pseudomonas putida KT2440
gccaccgacuccggcaag

SEQ ID NO: 3540600 - RNA, 22 nt, Pseudomonas putida KT2440
gccaccgaucucgccagccugc

SEQ ID NO: 3540601 - RNA, 19 nt, Pseudomonas putida KT2440
gccaccgcacucugcugcu

SEQ ID NO: 3540602 - RNA, 19 nt, Pseudomonas putida KT2440
gccaccgccggguggguga

SEQ ID NO: 3540603 - RNA, 16 nt, Pseudomonas putida KT2440
gccaccgccucggcua

SEQ ID NO: 3540604 - RNA, 14 nt, Pseudomonas putida KT2440
gccaccgcgaugga

SEQ ID NO: 3540605 - RNA, 16 nt, Pseudomonas putida KT2440
gccaccggacagaauc

SEQ ID NO: 3540606 - RNA, 16 nt, Pseudomonas putida KT2440
gccaccggcagcaccu

SEQ ID NO: 3540607 - RNA, 23 nt, Pseudomonas putida KT2440
gccaccggcgcugcguuggccau

SEQ ID NO: 3540608 - RNA, 22 nt, Pseudomonas putida KT2440
gccaccucgacccccuugccag

SEQ ID NO: 3540609 - RNA, 16 nt, Pseudomonas putida KT2440
gccaccucgcuaccca

SEQ ID NO: 3540610 - RNA, 22 nt, Pseudomonas putida KT2440
gccaccugauguacaaggaccu

SEQ ID NO: 3540611 - RNA, 15 nt, Pseudomonas putida KT2440
gccaccugccccagc

SEQ ID NO: 3540612 - RNA, 13 nt, Pseudomonas putida KT2440
gccaccuggccuu

SEQ ID NO: 3540613 - RNA, 16 nt, Pseudomonas putida KT2440
gccaccuguugccgcu

SEQ ID NO: 3540614 - RNA, 19 nt, Pseudomonas putida KT2440
gccaccuguugccgcuucg

SEQ ID NO: 3540615 - RNA, 22 nt, Pseudomonas putida KT2440
gccaccuucagcgggucgagcc

SEQ ID NO: 3540616 - RNA, 14 nt, Pseudomonas putida KT2440
gccacgaaggccgg

SEQ ID NO: 3540617 - RNA, 14 nt, Pseudomonas putida KT2440
gccacgacggaagc

SEQ ID NO: 3540618 - RNA, 18 nt, Pseudomonas putida KT2440
gccacgacgugucagugg

SEQ ID NO: 3540619 - RNA, 24 nt, Pseudomonas putida KT2440
gccacgauagcgucagcagggcca

SEQ ID NO: 3540620 - RNA, 18 nt, Pseudomonas putida KT2440
gccacgaucucuucaccg

SEQ ID NO: 3540621 - RNA, 17 nt, Pseudomonas putida KT2440
gccacgaugaucugccg

SEQ ID NO: 3540622 - RNA, 15 nt, Pseudomonas putida KT2440
gccacgauggucacc

SEQ ID NO: 3540623 - RNA, 19 nt, Pseudomonas putida KT2440
gccacgcaucugcaccugg

SEQ ID NO: 3540624 - RNA, 15 nt, Pseudomonas putida KT2440
gccacgcaugccuau

SEQ ID NO: 3540625 - RNA, 20 nt, Pseudomonas putida KT2440
gccacgccagaaccugacaa

SEQ ID NO: 3540626 - RNA, 22 nt, Pseudomonas putida KT2440
gccacgccagaaccugacaagc

SEQ ID NO: 3540627 - RNA, 16 nt, Pseudomonas putida KT2440
gccacgcccaacccag

SEQ ID NO: 3540628 - RNA, 19 nt, Pseudomonas putida KT2440
gccacgcccaacccagcca

SEQ ID NO: 3540629 - RNA, 19 nt, Pseudomonas putida KT2440
gccacgcccaaccccagcg

SEQ ID NO: 3540630 - RNA, 22 nt, Pseudomonas putida KT2440
gccacgcccaaccccagcgcgu

SEQ ID NO: 3540631 - RNA, 16 nt, Pseudomonas putida KT2440
gccacgcccgcugcau

SEQ ID NO: 3540632 - RNA, 19 nt, Pseudomonas putida KT2440
gccacgcccgcugcaugcu

SEQ ID NO: 3540633 - RNA, 20 nt, Pseudomonas putida KT2440
gccacgcccgguugcaccga

SEQ ID NO: 3540634 - RNA, 20 nt, Pseudomonas putida KT2440
gccacgcccuuuuucaccag

SEQ ID NO: 3540635 - RNA, 12 nt, Pseudomonas putida KT2440
gccacgccgcca

SEQ ID NO: 3540636 - RNA, 15 nt, Pseudomonas putida KT2440
gccacgccgccagau

SEQ ID NO: 3540637 - RNA, 19 nt, Pseudomonas putida KT2440
gccacgccggucgggcacu

SEQ ID NO: 3540638 - RNA, 22 nt, Pseudomonas putida KT2440
gccacgccugcagucgaucccg

SEQ ID NO: 3540639 - RNA, 12 nt, Pseudomonas putida KT2440
gccacgcgcgcc

SEQ ID NO: 3540640 - RNA, 20 nt, Pseudomonas putida KT2440
gccacgcgggcuaugcgauu

SEQ ID NO: 3540641 - RNA, 19 nt, Pseudomonas putida KT2440
gccacgcgguaccuguggg

SEQ ID NO: 3540642 - RNA, 21 nt, Pseudomonas putida KT2440
gccacgcucaaccccaucacc

SEQ ID NO: 3540643 - RNA, 14 nt, Pseudomonas putida KT2440
gccacgcucgugca

SEQ ID NO: 3540644 - RNA, 16 nt, Pseudomonas putida KT2440
gccacgcucgugcagg

SEQ ID NO: 3540645 - RNA, 17 nt, Pseudomonas putida KT2440
gccacgcugaacacgcc

SEQ ID NO: 3540646 - RNA, 15 nt, Pseudomonas putida KT2440
gccacggaucaccug

SEQ ID NO: 3540647 - RNA, 17 nt, Pseudomonas putida KT2440
gccacggaucaccuggc

SEQ ID NO: 3540648 - RNA, 20 nt, Pseudomonas putida KT2440
gccacggaucaccuggccgu

SEQ ID NO: 3540649 - RNA, 21 nt, Pseudomonas putida KT2440
gccacggaucaccuggccgug

SEQ ID NO: 3540650 - RNA, 17 nt, Pseudomonas putida KT2440
gccacggcaauggcccg

SEQ ID NO: 3540651 - RNA, 18 nt, Pseudomonas putida KT2440
gccacggcaauggcccgc

SEQ ID NO: 3540652 - RNA, 14 nt, Pseudomonas putida KT2440
gccacggcgcugac

SEQ ID NO: 3540653 - RNA, 17 nt, Pseudomonas putida KT2440
gccacgggcaaacaggc

SEQ ID NO: 3540654 - RNA, 16 nt, Pseudomonas putida KT2440
gccacgguacgggcaa

SEQ ID NO: 3540655 - RNA, 21 nt, Pseudomonas putida KT2440
gccacgguacgggcaaagccc

SEQ ID NO: 3540656 - RNA, 22 nt, Pseudomonas putida KT2440
gccacgguaggccuugaccagc

SEQ ID NO: 3540657 - RNA, 23 nt, Pseudomonas putida KT2440
gccacgguaggccuugaccagcu

SEQ ID NO: 3540658 - RNA, 17 nt, Pseudomonas putida KT2440
gccacggucuggcgcag

SEQ ID NO: 3540659 - RNA, 16 nt, Pseudomonas putida KT2440
gccacggugccgaaca

SEQ ID NO: 3540660 - RNA, 18 nt, Pseudomonas putida KT2440
gccacgguguauccagcc

SEQ ID NO: 3540661 - RNA, 16 nt, Pseudomonas putida KT2440
gccacggugucggaca

SEQ ID NO: 3540662 - RNA, 21 nt, Pseudomonas putida KT2440
gccacggugucggacagguug

SEQ ID NO: 3540663 - RNA, 15 nt, Pseudomonas putida KT2440
gccacguacagagau

SEQ ID NO: 3540664 - RNA, 19 nt, Pseudomonas putida KT2440
gccacguccgaugccguag

SEQ ID NO: 3540665 - RNA, 14 nt, Pseudomonas putida KT2440
gccacgucgccagc

SEQ ID NO: 3540666 - RNA, 19 nt, Pseudomonas putida KT2440
gccacgucgccagcggcaa

SEQ ID NO: 3540667 - RNA, 17 nt, Pseudomonas putida KT2440
gccacguucugcagccu

SEQ ID NO: 3540668 - RNA, 20 nt, Pseudomonas putida KT2440
gccacguugaucgucggccc

SEQ ID NO: 3540669 - RNA, 16 nt, Pseudomonas putida KT2440
gccacguuugagcagu

SEQ ID NO: 3540670 - RNA, 15 nt, Pseudomonas putida KT2440
gccacucagcggguc

SEQ ID NO: 3540671 - RNA, 23 nt, Pseudomonas putida KT2440
gccacucagcggguccucgaaac

SEQ ID NO: 3540672 - RNA, 12 nt, Pseudomonas putida KT2440
gccacucaggcg

SEQ ID NO: 3540673 - RNA, 19 nt, Pseudomonas putida KT2440
gccacuccgccucguuggc

SEQ ID NO: 3540674 - RNA, 23 nt, Pseudomonas putida KT2440
gccacuccgccucguuggcgaag

SEQ ID NO: 3540675 - RNA, 14 nt, Pseudomonas putida KT2440
gccacucuucacca

SEQ ID NO: 3540676 - RNA, 15 nt, Pseudomonas putida KT2440
gccacucuucaccau

SEQ ID NO: 3540677 - RNA, 21 nt, Pseudomonas putida KT2440
gccacucuucaccaugggccu

SEQ ID NO: 3540678 - RNA, 22 nt, Pseudomonas putida KT2440
gccacucuucaccaugggccug

SEQ ID NO: 3540679 - RNA, 14 nt, Pseudomonas putida KT2440
gccacugaccagcc

SEQ ID NO: 3540680 - RNA, 19 nt, Pseudomonas putida KT2440
gccacugaccagcccggcu

SEQ ID NO: 3540681 - RNA, 20 nt, Pseudomonas putida KT2440
gccacugccacuggucgccu

SEQ ID NO: 3540682 - RNA, 19 nt, Pseudomonas putida KT2440
gccacugcgcuacgaccca

SEQ ID NO: 3540683 - RNA, 16 nt, Pseudomonas putida KT2440
gccacuggccagcaga

SEQ ID NO: 3540684 - RNA, 14 nt, Pseudomonas putida KT2440
gccacuggucgccu

SEQ ID NO: 3540685 - RNA, 16 nt, Pseudomonas putida KT2440
gccacuguugcagcgc

SEQ ID NO: 3540686 - RNA, 17 nt, Pseudomonas putida KT2440
gccacuguugcagcgcc

SEQ ID NO: 3540687 - RNA, 18 nt, Pseudomonas putida KT2440
gccacuguugcagcgcca

SEQ ID NO: 3540688 - RNA, 20 nt, Pseudomonas putida KT2440
gccacuguugcagcgccagu

SEQ ID NO: 3540689 - RNA, 15 nt, Pseudomonas putida KT2440
gccacuucaugggcc

SEQ ID NO: 3540690 - RNA, 23 nt, Pseudomonas putida KT2440
gccacuucgccguacuggcugca

SEQ ID NO: 3540691 - RNA, 13 nt, Pseudomonas putida KT2440
gccacuucgcgag

SEQ ID NO: 3540692 - RNA, 19 nt, Pseudomonas putida KT2440
gccacuucgcgagcgagcg

SEQ ID NO: 3540693 - RNA, 14 nt, Pseudomonas putida KT2440
gccacuucgcggaa

SEQ ID NO: 3540694 - RNA, 23 nt, Pseudomonas putida KT2440
gccacuucuuccacgcgcucacg

SEQ ID NO: 3540695 - RNA, 20 nt, Pseudomonas putida KT2440
gccagaaagccacugcacca

SEQ ID NO: 3540696 - RNA, 23 nt, Pseudomonas putida KT2440
gccagaaagccacugcaccaaug

SEQ ID NO: 3540697 - RNA, 17 nt, Pseudomonas putida KT2440
gccagaaccugacaagc

SEQ ID NO: 3540698 - RNA, 19 nt, Pseudomonas putida KT2440
gccagaagcguaccgccag

SEQ ID NO: 3540699 - RNA, 13 nt, Pseudomonas putida KT2440
gccagaaggcuca

SEQ ID NO: 3540700 - RNA, 19 nt, Pseudomonas putida KT2440
gccagaagguaucggccau

SEQ ID NO: 3540701 - RNA, 16 nt, Pseudomonas putida KT2440
gccagacaacuggcca

SEQ ID NO: 3540702 - RNA, 14 nt, Pseudomonas putida KT2440
gccagaccaccuca

SEQ ID NO: 3540703 - RNA, 17 nt, Pseudomonas putida KT2440
gccagaccaccucaucc

SEQ ID NO: 3540704 - RNA, 21 nt, Pseudomonas putida KT2440
gccagaccaccucaucccccg

SEQ ID NO: 3540705 - RNA, 23 nt, Pseudomonas putida KT2440
gccagaccaccucaucccccggc

SEQ ID NO: 3540706 - RNA, 16 nt, Pseudomonas putida KT2440
gccagaccauaagcgg

SEQ ID NO: 3540707 - RNA, 17 nt, Pseudomonas putida KT2440
gccagaccuugcgcacg

SEQ ID NO: 3540708 - RNA, 14 nt, Pseudomonas putida KT2440
gccagacgaccagc

SEQ ID NO: 3540709 - RNA, 15 nt, Pseudomonas putida KT2440
gccagacgaccagca

SEQ ID NO: 3540710 - RNA, 18 nt, Pseudomonas putida KT2440
gccagacgaccagcaugc

SEQ ID NO: 3540711 - RNA, 14 nt, Pseudomonas putida KT2440
gccagacucagcug

SEQ ID NO: 3540712 - RNA, 20 nt, Pseudomonas putida KT2440
gccagagaauuucuccccag

SEQ ID NO: 3540713 - RNA, 18 nt, Pseudomonas putida KT2440
gccagagcgcgccacgca

SEQ ID NO: 3540714 - RNA, 14 nt, Pseudomonas putida KT2440
gccagaucauggcg

SEQ ID NO: 3540715 - RNA, 15 nt, Pseudomonas putida KT2440
gccagaucauggcgg

SEQ ID NO: 3540716 - RNA, 16 nt, Pseudomonas putida KT2440
gccagaucauggcggu

SEQ ID NO: 3540717 - RNA, 16 nt, Pseudomonas putida KT2440
gccagaucggccagcu

SEQ ID NO: 3540718 - RNA, 19 nt, Pseudomonas putida KT2440
gccagaucucgcgcuuuuc

SEQ ID NO: 3540719 - RNA, 13 nt, Pseudomonas putida KT2440
gccagaugcgccg

SEQ ID NO: 3540720 - RNA, 22 nt, Pseudomonas putida KT2440
gccagaugcgccgggacagcac

SEQ ID NO: 3540721 - RNA, 17 nt, Pseudomonas putida KT2440
gccagaugcgcgcugca

SEQ ID NO: 3540722 - RNA, 21 nt, Pseudomonas putida KT2440
gccagaugcgcgcugcaauca

SEQ ID NO: 3540723 - RNA, 20 nt, Pseudomonas putida KT2440
gccagcaaaaguuggcugac

SEQ ID NO: 3540724 - RNA, 19 nt, Pseudomonas putida KT2440
gccagcaaacccucggccu

SEQ ID NO: 3540725 - RNA, 14 nt, Pseudomonas putida KT2440
gccagcaacaagcu

SEQ ID NO: 3540726 - RNA, 15 nt, Pseudomonas putida KT2440
gccagcaacaagcug

SEQ ID NO: 3540727 - RNA, 24 nt, Pseudomonas putida KT2440
gccagcaacaagcuggacaugcac

SEQ ID NO: 3540728 - RNA, 13 nt, Pseudomonas putida KT2440
gccagcaacaggc

SEQ ID NO: 3540729 - RNA, 14 nt, Pseudomonas putida KT2440
gccagcaacaggcu

SEQ ID NO: 3540730 - RNA, 16 nt, Pseudomonas putida KT2440
gccagcaacgcagcca

SEQ ID NO: 3540731 - RNA, 18 nt, Pseudomonas putida KT2440
gccagcaacgcagccagg

SEQ ID NO: 3540732 - RNA, 17 nt, Pseudomonas putida KT2440
gccagcaacuggugaau

SEQ ID NO: 3540733 - RNA, 22 nt, Pseudomonas putida KT2440
gccagcaacuggugaaucagcc

SEQ ID NO: 3540734 - RNA, 23 nt, Pseudomonas putida KT2440
gccagcaacuggugaaucagccc

SEQ ID NO: 3540735 - RNA, 13 nt, Pseudomonas putida KT2440
gccagcaagcggg

SEQ ID NO: 3540736 - RNA, 21 nt, Pseudomonas putida KT2440
gccagcaaggcaauaccgaug

SEQ ID NO: 3540737 - RNA, 17 nt, Pseudomonas putida KT2440
gccagcaaugcgucggc

SEQ ID NO: 3540738 - RNA, 20 nt, Pseudomonas putida KT2440
gccagcacacgguaggcguc

SEQ ID NO: 3540739 - RNA, 22 nt, Pseudomonas putida KT2440
gccagcacacgguaggcgucuu

SEQ ID NO: 3540740 - RNA, 14 nt, Pseudomonas putida KT2440
gccagcacaggcgg

SEQ ID NO: 3540741 - RNA, 15 nt, Pseudomonas putida KT2440
gccagcaccaucagg

SEQ ID NO: 3540742 - RNA, 19 nt, Pseudomonas putida KT2440
gccagcaccgaaccggcga

SEQ ID NO: 3540743 - RNA, 15 nt, Pseudomonas putida KT2440
gccagcacgaacagc

SEQ ID NO: 3540744 - RNA, 16 nt, Pseudomonas putida KT2440
gccagcacgaacagca

SEQ ID NO: 3540745 - RNA, 17 nt, Pseudomonas putida KT2440
gccagcacgaacagcaa

SEQ ID NO: 3540746 - RNA, 19 nt, Pseudomonas putida KT2440
gccagcacgaacagcaaca

SEQ ID NO: 3540747 - RNA, 15 nt, Pseudomonas putida KT2440
gccagcacgcaggcc

SEQ ID NO: 3540748 - RNA, 17 nt, Pseudomonas putida KT2440
gccagcacgcaggccag

SEQ ID NO: 3540749 - RNA, 18 nt, Pseudomonas putida KT2440
gccagcacgcaggccagc

SEQ ID NO: 3540750 - RNA, 14 nt, Pseudomonas putida KT2440
gccagcacgccggc

SEQ ID NO: 3540751 - RNA, 15 nt, Pseudomonas putida KT2440
gccagcacggccagc

SEQ ID NO: 3540752 - RNA, 18 nt, Pseudomonas putida KT2440
gccagcacggccagcacc

SEQ ID NO: 3540753 - RNA, 20 nt, Pseudomonas putida KT2440
gccagcacggccagcaccga

SEQ ID NO: 3540754 - RNA, 21 nt, Pseudomonas putida KT2440
gccagcagauggcucaucgcc

SEQ ID NO: 3540755 - RNA, 22 nt, Pseudomonas putida KT2440
gccagcagauggcucaucgccg

SEQ ID NO: 3540756 - RNA, 12 nt, Pseudomonas putida KT2440
gccagcagcccc

SEQ ID NO: 3540757 - RNA, 12 nt, Pseudomonas putida KT2440
gccagcagcgca

SEQ ID NO: 3540758 - RNA, 17 nt, Pseudomonas putida KT2440
gccagcagcgcauggcu

SEQ ID NO: 3540759 - RNA, 13 nt, Pseudomonas putida KT2440
gccagcagcgcgu

SEQ ID NO: 3540760 - RNA, 18 nt, Pseudomonas putida KT2440
gccagcagcgcuccgcca

SEQ ID NO: 3540761 - RNA, 20 nt, Pseudomonas putida KT2440
gccagcagcggguuccccag

SEQ ID NO: 3540762 - RNA, 17 nt, Pseudomonas putida KT2440
gccagcagcuggcuugu

SEQ ID NO: 3540763 - RNA, 13 nt, Pseudomonas putida KT2440
gccagcagcuggu

SEQ ID NO: 3540764 - RNA, 16 nt, Pseudomonas putida KT2440
gccagcagcuggucgu

SEQ ID NO: 3540765 - RNA, 17 nt, Pseudomonas putida KT2440
gccagcaggacgauacc

SEQ ID NO: 3540766 - RNA, 18 nt, Pseudomonas putida KT2440
gccagcaggccaccggca

SEQ ID NO: 3540767 - RNA, 22 nt, Pseudomonas putida KT2440
gccagcaggccaccggcagcac

SEQ ID NO: 3540768 - RNA, 12 nt, Pseudomonas putida KT2440
gccagcaggccg

SEQ ID NO: 3540769 - RNA, 14 nt, Pseudomonas putida KT2440
gccagcaggccgcc

SEQ ID NO: 3540770 - RNA, 19 nt, Pseudomonas putida KT2440
gccagcaggccgccgacga

SEQ ID NO: 3540771 - RNA, 22 nt, Pseudomonas putida KT2440
gccagcagggcaggggacagcc

SEQ ID NO: 3540772 - RNA, 17 nt, Pseudomonas putida KT2440
gccagcagggccggccc

SEQ ID NO: 3540773 - RNA, 16 nt, Pseudomonas putida KT2440
gccagcaggucagcac

SEQ ID NO: 3540774 - RNA, 15 nt, Pseudomonas putida KT2440
gccagcaggucaggc

SEQ ID NO: 3540775 - RNA, 16 nt, Pseudomonas putida KT2440
gccagcaggucaggcc

SEQ ID NO: 3540776 - RNA, 18 nt, Pseudomonas putida KT2440
gccagcaggucaggcccu

SEQ ID NO: 3540777 - RNA, 15 nt, Pseudomonas putida KT2440
gccagcagugcaucg

SEQ ID NO: 3540778 - RNA, 15 nt, Pseudomonas putida KT2440
gccagcagugcggca

SEQ ID NO: 3540779 - RNA, 17 nt, Pseudomonas putida KT2440
gccagcagugcggcaac

SEQ ID NO: 3540780 - RNA, 22 nt, Pseudomonas putida KT2440
gccagcaguucgcagccauagu

SEQ ID NO: 3540781 - RNA, 12 nt, Pseudomonas putida KT2440
gccagcaucacc

SEQ ID NO: 3540782 - RNA, 15 nt, Pseudomonas putida KT2440
gccagcaucacgccg

SEQ ID NO: 3540783 - RNA, 22 nt, Pseudomonas putida KT2440
gccagcaucacgccgcgcuggc

SEQ ID NO: 3540784 - RNA, 22 nt, Pseudomonas putida KT2440
gccagcaucgaggaaggcaucg

SEQ ID NO: 3540785 - RNA, 15 nt, Pseudomonas putida KT2440
gccagcaucucggcc

SEQ ID NO: 3540786 - RNA, 18 nt, Pseudomonas putida KT2440
gccagcaucucggccagu

SEQ ID NO: 3540787 - RNA, 20 nt, Pseudomonas putida KT2440
gccagcaugcuaauugcccg

SEQ ID NO: 3540788 - RNA, 22 nt, Pseudomonas putida KT2440
gccagcaugcuaauugcccgag

SEQ ID NO: 3540789 - RNA, 13 nt, Pseudomonas putida KT2440
gccagcauggccg

SEQ ID NO: 3540790 - RNA, 22 nt, Pseudomonas putida KT2440
gccagcauggccggauagagcc

SEQ ID NO: 3540791 - RNA, 15 nt, Pseudomonas putida KT2440
gccagcauggugcag

SEQ ID NO: 3540792 - RNA, 17 nt, Pseudomonas putida KT2440
gccagccaacgcuggua

SEQ ID NO: 3540793 - RNA, 14 nt, Pseudomonas putida KT2440
gccagccaacggca

SEQ ID NO: 3540794 - RNA, 18 nt, Pseudomonas putida KT2440
gccagccaccaccaugcg

SEQ ID NO: 3540795 - RNA, 14 nt, Pseudomonas putida KT2440
gccagccagguugu

SEQ ID NO: 3540796 - RNA, 18 nt, Pseudomonas putida KT2440
gccagcccaggcuggcac

SEQ ID NO: 3540797 - RNA, 12 nt, Pseudomonas putida KT2440
gccagcccaucc

SEQ ID NO: 3540798 - RNA, 23 nt, Pseudomonas putida KT2440
gccagcccauccagggcuuccug

SEQ ID NO: 3540799 - RNA, 17 nt, Pseudomonas putida KT2440
gccagcccauggcgcug

SEQ ID NO: 3540800 - RNA, 12 nt, Pseudomonas putida KT2440
gccagccccagc

SEQ ID NO: 3540801 - RNA, 14 nt, Pseudomonas putida KT2440
gccagccccagccc

SEQ ID NO: 3540802 - RNA, 17 nt, Pseudomonas putida KT2440
gccagcccgccacaccg

SEQ ID NO: 3540803 - RNA, 19 nt, Pseudomonas putida KT2440
gccagcccugccgaggcca

SEQ ID NO: 3540804 - RNA, 12 nt, Pseudomonas putida KT2440
gccagccgaggg

SEQ ID NO: 3540805 - RNA, 21 nt, Pseudomonas putida KT2440
gccagccgcaaccgggucggc

SEQ ID NO: 3540806 - RNA, 14 nt, Pseudomonas putida KT2440
gccagccgccgccg

SEQ ID NO: 3540807 - RNA, 17 nt, Pseudomonas putida KT2440
gccagccgccgccgagu

SEQ ID NO: 3540808 - RNA, 16 nt, Pseudomonas putida KT2440
gccagccgcgccaggu

SEQ ID NO: 3540809 - RNA, 17 nt, Pseudomonas putida KT2440
gccagccgcgccagguc

SEQ ID NO: 3540810 - RNA, 20 nt, Pseudomonas putida KT2440
gccagccgcgccaggucggc

SEQ ID NO: 3540811 - RNA, 13 nt, Pseudomonas putida KT2440
gccagccgcggca

SEQ ID NO: 3540812 - RNA, 15 nt, Pseudomonas putida KT2440
gccagccgcggcagc

SEQ ID NO: 3540813 - RNA, 15 nt, Pseudomonas putida KT2440
gccagccgcucagcc

SEQ ID NO: 3540814 - RNA, 23 nt, Pseudomonas putida KT2440
gccagccguugauccaggcuugg

SEQ ID NO: 3540815 - RNA, 17 nt, Pseudomonas putida KT2440
gccagccguugcgccgc

SEQ ID NO: 3540816 - RNA, 18 nt, Pseudomonas putida KT2440
gccagccguugcgccgcu

SEQ ID NO: 3540817 - RNA, 23 nt, Pseudomonas putida KT2440
gccagccguuguuugucaccccg

SEQ ID NO: 3540818 - RNA, 14 nt, Pseudomonas putida KT2440
gccagccuccggcc

SEQ ID NO: 3540819 - RNA, 21 nt, Pseudomonas putida KT2440
gccagccuccggcccaucccg

SEQ ID NO: 3540820 - RNA, 13 nt, Pseudomonas putida KT2440
gccagccugcagc

SEQ ID NO: 3540821 - RNA, 14 nt, Pseudomonas putida KT2440
gccagccugcagcg

SEQ ID NO: 3540822 - RNA, 20 nt, Pseudomonas putida KT2440
gccagccugcagcgcggcga

SEQ ID NO: 3540823 - RNA, 23 nt, Pseudomonas putida KT2440
gccagccuuaccccccugcacca

SEQ ID NO: 3540824 - RNA, 12 nt, Pseudomonas putida KT2440
gccagccuucga

SEQ ID NO: 3540825 - RNA, 14 nt, Pseudomonas putida KT2440
gccagcgacagcau

SEQ ID NO: 3540826 - RNA, 15 nt, Pseudomonas putida KT2440
gccagcgacagcauc

SEQ ID NO: 3540827 - RNA, 13 nt, Pseudomonas putida KT2440
gccagcgaggcaa

SEQ ID NO: 3540828 - RNA, 21 nt, Pseudomonas putida KT2440
gccagcgaggcaaucagggca

SEQ ID NO: 3540829 - RNA, 15 nt, Pseudomonas putida KT2440
gccagcgcacagcug

SEQ ID NO: 3540830 - RNA, 17 nt, Pseudomonas putida KT2440
gccagcgcacagcugcc

SEQ ID NO: 3540831 - RNA, 16 nt, Pseudomonas putida KT2440
gccagcgccaccgcgc

SEQ ID NO: 3540832 - RNA, 15 nt, Pseudomonas putida KT2440
gccagcgccucaccg

SEQ ID NO: 3540833 - RNA, 12 nt, Pseudomonas putida KT2440
gccagcgccugc

SEQ ID NO: 3540834 - RNA, 15 nt, Pseudomonas putida KT2440
gccagcgccugcagg

SEQ ID NO: 3540835 - RNA, 19 nt, Pseudomonas putida KT2440
gccagcgccugcaggccca

SEQ ID NO: 3540836 - RNA, 14 nt, Pseudomonas putida KT2440
gccagcgccuggcg

SEQ ID NO: 3540837 - RNA, 17 nt, Pseudomonas putida KT2440
gccagcgccuggcgcag

SEQ ID NO: 3540838 - RNA, 18 nt, Pseudomonas putida KT2440
gccagcgcgcugagcagg

SEQ ID NO: 3540839 - RNA, 15 nt, Pseudomonas putida KT2440
gccagcgcgcugcgc

SEQ ID NO: 3540840 - RNA, 16 nt, Pseudomonas putida KT2440
gccagcgcgcugcgca

SEQ ID NO: 3540841 - RNA, 23 nt, Pseudomonas putida KT2440
gccagcgcgcugcgcaaggacga

SEQ ID NO: 3540842 - RNA, 19 nt, Pseudomonas putida KT2440
gccagcgcgguagcugccg

SEQ ID NO: 3540843 - RNA, 22 nt, Pseudomonas putida KT2440
gccagcgcgguagcugccgcgu

SEQ ID NO: 3540844 - RNA, 15 nt, Pseudomonas putida KT2440
gccagcgcuccagca

SEQ ID NO: 3540845 - RNA, 17 nt, Pseudomonas putida KT2440
gccagcggccagcgccu

SEQ ID NO: 3540846 - RNA, 23 nt, Pseudomonas putida KT2440
gccagcggccagcgccuggcgca

SEQ ID NO: 3540847 - RNA, 13 nt, Pseudomonas putida KT2440
gccagcggccgcu

SEQ ID NO: 3540848 - RNA, 16 nt, Pseudomonas putida KT2440
gccagcggcgaugcuc

SEQ ID NO: 3540849 - RNA, 21 nt, Pseudomonas putida KT2440
gccagcggcucgaccaagccu

SEQ ID NO: 3540850 - RNA, 23 nt, Pseudomonas putida KT2440
gccagcgggaaguuaccgcccgc

SEQ ID NO: 3540851 - RNA, 22 nt, Pseudomonas putida KT2440
gccagcgggucgucgcccaggc

SEQ ID NO: 3540852 - RNA, 17 nt, Pseudomonas putida KT2440
gccagcgguccggcccu

SEQ ID NO: 3540853 - RNA, 16 nt, Pseudomonas putida KT2440
gccagcgucagggucu

SEQ ID NO: 3540854 - RNA, 21 nt, Pseudomonas putida KT2440
gccagcgucguguucgccugu

SEQ ID NO: 3540855 - RNA, 17 nt, Pseudomonas putida KT2440
gccagcgugaaccggcu

SEQ ID NO: 3540856 - RNA, 13 nt, Pseudomonas putida KT2440
gccagcguggccg

SEQ ID NO: 3540857 - RNA, 22 nt, Pseudomonas putida KT2440
gccagcguggccgccaacagcg

SEQ ID NO: 3540858 - RNA, 14 nt, Pseudomonas putida KT2440
gccagcguguucca

SEQ ID NO: 3540859 - RNA, 19 nt, Pseudomonas putida KT2440
gccagcuaucucccagccu

SEQ ID NO: 3540860 - RNA, 13 nt, Pseudomonas putida KT2440
gccagcucaucca

SEQ ID NO: 3540861 - RNA, 16 nt, Pseudomonas putida KT2440
gccagcuccacacucg

SEQ ID NO: 3540862 - RNA, 14 nt, Pseudomonas putida KT2440
gccagcuccaccag

SEQ ID NO: 3540863 - RNA, 23 nt, Pseudomonas putida KT2440
gccagcuccuucgcuucgcgcac

SEQ ID NO: 3540864 - RNA, 13 nt, Pseudomonas putida KT2440
gccagcucggcag

SEQ ID NO: 3540865 - RNA, 17 nt, Pseudomonas putida KT2440
gccagcucggccgaugc

SEQ ID NO: 3540866 - RNA, 19 nt, Pseudomonas putida KT2440
gccagcucggccgaugcca

SEQ ID NO: 3540867 - RNA, 12 nt, Pseudomonas putida KT2440
gccagcugcgca

SEQ ID NO: 3540868 - RNA, 16 nt, Pseudomonas putida KT2440
gccagcugcgcacgca

SEQ ID NO: 3540869 - RNA, 23 nt, Pseudomonas putida KT2440
gccagcugcgcugccugcuggcg

SEQ ID NO: 3540870 - RNA, 11 nt, Pseudomonas putida KT2440
gccagcugcug

SEQ ID NO: 3540871 - RNA, 16 nt, Pseudomonas putida KT2440
gccagcugcugcccca

SEQ ID NO: 3540872 - RNA, 17 nt, Pseudomonas putida KT2440
gccagcuuggcaggcuu

SEQ ID NO: 3540873 - RNA, 21 nt, Pseudomonas putida KT2440
gccagcuuggcuuucggcgca

SEQ ID NO: 3540874 - RNA, 18 nt, Pseudomonas putida KT2440
gccagcuuggucagggca

SEQ ID NO: 3540875 - RNA, 19 nt, Pseudomonas putida KT2440
gccagcuuggucagggcaa

SEQ ID NO: 3540876 - RNA, 22 nt, Pseudomonas putida KT2440
gccagcuuuuagacauugagca

SEQ ID NO: 3540877 - RNA, 18 nt, Pseudomonas putida KT2440
gccaggaacagcgcagcc

SEQ ID NO: 3540878 - RNA, 19 nt, Pseudomonas putida KT2440
gccaggaacagcgccacgc

SEQ ID NO: 3540879 - RNA, 21 nt, Pseudomonas putida KT2440
gccaggaagucgauguucagc

SEQ ID NO: 3540880 - RNA, 18 nt, Pseudomonas putida KT2440
gccaggacggugguggcc

SEQ ID NO: 3540881 - RNA, 19 nt, Pseudomonas putida KT2440
gccaggagaacacccagcg

SEQ ID NO: 3540882 - RNA, 18 nt, Pseudomonas putida KT2440
gccaggaguucugcacag

SEQ ID NO: 3540883 - RNA, 20 nt, Pseudomonas putida KT2440
gccaggaucaacugccgcgc

SEQ ID NO: 3540884 - RNA, 14 nt, Pseudomonas putida KT2440
gccaggaucgagac

SEQ ID NO: 3540885 - RNA, 17 nt, Pseudomonas putida KT2440
gccaggaucgagaccuu

SEQ ID NO: 3540886 - RNA, 18 nt, Pseudomonas putida KT2440
gccaggcacccagccagc

SEQ ID NO: 3540887 - RNA, 13 nt, Pseudomonas putida KT2440
gccaggcagcaga

SEQ ID NO: 3540888 - RNA, 22 nt, Pseudomonas putida KT2440
gccaggcauuccccggucagca

SEQ ID NO: 3540889 - RNA, 14 nt, Pseudomonas putida KT2440
gccaggcauugccc

SEQ ID NO: 3540890 - RNA, 14 nt, Pseudomonas putida KT2440
gccaggcccaccac

SEQ ID NO: 3540891 - RNA, 18 nt, Pseudomonas putida KT2440
gccaggcccaccaccggu

SEQ ID NO: 3540892 - RNA, 13 nt, Pseudomonas putida KT2440
gccaggcccagcc

SEQ ID NO: 3540893 - RNA, 15 nt, Pseudomonas putida KT2440
gccaggcccagcccc

SEQ ID NO: 3540894 - RNA, 17 nt, Pseudomonas putida KT2440
gccaggcccagccccgc

SEQ ID NO: 3540895 - RNA, 12 nt, Pseudomonas putida KT2440
gccaggccgaca

SEQ ID NO: 3540896 - RNA, 16 nt, Pseudomonas putida KT2440
gccaggccgcacgcgc

SEQ ID NO: 3540897 - RNA, 14 nt, Pseudomonas putida KT2440
gccaggccggcgca

SEQ ID NO: 3540898 - RNA, 19 nt, Pseudomonas putida KT2440
gccaggccuuucagcgccc

SEQ ID NO: 3540899 - RNA, 15 nt, Pseudomonas putida KT2440
gccaggcgcaagccu

SEQ ID NO: 3540900 - RNA, 15 nt, Pseudomonas putida KT2440
gccaggcgcaccgcc

SEQ ID NO: 3540901 - RNA, 15 nt, Pseudomonas putida KT2440
gccaggcgcgguucg

SEQ ID NO: 3540902 - RNA, 21 nt, Pseudomonas putida KT2440
gccaggcguauucggccacca

SEQ ID NO: 3540903 - RNA, 18 nt, Pseudomonas putida KT2440
gccaggcgucgaucagau

SEQ ID NO: 3540904 - RNA, 15 nt, Pseudomonas putida KT2440
gccaggcgucguugu

SEQ ID NO: 3540905 - RNA, 16 nt, Pseudomonas putida KT2440
gccaggcguugugggu

SEQ ID NO: 3540906 - RNA, 20 nt, Pseudomonas putida KT2440
gccaggcguugugggugaag

SEQ ID NO: 3540907 - RNA, 13 nt, Pseudomonas putida KT2440
gccaggcucaggc

SEQ ID NO: 3540908 - RNA, 15 nt, Pseudomonas putida KT2440
gccaggcucaggccu

SEQ ID NO: 3540909 - RNA, 19 nt, Pseudomonas putida KT2440
gccaggcucgacggcgcaa

SEQ ID NO: 3540910 - RNA, 15 nt, Pseudomonas putida KT2440
gccaggcucuccagc

SEQ ID NO: 3540911 - RNA, 18 nt, Pseudomonas putida KT2440
gccaggcucuccagccgc

SEQ ID NO: 3540912 - RNA, 22 nt, Pseudomonas putida KT2440
gccaggcucuccagccgcugcu

SEQ ID NO: 3540913 - RNA, 13 nt, Pseudomonas putida KT2440
gccaggcugagcc

SEQ ID NO: 3540914 - RNA, 21 nt, Pseudomonas putida KT2440
gccaggcugauacgcgacagu

SEQ ID NO: 3540915 - RNA, 21 nt, Pseudomonas putida KT2440
gccaggcuuggcgugcggcgu

SEQ ID NO: 3540916 - RNA, 23 nt, Pseudomonas putida KT2440
gccaggcuugguuuggccucugg

SEQ ID NO: 3540917 - RNA, 16 nt, Pseudomonas putida KT2440
gccaggcuuuccaggu

SEQ ID NO: 3540918 - RNA, 20 nt, Pseudomonas putida KT2440
gccagggauuccuuggucag

SEQ ID NO: 3540919 - RNA, 20 nt, Pseudomonas putida KT2440
gccagggcaaaaugcagcaa

SEQ ID NO: 3540920 - RNA, 12 nt, Pseudomonas putida KT2440
gccagggcaucg

SEQ ID NO: 3540921 - RNA, 15 nt, Pseudomonas putida KT2440
gccagggccuguagg

SEQ ID NO: 3540922 - RNA, 16 nt, Pseudomonas putida KT2440
gccagggcgcugucgg

SEQ ID NO: 3540923 - RNA, 18 nt, Pseudomonas putida KT2440
gccagggcgcugucggcg

SEQ ID NO: 3540924 - RNA, 22 nt, Pseudomonas putida KT2440
gccaggguaccgccguccacca

SEQ ID NO: 3540925 - RNA, 16 nt, Pseudomonas putida KT2440
gccaggguacgauagg

SEQ ID NO: 3540926 - RNA, 20 nt, Pseudomonas putida KT2440
gccaggguuaccugcgcgag

SEQ ID NO: 3540927 - RNA, 21 nt, Pseudomonas putida KT2440
gccaggguugcaucgcgcacu

SEQ ID NO: 3540928 - RNA, 21 nt, Pseudomonas putida KT2440
gccagguagcgauugcggccu

SEQ ID NO: 3540929 - RNA, 14 nt, Pseudomonas putida KT2440
gccagguauggcca

SEQ ID NO: 3540930 - RNA, 21 nt, Pseudomonas putida KT2440
gccaggucaccgcccagcuuc

SEQ ID NO: 3540931 - RNA, 22 nt, Pseudomonas putida KT2440
gccagguccgguaacuggccca

SEQ ID NO: 3540932 - RNA, 18 nt, Pseudomonas putida KT2440
gccaggucgccggugugc

SEQ ID NO: 3540933 - RNA, 15 nt, Pseudomonas putida KT2440
gccaggugcucagcc

SEQ ID NO: 3540934 - RNA, 19 nt, Pseudomonas putida KT2440
gccaggugcucagccacgc

SEQ ID NO: 3540935 - RNA, 20 nt, Pseudomonas putida KT2440
gccaggugcucagccacgcu

SEQ ID NO: 3540936 - RNA, 11 nt, Pseudomonas putida KT2440
gccagguggcc

SEQ ID NO: 3540937 - RNA, 16 nt, Pseudomonas putida KT2440
gccagguggccuuccc

SEQ ID NO: 3540938 - RNA, 21 nt, Pseudomonas putida KT2440
gccagguucggaucagcaaug

SEQ ID NO: 3540939 - RNA, 16 nt, Pseudomonas putida KT2440
gccagguuggcaaacu

SEQ ID NO: 3540940 - RNA, 15 nt, Pseudomonas putida KT2440
gccagguuguucagu

SEQ ID NO: 3540941 - RNA, 18 nt, Pseudomonas putida KT2440
gccagguuguucaguggc

SEQ ID NO: 3540942 - RNA, 23 nt, Pseudomonas putida KT2440
gccagguuuuugaugucgccgua

SEQ ID NO: 3540943 - RNA, 15 nt, Pseudomonas putida KT2440
gccaguaaggcuugc

SEQ ID NO: 3540944 - RNA, 23 nt, Pseudomonas putida KT2440
gccaguaaggcuugcucaaggug

SEQ ID NO: 3540945 - RNA, 15 nt, Pseudomonas putida KT2440
gccaguaccagcagc

SEQ ID NO: 3540946 - RNA, 16 nt, Pseudomonas putida KT2440
gccaguaccagcagca

SEQ ID NO: 3540947 - RNA, 22 nt, Pseudomonas putida KT2440
gccaguaccaggucgccagcac

SEQ ID NO: 3540948 - RNA, 20 nt, Pseudomonas putida KT2440
gccaguaccuucuggcugga

SEQ ID NO: 3540949 - RNA, 19 nt, Pseudomonas putida KT2440
gccaguacgcgccugcacc

SEQ ID NO: 3540950 - RNA, 22 nt, Pseudomonas putida KT2440
gccaguacgcgccugcaccugg

SEQ ID NO: 3540951 - RNA, 16 nt, Pseudomonas putida KT2440
gccaguacggccauca

SEQ ID NO: 3540952 - RNA, 18 nt, Pseudomonas putida KT2440
gccaguacggccaucagc

SEQ ID NO: 3540953 - RNA, 15 nt, Pseudomonas putida KT2440
gccaguagcaaucag

SEQ ID NO: 3540954 - RNA, 15 nt, Pseudomonas putida KT2440
gccaguccaggccaa

SEQ ID NO: 3540955 - RNA, 17 nt, Pseudomonas putida KT2440
gccaguccuuggccaau

SEQ ID NO: 3540956 - RNA, 19 nt, Pseudomonas putida KT2440
gccagucgcacagguccag

SEQ ID NO: 3540957 - RNA, 17 nt, Pseudomonas putida KT2440
gccagucugcuccaccg

SEQ ID NO: 3540958 - RNA, 17 nt, Pseudomonas putida KT2440
gccagugaagcucgauc

SEQ ID NO: 3540959 - RNA, 15 nt, Pseudomonas putida KT2440
gccagugauccggcg

SEQ ID NO: 3540960 - RNA, 15 nt, Pseudomonas putida KT2440
gccagugcggugacc

SEQ ID NO: 3540961 - RNA, 13 nt, Pseudomonas putida KT2440
gccagugcgugca

SEQ ID NO: 3540962 - RNA, 21 nt, Pseudomonas putida KT2440
gccagugggugcuguggcgca

SEQ ID NO: 3540963 - RNA, 21 nt, Pseudomonas putida KT2440
gccagugucaguugcucgccc

SEQ ID NO: 3540964 - RNA, 23 nt, Pseudomonas putida KT2440
gccagugucaguugcucgcccgc

SEQ ID NO: 3540965 - RNA, 18 nt, Pseudomonas putida KT2440
gccaguguucgaacgggc

SEQ ID NO: 3540966 - RNA, 16 nt, Pseudomonas putida KT2440
gccaguuccucggccu

SEQ ID NO: 3540967 - RNA, 15 nt, Pseudomonas putida KT2440
gccaguucgacaggu

SEQ ID NO: 3540968 - RNA, 17 nt, Pseudomonas putida KT2440
gccaguucgacgcugcu

SEQ ID NO: 3540969 - RNA, 22 nt, Pseudomonas putida KT2440
gccaguucgacgcugcugucgg

SEQ ID NO: 3540970 - RNA, 23 nt, Pseudomonas putida KT2440
gccaguucgacgcugcugucggu

SEQ ID NO: 3540971 - RNA, 14 nt, Pseudomonas putida KT2440
gccaguucgacggu

SEQ ID NO: 3540972 - RNA, 16 nt, Pseudomonas putida KT2440
gccaguucgcggcgca

SEQ ID NO: 3540973 - RNA, 23 nt, Pseudomonas putida KT2440
gccaguugccccaggcccacggc

SEQ ID NO: 3540974 - RNA, 16 nt, Pseudomonas putida KT2440
gccaguugcuucugca

SEQ ID NO: 3540975 - RNA, 22 nt, Pseudomonas putida KT2440
gccaguuguucgucgagcacca

SEQ ID NO: 3540976 - RNA, 23 nt, Pseudomonas putida KT2440
gccaguuugcacuggcggggcuu

SEQ ID NO: 3540977 - RNA, 17 nt, Pseudomonas putida KT2440
gccaguuugucguucuc

SEQ ID NO: 3540978 - RNA, 17 nt, Pseudomonas putida KT2440
gccauaagcugucagca

SEQ ID NO: 3540979 - RNA, 19 nt, Pseudomonas putida KT2440
gccauaagcugucagcacc

SEQ ID NO: 3540980 - RNA, 18 nt, Pseudomonas putida KT2440
gccauacaagaucaagcc

SEQ ID NO: 3540981 - RNA, 19 nt, Pseudomonas putida KT2440
gccauacaagaucaagccc

SEQ ID NO: 3540982 - RNA, 22 nt, Pseudomonas putida KT2440
gccauacagggccuggcgcgaa

SEQ ID NO: 3540983 - RNA, 21 nt, Pseudomonas putida KT2440
gccauaccgggucuugccgau

SEQ ID NO: 3540984 - RNA, 15 nt, Pseudomonas putida KT2440
gccauagccaguagc

SEQ ID NO: 3540985 - RNA, 15 nt, Pseudomonas putida KT2440
gccauagcccucggc

SEQ ID NO: 3540986 - RNA, 17 nt, Pseudomonas putida KT2440
gccauagcccucggcaa

SEQ ID NO: 3540987 - RNA, 16 nt, Pseudomonas putida KT2440
gccauagcgcugcacc

SEQ ID NO: 3540988 - RNA, 17 nt, Pseudomonas putida KT2440
gccauagcgcugcaccg

SEQ ID NO: 3540989 - RNA, 14 nt, Pseudomonas putida KT2440
gccauagcguuguc

SEQ ID NO: 3540990 - RNA, 22 nt, Pseudomonas putida KT2440
gccauagcguugucgacugcac

SEQ ID NO: 3540991 - RNA, 16 nt, Pseudomonas putida KT2440
gccauaggcuugcgcu

SEQ ID NO: 3540992 - RNA, 15 nt, Pseudomonas putida KT2440
gccauaguugaccag

SEQ ID NO: 3540993 - RNA, 18 nt, Pseudomonas putida KT2440
gccauaguugaccagcac

SEQ ID NO: 3540994 - RNA, 17 nt, Pseudomonas putida KT2440
gccauaucccgccaggu

SEQ ID NO: 3540995 - RNA, 20 nt, Pseudomonas putida KT2440
gccauaucggcuugugcccg

SEQ ID NO: 3540996 - RNA, 18 nt, Pseudomonas putida KT2440
gccauauugcugagccag

SEQ ID NO: 3540997 - RNA, 19 nt, Pseudomonas putida KT2440
gccauauugcugagccagu

SEQ ID NO: 3540998 - RNA, 13 nt, Pseudomonas putida KT2440
gccaucaaggccg

SEQ ID NO: 3540999 - RNA, 15 nt, Pseudomonas putida KT2440
gccaucaaggccgac

SEQ ID NO: 3541000 - RNA, 18 nt, Pseudomonas putida KT2440
gccaucaauaccggcaug

SEQ ID NO: 3541001 - RNA, 22 nt, Pseudomonas putida KT2440
gccaucaauaccggcaugccca

SEQ ID NO: 3541002 - RNA, 17 nt, Pseudomonas putida KT2440
gccaucaccgcccgcgc

SEQ ID NO: 3541003 - RNA, 19 nt, Pseudomonas putida KT2440
gccaucacuucacggguca

SEQ ID NO: 3541004 - RNA, 22 nt, Pseudomonas putida KT2440
gccaucacuuccggcugcagca

SEQ ID NO: 3541005 - RNA, 18 nt, Pseudomonas putida KT2440
gccaucagaggcgauggc

SEQ ID NO: 3541006 - RNA, 19 nt, Pseudomonas putida KT2440
gccaucagcugcggaauac

SEQ ID NO: 3541007 - RNA, 15 nt, Pseudomonas putida KT2440
gccaucagggcgaug

SEQ ID NO: 3541008 - RNA, 16 nt, Pseudomonas putida KT2440
gccaucaucagguacg

SEQ ID NO: 3541009 - RNA, 19 nt, Pseudomonas putida KT2440
gccauccaccgcgccagcc

SEQ ID NO: 3541010 - RNA, 13 nt, Pseudomonas putida KT2440
gccauccagcggc

SEQ ID NO: 3541011 - RNA, 18 nt, Pseudomonas putida KT2440
gccauccagcggcgacag

SEQ ID NO: 3541012 - RNA, 21 nt, Pseudomonas putida KT2440
gccauccagucgaucagcgac

SEQ ID NO: 3541013 - RNA, 12 nt, Pseudomonas putida KT2440
gccaucccgcug

SEQ ID NO: 3541014 - RNA, 15 nt, Pseudomonas putida KT2440
gccauccgguaugcc

SEQ ID NO: 3541015 - RNA, 23 nt, Pseudomonas putida KT2440
gccauccgguaugcccaugcucu

SEQ ID NO: 3541016 - RNA, 21 nt, Pseudomonas putida KT2440
gccauccucggccaauggcag

SEQ ID NO: 3541017 - RNA, 16 nt, Pseudomonas putida KT2440
gccauccucggccagg

SEQ ID NO: 3541018 - RNA, 21 nt, Pseudomonas putida KT2440
gccauccugcuguagcgccca

SEQ ID NO: 3541019 - RNA, 17 nt, Pseudomonas putida KT2440
gccauccuugaagaaca

SEQ ID NO: 3541020 - RNA, 22 nt, Pseudomonas putida KT2440
gccauccuugaagaacaccugc

SEQ ID NO: 3541021 - RNA, 15 nt, Pseudomonas putida KT2440
gccaucgacccgcug

SEQ ID NO: 3541022 - RNA, 17 nt, Pseudomonas putida KT2440
gccaucgaggaaguggc

SEQ ID NO: 3541023 - RNA, 14 nt, Pseudomonas putida KT2440
gccaucgcaccacg

SEQ ID NO: 3541024 - RNA, 21 nt, Pseudomonas putida KT2440
gccaucgcagaaggccccguc

SEQ ID NO: 3541025 - RNA, 19 nt, Pseudomonas putida KT2440
gccaucgcgcaggucgaca

SEQ ID NO: 3541026 - RNA, 22 nt, Pseudomonas putida KT2440
gccaucgcucaccguucuucuc

SEQ ID NO: 3541027 - RNA, 14 nt, Pseudomonas putida KT2440
gccaucggccucuc

SEQ ID NO: 3541028 - RNA, 21 nt, Pseudomonas putida KT2440
gccaucuggcguugcgaaggc

SEQ ID NO: 3541029 - RNA, 22 nt, Pseudomonas putida KT2440
gccaucuggcguugcgaaggcg

SEQ ID NO: 3541030 - RNA, 13 nt, Pseudomonas putida KT2440
gccaucugguugc

SEQ ID NO: 3541031 - RNA, 18 nt, Pseudomonas putida KT2440
gccaucugguugcuggcg

SEQ ID NO: 3541032 - RNA, 20 nt, Pseudomonas putida KT2440
gccaucugguugcuggcgcc

SEQ ID NO: 3541033 - RNA, 15 nt, Pseudomonas putida KT2440
gccaucuucacggca

SEQ ID NO: 3541034 - RNA, 19 nt, Pseudomonas putida KT2440
gccaucuucacggcaagcc

SEQ ID NO: 3541035 - RNA, 20 nt, Pseudomonas putida KT2440
gccaucuucacggcaagccu

SEQ ID NO: 3541036 - RNA, 15 nt, Pseudomonas putida KT2440
gccaugaaaaagccc

SEQ ID NO: 3541037 - RNA, 18 nt, Pseudomonas putida KT2440
gccaugaaaaagcccggc

SEQ ID NO: 3541038 - RNA, 17 nt, Pseudomonas putida KT2440
gccaugaucagcgccug

SEQ ID NO: 3541039 - RNA, 12 nt, Pseudomonas putida KT2440
gccaugccaccc

SEQ ID NO: 3541040 - RNA, 17 nt, Pseudomonas putida KT2440
gccaugccacccccggc

SEQ ID NO: 3541041 - RNA, 20 nt, Pseudomonas putida KT2440
gccaugcccaccgcauugca

SEQ ID NO: 3541042 - RNA, 17 nt, Pseudomonas putida KT2440
gccaugcccgcccgggc

SEQ ID NO: 3541043 - RNA, 20 nt, Pseudomonas putida KT2440
gccaugccgaauugaacugg

SEQ ID NO: 3541044 - RNA, 13 nt, Pseudomonas putida KT2440
gccaugccggcaa

SEQ ID NO: 3541045 - RNA, 14 nt, Pseudomonas putida KT2440
gccaugccggcaac

SEQ ID NO: 3541046 - RNA, 21 nt, Pseudomonas putida KT2440
gccaugccguaagccgcaggc

SEQ ID NO: 3541047 - RNA, 13 nt, Pseudomonas putida KT2440
gccaugcgcaggc

SEQ ID NO: 3541048 - RNA, 14 nt, Pseudomonas putida KT2440
gccaugcgcaggca

SEQ ID NO: 3541049 - RNA, 18 nt, Pseudomonas putida KT2440
gccaugcgcaggcagcga

SEQ ID NO: 3541050 - RNA, 16 nt, Pseudomonas putida KT2440
gccaugcgcgggguga

SEQ ID NO: 3541051 - RNA, 13 nt, Pseudomonas putida KT2440
gccaugcgcugca

SEQ ID NO: 3541052 - RNA, 14 nt, Pseudomonas putida KT2440
gccaugcgcugcag

SEQ ID NO: 3541053 - RNA, 18 nt, Pseudomonas putida KT2440
gccaugcugcgccaggau

SEQ ID NO: 3541054 - RNA, 16 nt, Pseudomonas putida KT2440
gccaugcuuuccaggu

SEQ ID NO: 3541055 - RNA, 19 nt, Pseudomonas putida KT2440
gccaugcuuuccaggucgg

SEQ ID NO: 3541056 - RNA, 15 nt, Pseudomonas putida KT2440
gccauggccgagcca

SEQ ID NO: 3541057 - RNA, 23 nt, Pseudomonas putida KT2440
gccauggccucgucgcgguccuu

SEQ ID NO: 3541058 - RNA, 18 nt, Pseudomonas putida KT2440
gccauggcgacaauggcg

SEQ ID NO: 3541059 - RNA, 18 nt, Pseudomonas putida KT2440
gccaugggccugcacgau

SEQ ID NO: 3541060 - RNA, 19 nt, Pseudomonas putida KT2440
gccaugguuuugggcacga

SEQ ID NO: 3541061 - RNA, 21 nt, Pseudomonas putida KT2440
gccauguaccgggcggccacc

SEQ ID NO: 3541062 - RNA, 22 nt, Pseudomonas putida KT2440
gccauguaccgggcggccaccg

SEQ ID NO: 3541063 - RNA, 17 nt, Pseudomonas putida KT2440
gccauguacguugccag

SEQ ID NO: 3541064 - RNA, 22 nt, Pseudomonas putida KT2440
gccaugugcacacgcaacugau

SEQ ID NO: 3541065 - RNA, 13 nt, Pseudomonas putida KT2440
gccaugugcucgg

SEQ ID NO: 3541066 - RNA, 13 nt, Pseudomonas putida KT2440
gccaugugcuggc

SEQ ID NO: 3541067 - RNA, 14 nt, Pseudomonas putida KT2440
gccauguugcgcag

SEQ ID NO: 3541068 - RNA, 23 nt, Pseudomonas putida KT2440
gccauucaucguauugccccggc

SEQ ID NO: 3541069 - RNA, 18 nt, Pseudomonas putida KT2440
gccauuccggcugcagcu

SEQ ID NO: 3541070 - RNA, 17 nt, Pseudomonas putida KT2440
gccauucgcgggcaugc

SEQ ID NO: 3541071 - RNA, 21 nt, Pseudomonas putida KT2440
gccauucguccgaccaacggu

SEQ ID NO: 3541072 - RNA, 17 nt, Pseudomonas putida KT2440
gccauucucgccgccgc

SEQ ID NO: 3541073 - RNA, 22 nt, Pseudomonas putida KT2440
gccauucucgccgccgcugacc

SEQ ID NO: 3541074 - RNA, 17 nt, Pseudomonas putida KT2440
gccauucuucuccaggu

SEQ ID NO: 3541075 - RNA, 17 nt, Pseudomonas putida KT2440
gccauugacccgcuugc

SEQ ID NO: 3541076 - RNA, 18 nt, Pseudomonas putida KT2440
gccauugacccgcuugca

SEQ ID NO: 3541077 - RNA, 18 nt, Pseudomonas putida KT2440
gccauugacuaccaggua

SEQ ID NO: 3541078 - RNA, 14 nt, Pseudomonas putida KT2440
gccauugaggaagu

SEQ ID NO: 3541079 - RNA, 17 nt, Pseudomonas putida KT2440
gccauugcaccacgcca

SEQ ID NO: 3541080 - RNA, 16 nt, Pseudomonas putida KT2440
gccauugcccagccug

SEQ ID NO: 3541081 - RNA, 16 nt, Pseudomonas putida KT2440
gccauuggcccacgcu

SEQ ID NO: 3541082 - RNA, 14 nt, Pseudomonas putida KT2440
gccauuucuucagc

SEQ ID NO: 3541083 - RNA, 21 nt, Pseudomonas putida KT2440
gcccaaacaacaaagccccgg

SEQ ID NO: 3541084 - RNA, 16 nt, Pseudomonas putida KT2440
gcccaaacgccaacag

SEQ ID NO: 3541085 - RNA, 20 nt, Pseudomonas putida KT2440
gcccaaagcccgugccgcau

SEQ ID NO: 3541086 - RNA, 12 nt, Pseudomonas putida KT2440
gcccaaauguua

SEQ ID NO: 3541087 - RNA, 13 nt, Pseudomonas putida KT2440
gcccaacagcgcg

SEQ ID NO: 3541088 - RNA, 19 nt, Pseudomonas putida KT2440
gcccaacauaucgcgaaac

SEQ ID NO: 3541089 - RNA, 14 nt, Pseudomonas putida KT2440
gcccaacccagcca

SEQ ID NO: 3541090 - RNA, 20 nt, Pseudomonas putida KT2440
gcccaacccagccagcgaca

SEQ ID NO: 3541091 - RNA, 19 nt, Pseudomonas putida KT2440
gcccaaccccaggcgcaca

SEQ ID NO: 3541092 - RNA, 21 nt, Pseudomonas putida KT2440
gcccaacgaaaaaggcccugc

SEQ ID NO: 3541093 - RNA, 18 nt, Pseudomonas putida KT2440
gcccaacgccugaagcac

SEQ ID NO: 3541094 - RNA, 17 nt, Pseudomonas putida KT2440
gcccaagcgcuccgcca

SEQ ID NO: 3541095 - RNA, 12 nt, Pseudomonas putida KT2440
gcccaaggcacc

SEQ ID NO: 3541096 - RNA, 21 nt, Pseudomonas putida KT2440
gcccaaggccugcaccauuug

SEQ ID NO: 3541097 - RNA, 18 nt, Pseudomonas putida KT2440
gcccaaguacaccggcag

SEQ ID NO: 3541098 - RNA, 19 nt, Pseudomonas putida KT2440
gcccaauacccaacagcau

SEQ ID NO: 3541099 - RNA, 14 nt, Pseudomonas putida KT2440
gcccaaugccguga

SEQ ID NO: 3541100 - RNA, 16 nt, Pseudomonas putida KT2440
gcccaauggacgcgca

SEQ ID NO: 3541101 - RNA, 21 nt, Pseudomonas putida KT2440
gcccacaaguccgaacucccc

SEQ ID NO: 3541102 - RNA, 22 nt, Pseudomonas putida KT2440
gcccacaaguccgaacucccca

SEQ ID NO: 3541103 - RNA, 13 nt, Pseudomonas putida KT2440
gcccacacggcaa

SEQ ID NO: 3541104 - RNA, 17 nt, Pseudomonas putida KT2440
gcccacacggcaagcca

SEQ ID NO: 3541105 - RNA, 18 nt, Pseudomonas putida KT2440
gcccacaggggcuguaua

SEQ ID NO: 3541106 - RNA, 20 nt, Pseudomonas putida KT2440
gcccaccaauuacucggccc

SEQ ID NO: 3541107 - RNA, 13 nt, Pseudomonas putida KT2440
gcccaccaccagc

SEQ ID NO: 3541108 - RNA, 14 nt, Pseudomonas putida KT2440
gcccaccaccagcc

SEQ ID NO: 3541109 - RNA, 20 nt, Pseudomonas putida KT2440
gcccaccacgaacgccccca

SEQ ID NO: 3541110 - RNA, 23 nt, Pseudomonas putida KT2440
gcccaccacgaacgcccccagcc

SEQ ID NO: 3541111 - RNA, 13 nt, Pseudomonas putida KT2440
gcccaccagcgcu

SEQ ID NO: 3541112 - RNA, 17 nt, Pseudomonas putida KT2440
gcccaccagcugcacca

SEQ ID NO: 3541113 - RNA, 19 nt, Pseudomonas putida KT2440
gcccaccagcugcaccacc

SEQ ID NO: 3541114 - RNA, 18 nt, Pseudomonas putida KT2440
gcccaccaggauuggccg

SEQ ID NO: 3541115 - RNA, 13 nt, Pseudomonas putida KT2440
gcccaccagguca

SEQ ID NO: 3541116 - RNA, 22 nt, Pseudomonas putida KT2440
gcccaccaggucauaguucugg

SEQ ID NO: 3541117 - RNA, 20 nt, Pseudomonas putida KT2440
gcccaccagugaggucggga

SEQ ID NO: 3541118 - RNA, 13 nt, Pseudomonas putida KT2440
gcccacccaccac

SEQ ID NO: 3541119 - RNA, 14 nt, Pseudomonas putida KT2440
gcccacccaccaca

SEQ ID NO: 3541120 - RNA, 23 nt, Pseudomonas putida KT2440
gcccacccaccacaaaccacagc

SEQ ID NO: 3541121 - RNA, 22 nt, Pseudomonas putida KT2440
gcccaccgaucacggggcgacg

SEQ ID NO: 3541122 - RNA, 20 nt, Pseudomonas putida KT2440
gcccaccgcauugcaggcca

SEQ ID NO: 3541123 - RNA, 15 nt, Pseudomonas putida KT2440
gcccaccgcguuggc

SEQ ID NO: 3541124 - RNA, 20 nt, Pseudomonas putida KT2440
gcccaccgcguuggccaggu

SEQ ID NO: 3541125 - RNA, 15 nt, Pseudomonas putida KT2440
gcccaccgcugcaau

SEQ ID NO: 3541126 - RNA, 14 nt, Pseudomonas putida KT2440
gcccaccuucacgc

SEQ ID NO: 3541127 - RNA, 18 nt, Pseudomonas putida KT2440
gcccaccuucacgccauu

SEQ ID NO: 3541128 - RNA, 22 nt, Pseudomonas putida KT2440
gcccaccuuggcggugaucgag

SEQ ID NO: 3541129 - RNA, 20 nt, Pseudomonas putida KT2440
gcccacgaucucacgcgcca

SEQ ID NO: 3541130 - RNA, 13 nt, Pseudomonas putida KT2440
gcccacgccgcug

SEQ ID NO: 3541131 - RNA, 15 nt, Pseudomonas putida KT2440
gcccacgccggcaac

SEQ ID NO: 3541132 - RNA, 16 nt, Pseudomonas putida KT2440
gcccacgccuuccacc

SEQ ID NO: 3541133 - RNA, 20 nt, Pseudomonas putida KT2440
gcccacgcggguccagcgcg

SEQ ID NO: 3541134 - RNA, 19 nt, Pseudomonas putida KT2440
gcccacggcgauggucugc

SEQ ID NO: 3541135 - RNA, 18 nt, Pseudomonas putida KT2440
gcccacggcguccaggcc

SEQ ID NO: 3541136 - RNA, 15 nt, Pseudomonas putida KT2440
gcccacucacgcaac

SEQ ID NO: 3541137 - RNA, 15 nt, Pseudomonas putida KT2440
gcccacugcagccau

SEQ ID NO: 3541138 - RNA, 21 nt, Pseudomonas putida KT2440
gcccacuuccugaagacgcuu

SEQ ID NO: 3541139 - RNA, 19 nt, Pseudomonas putida KT2440
gcccagaaucucaaccacc

SEQ ID NO: 3541140 - RNA, 21 nt, Pseudomonas putida KT2440
gcccagaucacuuccaccugc

SEQ ID NO: 3541141 - RNA, 17 nt, Pseudomonas putida KT2440
gcccagaucagcagcac

SEQ ID NO: 3541142 - RNA, 18 nt, Pseudomonas putida KT2440
gcccagaucagcagcacc

SEQ ID NO: 3541143 - RNA, 22 nt, Pseudomonas putida KT2440
gcccagcaacugcgcccaaugc

SEQ ID NO: 3541144 - RNA, 10 nt, Pseudomonas putida KT2440
gcccagcagc

SEQ ID NO: 3541145 - RNA, 21 nt, Pseudomonas putida KT2440
gcccagcagccaacgccccag

SEQ ID NO: 3541146 - RNA, 22 nt, Pseudomonas putida KT2440
gcccagcagccaacgccccagg

SEQ ID NO: 3541147 - RNA, 14 nt, Pseudomonas putida KT2440
gcccagcagcccca

SEQ ID NO: 3541148 - RNA, 18 nt, Pseudomonas putida KT2440
gcccagcagguacagcac

SEQ ID NO: 3541149 - RNA, 21 nt, Pseudomonas putida KT2440
gcccagcagguagacgaugcc

SEQ ID NO: 3541150 - RNA, 17 nt, Pseudomonas putida KT2440
gcccagccaacccucga

SEQ ID NO: 3541151 - RNA, 18 nt, Pseudomonas putida KT2440
gcccagccaacccucgac

SEQ ID NO: 3541152 - RNA, 20 nt, Pseudomonas putida KT2440
gcccagccaacccucgaccu

SEQ ID NO: 3541153 - RNA, 12 nt, Pseudomonas putida KT2440
gcccagccaccg

SEQ ID NO: 3541154 - RNA, 13 nt, Pseudomonas putida KT2440
gcccagccaccga

SEQ ID NO: 3541155 - RNA, 18 nt, Pseudomonas putida KT2440
gcccagccagcgugggcc

SEQ ID NO: 3541156 - RNA, 15 nt, Pseudomonas putida KT2440
gcccagccaucgagc

SEQ ID NO: 3541157 - RNA, 20 nt, Pseudomonas putida KT2440
gcccagccaucgagcaccgg

SEQ ID NO: 3541158 - RNA, 14 nt, Pseudomonas putida KT2440
gcccagccccgagc

SEQ ID NO: 3541159 - RNA, 15 nt, Pseudomonas putida KT2440
gcccagccccgagca

SEQ ID NO: 3541160 - RNA, 17 nt, Pseudomonas putida KT2440
gcccagccugcccgccg

SEQ ID NO: 3541161 - RNA, 16 nt, Pseudomonas putida KT2440
gcccagcgccaccggc

SEQ ID NO: 3541162 - RNA, 19 nt, Pseudomonas putida KT2440
gcccagcgccaccggcagc

SEQ ID NO: 3541163 - RNA, 22 nt, Pseudomonas putida KT2440
gcccagcgccaccggcagcaag

SEQ ID NO: 3541164 - RNA, 13 nt, Pseudomonas putida KT2440
gcccagcgcucgu

SEQ ID NO: 3541165 - RNA, 14 nt, Pseudomonas putida KT2440
gcccagcuccagca

SEQ ID NO: 3541166 - RNA, 14 nt, Pseudomonas putida KT2440
gcccagcucgcugg

SEQ ID NO: 3541167 - RNA, 21 nt, Pseudomonas putida KT2440
gcccagcugaagugccaaggc

SEQ ID NO: 3541168 - RNA, 15 nt, Pseudomonas putida KT2440
gcccagcuucuccag

SEQ ID NO: 3541169 - RNA, 16 nt, Pseudomonas putida KT2440
gcccagcuucuccagc

SEQ ID NO: 3541170 - RNA, 18 nt, Pseudomonas putida KT2440
gcccagcuucuccagcaa

SEQ ID NO: 3541171 - RNA, 15 nt, Pseudomonas putida KT2440
gcccaggaucacugg

SEQ ID NO: 3541172 - RNA, 19 nt, Pseudomonas putida KT2440
gcccaggaucacuggccug

SEQ ID NO: 3541173 - RNA, 17 nt, Pseudomonas putida KT2440
gcccaggcccaacgggc

SEQ ID NO: 3541174 - RNA, 18 nt, Pseudomonas putida KT2440
gcccaggcccgacuccac

SEQ ID NO: 3541175 - RNA, 16 nt, Pseudomonas putida KT2440
gcccaggcgcaucacg

SEQ ID NO: 3541176 - RNA, 11 nt, Pseudomonas putida KT2440
gcccaggcugg

SEQ ID NO: 3541177 - RNA, 14 nt, Pseudomonas putida KT2440
gcccagggcugcuu

SEQ ID NO: 3541178 - RNA, 23 nt, Pseudomonas putida KT2440
gcccaggucaaacguauccgccg

SEQ ID NO: 3541179 - RNA, 17 nt, Pseudomonas putida KT2440
gcccaggugccaggcuc

SEQ ID NO: 3541180 - RNA, 19 nt, Pseudomonas putida KT2440
gcccaggugccaggcucag

SEQ ID NO: 3541181 - RNA, 17 nt, Pseudomonas putida KT2440
gcccagguuauacgccg

SEQ ID NO: 3541182 - RNA, 16 nt, Pseudomonas putida KT2440
gcccaguacgccaccc

SEQ ID NO: 3541183 - RNA, 16 nt, Pseudomonas putida KT2440
gcccagugcgcgcaac

SEQ ID NO: 3541184 - RNA, 18 nt, Pseudomonas putida KT2440
gcccagugcgcgcaacag

SEQ ID NO: 3541185 - RNA, 19 nt, Pseudomonas putida KT2440
gcccagugcgcgcaacagu

SEQ ID NO: 3541186 - RNA, 16 nt, Pseudomonas putida KT2440
gcccaguggcacacca

SEQ ID NO: 3541187 - RNA, 22 nt, Pseudomonas putida KT2440
gcccaguucguccaccgacggc

SEQ ID NO: 3541188 - RNA, 15 nt, Pseudomonas putida KT2440
gcccaguucuccggc

SEQ ID NO: 3541189 - RNA, 17 nt, Pseudomonas putida KT2440
gcccaguucuuggcggc

SEQ ID NO: 3541190 - RNA, 18 nt, Pseudomonas putida KT2440
gcccaguucuuggcggcu

SEQ ID NO: 3541191 - RNA, 21 nt, Pseudomonas putida KT2440
gcccauaaaagccucagcgcc

SEQ ID NO: 3541192 - RNA, 23 nt, Pseudomonas putida KT2440
gcccauaaaagccucagcgcccg

SEQ ID NO: 3541193 - RNA, 23 nt, Pseudomonas putida KT2440
gcccauaaaccccagccuucagc

SEQ ID NO: 3541194 - RNA, 14 nt, Pseudomonas putida KT2440
gcccauagcgccau

SEQ ID NO: 3541195 - RNA, 14 nt, Pseudomonas putida KT2440
gcccaucaccggca

SEQ ID NO: 3541196 - RNA, 14 nt, Pseudomonas putida KT2440
gcccaucagcgccg

SEQ ID NO: 3541197 - RNA, 16 nt, Pseudomonas putida KT2440
gcccaucaggaacagc

SEQ ID NO: 3541198 - RNA, 17 nt, Pseudomonas putida KT2440
gcccaucaggaacagcu

SEQ ID NO: 3541199 - RNA, 18 nt, Pseudomonas putida KT2440
gcccaucaggaacagcuc

SEQ ID NO: 3541200 - RNA, 18 nt, Pseudomonas putida KT2440
gcccauccaacgcaucca

SEQ ID NO: 3541201 - RNA, 19 nt, Pseudomonas putida KT2440
gcccauccaacgcauccag

SEQ ID NO: 3541202 - RNA, 18 nt, Pseudomonas putida KT2440
gcccauccagggcuuccu

SEQ ID NO: 3541203 - RNA, 22 nt, Pseudomonas putida KT2440
gcccaucccgcuucgccagcgc

SEQ ID NO: 3541204 - RNA, 20 nt, Pseudomonas putida KT2440
gcccaucccggucaccugca

SEQ ID NO: 3541205 - RNA, 16 nt, Pseudomonas putida KT2440
gcccaucgcacacccu

SEQ ID NO: 3541206 - RNA, 19 nt, Pseudomonas putida KT2440
gcccaucgcauaugcccca

SEQ ID NO: 3541207 - RNA, 20 nt, Pseudomonas putida KT2440
gcccaucucaggcccaccag

SEQ ID NO: 3541208 - RNA, 22 nt, Pseudomonas putida KT2440
gcccaucugcacgucauagccc

SEQ ID NO: 3541209 - RNA, 14 nt, Pseudomonas putida KT2440
gcccaugaacagca

SEQ ID NO: 3541210 - RNA, 15 nt, Pseudomonas putida KT2440
gcccaugaaguucau

SEQ ID NO: 3541211 - RNA, 19 nt, Pseudomonas putida KT2440
gcccaugaaguucauccag

SEQ ID NO: 3541212 - RNA, 16 nt, Pseudomonas putida KT2440
gcccaugaucgcggca

SEQ ID NO: 3541213 - RNA, 18 nt, Pseudomonas putida KT2440
gcccaugauguggcuggu

SEQ ID NO: 3541214 - RNA, 23 nt, Pseudomonas putida KT2440
gcccaugccaagcccacacaccg

SEQ ID NO: 3541215 - RNA, 22 nt, Pseudomonas putida KT2440
gcccaugcccagcucgcuggcc

SEQ ID NO: 3541216 - RNA, 11 nt, Pseudomonas putida KT2440
gcccauggcca

SEQ ID NO: 3541217 - RNA, 12 nt, Pseudomonas putida KT2440
gcccauggccag

SEQ ID NO: 3541218 - RNA, 16 nt, Pseudomonas putida KT2440
gcccauggccaggcug

SEQ ID NO: 3541219 - RNA, 15 nt, Pseudomonas putida KT2440
gcccauggcccugau

SEQ ID NO: 3541220 - RNA, 16 nt, Pseudomonas putida KT2440
gcccauggcgcagcuc

SEQ ID NO: 3541221 - RNA, 14 nt, Pseudomonas putida KT2440
gcccauggcgcuga

SEQ ID NO: 3541222 - RNA, 13 nt, Pseudomonas putida KT2440
gcccauggcuggc

SEQ ID NO: 3541223 - RNA, 15 nt, Pseudomonas putida KT2440
gcccauggcuggcag

SEQ ID NO: 3541224 - RNA, 17 nt, Pseudomonas putida KT2440
gcccaugucgaucagcg

SEQ ID NO: 3541225 - RNA, 13 nt, Pseudomonas putida KT2440
gcccauuccgggu

SEQ ID NO: 3541226 - RNA, 20 nt, Pseudomonas putida KT2440
gcccauuccgggucgccagu

SEQ ID NO: 3541227 - RNA, 13 nt, Pseudomonas putida KT2440
gcccauucgcggg

SEQ ID NO: 3541228 - RNA, 18 nt, Pseudomonas putida KT2440
gcccauucgcgggcaagc

SEQ ID NO: 3541229 - RNA, 19 nt, Pseudomonas putida KT2440
gcccauucgcgggcaagcc

SEQ ID NO: 3541230 - RNA, 23 nt, Pseudomonas putida KT2440
gcccauuuccgggcaaugcaggc

SEQ ID NO: 3541231 - RNA, 23 nt, Pseudomonas putida KT2440
gcccauuucgcgggucaggggga

SEQ ID NO: 3541232 - RNA, 15 nt, Pseudomonas putida KT2440
gcccauuucgugggu

SEQ ID NO: 3541233 - RNA, 23 nt, Pseudomonas putida KT2440
gcccauuucgugggucacgcaga

SEQ ID NO: 3541234 - RNA, 18 nt, Pseudomonas putida KT2440
gcccauuucugcaugucc

SEQ ID NO: 3541235 - RNA, 21 nt, Pseudomonas putida KT2440
gccccaaaggaagucaaccuc

SEQ ID NO: 3541236 - RNA, 16 nt, Pseudomonas putida KT2440
gccccaacccaccagc

SEQ ID NO: 3541237 - RNA, 17 nt, Pseudomonas putida KT2440
gccccaaccuuccagca

SEQ ID NO: 3541238 - RNA, 16 nt, Pseudomonas putida KT2440
gccccaacugcauccg

SEQ ID NO: 3541239 - RNA, 20 nt, Pseudomonas putida KT2440
gccccaacugcauccgcccc

SEQ ID NO: 3541240 - RNA, 20 nt, Pseudomonas putida KT2440
gccccaagcgccugacgcag

SEQ ID NO: 3541241 - RNA, 14 nt, Pseudomonas putida KT2440
gccccaagcgggcc

SEQ ID NO: 3541242 - RNA, 19 nt, Pseudomonas putida KT2440
gccccaagcgggccaaggu

SEQ ID NO: 3541243 - RNA, 21 nt, Pseudomonas putida KT2440
gccccaagcgggccaagguca

SEQ ID NO: 3541244 - RNA, 18 nt, Pseudomonas putida KT2440
gccccaauggcgaacccc

SEQ ID NO: 3541245 - RNA, 19 nt, Pseudomonas putida KT2440
gccccaauggcgaacccca

SEQ ID NO: 3541246 - RNA, 17 nt, Pseudomonas putida KT2440
gccccacaacggccgca

SEQ ID NO: 3541247 - RNA, 22 nt, Pseudomonas putida KT2440
gccccacaauaagaugcggcgc

SEQ ID NO: 3541248 - RNA, 14 nt, Pseudomonas putida KT2440
gccccaccaggcac

SEQ ID NO: 3541249 - RNA, 15 nt, Pseudomonas putida KT2440
gccccaccaggcacc

SEQ ID NO: 3541250 - RNA, 16 nt, Pseudomonas putida KT2440
gccccaccaggcaccg

SEQ ID NO: 3541251 - RNA, 21 nt, Pseudomonas putida KT2440
gccccacccaguccguuacca

SEQ ID NO: 3541252 - RNA, 15 nt, Pseudomonas putida KT2440
gccccaccucggcga

SEQ ID NO: 3541253 - RNA, 19 nt, Pseudomonas putida KT2440
gccccacucgcgcagcaca

SEQ ID NO: 3541254 - RNA, 14 nt, Pseudomonas putida KT2440
gccccacucggcgc

SEQ ID NO: 3541255 - RNA, 16 nt, Pseudomonas putida KT2440
gccccacuuccagcga

SEQ ID NO: 3541256 - RNA, 17 nt, Pseudomonas putida KT2440
gccccacuuccagcgac

SEQ ID NO: 3541257 - RNA, 18 nt, Pseudomonas putida KT2440
gccccacuuccagcgaca

SEQ ID NO: 3541258 - RNA, 17 nt, Pseudomonas putida KT2440
gccccagacaaucaccu

SEQ ID NO: 3541259 - RNA, 14 nt, Pseudomonas putida KT2440
gccccagaccauca

SEQ ID NO: 3541260 - RNA, 14 nt, Pseudomonas putida KT2440
gccccagcagcgcu

SEQ ID NO: 3541261 - RNA, 22 nt, Pseudomonas putida KT2440
gccccagcaucaacgcugccau

SEQ ID NO: 3541262 - RNA, 12 nt, Pseudomonas putida KT2440
gccccagccggu

SEQ ID NO: 3541263 - RNA, 12 nt, Pseudomonas putida KT2440
gccccagccuca

SEQ ID NO: 3541264 - RNA, 20 nt, Pseudomonas putida KT2440
gccccagccucagcuggccg

SEQ ID NO: 3541265 - RNA, 23 nt, Pseudomonas putida KT2440
gccccagccucagcuggccggcu

SEQ ID NO: 3541266 - RNA, 12 nt, Pseudomonas putida KT2440
gccccagcgccu

SEQ ID NO: 3541267 - RNA, 22 nt, Pseudomonas putida KT2440
gccccagcgccuuggccugcuc

SEQ ID NO: 3541268 - RNA, 17 nt, Pseudomonas putida KT2440
gccccagcgcgccagca

SEQ ID NO: 3541269 - RNA, 17 nt, Pseudomonas putida KT2440
gccccagcggcaaccug

SEQ ID NO: 3541270 - RNA, 19 nt, Pseudomonas putida KT2440
gccccagcggcagcagcag

SEQ ID NO: 3541271 - RNA, 12 nt, Pseudomonas putida KT2440
gccccagcguca

SEQ ID NO: 3541272 - RNA, 17 nt, Pseudomonas putida KT2440
gccccagcgucacccgu

SEQ ID NO: 3541273 - RNA, 19 nt, Pseudomonas putida KT2440
gccccaggcauugcaaggu

SEQ ID NO: 3541274 - RNA, 12 nt, Pseudomonas putida KT2440
gccccaggccgc

SEQ ID NO: 3541275 - RNA, 15 nt, Pseudomonas putida KT2440
gccccaggccgcggc

SEQ ID NO: 3541276 - RNA, 12 nt, Pseudomonas putida KT2440
gccccaggcggu

SEQ ID NO: 3541277 - RNA, 15 nt, Pseudomonas putida KT2440
gccccaggcggugca

SEQ ID NO: 3541278 - RNA, 16 nt, Pseudomonas putida KT2440
gccccaggcggugcac

SEQ ID NO: 3541279 - RNA, 19 nt, Pseudomonas putida KT2440
gccccaggcggugcacggc

SEQ ID NO: 3541280 - RNA, 17 nt, Pseudomonas putida KT2440
gccccagggaucgaugc

SEQ ID NO: 3541281 - RNA, 19 nt, Pseudomonas putida KT2440
gccccagggaucgaugccc

SEQ ID NO: 3541282 - RNA, 15 nt, Pseudomonas putida KT2440
gccccagggcccuca

SEQ ID NO: 3541283 - RNA, 19 nt, Pseudomonas putida KT2440
gccccagggggcagcugcu

SEQ ID NO: 3541284 - RNA, 23 nt, Pseudomonas putida KT2440
gccccaggguguuguucacgggu

SEQ ID NO: 3541285 - RNA, 22 nt, Pseudomonas putida KT2440
gccccagucauccgggccguca

SEQ ID NO: 3541286 - RNA, 14 nt, Pseudomonas putida KT2440
gccccagucuucgu

SEQ ID NO: 3541287 - RNA, 20 nt, Pseudomonas putida KT2440
gccccaguggcuuacagcgu

SEQ ID NO: 3541288 - RNA, 22 nt, Pseudomonas putida KT2440
gccccagugugcaaacacccag

SEQ ID NO: 3541289 - RNA, 15 nt, Pseudomonas putida KT2440
gccccauagccugcu

SEQ ID NO: 3541290 - RNA, 17 nt, Pseudomonas putida KT2440
gccccauagccugcugc

SEQ ID NO: 3541291 - RNA, 23 nt, Pseudomonas putida KT2440
gccccauagccugcugcucccca

SEQ ID NO: 3541292 - RNA, 17 nt, Pseudomonas putida KT2440
gccccaucaccagcccg

SEQ ID NO: 3541293 - RNA, 22 nt, Pseudomonas putida KT2440
gccccaucaccagcccgaagcg

SEQ ID NO: 3541294 - RNA, 18 nt, Pseudomonas putida KT2440
gccccaugcgaacugcag

SEQ ID NO: 3541295 - RNA, 16 nt, Pseudomonas putida KT2440
gccccaugcgaccagu

SEQ ID NO: 3541296 - RNA, 16 nt, Pseudomonas putida KT2440
gccccauucgcugcgu

SEQ ID NO: 3541297 - RNA, 22 nt, Pseudomonas putida KT2440
gccccauucgcugcgucaggcc

SEQ ID NO: 3541298 - RNA, 23 nt, Pseudomonas putida KT2440
gccccauucgcugcgucaggcca

SEQ ID NO: 3541299 - RNA, 15 nt, Pseudomonas putida KT2440
gcccccaaaccgcug

SEQ ID NO: 3541300 - RNA, 19 nt, Pseudomonas putida KT2440
gcccccaaaccgcugccca

SEQ ID NO: 3541301 - RNA, 16 nt, Pseudomonas putida KT2440
gcccccaaagccgcca

SEQ ID NO: 3541302 - RNA, 17 nt, Pseudomonas putida KT2440
gcccccaaugggcaccg

SEQ ID NO: 3541303 - RNA, 16 nt, Pseudomonas putida KT2440
gcccccacgccgaccg

SEQ ID NO: 3541304 - RNA, 12 nt, Pseudomonas putida KT2440
gcccccagcaca

SEQ ID NO: 3541305 - RNA, 14 nt, Pseudomonas putida KT2440
gcccccagccuuga

SEQ ID NO: 3541306 - RNA, 22 nt, Pseudomonas putida KT2440
gcccccaugaugaccaccagga

SEQ ID NO: 3541307 - RNA, 14 nt, Pseudomonas putida KT2440
gccccccagccagc

SEQ ID NO: 3541308 - RNA, 16 nt, Pseudomonas putida KT2440
gccccccagccagcag

SEQ ID NO: 3541309 - RNA, 23 nt, Pseudomonas putida KT2440
gccccccaggcggugaguguucu

SEQ ID NO: 3541310 - RNA, 15 nt, Pseudomonas putida KT2440
gcccccccaaggcga

SEQ ID NO: 3541311 - RNA, 13 nt, Pseudomonas putida KT2440
gccccccugccgc

SEQ ID NO: 3541312 - RNA, 21 nt, Pseudomonas putida KT2440
gccccccuguaggagcggguu

SEQ ID NO: 3541313 - RNA, 19 nt, Pseudomonas putida KT2440
gccccccuuccgcgugccc

SEQ ID NO: 3541314 - RNA, 14 nt, Pseudomonas putida KT2440
gcccccgccacccc

SEQ ID NO: 3541315 - RNA, 13 nt, Pseudomonas putida KT2440
gcccccgccgaag

SEQ ID NO: 3541316 - RNA, 21 nt, Pseudomonas putida KT2440
gcccccgccugcuggccgcgc

SEQ ID NO: 3541317 - RNA, 13 nt, Pseudomonas putida KT2440
gcccccgcugcac

SEQ ID NO: 3541318 - RNA, 20 nt, Pseudomonas putida KT2440
gcccccgcugcacaggccag

SEQ ID NO: 3541319 - RNA, 19 nt, Pseudomonas putida KT2440
gcccccggauggugugcag

SEQ ID NO: 3541320 - RNA, 13 nt, Pseudomonas putida KT2440
gcccccggcggcg

SEQ ID NO: 3541321 - RNA, 15 nt, Pseudomonas putida KT2440
gcccccggcggcggc

SEQ ID NO: 3541322 - RNA, 13 nt, Pseudomonas putida KT2440
gcccccggcuguc

SEQ ID NO: 3541323 - RNA, 16 nt, Pseudomonas putida KT2440
gcccccgucagcggca

SEQ ID NO: 3541324 - RNA, 21 nt, Pseudomonas putida KT2440
gcccccgucagcggcaacacc

SEQ ID NO: 3541325 - RNA, 11 nt, Pseudomonas putida KT2440
gcccccugguu

SEQ ID NO: 3541326 - RNA, 21 nt, Pseudomonas putida KT2440
gcccccugguuuuccaccggc

SEQ ID NO: 3541327 - RNA, 19 nt, Pseudomonas putida KT2440
gcccccuguaggagcgggu

SEQ ID NO: 3541328 - RNA, 17 nt, Pseudomonas putida KT2440
gccccgaccaccgccuc

SEQ ID NO: 3541329 - RNA, 19 nt, Pseudomonas putida KT2440
gccccgaccaccgccucga

SEQ ID NO: 3541330 - RNA, 16 nt, Pseudomonas putida KT2440
gccccgagcaaagccc

SEQ ID NO: 3541331 - RNA, 20 nt, Pseudomonas putida KT2440
gccccgagcaaagcccgccc

SEQ ID NO: 3541332 - RNA, 16 nt, Pseudomonas putida KT2440
gccccgauacagcgcg

SEQ ID NO: 3541333 - RNA, 20 nt, Pseudomonas putida KT2440
gccccgcacaucacggcgca

SEQ ID NO: 3541334 - RNA, 21 nt, Pseudomonas putida KT2440
gccccgcacaucacggcgcag

SEQ ID NO: 3541335 - RNA, 21 nt, Pseudomonas putida KT2440
gccccgcaccagaccagcagc

SEQ ID NO: 3541336 - RNA, 17 nt, Pseudomonas putida KT2440
gccccgcaccgcggaug

SEQ ID NO: 3541337 - RNA, 13 nt, Pseudomonas putida KT2440
gccccgcaggccg

SEQ ID NO: 3541338 - RNA, 15 nt, Pseudomonas putida KT2440
gccccgcaugcucgc

SEQ ID NO: 3541339 - RNA, 22 nt, Pseudomonas putida KT2440
gccccgcaugcucgcugcugcc

SEQ ID NO: 3541340 - RNA, 20 nt, Pseudomonas putida KT2440
gccccgccaacaacaagcgc

SEQ ID NO: 3541341 - RNA, 22 nt, Pseudomonas putida KT2440
gccccgccaacaacaagcgcug

SEQ ID NO: 3541342 - RNA, 14 nt, Pseudomonas putida KT2440
gccccgccagcgcc

SEQ ID NO: 3541343 - RNA, 18 nt, Pseudomonas putida KT2440
gccccgccagcgccuggc

SEQ ID NO: 3541344 - RNA, 19 nt, Pseudomonas putida KT2440
gccccgccagcgccuggcg

SEQ ID NO: 3541345 - RNA, 11 nt, Pseudomonas putida KT2440
gccccgccagu

SEQ ID NO: 3541346 - RNA, 13 nt, Pseudomonas putida KT2440
gccccgcccaggu

SEQ ID NO: 3541347 - RNA, 16 nt, Pseudomonas putida KT2440
gccccgcccgaagggc

SEQ ID NO: 3541348 - RNA, 12 nt, Pseudomonas putida KT2440
gccccgccgccc

SEQ ID NO: 3541349 - RNA, 12 nt, Pseudomonas putida KT2440
gccccgcgccgc

SEQ ID NO: 3541350 - RNA, 14 nt, Pseudomonas putida KT2440
gccccgcgccgcca

SEQ ID NO: 3541351 - RNA, 20 nt, Pseudomonas putida KT2440
gccccgcgcguccauggcgc

SEQ ID NO: 3541352 - RNA, 17 nt, Pseudomonas putida KT2440
gccccgcucgccuggcc

SEQ ID NO: 3541353 - RNA, 20 nt, Pseudomonas putida KT2440
gccccgcuggucgcgcagau

SEQ ID NO: 3541354 - RNA, 15 nt, Pseudomonas putida KT2440
gccccggcaauaccg

SEQ ID NO: 3541355 - RNA, 16 nt, Pseudomonas putida KT2440
gccccggccagugccu

SEQ ID NO: 3541356 - RNA, 14 nt, Pseudomonas putida KT2440
gccccggccccagg

SEQ ID NO: 3541357 - RNA, 15 nt, Pseudomonas putida KT2440
gccccggccccaggg

SEQ ID NO: 3541358 - RNA, 16 nt, Pseudomonas putida KT2440
gccccggccugcacaa

SEQ ID NO: 3541359 - RNA, 23 nt, Pseudomonas putida KT2440
gccccggcgauacucaccgccgc

SEQ ID NO: 3541360 - RNA, 14 nt, Pseudomonas putida KT2440
gccccggcgccgcc

SEQ ID NO: 3541361 - RNA, 15 nt, Pseudomonas putida KT2440
gccccggcgccgcca

SEQ ID NO: 3541362 - RNA, 19 nt, Pseudomonas putida KT2440
gccccggcgccgccaggca

SEQ ID NO: 3541363 - RNA, 21 nt, Pseudomonas putida KT2440
gccccggcgccgccaggcagc

SEQ ID NO: 3541364 - RNA, 22 nt, Pseudomonas putida KT2440
gccccggcgccgccaggcagca

SEQ ID NO: 3541365 - RNA, 23 nt, Pseudomonas putida KT2440
gccccggcgccgccaggcagcag

SEQ ID NO: 3541366 - RNA, 13 nt, Pseudomonas putida KT2440
gccccggcggcgc

SEQ ID NO: 3541367 - RNA, 22 nt, Pseudomonas putida KT2440
gccccggcggcgcgaaucagcg

SEQ ID NO: 3541368 - RNA, 16 nt, Pseudomonas putida KT2440
gccccggcuaucucag

SEQ ID NO: 3541369 - RNA, 20 nt, Pseudomonas putida KT2440
gccccggcuaucucaggcca

SEQ ID NO: 3541370 - RNA, 21 nt, Pseudomonas putida KT2440
gccccggcuaucucaggccag

SEQ ID NO: 3541371 - RNA, 18 nt, Pseudomonas putida KT2440
gccccgggcaggccaugc

SEQ ID NO: 3541372 - RNA, 14 nt, Pseudomonas putida KT2440
gccccgggugcagc

SEQ ID NO: 3541373 - RNA, 19 nt, Pseudomonas putida KT2440
gccccgguacgacgcacca

SEQ ID NO: 3541374 - RNA, 16 nt, Pseudomonas putida KT2440
gccccggucagcagga

SEQ ID NO: 3541375 - RNA, 17 nt, Pseudomonas putida KT2440
gccccggucagcaggaa

SEQ ID NO: 3541376 - RNA, 20 nt, Pseudomonas putida KT2440
gccccgguccagcacacuga

SEQ ID NO: 3541377 - RNA, 16 nt, Pseudomonas putida KT2440
gccccguccacagcga

SEQ ID NO: 3541378 - RNA, 19 nt, Pseudomonas putida KT2440
gccccgugcccgaucaccg

SEQ ID NO: 3541379 - RNA, 16 nt, Pseudomonas putida KT2440
gccccgugcuacgcgc

SEQ ID NO: 3541380 - RNA, 15 nt, Pseudomonas putida KT2440
gccccuaccgccaac

SEQ ID NO: 3541381 - RNA, 14 nt, Pseudomonas putida KT2440
gccccuacgcuggu

SEQ ID NO: 3541382 - RNA, 18 nt, Pseudomonas putida KT2440
gccccuacgucagcuugc

SEQ ID NO: 3541383 - RNA, 14 nt, Pseudomonas putida KT2440
gccccucaggcaca

SEQ ID NO: 3541384 - RNA, 15 nt, Pseudomonas putida KT2440
gccccucaggcacau

SEQ ID NO: 3541385 - RNA, 23 nt, Pseudomonas putida KT2440
gccccucauucaaagccugcucc

SEQ ID NO: 3541386 - RNA, 17 nt, Pseudomonas putida KT2440
gccccucgaacagcgcc

SEQ ID NO: 3541387 - RNA, 19 nt, Pseudomonas putida KT2440
gccccucgaccacgcacag

SEQ ID NO: 3541388 - RNA, 23 nt, Pseudomonas putida KT2440
gccccucgaccacgcacagcugu

SEQ ID NO: 3541389 - RNA, 22 nt, Pseudomonas putida KT2440
gccccucgucacugacccucaa

SEQ ID NO: 3541390 - RNA, 19 nt, Pseudomonas putida KT2440
gccccugauaggacugcuu

SEQ ID NO: 3541391 - RNA, 22 nt, Pseudomonas putida KT2440
gccccugcaacagggcgcuugc

SEQ ID NO: 3541392 - RNA, 22 nt, Pseudomonas putida KT2440
gccccugcacaucacgcgaccu

SEQ ID NO: 3541393 - RNA, 23 nt, Pseudomonas putida KT2440
gccccugcacaucacgcgaccuc

SEQ ID NO: 3541394 - RNA, 16 nt, Pseudomonas putida KT2440
gccccugccagcacca

SEQ ID NO: 3541395 - RNA, 23 nt, Pseudomonas putida KT2440
gccccugccagcaccagcgcgau

SEQ ID NO: 3541396 - RNA, 13 nt, Pseudomonas putida KT2440
gccccugcgccgc

SEQ ID NO: 3541397 - RNA, 15 nt, Pseudomonas putida KT2440
gccccugcggcugcc

SEQ ID NO: 3541398 - RNA, 17 nt, Pseudomonas putida KT2440
gccccugcuugaccaug

SEQ ID NO: 3541399 - RNA, 13 nt, Pseudomonas putida KT2440
gccccuggaaccc

SEQ ID NO: 3541400 - RNA, 15 nt, Pseudomonas putida KT2440
gccccuggaagcgaa

SEQ ID NO: 3541401 - RNA, 22 nt, Pseudomonas putida KT2440
gccccuggcugucccaugcugc

SEQ ID NO: 3541402 - RNA, 23 nt, Pseudomonas putida KT2440
gccccuggcugucccaugcugca

SEQ ID NO: 3541403 - RNA, 14 nt, Pseudomonas putida KT2440
gccccugguaccga

SEQ ID NO: 3541404 - RNA, 20 nt, Pseudomonas putida KT2440
gccccugguaccgauggugc

SEQ ID NO: 3541405 - RNA, 15 nt, Pseudomonas putida KT2440
gccccuguaggaucg

SEQ ID NO: 3541406 - RNA, 15 nt, Pseudomonas putida KT2440
gccccuuccccaggc

SEQ ID NO: 3541407 - RNA, 19 nt, Pseudomonas putida KT2440
gccccuuccccaggccgcc

SEQ ID NO: 3541408 - RNA, 19 nt, Pseudomonas putida KT2440
gccccuuccuuguaggcca

SEQ ID NO: 3541409 - RNA, 21 nt, Pseudomonas putida KT2440
gccccuuccuuguaggccauu

SEQ ID NO: 3541410 - RNA, 14 nt, Pseudomonas putida KT2440
gccccuucgauuca

SEQ ID NO: 3541411 - RNA, 23 nt, Pseudomonas putida KT2440
gccccuucuauuaaugcacgccu

SEQ ID NO: 3541412 - RNA, 23 nt, Pseudomonas putida KT2440
gccccuuggcacggccagccagc

SEQ ID NO: 3541413 - RNA, 16 nt, Pseudomonas putida KT2440
gccccuuucgcgacac

SEQ ID NO: 3541414 - RNA, 20 nt, Pseudomonas putida KT2440
gcccgaaacacccugcacca

SEQ ID NO: 3541415 - RNA, 17 nt, Pseudomonas putida KT2440
gcccgaaaccaugcagg

SEQ ID NO: 3541416 - RNA, 18 nt, Pseudomonas putida KT2440
gcccgaaaccgccagcca

SEQ ID NO: 3541417 - RNA, 14 nt, Pseudomonas putida KT2440
gcccgaacaacagg

SEQ ID NO: 3541418 - RNA, 18 nt, Pseudomonas putida KT2440
gcccgaacaacaggucgg

SEQ ID NO: 3541419 - RNA, 21 nt, Pseudomonas putida KT2440
gcccgaacaacaggucggcgc

SEQ ID NO: 3541420 - RNA, 16 nt, Pseudomonas putida KT2440
gcccgaacagcacgau

SEQ ID NO: 3541421 - RNA, 23 nt, Pseudomonas putida KT2440
gcccgaaccuugcuugaccuugu

SEQ ID NO: 3541422 - RNA, 15 nt, Pseudomonas putida KT2440
gcccgaacgacacgg

SEQ ID NO: 3541423 - RNA, 16 nt, Pseudomonas putida KT2440
gcccgaacgacacggc

SEQ ID NO: 3541424 - RNA, 17 nt, Pseudomonas putida KT2440
gcccgaacgcagcgccg

SEQ ID NO: 3541425 - RNA, 18 nt, Pseudomonas putida KT2440
gcccgaacgggcucaccu

SEQ ID NO: 3541426 - RNA, 13 nt, Pseudomonas putida KT2440
gcccgaagcgcag

SEQ ID NO: 3541427 - RNA, 18 nt, Pseudomonas putida KT2440
gcccgaagcgcaggucca

SEQ ID NO: 3541428 - RNA, 17 nt, Pseudomonas putida KT2440
gcccgaagcuaucgcca

SEQ ID NO: 3541429 - RNA, 23 nt, Pseudomonas putida KT2440
gcccgaagcuaucgccagcaggc

SEQ ID NO: 3541430 - RNA, 18 nt, Pseudomonas putida KT2440
gcccgacaaagaagcgcc

SEQ ID NO: 3541431 - RNA, 14 nt, Pseudomonas putida KT2440
gcccgacaagccac

SEQ ID NO: 3541432 - RNA, 18 nt, Pseudomonas putida KT2440
gcccgaccgccagcccgc

SEQ ID NO: 3541433 - RNA, 16 nt, Pseudomonas putida KT2440
gcccgaccucacgcag

SEQ ID NO: 3541434 - RNA, 17 nt, Pseudomonas putida KT2440
gcccgaccuuggcgaca

SEQ ID NO: 3541435 - RNA, 14 nt, Pseudomonas putida KT2440
gcccgacuggcugg

SEQ ID NO: 3541436 - RNA, 17 nt, Pseudomonas putida KT2440
gcccgacuggcuggccu

SEQ ID NO: 3541437 - RNA, 14 nt, Pseudomonas putida KT2440
gcccgagcccccgc

SEQ ID NO: 3541438 - RNA, 15 nt, Pseudomonas putida KT2440
gcccgaucaccgcga

SEQ ID NO: 3541439 - RNA, 18 nt, Pseudomonas putida KT2440
gcccgaucgccucgcugg

SEQ ID NO: 3541440 - RNA, 20 nt, Pseudomonas putida KT2440
gcccgaucgccucgcuggcg

SEQ ID NO: 3541441 - RNA, 18 nt, Pseudomonas putida KT2440
gcccgaucggguacucca

SEQ ID NO: 3541442 - RNA, 21 nt, Pseudomonas putida KT2440
gcccgaucggguacuccacca

SEQ ID NO: 3541443 - RNA, 15 nt, Pseudomonas putida KT2440
gcccgcaaagcagcg

SEQ ID NO: 3541444 - RNA, 16 nt, Pseudomonas putida KT2440
gcccgcaacaaccugg

SEQ ID NO: 3541445 - RNA, 18 nt, Pseudomonas putida KT2440
gcccgcaacaccaggaca

SEQ ID NO: 3541446 - RNA, 22 nt, Pseudomonas putida KT2440
gcccgcaacagaucccgcuccu

SEQ ID NO: 3541447 - RNA, 19 nt, Pseudomonas putida KT2440
gcccgcaacauaaggugca

SEQ ID NO: 3541448 - RNA, 15 nt, Pseudomonas putida KT2440
gcccgcaagggucug

SEQ ID NO: 3541449 - RNA, 15 nt, Pseudomonas putida KT2440
gcccgcaccggccga

SEQ ID NO: 3541450 - RNA, 16 nt, Pseudomonas putida KT2440
gcccgcacugcaaugc

SEQ ID NO: 3541451 - RNA, 21 nt, Pseudomonas putida KT2440
gcccgcaggugcggcgcgacu

SEQ ID NO: 3541452 - RNA, 23 nt, Pseudomonas putida KT2440
gcccgcaguacuuauaagcagca

SEQ ID NO: 3541453 - RNA, 21 nt, Pseudomonas putida KT2440
gcccgcaucaaacgaugcggg

SEQ ID NO: 3541454 - RNA, 22 nt, Pseudomonas putida KT2440
gcccgcaucaaacgaugcgggc

SEQ ID NO: 3541455 - RNA, 11 nt, Pseudomonas putida KT2440
gcccgcaucgu

SEQ ID NO: 3541456 - RNA, 21 nt, Pseudomonas putida KT2440
gcccgcaucguuugaugcggg

SEQ ID NO: 3541457 - RNA, 19 nt, Pseudomonas putida KT2440
gcccgcaugauugcgggcu

SEQ ID NO: 3541458 - RNA, 17 nt, Pseudomonas putida KT2440
gcccgcaugcaacccgc

SEQ ID NO: 3541459 - RNA, 19 nt, Pseudomonas putida KT2440
gcccgcaugcaacccgcau

SEQ ID NO: 3541460 - RNA, 15 nt, Pseudomonas putida KT2440
gcccgccaaaaggcc

SEQ ID NO: 3541461 - RNA, 18 nt, Pseudomonas putida KT2440
gcccgccaaaaggcccga

SEQ ID NO: 3541462 - RNA, 14 nt, Pseudomonas putida KT2440
gcccgccacaccga

SEQ ID NO: 3541463 - RNA, 22 nt, Pseudomonas putida KT2440
gcccgccacaccugccaggcca

SEQ ID NO: 3541464 - RNA, 21 nt, Pseudomonas putida KT2440
gcccgccaccgccucgcccag

SEQ ID NO: 3541465 - RNA, 13 nt, Pseudomonas putida KT2440
gcccgccagcagg

SEQ ID NO: 3541466 - RNA, 16 nt, Pseudomonas putida KT2440
gcccgccagcaggcca

SEQ ID NO: 3541467 - RNA, 19 nt, Pseudomonas putida KT2440
gcccgccagcaggccaccg

SEQ ID NO: 3541468 - RNA, 14 nt, Pseudomonas putida KT2440
gcccgccaggcgca

SEQ ID NO: 3541469 - RNA, 22 nt, Pseudomonas putida KT2440
gcccgccaggcgcaagccuucg

SEQ ID NO: 3541470 - RNA, 22 nt, Pseudomonas putida KT2440
gcccgccaguaggcugcagccu

SEQ ID NO: 3541471 - RNA, 14 nt, Pseudomonas putida KT2440
gcccgccaugcaac

SEQ ID NO: 3541472 - RNA, 16 nt, Pseudomonas putida KT2440
gcccgcccacaugcga

SEQ ID NO: 3541473 - RNA, 17 nt, Pseudomonas putida KT2440
gcccgcccaccaccagc

SEQ ID NO: 3541474 - RNA, 16 nt, Pseudomonas putida KT2440
gcccgcccacgccgcu

SEQ ID NO: 3541475 - RNA, 14 nt, Pseudomonas putida KT2440
gcccgcccagcugg

SEQ ID NO: 3541476 - RNA, 15 nt, Pseudomonas putida KT2440
gcccgcccgccugcg

SEQ ID NO: 3541477 - RNA, 16 nt, Pseudomonas putida KT2440
gcccgcccgccugcgc

SEQ ID NO: 3541478 - RNA, 14 nt, Pseudomonas putida KT2440
gcccgccgccacca

SEQ ID NO: 3541479 - RNA, 23 nt, Pseudomonas putida KT2440
gcccgccgccaccagcgccgcca

SEQ ID NO: 3541480 - RNA, 17 nt, Pseudomonas putida KT2440
gcccgccgcccgcggcg

SEQ ID NO: 3541481 - RNA, 22 nt, Pseudomonas putida KT2440
gcccgccggcaacuccuccagc

SEQ ID NO: 3541482 - RNA, 19 nt, Pseudomonas putida KT2440
gcccgccggcacuuccucg

SEQ ID NO: 3541483 - RNA, 18 nt, Pseudomonas putida KT2440
gcccgccgucaucgaacc

SEQ ID NO: 3541484 - RNA, 18 nt, Pseudomonas putida KT2440
gcccgccguguucccagc

SEQ ID NO: 3541485 - RNA, 22 nt, Pseudomonas putida KT2440
gcccgccucgccauaagcuguc

SEQ ID NO: 3541486 - RNA, 23 nt, Pseudomonas putida KT2440
gcccgccucgccauaagcuguca

SEQ ID NO: 3541487 - RNA, 14 nt, Pseudomonas putida KT2440
gcccgccugcgcca

SEQ ID NO: 3541488 - RNA, 16 nt, Pseudomonas putida KT2440
gcccgccugcgccagc

SEQ ID NO: 3541489 - RNA, 22 nt, Pseudomonas putida KT2440
gcccgccugcucaaucaaccag

SEQ ID NO: 3541490 - RNA, 18 nt, Pseudomonas putida KT2440
gcccgccuucgcgggcuu

SEQ ID NO: 3541491 - RNA, 12 nt, Pseudomonas putida KT2440
gcccgcgaaaug

SEQ ID NO: 3541492 - RNA, 13 nt, Pseudomonas putida KT2440
gcccgcgaaaugc

SEQ ID NO: 3541493 - RNA, 17 nt, Pseudomonas putida KT2440
gcccgcgaaaugcccaa

SEQ ID NO: 3541494 - RNA, 16 nt, Pseudomonas putida KT2440
gcccgcgaacaaggcu

SEQ ID NO: 3541495 - RNA, 18 nt, Pseudomonas putida KT2440
gcccgcgaacaaggcuca

SEQ ID NO: 3541496 - RNA, 22 nt, Pseudomonas putida KT2440
gcccgcgaacaaggcucagcug

SEQ ID NO: 3541497 - RNA, 21 nt, Pseudomonas putida KT2440
gcccgcgaacacgggcgaagc

SEQ ID NO: 3541498 - RNA, 14 nt, Pseudomonas putida KT2440
gcccgcgaagaggc

SEQ ID NO: 3541499 - RNA, 15 nt, Pseudomonas putida KT2440
gcccgcgaagaggcc

SEQ ID NO: 3541500 - RNA, 16 nt, Pseudomonas putida KT2440
gcccgcgaagaggcca

SEQ ID NO: 3541501 - RNA, 18 nt, Pseudomonas putida KT2440
gcccgcgaagaggccagc

SEQ ID NO: 3541502 - RNA, 19 nt, Pseudomonas putida KT2440
gcccgcgaagaggccagca

SEQ ID NO: 3541503 - RNA, 20 nt, Pseudomonas putida KT2440
gcccgcgaagaggccagcac

SEQ ID NO: 3541504 - RNA, 18 nt, Pseudomonas putida KT2440
gcccgcgaagaggccggc

SEQ ID NO: 3541505 - RNA, 19 nt, Pseudomonas putida KT2440
gcccgcgaagaggccggca

SEQ ID NO: 3541506 - RNA, 21 nt, Pseudomonas putida KT2440
gcccgcgaagaggccgguaca

SEQ ID NO: 3541507 - RNA, 18 nt, Pseudomonas putida KT2440
gcccgcgaagggccgcaa

SEQ ID NO: 3541508 - RNA, 19 nt, Pseudomonas putida KT2440
gcccgcgaagggcucaaca

SEQ ID NO: 3541509 - RNA, 16 nt, Pseudomonas putida KT2440
gcccgcgaaggggccg

SEQ ID NO: 3541510 - RNA, 23 nt, Pseudomonas putida KT2440
gcccgcgaaucgccuucagcgcc

SEQ ID NO: 3541511 - RNA, 15 nt, Pseudomonas putida KT2440
gcccgcgaaugggcc

SEQ ID NO: 3541512 - RNA, 15 nt, Pseudomonas putida KT2440
gcccgcgaggaggcc

SEQ ID NO: 3541513 - RNA, 23 nt, Pseudomonas putida KT2440
gcccgcgaggaggccggggaugc

SEQ ID NO: 3541514 - RNA, 19 nt, Pseudomonas putida KT2440
gcccgcgcagcuuccacca

SEQ ID NO: 3541515 - RNA, 21 nt, Pseudomonas putida KT2440
gcccgcgccacccgcugggcu

SEQ ID NO: 3541516 - RNA, 16 nt, Pseudomonas putida KT2440
gcccgcgccgcccagc

SEQ ID NO: 3541517 - RNA, 20 nt, Pseudomonas putida KT2440
gcccgcgcgcgaugcgccgc

SEQ ID NO: 3541518 - RNA, 12 nt, Pseudomonas putida KT2440
gcccgcgcggcg

SEQ ID NO: 3541519 - RNA, 15 nt, Pseudomonas putida KT2440
gcccgcgcuucacgu

SEQ ID NO: 3541520 - RNA, 19 nt, Pseudomonas putida KT2440
gcccgcggaucgcgccuuc

SEQ ID NO: 3541521 - RNA, 21 nt, Pseudomonas putida KT2440
gcccgcggcgaacacagcggc

SEQ ID NO: 3541522 - RNA, 12 nt, Pseudomonas putida KT2440
gcccgcggcuca

SEQ ID NO: 3541523 - RNA, 21 nt, Pseudomonas putida KT2440
gcccgcggcucacccaccagc

SEQ ID NO: 3541524 - RNA, 15 nt, Pseudomonas putida KT2440
gcccgcgucugccgc

SEQ ID NO: 3541525 - RNA, 18 nt, Pseudomonas putida KT2440
gcccgcgucugccgcagc

SEQ ID NO: 3541526 - RNA, 18 nt, Pseudomonas putida KT2440
gcccgcgugcuucaagcc

SEQ ID NO: 3541527 - RNA, 23 nt, Pseudomonas putida KT2440
gcccgcuacgacccugaagcccu

SEQ ID NO: 3541528 - RNA, 20 nt, Pseudomonas putida KT2440
gcccgcuauccucgaucgcc

SEQ ID NO: 3541529 - RNA, 16 nt, Pseudomonas putida KT2440
gcccgcucauguccag

SEQ ID NO: 3541530 - RNA, 16 nt, Pseudomonas putida KT2440
gcccgcucccacagga

SEQ ID NO: 3541531 - RNA, 19 nt, Pseudomonas putida KT2440
gcccgcucccacaggaauu

SEQ ID NO: 3541532 - RNA, 20 nt, Pseudomonas putida KT2440
gcccgcucccacaggaauua

SEQ ID NO: 3541533 - RNA, 18 nt, Pseudomonas putida KT2440
gcccgcucccacagguaa

SEQ ID NO: 3541534 - RNA, 20 nt, Pseudomonas putida KT2440
gcccgcucccacagguacuc

SEQ ID NO: 3541535 - RNA, 19 nt, Pseudomonas putida KT2440
gcccgcucccacagguaug

SEQ ID NO: 3541536 - RNA, 20 nt, Pseudomonas putida KT2440
gcccgcucccacagguucgg

SEQ ID NO: 3541537 - RNA, 20 nt, Pseudomonas putida KT2440
gcccgcucccacagguuugc

SEQ ID NO: 3541538 - RNA, 22 nt, Pseudomonas putida KT2440
gcccgcuccgacauugaucggc

SEQ ID NO: 3541539 - RNA, 14 nt, Pseudomonas putida KT2440
gcccgcucucacag

SEQ ID NO: 3541540 - RNA, 20 nt, Pseudomonas putida KT2440
gcccgcugaaacaucagccg

SEQ ID NO: 3541541 - RNA, 22 nt, Pseudomonas putida KT2440
gcccgcugaaacaucagccggu

SEQ ID NO: 3541542 - RNA, 17 nt, Pseudomonas putida KT2440
gcccgcugaccgggucg

SEQ ID NO: 3541543 - RNA, 15 nt, Pseudomonas putida KT2440
gcccgcugccaccuu

SEQ ID NO: 3541544 - RNA, 13 nt, Pseudomonas putida KT2440
gcccgcugcgccg

SEQ ID NO: 3541545 - RNA, 13 nt, Pseudomonas putida KT2440
gcccgcugcuucc

SEQ ID NO: 3541546 - RNA, 16 nt, Pseudomonas putida KT2440
gcccgcugcuuccggc

SEQ ID NO: 3541547 - RNA, 18 nt, Pseudomonas putida KT2440
gcccgcuggccgcaccca

SEQ ID NO: 3541548 - RNA, 23 nt, Pseudomonas putida KT2440
gcccgcuggccgcacccagcagg

SEQ ID NO: 3541549 - RNA, 21 nt, Pseudomonas putida KT2440
gcccgcuguugagcagcagcc

SEQ ID NO: 3541550 - RNA, 14 nt, Pseudomonas putida KT2440
gcccgcuugcccga

SEQ ID NO: 3541551 - RNA, 14 nt, Pseudomonas putida KT2440
gcccgcuugcgcgg

SEQ ID NO: 3541552 - RNA, 13 nt, Pseudomonas putida KT2440
gcccgcuugcugu

SEQ ID NO: 3541553 - RNA, 17 nt, Pseudomonas putida KT2440
gcccgcuugcuguguua

SEQ ID NO: 3541554 - RNA, 18 nt, Pseudomonas putida KT2440
gcccggaagcuucucgag

SEQ ID NO: 3541555 - RNA, 17 nt, Pseudomonas putida KT2440
gcccggacugcaccagg

SEQ ID NO: 3541556 - RNA, 16 nt, Pseudomonas putida KT2440
gcccggauaguguucg

SEQ ID NO: 3541557 - RNA, 18 nt, Pseudomonas putida KT2440
gcccggauaguguucgag

SEQ ID NO: 3541558 - RNA, 13 nt, Pseudomonas putida KT2440
gcccggcaaacac

SEQ ID NO: 3541559 - RNA, 19 nt, Pseudomonas putida KT2440
gcccggcaaacacauccac

SEQ ID NO: 3541560 - RNA, 16 nt, Pseudomonas putida KT2440
gcccggcaaucgccag

SEQ ID NO: 3541561 - RNA, 19 nt, Pseudomonas putida KT2440
gcccggcaauuucauccac

SEQ ID NO: 3541562 - RNA, 14 nt, Pseudomonas putida KT2440
gcccggcaccugcc

SEQ ID NO: 3541563 - RNA, 17 nt, Pseudomonas putida KT2440
gcccggcacgguugcgc

SEQ ID NO: 3541564 - RNA, 21 nt, Pseudomonas putida KT2440
gcccggcacgguugcgcccgg

SEQ ID NO: 3541565 - RNA, 16 nt, Pseudomonas putida KT2440
gcccggcagaucgagc

SEQ ID NO: 3541566 - RNA, 21 nt, Pseudomonas putida KT2440
gcccggcagaucgagcgccgc

SEQ ID NO: 3541567 - RNA, 22 nt, Pseudomonas putida KT2440
gcccggcagaucgagcgccgcc

SEQ ID NO: 3541568 - RNA, 14 nt, Pseudomonas putida KT2440
gcccggcagguugc

SEQ ID NO: 3541569 - RNA, 21 nt, Pseudomonas putida KT2440
gcccggcauccgccucauccu

SEQ ID NO: 3541570 - RNA, 15 nt, Pseudomonas putida KT2440
gcccggcauccuugg

SEQ ID NO: 3541571 - RNA, 14 nt, Pseudomonas putida KT2440
gcccggccaacaac

SEQ ID NO: 3541572 - RNA, 23 nt, Pseudomonas putida KT2440
gcccggccacgaauuucaaggcg

SEQ ID NO: 3541573 - RNA, 14 nt, Pseudomonas putida KT2440
gcccggccagcagg

SEQ ID NO: 3541574 - RNA, 15 nt, Pseudomonas putida KT2440
gcccggccagcagga

SEQ ID NO: 3541575 - RNA, 12 nt, Pseudomonas putida KT2440
gcccggccagcg

SEQ ID NO: 3541576 - RNA, 16 nt, Pseudomonas putida KT2440
gcccggcccuuucgcg

SEQ ID NO: 3541577 - RNA, 17 nt, Pseudomonas putida KT2440
gcccggcccuuucgcgg

SEQ ID NO: 3541578 - RNA, 19 nt, Pseudomonas putida KT2440
gcccggcccuuucgcgggu

SEQ ID NO: 3541579 - RNA, 18 nt, Pseudomonas putida KT2440
gcccggccgcgccaccgg

SEQ ID NO: 3541580 - RNA, 22 nt, Pseudomonas putida KT2440
gcccggcgccaaacgccagggc

SEQ ID NO: 3541581 - RNA, 13 nt, Pseudomonas putida KT2440
gcccggcgcgcgc

SEQ ID NO: 3541582 - RNA, 15 nt, Pseudomonas putida KT2440
gcccggcgcuggugc

SEQ ID NO: 3541583 - RNA, 16 nt, Pseudomonas putida KT2440
gcccggcgcuggugca

SEQ ID NO: 3541584 - RNA, 17 nt, Pseudomonas putida KT2440
gcccggcgcuggugcag

SEQ ID NO: 3541585 - RNA, 21 nt, Pseudomonas putida KT2440
gcccggcgucgaacaacggca

SEQ ID NO: 3541586 - RNA, 19 nt, Pseudomonas putida KT2440
gcccggcuccagguacucg

SEQ ID NO: 3541587 - RNA, 14 nt, Pseudomonas putida KT2440
gcccggcuccgcgc

SEQ ID NO: 3541588 - RNA, 17 nt, Pseudomonas putida KT2440
gcccggcuccgcgcaag

SEQ ID NO: 3541589 - RNA, 19 nt, Pseudomonas putida KT2440
gcccggcugaaaccgcgaa

SEQ ID NO: 3541590 - RNA, 20 nt, Pseudomonas putida KT2440
gcccggcugaaaccgcgaau

SEQ ID NO: 3541591 - RNA, 13 nt, Pseudomonas putida KT2440
gcccggcuggcca

SEQ ID NO: 3541592 - RNA, 14 nt, Pseudomonas putida KT2440
gcccggcuggccac

SEQ ID NO: 3541593 - RNA, 18 nt, Pseudomonas putida KT2440
gcccggcuugcaccaacg

SEQ ID NO: 3541594 - RNA, 16 nt, Pseudomonas putida KT2440
gcccggcuugcccggg

SEQ ID NO: 3541595 - RNA, 18 nt, Pseudomonas putida KT2440
gcccgggaacggcugccg

SEQ ID NO: 3541596 - RNA, 22 nt, Pseudomonas putida KT2440
gcccgggaagugguuggcagug

SEQ ID NO: 3541597 - RNA, 18 nt, Pseudomonas putida KT2440
gcccgggcacgggccagc

SEQ ID NO: 3541598 - RNA, 20 nt, Pseudomonas putida KT2440
gcccgggcacgggccagcgc

SEQ ID NO: 3541599 - RNA, 13 nt, Pseudomonas putida KT2440
gcccgggcagccg

SEQ ID NO: 3541600 - RNA, 13 nt, Pseudomonas putida KT2440
gcccgggccgcuu

SEQ ID NO: 3541601 - RNA, 16 nt, Pseudomonas putida KT2440
gcccgggcgcaggcag

SEQ ID NO: 3541602 - RNA, 18 nt, Pseudomonas putida KT2440
gcccgggcgcaggcagca

SEQ ID NO: 3541603 - RNA, 20 nt, Pseudomonas putida KT2440
gcccggggaucuugcuggcc

SEQ ID NO: 3541604 - RNA, 23 nt, Pseudomonas putida KT2440
gcccggggaucuugcuggccggu

SEQ ID NO: 3541605 - RNA, 13 nt, Pseudomonas putida KT2440
gcccgggucccgu

SEQ ID NO: 3541606 - RNA, 17 nt, Pseudomonas putida KT2440
gcccgguaauagcggcg

SEQ ID NO: 3541607 - RNA, 17 nt, Pseudomonas putida KT2440
gcccggucccgcugccg

SEQ ID NO: 3541608 - RNA, 16 nt, Pseudomonas putida KT2440
gcccggugcaagccaa

SEQ ID NO: 3541609 - RNA, 20 nt, Pseudomonas putida KT2440
gcccggugcccuugccgccc

SEQ ID NO: 3541610 - RNA, 21 nt, Pseudomonas putida KT2440
gcccggugcccuugccgcccc

SEQ ID NO: 3541611 - RNA, 15 nt, Pseudomonas putida KT2440
gcccgguggcgcggc

SEQ ID NO: 3541612 - RNA, 15 nt, Pseudomonas putida KT2440
gcccgguuccagcgc

SEQ ID NO: 3541613 - RNA, 16 nt, Pseudomonas putida KT2440
gcccgguuccagcgca

SEQ ID NO: 3541614 - RNA, 19 nt, Pseudomonas putida KT2440
gcccgguuccagcgcaccg

SEQ ID NO: 3541615 - RNA, 20 nt, Pseudomonas putida KT2440
gcccgguugcaccgagaagc

SEQ ID NO: 3541616 - RNA, 21 nt, Pseudomonas putida KT2440
gcccguacagaccgccgggcc

SEQ ID NO: 3541617 - RNA, 13 nt, Pseudomonas putida KT2440
gcccguaggagcg

SEQ ID NO: 3541618 - RNA, 16 nt, Pseudomonas putida KT2440
gcccguaggagcgggu

SEQ ID NO: 3541619 - RNA, 16 nt, Pseudomonas putida KT2440
gcccgucagcuugccu

SEQ ID NO: 3541620 - RNA, 18 nt, Pseudomonas putida KT2440
gcccgucugcgugcaccc

SEQ ID NO: 3541621 - RNA, 19 nt, Pseudomonas putida KT2440
gcccgucugcgugcaccca

SEQ ID NO: 3541622 - RNA, 22 nt, Pseudomonas putida KT2440
gcccgucugcgugcacccaacc

SEQ ID NO: 3541623 - RNA, 14 nt, Pseudomonas putida KT2440
gcccgucuggcugc

SEQ ID NO: 3541624 - RNA, 15 nt, Pseudomonas putida KT2440
gcccgucuggcugca

SEQ ID NO: 3541625 - RNA, 21 nt, Pseudomonas putida KT2440
gcccgucuggcugcaaggucc

SEQ ID NO: 3541626 - RNA, 15 nt, Pseudomonas putida KT2440
gcccgugccauccac

SEQ ID NO: 3541627 - RNA, 15 nt, Pseudomonas putida KT2440
gcccgugccgcauca

SEQ ID NO: 3541628 - RNA, 19 nt, Pseudomonas putida KT2440
gcccgugccgcaucagccg

SEQ ID NO: 3541629 - RNA, 21 nt, Pseudomonas putida KT2440
gcccgugccgcaucagccggc

SEQ ID NO: 3541630 - RNA, 19 nt, Pseudomonas putida KT2440
gcccguggcccucagccca

SEQ ID NO: 3541631 - RNA, 20 nt, Pseudomonas putida KT2440
gcccguggcccucagcccag

SEQ ID NO: 3541632 - RNA, 23 nt, Pseudomonas putida KT2440
gcccguucuggccuuggcgugca

SEQ ID NO: 3541633 - RNA, 15 nt, Pseudomonas putida KT2440
gcccguugagggugg

SEQ ID NO: 3541634 - RNA, 20 nt, Pseudomonas putida KT2440
gcccguugcgcaucaccucg

SEQ ID NO: 3541635 - RNA, 19 nt, Pseudomonas putida KT2440
gcccuagaacaggcggcug

SEQ ID NO: 3541636 - RNA, 20 nt, Pseudomonas putida KT2440
gcccuaucgcgacgcaaggc

SEQ ID NO: 3541637 - RNA, 20 nt, Pseudomonas putida KT2440
gcccuauggggugagcggcu

SEQ ID NO: 3541638 - RNA, 15 nt, Pseudomonas putida KT2440
gcccucaacccucgc

SEQ ID NO: 3541639 - RNA, 16 nt, Pseudomonas putida KT2440
gcccucaacccucgcc

SEQ ID NO: 3541640 - RNA, 19 nt, Pseudomonas putida KT2440
gcccucaacccucgcccag

SEQ ID NO: 3541641 - RNA, 18 nt, Pseudomonas putida KT2440
gcccucaagggauuggca

SEQ ID NO: 3541642 - RNA, 19 nt, Pseudomonas putida KT2440
gcccucaagggauuggcaa

SEQ ID NO: 3541643 - RNA, 12 nt, Pseudomonas putida KT2440
gcccucaagggc

SEQ ID NO: 3541644 - RNA, 18 nt, Pseudomonas putida KT2440
gcccucacucaccgcaca

SEQ ID NO: 3541645 - RNA, 18 nt, Pseudomonas putida KT2440
gcccucauucgcccgcac

SEQ ID NO: 3541646 - RNA, 15 nt, Pseudomonas putida KT2440
gcccuccagcccugg

SEQ ID NO: 3541647 - RNA, 22 nt, Pseudomonas putida KT2440
gcccuccaucaaucgcucgaaa

SEQ ID NO: 3541648 - RNA, 18 nt, Pseudomonas putida KT2440
gcccuccuaucgcgacac

SEQ ID NO: 3541649 - RNA, 19 nt, Pseudomonas putida KT2440
gcccucgacaaucgccagg

SEQ ID NO: 3541650 - RNA, 20 nt, Pseudomonas putida KT2440
gcccucgacaaucgccaggu

SEQ ID NO: 3541651 - RNA, 21 nt, Pseudomonas putida KT2440
gcccucgacaaucgccaggua

SEQ ID NO: 3541652 - RNA, 23 nt, Pseudomonas putida KT2440
gcccucgacaaucgccagguaca

SEQ ID NO: 3541653 - RNA, 19 nt, Pseudomonas putida KT2440
gcccucgagugcgcugauc

SEQ ID NO: 3541654 - RNA, 17 nt, Pseudomonas putida KT2440
gcccucgaugucuucca

SEQ ID NO: 3541655 - RNA, 22 nt, Pseudomonas putida KT2440
gcccucgaugucuuccagacca

SEQ ID NO: 3541656 - RNA, 18 nt, Pseudomonas putida KT2440
gcccucggauccaauguu

SEQ ID NO: 3541657 - RNA, 20 nt, Pseudomonas putida KT2440
gcccucggcaaucugcagca

SEQ ID NO: 3541658 - RNA, 23 nt, Pseudomonas putida KT2440
gcccucggcaaucugcagcagca

SEQ ID NO: 3541659 - RNA, 21 nt, Pseudomonas putida KT2440
gcccucggccggggccaggcg

SEQ ID NO: 3541660 - RNA, 22 nt, Pseudomonas putida KT2440
gcccucggccggggccaggcgc

SEQ ID NO: 3541661 - RNA, 17 nt, Pseudomonas putida KT2440
gcccucguucgcgggca

SEQ ID NO: 3541662 - RNA, 20 nt, Pseudomonas putida KT2440
gcccucugcgugguaugcau

SEQ ID NO: 3541663 - RNA, 19 nt, Pseudomonas putida KT2440
gcccucuucgcgggcaugc

SEQ ID NO: 3541664 - RNA, 22 nt, Pseudomonas putida KT2440
gcccugaacuuggccuccagca

SEQ ID NO: 3541665 - RNA, 17 nt, Pseudomonas putida KT2440
gcccugacgccagcgcu

SEQ ID NO: 3541666 - RNA, 18 nt, Pseudomonas putida KT2440
gcccugacgccagcgcug

SEQ ID NO: 3541667 - RNA, 18 nt, Pseudomonas putida KT2440
gcccugagccaaggccgc

SEQ ID NO: 3541668 - RNA, 17 nt, Pseudomonas putida KT2440
gcccugaucccggccgu

SEQ ID NO: 3541669 - RNA, 18 nt, Pseudomonas putida KT2440
gcccugaucccggccguu

SEQ ID NO: 3541670 - RNA, 14 nt, Pseudomonas putida KT2440
gcccugaucgccuc

SEQ ID NO: 3541671 - RNA, 17 nt, Pseudomonas putida KT2440
gcccugaucgccuccag

SEQ ID NO: 3541672 - RNA, 18 nt, Pseudomonas putida KT2440
gcccugaucgccuccagg

SEQ ID NO: 3541673 - RNA, 19 nt, Pseudomonas putida KT2440
gcccugaucgccuccaggc

SEQ ID NO: 3541674 - RNA, 18 nt, Pseudomonas putida KT2440
gcccugcagcuucccggc

SEQ ID NO: 3541675 - RNA, 19 nt, Pseudomonas putida KT2440
gcccugcagcuucccggcc

SEQ ID NO: 3541676 - RNA, 21 nt, Pseudomonas putida KT2440
gcccugcagcuucccggccug

SEQ ID NO: 3541677 - RNA, 13 nt, Pseudomonas putida KT2440
gcccugcccucga

SEQ ID NO: 3541678 - RNA, 17 nt, Pseudomonas putida KT2440
gcccugccgaggccaug

SEQ ID NO: 3541679 - RNA, 21 nt, Pseudomonas putida KT2440
gcccugccuaccaccgcaucc

SEQ ID NO: 3541680 - RNA, 13 nt, Pseudomonas putida KT2440
gcccugcgccugc

SEQ ID NO: 3541681 - RNA, 15 nt, Pseudomonas putida KT2440
gcccugcucacgcag

SEQ ID NO: 3541682 - RNA, 15 nt, Pseudomonas putida KT2440
gcccugcucauccag

SEQ ID NO: 3541683 - RNA, 20 nt, Pseudomonas putida KT2440
gcccugcucguccaucaccg

SEQ ID NO: 3541684 - RNA, 20 nt, Pseudomonas putida KT2440
gcccugcucuucgauccgcg

SEQ ID NO: 3541685 - RNA, 21 nt, Pseudomonas putida KT2440
gcccugcuggccaaucuccac

SEQ ID NO: 3541686 - RNA, 14 nt, Pseudomonas putida KT2440
gcccuggacaaucu

SEQ ID NO: 3541687 - RNA, 13 nt, Pseudomonas putida KT2440
gcccuggcaugcu

SEQ ID NO: 3541688 - RNA, 15 nt, Pseudomonas putida KT2440
gcccuggcccgccgc

SEQ ID NO: 3541689 - RNA, 16 nt, Pseudomonas putida KT2440
gcccuggcccgccgcc

SEQ ID NO: 3541690 - RNA, 17 nt, Pseudomonas putida KT2440
gcccuggcccgccgcca

SEQ ID NO: 3541691 - RNA, 13 nt, Pseudomonas putida KT2440
gcccuggcgacga

SEQ ID NO: 3541692 - RNA, 23 nt, Pseudomonas putida KT2440
gcccuggcgacgaguuuaccucc

SEQ ID NO: 3541693 - RNA, 18 nt, Pseudomonas putida KT2440
gcccuggcggccacggca

SEQ ID NO: 3541694 - RNA, 21 nt, Pseudomonas putida KT2440
gcccugggcgagcaggugacc

SEQ ID NO: 3541695 - RNA, 15 nt, Pseudomonas putida KT2440
gcccuggucauucca

SEQ ID NO: 3541696 - RNA, 17 nt, Pseudomonas putida KT2440
gcccuguaccgccucgg

SEQ ID NO: 3541697 - RNA, 17 nt, Pseudomonas putida KT2440
gcccuguagagcgccuu

SEQ ID NO: 3541698 - RNA, 22 nt, Pseudomonas putida KT2440
gcccugugcuuugagcaggcgc

SEQ ID NO: 3541699 - RNA, 14 nt, Pseudomonas putida KT2440
gcccugugggagcg

SEQ ID NO: 3541700 - RNA, 19 nt, Pseudomonas putida KT2440
gcccugugggagcggccuu

SEQ ID NO: 3541701 - RNA, 21 nt, Pseudomonas putida KT2440
gcccugugggagcgggcaugc

SEQ ID NO: 3541702 - RNA, 21 nt, Pseudomonas putida KT2440
gcccugugggagcgggcgugc

SEQ ID NO: 3541703 - RNA, 19 nt, Pseudomonas putida KT2440
gcccuguguaggagcgggu

SEQ ID NO: 3541704 - RNA, 18 nt, Pseudomonas putida KT2440
gcccuguuucuucaaggc

SEQ ID NO: 3541705 - RNA, 21 nt, Pseudomonas putida KT2440
gcccuuaaggucaaucaggga

SEQ ID NO: 3541706 - RNA, 20 nt, Pseudomonas putida KT2440
gcccuucagcguuuuauaaa

SEQ ID NO: 3541707 - RNA, 15 nt, Pseudomonas putida KT2440
gcccuucaggcccca

SEQ ID NO: 3541708 - RNA, 23 nt, Pseudomonas putida KT2440
gcccuucaggccccagucauccg

SEQ ID NO: 3541709 - RNA, 18 nt, Pseudomonas putida KT2440
gcccuucauacagcgccu

SEQ ID NO: 3541710 - RNA, 15 nt, Pseudomonas putida KT2440
gcccuucaugcgccc

SEQ ID NO: 3541711 - RNA, 19 nt, Pseudomonas putida KT2440
gcccuucgcggaagcucuc

SEQ ID NO: 3541712 - RNA, 13 nt, Pseudomonas putida KT2440
gcccuucgcgggc

SEQ ID NO: 3541713 - RNA, 17 nt, Pseudomonas putida KT2440
gcccuucgcgggcacgc

SEQ ID NO: 3541714 - RNA, 15 nt, Pseudomonas putida KT2440
gcccuucugaaaggc

SEQ ID NO: 3541715 - RNA, 22 nt, Pseudomonas putida KT2440
gcccuugaacagaccccagucg

SEQ ID NO: 3541716 - RNA, 22 nt, Pseudomonas putida KT2440
gcccuugagcuucagcgcgcca

SEQ ID NO: 3541717 - RNA, 23 nt, Pseudomonas putida KT2440
gcccuugaugaucaggucggcgg

SEQ ID NO: 3541718 - RNA, 22 nt, Pseudomonas putida KT2440
gcccuugccaccagugccgggu

SEQ ID NO: 3541719 - RNA, 18 nt, Pseudomonas putida KT2440
gcccuugcggaccaccug

SEQ ID NO: 3541720 - RNA, 17 nt, Pseudomonas putida KT2440
gcccuugcucaaugucu

SEQ ID NO: 3541721 - RNA, 13 nt, Pseudomonas putida KT2440
gcccuugcucggc

SEQ ID NO: 3541722 - RNA, 15 nt, Pseudomonas putida KT2440
gcccuugcugcagca

SEQ ID NO: 3541723 - RNA, 13 nt, Pseudomonas putida KT2440
gcccuuggcagcg

SEQ ID NO: 3541724 - RNA, 17 nt, Pseudomonas putida KT2440
gcccuuggcagcgcugc

SEQ ID NO: 3541725 - RNA, 18 nt, Pseudomonas putida KT2440
gcccuuggcagcgcugca

SEQ ID NO: 3541726 - RNA, 12 nt, Pseudomonas putida KT2440
gcccuuguccau

SEQ ID NO: 3541727 - RNA, 16 nt, Pseudomonas putida KT2440
gcccuugucgaacagc

SEQ ID NO: 3541728 - RNA, 13 nt, Pseudomonas putida KT2440
gcccuuucagggu

SEQ ID NO: 3541729 - RNA, 13 nt, Pseudomonas putida KT2440
gcccuuucgcggg

SEQ ID NO: 3541730 - RNA, 16 nt, Pseudomonas putida KT2440
gcccuuucgcgggaga

SEQ ID NO: 3541731 - RNA, 20 nt, Pseudomonas putida KT2440
gcccuuucgcgggugaaccc

SEQ ID NO: 3541732 - RNA, 22 nt, Pseudomonas putida KT2440
gcccuuucgcgggugaacccga

SEQ ID NO: 3541733 - RNA, 21 nt, Pseudomonas putida KT2440
gcccuuugguacugcgccggc

SEQ ID NO: 3541734 - RNA, 18 nt, Pseudomonas putida KT2440
gcccuuuguucauggugg

SEQ ID NO: 3541735 - RNA, 19 nt, Pseudomonas putida KT2440
gcccuuuucuacauggugg

SEQ ID NO: 3541736 - RNA, 17 nt, Pseudomonas putida KT2440
gcccuuuuucaccaggc

SEQ ID NO: 3541737 - RNA, 20 nt, Pseudomonas putida KT2440
gcccuuuuucaccaggcggu

SEQ ID NO: 3541738 - RNA, 15 nt, Pseudomonas putida KT2440
gccgaaaccagcccc

SEQ ID NO: 3541739 - RNA, 15 nt, Pseudomonas putida KT2440
gccgaaaccgcccgg

SEQ ID NO: 3541740 - RNA, 18 nt, Pseudomonas putida KT2440
gccgaaaccgcccgggau

SEQ ID NO: 3541741 - RNA, 13 nt, Pseudomonas putida KT2440
gccgaaaggugca

SEQ ID NO: 3541742 - RNA, 20 nt, Pseudomonas putida KT2440
gccgaaauaugcagugcccg

SEQ ID NO: 3541743 - RNA, 20 nt, Pseudomonas putida KT2440
gccgaacagcacgauaccgg

SEQ ID NO: 3541744 - RNA, 17 nt, Pseudomonas putida KT2440
gccgaacagucauccag

SEQ ID NO: 3541745 - RNA, 13 nt, Pseudomonas putida KT2440
gccgaacauggug

SEQ ID NO: 3541746 - RNA, 11 nt, Pseudomonas putida KT2440
gccgaaccacc

SEQ ID NO: 3541747 - RNA, 17 nt, Pseudomonas putida KT2440
gccgaaccaccgaugcu

SEQ ID NO: 3541748 - RNA, 14 nt, Pseudomonas putida KT2440
gccgaaccagcaga

SEQ ID NO: 3541749 - RNA, 18 nt, Pseudomonas putida KT2440
gccgaaccagcagaaccc

SEQ ID NO: 3541750 - RNA, 20 nt, Pseudomonas putida KT2440
gccgaacgcaagaaggcugc

SEQ ID NO: 3541751 - RNA, 20 nt, Pseudomonas putida KT2440
gccgaacgggccaccaaagg

SEQ ID NO: 3541752 - RNA, 22 nt, Pseudomonas putida KT2440
gccgaacgggccaccaaaggcc

SEQ ID NO: 3541753 - RNA, 22 nt, Pseudomonas putida KT2440
gccgaacucuggcaacagcuca

SEQ ID NO: 3541754 - RNA, 16 nt, Pseudomonas putida KT2440
gccgaagaacgcgagc

SEQ ID NO: 3541755 - RNA, 15 nt, Pseudomonas putida KT2440
gccgaagccaugagc

SEQ ID NO: 3541756 - RNA, 18 nt, Pseudomonas putida KT2440
gccgaagccaugagcgag

SEQ ID NO: 3541757 - RNA, 21 nt, Pseudomonas putida KT2440
gccgaagccaugagcgagcuc

SEQ ID NO: 3541758 - RNA, 15 nt, Pseudomonas putida KT2440
gccgaagcccagcga

SEQ ID NO: 3541759 - RNA, 18 nt, Pseudomonas putida KT2440
gccgaagcccagcgaggc

SEQ ID NO: 3541760 - RNA, 14 nt, Pseudomonas putida KT2440
gccgaaggccuuca

SEQ ID NO: 3541761 - RNA, 19 nt, Pseudomonas putida KT2440
gccgaagucauccauggca

SEQ ID NO: 3541762 - RNA, 20 nt, Pseudomonas putida KT2440
gccgaaguggcggcucgcug

SEQ ID NO: 3541763 - RNA, 18 nt, Pseudomonas putida KT2440
gccgacaaaaacaacaau

SEQ ID NO: 3541764 - RNA, 19 nt, Pseudomonas putida KT2440
gccgacaaaaacaacaaua

SEQ ID NO: 3541765 - RNA, 21 nt, Pseudomonas putida KT2440
gccgacaaacguaccagccgc

SEQ ID NO: 3541766 - RNA, 13 nt, Pseudomonas putida KT2440
gccgacaacagca

SEQ ID NO: 3541767 - RNA, 19 nt, Pseudomonas putida KT2440
gccgacaacagcaugcuca

SEQ ID NO: 3541768 - RNA, 21 nt, Pseudomonas putida KT2440
gccgacaacgguguggccagu

SEQ ID NO: 3541769 - RNA, 19 nt, Pseudomonas putida KT2440
gccgacagccucaaggccg

SEQ ID NO: 3541770 - RNA, 22 nt, Pseudomonas putida KT2440
gccgacaguguugccggcgagc

SEQ ID NO: 3541771 - RNA, 17 nt, Pseudomonas putida KT2440
gccgacaucgaagcagu

SEQ ID NO: 3541772 - RNA, 23 nt, Pseudomonas putida KT2440
gccgacaucgaagcagugcugcc

SEQ ID NO: 3541773 - RNA, 14 nt, Pseudomonas putida KT2440
gccgaccagguggu

SEQ ID NO: 3541774 - RNA, 17 nt, Pseudomonas putida KT2440
gccgaccaguaccacag

SEQ ID NO: 3541775 - RNA, 18 nt, Pseudomonas putida KT2440
gccgaccaguaccacagc

SEQ ID NO: 3541776 - RNA, 20 nt, Pseudomonas putida KT2440
gccgaccaguaccacagcca

SEQ ID NO: 3541777 - RNA, 21 nt, Pseudomonas putida KT2440
gccgacccgccuggugccagc

SEQ ID NO: 3541778 - RNA, 16 nt, Pseudomonas putida KT2440
gccgacccgggccagc

SEQ ID NO: 3541779 - RNA, 17 nt, Pseudomonas putida KT2440
gccgacccgggccagcc

SEQ ID NO: 3541780 - RNA, 18 nt, Pseudomonas putida KT2440
gccgacccgggccagcca

SEQ ID NO: 3541781 - RNA, 22 nt, Pseudomonas putida KT2440
gccgacccugugggagcgggcu

SEQ ID NO: 3541782 - RNA, 19 nt, Pseudomonas putida KT2440
gccgaccgaaccggcgcug

SEQ ID NO: 3541783 - RNA, 21 nt, Pseudomonas putida KT2440
gccgaccgaaccggcgcuggc

SEQ ID NO: 3541784 - RNA, 16 nt, Pseudomonas putida KT2440
gccgaccgcgcgcacg

SEQ ID NO: 3541785 - RNA, 15 nt, Pseudomonas putida KT2440
gccgacgauaccgcc

SEQ ID NO: 3541786 - RNA, 19 nt, Pseudomonas putida KT2440
gccgacgaucaguaccggc

SEQ ID NO: 3541787 - RNA, 15 nt, Pseudomonas putida KT2440
gccgacuccaacgcg

SEQ ID NO: 3541788 - RNA, 17 nt, Pseudomonas putida KT2440
gccgacucuucaccagc

SEQ ID NO: 3541789 - RNA, 21 nt, Pseudomonas putida KT2440
gccgacuggcgcaccagcggc

SEQ ID NO: 3541790 - RNA, 12 nt, Pseudomonas putida KT2440
gccgagaaaugg

SEQ ID NO: 3541791 - RNA, 17 nt, Pseudomonas putida KT2440
gccgagaaauggcagug

SEQ ID NO: 3541792 - RNA, 23 nt, Pseudomonas putida KT2440
gccgagaggcgcugcgggucuuu

SEQ ID NO: 3541793 - RNA, 17 nt, Pseudomonas putida KT2440
gccgagcaucuuccagc

SEQ ID NO: 3541794 - RNA, 20 nt, Pseudomonas putida KT2440
gccgagcaucuuccagccug

SEQ ID NO: 3541795 - RNA, 21 nt, Pseudomonas putida KT2440
gccgagcaucuuccagccugc

SEQ ID NO: 3541796 - RNA, 22 nt, Pseudomonas putida KT2440
gccgagcaucuuccagccugca

SEQ ID NO: 3541797 - RNA, 20 nt, Pseudomonas putida KT2440
gccgagcauuacaggcagau

SEQ ID NO: 3541798 - RNA, 15 nt, Pseudomonas putida KT2440
gccgagccaaccgcu

SEQ ID NO: 3541799 - RNA, 23 nt, Pseudomonas putida KT2440
gccgagccaaccgcuucaccgcg

SEQ ID NO: 3541800 - RNA, 18 nt, Pseudomonas putida KT2440
gccgagcgagugaccuug

SEQ ID NO: 3541801 - RNA, 21 nt, Pseudomonas putida KT2440
gccgagcgccgugcucggccu

SEQ ID NO: 3541802 - RNA, 13 nt, Pseudomonas putida KT2440
gccgagcgcgagc

SEQ ID NO: 3541803 - RNA, 19 nt, Pseudomonas putida KT2440
gccgagcgcggcgcccagc

SEQ ID NO: 3541804 - RNA, 16 nt, Pseudomonas putida KT2440
gccgagcugaugccgg

SEQ ID NO: 3541805 - RNA, 19 nt, Pseudomonas putida KT2440
gccgagcuuuguagcuccc

SEQ ID NO: 3541806 - RNA, 15 nt, Pseudomonas putida KT2440
gccgaggacaacaag

SEQ ID NO: 3541807 - RNA, 18 nt, Pseudomonas putida KT2440
gccgaggacauaccacac

SEQ ID NO: 3541808 - RNA, 14 nt, Pseudomonas putida KT2440
gccgaggccggguu

SEQ ID NO: 3541809 - RNA, 16 nt, Pseudomonas putida KT2440
gccgaggcgccgacga

SEQ ID NO: 3541810 - RNA, 16 nt, Pseudomonas putida KT2440
gccgagggcaugggcc

SEQ ID NO: 3541811 - RNA, 23 nt, Pseudomonas putida KT2440
gccgagggcaugggccacuucgc

SEQ ID NO: 3541812 - RNA, 22 nt, Pseudomonas putida KT2440
gccgagggguguaacccggguu

SEQ ID NO: 3541813 - RNA, 19 nt, Pseudomonas putida KT2440
gccgaguaaccggcggcga

SEQ ID NO: 3541814 - RNA, 21 nt, Pseudomonas putida KT2440
gccgaguaaccggcggcgaac

SEQ ID NO: 3541815 - RNA, 23 nt, Pseudomonas putida KT2440
gccgaguccuugcgugccucagc

SEQ ID NO: 3541816 - RNA, 16 nt, Pseudomonas putida KT2440
gccgaguuggcuucuu

SEQ ID NO: 3541817 - RNA, 20 nt, Pseudomonas putida KT2440
gccgauaaagcgucgcccgc

SEQ ID NO: 3541818 - RNA, 15 nt, Pseudomonas putida KT2440
gccgauaccgaacac

SEQ ID NO: 3541819 - RNA, 18 nt, Pseudomonas putida KT2440
gccgauaccgaacaccag

SEQ ID NO: 3541820 - RNA, 16 nt, Pseudomonas putida KT2440
gccgauagcagcaccg

SEQ ID NO: 3541821 - RNA, 17 nt, Pseudomonas putida KT2440
gccgauagccagcuggc

SEQ ID NO: 3541822 - RNA, 12 nt, Pseudomonas putida KT2440
gccgaucaccag

SEQ ID NO: 3541823 - RNA, 15 nt, Pseudomonas putida KT2440
gccgaucacuuccug

SEQ ID NO: 3541824 - RNA, 20 nt, Pseudomonas putida KT2440
gccgaucagcacgccgccga

SEQ ID NO: 3541825 - RNA, 17 nt, Pseudomonas putida KT2440
gccgaucagcuggguga

SEQ ID NO: 3541826 - RNA, 22 nt, Pseudomonas putida KT2440
gccgaucagcuuaacgcuuggc

SEQ ID NO: 3541827 - RNA, 13 nt, Pseudomonas putida KT2440
gccgaucaggaag

SEQ ID NO: 3541828 - RNA, 18 nt, Pseudomonas putida KT2440
gccgaucaggaaggccuu

SEQ ID NO: 3541829 - RNA, 18 nt, Pseudomonas putida KT2440
gccgaucgaagcagcagc

SEQ ID NO: 3541830 - RNA, 17 nt, Pseudomonas putida KT2440
gccgaucuucaggcuga

SEQ ID NO: 3541831 - RNA, 20 nt, Pseudomonas putida KT2440
gccgaucuucaggcugacgu

SEQ ID NO: 3541832 - RNA, 19 nt, Pseudomonas putida KT2440
gccgaucuucgcccugggc

SEQ ID NO: 3541833 - RNA, 18 nt, Pseudomonas putida KT2440
gccgaugaagcaggccga

SEQ ID NO: 3541834 - RNA, 13 nt, Pseudomonas putida KT2440
gccgaugccaagc

SEQ ID NO: 3541835 - RNA, 16 nt, Pseudomonas putida KT2440
gccgaugccagguaca

SEQ ID NO: 3541836 - RNA, 14 nt, Pseudomonas putida KT2440
gccgaugccgucga

SEQ ID NO: 3541837 - RNA, 23 nt, Pseudomonas putida KT2440
gccgaugccgucgauuuugcagu

SEQ ID NO: 3541838 - RNA, 16 nt, Pseudomonas putida KT2440
gccgaugcuaccaagc

SEQ ID NO: 3541839 - RNA, 19 nt, Pseudomonas putida KT2440
gccgaugcucgucagcccc

SEQ ID NO: 3541840 - RNA, 14 nt, Pseudomonas putida KT2440
gccgauggcgcaaa

SEQ ID NO: 3541841 - RNA, 19 nt, Pseudomonas putida KT2440
gccgaugggcacuggccac

SEQ ID NO: 3541842 - RNA, 17 nt, Pseudomonas putida KT2440
gccgaugggcaggccau

SEQ ID NO: 3541843 - RNA, 19 nt, Pseudomonas putida KT2440
gccgaugggcuguuccagc

SEQ ID NO: 3541844 - RNA, 22 nt, Pseudomonas putida KT2440
gccgaugggcuguuccagcagc

SEQ ID NO: 3541845 - RNA, 17 nt, Pseudomonas putida KT2440
gccgaugucggcgugca

SEQ ID NO: 3541846 - RNA, 12 nt, Pseudomonas putida KT2440
gccgauugcugc

SEQ ID NO: 3541847 - RNA, 17 nt, Pseudomonas putida KT2440
gccgauugcugccgacc

SEQ ID NO: 3541848 - RNA, 14 nt, Pseudomonas putida KT2440
gccgauuuggcccg

SEQ ID NO: 3541849 - RNA, 18 nt, Pseudomonas putida KT2440
gccgauuuggcccgcugc

SEQ ID NO: 3541850 - RNA, 22 nt, Pseudomonas putida KT2440
gccgauuuggcccgcugcgccg

SEQ ID NO: 3541851 - RNA, 20 nt, Pseudomonas putida KT2440
gccgcaaagacugccaagua

SEQ ID NO: 3541852 - RNA, 15 nt, Pseudomonas putida KT2440
gccgcaaagcggccc

SEQ ID NO: 3541853 - RNA, 19 nt, Pseudomonas putida KT2440
gccgcaaagcggccccagu

SEQ ID NO: 3541854 - RNA, 18 nt, Pseudomonas putida KT2440
gccgcaaagcggccccca

SEQ ID NO: 3541855 - RNA, 19 nt, Pseudomonas putida KT2440
gccgcaaagcggccccuuc

SEQ ID NO: 3541856 - RNA, 21 nt, Pseudomonas putida KT2440
gccgcaaagcggccccuucga

SEQ ID NO: 3541857 - RNA, 16 nt, Pseudomonas putida KT2440
gccgcaaccgccgcgc

SEQ ID NO: 3541858 - RNA, 20 nt, Pseudomonas putida KT2440
gccgcaaccgggucggcgcc

SEQ ID NO: 3541859 - RNA, 14 nt, Pseudomonas putida KT2440
gccgcaacgcggcc

SEQ ID NO: 3541860 - RNA, 16 nt, Pseudomonas putida KT2440
gccgcaacgcggcccu

SEQ ID NO: 3541861 - RNA, 14 nt, Pseudomonas putida KT2440
gccgcaagcagucc

SEQ ID NO: 3541862 - RNA, 22 nt, Pseudomonas putida KT2440
gccgcaagcagucccagcaccg

SEQ ID NO: 3541863 - RNA, 16 nt, Pseudomonas putida KT2440
gccgcaagcccgcguu

SEQ ID NO: 3541864 - RNA, 15 nt, Pseudomonas putida KT2440
gccgcaaggcggccc

SEQ ID NO: 3541865 - RNA, 16 nt, Pseudomonas putida KT2440
gccgcaauggcgccau

SEQ ID NO: 3541866 - RNA, 19 nt, Pseudomonas putida KT2440
gccgcaauggucuuaccag

SEQ ID NO: 3541867 - RNA, 22 nt, Pseudomonas putida KT2440
gccgcaauggucuuaccaguag

SEQ ID NO: 3541868 - RNA, 21 nt, Pseudomonas putida KT2440
gccgcacaaggccgcucccac

SEQ ID NO: 3541869 - RNA, 16 nt, Pseudomonas putida KT2440
gccgcacccagcaggc

SEQ ID NO: 3541870 - RNA, 13 nt, Pseudomonas putida KT2440
gccgcacccaggc

SEQ ID NO: 3541871 - RNA, 16 nt, Pseudomonas putida KT2440
gccgcacccaggccac

SEQ ID NO: 3541872 - RNA, 15 nt, Pseudomonas putida KT2440
gccgcaccuacaggg

SEQ ID NO: 3541873 - RNA, 12 nt, Pseudomonas putida KT2440
gccgcaccugcc

SEQ ID NO: 3541874 - RNA, 19 nt, Pseudomonas putida KT2440
gccgcaccugcccgcccuc

SEQ ID NO: 3541875 - RNA, 13 nt, Pseudomonas putida KT2440
gccgcagcaaucu

SEQ ID NO: 3541876 - RNA, 20 nt, Pseudomonas putida KT2440
gccgcagcaguuggccgacg

SEQ ID NO: 3541877 - RNA, 13 nt, Pseudomonas putida KT2440
gccgcagccaugc

SEQ ID NO: 3541878 - RNA, 14 nt, Pseudomonas putida KT2440
gccgcagccaugcc

SEQ ID NO: 3541879 - RNA, 22 nt, Pseudomonas putida KT2440
gccgcagccucuucggccagca

SEQ ID NO: 3541880 - RNA, 15 nt, Pseudomonas putida KT2440
gccgcagcgcauggu

SEQ ID NO: 3541881 - RNA, 12 nt, Pseudomonas putida KT2440
gccgcagcugcg

SEQ ID NO: 3541882 - RNA, 21 nt, Pseudomonas putida KT2440
gccgcagcugcggucgagcug

SEQ ID NO: 3541883 - RNA, 14 nt, Pseudomonas putida KT2440
gccgcaggcgcccc

SEQ ID NO: 3541884 - RNA, 19 nt, Pseudomonas putida KT2440
gccgcagguccaccugguu

SEQ ID NO: 3541885 - RNA, 14 nt, Pseudomonas putida KT2440
gccgcagucccgcc

SEQ ID NO: 3541886 - RNA, 16 nt, Pseudomonas putida KT2440
gccgcauauacgccgg

SEQ ID NO: 3541887 - RNA, 19 nt, Pseudomonas putida KT2440
gccgcaucguuauccagca

SEQ ID NO: 3541888 - RNA, 22 nt, Pseudomonas putida KT2440
gccgcaucguuauccagcaccc

SEQ ID NO: 3541889 - RNA, 15 nt, Pseudomonas putida KT2440
gccgcauucgcgggu

SEQ ID NO: 3541890 - RNA, 17 nt, Pseudomonas putida KT2440
gccgccaacagcgcagg

SEQ ID NO: 3541891 - RNA, 20 nt, Pseudomonas putida KT2440
gccgccaaccccuccagcac

SEQ ID NO: 3541892 - RNA, 17 nt, Pseudomonas putida KT2440
gccgccaacucgccauu

SEQ ID NO: 3541893 - RNA, 20 nt, Pseudomonas putida KT2440
gccgccaagcggccccaaug

SEQ ID NO: 3541894 - RNA, 22 nt, Pseudomonas putida KT2440
gccgccaauagcccgcuggccg

SEQ ID NO: 3541895 - RNA, 18 nt, Pseudomonas putida KT2440
gccgccacauccagcgcc

SEQ ID NO: 3541896 - RNA, 19 nt, Pseudomonas putida KT2440
gccgccacauccagcgccu

SEQ ID NO: 3541897 - RNA, 13 nt, Pseudomonas putida KT2440
gccgccaccagcg

SEQ ID NO: 3541898 - RNA, 13 nt, Pseudomonas putida KT2440
gccgccaccaucg

SEQ ID NO: 3541899 - RNA, 23 nt, Pseudomonas putida KT2440
gccgccaccaucgacucacgcuc

SEQ ID NO: 3541900 - RNA, 12 nt, Pseudomonas putida KT2440
gccgccaccucg

SEQ ID NO: 3541901 - RNA, 15 nt, Pseudomonas putida KT2440
gccgccaccugcggc

SEQ ID NO: 3541902 - RNA, 20 nt, Pseudomonas putida KT2440
gccgccaccugcggcaggug

SEQ ID NO: 3541903 - RNA, 14 nt, Pseudomonas putida KT2440
gccgccaccuggcu

SEQ ID NO: 3541904 - RNA, 16 nt, Pseudomonas putida KT2440
gccgccaccuggcugc

SEQ ID NO: 3541905 - RNA, 17 nt, Pseudomonas putida KT2440
gccgccaccuggcugcg

SEQ ID NO: 3541906 - RNA, 15 nt, Pseudomonas putida KT2440
gccgccacgaccacg

SEQ ID NO: 3541907 - RNA, 13 nt, Pseudomonas putida KT2440
gccgccacgaucg

SEQ ID NO: 3541908 - RNA, 15 nt, Pseudomonas putida KT2440
gccgccagacaacug

SEQ ID NO: 3541909 - RNA, 17 nt, Pseudomonas putida KT2440
gccgccagaccauaagc

SEQ ID NO: 3541910 - RNA, 12 nt, Pseudomonas putida KT2440
gccgccagcagc

SEQ ID NO: 3541911 - RNA, 13 nt, Pseudomonas putida KT2440
gccgccagcagcg

SEQ ID NO: 3541912 - RNA, 15 nt, Pseudomonas putida KT2440
gccgccagcgcucca

SEQ ID NO: 3541913 - RNA, 12 nt, Pseudomonas putida KT2440
gccgccagcggc

SEQ ID NO: 3541914 - RNA, 19 nt, Pseudomonas putida KT2440
gccgccagcggcaguugca

SEQ ID NO: 3541915 - RNA, 18 nt, Pseudomonas putida KT2440
gccgccaggauggcaccg

SEQ ID NO: 3541916 - RNA, 13 nt, Pseudomonas putida KT2440
gccgccaggcagc

SEQ ID NO: 3541917 - RNA, 16 nt, Pseudomonas putida KT2440
gccgccaggcagcaga

SEQ ID NO: 3541918 - RNA, 16 nt, Pseudomonas putida KT2440
gccgccaggcccacca

SEQ ID NO: 3541919 - RNA, 13 nt, Pseudomonas putida KT2440
gccgccaggcggu

SEQ ID NO: 3541920 - RNA, 19 nt, Pseudomonas putida KT2440
gccgccaguucgcccuuca

SEQ ID NO: 3541921 - RNA, 12 nt, Pseudomonas putida KT2440
gccgccaucucg

SEQ ID NO: 3541922 - RNA, 17 nt, Pseudomonas putida KT2440
gccgccaugaucugccc

SEQ ID NO: 3541923 - RNA, 16 nt, Pseudomonas putida KT2440
gccgccaugcagcccg

SEQ ID NO: 3541924 - RNA, 23 nt, Pseudomonas putida KT2440
gccgccauugaugccgaaggccu

SEQ ID NO: 3541925 - RNA, 21 nt, Pseudomonas putida KT2440
gccgcccaguggcacaccaug

SEQ ID NO: 3541926 - RNA, 14 nt, Pseudomonas putida KT2440
gccgcccaucaccg

SEQ ID NO: 3541927 - RNA, 22 nt, Pseudomonas putida KT2440
gccgccccaaacauaaggagua

SEQ ID NO: 3541928 - RNA, 14 nt, Pseudomonas putida KT2440
gccgccccacccuu

SEQ ID NO: 3541929 - RNA, 18 nt, Pseudomonas putida KT2440
gccgccccacucgcgcag

SEQ ID NO: 3541930 - RNA, 20 nt, Pseudomonas putida KT2440
gccgccccacucgcgcagca

SEQ ID NO: 3541931 - RNA, 14 nt, Pseudomonas putida KT2440
gccgccccccagua

SEQ ID NO: 3541932 - RNA, 12 nt, Pseudomonas putida KT2440
gccgcccccuuc

SEQ ID NO: 3541933 - RNA, 23 nt, Pseudomonas putida KT2440
gccgccccgcaccagaccagcag

SEQ ID NO: 3541934 - RNA, 20 nt, Pseudomonas putida KT2440
gccgccccuccacccaccuu

SEQ ID NO: 3541935 - RNA, 14 nt, Pseudomonas putida KT2440
gccgcccgccucga

SEQ ID NO: 3541936 - RNA, 14 nt, Pseudomonas putida KT2440
gccgcccgcggcga

SEQ ID NO: 3541937 - RNA, 15 nt, Pseudomonas putida KT2440
gccgcccgcggcgaa

SEQ ID NO: 3541938 - RNA, 17 nt, Pseudomonas putida KT2440
gccgcccgcggcgaaca

SEQ ID NO: 3541939 - RNA, 14 nt, Pseudomonas putida KT2440
gccgcccgcuugug

SEQ ID NO: 3541940 - RNA, 22 nt, Pseudomonas putida KT2440
gccgcccgcuuuuggcugugca

SEQ ID NO: 3541941 - RNA, 20 nt, Pseudomonas putida KT2440
gccgcccggucauacagccc

SEQ ID NO: 3541942 - RNA, 21 nt, Pseudomonas putida KT2440
gccgcccggucauacagcccu

SEQ ID NO: 3541943 - RNA, 22 nt, Pseudomonas putida KT2440
gccgcccuagcuaucucaagcc

SEQ ID NO: 3541944 - RNA, 20 nt, Pseudomonas putida KT2440
gccgcccucuucgcgggcac

SEQ ID NO: 3541945 - RNA, 23 nt, Pseudomonas putida KT2440
gccgcccucuugcugcaacagcu

SEQ ID NO: 3541946 - RNA, 14 nt, Pseudomonas putida KT2440
gccgcccugcggcu

SEQ ID NO: 3541947 - RNA, 15 nt, Pseudomonas putida KT2440
gccgcccugcggcug

SEQ ID NO: 3541948 - RNA, 23 nt, Pseudomonas putida KT2440
gccgcccuugagcuucagcgcgc

SEQ ID NO: 3541949 - RNA, 19 nt, Pseudomonas putida KT2440
gccgcccuuggugcaccag

SEQ ID NO: 3541950 - RNA, 14 nt, Pseudomonas putida KT2440
gccgcccuuucgcg

SEQ ID NO: 3541951 - RNA, 17 nt, Pseudomonas putida KT2440
gccgcccuuucgcgggu

SEQ ID NO: 3541952 - RNA, 19 nt, Pseudomonas putida KT2440
gccgcccuuucgcggguga

SEQ ID NO: 3541953 - RNA, 14 nt, Pseudomonas putida KT2440
gccgccgaacaggc

SEQ ID NO: 3541954 - RNA, 17 nt, Pseudomonas putida KT2440
gccgccgaacaggccgg

SEQ ID NO: 3541955 - RNA, 18 nt, Pseudomonas putida KT2440
gccgccgaacaggccggc

SEQ ID NO: 3541956 - RNA, 15 nt, Pseudomonas putida KT2440
gccgccgacgaugcc

SEQ ID NO: 3541957 - RNA, 17 nt, Pseudomonas putida KT2440
gccgccgagcugaugcc

SEQ ID NO: 3541958 - RNA, 14 nt, Pseudomonas putida KT2440
gccgccgaggcacc

SEQ ID NO: 3541959 - RNA, 15 nt, Pseudomonas putida KT2440
gccgccgaggcaccg

SEQ ID NO: 3541960 - RNA, 16 nt, Pseudomonas putida KT2440
gccgccgaggcaccgg

SEQ ID NO: 3541961 - RNA, 16 nt, Pseudomonas putida KT2440
gccgccgauagcagca

SEQ ID NO: 3541962 - RNA, 18 nt, Pseudomonas putida KT2440
gccgccgauagcagcacc

SEQ ID NO: 3541963 - RNA, 19 nt, Pseudomonas putida KT2440
gccgccgauagcagcaccg

SEQ ID NO: 3541964 - RNA, 19 nt, Pseudomonas putida KT2440
gccgccgcagcaaucugcu

SEQ ID NO: 3541965 - RNA, 13 nt, Pseudomonas putida KT2440
gccgccgccagaa

SEQ ID NO: 3541966 - RNA, 14 nt, Pseudomonas putida KT2440
gccgccgccagaag

SEQ ID NO: 3541967 - RNA, 13 nt, Pseudomonas putida KT2440
gccgccgccagac

SEQ ID NO: 3541968 - RNA, 13 nt, Pseudomonas putida KT2440
gccgccgccucga

SEQ ID NO: 3541969 - RNA, 14 nt, Pseudomonas putida KT2440
gccgccgcugccag

SEQ ID NO: 3541970 - RNA, 15 nt, Pseudomonas putida KT2440
gccgccgcugccagc

SEQ ID NO: 3541971 - RNA, 21 nt, Pseudomonas putida KT2440
gccgccgcugccagcagggca

SEQ ID NO: 3541972 - RNA, 17 nt, Pseudomonas putida KT2440
gccgccgcugcgaggau

SEQ ID NO: 3541973 - RNA, 13 nt, Pseudomonas putida KT2440
gccgccgcuggcg

SEQ ID NO: 3541974 - RNA, 13 nt, Pseudomonas putida KT2440
gccgccggcaacu

SEQ ID NO: 3541975 - RNA, 16 nt, Pseudomonas putida KT2440
gccgccggcaacuggc

SEQ ID NO: 3541976 - RNA, 18 nt, Pseudomonas putida KT2440
gccgccggcaacuggcau

SEQ ID NO: 3541977 - RNA, 20 nt, Pseudomonas putida KT2440
gccgccgguuucucgcagca

SEQ ID NO: 3541978 - RNA, 21 nt, Pseudomonas putida KT2440
gccgccgguuucucgcagcag

SEQ ID NO: 3541979 - RNA, 22 nt, Pseudomonas putida KT2440
gccgccgguuucucgcagcagc

SEQ ID NO: 3541980 - RNA, 17 nt, Pseudomonas putida KT2440
gccgccuccaccgggau

SEQ ID NO: 3541981 - RNA, 20 nt, Pseudomonas putida KT2440
gccgccuccaccgggauggc

SEQ ID NO: 3541982 - RNA, 16 nt, Pseudomonas putida KT2440
gccgccuccugcugcu

SEQ ID NO: 3541983 - RNA, 16 nt, Pseudomonas putida KT2440
gccgccugggucaggc

SEQ ID NO: 3541984 - RNA, 22 nt, Pseudomonas putida KT2440
gccgccugguugcguucgucga

SEQ ID NO: 3541985 - RNA, 24 nt, Pseudomonas putida KT2440
gccgccugguugcguucgucgaug

SEQ ID NO: 3541986 - RNA, 18 nt, Pseudomonas putida KT2440
gccgccugucgcgacggg

SEQ ID NO: 3541987 - RNA, 23 nt, Pseudomonas putida KT2440
gccgccuucggacucgacgucgu

SEQ ID NO: 3541988 - RNA, 21 nt, Pseudomonas putida KT2440
gccgccuuuaauuccggccgg

SEQ ID NO: 3541989 - RNA, 15 nt, Pseudomonas putida KT2440
gccgcgaacgccccg

SEQ ID NO: 3541990 - RNA, 17 nt, Pseudomonas putida KT2440
gccgcgaacgccccgaa

SEQ ID NO: 3541991 - RNA, 14 nt, Pseudomonas putida KT2440
gccgcgaagcggcg

SEQ ID NO: 3541992 - RNA, 14 nt, Pseudomonas putida KT2440
gccgcgacgcggcc

SEQ ID NO: 3541993 - RNA, 15 nt, Pseudomonas putida KT2440
gccgcgacgcggccc

SEQ ID NO: 3541994 - RNA, 19 nt, Pseudomonas putida KT2440
gccgcgacgcggccccaga

SEQ ID NO: 3541995 - RNA, 17 nt, Pseudomonas putida KT2440
gccgcgacgcggcccug

SEQ ID NO: 3541996 - RNA, 18 nt, Pseudomonas putida KT2440
gccgcgacgcggcccugg

SEQ ID NO: 3541997 - RNA, 21 nt, Pseudomonas putida KT2440
gccgcgacuggaacgauaccg

SEQ ID NO: 3541998 - RNA, 18 nt, Pseudomonas putida KT2440
gccgcgaugaugaucaau

SEQ ID NO: 3541999 - RNA, 16 nt, Pseudomonas putida KT2440
gccgcgcagccuuuga

SEQ ID NO: 3542000 - RNA, 18 nt, Pseudomonas putida KT2440
gccgcgcagccuuugaaa

SEQ ID NO: 3542001 - RNA, 14 nt, Pseudomonas putida KT2440
gccgcgcagggcgu

SEQ ID NO: 3542002 - RNA, 23 nt, Pseudomonas putida KT2440
gccgcgcaugaugaaguggcgca

SEQ ID NO: 3542003 - RNA, 18 nt, Pseudomonas putida KT2440
gccgcgccaccgaucucg

SEQ ID NO: 3542004 - RNA, 15 nt, Pseudomonas putida KT2440
gccgcgccaggucgg

SEQ ID NO: 3542005 - RNA, 19 nt, Pseudomonas putida KT2440
gccgcgccaggucggcggg

SEQ ID NO: 3542006 - RNA, 20 nt, Pseudomonas putida KT2440
gccgcgccauuggccgcgcg

SEQ ID NO: 3542007 - RNA, 16 nt, Pseudomonas putida KT2440
gccgcgcccucuuccg

SEQ ID NO: 3542008 - RNA, 20 nt, Pseudomonas putida KT2440
gccgcgcccucuuccgcacg

SEQ ID NO: 3542009 - RNA, 12 nt, Pseudomonas putida KT2440
gccgcgccgcgc

SEQ ID NO: 3542010 - RNA, 17 nt, Pseudomonas putida KT2440
gccgcgcgcccaucugc

SEQ ID NO: 3542011 - RNA, 19 nt, Pseudomonas putida KT2440
gccgcgcgcccgcugaccg

SEQ ID NO: 3542012 - RNA, 15 nt, Pseudomonas putida KT2440
gccgcgcucgguuga

SEQ ID NO: 3542013 - RNA, 13 nt, Pseudomonas putida KT2440
gccgcgcugacca

SEQ ID NO: 3542014 - RNA, 14 nt, Pseudomonas putida KT2440
gccgcgcugacgca

SEQ ID NO: 3542015 - RNA, 15 nt, Pseudomonas putida KT2440
gccgcgcugacgcag

SEQ ID NO: 3542016 - RNA, 18 nt, Pseudomonas putida KT2440
gccgcgcugacgcagggc

SEQ ID NO: 3542017 - RNA, 20 nt, Pseudomonas putida KT2440
gccgcgcugacgcagggccu

SEQ ID NO: 3542018 - RNA, 11 nt, Pseudomonas putida KT2440
gccgcgcuggc

SEQ ID NO: 3542019 - RNA, 14 nt, Pseudomonas putida KT2440
gccgcgcuguggcg

SEQ ID NO: 3542020 - RNA, 19 nt, Pseudomonas putida KT2440
gccgcgcuguggcgcccgg

SEQ ID NO: 3542021 - RNA, 21 nt, Pseudomonas putida KT2440
gccgcgcuguggcgcccggcg

SEQ ID NO: 3542022 - RNA, 17 nt, Pseudomonas putida KT2440
gccgcggauguggugga

SEQ ID NO: 3542023 - RNA, 13 nt, Pseudomonas putida KT2440
gccgcggcaccca

SEQ ID NO: 3542024 - RNA, 22 nt, Pseudomonas putida KT2440
gccgcggguaguccggcacguu

SEQ ID NO: 3542025 - RNA, 18 nt, Pseudomonas putida KT2440
gccgcgguagugcggccg

SEQ ID NO: 3542026 - RNA, 21 nt, Pseudomonas putida KT2440
gccgcgguagugcggccgggu

SEQ ID NO: 3542027 - RNA, 22 nt, Pseudomonas putida KT2440
gccgcgucgcggccccagggcu

SEQ ID NO: 3542028 - RNA, 22 nt, Pseudomonas putida KT2440
gccgcguucgcccaggcgccgc

SEQ ID NO: 3542029 - RNA, 15 nt, Pseudomonas putida KT2440
gccgcguugcggccc

SEQ ID NO: 3542030 - RNA, 16 nt, Pseudomonas putida KT2440
gccgcguugucaggca

SEQ ID NO: 3542031 - RNA, 14 nt, Pseudomonas putida KT2440
gccgcuacgcgccc

SEQ ID NO: 3542032 - RNA, 19 nt, Pseudomonas putida KT2440
gccgcuaggcggccccauu

SEQ ID NO: 3542033 - RNA, 15 nt, Pseudomonas putida KT2440
gccgcucaccccaua

SEQ ID NO: 3542034 - RNA, 23 nt, Pseudomonas putida KT2440
gccgcucaccccauagggccagc

SEQ ID NO: 3542035 - RNA, 13 nt, Pseudomonas putida KT2440
gccgcucaccggc

SEQ ID NO: 3542036 - RNA, 22 nt, Pseudomonas putida KT2440
gccgcucaccggccagcgcgcu

SEQ ID NO: 3542037 - RNA, 16 nt, Pseudomonas putida KT2440
gccgcucagccaccug

SEQ ID NO: 3542038 - RNA, 21 nt, Pseudomonas putida KT2440
gccgcucagccaccugugggu

SEQ ID NO: 3542039 - RNA, 13 nt, Pseudomonas putida KT2440
gccgcuccagcuc

SEQ ID NO: 3542040 - RNA, 22 nt, Pseudomonas putida KT2440
gccgcuccagcucggcuggcug

SEQ ID NO: 3542041 - RNA, 18 nt, Pseudomonas putida KT2440
gccgcucccacagguaau

SEQ ID NO: 3542042 - RNA, 22 nt, Pseudomonas putida KT2440
gccgcuccugcggucagccugc

SEQ ID NO: 3542043 - RNA, 17 nt, Pseudomonas putida KT2440
gccgcuccuucaccagg

SEQ ID NO: 3542044 - RNA, 14 nt, Pseudomonas putida KT2440
gccgcucgauaugc

SEQ ID NO: 3542045 - RNA, 19 nt, Pseudomonas putida KT2440
gccgcucgauaugccgccg

SEQ ID NO: 3542046 - RNA, 20 nt, Pseudomonas putida KT2440
gccgcucgauaugccgccgu

SEQ ID NO: 3542047 - RNA, 17 nt, Pseudomonas putida KT2440
gccgcucgcccagcagc

SEQ ID NO: 3542048 - RNA, 14 nt, Pseudomonas putida KT2440
gccgcucguacugg

SEQ ID NO: 3542049 - RNA, 19 nt, Pseudomonas putida KT2440
gccgcucguacuggucgag

SEQ ID NO: 3542050 - RNA, 16 nt, Pseudomonas putida KT2440
gccgcucugcccgcgc

SEQ ID NO: 3542051 - RNA, 21 nt, Pseudomonas putida KT2440
gccgcugccaaaguccggcga

SEQ ID NO: 3542052 - RNA, 14 nt, Pseudomonas putida KT2440
gccgcugccaaccg

SEQ ID NO: 3542053 - RNA, 12 nt, Pseudomonas putida KT2440
gccgcugccaca

SEQ ID NO: 3542054 - RNA, 18 nt, Pseudomonas putida KT2440
gccgcugccacagguacu

SEQ ID NO: 3542055 - RNA, 15 nt, Pseudomonas putida KT2440
gccgcugccugggca

SEQ ID NO: 3542056 - RNA, 16 nt, Pseudomonas putida KT2440
gccgcugcgccugccg

SEQ ID NO: 3542057 - RNA, 13 nt, Pseudomonas putida KT2440
gccgcugcgcggu

SEQ ID NO: 3542058 - RNA, 18 nt, Pseudomonas putida KT2440
gccgcugcgcgguaaacg

SEQ ID NO: 3542059 - RNA, 16 nt, Pseudomonas putida KT2440
gccgcugcggcugcuc

SEQ ID NO: 3542060 - RNA, 15 nt, Pseudomonas putida KT2440
gccgcugcugcgccu

SEQ ID NO: 3542061 - RNA, 16 nt, Pseudomonas putida KT2440
gccgcugcugcgccuc

SEQ ID NO: 3542062 - RNA, 21 nt, Pseudomonas putida KT2440
gccgcugcugcgccucgcagg

SEQ ID NO: 3542063 - RNA, 15 nt, Pseudomonas putida KT2440
gccgcuggcuuccuc

SEQ ID NO: 3542064 - RNA, 14 nt, Pseudomonas putida KT2440
gccgcugggcuuca

SEQ ID NO: 3542065 - RNA, 21 nt, Pseudomonas putida KT2440
gccgcugggcuucacguccaa

SEQ ID NO: 3542066 - RNA, 15 nt, Pseudomonas putida KT2440
gccgcuguacaccag

SEQ ID NO: 3542067 - RNA, 21 nt, Pseudomonas putida KT2440
gccgcugucauccugcguggc

SEQ ID NO: 3542068 - RNA, 13 nt, Pseudomonas putida KT2440
gccgcugugccag

SEQ ID NO: 3542069 - RNA, 14 nt, Pseudomonas putida KT2440
gccgcuguucagcc

SEQ ID NO: 3542070 - RNA, 19 nt, Pseudomonas putida KT2440
gccgcuguucagcccuugc

SEQ ID NO: 3542071 - RNA, 14 nt, Pseudomonas putida KT2440
gccgcuucacuguc

SEQ ID NO: 3542072 - RNA, 16 nt, Pseudomonas putida KT2440
gccgcuucacuguccu

SEQ ID NO: 3542073 - RNA, 13 nt, Pseudomonas putida KT2440
gccgcuucgcgga

SEQ ID NO: 3542074 - RNA, 15 nt, Pseudomonas putida KT2440
gccgcuucgcggauc

SEQ ID NO: 3542075 - RNA, 21 nt, Pseudomonas putida KT2440
gccgcuucgcggccaagccgc

SEQ ID NO: 3542076 - RNA, 15 nt, Pseudomonas putida KT2440
gccgcuucguccagg

SEQ ID NO: 3542077 - RNA, 16 nt, Pseudomonas putida KT2440
gccgcuucguccaggu

SEQ ID NO: 3542078 - RNA, 19 nt, Pseudomonas putida KT2440
gccgcuucguccagguagu

SEQ ID NO: 3542079 - RNA, 18 nt, Pseudomonas putida KT2440
gccgcuugaugucuccuu

SEQ ID NO: 3542080 - RNA, 15 nt, Pseudomonas putida KT2440
gccgcuugcucaggc

SEQ ID NO: 3542081 - RNA, 14 nt, Pseudomonas putida KT2440
gccgcuuggcggcc

SEQ ID NO: 3542082 - RNA, 15 nt, Pseudomonas putida KT2440
gccgcuuggcggccc

SEQ ID NO: 3542083 - RNA, 18 nt, Pseudomonas putida KT2440
gccgcuuuggcagcagcc

SEQ ID NO: 3542084 - RNA, 19 nt, Pseudomonas putida KT2440
gccgcuuuguuugcuggca

SEQ ID NO: 3542085 - RNA, 15 nt, Pseudomonas putida KT2440
gccggaccugccgca

SEQ ID NO: 3542086 - RNA, 16 nt, Pseudomonas putida KT2440
gccggaccugccgcag

SEQ ID NO: 3542087 - RNA, 17 nt, Pseudomonas putida KT2440
gccggaccugccgcagc

SEQ ID NO: 3542088 - RNA, 20 nt, Pseudomonas putida KT2440
gccggaccugccgcagcgau

SEQ ID NO: 3542089 - RNA, 13 nt, Pseudomonas putida KT2440
gccggaccugcug

SEQ ID NO: 3542090 - RNA, 20 nt, Pseudomonas putida KT2440
gccggauagagcccggcgca

SEQ ID NO: 3542091 - RNA, 14 nt, Pseudomonas putida KT2440
gccggaucuggcag

SEQ ID NO: 3542092 - RNA, 15 nt, Pseudomonas putida KT2440
gccggcaaccccugc

SEQ ID NO: 3542093 - RNA, 20 nt, Pseudomonas putida KT2440
gccggcaacgauacccacgc

SEQ ID NO: 3542094 - RNA, 15 nt, Pseudomonas putida KT2440
gccggcaacggccac

SEQ ID NO: 3542095 - RNA, 12 nt, Pseudomonas putida KT2440
gccggcaacucc

SEQ ID NO: 3542096 - RNA, 18 nt, Pseudomonas putida KT2440
gccggcaacuccuccagc

SEQ ID NO: 3542097 - RNA, 20 nt, Pseudomonas putida KT2440
gccggcaacuccuccagccg

SEQ ID NO: 3542098 - RNA, 22 nt, Pseudomonas putida KT2440
gccggcaagcuggucaggugca

SEQ ID NO: 3542099 - RNA, 16 nt, Pseudomonas putida KT2440
gccggcacagacaccg

SEQ ID NO: 3542100 - RNA, 18 nt, Pseudomonas putida KT2440
gccggcacagacaccgca

SEQ ID NO: 3542101 - RNA, 15 nt, Pseudomonas putida KT2440
gccggcaccgccaug

SEQ ID NO: 3542102 - RNA, 14 nt, Pseudomonas putida KT2440
gccggcacgcccgc

SEQ ID NO: 3542103 - RNA, 15 nt, Pseudomonas putida KT2440
gccggcacgcccgcu

SEQ ID NO: 3542104 - RNA, 19 nt, Pseudomonas putida KT2440
gccggcacgcuaccaccug

SEQ ID NO: 3542105 - RNA, 15 nt, Pseudomonas putida KT2440
gccggcacggccggu

SEQ ID NO: 3542106 - RNA, 21 nt, Pseudomonas putida KT2440
gccggcagcaaggcauccagc

SEQ ID NO: 3542107 - RNA, 19 nt, Pseudomonas putida KT2440
gccggcagcacgucggcgc

SEQ ID NO: 3542108 - RNA, 22 nt, Pseudomonas putida KT2440
gccggcagccagggccugaccg

SEQ ID NO: 3542109 - RNA, 12 nt, Pseudomonas putida KT2440
gccggcagcgcg

SEQ ID NO: 3542110 - RNA, 14 nt, Pseudomonas putida KT2440
gccggcagcgcggc

SEQ ID NO: 3542111 - RNA, 15 nt, Pseudomonas putida KT2440
gccggcagcgcggcc

SEQ ID NO: 3542112 - RNA, 14 nt, Pseudomonas putida KT2440
gccggcagcucgcg

SEQ ID NO: 3542113 - RNA, 21 nt, Pseudomonas putida KT2440
gccggcagcucgcgcugcgca

SEQ ID NO: 3542114 - RNA, 16 nt, Pseudomonas putida KT2440
gccggcagucacccac

SEQ ID NO: 3542115 - RNA, 19 nt, Pseudomonas putida KT2440
gccggcagucacccaccgg

SEQ ID NO: 3542116 - RNA, 20 nt, Pseudomonas putida KT2440
gccggcagucacccaccggc

SEQ ID NO: 3542117 - RNA, 19 nt, Pseudomonas putida KT2440
gccggcaguccacuugcgu

SEQ ID NO: 3542118 - RNA, 23 nt, Pseudomonas putida KT2440
gccggcaguccacuugcguucgc

SEQ ID NO: 3542119 - RNA, 16 nt, Pseudomonas putida KT2440
gccggcauaacggcug

SEQ ID NO: 3542120 - RNA, 19 nt, Pseudomonas putida KT2440
gccggcauaacggcuggcg

SEQ ID NO: 3542121 - RNA, 21 nt, Pseudomonas putida KT2440
gccggcauaacggcuggcgca

SEQ ID NO: 3542122 - RNA, 21 nt, Pseudomonas putida KT2440
gccggcaucgccaacagaggc

SEQ ID NO: 3542123 - RNA, 15 nt, Pseudomonas putida KT2440
gccggcaucgccucc

SEQ ID NO: 3542124 - RNA, 16 nt, Pseudomonas putida KT2440
gccggcaucgccucca

SEQ ID NO: 3542125 - RNA, 17 nt, Pseudomonas putida KT2440
gccggcauggcgugccc

SEQ ID NO: 3542126 - RNA, 20 nt, Pseudomonas putida KT2440
gccggccaaggucagcaagc

SEQ ID NO: 3542127 - RNA, 17 nt, Pseudomonas putida KT2440
gccggccaccagugcuu

SEQ ID NO: 3542128 - RNA, 18 nt, Pseudomonas putida KT2440
gccggccauucaucaucg

SEQ ID NO: 3542129 - RNA, 17 nt, Pseudomonas putida KT2440
gccggccauugccgcgc

SEQ ID NO: 3542130 - RNA, 20 nt, Pseudomonas putida KT2440
gccggccauugccgcgccgc

SEQ ID NO: 3542131 - RNA, 21 nt, Pseudomonas putida KT2440
gccggcccaaggcaccaacug

SEQ ID NO: 3542132 - RNA, 16 nt, Pseudomonas putida KT2440
gccggcccauucgcgg

SEQ ID NO: 3542133 - RNA, 17 nt, Pseudomonas putida KT2440
gccggcccauucgcggg

SEQ ID NO: 3542134 - RNA, 19 nt, Pseudomonas putida KT2440
gccggcccauucgcgggua

SEQ ID NO: 3542135 - RNA, 17 nt, Pseudomonas putida KT2440
gccggccccacgcaguu

SEQ ID NO: 3542136 - RNA, 13 nt, Pseudomonas putida KT2440
gccggccccggca

SEQ ID NO: 3542137 - RNA, 21 nt, Pseudomonas putida KT2440
gccggccccguauacccaucg

SEQ ID NO: 3542138 - RNA, 13 nt, Pseudomonas putida KT2440
gccggccccugcu

SEQ ID NO: 3542139 - RNA, 22 nt, Pseudomonas putida KT2440
gccggcccugccuaccaccgca

SEQ ID NO: 3542140 - RNA, 17 nt, Pseudomonas putida KT2440
gccggcccugcuggcca

SEQ ID NO: 3542141 - RNA, 18 nt, Pseudomonas putida KT2440
gccggcccuucugcugcu

SEQ ID NO: 3542142 - RNA, 21 nt, Pseudomonas putida KT2440
gccggcccuucugcugcucgu

SEQ ID NO: 3542143 - RNA, 15 nt, Pseudomonas putida KT2440
gccggccgggcucug

SEQ ID NO: 3542144 - RNA, 17 nt, Pseudomonas putida KT2440
gccggccguggguccug

SEQ ID NO: 3542145 - RNA, 16 nt, Pseudomonas putida KT2440
gccggccucaauucca

SEQ ID NO: 3542146 - RNA, 15 nt, Pseudomonas putida KT2440
gccggccuguugcgc

SEQ ID NO: 3542147 - RNA, 15 nt, Pseudomonas putida KT2440
gccggccuugaccuc

SEQ ID NO: 3542148 - RNA, 22 nt, Pseudomonas putida KT2440
gccggccuugaccucgaccagg

SEQ ID NO: 3542149 - RNA, 18 nt, Pseudomonas putida KT2440
gccggccuuggcgcggcg

SEQ ID NO: 3542150 - RNA, 14 nt, Pseudomonas putida KT2440
gccggcgaacagca

SEQ ID NO: 3542151 - RNA, 16 nt, Pseudomonas putida KT2440
gccggcgaauccagcc

SEQ ID NO: 3542152 - RNA, 17 nt, Pseudomonas putida KT2440
gccggcgaauccagccg

SEQ ID NO: 3542153 - RNA, 14 nt, Pseudomonas putida KT2440
gccggcgagcgcgu

SEQ ID NO: 3542154 - RNA, 17 nt, Pseudomonas putida KT2440
gccggcgagcgcgugcg

SEQ ID NO: 3542155 - RNA, 22 nt, Pseudomonas putida KT2440
gccggcgcacgcaugcgcgaca

SEQ ID NO: 3542156 - RNA, 15 nt, Pseudomonas putida KT2440
gccggcgcaggucga

SEQ ID NO: 3542157 - RNA, 20 nt, Pseudomonas putida KT2440
gccggcgccgguggcggccg

SEQ ID NO: 3542158 - RNA, 23 nt, Pseudomonas putida KT2440
gccggcgccgguggcggccgcag

SEQ ID NO: 3542159 - RNA, 17 nt, Pseudomonas putida KT2440
gccggcgcucagcgggc

SEQ ID NO: 3542160 - RNA, 19 nt, Pseudomonas putida KT2440
gccggcgcucagcgggcgu

SEQ ID NO: 3542161 - RNA, 20 nt, Pseudomonas putida KT2440
gccggcgcugagcgacagca

SEQ ID NO: 3542162 - RNA, 22 nt, Pseudomonas putida KT2440
gccggcgcugggcuuacggucu

SEQ ID NO: 3542163 - RNA, 18 nt, Pseudomonas putida KT2440
gccggcggauagccccgc

SEQ ID NO: 3542164 - RNA, 22 nt, Pseudomonas putida KT2440
gccggcggugaugccauugauc

SEQ ID NO: 3542165 - RNA, 12 nt, Pseudomonas putida KT2440
gccggcguuggc

SEQ ID NO: 3542166 - RNA, 15 nt, Pseudomonas putida KT2440
gccggcuaucggcca

SEQ ID NO: 3542167 - RNA, 17 nt, Pseudomonas putida KT2440
gccggcuaucggccagc

SEQ ID NO: 3542168 - RNA, 12 nt, Pseudomonas putida KT2440
gccggcucgaac

SEQ ID NO: 3542169 - RNA, 15 nt, Pseudomonas putida KT2440
gccggcuuccagcga

SEQ ID NO: 3542170 - RNA, 15 nt, Pseudomonas putida KT2440
gccggcuugccuuca

SEQ ID NO: 3542171 - RNA, 23 nt, Pseudomonas putida KT2440
gccggcuuguucuguuucaccag

SEQ ID NO: 3542172 - RNA, 20 nt, Pseudomonas putida KT2440
gccgggaagcgcccgcccac

SEQ ID NO: 3542173 - RNA, 17 nt, Pseudomonas putida KT2440
gccgggacagcaccaug

SEQ ID NO: 3542174 - RNA, 20 nt, Pseudomonas putida KT2440
gccgggcacaucaccagcag

SEQ ID NO: 3542175 - RNA, 21 nt, Pseudomonas putida KT2440
gccgggcacaucaccagcagc

SEQ ID NO: 3542176 - RNA, 20 nt, Pseudomonas putida KT2440
gccgggcacgacacuccgcu

SEQ ID NO: 3542177 - RNA, 12 nt, Pseudomonas putida KT2440
gccgggcacugc

SEQ ID NO: 3542178 - RNA, 17 nt, Pseudomonas putida KT2440
gccgggcaucgaucacu

SEQ ID NO: 3542179 - RNA, 12 nt, Pseudomonas putida KT2440
gccgggcaugca

SEQ ID NO: 3542180 - RNA, 20 nt, Pseudomonas putida KT2440
gccgggccaacuugcgcagu

SEQ ID NO: 3542181 - RNA, 15 nt, Pseudomonas putida KT2440
gccgggccaccaccg

SEQ ID NO: 3542182 - RNA, 21 nt, Pseudomonas putida KT2440
gccgggccugacgugcgcggg

SEQ ID NO: 3542183 - RNA, 20 nt, Pseudomonas putida KT2440
gccgggccuugaccagcaac

SEQ ID NO: 3542184 - RNA, 16 nt, Pseudomonas putida KT2440
gccgggccuuucaccg

SEQ ID NO: 3542185 - RNA, 15 nt, Pseudomonas putida KT2440
gccgggcgcaccacg

SEQ ID NO: 3542186 - RNA, 22 nt, Pseudomonas putida KT2440
gccgggcgguugucgaccuggc

SEQ ID NO: 3542187 - RNA, 18 nt, Pseudomonas putida KT2440
gccgggcguaggcgcauc

SEQ ID NO: 3542188 - RNA, 20 nt, Pseudomonas putida KT2440
gccgggcucggccggggcaa

SEQ ID NO: 3542189 - RNA, 21 nt, Pseudomonas putida KT2440
gccgggcucggccggggcaac

SEQ ID NO: 3542190 - RNA, 15 nt, Pseudomonas putida KT2440
gccgggcucugggca

SEQ ID NO: 3542191 - RNA, 15 nt, Pseudomonas putida KT2440
gccgggcuucaacca

SEQ ID NO: 3542192 - RNA, 20 nt, Pseudomonas putida KT2440
gccgggcuuuuuugugccuc

SEQ ID NO: 3542193 - RNA, 15 nt, Pseudomonas putida KT2440
gccggggcaaccugg

SEQ ID NO: 3542194 - RNA, 16 nt, Pseudomonas putida KT2440
gccggggcaaccuggg

SEQ ID NO: 3542195 - RNA, 13 nt, Pseudomonas putida KT2440
gccggggcaugcg

SEQ ID NO: 3542196 - RNA, 21 nt, Pseudomonas putida KT2440
gccggggcugcuuugcagccc

SEQ ID NO: 3542197 - RNA, 17 nt, Pseudomonas putida KT2440
gccgggguaauggcgcu

SEQ ID NO: 3542198 - RNA, 18 nt, Pseudomonas putida KT2440
gccgggguaauggcgcug

SEQ ID NO: 3542199 - RNA, 15 nt, Pseudomonas putida KT2440
gccgggguucuggua

SEQ ID NO: 3542200 - RNA, 18 nt, Pseudomonas putida KT2440
gccgggguuucagugacc

SEQ ID NO: 3542201 - RNA, 23 nt, Pseudomonas putida KT2440
gccgggguuuuuuauugccugcc

SEQ ID NO: 3542202 - RNA, 15 nt, Pseudomonas putida KT2440
gccggguccaccagc

SEQ ID NO: 3542203 - RNA, 18 nt, Pseudomonas putida KT2440
gccggguccaccagcccg

SEQ ID NO: 3542204 - RNA, 21 nt, Pseudomonas putida KT2440
gccgggucgaaggcaaucggg

SEQ ID NO: 3542205 - RNA, 16 nt, Pseudomonas putida KT2440
gccgggucggccugcu

SEQ ID NO: 3542206 - RNA, 22 nt, Pseudomonas putida KT2440
gccggguuuuuugugccugugu

SEQ ID NO: 3542207 - RNA, 15 nt, Pseudomonas putida KT2440
gccgguacagccagc

SEQ ID NO: 3542208 - RNA, 17 nt, Pseudomonas putida KT2440
gccgguacagccuacca

SEQ ID NO: 3542209 - RNA, 22 nt, Pseudomonas putida KT2440
gccgguacagccuaccaacgca

SEQ ID NO: 3542210 - RNA, 13 nt, Pseudomonas putida KT2440
gccgguaccacug

SEQ ID NO: 3542211 - RNA, 11 nt, Pseudomonas putida KT2440
gccgguaccgc

SEQ ID NO: 3542212 - RNA, 16 nt, Pseudomonas putida KT2440
gccgguagcggcuggg

SEQ ID NO: 3542213 - RNA, 16 nt, Pseudomonas putida KT2440
gccgguagcugcgcag

SEQ ID NO: 3542214 - RNA, 22 nt, Pseudomonas putida KT2440
gccgguaggucuaaccgcgcug

SEQ ID NO: 3542215 - RNA, 17 nt, Pseudomonas putida KT2440
gccgguaggugcucaag

SEQ ID NO: 3542216 - RNA, 14 nt, Pseudomonas putida KT2440
gccgguauucgcga

SEQ ID NO: 3542217 - RNA, 22 nt, Pseudomonas putida KT2440
gccggucaagacgaagcgcuug

SEQ ID NO: 3542218 - RNA, 19 nt, Pseudomonas putida KT2440
gccggucacccccaucagc

SEQ ID NO: 3542219 - RNA, 15 nt, Pseudomonas putida KT2440
gccggucagcagcau

SEQ ID NO: 3542220 - RNA, 14 nt, Pseudomonas putida KT2440
gccggucauccagc

SEQ ID NO: 3542221 - RNA, 16 nt, Pseudomonas putida KT2440
gccggucauccagcag

SEQ ID NO: 3542222 - RNA, 17 nt, Pseudomonas putida KT2440
gccggucauccagcagc

SEQ ID NO: 3542223 - RNA, 18 nt, Pseudomonas putida KT2440
gccggucauccagcagcu

SEQ ID NO: 3542224 - RNA, 18 nt, Pseudomonas putida KT2440
gccggucggggugcugcg

SEQ ID NO: 3542225 - RNA, 20 nt, Pseudomonas putida KT2440
gccggucggggugcugcgca

SEQ ID NO: 3542226 - RNA, 20 nt, Pseudomonas putida KT2440
gccggucguuacccaccagc

SEQ ID NO: 3542227 - RNA, 15 nt, Pseudomonas putida KT2440
gccggucucccagcg

SEQ ID NO: 3542228 - RNA, 20 nt, Pseudomonas putida KT2440
gccggugccauccaccgcgc

SEQ ID NO: 3542229 - RNA, 22 nt, Pseudomonas putida KT2440
gccgguggcgaucucugcuucc

SEQ ID NO: 3542230 - RNA, 15 nt, Pseudomonas putida KT2440
gccgguggcggccgc

SEQ ID NO: 3542231 - RNA, 14 nt, Pseudomonas putida KT2440
gccggugggcaaca

SEQ ID NO: 3542232 - RNA, 17 nt, Pseudomonas putida KT2440
gccggugggcaacagcu

SEQ ID NO: 3542233 - RNA, 18 nt, Pseudomonas putida KT2440
gccgguggggugucuggu

SEQ ID NO: 3542234 - RNA, 20 nt, Pseudomonas putida KT2440
gccgguggggugucuggugu

SEQ ID NO: 3542235 - RNA, 20 nt, Pseudomonas putida KT2440
gccggugguaauuggccggc

SEQ ID NO: 3542236 - RNA, 21 nt, Pseudomonas putida KT2440
gccggugguaauuggccggca

SEQ ID NO: 3542237 - RNA, 21 nt, Pseudomonas putida KT2440
gccgguggugaaaugguugaa

SEQ ID NO: 3542238 - RNA, 15 nt, Pseudomonas putida KT2440
gccgguggugaccuc

SEQ ID NO: 3542239 - RNA, 16 nt, Pseudomonas putida KT2440
gccgguguaccaucca

SEQ ID NO: 3542240 - RNA, 17 nt, Pseudomonas putida KT2440
gccgguguggccaaggc

SEQ ID NO: 3542241 - RNA, 22 nt, Pseudomonas putida KT2440
gccgguguggccaaggcggcga

SEQ ID NO: 3542242 - RNA, 20 nt, Pseudomonas putida KT2440
gccgguguucgcgggcaugc

SEQ ID NO: 3542243 - RNA, 17 nt, Pseudomonas putida KT2440
gccgguuaaaacccagg

SEQ ID NO: 3542244 - RNA, 15 nt, Pseudomonas putida KT2440
gccgguuucucgcag

SEQ ID NO: 3542245 - RNA, 17 nt, Pseudomonas putida KT2440
gccgguuucucgcagca

SEQ ID NO: 3542246 - RNA, 19 nt, Pseudomonas putida KT2440
gccgguuucucgcagcagc

SEQ ID NO: 3542247 - RNA, 21 nt, Pseudomonas putida KT2440
gccgguuucucgcagcagcac

SEQ ID NO: 3542248 - RNA, 23 nt, Pseudomonas putida KT2440
gccgguuuuuuuugauuguucau

SEQ ID NO: 3542249 - RNA, 16 nt, Pseudomonas putida KT2440
gccguacaccaugcuc

SEQ ID NO: 3542250 - RNA, 18 nt, Pseudomonas putida KT2440
gccguacaccaugcucag

SEQ ID NO: 3542251 - RNA, 22 nt, Pseudomonas putida KT2440
gccguacaccaugcucaggaac

SEQ ID NO: 3542252 - RNA, 12 nt, Pseudomonas putida KT2440
gccguaccuucg

SEQ ID NO: 3542253 - RNA, 21 nt, Pseudomonas putida KT2440
gccguaccuucggcgacaggu

SEQ ID NO: 3542254 - RNA, 15 nt, Pseudomonas putida KT2440
gccguacggcccaug

SEQ ID NO: 3542255 - RNA, 20 nt, Pseudomonas putida KT2440
gccguacugcugggucagca

SEQ ID NO: 3542256 - RNA, 14 nt, Pseudomonas putida KT2440
gccguacuggcugc

SEQ ID NO: 3542257 - RNA, 13 nt, Pseudomonas putida KT2440
gccguagaugccg

SEQ ID NO: 3542258 - RNA, 16 nt, Pseudomonas putida KT2440
gccguagccaaccgag

SEQ ID NO: 3542259 - RNA, 23 nt, Pseudomonas putida KT2440
gccguagccaaccgagucaacac

SEQ ID NO: 3542260 - RNA, 16 nt, Pseudomonas putida KT2440
gccguaggagcgggcu

SEQ ID NO: 3542261 - RNA, 13 nt, Pseudomonas putida KT2440
gccguaggccagg

SEQ ID NO: 3542262 - RNA, 21 nt, Pseudomonas putida KT2440
gccguaggccagguacaggca

SEQ ID NO: 3542263 - RNA, 22 nt, Pseudomonas putida KT2440
gccguaggccagguacaggcaa

SEQ ID NO: 3542264 - RNA, 19 nt, Pseudomonas putida KT2440
gccguaguaagccagcccu

SEQ ID NO: 3542265 - RNA, 22 nt, Pseudomonas putida KT2440
gccguaguaagccagcccugcc

SEQ ID NO: 3542266 - RNA, 20 nt, Pseudomonas putida KT2440
gccguaguagccuucuucgg

SEQ ID NO: 3542267 - RNA, 15 nt, Pseudomonas putida KT2440
gccguaucgcgguua

SEQ ID NO: 3542268 - RNA, 20 nt, Pseudomonas putida KT2440
gccguauggcguugcucaac

SEQ ID NO: 3542269 - RNA, 22 nt, Pseudomonas putida KT2440
gccguauucaccgguagcggcg

SEQ ID NO: 3542270 - RNA, 17 nt, Pseudomonas putida KT2440
gccgucaacgaggccgc

SEQ ID NO: 3542271 - RNA, 18 nt, Pseudomonas putida KT2440
gccgucaccgcugccgau

SEQ ID NO: 3542272 - RNA, 12 nt, Pseudomonas putida KT2440
gccgucagcagc

SEQ ID NO: 3542273 - RNA, 20 nt, Pseudomonas putida KT2440
gccgucagcagcaggcgcga

SEQ ID NO: 3542274 - RNA, 23 nt, Pseudomonas putida KT2440
gccgucagcagcaggcgcgagcc

SEQ ID NO: 3542275 - RNA, 15 nt, Pseudomonas putida KT2440
gccgucagccuuuga

SEQ ID NO: 3542276 - RNA, 13 nt, Pseudomonas putida KT2440
gccgucaucacca

SEQ ID NO: 3542277 - RNA, 16 nt, Pseudomonas putida KT2440
gccguccaauagccau

SEQ ID NO: 3542278 - RNA, 19 nt, Pseudomonas putida KT2440
gccguccaauagccauucc

SEQ ID NO: 3542279 - RNA, 19 nt, Pseudomonas putida KT2440
gccguccaccaucuccagc

SEQ ID NO: 3542280 - RNA, 12 nt, Pseudomonas putida KT2440
gccguccagcug

SEQ ID NO: 3542281 - RNA, 20 nt, Pseudomonas putida KT2440
gccguccagguccaggccag

SEQ ID NO: 3542282 - RNA, 21 nt, Pseudomonas putida KT2440
gccguccagguccaggccagc

SEQ ID NO: 3542283 - RNA, 13 nt, Pseudomonas putida KT2440
gccguccucgacc

SEQ ID NO: 3542284 - RNA, 14 nt, Pseudomonas putida KT2440
gccgucgaccaggc

SEQ ID NO: 3542285 - RNA, 15 nt, Pseudomonas putida KT2440
gccgucgaccaggca

SEQ ID NO: 3542286 - RNA, 18 nt, Pseudomonas putida KT2440
gccgucgacgacgaucuc

SEQ ID NO: 3542287 - RNA, 16 nt, Pseudomonas putida KT2440
gccgucgauuacccag

SEQ ID NO: 3542288 - RNA, 22 nt, Pseudomonas putida KT2440
gccgucgauuacccagcgcgaa

SEQ ID NO: 3542289 - RNA, 15 nt, Pseudomonas putida KT2440
gccgucgccgcuucg

SEQ ID NO: 3542290 - RNA, 22 nt, Pseudomonas putida KT2440
gccgucgccucccccuccacug

SEQ ID NO: 3542291 - RNA, 23 nt, Pseudomonas putida KT2440
gccgucgccucccccuccacugu

SEQ ID NO: 3542292 - RNA, 19 nt, Pseudomonas putida KT2440
gccgucgcuggagcgggau

SEQ ID NO: 3542293 - RNA, 13 nt, Pseudomonas putida KT2440
gccgucgguaaac

SEQ ID NO: 3542294 - RNA, 15 nt, Pseudomonas putida KT2440
gccgucguuguucuu

SEQ ID NO: 3542295 - RNA, 18 nt, Pseudomonas putida KT2440
gccgucucgucacuggcu

SEQ ID NO: 3542296 - RNA, 20 nt, Pseudomonas putida KT2440
gccgucucgucacuggcugc

SEQ ID NO: 3542297 - RNA, 22 nt, Pseudomonas putida KT2440
gccgucucgucacuggcugcug

SEQ ID NO: 3542298 - RNA, 23 nt, Pseudomonas putida KT2440
gccgucuuugagggucagcuggc

SEQ ID NO: 3542299 - RNA, 21 nt, Pseudomonas putida KT2440
gccgucuuuuccgugcaaccg

SEQ ID NO: 3542300 - RNA, 23 nt, Pseudomonas putida KT2440
gccgucuuuuccgugcaaccgcu

SEQ ID NO: 3542301 - RNA, 17 nt, Pseudomonas putida KT2440
gccgugaagaggccagu

SEQ ID NO: 3542302 - RNA, 21 nt, Pseudomonas putida KT2440
gccgugaagaggccagugagc

SEQ ID NO: 3542303 - RNA, 20 nt, Pseudomonas putida KT2440
gccgugaguggccucgaaca

SEQ ID NO: 3542304 - RNA, 14 nt, Pseudomonas putida KT2440
gccgugaucgccgg

SEQ ID NO: 3542305 - RNA, 23 nt, Pseudomonas putida KT2440
gccgugaugguaucugccagcac

SEQ ID NO: 3542306 - RNA, 15 nt, Pseudomonas putida KT2440
gccgugcaacgccgg

SEQ ID NO: 3542307 - RNA, 12 nt, Pseudomonas putida KT2440
gccgugcagcac

SEQ ID NO: 3542308 - RNA, 16 nt, Pseudomonas putida KT2440
gccgugcaggcggcga

SEQ ID NO: 3542309 - RNA, 19 nt, Pseudomonas putida KT2440
gccgugcaggcggcgacaa

SEQ ID NO: 3542310 - RNA, 17 nt, Pseudomonas putida KT2440
gccgugcagggcgccga

SEQ ID NO: 3542311 - RNA, 13 nt, Pseudomonas putida KT2440
gccgugcagguca

SEQ ID NO: 3542312 - RNA, 22 nt, Pseudomonas putida KT2440
gccgugcaguucuaccguuggc

SEQ ID NO: 3542313 - RNA, 16 nt, Pseudomonas putida KT2440
gccgugccagguguuu

SEQ ID NO: 3542314 - RNA, 15 nt, Pseudomonas putida KT2440
gccgugcccaccagc

SEQ ID NO: 3542315 - RNA, 16 nt, Pseudomonas putida KT2440
gccgugcccaccagcg

SEQ ID NO: 3542316 - RNA, 18 nt, Pseudomonas putida KT2440
gccgugcccaccagcgcu

SEQ ID NO: 3542317 - RNA, 13 nt, Pseudomonas putida KT2440
gccgugccugggu

SEQ ID NO: 3542318 - RNA, 13 nt, Pseudomonas putida KT2440
gccgugcgcggca

SEQ ID NO: 3542319 - RNA, 18 nt, Pseudomonas putida KT2440
gccgugcgcggcaucagc

SEQ ID NO: 3542320 - RNA, 15 nt, Pseudomonas putida KT2440
gccgugcggccaaag

SEQ ID NO: 3542321 - RNA, 19 nt, Pseudomonas putida KT2440
gccgugcggccaaagcugu

SEQ ID NO: 3542322 - RNA, 14 nt, Pseudomonas putida KT2440
gccgugcucggccu

SEQ ID NO: 3542323 - RNA, 18 nt, Pseudomonas putida KT2440
gccgugcucggccuugcc

SEQ ID NO: 3542324 - RNA, 21 nt, Pseudomonas putida KT2440
gccgugcuugaggccgccauu

SEQ ID NO: 3542325 - RNA, 15 nt, Pseudomonas putida KT2440
gccguggcaaggccc

SEQ ID NO: 3542326 - RNA, 19 nt, Pseudomonas putida KT2440
gccguggcaaggcccgcgc

SEQ ID NO: 3542327 - RNA, 18 nt, Pseudomonas putida KT2440
gccguggguugaacaggu

SEQ ID NO: 3542328 - RNA, 16 nt, Pseudomonas putida KT2440
gccguggucgccuuca

SEQ ID NO: 3542329 - RNA, 22 nt, Pseudomonas putida KT2440
gccgugguuucgaagucgaaca

SEQ ID NO: 3542330 - RNA, 20 nt, Pseudomonas putida KT2440
gccguguucaggcacgaucg

SEQ ID NO: 3542331 - RNA, 21 nt, Pseudomonas putida KT2440
gccguguucccagcaccccag

SEQ ID NO: 3542332 - RNA, 18 nt, Pseudomonas putida KT2440
gccguugaaggcgaauga

SEQ ID NO: 3542333 - RNA, 15 nt, Pseudomonas putida KT2440
gccguugaggccgaa

SEQ ID NO: 3542334 - RNA, 17 nt, Pseudomonas putida KT2440
gccguugaucagcgaca

SEQ ID NO: 3542335 - RNA, 21 nt, Pseudomonas putida KT2440
gccguugccgcccggggcgug

SEQ ID NO: 3542336 - RNA, 15 nt, Pseudomonas putida KT2440
gccguugcgccgcuc

SEQ ID NO: 3542337 - RNA, 15 nt, Pseudomonas putida KT2440
gccguuggagcagcc

SEQ ID NO: 3542338 - RNA, 18 nt, Pseudomonas putida KT2440
gccguuggagcagccguu

SEQ ID NO: 3542339 - RNA, 15 nt, Pseudomonas putida KT2440
gccguuguacaagcu

SEQ ID NO: 3542340 - RNA, 16 nt, Pseudomonas putida KT2440
gccguugucacgcgcc

SEQ ID NO: 3542341 - RNA, 15 nt, Pseudomonas putida KT2440
gccguugucgcccgc

SEQ ID NO: 3542342 - RNA, 22 nt, Pseudomonas putida KT2440
gccguuguucggcaaaggccuc

SEQ ID NO: 3542343 - RNA, 19 nt, Pseudomonas putida KT2440
gccuaagguugcuccugca

SEQ ID NO: 3542344 - RNA, 20 nt, Pseudomonas putida KT2440
gccuacaaagcgcucgaagu

SEQ ID NO: 3542345 - RNA, 15 nt, Pseudomonas putida KT2440
gccuacaacauaccg

SEQ ID NO: 3542346 - RNA, 18 nt, Pseudomonas putida KT2440
gccuacagcggccugugc

SEQ ID NO: 3542347 - RNA, 23 nt, Pseudomonas putida KT2440
gccuacaggcaaccgcauccccu

SEQ ID NO: 3542348 - RNA, 17 nt, Pseudomonas putida KT2440
gccuaccaacgcagcau

SEQ ID NO: 3542349 - RNA, 14 nt, Pseudomonas putida KT2440
gccuacccaggcaa

SEQ ID NO: 3542350 - RNA, 15 nt, Pseudomonas putida KT2440
gccuacccgggcgca

SEQ ID NO: 3542351 - RNA, 18 nt, Pseudomonas putida KT2440
gccuaccgcgucgccaau

SEQ ID NO: 3542352 - RNA, 15 nt, Pseudomonas putida KT2440
gccuacgcccccagc

SEQ ID NO: 3542353 - RNA, 16 nt, Pseudomonas putida KT2440
gccuacgcccccagcc

SEQ ID NO: 3542354 - RNA, 14 nt, Pseudomonas putida KT2440
gccuacugcuggcg

SEQ ID NO: 3542355 - RNA, 13 nt, Pseudomonas putida KT2440
gccuagcaaggcc

SEQ ID NO: 3542356 - RNA, 15 nt, Pseudomonas putida KT2440
gccuagcaaggccuc

SEQ ID NO: 3542357 - RNA, 20 nt, Pseudomonas putida KT2440
gccuagcaaggccuccaggu

SEQ ID NO: 3542358 - RNA, 18 nt, Pseudomonas putida KT2440
gccuaguucggcaccuuu

SEQ ID NO: 3542359 - RNA, 17 nt, Pseudomonas putida KT2440
gccuaucagaucgagcg

SEQ ID NO: 3542360 - RNA, 21 nt, Pseudomonas putida KT2440
gccuaucagaucgagcgccca

SEQ ID NO: 3542361 - RNA, 16 nt, Pseudomonas putida KT2440
gccuaucaggccuucg

SEQ ID NO: 3542362 - RNA, 20 nt, Pseudomonas putida KT2440
gccuaucgcucuggcacuca

SEQ ID NO: 3542363 - RNA, 22 nt, Pseudomonas putida KT2440
gccuaucgcucuggcacucaag

SEQ ID NO: 3542364 - RNA, 15 nt, Pseudomonas putida KT2440
gccuaucucuuccag

SEQ ID NO: 3542365 - RNA, 19 nt, Pseudomonas putida KT2440
gccuaucuucgucauggga

SEQ ID NO: 3542366 - RNA, 20 nt, Pseudomonas putida KT2440
gccuauucgcggguaaaccc

SEQ ID NO: 3542367 - RNA, 20 nt, Pseudomonas putida KT2440
gccucaagccucgcgcaaca

SEQ ID NO: 3542368 - RNA, 14 nt, Pseudomonas putida KT2440
gccucaaggccggc

SEQ ID NO: 3542369 - RNA, 21 nt, Pseudomonas putida KT2440
gccucaaugggcuuccccagc

SEQ ID NO: 3542370 - RNA, 18 nt, Pseudomonas putida KT2440
gccucacagcgccgcggc

SEQ ID NO: 3542371 - RNA, 20 nt, Pseudomonas putida KT2440
gccucacagcgccgcggcca

SEQ ID NO: 3542372 - RNA, 18 nt, Pseudomonas putida KT2440
gccucacauucaccgcca

SEQ ID NO: 3542373 - RNA, 19 nt, Pseudomonas putida KT2440
gccucaccgacccacaggc

SEQ ID NO: 3542374 - RNA, 14 nt, Pseudomonas putida KT2440
gccucaccgccgca

SEQ ID NO: 3542375 - RNA, 15 nt, Pseudomonas putida KT2440
gccucaccuccaccg

SEQ ID NO: 3542376 - RNA, 18 nt, Pseudomonas putida KT2440
gccucacgcaucugcgcu

SEQ ID NO: 3542377 - RNA, 22 nt, Pseudomonas putida KT2440
gccucacgcaucugcgcuaccu

SEQ ID NO: 3542378 - RNA, 14 nt, Pseudomonas putida KT2440
gccucagccaggcu

SEQ ID NO: 3542379 - RNA, 16 nt, Pseudomonas putida KT2440
gccucagccaggcuga

SEQ ID NO: 3542380 - RNA, 17 nt, Pseudomonas putida KT2440
gccucagccaggcugag

SEQ ID NO: 3542381 - RNA, 12 nt, Pseudomonas putida KT2440
gccucagccggc

SEQ ID NO: 3542382 - RNA, 12 nt, Pseudomonas putida KT2440
gccucagcgccc

SEQ ID NO: 3542383 - RNA, 16 nt, Pseudomonas putida KT2440
gccucagcuggccggc

SEQ ID NO: 3542384 - RNA, 13 nt, Pseudomonas putida KT2440
gccucaggcccca

SEQ ID NO: 3542385 - RNA, 21 nt, Pseudomonas putida KT2440
gccucaggccccaggccaucc

SEQ ID NO: 3542386 - RNA, 16 nt, Pseudomonas putida KT2440
gccucaggugcacagg

SEQ ID NO: 3542387 - RNA, 19 nt, Pseudomonas putida KT2440
gccucaggugcacagggcg

SEQ ID NO: 3542388 - RNA, 21 nt, Pseudomonas putida KT2440
gccucauagcuuucaggcgca

SEQ ID NO: 3542389 - RNA, 23 nt, Pseudomonas putida KT2440
gccucauagcuuucaggcgcagc

SEQ ID NO: 3542390 - RNA, 22 nt, Pseudomonas putida KT2440
gccucaucaucgaaauacaggc

SEQ ID NO: 3542391 - RNA, 20 nt, Pseudomonas putida KT2440
gccuccacaccgacauccac

SEQ ID NO: 3542392 - RNA, 15 nt, Pseudomonas putida KT2440
gccuccaccaccugc

SEQ ID NO: 3542393 - RNA, 15 nt, Pseudomonas putida KT2440
gccuccaccgggaug

SEQ ID NO: 3542394 - RNA, 21 nt, Pseudomonas putida KT2440
gccuccaccuggaauucgcug

SEQ ID NO: 3542395 - RNA, 17 nt, Pseudomonas putida KT2440
gccuccagagaaccgca

SEQ ID NO: 3542396 - RNA, 12 nt, Pseudomonas putida KT2440
gccuccagcagc

SEQ ID NO: 3542397 - RNA, 16 nt, Pseudomonas putida KT2440
gccuccagcaggggca

SEQ ID NO: 3542398 - RNA, 17 nt, Pseudomonas putida KT2440
gccuccagcaggggcag

SEQ ID NO: 3542399 - RNA, 11 nt, Pseudomonas putida KT2440
gccuccagcug

SEQ ID NO: 3542400 - RNA, 14 nt, Pseudomonas putida KT2440
gccuccagcuggcc

SEQ ID NO: 3542401 - RNA, 23 nt, Pseudomonas putida KT2440
gccuccagcuggccaucgacccg

SEQ ID NO: 3542402 - RNA, 19 nt, Pseudomonas putida KT2440
gccuccagcuuuggcugca

SEQ ID NO: 3542403 - RNA, 15 nt, Pseudomonas putida KT2440
gccuccaggcguugc

SEQ ID NO: 3542404 - RNA, 14 nt, Pseudomonas putida KT2440
gccuccagggcggc

SEQ ID NO: 3542405 - RNA, 13 nt, Pseudomonas putida KT2440
gccuccagguaau

SEQ ID NO: 3542406 - RNA, 15 nt, Pseudomonas putida KT2440
gccuccaguugcucc

SEQ ID NO: 3542407 - RNA, 15 nt, Pseudomonas putida KT2440
gccuccauacgcugg

SEQ ID NO: 3542408 - RNA, 13 nt, Pseudomonas putida KT2440
gccucccaggacu

SEQ ID NO: 3542409 - RNA, 20 nt, Pseudomonas putida KT2440
gccucccaggacuucagcag

SEQ ID NO: 3542410 - RNA, 22 nt, Pseudomonas putida KT2440
gccucccccacccccgccccac

SEQ ID NO: 3542411 - RNA, 12 nt, Pseudomonas putida KT2440
gccucccccagc

SEQ ID NO: 3542412 - RNA, 17 nt, Pseudomonas putida KT2440
gccucccccagcgcggu

SEQ ID NO: 3542413 - RNA, 14 nt, Pseudomonas putida KT2440
gccucccccuccac

SEQ ID NO: 3542414 - RNA, 17 nt, Pseudomonas putida KT2440
gccucccgcuacgagag

SEQ ID NO: 3542415 - RNA, 19 nt, Pseudomonas putida KT2440
gccuccucgcgggcaaacc

SEQ ID NO: 3542416 - RNA, 15 nt, Pseudomonas putida KT2440
gccuccugaagggcc

SEQ ID NO: 3542417 - RNA, 17 nt, Pseudomonas putida KT2440
gccuccugcugcugcau

SEQ ID NO: 3542418 - RNA, 16 nt, Pseudomonas putida KT2440
gccucgaacauggcca

SEQ ID NO: 3542419 - RNA, 23 nt, Pseudomonas putida KT2440
gccucgaaguaggcaaacggcuc

SEQ ID NO: 3542420 - RNA, 16 nt, Pseudomonas putida KT2440
gccucgacccgcuggc

SEQ ID NO: 3542421 - RNA, 18 nt, Pseudomonas putida KT2440
gccucgacccgcuggcga

SEQ ID NO: 3542422 - RNA, 14 nt, Pseudomonas putida KT2440
gccucgaccuggcc

SEQ ID NO: 3542423 - RNA, 16 nt, Pseudomonas putida KT2440
gccucgaccuggcccg

SEQ ID NO: 3542424 - RNA, 15 nt, Pseudomonas putida KT2440
gccucgacgcagaca

SEQ ID NO: 3542425 - RNA, 21 nt, Pseudomonas putida KT2440
gccucgaucauuuccggcacg

SEQ ID NO: 3542426 - RNA, 19 nt, Pseudomonas putida KT2440
gccucgaucccgccgccag

SEQ ID NO: 3542427 - RNA, 21 nt, Pseudomonas putida KT2440
gccucgaucccgccgccagac

SEQ ID NO: 3542428 - RNA, 19 nt, Pseudomonas putida KT2440
gccucgaucgucgacaacg

SEQ ID NO: 3542429 - RNA, 21 nt, Pseudomonas putida KT2440
gccucgaugcggucuuccagc

SEQ ID NO: 3542430 - RNA, 19 nt, Pseudomonas putida KT2440
gccucgaugugcgugaaca

SEQ ID NO: 3542431 - RNA, 15 nt, Pseudomonas putida KT2440
gccucgauuucuuca

SEQ ID NO: 3542432 - RNA, 14 nt, Pseudomonas putida KT2440
gccucgcccaggcc

SEQ ID NO: 3542433 - RNA, 19 nt, Pseudomonas putida KT2440
gccucgcccaggccgccga

SEQ ID NO: 3542434 - RNA, 18 nt, Pseudomonas putida KT2440
gccucgcccuugucagcc

SEQ ID NO: 3542435 - RNA, 19 nt, Pseudomonas putida KT2440
gccucgcccuugucagccg

SEQ ID NO: 3542436 - RNA, 21 nt, Pseudomonas putida KT2440
gccucgcccuugucagccgcc

SEQ ID NO: 3542437 - RNA, 12 nt, Pseudomonas putida KT2440
gccucgcgcaac

SEQ ID NO: 3542438 - RNA, 18 nt, Pseudomonas putida KT2440
gccucgcgcaacaccgcc

SEQ ID NO: 3542439 - RNA, 20 nt, Pseudomonas putida KT2440
gccucgcgcauggccgcuuc

SEQ ID NO: 3542440 - RNA, 17 nt, Pseudomonas putida KT2440
gccucgcugaccaguug

SEQ ID NO: 3542441 - RNA, 24 nt, Pseudomonas putida KT2440
gccucgcugccuuuggccgccagc

SEQ ID NO: 3542442 - RNA, 14 nt, Pseudomonas putida KT2440
gccucggccgcccu

SEQ ID NO: 3542443 - RNA, 17 nt, Pseudomonas putida KT2440
gccucggcgaucgccag

SEQ ID NO: 3542444 - RNA, 19 nt, Pseudomonas putida KT2440
gccucggcgaucgccaggu

SEQ ID NO: 3542445 - RNA, 20 nt, Pseudomonas putida KT2440
gccucggcgaucgccaggug

SEQ ID NO: 3542446 - RNA, 15 nt, Pseudomonas putida KT2440
gccucgggcgcucgc

SEQ ID NO: 3542447 - RNA, 16 nt, Pseudomonas putida KT2440
gccucgggguagaaca

SEQ ID NO: 3542448 - RNA, 19 nt, Pseudomonas putida KT2440
gccucgguacccuugggcg

SEQ ID NO: 3542449 - RNA, 16 nt, Pseudomonas putida KT2440
gccucggucagguacu

SEQ ID NO: 3542450 - RNA, 18 nt, Pseudomonas putida KT2440
gccucgguccaccccaug

SEQ ID NO: 3542451 - RNA, 23 nt, Pseudomonas putida KT2440
gccucgguccaccccauguggcg

SEQ ID NO: 3542452 - RNA, 19 nt, Pseudomonas putida KT2440
gccucguccaucuugcugc

SEQ ID NO: 3542453 - RNA, 13 nt, Pseudomonas putida KT2440
gccucgucgaugu

SEQ ID NO: 3542454 - RNA, 22 nt, Pseudomonas putida KT2440
gccucgucgcgguccuugccgu

SEQ ID NO: 3542455 - RNA, 19 nt, Pseudomonas putida KT2440
gccucgucggugggcguca

SEQ ID NO: 3542456 - RNA, 14 nt, Pseudomonas putida KT2440
gccucgugcagcug

SEQ ID NO: 3542457 - RNA, 17 nt, Pseudomonas putida KT2440
gccucgugcagcugcac

SEQ ID NO: 3542458 - RNA, 17 nt, Pseudomonas putida KT2440
gccucguucgggcacuc

SEQ ID NO: 3542459 - RNA, 21 nt, Pseudomonas putida KT2440
gccucguuggcgaagucggcc

SEQ ID NO: 3542460 - RNA, 16 nt, Pseudomonas putida KT2440
gccucuaccgcugcuc

SEQ ID NO: 3542461 - RNA, 16 nt, Pseudomonas putida KT2440
gccucugcugcggaua

SEQ ID NO: 3542462 - RNA, 15 nt, Pseudomonas putida KT2440
gccucuguuugcugg

SEQ ID NO: 3542463 - RNA, 23 nt, Pseudomonas putida KT2440
gccucuucacggcuaaagccgca

SEQ ID NO: 3542464 - RNA, 21 nt, Pseudomonas putida KT2440
gccucuucaggcaauggcgaa

SEQ ID NO: 3542465 - RNA, 17 nt, Pseudomonas putida KT2440
gccucuucgcagcacaa

SEQ ID NO: 3542466 - RNA, 13 nt, Pseudomonas putida KT2440
gccucuucgcggg

SEQ ID NO: 3542467 - RNA, 15 nt, Pseudomonas putida KT2440
gccucuucgcgggca

SEQ ID NO: 3542468 - RNA, 17 nt, Pseudomonas putida KT2440
gccucuucgcgggcaag

SEQ ID NO: 3542469 - RNA, 22 nt, Pseudomonas putida KT2440
gccucuucgcgggcaagcccgc

SEQ ID NO: 3542470 - RNA, 23 nt, Pseudomonas putida KT2440
gccucuucgcgggcaagcccgcu

SEQ ID NO: 3542471 - RNA, 18 nt, Pseudomonas putida KT2440
gccucuucgcggguaaac

SEQ ID NO: 3542472 - RNA, 19 nt, Pseudomonas putida KT2440
gccucuucgcggguaaacc

SEQ ID NO: 3542473 - RNA, 20 nt, Pseudomonas putida KT2440
gccucuucgcggguaaaccc

SEQ ID NO: 3542474 - RNA, 23 nt, Pseudomonas putida KT2440
gccucuucgcggguaaacccgcu

SEQ ID NO: 3542475 - RNA, 18 nt, Pseudomonas putida KT2440
gccucuucggccagcaac

SEQ ID NO: 3542476 - RNA, 20 nt, Pseudomonas putida KT2440
gccucuucuucaaggcugcu

SEQ ID NO: 3542477 - RNA, 24 nt, Pseudomonas putida KT2440
gccucuucuucaaggcugcucucc

SEQ ID NO: 3542478 - RNA, 18 nt, Pseudomonas putida KT2440
gccucuugcaccuguccc

SEQ ID NO: 3542479 - RNA, 20 nt, Pseudomonas putida KT2440
gccucuugcaccugucccag

SEQ ID NO: 3542480 - RNA, 12 nt, Pseudomonas putida KT2440
gccugaaaccca

SEQ ID NO: 3542481 - RNA, 20 nt, Pseudomonas putida KT2440
gccugaaacccauccacggc

SEQ ID NO: 3542482 - RNA, 18 nt, Pseudomonas putida KT2440
gccugaacagcaucagcc

SEQ ID NO: 3542483 - RNA, 16 nt, Pseudomonas putida KT2440
gccugaacgcugcgcg

SEQ ID NO: 3542484 - RNA, 17 nt, Pseudomonas putida KT2440
gccugacacuaggagug

SEQ ID NO: 3542485 - RNA, 18 nt, Pseudomonas putida KT2440
gccugaccugugcugaau

SEQ ID NO: 3542486 - RNA, 15 nt, Pseudomonas putida KT2440
gccugacgcagugca

SEQ ID NO: 3542487 - RNA, 18 nt, Pseudomonas putida KT2440
gccugacgccgccagcgc

SEQ ID NO: 3542488 - RNA, 22 nt, Pseudomonas putida KT2440
gccugacgccgccagcgcucca

SEQ ID NO: 3542489 - RNA, 21 nt, Pseudomonas putida KT2440
gccugacgcgccgccaacccc

SEQ ID NO: 3542490 - RNA, 20 nt, Pseudomonas putida KT2440
gccugacgggccucuucgcg

SEQ ID NO: 3542491 - RNA, 22 nt, Pseudomonas putida KT2440
gccugagccuuguucgcgcagg

SEQ ID NO: 3542492 - RNA, 13 nt, Pseudomonas putida KT2440
gccugaggcugcg

SEQ ID NO: 3542493 - RNA, 22 nt, Pseudomonas putida KT2440
gccugagggguguucagugauu

SEQ ID NO: 3542494 - RNA, 22 nt, Pseudomonas putida KT2440
gccugagggucgugagccugca

SEQ ID NO: 3542495 - RNA, 17 nt, Pseudomonas putida KT2440
gccugaucaaagucgcc

SEQ ID NO: 3542496 - RNA, 23 nt, Pseudomonas putida KT2440
gccugaucaagguuucagcagcg

SEQ ID NO: 3542497 - RNA, 12 nt, Pseudomonas putida KT2440
gccugaucagac

SEQ ID NO: 3542498 - RNA, 22 nt, Pseudomonas putida KT2440
gccugaugccucaucaggccga

SEQ ID NO: 3542499 - RNA, 15 nt, Pseudomonas putida KT2440
gccugauuacccugc

SEQ ID NO: 3542500 - RNA, 23 nt, Pseudomonas putida KT2440
gccugauuacccugcgccaggca

SEQ ID NO: 3542501 - RNA, 19 nt, Pseudomonas putida KT2440
gccugcaaacgcaggugcg

SEQ ID NO: 3542502 - RNA, 15 nt, Pseudomonas putida KT2440
gccugcaaacgccgc

SEQ ID NO: 3542503 - RNA, 19 nt, Pseudomonas putida KT2440
gccugcaaacgccgcucga

SEQ ID NO: 3542504 - RNA, 17 nt, Pseudomonas putida KT2440
gccugcaaccagucauc

SEQ ID NO: 3542505 - RNA, 22 nt, Pseudomonas putida KT2440
gccugcaaccccuggaaacccu

SEQ ID NO: 3542506 - RNA, 15 nt, Pseudomonas putida KT2440
gccugcaagccggcg

SEQ ID NO: 3542507 - RNA, 22 nt, Pseudomonas putida KT2440
gccugcaagccggcgaacagca

SEQ ID NO: 3542508 - RNA, 23 nt, Pseudomonas putida KT2440
gccugcaaggaaaaccccgcuuc

SEQ ID NO: 3542509 - RNA, 23 nt, Pseudomonas putida KT2440
gccugcaaucagcucacaggcuc

SEQ ID NO: 3542510 - RNA, 14 nt, Pseudomonas putida KT2440
gccugcaccaguuc

SEQ ID NO: 3542511 - RNA, 17 nt, Pseudomonas putida KT2440
gccugcacccaggcucu

SEQ ID NO: 3542512 - RNA, 17 nt, Pseudomonas putida KT2440
gccugcacccgcgcgcc

SEQ ID NO: 3542513 - RNA, 15 nt, Pseudomonas putida KT2440
gccugcaccuggcug

SEQ ID NO: 3542514 - RNA, 21 nt, Pseudomonas putida KT2440
gccugcacggcaaaguccagc

SEQ ID NO: 3542515 - RNA, 22 nt, Pseudomonas putida KT2440
gccugcacuaagggcaggccug

SEQ ID NO: 3542516 - RNA, 22 nt, Pseudomonas putida KT2440
gccugcacuaccucgcucaggc

SEQ ID NO: 3542517 - RNA, 22 nt, Pseudomonas putida KT2440
gccugcacugcacccucuuccu

SEQ ID NO: 3542518 - RNA, 11 nt, Pseudomonas putida KT2440
gccugcagccc

SEQ ID NO: 3542519 - RNA, 16 nt, Pseudomonas putida KT2440
gccugcagcccggcaa

SEQ ID NO: 3542520 - RNA, 16 nt, Pseudomonas putida KT2440
gccugcagcgcggcga

SEQ ID NO: 3542521 - RNA, 13 nt, Pseudomonas putida KT2440
gccugcagcgcgu

SEQ ID NO: 3542522 - RNA, 15 nt, Pseudomonas putida KT2440
gccugcagcgcguca

SEQ ID NO: 3542523 - RNA, 20 nt, Pseudomonas putida KT2440
gccugcagcgcgucauccgc

SEQ ID NO: 3542524 - RNA, 13 nt, Pseudomonas putida KT2440
gccugcaggcagc

SEQ ID NO: 3542525 - RNA, 14 nt, Pseudomonas putida KT2440
gccugcaggcagca

SEQ ID NO: 3542526 - RNA, 15 nt, Pseudomonas putida KT2440
gccugcaggcagcau

SEQ ID NO: 3542527 - RNA, 14 nt, Pseudomonas putida KT2440
gccugcagggccuc

SEQ ID NO: 3542528 - RNA, 19 nt, Pseudomonas putida KT2440
gccugcaguucgcugcgca

SEQ ID NO: 3542529 - RNA, 12 nt, Pseudomonas putida KT2440
gccugcauccac

SEQ ID NO: 3542530 - RNA, 22 nt, Pseudomonas putida KT2440
gccugcauccacaccagcggcg

SEQ ID NO: 3542531 - RNA, 20 nt, Pseudomonas putida KT2440
gccugcaugcucaucgcggc

SEQ ID NO: 3542532 - RNA, 16 nt, Pseudomonas putida KT2440
gccugccacgaugguc

SEQ ID NO: 3542533 - RNA, 22 nt, Pseudomonas putida KT2440
gccugccaggucaccgcccagc

SEQ ID NO: 3542534 - RNA, 15 nt, Pseudomonas putida KT2440
gccugccagguccga

SEQ ID NO: 3542535 - RNA, 17 nt, Pseudomonas putida KT2440
gccugccauaccugcuu

SEQ ID NO: 3542536 - RNA, 15 nt, Pseudomonas putida KT2440
gccugcccgcccccc

SEQ ID NO: 3542537 - RNA, 16 nt, Pseudomonas putida KT2440
gccugcccgccgucca

SEQ ID NO: 3542538 - RNA, 19 nt, Pseudomonas putida KT2440
gccugccgggucaaggcca

SEQ ID NO: 3542539 - RNA, 24 nt, Pseudomonas putida KT2440
gccugccgggucaaggccagcgcc

SEQ ID NO: 3542540 - RNA, 16 nt, Pseudomonas putida KT2440
gccugccgguacagcc

SEQ ID NO: 3542541 - RNA, 22 nt, Pseudomonas putida KT2440
gccugcgauugcgauccgcccc

SEQ ID NO: 3542542 - RNA, 14 nt, Pseudomonas putida KT2440
gccugcgcaggcgc

SEQ ID NO: 3542543 - RNA, 14 nt, Pseudomonas putida KT2440
gccugcgcuccagc

SEQ ID NO: 3542544 - RNA, 15 nt, Pseudomonas putida KT2440
gccugcgcuccagca

SEQ ID NO: 3542545 - RNA, 19 nt, Pseudomonas putida KT2440
gccugcgcuccagcagcuc

SEQ ID NO: 3542546 - RNA, 17 nt, Pseudomonas putida KT2440
gccugcggcaucagggc

SEQ ID NO: 3542547 - RNA, 19 nt, Pseudomonas putida KT2440
gccugcggcaucagggccc

SEQ ID NO: 3542548 - RNA, 17 nt, Pseudomonas putida KT2440
gccugcggccaggccgg

SEQ ID NO: 3542549 - RNA, 18 nt, Pseudomonas putida KT2440
gccugcggccaggccggc

SEQ ID NO: 3542550 - RNA, 20 nt, Pseudomonas putida KT2440
gccugcggccaggccggcgc

SEQ ID NO: 3542551 - RNA, 19 nt, Pseudomonas putida KT2440
gccugcgggaaguccgcca

SEQ ID NO: 3542552 - RNA, 19 nt, Pseudomonas putida KT2440
gccugcucaaucaaccagc

SEQ ID NO: 3542553 - RNA, 20 nt, Pseudomonas putida KT2440
gccugcucacccgaccagau

SEQ ID NO: 3542554 - RNA, 15 nt, Pseudomonas putida KT2440
gccugcuccaugggc

SEQ ID NO: 3542555 - RNA, 22 nt, Pseudomonas putida KT2440
gccugcuccaugggcaggccca

SEQ ID NO: 3542556 - RNA, 13 nt, Pseudomonas putida KT2440
gccugcucgcugg

SEQ ID NO: 3542557 - RNA, 15 nt, Pseudomonas putida KT2440
gccugcugacgcagg

SEQ ID NO: 3542558 - RNA, 23 nt, Pseudomonas putida KT2440
gccugcugcaacagcucauccag

SEQ ID NO: 3542559 - RNA, 12 nt, Pseudomonas putida KT2440
gccugcugcugg

SEQ ID NO: 3542560 - RNA, 23 nt, Pseudomonas putida KT2440
gccugcugcuggaucagugucug

SEQ ID NO: 3542561 - RNA, 16 nt, Pseudomonas putida KT2440
gccugcuggccgcgca

SEQ ID NO: 3542562 - RNA, 17 nt, Pseudomonas putida KT2440
gccugcuggccgcgcag

SEQ ID NO: 3542563 - RNA, 20 nt, Pseudomonas putida KT2440
gccugcuggccgcgcaggaa

SEQ ID NO: 3542564 - RNA, 15 nt, Pseudomonas putida KT2440
gccugcuggcggcug

SEQ ID NO: 3542565 - RNA, 20 nt, Pseudomonas putida KT2440
gccugcuggcggcugagccg

SEQ ID NO: 3542566 - RNA, 17 nt, Pseudomonas putida KT2440
gccugcugguacagccg

SEQ ID NO: 3542567 - RNA, 21 nt, Pseudomonas putida KT2440
gccugcugguacagccggcug

SEQ ID NO: 3542568 - RNA, 23 nt, Pseudomonas putida KT2440
gccugcuugaucaggcccggcug

SEQ ID NO: 3542569 - RNA, 20 nt, Pseudomonas putida KT2440
gccugcuuggccgacuggcg

SEQ ID NO: 3542570 - RNA, 22 nt, Pseudomonas putida KT2440
gccugcuuggccgacuggcgca

SEQ ID NO: 3542571 - RNA, 22 nt, Pseudomonas putida KT2440
gccuggaaaauccgcuugaugg

SEQ ID NO: 3542572 - RNA, 15 nt, Pseudomonas putida KT2440
gccuggaauuccugc

SEQ ID NO: 3542573 - RNA, 16 nt, Pseudomonas putida KT2440
gccuggacgcgugcaa

SEQ ID NO: 3542574 - RNA, 23 nt, Pseudomonas putida KT2440
gccuggauaaucgccuguaccuc

SEQ ID NO: 3542575 - RNA, 15 nt, Pseudomonas putida KT2440
gccuggaugcguugc

SEQ ID NO: 3542576 - RNA, 16 nt, Pseudomonas putida KT2440
gccuggcaaauaauca

SEQ ID NO: 3542577 - RNA, 12 nt, Pseudomonas putida KT2440
gccuggccaagc

SEQ ID NO: 3542578 - RNA, 13 nt, Pseudomonas putida KT2440
gccuggccacugu

SEQ ID NO: 3542579 - RNA, 20 nt, Pseudomonas putida KT2440
gccuggccacuguugcagcg

SEQ ID NO: 3542580 - RNA, 15 nt, Pseudomonas putida KT2440
gccuggcccgcagcg

SEQ ID NO: 3542581 - RNA, 15 nt, Pseudomonas putida KT2440
gccuggccgcugcgc

SEQ ID NO: 3542582 - RNA, 18 nt, Pseudomonas putida KT2440
gccuggccugcaugcuca

SEQ ID NO: 3542583 - RNA, 19 nt, Pseudomonas putida KT2440
gccuggcgcaguucgucca

SEQ ID NO: 3542584 - RNA, 18 nt, Pseudomonas putida KT2440
gccuggcgccugcgccag

SEQ ID NO: 3542585 - RNA, 21 nt, Pseudomonas putida KT2440
gccuggcgcgaaaagcugucg

SEQ ID NO: 3542586 - RNA, 18 nt, Pseudomonas putida KT2440
gccuggcgcuugaucagc

SEQ ID NO: 3542587 - RNA, 16 nt, Pseudomonas putida KT2440
gccuggcuuuccaggu

SEQ ID NO: 3542588 - RNA, 10 nt, Pseudomonas putida KT2440
gccugggccg

SEQ ID NO: 3542589 - RNA, 15 nt, Pseudomonas putida KT2440
gccugggccgguccu

SEQ ID NO: 3542590 - RNA, 17 nt, Pseudomonas putida KT2440
gccugggccggugggca

SEQ ID NO: 3542591 - RNA, 15 nt, Pseudomonas putida KT2440
gccuggggcaggccc

SEQ ID NO: 3542592 - RNA, 22 nt, Pseudomonas putida KT2440
gccugggguauuugcagugguu

SEQ ID NO: 3542593 - RNA, 21 nt, Pseudomonas putida KT2440
gccugggucacggcauccccg

SEQ ID NO: 3542594 - RNA, 15 nt, Pseudomonas putida KT2440
gccugggucagcugg

SEQ ID NO: 3542595 - RNA, 15 nt, Pseudomonas putida KT2440
gccugggucaggcgu

SEQ ID NO: 3542596 - RNA, 19 nt, Pseudomonas putida KT2440
gccugggugguaucugccg

SEQ ID NO: 3542597 - RNA, 12 nt, Pseudomonas putida KT2440
gccuggguuuua

SEQ ID NO: 3542598 - RNA, 19 nt, Pseudomonas putida KT2440
gccuggucgccgccaccca

SEQ ID NO: 3542599 - RNA, 23 nt, Pseudomonas putida KT2440
gccuggucuucguuacgcccggc

SEQ ID NO: 3542600 - RNA, 16 nt, Pseudomonas putida KT2440
gccuggugccagcggc

SEQ ID NO: 3542601 - RNA, 17 nt, Pseudomonas putida KT2440
gccugguuuucgcucgc

SEQ ID NO: 3542602 - RNA, 19 nt, Pseudomonas putida KT2440
gccugguuuucgcucgccg

SEQ ID NO: 3542603 - RNA, 20 nt, Pseudomonas putida KT2440
gccugguuuucgcucgccgg

SEQ ID NO: 3542604 - RNA, 19 nt, Pseudomonas putida KT2440
gccuguacacagcccaagg

SEQ ID NO: 3542605 - RNA, 20 nt, Pseudomonas putida KT2440
gccuguaccgaccucuucgc

SEQ ID NO: 3542606 - RNA, 21 nt, Pseudomonas putida KT2440
gccuguaccgaccucuucgcg

SEQ ID NO: 3542607 - RNA, 21 nt, Pseudomonas putida KT2440
gccuguaccgcccucuucgcg

SEQ ID NO: 3542608 - RNA, 14 nt, Pseudomonas putida KT2440
gccuguaccggccu

SEQ ID NO: 3542609 - RNA, 21 nt, Pseudomonas putida KT2440
gccuguaucggccucuucgcg

SEQ ID NO: 3542610 - RNA, 16 nt, Pseudomonas putida KT2440
gccugucacgccuuca

SEQ ID NO: 3542611 - RNA, 22 nt, Pseudomonas putida KT2440
gccugucacgccuucaaacacu

SEQ ID NO: 3542612 - RNA, 21 nt, Pseudomonas putida KT2440
gccugucaguuccugaaccac

SEQ ID NO: 3542613 - RNA, 13 nt, Pseudomonas putida KT2440
gccuguccaggca

SEQ ID NO: 3542614 - RNA, 14 nt, Pseudomonas putida KT2440
gccuguccaggcaa

SEQ ID NO: 3542615 - RNA, 17 nt, Pseudomonas putida KT2440
gccuguccccuuggccc

SEQ ID NO: 3542616 - RNA, 18 nt, Pseudomonas putida KT2440
gccuguccccuuggcccu

SEQ ID NO: 3542617 - RNA, 16 nt, Pseudomonas putida KT2440
gccuguccgggcucgu

SEQ ID NO: 3542618 - RNA, 16 nt, Pseudomonas putida KT2440
gccugucgcgacgggc

SEQ ID NO: 3542619 - RNA, 17 nt, Pseudomonas putida KT2440
gccugucgcgacgggcu

SEQ ID NO: 3542620 - RNA, 21 nt, Pseudomonas putida KT2440
gccugucuagccgccugccgc

SEQ ID NO: 3542621 - RNA, 20 nt, Pseudomonas putida KT2440
gccugucuggccucuucgcg

SEQ ID NO: 3542622 - RNA, 17 nt, Pseudomonas putida KT2440
gccugugagaucgagcg

SEQ ID NO: 3542623 - RNA, 18 nt, Pseudomonas putida KT2440
gccugugauuuacgcugg

SEQ ID NO: 3542624 - RNA, 13 nt, Pseudomonas putida KT2440
gccugugccgaac

SEQ ID NO: 3542625 - RNA, 15 nt, Pseudomonas putida KT2440
gccugugccggccgc

SEQ ID NO: 3542626 - RNA, 14 nt, Pseudomonas putida KT2440
gccugugcuggccu

SEQ ID NO: 3542627 - RNA, 21 nt, Pseudomonas putida KT2440
gccugugcuggccucuucgcg

SEQ ID NO: 3542628 - RNA, 20 nt, Pseudomonas putida KT2440
gccuguggggcaacugcgcg

SEQ ID NO: 3542629 - RNA, 14 nt, Pseudomonas putida KT2440
gccuguggguaacc

SEQ ID NO: 3542630 - RNA, 17 nt, Pseudomonas putida KT2440
gccugugucgaaccacu

SEQ ID NO: 3542631 - RNA, 20 nt, Pseudomonas putida KT2440
gccugugucgaaccacugau

SEQ ID NO: 3542632 - RNA, 17 nt, Pseudomonas putida KT2440
gccuguucgauuucacc

SEQ ID NO: 3542633 - RNA, 21 nt, Pseudomonas putida KT2440
gccuguucgauuucaccggcu

SEQ ID NO: 3542634 - RNA, 17 nt, Pseudomonas putida KT2440
gccuguugcgcacugcc

SEQ ID NO: 3542635 - RNA, 14 nt, Pseudomonas putida KT2440
gccuguuucucacg

SEQ ID NO: 3542636 - RNA, 19 nt, Pseudomonas putida KT2440
gccuguuucucacguucgc

SEQ ID NO: 3542637 - RNA, 15 nt, Pseudomonas putida KT2440
gccuguuuggccgca

SEQ ID NO: 3542638 - RNA, 15 nt, Pseudomonas putida KT2440
gccuguuuuccauug

SEQ ID NO: 3542639 - RNA, 17 nt, Pseudomonas putida KT2440
gccuguuuuccauugca

SEQ ID NO: 3542640 - RNA, 23 nt, Pseudomonas putida KT2440
gccuguuuuccauugcacacguu

SEQ ID NO: 3542641 - RNA, 21 nt, Pseudomonas putida KT2440
gccuucaaacacuucaucucg

SEQ ID NO: 3542642 - RNA, 16 nt, Pseudomonas putida KT2440
gccuucaagcucccca

SEQ ID NO: 3542643 - RNA, 22 nt, Pseudomonas putida KT2440
gccuucacacaggcugucggca

SEQ ID NO: 3542644 - RNA, 13 nt, Pseudomonas putida KT2440
gccuucaccagcu

SEQ ID NO: 3542645 - RNA, 17 nt, Pseudomonas putida KT2440
gccuucagcgccccauc

SEQ ID NO: 3542646 - RNA, 16 nt, Pseudomonas putida KT2440
gccuucaggcgcuggu

SEQ ID NO: 3542647 - RNA, 21 nt, Pseudomonas putida KT2440
gccuucaggguuguggugagc

SEQ ID NO: 3542648 - RNA, 20 nt, Pseudomonas putida KT2440
gccuucauaggcggccacgg

SEQ ID NO: 3542649 - RNA, 19 nt, Pseudomonas putida KT2440
gccuucaucacgcaccagg

SEQ ID NO: 3542650 - RNA, 14 nt, Pseudomonas putida KT2440
ggaacucgaucggc

SEQ ID NO: 3542651 - RNA, 18 nt, Pseudomonas putida KT2440
ggaacugcgcgagccaau

SEQ ID NO: 3542652 - RNA, 14 nt, Pseudomonas putida KT2440
ggaagaauugcugg

SEQ ID NO: 3542653 - RNA, 22 nt, Pseudomonas putida KT2440
ggaagaucaccuggucgaccga

SEQ ID NO: 3542654 - RNA, 23 nt, Pseudomonas putida KT2440
ggaagaucaccuggucgaccgac

SEQ ID NO: 3542655 - RNA, 17 nt, Pseudomonas putida KT2440
ggaagauugaaggggca

SEQ ID NO: 3542656 - RNA, 23 nt, Pseudomonas putida KT2440
ggaagcagaugaacccggcaaug

SEQ ID NO: 3542657 - RNA, 15 nt, Pseudomonas putida KT2440
ggaagccugcauccc

SEQ ID NO: 3542658 - RNA, 16 nt, Pseudomonas putida KT2440
ggaagcgcccgcccac

SEQ ID NO: 3542659 - RNA, 13 nt, Pseudomonas putida KT2440
ggaagcugggaau

SEQ ID NO: 3542660 - RNA, 19 nt, Pseudomonas putida KT2440
ggaagcuguacagcgcaua

SEQ ID NO: 3542661 - RNA, 21 nt, Pseudomonas putida KT2440
ggaaggcaccacggaaggcca

SEQ ID NO: 3542662 - RNA, 13 nt, Pseudomonas putida KT2440
ggaaggcagcggg

SEQ ID NO: 3542663 - RNA, 19 nt, Pseudomonas putida KT2440
ggaaggcgucacgcagggc

SEQ ID NO: 3542664 - RNA, 21 nt, Pseudomonas putida KT2440
ggaaggcgucacgcagggcca

SEQ ID NO: 3542665 - RNA, 17 nt, Pseudomonas putida KT2440
ggaaggcgucguacagg

SEQ ID NO: 3542666 - RNA, 14 nt, Pseudomonas putida KT2440
ggaagucgccgcgg

SEQ ID NO: 3542667 - RNA, 18 nt, Pseudomonas putida KT2440
ggcaacggcaauggccgg

SEQ ID NO: 3542668 - RNA, 15 nt, Pseudomonas putida KT2440
ggcaacggccacgcu

SEQ ID NO: 3542669 - RNA, 21 nt, Pseudomonas putida KT2440
ggcaacggccacgcugcggcg

SEQ ID NO: 3542670 - RNA, 14 nt, Pseudomonas putida KT2440
ggcaacuccuccag

SEQ ID NO: 3542671 - RNA, 16 nt, Pseudomonas putida KT2440
ggcaacuccuccagcc

SEQ ID NO: 3542672 - RNA, 14 nt, Pseudomonas putida KT2440
ggcaacugcgccug

SEQ ID NO: 3542673 - RNA, 17 nt, Pseudomonas putida KT2440
ggcaagccaaaguccug

SEQ ID NO: 3542674 - RNA, 17 nt, Pseudomonas putida KT2440
ggcaagcccauggcugg

SEQ ID NO: 3542675 - RNA, 15 nt, Pseudomonas putida KT2440
ggcaagcccgcgaag

SEQ ID NO: 3542676 - RNA, 21 nt, Pseudomonas putida KT2440
ggcaagcccgcgaagaggcca

SEQ ID NO: 3542677 - RNA, 23 nt, Pseudomonas putida KT2440
ggcaagcccgcgaagaggccagc

SEQ ID NO: 3542678 - RNA, 18 nt, Pseudomonas putida KT2440
ggcaagcccgcucccaca

SEQ ID NO: 3542679 - RNA, 19 nt, Pseudomonas putida KT2440
ggcaagcccgcuccuacag

SEQ ID NO: 3542680 - RNA, 19 nt, Pseudomonas putida KT2440
ggcacgcccagcaacugcg

SEQ ID NO: 3542681 - RNA, 22 nt, Pseudomonas putida KT2440
ggcacgcccauuuccgggcaau

SEQ ID NO: 3542682 - RNA, 21 nt, Pseudomonas putida KT2440
ggcacgcccgcucccacaggu

SEQ ID NO: 3542683 - RNA, 17 nt, Pseudomonas putida KT2440
ggcacgccuucagcagc

SEQ ID NO: 3542684 - RNA, 18 nt, Pseudomonas putida KT2440
ggcacgccuucagcagcc

SEQ ID NO: 3542685 - RNA, 19 nt, Pseudomonas putida KT2440
ggcacgcgccagcagcgcg

SEQ ID NO: 3542686 - RNA, 21 nt, Pseudomonas putida KT2440
ggcacggauuuuguucuccag

SEQ ID NO: 3542687 - RNA, 18 nt, Pseudomonas putida KT2440
ggcacggcaccagcacca

SEQ ID NO: 3542688 - RNA, 19 nt, Pseudomonas putida KT2440
ggcacggccgguacggcca

SEQ ID NO: 3542689 - RNA, 18 nt, Pseudomonas putida KT2440
ggcacgggccagcgcggu

SEQ ID NO: 3542690 - RNA, 19 nt, Pseudomonas putida KT2440
ggcacgggccagcgcggua

SEQ ID NO: 3542691 - RNA, 13 nt, Pseudomonas putida KT2440
ggcacggugcuac

SEQ ID NO: 3542692 - RNA, 23 nt, Pseudomonas putida KT2440
ggcacggugcuaccaaccuccag

SEQ ID NO: 3542693 - RNA, 13 nt, Pseudomonas putida KT2440
ggcacgguugcgc

SEQ ID NO: 3542694 - RNA, 22 nt, Pseudomonas putida KT2440
ggcacgguugcgcccggcgucg

SEQ ID NO: 3542695 - RNA, 16 nt, Pseudomonas putida KT2440
ggcacguuggugccgg

SEQ ID NO: 3542696 - RNA, 20 nt, Pseudomonas putida KT2440
ggcacuaccaggcccaacag

SEQ ID NO: 3542697 - RNA, 20 nt, Pseudomonas putida KT2440
ggcacuccagcgaguggcca

SEQ ID NO: 3542698 - RNA, 13 nt, Pseudomonas putida KT2440
ggcacucggucgg

SEQ ID NO: 3542699 - RNA, 17 nt, Pseudomonas putida KT2440
ggcacucggucggcugg

SEQ ID NO: 3542700 - RNA, 21 nt, Pseudomonas putida KT2440
ggcacugaccacuucaagcac

SEQ ID NO: 3542701 - RNA, 23 nt, Pseudomonas putida KT2440
ggcacugcccaagccauccacca

SEQ ID NO: 3542702 - RNA, 13 nt, Pseudomonas putida KT2440
ggcacuggccagc

SEQ ID NO: 3542703 - RNA, 23 nt, Pseudomonas putida KT2440
ggcacuggccagcggcgcggccu

SEQ ID NO: 3542704 - RNA, 15 nt, Pseudomonas putida KT2440
ggcacuggcgcgaug

SEQ ID NO: 3542705 - RNA, 22 nt, Pseudomonas putida KT2440
ggcacuucguuacccucggcau

SEQ ID NO: 3542706 - RNA, 23 nt, Pseudomonas putida KT2440
ggcacuuggcauuggccugggcc

SEQ ID NO: 3542707 - RNA, 14 nt, Pseudomonas putida KT2440
ggcacuugggaucg

SEQ ID NO: 3542708 - RNA, 16 nt, Pseudomonas putida KT2440
ggcacuugggaucgau

SEQ ID NO: 3542709 - RNA, 22 nt, Pseudomonas putida KT2440
ggcacuuguugguguggcagcu

SEQ ID NO: 3542710 - RNA, 22 nt, Pseudomonas putida KT2440
ggcagaacacaucgguacgccg

SEQ ID NO: 3542711 - RNA, 13 nt, Pseudomonas putida KT2440
ggcagaacaucgc

SEQ ID NO: 3542712 - RNA, 22 nt, Pseudomonas putida KT2440
ggcagaacaucgcccauugccg

SEQ ID NO: 3542713 - RNA, 21 nt, Pseudomonas putida KT2440
ggcagaaucagguucagggca

SEQ ID NO: 3542714 - RNA, 13 nt, Pseudomonas putida KT2440
ggcagaauuucag

SEQ ID NO: 3542715 - RNA, 22 nt, Pseudomonas putida KT2440
ggcagaauuucaggcugggugg

SEQ ID NO: 3542716 - RNA, 16 nt, Pseudomonas putida KT2440
ggcagacacaggcgcu

SEQ ID NO: 3542717 - RNA, 17 nt, Pseudomonas putida KT2440
ggcagacacaggcgcuc

SEQ ID NO: 3542718 - RNA, 14 nt, Pseudomonas putida KT2440
ggcagaccugcugg

SEQ ID NO: 3542719 - RNA, 13 nt, Pseudomonas putida KT2440
ggcagagcgccag

SEQ ID NO: 3542720 - RNA, 17 nt, Pseudomonas putida KT2440
ggcagagcgccagcauc

SEQ ID NO: 3542721 - RNA, 13 nt, Pseudomonas putida KT2440
ggcagauccugca

SEQ ID NO: 3542722 - RNA, 14 nt, Pseudomonas putida KT2440
ggcagaucgaaaga

SEQ ID NO: 3542723 - RNA, 16 nt, Pseudomonas putida KT2440
ggcagaucgaaagaca

SEQ ID NO: 3542724 - RNA, 21 nt, Pseudomonas putida KT2440
ggcagaucgaaagacagcgcg

SEQ ID NO: 3542725 - RNA, 19 nt, Pseudomonas putida KT2440
ggcagaucgagcgccgccc

SEQ ID NO: 3542726 - RNA, 13 nt, Pseudomonas putida KT2440
ggcagaugcgucu

SEQ ID NO: 3542727 - RNA, 17 nt, Pseudomonas putida KT2440
ggcagcaaggcauccag

SEQ ID NO: 3542728 - RNA, 20 nt, Pseudomonas putida KT2440
ggcagcaaguugaagaacag

SEQ ID NO: 3542729 - RNA, 24 nt, Pseudomonas putida KT2440
ggcagcaaguugaagaacagugug

SEQ ID NO: 3542730 - RNA, 14 nt, Pseudomonas putida KT2440
ggcagcaaucgccg

SEQ ID NO: 3542731 - RNA, 18 nt, Pseudomonas putida KT2440
ggcagcaaucggcagcgc

SEQ ID NO: 3542732 - RNA, 20 nt, Pseudomonas putida KT2440
ggcagcaccgcguaucaggc

SEQ ID NO: 3542733 - RNA, 19 nt, Pseudomonas putida KT2440
ggcagcaccgcugccagcu

SEQ ID NO: 3542734 - RNA, 20 nt, Pseudomonas putida KT2440
ggcagcaccgcugccagcug

SEQ ID NO: 3542735 - RNA, 23 nt, Pseudomonas putida KT2440
ggcagcaccgcugccagcugcgc

SEQ ID NO: 3542736 - RNA, 18 nt, Pseudomonas putida KT2440
ggcagcacgaucagcgcg

SEQ ID NO: 3542737 - RNA, 21 nt, Pseudomonas putida KT2440
ggcagcagcaaugccgaacag

SEQ ID NO: 3542738 - RNA, 17 nt, Pseudomonas putida KT2440
ggcagcagcagccccag

SEQ ID NO: 3542739 - RNA, 18 nt, Pseudomonas putida KT2440
ggcagcagccucggccuc

SEQ ID NO: 3542740 - RNA, 20 nt, Pseudomonas putida KT2440
ggcagcaggccaaugcccau

SEQ ID NO: 3542741 - RNA, 16 nt, Pseudomonas putida KT2440
ggcagcauauggcgcu

SEQ ID NO: 3542742 - RNA, 19 nt, Pseudomonas putida KT2440
ggcagcaucaccacgcccu

SEQ ID NO: 3542743 - RNA, 17 nt, Pseudomonas putida KT2440
ggcagcaucuucuucac

SEQ ID NO: 3542744 - RNA, 20 nt, Pseudomonas putida KT2440
ggcagcaugaacagcgcugc

SEQ ID NO: 3542745 - RNA, 22 nt, Pseudomonas putida KT2440
ggcagccaugcugucgaugucu

SEQ ID NO: 3542746 - RNA, 18 nt, Pseudomonas putida KT2440
ggcagcccccccagcaac

SEQ ID NO: 3542747 - RNA, 19 nt, Pseudomonas putida KT2440
ggcagcccuucgcgggcac

SEQ ID NO: 3542748 - RNA, 23 nt, Pseudomonas putida KT2440
ggcagcccuucgcgggcacgccc

SEQ ID NO: 3542749 - RNA, 15 nt, Pseudomonas putida KT2440
ggcagccgcguccuu

SEQ ID NO: 3542750 - RNA, 23 nt, Pseudomonas putida KT2440
ggcagccgcguccuugaucaggg

SEQ ID NO: 3542751 - RNA, 13 nt, Pseudomonas putida KT2440
ggcagccggcgcc

SEQ ID NO: 3542752 - RNA, 15 nt, Pseudomonas putida KT2440
ggcagccugccaggu

SEQ ID NO: 3542753 - RNA, 18 nt, Pseudomonas putida KT2440
ggcagcgaucagcgcaga

SEQ ID NO: 3542754 - RNA, 12 nt, Pseudomonas putida KT2440
ggcagcgaugcc

SEQ ID NO: 3542755 - RNA, 15 nt, Pseudomonas putida KT2440
ggcagcgaugccggg

SEQ ID NO: 3542756 - RNA, 18 nt, Pseudomonas putida KT2440
ggcagcgcaaucaccgcc

SEQ ID NO: 3542757 - RNA, 16 nt, Pseudomonas putida KT2440
ggcagcgcggccgggu

SEQ ID NO: 3542758 - RNA, 20 nt, Pseudomonas putida KT2440
ggcagcgcgggcagaugagg

SEQ ID NO: 3542759 - RNA, 12 nt, Pseudomonas putida KT2440
ggcagcggcugg

SEQ ID NO: 3542760 - RNA, 16 nt, Pseudomonas putida KT2440
ggcagcgggcucgccc

SEQ ID NO: 3542761 - RNA, 17 nt, Pseudomonas putida KT2440
ggcagcgggcucgccca

SEQ ID NO: 3542762 - RNA, 19 nt, Pseudomonas putida KT2440
ggcagcuacgagacggugg

SEQ ID NO: 3542763 - RNA, 15 nt, Pseudomonas putida KT2440
ggcagcucgagcaug

SEQ ID NO: 3542764 - RNA, 12 nt, Pseudomonas putida KT2440
ggcagcucgccg

SEQ ID NO: 3542765 - RNA, 15 nt, Pseudomonas putida KT2440
ggcagcucgccgugg

SEQ ID NO: 3542766 - RNA, 18 nt, Pseudomonas putida KT2440
ggcagcugcagugcuggg

SEQ ID NO: 3542767 - RNA, 13 nt, Pseudomonas putida KT2440
ggcagcugcugac

SEQ ID NO: 3542768 - RNA, 18 nt, Pseudomonas putida KT2440
ggcaggaaacaccagggu

SEQ ID NO: 3542769 - RNA, 12 nt, Pseudomonas putida KT2440
ggcaggccagca

SEQ ID NO: 3542770 - RNA, 16 nt, Pseudomonas putida KT2440
ggcaggcccagguaac

SEQ ID NO: 3542771 - RNA, 22 nt, Pseudomonas putida KT2440
ggcaggcccggcagguugaugu

SEQ ID NO: 3542772 - RNA, 15 nt, Pseudomonas putida KT2440
ggcaggccggccacc

SEQ ID NO: 3542773 - RNA, 17 nt, Pseudomonas putida KT2440
ggcaggccuuguuccac

SEQ ID NO: 3542774 - RNA, 13 nt, Pseudomonas putida KT2440
gcguuggccaggu

SEQ ID NO: 3542775 - RNA, 18 nt, Pseudomonas putida KT2440
gcguuggccgaaggccgu

SEQ ID NO: 3542776 - RNA, 22 nt, Pseudomonas putida KT2440
gcguuggcguuauugcacuucc

SEQ ID NO: 3542777 - RNA, 20 nt, Pseudomonas putida KT2440
gcguugucgacugcacugcc

SEQ ID NO: 3542778 - RNA, 22 nt, Pseudomonas putida KT2440
gcguugucgacugcacugccag

SEQ ID NO: 3542779 - RNA, 15 nt, Pseudomonas putida KT2440
gcguuguguugcugg

SEQ ID NO: 3542780 - RNA, 19 nt, Pseudomonas putida KT2440
gcguuguucagcagcgaag

SEQ ID NO: 3542781 - RNA, 14 nt, Pseudomonas putida KT2440
gcguuucgcuggcc

SEQ ID NO: 3542782 - RNA, 15 nt, Pseudomonas putida KT2440
gcguuucuucauccc

SEQ ID NO: 3542783 - RNA, 16 nt, Pseudomonas putida KT2440
gcguuucuucaucccu

SEQ ID NO: 3542784 - RNA, 17 nt, Pseudomonas putida KT2440
gcguuugcgaaccucag

SEQ ID NO: 3542785 - RNA, 19 nt, Pseudomonas putida KT2440
gcguuugcgagcgcgggca

SEQ ID NO: 3542786 - RNA, 14 nt, Pseudomonas putida KT2440
gcguuuuauaaaga

SEQ ID NO: 3542787 - RNA, 22 nt, Pseudomonas putida KT2440
gcguuuucuucaagcagcgaau

SEQ ID NO: 3542788 - RNA, 21 nt, Pseudomonas putida KT2440
gcguuuuucucgaugaugcug

SEQ ID NO: 3542789 - RNA, 21 nt, Pseudomonas putida KT2440
gcguuuuuguuuggguugccu

SEQ ID NO: 3542790 - RNA, 19 nt, Pseudomonas putida KT2440
gcuaaaccgcgaugcugca

SEQ ID NO: 3542791 - RNA, 18 nt, Pseudomonas putida KT2440
gcuaaacgaguuucucgc

SEQ ID NO: 3542792 - RNA, 15 nt, Pseudomonas putida KT2440
gcuaaagaguccgaa

SEQ ID NO: 3542793 - RNA, 19 nt, Pseudomonas putida KT2440
gcuaaagccgcaccuacag

SEQ ID NO: 3542794 - RNA, 19 nt, Pseudomonas putida KT2440
gcuaacgacccaaaaaugg

SEQ ID NO: 3542795 - RNA, 16 nt, Pseudomonas putida KT2440
gcuacaccggccugga

SEQ ID NO: 3542796 - RNA, 17 nt, Pseudomonas putida KT2440
gcuacagaagccucacc

SEQ ID NO: 3542797 - RNA, 22 nt, Pseudomonas putida KT2440
gcuacagaagccucaccgccgc

SEQ ID NO: 3542798 - RNA, 14 nt, Pseudomonas putida KT2440
gcuacagccccuuc

SEQ ID NO: 3542799 - RNA, 21 nt, Pseudomonas putida KT2440
gcuacagccccuuccccaggc

SEQ ID NO: 3542800 - RNA, 22 nt, Pseudomonas putida KT2440
gcuacagccccuuccccaggcc

SEQ ID NO: 3542801 - RNA, 15 nt, Pseudomonas putida KT2440
gcuacaugaaccaca

SEQ ID NO: 3542802 - RNA, 17 nt, Pseudomonas putida KT2440
gcuacaugaaccacaca

SEQ ID NO: 3542803 - RNA, 15 nt, Pseudomonas putida KT2440
gcuaccaaucuguac

SEQ ID NO: 3542804 - RNA, 23 nt, Pseudomonas putida KT2440
gcuggccgccacggugccgaaca

SEQ ID NO: 3542805 - RNA, 19 nt, Pseudomonas putida KT2440
gcuggccgcccgcccgcgu

SEQ ID NO: 3542806 - RNA, 14 nt, Pseudomonas putida KT2440
gcuggccgguggcu

SEQ ID NO: 3542807 - RNA, 16 nt, Pseudomonas putida KT2440
gcuggccgguggcuuc

SEQ ID NO: 3542808 - RNA, 22 nt, Pseudomonas putida KT2440
gcuggccgucacauaguugggc

SEQ ID NO: 3542809 - RNA, 19 nt, Pseudomonas putida KT2440
gcuggccguccagcugagc

SEQ ID NO: 3542810 - RNA, 14 nt, Pseudomonas putida KT2440
gcuggccgugguga

SEQ ID NO: 3542811 - RNA, 22 nt, Pseudomonas putida KT2440
gcuggccguggugauguucuca

SEQ ID NO: 3542812 - RNA, 20 nt, Pseudomonas putida KT2440
gcuggccucacaucgcgcag

SEQ ID NO: 3542813 - RNA, 16 nt, Pseudomonas putida KT2440
gcuggccucuucgcgg

SEQ ID NO: 3542814 - RNA, 17 nt, Pseudomonas putida KT2440
gcuggccucuucgcggg

SEQ ID NO: 3542815 - RNA, 18 nt, Pseudomonas putida KT2440
gcuggccugcagccguug

SEQ ID NO: 3542816 - RNA, 21 nt, Pseudomonas putida KT2440
gcuggccuucgaacagcgaag

SEQ ID NO: 3542817 - RNA, 21 nt, Pseudomonas putida KT2440
gcuggccuuggacaccaggcu

SEQ ID NO: 3542818 - RNA, 18 nt, Pseudomonas putida KT2440
gcuggccuuguacaacgc

SEQ ID NO: 3542819 - RNA, 23 nt, Pseudomonas putida KT2440
gcuggccuuguacaacgccuuga

SEQ ID NO: 3542820 - RNA, 17 nt, Pseudomonas putida KT2440
gcuggccuuuucgcggg

SEQ ID NO: 3542821 - RNA, 17 nt, Pseudomonas putida KT2440
gcuggcgacgaagcugc

SEQ ID NO: 3542822 - RNA, 17 nt, Pseudomonas putida KT2440
gcuggcgaucaggcagg

SEQ ID NO: 3542823 - RNA, 20 nt, Pseudomonas putida KT2440
gcuggcgaucaggcaggcca

SEQ ID NO: 3542824 - RNA, 17 nt, Pseudomonas putida KT2440
gcuggcgaucggcuggu

SEQ ID NO: 3542825 - RNA, 21 nt, Pseudomonas putida KT2440
gcuggcgaugaagacgcucga

SEQ ID NO: 3542826 - RNA, 17 nt, Pseudomonas putida KT2440
gcuggcgccagcgaugc

SEQ ID NO: 3542827 - RNA, 13 nt, Pseudomonas putida KT2440
gcuggcgcgacca

SEQ ID NO: 3542828 - RNA, 20 nt, Pseudomonas putida KT2440
gcuggcgcgaccaucaccgc

SEQ ID NO: 3542829 - RNA, 12 nt, Pseudomonas putida KT2440
gcuggcgcgcug

SEQ ID NO: 3542830 - RNA, 20 nt, Pseudomonas putida KT2440
gcuggcgcucaauggcaccg

SEQ ID NO: 3542831 - RNA, 16 nt, Pseudomonas putida KT2440
gcuggcgcuggucaau

SEQ ID NO: 3542832 - RNA, 22 nt, Pseudomonas putida KT2440
gcuggcgcuuccuuccuggaag

SEQ ID NO: 3542833 - RNA, 17 nt, Pseudomonas putida KT2440
gcuggcggcugagccgg

SEQ ID NO: 3542834 - RNA, 18 nt, Pseudomonas putida KT2440
gcuggcgggcaaacuggc

SEQ ID NO: 3542835 - RNA, 15 nt, Pseudomonas putida KT2440
gcuggcgguguagaa

SEQ ID NO: 3542836 - RNA, 23 nt, Pseudomonas putida KT2440
gcuggcgucauccugcgcggcca

SEQ ID NO: 3542837 - RNA, 19 nt, Pseudomonas putida KT2440
gcuggcgucgaugaucacc

SEQ ID NO: 3542838 - RNA, 13 nt, Pseudomonas putida KT2440
gcuggcuacccgc

SEQ ID NO: 3542839 - RNA, 19 nt, Pseudomonas putida KT2440
gcuggcuacccgcucggcc

SEQ ID NO: 3542840 - RNA, 22 nt, Pseudomonas putida KT2440
gcuggcuacccgcucggccuug

SEQ ID NO: 3542841 - RNA, 13 nt, Pseudomonas putida KT2440
gcuggcucagcga

SEQ ID NO: 3542842 - RNA, 14 nt, Pseudomonas putida KT2440
gcuggcucagcgag

SEQ ID NO: 3542843 - RNA, 21 nt, Pseudomonas putida KT2440
gcuggcucaucugccggcgaa

SEQ ID NO: 3542844 - RNA, 14 nt, Pseudomonas putida KT2440
gcuggcugaucagc

SEQ ID NO: 3542845 - RNA, 17 nt, Pseudomonas putida KT2440
gcuggcugucgaaggcu

SEQ ID NO: 3542846 - RNA, 22 nt, Pseudomonas putida KT2440
gcuggcuuacaucaugccgccc

SEQ ID NO: 3542847 - RNA, 18 nt, Pseudomonas putida KT2440
gcuggcuuuggagccugc

SEQ ID NO: 3542848 - RNA, 17 nt, Pseudomonas putida KT2440
gcugggaauccagugca

SEQ ID NO: 3542849 - RNA, 22 nt, Pseudomonas putida KT2440
gcugggaauccagugcaggucu

SEQ ID NO: 3542850 - RNA, 23 nt, Pseudomonas putida KT2440
gcugggaauccagugcaggucua

SEQ ID NO: 3542851 - RNA, 23 nt, Pseudomonas putida KT2440
gcugggcacccugaucgaugagc

SEQ ID NO: 3542852 - RNA, 20 nt, Pseudomonas putida KT2440
gcugggcacggcgcugucgg

SEQ ID NO: 3542853 - RNA, 21 nt, Pseudomonas putida KT2440
gcugggcaucgacaaucggcu

SEQ ID NO: 3542854 - RNA, 17 nt, Pseudomonas putida KT2440
gcugggccccaggcggu

SEQ ID NO: 3542855 - RNA, 19 nt, Pseudomonas putida KT2440
gcugggcccgcccagcugg

SEQ ID NO: 3542856 - RNA, 24 nt, Pseudomonas putida KT2440
gcugggcgaacgccugcagggccu

SEQ ID NO: 3542857 - RNA, 23 nt, Pseudomonas putida KT2440
gcugggcgaugaucgccuggccg

SEQ ID NO: 3542858 - RNA, 20 nt, Pseudomonas putida KT2440
gcugggcgucaaccaauguc

SEQ ID NO: 3542859 - RNA, 17 nt, Pseudomonas putida KT2440
gcugggcgugccaggcu

SEQ ID NO: 3542860 - RNA, 19 nt, Pseudomonas putida KT2440
gcugggcuucgacaaccgg

SEQ ID NO: 3542861 - RNA, 20 nt, Pseudomonas putida KT2440
gcugggcuucgacaaccggg

SEQ ID NO: 3542862 - RNA, 22 nt, Pseudomonas putida KT2440
gcugggcuucuucgugcgccuc

SEQ ID NO: 3542863 - RNA, 23 nt, Pseudomonas putida KT2440
gcugggcuucuucgugcgccuca

SEQ ID NO: 3542864 - RNA, 23 nt, Pseudomonas putida KT2440
gcuggggauggcaccggcucugc

SEQ ID NO: 3542865 - RNA, 19 nt, Pseudomonas putida KT2440
gcuggggccgcaaagcggc

SEQ ID NO: 3542866 - RNA, 21 nt, Pseudomonas putida KT2440
gcugguaagccucgagcgcuu

SEQ ID NO: 3542867 - RNA, 16 nt, Pseudomonas putida KT2440
gcugguacagggucag

SEQ ID NO: 3542868 - RNA, 12 nt, Pseudomonas putida KT2440
gcugguacucca

SEQ ID NO: 3542869 - RNA, 23 nt, Pseudomonas putida KT2440
gcugguagagaaugucgcggcua

SEQ ID NO: 3542870 - RNA, 17 nt, Pseudomonas putida KT2440
gcugguccacgguucug

SEQ ID NO: 3542871 - RNA, 19 nt, Pseudomonas putida KT2440
gcugguccgggcccaugcc

SEQ ID NO: 3542872 - RNA, 22 nt, Pseudomonas putida KT2440
gcugguccgggcccaugccacg

SEQ ID NO: 3542873 - RNA, 17 nt, Pseudomonas putida KT2440
gcuggucgaggcggcug

SEQ ID NO: 3542874 - RNA, 18 nt, Pseudomonas putida KT2440
gcuggucgccgugcagca

SEQ ID NO: 3542875 - RNA, 22 nt, Pseudomonas putida KT2440
gcuggucggcuauggcgcggug

SEQ ID NO: 3542876 - RNA, 18 nt, Pseudomonas putida KT2440
gcuggugaaggcagguca

SEQ ID NO: 3542877 - RNA, 23 nt, Pseudomonas putida KT2440
gcuggugacaacgcccgccguca

SEQ ID NO: 3542878 - RNA, 19 nt, Pseudomonas putida KT2440
gcuggugcaguggcuguac

SEQ ID NO: 3542879 - RNA, 12 nt, Pseudomonas putida KT2440
gcugguggcggc

SEQ ID NO: 3542880 - RNA, 15 nt, Pseudomonas putida KT2440
gcuggugggcgauga

SEQ ID NO: 3542881 - RNA, 17 nt, Pseudomonas putida KT2440
gcuggugguggcccuga

SEQ ID NO: 3542882 - RNA, 19 nt, Pseudomonas putida KT2440
gcuggugguggcccugacc

SEQ ID NO: 3542883 - RNA, 18 nt, Pseudomonas putida KT2440
gcugguguguugaagucc

SEQ ID NO: 3542884 - RNA, 18 nt, Pseudomonas putida KT2440
gcugguuaugagccuaca

SEQ ID NO: 3542885 - RNA, 22 nt, Pseudomonas putida KT2440
gcugguucauugccaacagcag

SEQ ID NO: 3542886 - RNA, 21 nt, Pseudomonas putida KT2440
gcugguucgauuccagcaggg

SEQ ID NO: 3542887 - RNA, 15 nt, Pseudomonas putida KT2440
gcugguucugcugca

SEQ ID NO: 3542888 - RNA, 21 nt, Pseudomonas putida KT2440
gcugguuuaucagcagcucga

SEQ ID NO: 3542889 - RNA, 16 nt, Pseudomonas putida KT2440
gcugguuuggcagcac

SEQ ID NO: 3542890 - RNA, 16 nt, Pseudomonas putida KT2440
gcuguaauugccaacu

SEQ ID NO: 3542891 - RNA, 14 nt, Pseudomonas putida KT2440
gcuguacaacgcag

SEQ ID NO: 3542892 - RNA, 22 nt, Pseudomonas putida KT2440
gcuguacaacgcagccggcacc

SEQ ID NO: 3542893 - RNA, 14 nt, Pseudomonas putida KT2440
gcuguacagcgcau

SEQ ID NO: 3542894 - RNA, 15 nt, Pseudomonas putida KT2440
gcuguacaggugcga

SEQ ID NO: 3542895 - RNA, 13 nt, Pseudomonas putida KT2440
gcuguaccggccu

SEQ ID NO: 3542896 - RNA, 13 nt, Pseudomonas putida KT2440
gcuguacgcuggc

SEQ ID NO: 3542897 - RNA, 15 nt, Pseudomonas putida KT2440
gcuguacgcuggcca

SEQ ID NO: 3542898 - RNA, 17 nt, Pseudomonas putida KT2440
gcuguacgcuggccaag

SEQ ID NO: 3542899 - RNA, 15 nt, Pseudomonas putida KT2440
gcuguagcgcccaca

SEQ ID NO: 3542900 - RNA, 20 nt, Pseudomonas putida KT2440
gcuguaggggcgggccugcu

SEQ ID NO: 3542901 - RNA, 22 nt, Pseudomonas putida KT2440
gcuguaugauucgccucccgcu

SEQ ID NO: 3542902 - RNA, 15 nt, Pseudomonas putida KT2440
gcugucaccauugcu

SEQ ID NO: 3542903 - RNA, 23 nt, Pseudomonas putida KT2440
gcugucacgaugaugcuauggcu

SEQ ID NO: 3542904 - RNA, 18 nt, Pseudomonas putida KT2440
gcuguccagcaagggccu

SEQ ID NO: 3542905 - RNA, 16 nt, Pseudomonas putida KT2440
gcuguccagcgcauca

SEQ ID NO: 3542906 - RNA, 21 nt, Pseudomonas putida KT2440
gcuguccucaaucacauccac

SEQ ID NO: 3542907 - RNA, 22 nt, Pseudomonas putida KT2440
gcuguccuuggccaacugcagc

SEQ ID NO: 3542908 - RNA, 17 nt, Pseudomonas putida KT2440
gcuucgcugccaggaag

SEQ ID NO: 3542909 - RNA, 16 nt, Pseudomonas putida KT2440
gcuucggcaugcacgg

SEQ ID NO: 3542910 - RNA, 15 nt, Pseudomonas putida KT2440
gcuucggcgcgggca

SEQ ID NO: 3542911 - RNA, 19 nt, Pseudomonas putida KT2440
gcuucggcgggguuuuuuc

SEQ ID NO: 3542912 - RNA, 16 nt, Pseudomonas putida KT2440
gcuucgggaauaccag

SEQ ID NO: 3542913 - RNA, 22 nt, Pseudomonas putida KT2440
gcuucggugugcuccagcucca

SEQ ID NO: 3542914 - RNA, 14 nt, Pseudomonas putida KT2440
gcuucguccaggua

SEQ ID NO: 3542915 - RNA, 16 nt, Pseudomonas putida KT2440
gcuucguccagguagu

SEQ ID NO: 3542916 - RNA, 20 nt, Pseudomonas putida KT2440
gcuucguccguguucgcgag

SEQ ID NO: 3542917 - RNA, 19 nt, Pseudomonas putida KT2440
gcuucgucggugcccuuca

SEQ ID NO: 3542918 - RNA, 23 nt, Pseudomonas putida KT2440
gcuucgucggugcccuucacugg

SEQ ID NO: 3542919 - RNA, 19 nt, Pseudomonas putida KT2440
gcuucgugcagguugcugg

SEQ ID NO: 3542920 - RNA, 17 nt, Pseudomonas putida KT2440
gcuucguggaagacgaa

SEQ ID NO: 3542921 - RNA, 14 nt, Pseudomonas putida KT2440
gcuucuaccacugg

SEQ ID NO: 3542922 - RNA, 22 nt, Pseudomonas putida KT2440
gcuucuaccacuggggcuucug

SEQ ID NO: 3542923 - RNA, 18 nt, Pseudomonas putida KT2440
gcuucuccagcaagcgcu

SEQ ID NO: 3542924 - RNA, 17 nt, Pseudomonas putida KT2440
gcuucucgcgcuuggcc

SEQ ID NO: 3542925 - RNA, 19 nt, Pseudomonas putida KT2440
gcuucucgcgcuuggccag

SEQ ID NO: 3542926 - RNA, 13 nt, Pseudomonas putida KT2440
gcuucucggcaaa

SEQ ID NO: 3542927 - RNA, 13 nt, Pseudomonas putida KT2440
gcuucugagccag

SEQ ID NO: 3542928 - RNA, 15 nt, Pseudomonas putida KT2440
gcuucugagccagcc

SEQ ID NO: 3542929 - RNA, 21 nt, Pseudomonas putida KT2440
gcuucugcagauccuugauca

SEQ ID NO: 3542930 - RNA, 14 nt, Pseudomonas putida KT2440
gcuucugccguuca

SEQ ID NO: 3542931 - RNA, 13 nt, Pseudomonas putida KT2440
gcuucugcuucag

SEQ ID NO: 3542932 - RNA, 15 nt, Pseudomonas putida KT2440
gcuucugcuucagcu

SEQ ID NO: 3542933 - RNA, 16 nt, Pseudomonas putida KT2440
gcuucugcuucagcuc

SEQ ID NO: 3542934 - RNA, 18 nt, Pseudomonas putida KT2440
gcuucugcuucagcucga

SEQ ID NO: 3542935 - RNA, 18 nt, Pseudomonas putida KT2440
gcuucuggauaugcucca

SEQ ID NO: 3542936 - RNA, 14 nt, Pseudomonas putida KT2440
gcuucuggcccugg

SEQ ID NO: 3542937 - RNA, 17 nt, Pseudomonas putida KT2440
gcuucuggcgcguguca

SEQ ID NO: 3542938 - RNA, 12 nt, Pseudomonas putida KT2440
gcuucugguugu

SEQ ID NO: 3542939 - RNA, 14 nt, Pseudomonas putida KT2440
gcuucuguaccgcc

SEQ ID NO: 3542940 - RNA, 18 nt, Pseudomonas putida KT2440
gcuucuucacaccggccu

SEQ ID NO: 3542941 - RNA, 14 nt, Pseudomonas putida KT2440
gcuucuucgcgggc

SEQ ID NO: 3542942 - RNA, 13 nt, Pseudomonas putida KT2440
gcuugaacaacgg

SEQ ID NO: 3542943 - RNA, 17 nt, Pseudomonas putida KT2440
gcuugaacaacggcgcu

SEQ ID NO: 3542944 - RNA, 21 nt, Pseudomonas putida KT2440
gcuugaacacauagaacaggu

SEQ ID NO: 3542945 - RNA, 15 nt, Pseudomonas putida KT2440
gcuugaagcggccua

SEQ ID NO: 3542946 - RNA, 16 nt, Pseudomonas putida KT2440
gcuugaagcugcgcuc

SEQ ID NO: 3542947 - RNA, 17 nt, Pseudomonas putida KT2440
gcuugaagcugcgcucg

SEQ ID NO: 3542948 - RNA, 14 nt, Pseudomonas putida KT2440
gcuugaaucagccu

SEQ ID NO: 3542949 - RNA, 20 nt, Pseudomonas putida KT2440
gcuugacagcguuggcacga

SEQ ID NO: 3542950 - RNA, 13 nt, Pseudomonas putida KT2440
gcuugaccauggc

SEQ ID NO: 3542951 - RNA, 15 nt, Pseudomonas putida KT2440
gcuugaccauggcga

SEQ ID NO: 3542952 - RNA, 19 nt, Pseudomonas putida KT2440
gcuugacgaucgccagccc

SEQ ID NO: 3542953 - RNA, 22 nt, Pseudomonas putida KT2440
gcuugacgaucgccagccccag

SEQ ID NO: 3542954 - RNA, 18 nt, Pseudomonas putida KT2440
gcuugagaccaggccugg

SEQ ID NO: 3542955 - RNA, 19 nt, Pseudomonas putida KT2440
gcuugagccuugugcugug

SEQ ID NO: 3542956 - RNA, 19 nt, Pseudomonas putida KT2440
gcuugagcgcgccgccuuc

SEQ ID NO: 3542957 - RNA, 13 nt, Pseudomonas putida KT2440
gcuugagcuccga

SEQ ID NO: 3542958 - RNA, 16 nt, Pseudomonas putida KT2440
gcuugagcucggcaaa

SEQ ID NO: 3542959 - RNA, 13 nt, Pseudomonas putida KT2440
gcuugaggcccau

SEQ ID NO: 3542960 - RNA, 15 nt, Pseudomonas putida KT2440
gcuugaggcccaugu

SEQ ID NO: 3542961 - RNA, 16 nt, Pseudomonas putida KT2440
gcuugaggucgccagg

SEQ ID NO: 3542962 - RNA, 13 nt, Pseudomonas putida KT2440
gcuugaggugcca

SEQ ID NO: 3542963 - RNA, 16 nt, Pseudomonas putida KT2440
gcuugaggugcucgac

SEQ ID NO: 3542964 - RNA, 18 nt, Pseudomonas putida KT2440
gcuugagucucggcuagc

SEQ ID NO: 3542965 - RNA, 20 nt, Pseudomonas putida KT2440
gcuugaguugaguggggugg

SEQ ID NO: 3542966 - RNA, 20 nt, Pseudomonas putida KT2440
gcuugauauccagcaccggc

SEQ ID NO: 3542967 - RNA, 13 nt, Pseudomonas putida KT2440
gcuugaucagccu

SEQ ID NO: 3542968 - RNA, 14 nt, Pseudomonas putida KT2440
gcuugcacagguau

SEQ ID NO: 3542969 - RNA, 13 nt, Pseudomonas putida KT2440
gcuugcaccgaca

SEQ ID NO: 3542970 - RNA, 12 nt, Pseudomonas putida KT2440
gcuugcagcgcu

SEQ ID NO: 3542971 - RNA, 17 nt, Pseudomonas putida KT2440
gcuugcaguuguccagg

SEQ ID NO: 3542972 - RNA, 15 nt, Pseudomonas putida KT2440
gcuugcaucaaauuu

SEQ ID NO: 3542973 - RNA, 17 nt, Pseudomonas putida KT2440
gcuugccacccaggccc

SEQ ID NO: 3542974 - RNA, 20 nt, Pseudomonas putida KT2440
gcuugccacggcguggagcg

SEQ ID NO: 3542975 - RNA, 14 nt, Pseudomonas putida KT2440
gcuugccagcgucu

SEQ ID NO: 3542976 - RNA, 15 nt, Pseudomonas putida KT2440
gcuugccagcguucu

SEQ ID NO: 3542977 - RNA, 20 nt, Pseudomonas putida KT2440
gcuugcccaugaagcggccg

SEQ ID NO: 3542978 - RNA, 18 nt, Pseudomonas putida KT2440
gcuugcccgcgaacacgg

SEQ ID NO: 3542979 - RNA, 20 nt, Pseudomonas putida KT2440
gcuugcccgcgaacacgggc

SEQ ID NO: 3542980 - RNA, 22 nt, Pseudomonas putida KT2440
gcuugcccgcgaagaggccagc

SEQ ID NO: 3542981 - RNA, 22 nt, Pseudomonas putida KT2440
gcuugcccgcgaagaggccggu

SEQ ID NO: 3542982 - RNA, 20 nt, Pseudomonas putida KT2440
gcuugcccgcgaagggccgc

SEQ ID NO: 3542983 - RNA, 22 nt, Pseudomonas putida KT2440
gcuugcccgcgaagggccgcca

SEQ ID NO: 3542984 - RNA, 17 nt, Pseudomonas putida KT2440
gcuugccgaucagcgag

SEQ ID NO: 3542985 - RNA, 15 nt, Pseudomonas putida KT2440
gcuugccgcgugcga

SEQ ID NO: 3542986 - RNA, 21 nt, Pseudomonas putida KT2440
gcuugccgcuggcauccacca

SEQ ID NO: 3542987 - RNA, 15 nt, Pseudomonas putida KT2440
gcuugccggaagauc

SEQ ID NO: 3542988 - RNA, 19 nt, Pseudomonas putida KT2440
gcuugccggaagaucaggc

SEQ ID NO: 3542989 - RNA, 13 nt, Pseudomonas putida KT2440
gcuugccggcaau

SEQ ID NO: 3542990 - RNA, 15 nt, Pseudomonas putida KT2440
gcuugccggcaauac

SEQ ID NO: 3542991 - RNA, 13 nt, Pseudomonas putida KT2440
gcuugccgggugc

SEQ ID NO: 3542992 - RNA, 16 nt, Pseudomonas putida KT2440
gcuugccuuccgggaa

SEQ ID NO: 3542993 - RNA, 17 nt, Pseudomonas putida KT2440
gcuugccuuccucggcc

SEQ ID NO: 3542994 - RNA, 23 nt, Pseudomonas putida KT2440
gcuugccuuccucggccaugcgc

SEQ ID NO: 3542995 - RNA, 22 nt, Pseudomonas putida KT2440
gcuugcgacuugugcauccugc

SEQ ID NO: 3542996 - RNA, 13 nt, Pseudomonas putida KT2440
gcuugcgcugaag

SEQ ID NO: 3542997 - RNA, 22 nt, Pseudomonas putida KT2440
gcuugcucgcggcgcagggugu

SEQ ID NO: 3542998 - RNA, 17 nt, Pseudomonas putida KT2440
gcuuggaguugcucgag

SEQ ID NO: 3542999 - RNA, 14 nt, Pseudomonas putida KT2440
gcuuggcaccggca

SEQ ID NO: 3543000 - RNA, 19 nt, Pseudomonas putida KT2440
gcuuggcaccggcagcagc

SEQ ID NO: 3543001 - RNA, 19 nt, Pseudomonas putida KT2440
gcuuggcaccuaucgcugc

SEQ ID NO: 3543002 - RNA, 23 nt, Pseudomonas putida KT2440
gcuuggcagcaccgcugccagcu

SEQ ID NO: 3543003 - RNA, 12 nt, Pseudomonas putida KT2440
gcuuggcaggcu

SEQ ID NO: 3543004 - RNA, 15 nt, Pseudomonas putida KT2440
gcuuggccaccacgu

SEQ ID NO: 3543005 - RNA, 18 nt, Pseudomonas putida KT2440
gcuuggccaccacguagu

SEQ ID NO: 3543006 - RNA, 23 nt, Pseudomonas putida KT2440
gcuuggccagaaacggcggcaga

SEQ ID NO: 3543007 - RNA, 19 nt, Pseudomonas putida KT2440
gcuuggccagggugcgggc

SEQ ID NO: 3543008 - RNA, 21 nt, Pseudomonas putida KT2440
gcuuggcggcccauucgcggg

SEQ ID NO: 3543009 - RNA, 17 nt, Pseudomonas putida KT2440
gcuuggcuucggcggcu

SEQ ID NO: 3543010 - RNA, 22 nt, Pseudomonas putida KT2440
gcuuggcuuucggcgcacccgg

SEQ ID NO: 3543011 - RNA, 14 nt, Pseudomonas putida KT2440
gcuuggggccgcuc

SEQ ID NO: 3543012 - RNA, 15 nt, Pseudomonas putida KT2440
gcuuggucucguugc

SEQ ID NO: 3543013 - RNA, 14 nt, Pseudomonas putida KT2440
gcuuguccaucccc

SEQ ID NO: 3543014 - RNA, 20 nt, Pseudomonas putida KT2440
cugaggcccgaagguguuug

SEQ ID NO: 3543015 - RNA, 13 nt, Pseudomonas putida KT2440
cugaggcugcgcc

SEQ ID NO: 3543016 - RNA, 21 nt, Pseudomonas putida KT2440
cugaggguuguugaagaagaa

SEQ ID NO: 3543017 - RNA, 16 nt, Pseudomonas putida KT2440
cugagguucagcgcac

SEQ ID NO: 3543018 - RNA, 23 nt, Pseudomonas putida KT2440
cugaguauucuccuucuuccaga

SEQ ID NO: 3543019 - RNA, 13 nt, Pseudomonas putida KT2440
cugagucagcuug

SEQ ID NO: 3543020 - RNA, 13 nt, Pseudomonas putida KT2440
cugaguccgccac

SEQ ID NO: 3543021 - RNA, 16 nt, Pseudomonas putida KT2440
cugagucggccucgau

SEQ ID NO: 3543022 - RNA, 11 nt, Pseudomonas putida KT2440
cugagucuggc

SEQ ID NO: 3543023 - RNA, 16 nt, Pseudomonas putida KT2440
cugauagccagggccu

SEQ ID NO: 3543024 - RNA, 22 nt, Pseudomonas putida KT2440
cugauagcgcuuuuccaguucc

SEQ ID NO: 3543025 - RNA, 16 nt, Pseudomonas putida KT2440
cugaucaccgccgcca

SEQ ID NO: 3543026 - RNA, 17 nt, Pseudomonas putida KT2440
cugaucaccgccgccac

SEQ ID NO: 3543027 - RNA, 15 nt, Pseudomonas putida KT2440
cugaucacuugcuca

SEQ ID NO: 3543028 - RNA, 16 nt, Pseudomonas putida KT2440
cugauccgccuggccc

SEQ ID NO: 3543029 - RNA, 17 nt, Pseudomonas putida KT2440
cugauccgccuggcccg

SEQ ID NO: 3543030 - RNA, 21 nt, Pseudomonas putida KT2440
cugauccucacgcacaaccgc

SEQ ID NO: 3543031 - RNA, 17 nt, Pseudomonas putida KT2440
cugaucgccgucgacca

SEQ ID NO: 3543032 - RNA, 16 nt, Pseudomonas putida KT2440
cugaucgccuccaggc

SEQ ID NO: 3543033 - RNA, 15 nt, Pseudomonas putida KT2440
cugaucgcuugcgcg

SEQ ID NO: 3543034 - RNA, 22 nt, Pseudomonas putida KT2440
cugaucugaaaguucagcgccu

SEQ ID NO: 3543035 - RNA, 16 nt, Pseudomonas putida KT2440
cugaucugcccuuccu

SEQ ID NO: 3543036 - RNA, 14 nt, Pseudomonas putida KT2440
cugaugaaagcgca

SEQ ID NO: 3543037 - RNA, 17 nt, Pseudomonas putida KT2440
cugaugaaagcgcaugu

SEQ ID NO: 3543038 - RNA, 20 nt, Pseudomonas putida KT2440
cugaugaacuuccaguccgc

SEQ ID NO: 3543039 - RNA, 16 nt, Pseudomonas putida KT2440
cugaugagguuugcca

SEQ ID NO: 3543040 - RNA, 12 nt, Pseudomonas putida KT2440
cugaugcaccag

SEQ ID NO: 3543041 - RNA, 17 nt, Pseudomonas putida KT2440
cugaugcaccaggccca

SEQ ID NO: 3543042 - RNA, 18 nt, Pseudomonas putida KT2440
cugaugcagcagugccag

SEQ ID NO: 3543043 - RNA, 14 nt, Pseudomonas putida KT2440
gcagccacgauagc

SEQ ID NO: 3543044 - RNA, 21 nt, Pseudomonas putida KT2440
gcagccacgauagcgucagca

SEQ ID NO: 3543045 - RNA, 19 nt, Pseudomonas putida KT2440
gcagccagcaucucggcca

SEQ ID NO: 3543046 - RNA, 15 nt, Pseudomonas putida KT2440
gcagccagccccaac

SEQ ID NO: 3543047 - RNA, 23 nt, Pseudomonas putida KT2440
gcagccagccccaacccaccagc

SEQ ID NO: 3543048 - RNA, 22 nt, Pseudomonas putida KT2440
gcagccaggauuuucagcgcga

SEQ ID NO: 3543049 - RNA, 20 nt, Pseudomonas putida KT2440
gcagccagggccugaccgcc

SEQ ID NO: 3543050 - RNA, 18 nt, Pseudomonas putida KT2440
gcagccaguucgacaggu

SEQ ID NO: 3543051 - RNA, 19 nt, Pseudomonas putida KT2440
gcagccaguucgacagguu

SEQ ID NO: 3543052 - RNA, 18 nt, Pseudomonas putida KT2440
gcagccauagccaguagc

SEQ ID NO: 3543053 - RNA, 21 nt, Pseudomonas putida KT2440
gcagccauucauccucggccu

SEQ ID NO: 3543054 - RNA, 16 nt, Pseudomonas putida KT2440
gcagcccaaacagcau

SEQ ID NO: 3543055 - RNA, 17 nt, Pseudomonas putida KT2440
gcagcccaaacagcauc

SEQ ID NO: 3543056 - RNA, 13 nt, Pseudomonas putida KT2440
gcagcccacggcc

SEQ ID NO: 3543057 - RNA, 16 nt, Pseudomonas putida KT2440
gcagcccacggccgcc

SEQ ID NO: 3543058 - RNA, 11 nt, Pseudomonas putida KT2440
gcagcccagcg

SEQ ID NO: 3543059 - RNA, 14 nt, Pseudomonas putida KT2440
gcagcccagcgccg

SEQ ID NO: 3543060 - RNA, 15 nt, Pseudomonas putida KT2440
gcagcccagcgccgc

SEQ ID NO: 3543061 - RNA, 13 nt, Pseudomonas putida KT2440
gcagcccauucgc

SEQ ID NO: 3543062 - RNA, 23 nt, Pseudomonas putida KT2440
gcagcccauucgcgggcaagccc

SEQ ID NO: 3543063 - RNA, 21 nt, Pseudomonas putida KT2440
gcagcccauucgcggguaaac

SEQ ID NO: 3543064 - RNA, 14 nt, Pseudomonas putida KT2440
gcagccccaccucg

SEQ ID NO: 3543065 - RNA, 19 nt, Pseudomonas putida KT2440
gcagccccagcggcaaccu

SEQ ID NO: 3543066 - RNA, 15 nt, Pseudomonas putida KT2440
gcagcccccccagca

SEQ ID NO: 3543067 - RNA, 12 nt, Pseudomonas putida KT2440
gcagccccgccg

SEQ ID NO: 3543068 - RNA, 13 nt, Pseudomonas putida KT2440
gcagccccggcaa

SEQ ID NO: 3543069 - RNA, 14 nt, Pseudomonas putida KT2440
gcagccccggcaau

SEQ ID NO: 3543070 - RNA, 22 nt, Pseudomonas putida KT2440
gcagccccggcuuucucaagcc

SEQ ID NO: 3543071 - RNA, 14 nt, Pseudomonas putida KT2440
gcagccccugcaca

SEQ ID NO: 3543072 - RNA, 19 nt, Pseudomonas putida KT2440
gcagccccugcacaucacg

SEQ ID NO: 3543073 - RNA, 14 nt, Pseudomonas putida KT2440
gcagcccuucgcag

SEQ ID NO: 3543074 - RNA, 14 nt, Pseudomonas putida KT2440
gcagcccuucgcgg

SEQ ID NO: 3543075 - RNA, 15 nt, Pseudomonas putida KT2440
gcagcccuucgcggg

SEQ ID NO: 3543076 - RNA, 18 nt, Pseudomonas putida KT2440
gcagcccuucgcgggcac

SEQ ID NO: 3543077 - RNA, 22 nt, Pseudomonas putida KT2440
gcagccgauacggugccaauaa

SEQ ID NO: 3543078 - RNA, 21 nt, Pseudomonas putida KT2440
gcagccgcacccaggccacga

SEQ ID NO: 3543079 - RNA, 15 nt, Pseudomonas putida KT2440
gcagccgcaccugcc

SEQ ID NO: 3543080 - RNA, 20 nt, Pseudomonas putida KT2440
gcagccgcccuugagcuuca

SEQ ID NO: 3543081 - RNA, 15 nt, Pseudomonas putida KT2440
gcagccgcguccuug

SEQ ID NO: 3543082 - RNA, 12 nt, Pseudomonas putida KT2440
gcagccggcacc

SEQ ID NO: 3543083 - RNA, 14 nt, Pseudomonas putida KT2440
gcagccggcaccgc

SEQ ID NO: 3543084 - RNA, 15 nt, Pseudomonas putida KT2440
gcagccggcaccgcc

SEQ ID NO: 3543085 - RNA, 21 nt, Pseudomonas putida KT2440
gcagccgggccugauuggcau

SEQ ID NO: 3543086 - RNA, 15 nt, Pseudomonas putida KT2440
gcagccguugcuggg

SEQ ID NO: 3543087 - RNA, 17 nt, Pseudomonas putida KT2440
gcagccguugcugggcu

SEQ ID NO: 3543088 - RNA, 14 nt, Pseudomonas putida KT2440
gcagccugccaggu

SEQ ID NO: 3543089 - RNA, 15 nt, Pseudomonas putida KT2440
gcagccugccagguc

SEQ ID NO: 3543090 - RNA, 16 nt, Pseudomonas putida KT2440
gcagccugccagguca

SEQ ID NO: 3543091 - RNA, 18 nt, Pseudomonas putida KT2440
gcagccugccaggucacc

SEQ ID NO: 3543092 - RNA, 21 nt, Pseudomonas putida KT2440
gcagccuugucucugaacaca

SEQ ID NO: 3543093 - RNA, 14 nt, Pseudomonas putida KT2440
gcagcgaacgccgg

SEQ ID NO: 3543094 - RNA, 14 nt, Pseudomonas putida KT2440
gcagcgacggcgaa

SEQ ID NO: 3543095 - RNA, 13 nt, Pseudomonas putida KT2440
gcagcgagcgcug

SEQ ID NO: 3543096 - RNA, 18 nt, Pseudomonas putida KT2440
gcagcgaucagugccuug

SEQ ID NO: 3543097 - RNA, 21 nt, Pseudomonas putida KT2440
gcagcgaucagugccuugacc

SEQ ID NO: 3543098 - RNA, 23 nt, Pseudomonas putida KT2440
gcagcgaucccacggccgcgcag

SEQ ID NO: 3543099 - RNA, 13 nt, Pseudomonas putida KT2440
gcagcgcaaaaaa

SEQ ID NO: 3543100 - RNA, 18 nt, Pseudomonas putida KT2440
gcagcgcaaaaaacgccg

SEQ ID NO: 3543101 - RNA, 13 nt, Pseudomonas putida KT2440
gcagcgcaaucac

SEQ ID NO: 3543102 - RNA, 17 nt, Pseudomonas putida KT2440
gcagcgcaaucaccgcc

SEQ ID NO: 3543103 - RNA, 23 nt, Pseudomonas putida KT2440
gcagcgcaccgugcaccagcacc

SEQ ID NO: 3543104 - RNA, 13 nt, Pseudomonas putida KT2440
gcagcgcacggcu

SEQ ID NO: 3543105 - RNA, 17 nt, Pseudomonas putida KT2440
gcagcgcauccaccucg

SEQ ID NO: 3543106 - RNA, 19 nt, Pseudomonas putida KT2440
gcagcgcaugcucgcgggc

SEQ ID NO: 3543107 - RNA, 15 nt, Pseudomonas putida KT2440
gcagcgcauggcuca

SEQ ID NO: 3543108 - RNA, 13 nt, Pseudomonas putida KT2440
gcagcgcaugguc

SEQ ID NO: 3543109 - RNA, 20 nt, Pseudomonas putida KT2440
gcagcgccgcauccagcacu

SEQ ID NO: 3543110 - RNA, 15 nt, Pseudomonas putida KT2440
gcagcgccgccaacu

SEQ ID NO: 3543111 - RNA, 22 nt, Pseudomonas putida KT2440
gcagcgccgccaggcccaccac

SEQ ID NO: 3543112 - RNA, 17 nt, Pseudomonas putida KT2440
gcagcgccugcagcgcg

SEQ ID NO: 3543113 - RNA, 20 nt, Pseudomonas putida KT2440
gcagcgccugugagaucgag

SEQ ID NO: 3543114 - RNA, 21 nt, Pseudomonas putida KT2440
gcagcgcgcaggucgugcuug

SEQ ID NO: 3543115 - RNA, 18 nt, Pseudomonas putida KT2440
gcagcgcgggcagaugag

SEQ ID NO: 3543116 - RNA, 11 nt, Pseudomonas putida KT2440
gcagcgcguca

SEQ ID NO: 3543117 - RNA, 20 nt, Pseudomonas putida KT2440
gcagcgcgucauccgccaac

SEQ ID NO: 3543118 - RNA, 18 nt, Pseudomonas putida KT2440
gcagcgcuaugccuugga

SEQ ID NO: 3543119 - RNA, 22 nt, Pseudomonas putida KT2440
gcagcgcuccgccaaaccccag

SEQ ID NO: 3543120 - RNA, 22 nt, Pseudomonas putida KT2440
gcagcgcuucgaucagcgccug

SEQ ID NO: 3543121 - RNA, 11 nt, Pseudomonas putida KT2440
gcagcggcaag

SEQ ID NO: 3543122 - RNA, 13 nt, Pseudomonas putida KT2440
gcagcggcaaggu

SEQ ID NO: 3543123 - RNA, 20 nt, Pseudomonas putida KT2440
gcagcggcaagguagccugc

SEQ ID NO: 3543124 - RNA, 17 nt, Pseudomonas putida KT2440
gcagcgggagucgaacc

SEQ ID NO: 3543125 - RNA, 21 nt, Pseudomonas putida KT2440
gcagcgggagucgaaccugcc

SEQ ID NO: 3543126 - RNA, 17 nt, Pseudomonas putida KT2440
gcagcgggcacaggccg

SEQ ID NO: 3543127 - RNA, 10 nt, Pseudomonas putida KT2440
gcagcgggcu

SEQ ID NO: 3543128 - RNA, 17 nt, Pseudomonas putida KT2440
gcagcgggcucgcccac

SEQ ID NO: 3543129 - RNA, 19 nt, Pseudomonas putida KT2440
gcagcgggcucgcccacac

SEQ ID NO: 3543130 - RNA, 24 nt, Pseudomonas putida KT2440
gcagcgggcucgcccacacggcaa

SEQ ID NO: 3543131 - RNA, 12 nt, Pseudomonas putida KT2440
gcagcgggucgc

SEQ ID NO: 3543132 - RNA, 14 nt, Pseudomonas putida KT2440
gcagcgugggugua

SEQ ID NO: 3543133 - RNA, 19 nt, Pseudomonas putida KT2440
gcagcguucucgguguaga

SEQ ID NO: 3543134 - RNA, 15 nt, Pseudomonas putida KT2440
gcagcucagccagca

SEQ ID NO: 3543135 - RNA, 23 nt, Pseudomonas putida KT2440
gcagcucaugcgggucaagcugg

SEQ ID NO: 3543136 - RNA, 22 nt, Pseudomonas putida KT2440
gcagcuccacuggaacucgauc

SEQ ID NO: 3543137 - RNA, 14 nt, Pseudomonas putida KT2440
gcagcuccagccag

SEQ ID NO: 3543138 - RNA, 17 nt, Pseudomonas putida KT2440
gcagcuccagcguuugc

SEQ ID NO: 3543139 - RNA, 14 nt, Pseudomonas putida KT2440
gcagcuccauacca

SEQ ID NO: 3543140 - RNA, 17 nt, Pseudomonas putida KT2440
gcagcucgcgcugcgca

SEQ ID NO: 3543141 - RNA, 19 nt, Pseudomonas putida KT2440
gcagcucggacaaauccag

SEQ ID NO: 3543142 - RNA, 15 nt, Pseudomonas putida KT2440
gcagcucggugaaca

SEQ ID NO: 3543143 - RNA, 19 nt, Pseudomonas putida KT2440
gcagcucggugaacagguu

SEQ ID NO: 3543144 - RNA, 22 nt, Pseudomonas putida KT2440
gcagcucggugaacagguugcg

SEQ ID NO: 3543145 - RNA, 21 nt, Pseudomonas putida KT2440
gcagcucuugucgacagugaa

SEQ ID NO: 3543146 - RNA, 19 nt, Pseudomonas putida KT2440
gcagcucuuuugccgggaa

SEQ ID NO: 3543147 - RNA, 18 nt, Pseudomonas putida KT2440
gcagcugcugaccucgac

SEQ ID NO: 3543148 - RNA, 17 nt, Pseudomonas putida KT2440
gcagcugggugaucagc

SEQ ID NO: 3543149 - RNA, 18 nt, Pseudomonas putida KT2440
gcagggugugcugcugcc

SEQ ID NO: 3543150 - RNA, 22 nt, Pseudomonas putida KT2440
gcaggguucgccgucagccuuu

SEQ ID NO: 3543151 - RNA, 19 nt, Pseudomonas putida KT2440
gcaggguuuucagcgccgc

SEQ ID NO: 3543152 - RNA, 21 nt, Pseudomonas putida KT2440
gcagguaaacccgcgccugca

SEQ ID NO: 3543153 - RNA, 18 nt, Pseudomonas putida KT2440
gcagguaaugcgccgcac

SEQ ID NO: 3543154 - RNA, 15 nt, Pseudomonas putida KT2440
gcagguacaccgccu

SEQ ID NO: 3543155 - RNA, 19 nt, Pseudomonas putida KT2440
gcagguacacgggcaugcc

SEQ ID NO: 3543156 - RNA, 13 nt, Pseudomonas putida KT2440
gcagguacagcag

SEQ ID NO: 3543157 - RNA, 14 nt, Pseudomonas putida KT2440
gcagguacagcagc

SEQ ID NO: 3543158 - RNA, 22 nt, Pseudomonas putida KT2440
gcagguacagcagcugcauugg

SEQ ID NO: 3543159 - RNA, 14 nt, Pseudomonas putida KT2440
gcagguaccaguug

SEQ ID NO: 3543160 - RNA, 16 nt, Pseudomonas putida KT2440
gcagguacgcgcaggc

SEQ ID NO: 3543161 - RNA, 18 nt, Pseudomonas putida KT2440
gcagguacgcgcaggcag

SEQ ID NO: 3543162 - RNA, 16 nt, Pseudomonas putida KT2440
gcagguacugcaugug

SEQ ID NO: 3543163 - RNA, 14 nt, Pseudomonas putida KT2440
gcagguaggcccag

SEQ ID NO: 3543164 - RNA, 15 nt, Pseudomonas putida KT2440
gcagguaggcccagc

SEQ ID NO: 3543165 - RNA, 21 nt, Pseudomonas putida KT2440
gcagguaucacgcgagcuguu

SEQ ID NO: 3543166 - RNA, 12 nt, Pseudomonas putida KT2440
gcaggucagcac

SEQ ID NO: 3543167 - RNA, 13 nt, Pseudomonas putida KT2440
gcaggucagcgcu

SEQ ID NO: 3543168 - RNA, 12 nt, Pseudomonas putida KT2440
gcaggucagcgu

SEQ ID NO: 3543169 - RNA, 14 nt, Pseudomonas putida KT2440
gcaggucaugcagg

SEQ ID NO: 3543170 - RNA, 19 nt, Pseudomonas putida KT2440
gcaggucauuggcgccauc

SEQ ID NO: 3543171 - RNA, 20 nt, Pseudomonas putida KT2440
gcagguccggaaacucacgc

SEQ ID NO: 3543172 - RNA, 19 nt, Pseudomonas putida KT2440
gcaggucgaacagcccccg

SEQ ID NO: 3543173 - RNA, 21 nt, Pseudomonas putida KT2440
gcaggucgaacagcccccgga

SEQ ID NO: 3543174 - RNA, 20 nt, Pseudomonas putida KT2440
gcaggucgacaugcaccacg

SEQ ID NO: 3543175 - RNA, 14 nt, Pseudomonas putida KT2440
gcaggucgacccgc

SEQ ID NO: 3543176 - RNA, 22 nt, Pseudomonas putida KT2440
gcaggucgacccgcgccagggu

SEQ ID NO: 3543177 - RNA, 12 nt, Pseudomonas putida KT2440
gcaggucgaccu

SEQ ID NO: 3543178 - RNA, 21 nt, Pseudomonas putida KT2440
gcaggucgacgauacccagcg

SEQ ID NO: 3543179 - RNA, 19 nt, Pseudomonas putida KT2440
gcaggucgauguccaggcc

SEQ ID NO: 3543180 - RNA, 13 nt, Pseudomonas putida KT2440
gcaggucgccauc

SEQ ID NO: 3543181 - RNA, 17 nt, Pseudomonas putida KT2440
gcaggucggcacgcacc

SEQ ID NO: 3543182 - RNA, 20 nt, Pseudomonas putida KT2440
gcaggucggccagcucggca

SEQ ID NO: 3543183 - RNA, 23 nt, Pseudomonas putida KT2440
gcaggucgugcuugacccccuuc

SEQ ID NO: 3543184 - RNA, 13 nt, Pseudomonas putida KT2440
gcaggucguugac

SEQ ID NO: 3543185 - RNA, 14 nt, Pseudomonas putida KT2440
gcaggucuucucgg

SEQ ID NO: 3543186 - RNA, 23 nt, Pseudomonas putida KT2440
gcaggugaaaaugcuggucgaac

SEQ ID NO: 3543187 - RNA, 12 nt, Pseudomonas putida KT2440
gcaggugcaggc

SEQ ID NO: 3543188 - RNA, 12 nt, Pseudomonas putida KT2440
gcaggugcaggu

SEQ ID NO: 3543189 - RNA, 13 nt, Pseudomonas putida KT2440
gcaggugcagguu

SEQ ID NO: 3543190 - RNA, 18 nt, Pseudomonas putida KT2440
gcaggugcagguucgacc

SEQ ID NO: 3543191 - RNA, 18 nt, Pseudomonas putida KT2440
gcaggugcccaagcggca

SEQ ID NO: 3543192 - RNA, 21 nt, Pseudomonas putida KT2440
gcaggugcgcacgcugcccag

SEQ ID NO: 3543193 - RNA, 22 nt, Pseudomonas putida KT2440
gcaggugcgcacgcugcccagg

SEQ ID NO: 3543194 - RNA, 18 nt, Pseudomonas putida KT2440
gcaggugcggcgcgacuc

SEQ ID NO: 3543195 - RNA, 19 nt, Pseudomonas putida KT2440
gcaggugggucacggucag

SEQ ID NO: 3543196 - RNA, 20 nt, Pseudomonas putida KT2440
gcagguucaacggcgcccgg

SEQ ID NO: 3543197 - RNA, 21 nt, Pseudomonas putida KT2440
gcagguucaggcgcagcacgc

SEQ ID NO: 3543198 - RNA, 18 nt, Pseudomonas putida KT2440
gcagguucagugaucaug

SEQ ID NO: 3543199 - RNA, 16 nt, Pseudomonas putida KT2440
gcagguucgaccacug

SEQ ID NO: 3543200 - RNA, 18 nt, Pseudomonas putida KT2440
gcagguucgaccacugca

SEQ ID NO: 3543201 - RNA, 22 nt, Pseudomonas putida KT2440
gcagguucgaccacugcaggug

SEQ ID NO: 3543202 - RNA, 18 nt, Pseudomonas putida KT2440
gcagguucgaccagaaca

SEQ ID NO: 3543203 - RNA, 19 nt, Pseudomonas putida KT2440
gcagguucgacucccgcug

SEQ ID NO: 3543204 - RNA, 21 nt, Pseudomonas putida KT2440
gcagguucugaaucuggcucu

SEQ ID NO: 3543205 - RNA, 22 nt, Pseudomonas putida KT2440
gcagguucugaaucuggcucug

SEQ ID NO: 3543206 - RNA, 14 nt, Pseudomonas putida KT2440
gcagguugaacagc

SEQ ID NO: 3543207 - RNA, 15 nt, Pseudomonas putida KT2440
gcagguugaacagca

SEQ ID NO: 3543208 - RNA, 16 nt, Pseudomonas putida KT2440
gcagguugaacagcag

SEQ ID NO: 3543209 - RNA, 18 nt, Pseudomonas putida KT2440
gcagguugaacagcagcg

SEQ ID NO: 3543210 - RNA, 15 nt, Pseudomonas putida KT2440
gcagguugaacaggu

SEQ ID NO: 3543211 - RNA, 18 nt, Pseudomonas putida KT2440
gcagguugauccagcccu

SEQ ID NO: 3543212 - RNA, 17 nt, Pseudomonas putida KT2440
gcagguugaugugcagg

SEQ ID NO: 3543213 - RNA, 15 nt, Pseudomonas putida KT2440
gcagguugcuggccu

SEQ ID NO: 3543214 - RNA, 18 nt, Pseudomonas putida KT2440
gcagguugcuggccuugg

SEQ ID NO: 3543215 - RNA, 20 nt, Pseudomonas putida KT2440
gcagguuggacagcgcccgg

SEQ ID NO: 3543216 - RNA, 22 nt, Pseudomonas putida KT2440
gcagguuggacagcgcccggcg

SEQ ID NO: 3543217 - RNA, 15 nt, Pseudomonas putida KT2440
gcagguuggcgcgaa

SEQ ID NO: 3543218 - RNA, 18 nt, Pseudomonas putida KT2440
gcagguuguucggcaggc

SEQ ID NO: 3543219 - RNA, 19 nt, Pseudomonas putida KT2440
gcagguuguucggcaggcu

SEQ ID NO: 3543220 - RNA, 22 nt, Pseudomonas putida KT2440
gcaguacauagaacagcaucaa

SEQ ID NO: 3543221 - RNA, 19 nt, Pseudomonas putida KT2440
gcaguaccacacguugucc

SEQ ID NO: 3543222 - RNA, 18 nt, Pseudomonas putida KT2440
gcaguaccuguggcagcg

SEQ ID NO: 3543223 - RNA, 18 nt, Pseudomonas putida KT2440
gcaguacuuauaagcagc

SEQ ID NO: 3543224 - RNA, 22 nt, Pseudomonas putida KT2440
gcaguagaaaguccaucugcuu

SEQ ID NO: 3543225 - RNA, 16 nt, Pseudomonas putida KT2440
gcaguaucgccccggu

SEQ ID NO: 3543226 - RNA, 22 nt, Pseudomonas putida KT2440
gcagucaaagccuuuuuucggg

SEQ ID NO: 3543227 - RNA, 13 nt, Pseudomonas putida KT2440
gcagucaccacac

SEQ ID NO: 3543228 - RNA, 14 nt, Pseudomonas putida KT2440
gcagucaccuggcc

SEQ ID NO: 3543229 - RNA, 23 nt, Pseudomonas putida KT2440
gcagucagggucucggccaaucg

SEQ ID NO: 3543230 - RNA, 16 nt, Pseudomonas putida KT2440
gcagucaugggccaug

SEQ ID NO: 3543231 - RNA, 23 nt, Pseudomonas putida KT2440
gcaguccuuucgcgacacaaggc

SEQ ID NO: 3543232 - RNA, 23 nt, Pseudomonas putida KT2440
gcagucgaaggggaucagcacgc

SEQ ID NO: 3543233 - RNA, 16 nt, Pseudomonas putida KT2440
gcagucgaccgggcag

SEQ ID NO: 3543234 - RNA, 20 nt, Pseudomonas putida KT2440
gcagucgaccgggcagaccu

SEQ ID NO: 3543235 - RNA, 17 nt, Pseudomonas putida KT2440
gcagucguacgcgggca

SEQ ID NO: 3543236 - RNA, 20 nt, Pseudomonas putida KT2440
gcagucguuguccagguggu

SEQ ID NO: 3543237 - RNA, 23 nt, Pseudomonas putida KT2440
gcagucguuguccaggugguagu

SEQ ID NO: 3543238 - RNA, 16 nt, Pseudomonas putida KT2440
gcagucuugcugauca

SEQ ID NO: 3543239 - RNA, 20 nt, Pseudomonas putida KT2440
gcagugacacggcgaugcgc

SEQ ID NO: 3543240 - RNA, 17 nt, Pseudomonas putida KT2440
gcagugaucuggcgcag

SEQ ID NO: 3543241 - RNA, 17 nt, Pseudomonas putida KT2440
gcagugaugccgugguu

SEQ ID NO: 3543242 - RNA, 23 nt, Pseudomonas putida KT2440
gcagugaugccgugguucaucac

SEQ ID NO: 3543243 - RNA, 15 nt, Pseudomonas putida KT2440
gcagugcaauaccag

SEQ ID NO: 3543244 - RNA, 22 nt, Pseudomonas putida KT2440
gcagugcacccaucggcgcgaa

SEQ ID NO: 3543245 - RNA, 13 nt, Pseudomonas putida KT2440
gcagugcacccgc

SEQ ID NO: 3543246 - RNA, 16 nt, Pseudomonas putida KT2440
gcagugcacgcgggcg

SEQ ID NO: 3543247 - RNA, 11 nt, Pseudomonas putida KT2440
gcagugcagcc

SEQ ID NO: 3543248 - RNA, 19 nt, Pseudomonas putida KT2440
gcagugcaucgaagcaggc

SEQ ID NO: 3543249 - RNA, 22 nt, Pseudomonas putida KT2440
gcagugcaucgaagcaggccgg

SEQ ID NO: 3543250 - RNA, 14 nt, Pseudomonas putida KT2440
gcagugccagcaac

SEQ ID NO: 3543251 - RNA, 18 nt, Pseudomonas putida KT2440
gcagugccagcaacaagc

SEQ ID NO: 3543252 - RNA, 15 nt, Pseudomonas putida KT2440
gcagugcccagucga

SEQ ID NO: 3543253 - RNA, 21 nt, Pseudomonas putida KT2440
gcagugcccccgucagcggca

SEQ ID NO: 3543254 - RNA, 21 nt, Pseudomonas putida KT2440
gcaucgaggaaggcaucgggc

SEQ ID NO: 3543255 - RNA, 16 nt, Pseudomonas putida KT2440
gcaucgauguacaccc

SEQ ID NO: 3543256 - RNA, 17 nt, Pseudomonas putida KT2440
gcaucgccaacagaggc

SEQ ID NO: 3543257 - RNA, 19 nt, Pseudomonas putida KT2440
gcaucgccaacagaggccu

SEQ ID NO: 3543258 - RNA, 16 nt, Pseudomonas putida KT2440
gcaucgcgagcaagcu

SEQ ID NO: 3543259 - RNA, 18 nt, Pseudomonas putida KT2440
gcaucgcgcacuugccag

SEQ ID NO: 3543260 - RNA, 19 nt, Pseudomonas putida KT2440
gcaucgcugcccgggcaaa

SEQ ID NO: 3543261 - RNA, 16 nt, Pseudomonas putida KT2440
gcaucggccuggggca

SEQ ID NO: 3543262 - RNA, 15 nt, Pseudomonas putida KT2440
gcaucggcgugcugc

SEQ ID NO: 3543263 - RNA, 12 nt, Pseudomonas putida KT2440
gcaucggcguug

SEQ ID NO: 3543264 - RNA, 19 nt, Pseudomonas putida KT2440
gcaucggcguugcggugca

SEQ ID NO: 3543265 - RNA, 20 nt, Pseudomonas putida KT2440
gcaucggcguugcggugcag

SEQ ID NO: 3543266 - RNA, 16 nt, Pseudomonas putida KT2440
gcaucgggcgcgucgu

SEQ ID NO: 3543267 - RNA, 22 nt, Pseudomonas putida KT2440
gcaucgggugaaaucaguucac

SEQ ID NO: 3543268 - RNA, 19 nt, Pseudomonas putida KT2440
gcaucgucacauccugcuc

SEQ ID NO: 3543269 - RNA, 21 nt, Pseudomonas putida KT2440
gcaucguuauccagcacccac

SEQ ID NO: 3543270 - RNA, 12 nt, Pseudomonas putida KT2440
gcaucucggcca

SEQ ID NO: 3543271 - RNA, 15 nt, Pseudomonas putida KT2440
gcaucucggucgaca

SEQ ID NO: 3543272 - RNA, 15 nt, Pseudomonas putida KT2440
gcaucugcaccagga

SEQ ID NO: 3543273 - RNA, 16 nt, Pseudomonas putida KT2440
gcaucugccgggucgg

SEQ ID NO: 3543274 - RNA, 23 nt, Pseudomonas putida KT2440
gcaucugccgggucggccugcuc

SEQ ID NO: 3543275 - RNA, 19 nt, Pseudomonas putida KT2440
gcaucugcgccccgcucgc

SEQ ID NO: 3543276 - RNA, 23 nt, Pseudomonas putida KT2440
gcaucugcucccccaggcugcca

SEQ ID NO: 3543277 - RNA, 16 nt, Pseudomonas putida KT2440
gcaucugcugcggcag

SEQ ID NO: 3543278 - RNA, 19 nt, Pseudomonas putida KT2440
gcaucugcugcggcaggcu

SEQ ID NO: 3543279 - RNA, 20 nt, Pseudomonas putida KT2440
gcaucugguaauaccacauc

SEQ ID NO: 3543280 - RNA, 22 nt, Pseudomonas putida KT2440
gcaucuucuucacguccagcca

SEQ ID NO: 3543281 - RNA, 23 nt, Pseudomonas putida KT2440
gcaucuucuucacguccagccac

SEQ ID NO: 3543282 - RNA, 13 nt, Pseudomonas putida KT2440
gcaucuucuuccc

SEQ ID NO: 3543283 - RNA, 13 nt, Pseudomonas putida KT2440
gcaugaacagcgc

SEQ ID NO: 3543284 - RNA, 14 nt, Pseudomonas putida KT2440
gcaugaacagcgcu

SEQ ID NO: 3543285 - RNA, 20 nt, Pseudomonas putida KT2440
gcaugaaggacaucaccagg

SEQ ID NO: 3543286 - RNA, 21 nt, Pseudomonas putida KT2440
gcaugacaaacgccagcaugc

SEQ ID NO: 3543287 - RNA, 19 nt, Pseudomonas putida KT2440
gcaugacccuaugcgugaa

SEQ ID NO: 3543288 - RNA, 17 nt, Pseudomonas putida KT2440
gcaugacgacguugcgc

SEQ ID NO: 3543289 - RNA, 16 nt, Pseudomonas putida KT2440
gcaugagccuggccgg

SEQ ID NO: 3543290 - RNA, 20 nt, Pseudomonas putida KT2440
gcaugaucaccgccagcggc

SEQ ID NO: 3543291 - RNA, 21 nt, Pseudomonas putida KT2440
gcaugaucaccgccagcggca

SEQ ID NO: 3543292 - RNA, 19 nt, Pseudomonas putida KT2440
gcaugaucuugggcuucau

SEQ ID NO: 3543293 - RNA, 23 nt, Pseudomonas putida KT2440
gcaugcaacggcacacgcaccac

SEQ ID NO: 3543294 - RNA, 13 nt, Pseudomonas putida KT2440
gcaugcaagcagc

SEQ ID NO: 3543295 - RNA, 15 nt, Pseudomonas putida KT2440
gcaugcaagcagcca

SEQ ID NO: 3543296 - RNA, 14 nt, Pseudomonas putida KT2440
gcaugcacggcagc

SEQ ID NO: 3543297 - RNA, 17 nt, Pseudomonas putida KT2440
gcaugcaggaggucagc

SEQ ID NO: 3543298 - RNA, 19 nt, Pseudomonas putida KT2440
gcaugcaggucgaccugcc

SEQ ID NO: 3543299 - RNA, 15 nt, Pseudomonas putida KT2440
gcaugcaucugcgcc

SEQ ID NO: 3543300 - RNA, 16 nt, Pseudomonas putida KT2440
gcaugcaugcguugca

SEQ ID NO: 3543301 - RNA, 13 nt, Pseudomonas putida KT2440
gcaugccagcagc

SEQ ID NO: 3543302 - RNA, 22 nt, Pseudomonas putida KT2440
gcaugccaguagaagcccagau

SEQ ID NO: 3543303 - RNA, 20 nt, Pseudomonas putida KT2440
gcaugccauugcaccacccc

SEQ ID NO: 3543304 - RNA, 14 nt, Pseudomonas putida KT2440
gcaugcccagcgcc

SEQ ID NO: 3543305 - RNA, 16 nt, Pseudomonas putida KT2440
gcaugcccagcgccac

SEQ ID NO: 3543306 - RNA, 17 nt, Pseudomonas putida KT2440
gcaugcccagcgccacc

SEQ ID NO: 3543307 - RNA, 20 nt, Pseudomonas putida KT2440
gcaugcccaguucgcgugcc

SEQ ID NO: 3543308 - RNA, 17 nt, Pseudomonas putida KT2440
gcaugcccgccccugcc

SEQ ID NO: 3543309 - RNA, 21 nt, Pseudomonas putida KT2440
gcaugcccgcgcaaaucgccg

SEQ ID NO: 3543310 - RNA, 16 nt, Pseudomonas putida KT2440
gcaugcccgcucccac

SEQ ID NO: 3543311 - RNA, 23 nt, Pseudomonas putida KT2440
gcaugcccgcucccacaggucca

SEQ ID NO: 3543312 - RNA, 18 nt, Pseudomonas putida KT2440
gcaugccuaucucuucca

SEQ ID NO: 3543313 - RNA, 18 nt, Pseudomonas putida KT2440
gcaugccuuccugcaccu

SEQ ID NO: 3543314 - RNA, 11 nt, Pseudomonas putida KT2440
gcaugcgcacg

SEQ ID NO: 3543315 - RNA, 16 nt, Pseudomonas putida KT2440
gcaugcgcgacagcau

SEQ ID NO: 3543316 - RNA, 19 nt, Pseudomonas putida KT2440
gcaugcgcgacagcaucau

SEQ ID NO: 3543317 - RNA, 13 nt, Pseudomonas putida KT2440
gcaugcgcgccau

SEQ ID NO: 3543318 - RNA, 20 nt, Pseudomonas putida KT2440
gcaugcgcgccauggccucg

SEQ ID NO: 3543319 - RNA, 19 nt, Pseudomonas putida KT2440
gcaugcggcauagcgugcu

SEQ ID NO: 3543320 - RNA, 17 nt, Pseudomonas putida KT2440
gcaugcgggggccccac

SEQ ID NO: 3543321 - RNA, 16 nt, Pseudomonas putida KT2440
gcaugcgucuggcggc

SEQ ID NO: 3543322 - RNA, 17 nt, Pseudomonas putida KT2440
gcaugcgucuggcggcc

SEQ ID NO: 3543323 - RNA, 17 nt, Pseudomonas putida KT2440
gcaugcucaucgcggcc

SEQ ID NO: 3543324 - RNA, 21 nt, Pseudomonas putida KT2440
gcaugcucaucgcggccgaag

SEQ ID NO: 3543325 - RNA, 18 nt, Pseudomonas putida KT2440
gcaugcucggcggugccu

SEQ ID NO: 3543326 - RNA, 15 nt, Pseudomonas putida KT2440
gcaugcugccaggca

SEQ ID NO: 3543327 - RNA, 13 nt, Pseudomonas putida KT2440
gcaugcugugccc

SEQ ID NO: 3543328 - RNA, 15 nt, Pseudomonas putida KT2440
gcaugcugugcccug

SEQ ID NO: 3543329 - RNA, 19 nt, Pseudomonas putida KT2440
gcauggcaaacagcaccag

SEQ ID NO: 3543330 - RNA, 20 nt, Pseudomonas putida KT2440
gcauggcaaacagcaccagc

SEQ ID NO: 3543331 - RNA, 17 nt, Pseudomonas putida KT2440
gcauggcaaucaaugac

SEQ ID NO: 3543332 - RNA, 14 nt, Pseudomonas putida KT2440
gcauggcaaucggg

SEQ ID NO: 3543333 - RNA, 12 nt, Pseudomonas putida KT2440
gcauggcaugca

SEQ ID NO: 3543334 - RNA, 21 nt, Pseudomonas putida KT2440
gcauggccagccggcagcaag

SEQ ID NO: 3543335 - RNA, 15 nt, Pseudomonas putida KT2440
gcauggccaguuccu

SEQ ID NO: 3543336 - RNA, 18 nt, Pseudomonas putida KT2440
gcauggcccaugaucgcg

SEQ ID NO: 3543337 - RNA, 13 nt, Pseudomonas putida KT2440
gcauggccuggca

SEQ ID NO: 3543338 - RNA, 15 nt, Pseudomonas putida KT2440
gcauggccuggucga

SEQ ID NO: 3543339 - RNA, 19 nt, Pseudomonas putida KT2440
gcauggcgaucucuucccu

SEQ ID NO: 3543340 - RNA, 20 nt, Pseudomonas putida KT2440
gcauggcggcaccgaaggca

SEQ ID NO: 3543341 - RNA, 21 nt, Pseudomonas putida KT2440
gcauggcgucggcgauggcgu

SEQ ID NO: 3543342 - RNA, 17 nt, Pseudomonas putida KT2440
gcauggcgugcccggca

SEQ ID NO: 3543343 - RNA, 17 nt, Pseudomonas putida KT2440
gcauggcguuguccagc

SEQ ID NO: 3543344 - RNA, 20 nt, Pseudomonas putida KT2440
gcauggcguuguccagcagg

SEQ ID NO: 3543345 - RNA, 21 nt, Pseudomonas putida KT2440
gcauggcguuguccagcaggu

SEQ ID NO: 3543346 - RNA, 13 nt, Pseudomonas putida KT2440
gcaugggccacuu

SEQ ID NO: 3543347 - RNA, 13 nt, Pseudomonas putida KT2440
gcaugggccaggg

SEQ ID NO: 3543348 - RNA, 15 nt, Pseudomonas putida KT2440
gcaugggugagcacg

SEQ ID NO: 3543349 - RNA, 22 nt, Pseudomonas putida KT2440
gcauggguuguggcuuggccca

SEQ ID NO: 3543350 - RNA, 21 nt, Pseudomonas putida KT2440
gcauggucacguagaacaggc

SEQ ID NO: 3543351 - RNA, 22 nt, Pseudomonas putida KT2440
gcauggucacguagaacaggcc

SEQ ID NO: 3543352 - RNA, 23 nt, Pseudomonas putida KT2440
gcauggucacguagaacaggccu

SEQ ID NO: 3543353 - RNA, 17 nt, Pseudomonas putida KT2440
gcauggugaagcccgcc

SEQ ID NO: 3543354 - RNA, 14 nt, Pseudomonas putida KT2440
gcaugguggaaguc

SEQ ID NO: 3543355 - RNA, 17 nt, Pseudomonas putida KT2440
gcauguacucuucgacg

SEQ ID NO: 3543356 - RNA, 14 nt, Pseudomonas putida KT2440
gcauguagccaauc

SEQ ID NO: 3543357 - RNA, 17 nt, Pseudomonas putida KT2440
gcauguagccacgcugc

SEQ ID NO: 3543358 - RNA, 15 nt, Pseudomonas putida KT2440
gcauguccagucagg

SEQ ID NO: 3543359 - RNA, 18 nt, Pseudomonas putida KT2440
gccaauaccgcugcaaca

SEQ ID NO: 3543360 - RNA, 18 nt, Pseudomonas putida KT2440
gccaaucaaccgcuuggc

SEQ ID NO: 3543361 - RNA, 16 nt, Pseudomonas putida KT2440
gccaaucaccugcaca

SEQ ID NO: 3543362 - RNA, 13 nt, Pseudomonas putida KT2440
gccaaucaucgcc

SEQ ID NO: 3543363 - RNA, 19 nt, Pseudomonas putida KT2440
gccaaucaucgccagcagc

SEQ ID NO: 3543364 - RNA, 21 nt, Pseudomonas putida KT2440
gccaaucaucgccagcagcgc

SEQ ID NO: 3543365 - RNA, 23 nt, Pseudomonas putida KT2440
gccaaucaucgccagcagcgcuc

SEQ ID NO: 3543366 - RNA, 20 nt, Pseudomonas putida KT2440
gccaaucgaucugcucgccc

SEQ ID NO: 3543367 - RNA, 17 nt, Pseudomonas putida KT2440
gccaaucucguugcgcc

SEQ ID NO: 3543368 - RNA, 20 nt, Pseudomonas putida KT2440
gccaaugaucgagcgcaccu

SEQ ID NO: 3543369 - RNA, 12 nt, Pseudomonas putida KT2440
gccaaugcucag

SEQ ID NO: 3543370 - RNA, 18 nt, Pseudomonas putida KT2440
gccaaugcugaugaagcc

SEQ ID NO: 3543371 - RNA, 20 nt, Pseudomonas putida KT2440
gccaauggcgaugaacacgc

SEQ ID NO: 3543372 - RNA, 17 nt, Pseudomonas putida KT2440
gccaaugguauugcccg

SEQ ID NO: 3543373 - RNA, 18 nt, Pseudomonas putida KT2440
gccaauugcgccagccgc

SEQ ID NO: 3543374 - RNA, 14 nt, Pseudomonas putida KT2440
gccaauugcgccau

SEQ ID NO: 3543375 - RNA, 18 nt, Pseudomonas putida KT2440
gccaauugcggacucaua

SEQ ID NO: 3543376 - RNA, 16 nt, Pseudomonas putida KT2440
gccaauuugccagcgu

SEQ ID NO: 3543377 - RNA, 18 nt, Pseudomonas putida KT2440
gccacaaaaucacaggcc

SEQ ID NO: 3543378 - RNA, 22 nt, Pseudomonas putida KT2440
gccacaacccaucacggccugc

SEQ ID NO: 3543379 - RNA, 18 nt, Pseudomonas putida KT2440
gccacaacccuugcagcg

SEQ ID NO: 3543380 - RNA, 21 nt, Pseudomonas putida KT2440
gccacaacccuugcagcgccu

SEQ ID NO: 3543381 - RNA, 16 nt, Pseudomonas putida KT2440
gccacaacggcgcgcc

SEQ ID NO: 3543382 - RNA, 17 nt, Pseudomonas putida KT2440
gccacaauggcgcacag

SEQ ID NO: 3543383 - RNA, 19 nt, Pseudomonas putida KT2440
gccacacacccgggcccgc

SEQ ID NO: 3543384 - RNA, 20 nt, Pseudomonas putida KT2440
gccacaccacagcugcacau

SEQ ID NO: 3543385 - RNA, 20 nt, Pseudomonas putida KT2440
gccacacccgcuacaccggc

SEQ ID NO: 3543386 - RNA, 13 nt, Pseudomonas putida KT2440
gccacaccgaagc

SEQ ID NO: 3543387 - RNA, 12 nt, Pseudomonas putida KT2440
aaaaaaagauuu

SEQ ID NO: 3543388 - RNA, 13 nt, Pseudomonas putida KT2440
aaaaaaagauuug

SEQ ID NO: 3543389 - RNA, 22 nt, Pseudomonas putida KT2440
aaaaaaagauuugcguuuuaaa

SEQ ID NO: 3543390 - RNA, 20 nt, Pseudomonas putida KT2440
aaaaaacgcgauacccaaua

SEQ ID NO: 3543391 - RNA, 14 nt, Pseudomonas putida KT2440
aaaaaagggcaccu

SEQ ID NO: 3543392 - RNA, 17 nt, Pseudomonas putida KT2440
aaaaacaacaaccaauc

SEQ ID NO: 3543393 - RNA, 14 nt, Pseudomonas putida KT2440
aaaaacaacaauag

SEQ ID NO: 3543394 - RNA, 22 nt, Pseudomonas putida KT2440
aaaaacagugccgucagaaaga

SEQ ID NO: 3543395 - RNA, 21 nt, Pseudomonas putida KT2440
aaaaacccggcgcaagccggg

SEQ ID NO: 3543396 - RNA, 18 nt, Pseudomonas putida KT2440
aaaaaccggccaagcgcc

SEQ ID NO: 3543397 - RNA, 16 nt, Pseudomonas putida KT2440
aaaaacgcgauaccca

SEQ ID NO: 3543398 - RNA, 20 nt, Pseudomonas putida KT2440
aaaaacgcgauacccaauaa

SEQ ID NO: 3543399 - RNA, 23 nt, Pseudomonas putida KT2440
aaaaacgcgauacccaauaaaaa

SEQ ID NO: 3543400 - RNA, 12 nt, Pseudomonas putida KT2440
aaaaagcccagu

SEQ ID NO: 3543401 - RNA, 15 nt, Pseudomonas putida KT2440
aaaaaucuuaacuca

SEQ ID NO: 3543402 - RNA, 13 nt, Pseudomonas putida KT2440
aaaacaacaauag

SEQ ID NO: 3543403 - RNA, 12 nt, Pseudomonas putida KT2440
aaaacaacaggu

SEQ ID NO: 3543404 - RNA, 16 nt, Pseudomonas putida KT2440
aaaacauugcuaauuu

SEQ ID NO: 3543405 - RNA, 20 nt, Pseudomonas putida KT2440
aaaacauugcuaauuucagg

SEQ ID NO: 3543406 - RNA, 13 nt, Pseudomonas putida KT2440
aaaaccaccagcc

SEQ ID NO: 3543407 - RNA, 15 nt, Pseudomonas putida KT2440
aaaaccggccaagcg

SEQ ID NO: 3543408 - RNA, 19 nt, Pseudomonas putida KT2440
aaaaccggccacgaaggcc

SEQ ID NO: 3543409 - RNA, 16 nt, Pseudomonas putida KT2440
aaaaccguacaaggca

SEQ ID NO: 3543410 - RNA, 18 nt, Pseudomonas putida KT2440
aaaacgaagaauguagaa

SEQ ID NO: 3543411 - RNA, 19 nt, Pseudomonas putida KT2440
aaaacggcggcccggccaa

SEQ ID NO: 3543412 - RNA, 16 nt, Pseudomonas putida KT2440
aaaacggugcagaccu

SEQ ID NO: 3543413 - RNA, 16 nt, Pseudomonas putida KT2440
aaaacuaauauuugaa

SEQ ID NO: 3543414 - RNA, 16 nt, Pseudomonas putida KT2440
aaaacucggucaggca

SEQ ID NO: 3543415 - RNA, 13 nt, Pseudomonas putida KT2440
aaaacucugcagg

SEQ ID NO: 3543416 - RNA, 19 nt, Pseudomonas putida KT2440
aaaagauuugcguuuuaaa

SEQ ID NO: 3543417 - RNA, 18 nt, Pseudomonas putida KT2440
aaaagccccgccagugca

SEQ ID NO: 3543418 - RNA, 15 nt, Pseudomonas putida KT2440
aaaaggguugcaaag

SEQ ID NO: 3543419 - RNA, 18 nt, Pseudomonas putida KT2440
aaaagugguugacaagca

SEQ ID NO: 3543420 - RNA, 21 nt, Pseudomonas putida KT2440
aaaaguuggcugaccggcacg

SEQ ID NO: 3543421 - RNA, 14 nt, Pseudomonas putida KT2440
aaaauauugcgaaa

SEQ ID NO: 3543422 - RNA, 13 nt, Pseudomonas putida KT2440
aaaaucaugcagu

SEQ ID NO: 3543423 - RNA, 20 nt, Pseudomonas putida KT2440
aaaaucucguucaugcccuu

SEQ ID NO: 3543424 - RNA, 14 nt, Pseudomonas putida KT2440
aaaaugcagcaagc

SEQ ID NO: 3543425 - RNA, 15 nt, Pseudomonas putida KT2440
aaaaugcagcaagcu

SEQ ID NO: 3543426 - RNA, 17 nt, Pseudomonas putida KT2440
aaaaugcccccgccgaa

SEQ ID NO: 3543427 - RNA, 18 nt, Pseudomonas putida KT2440
aaaauucuccccgcugaa

SEQ ID NO: 3543428 - RNA, 13 nt, Pseudomonas putida KT2440
aaaauuuuugaau

SEQ ID NO: 3543429 - RNA, 13 nt, Pseudomonas putida KT2440
aaacaacaauagg

SEQ ID NO: 3543430 - RNA, 20 nt, Pseudomonas putida KT2440
aaacacauccacauccggug

SEQ ID NO: 3543431 - RNA, 14 nt, Pseudomonas putida KT2440
aaacaccagcaaca

SEQ ID NO: 3543432 - RNA, 15 nt, Pseudomonas putida KT2440
aaacacgaacaucag

SEQ ID NO: 3543433 - RNA, 13 nt, Pseudomonas putida KT2440
aaacagcaccagc

SEQ ID NO: 3543434 - RNA, 9 nt, Pseudomonas putida KT2440
aaacagcau

SEQ ID NO: 3543435 - RNA, 22 nt, Pseudomonas putida KT2440
aaacaucagccggucucccagc

SEQ ID NO: 3543436 - RNA, 17 nt, Pseudomonas putida KT2440
aaaccaauuacuuggcc

SEQ ID NO: 3543437 - RNA, 14 nt, Pseudomonas putida KT2440
aaaccacagcggcc

SEQ ID NO: 3543438 - RNA, 20 nt, Pseudomonas putida KT2440
aaaccagcagcgccugcagc

SEQ ID NO: 3543439 - RNA, 12 nt, Pseudomonas putida KT2440
aaaccagccccu

SEQ ID NO: 3543440 - RNA, 20 nt, Pseudomonas putida KT2440
aaacccagguacgaagccau

SEQ ID NO: 3543441 - RNA, 14 nt, Pseudomonas putida KT2440
aaaccccagcaagg

SEQ ID NO: 3543442 - RNA, 15 nt, Pseudomonas putida KT2440
aaacccgacaacagc

SEQ ID NO: 3543443 - RNA, 20 nt, Pseudomonas putida KT2440
aaacccgcuccuacaaggua

SEQ ID NO: 3543444 - RNA, 19 nt, Pseudomonas putida KT2440
aaacccgcuccuacgggca

SEQ ID NO: 3543445 - RNA, 20 nt, Pseudomonas putida KT2440
aaacccgcuccuacgggcaa

SEQ ID NO: 3543446 - RNA, 18 nt, Pseudomonas putida KT2440
aaacccggccagcagguc

SEQ ID NO: 3543447 - RNA, 17 nt, Pseudomonas putida KT2440
aaacccucacgcgccag

SEQ ID NO: 3543448 - RNA, 15 nt, Pseudomonas putida KT2440
aaacccucggccaca

SEQ ID NO: 3543449 - RNA, 13 nt, Pseudomonas putida KT2440
aaacccuucucuu

SEQ ID NO: 3543450 - RNA, 15 nt, Pseudomonas putida KT2440
aaaccgaccaggcag

SEQ ID NO: 3543451 - RNA, 19 nt, Pseudomonas putida KT2440
aaaccgcacccggcuacca

SEQ ID NO: 3543452 - RNA, 17 nt, Pseudomonas putida KT2440
aaaccgcucgaagauau

SEQ ID NO: 3543453 - RNA, 21 nt, Pseudomonas putida KT2440
aaaccggaucgggcacaacuc

SEQ ID NO: 3543454 - RNA, 23 nt, Pseudomonas putida KT2440
aaaccggaucgggcacaacucca

SEQ ID NO: 3543455 - RNA, 23 nt, Pseudomonas putida KT2440
aaaccggcaccggcgaacagcaa

SEQ ID NO: 3543456 - RNA, 19 nt, Pseudomonas putida KT2440
aaaccggguaggccccagg

SEQ ID NO: 3543457 - RNA, 17 nt, Pseudomonas putida KT2440
aaaccgucaugcagaug

SEQ ID NO: 3543458 - RNA, 15 nt, Pseudomonas putida KT2440
aaaccgugcaaacaa

SEQ ID NO: 3543459 - RNA, 20 nt, Pseudomonas putida KT2440
aaaccgugcaaacaacuccg

SEQ ID NO: 3543460 - RNA, 22 nt, Pseudomonas putida KT2440
aaaccguuggucagcgacugcc

SEQ ID NO: 3543461 - RNA, 20 nt, Pseudomonas putida KT2440
aaaccuccggcaucauccug

SEQ ID NO: 3543462 - RNA, 22 nt, Pseudomonas putida KT2440
aaaccugccggugcgcgggcgu

SEQ ID NO: 3543463 - RNA, 20 nt, Pseudomonas putida KT2440
aaaccugcgcuugcaccagg

SEQ ID NO: 3543464 - RNA, 15 nt, Pseudomonas putida KT2440
aaacgaaacccugcu

SEQ ID NO: 3543465 - RNA, 23 nt, Pseudomonas putida KT2440
aaacgcaggugcgcacgcugccc

SEQ ID NO: 3543466 - RNA, 13 nt, Pseudomonas putida KT2440
aaacgccagcugu

SEQ ID NO: 3543467 - RNA, 23 nt, Pseudomonas putida KT2440
aaacgcgauacccaauaaaaaca

SEQ ID NO: 3543468 - RNA, 22 nt, Pseudomonas putida KT2440
aaacgcggaucgugacggucug

SEQ ID NO: 3543469 - RNA, 22 nt, Pseudomonas putida KT2440
aaacggaccgcauaguggguau

SEQ ID NO: 3543470 - RNA, 22 nt, Pseudomonas putida KT2440
aaacggcggcccggccaacaac

SEQ ID NO: 3543471 - RNA, 21 nt, Pseudomonas putida KT2440
aaacggugcagaccuguggga

SEQ ID NO: 3543472 - RNA, 15 nt, Pseudomonas putida KT2440
aaacuaauauuugaa

SEQ ID NO: 3543473 - RNA, 14 nt, Pseudomonas putida KT2440
aaacuccacugugc

SEQ ID NO: 3543474 - RNA, 17 nt, Pseudomonas putida KT2440
aacaccgccagaaaauu

SEQ ID NO: 3543475 - RNA, 17 nt, Pseudomonas putida KT2440
aacaccugccagccccg

SEQ ID NO: 3543476 - RNA, 14 nt, Pseudomonas putida KT2440
aacacgaacaccgg

SEQ ID NO: 3543477 - RNA, 16 nt, Pseudomonas putida KT2440
aacacgaacaucagca

SEQ ID NO: 3543478 - RNA, 18 nt, Pseudomonas putida KT2440
aacacgaacaucagcagg

SEQ ID NO: 3543479 - RNA, 21 nt, Pseudomonas putida KT2440
aacacgacgauggccaccagc

SEQ ID NO: 3543480 - RNA, 14 nt, Pseudomonas putida KT2440
aacacgcaggucuu

SEQ ID NO: 3543481 - RNA, 22 nt, Pseudomonas putida KT2440
aacacggcuucgcagacgucuu

SEQ ID NO: 3543482 - RNA, 19 nt, Pseudomonas putida KT2440
aacacgucggcuggcagcu

SEQ ID NO: 3543483 - RNA, 16 nt, Pseudomonas putida KT2440
aacacuuccgggcuga

SEQ ID NO: 3543484 - RNA, 17 nt, Pseudomonas putida KT2440
aacagaacgccuuguuc

SEQ ID NO: 3543485 - RNA, 15 nt, Pseudomonas putida KT2440
aacagaucccgcucc

SEQ ID NO: 3543486 - RNA, 16 nt, Pseudomonas putida KT2440
aacagaucccgcuccu

SEQ ID NO: 3543487 - RNA, 14 nt, Pseudomonas putida KT2440
aacagcacugccag

SEQ ID NO: 3543488 - RNA, 13 nt, Pseudomonas putida KT2440
aacagcagcaccg

SEQ ID NO: 3543489 - RNA, 19 nt, Pseudomonas putida KT2440
aacagcagcgccgccaggc

SEQ ID NO: 3543490 - RNA, 13 nt, Pseudomonas putida KT2440
aacagcaggcaaa

SEQ ID NO: 3543491 - RNA, 17 nt, Pseudomonas putida KT2440
aacagcaguuugcugcg

SEQ ID NO: 3543492 - RNA, 15 nt, Pseudomonas putida KT2440
aacagcauccagcgc

SEQ ID NO: 3543493 - RNA, 22 nt, Pseudomonas putida KT2440
aacagccccaucaccagcccga

SEQ ID NO: 3543494 - RNA, 19 nt, Pseudomonas putida KT2440
aacagcccggugaagucac

SEQ ID NO: 3543495 - RNA, 13 nt, Pseudomonas putida KT2440
aacagccgcgcau

SEQ ID NO: 3543496 - RNA, 19 nt, Pseudomonas putida KT2440
aacagccggcuaucggcca

SEQ ID NO: 3543497 - RNA, 13 nt, Pseudomonas putida KT2440
aacagccgggcag

SEQ ID NO: 3543498 - RNA, 11 nt, Pseudomonas putida KT2440
aacagccuugu

SEQ ID NO: 3543499 - RNA, 18 nt, Pseudomonas putida KT2440
aacagcgcagccaccagc

SEQ ID NO: 3543500 - RNA, 18 nt, Pseudomonas putida KT2440
aacagcgccacgccugca

SEQ ID NO: 3543501 - RNA, 18 nt, Pseudomonas putida KT2440
aacagcgcccagaucagc

SEQ ID NO: 3543502 - RNA, 22 nt, Pseudomonas putida KT2440
aacagcgcccagaucagcagca

SEQ ID NO: 3543503 - RNA, 14 nt, Pseudomonas putida KT2440
aacagcgccgcgau

SEQ ID NO: 3543504 - RNA, 14 nt, Pseudomonas putida KT2440
aacagcgccggcag

SEQ ID NO: 3543505 - RNA, 15 nt, Pseudomonas putida KT2440
aacagcgcgacgcag

SEQ ID NO: 3543506 - RNA, 19 nt, Pseudomonas putida KT2440
aacagcgcgacgcagcagc

SEQ ID NO: 3543507 - RNA, 18 nt, Pseudomonas putida KT2440
aacagcgcgcgaaucacc

SEQ ID NO: 3543508 - RNA, 19 nt, Pseudomonas putida KT2440
aacagcgcgcgaaucacca

SEQ ID NO: 3543509 - RNA, 22 nt, Pseudomonas putida KT2440
aacagcgcugcgaggccccaga

SEQ ID NO: 3543510 - RNA, 22 nt, Pseudomonas putida KT2440
aacagcggcaauucggccggcc

SEQ ID NO: 3543511 - RNA, 21 nt, Pseudomonas putida KT2440
aacagcgucaugcgguacagc

SEQ ID NO: 3543512 - RNA, 15 nt, Pseudomonas putida KT2440
aacagcuccagcaac

SEQ ID NO: 3543513 - RNA, 20 nt, Pseudomonas putida KT2440
aacagcuccagcaacugcgc

SEQ ID NO: 3543514 - RNA, 19 nt, Pseudomonas putida KT2440
aacagcucgauggccagga

SEQ ID NO: 3543515 - RNA, 19 nt, Pseudomonas putida KT2440
aacagcucuggcagcagug

SEQ ID NO: 3543516 - RNA, 22 nt, Pseudomonas putida KT2440
aacagcugcgcgaaguggauau

SEQ ID NO: 3543517 - RNA, 14 nt, Pseudomonas putida KT2440
aacagcuggcgcau

SEQ ID NO: 3543518 - RNA, 20 nt, Pseudomonas putida KT2440
aacagcuggcgcaugacuuc

SEQ ID NO: 3543519 - RNA, 13 nt, Pseudomonas putida KT2440
aacagcuugccau

SEQ ID NO: 3543520 - RNA, 20 nt, Pseudomonas putida KT2440
aacagcuugccauccuugaa

SEQ ID NO: 3543521 - RNA, 15 nt, Pseudomonas putida KT2440
aacaggaacagcgug

SEQ ID NO: 3543522 - RNA, 13 nt, Pseudomonas putida KT2440
aacaggaucagcg

SEQ ID NO: 3543523 - RNA, 20 nt, Pseudomonas putida KT2440
aacaggaucuccucggccag

SEQ ID NO: 3543524 - RNA, 22 nt, Pseudomonas putida KT2440
aacaggcgcuugcccgccgaau

SEQ ID NO: 3543525 - RNA, 13 nt, Pseudomonas putida KT2440
aacaggcggcccg

SEQ ID NO: 3543526 - RNA, 22 nt, Pseudomonas putida KT2440
aacaggcguacaucagccucgg

SEQ ID NO: 3543527 - RNA, 22 nt, Pseudomonas putida KT2440
aacaggcugaugcgcuggcccu

SEQ ID NO: 3543528 - RNA, 15 nt, Pseudomonas putida KT2440
aacagggaaacaaau

SEQ ID NO: 3543529 - RNA, 20 nt, Pseudomonas putida KT2440
aacaggucgccgcuguucag

SEQ ID NO: 3543530 - RNA, 14 nt, Pseudomonas putida KT2440
aacaggugcucacc

SEQ ID NO: 3543531 - RNA, 21 nt, Pseudomonas putida KT2440
aacaguggcccgaugaucagg

SEQ ID NO: 3543532 - RNA, 22 nt, Pseudomonas putida KT2440
aacaguggcccgaugaucaggc

SEQ ID NO: 3543533 - RNA, 19 nt, Pseudomonas putida KT2440
aacaguugaccaaggaacu

SEQ ID NO: 3543534 - RNA, 23 nt, Pseudomonas putida KT2440
aacaguuugcuuuuucgagcagc

SEQ ID NO: 3543535 - RNA, 12 nt, Pseudomonas putida KT2440
aacaguuuucaa

SEQ ID NO: 3543536 - RNA, 15 nt, Pseudomonas putida KT2440
aacaucaggucugcc

SEQ ID NO: 3543537 - RNA, 22 nt, Pseudomonas putida KT2440
aacaucaggucugccaguguca

SEQ ID NO: 3543538 - RNA, 20 nt, Pseudomonas putida KT2440
aacaucgaauuucugcaaca

SEQ ID NO: 3543539 - RNA, 23 nt, Pseudomonas putida KT2440
aacaucgaggcgcgcgccugggu

SEQ ID NO: 3543540 - RNA, 21 nt, Pseudomonas putida KT2440
aacaucgcccccgcugcacag

SEQ ID NO: 3543541 - RNA, 17 nt, Pseudomonas putida KT2440
aacauguuuucaguauc

SEQ ID NO: 3543542 - RNA, 22 nt, Pseudomonas putida KT2440
aaccacacagaugccgccgcug

SEQ ID NO: 3543543 - RNA, 21 nt, Pseudomonas putida KT2440
aaccacaucacgaucaugcug

SEQ ID NO: 3543544 - RNA, 22 nt, Pseudomonas putida KT2440
aaccacaucggcgcgcccuccu

SEQ ID NO: 3543545 - RNA, 14 nt, Pseudomonas putida KT2440
aaccaccaacagca

SEQ ID NO: 3543546 - RNA, 14 nt, Pseudomonas putida KT2440
aaccaccaccgacc

SEQ ID NO: 3543547 - RNA, 21 nt, Pseudomonas putida KT2440
aaccaccgcucaaacccggca

SEQ ID NO: 3543548 - RNA, 18 nt, Pseudomonas putida KT2440
aaccacgaccggcucaac

SEQ ID NO: 3543549 - RNA, 18 nt, Pseudomonas putida KT2440
aaccacugcaaauacccc

SEQ ID NO: 3543550 - RNA, 21 nt, Pseudomonas putida KT2440
aaccagaugcuugguaccguc

SEQ ID NO: 3543551 - RNA, 19 nt, Pseudomonas putida KT2440
aaccagcagaaccccacuc

SEQ ID NO: 3543552 - RNA, 22 nt, Pseudomonas putida KT2440
aaccagcagaaccccacucucc

SEQ ID NO: 3543553 - RNA, 12 nt, Pseudomonas putida KT2440
aaccaggcgcag

SEQ ID NO: 3543554 - RNA, 15 nt, Pseudomonas putida KT2440
aaccaggcgcagcag

SEQ ID NO: 3543555 - RNA, 21 nt, Pseudomonas putida KT2440
aaccaggugcgguccggcucc

SEQ ID NO: 3543556 - RNA, 21 nt, Pseudomonas putida KT2440
aaccaguacugggcguccuuc

SEQ ID NO: 3543557 - RNA, 16 nt, Pseudomonas putida KT2440
aaccaguucagcgccc

SEQ ID NO: 3543558 - RNA, 22 nt, Pseudomonas putida KT2440
aaccaugcgccgcugcuccaug

SEQ ID NO: 3543559 - RNA, 15 nt, Pseudomonas putida KT2440
aaccauguugaaaau

SEQ ID NO: 3543560 - RNA, 20 nt, Pseudomonas putida KT2440
aacccaguacggcgccacug

SEQ ID NO: 3543561 - RNA, 19 nt, Pseudomonas putida KT2440
aacccauacgcaugaaguc

SEQ ID NO: 3543562 - RNA, 22 nt, Pseudomonas putida KT2440
aaccccaccagcacugccuugc

SEQ ID NO: 3543563 - RNA, 12 nt, Pseudomonas putida KT2440
aaccccacgccu

SEQ ID NO: 3543564 - RNA, 13 nt, Pseudomonas putida KT2440
aaccccagccuuc

SEQ ID NO: 3543565 - RNA, 20 nt, Pseudomonas putida KT2440
aaccccagccuucagcaggc

SEQ ID NO: 3543566 - RNA, 13 nt, Pseudomonas putida KT2440
aaccccagcgcgu

SEQ ID NO: 3543567 - RNA, 21 nt, Pseudomonas putida KT2440
aaccccagcgcguacagcgac

SEQ ID NO: 3543568 - RNA, 19 nt, Pseudomonas putida KT2440
aaccccaucaccuuggccg

SEQ ID NO: 3543569 - RNA, 14 nt, Pseudomonas putida KT2440
aaccccuccuucag

SEQ ID NO: 3543570 - RNA, 19 nt, Pseudomonas putida KT2440
aaccccugcaaggccagcg

SEQ ID NO: 3543571 - RNA, 15 nt, Pseudomonas putida KT2440
aaccccuggaaaccc

SEQ ID NO: 3543572 - RNA, 21 nt, Pseudomonas putida KT2440
aacccgauuccuugcagcgcc

SEQ ID NO: 3543573 - RNA, 22 nt, Pseudomonas putida KT2440
aacccgauuccuugcagcgccg

SEQ ID NO: 3543574 - RNA, 20 nt, Pseudomonas putida KT2440
aacccgauuucgcuggggcu

SEQ ID NO: 3543575 - RNA, 15 nt, Pseudomonas putida KT2440
aacccgcgccuacag

SEQ ID NO: 3543576 - RNA, 16 nt, Pseudomonas putida KT2440
aacccgcgccuacgac

SEQ ID NO: 3543577 - RNA, 15 nt, Pseudomonas putida KT2440
aacccgcuccuacac

SEQ ID NO: 3543578 - RNA, 23 nt, Pseudomonas putida KT2440
aacccgcuccuacagggguagcg

SEQ ID NO: 3543579 - RNA, 17 nt, Pseudomonas putida KT2440
aacggacaacaccguug

SEQ ID NO: 3543580 - RNA, 16 nt, Pseudomonas putida KT2440
aacggcaacgccagca

SEQ ID NO: 3543581 - RNA, 17 nt, Pseudomonas putida KT2440
aacggcacacgcaccac

SEQ ID NO: 3543582 - RNA, 18 nt, Pseudomonas putida KT2440
aacggcaccuuugcaggu

SEQ ID NO: 3543583 - RNA, 15 nt, Pseudomonas putida KT2440
aacggcacucgaagc

SEQ ID NO: 3543584 - RNA, 17 nt, Pseudomonas putida KT2440
aacggcagcgacagcug

SEQ ID NO: 3543585 - RNA, 18 nt, Pseudomonas putida KT2440
aacggccgcaccucauuc

SEQ ID NO: 3543586 - RNA, 14 nt, Pseudomonas putida KT2440
aacggccgucaccu

SEQ ID NO: 3543587 - RNA, 15 nt, Pseudomonas putida KT2440
aacggcgccagcagu

SEQ ID NO: 3543588 - RNA, 18 nt, Pseudomonas putida KT2440
aacggcgcuguccagcgc

SEQ ID NO: 3543589 - RNA, 17 nt, Pseudomonas putida KT2440
aacggcggauguuggcc

SEQ ID NO: 3543590 - RNA, 23 nt, Pseudomonas putida KT2440
aacggcucugacauaacaagaac

SEQ ID NO: 3543591 - RNA, 13 nt, Pseudomonas putida KT2440
aacggcuggcgca

SEQ ID NO: 3543592 - RNA, 15 nt, Pseudomonas putida KT2440
aacgggcaaggcugg

SEQ ID NO: 3543593 - RNA, 22 nt, Pseudomonas putida KT2440
aacggguucagguacagcagcu

SEQ ID NO: 3543594 - RNA, 17 nt, Pseudomonas putida KT2440
aacgguaauggccggcu

SEQ ID NO: 3543595 - RNA, 20 nt, Pseudomonas putida KT2440
aacgguaauggccggcugug

SEQ ID NO: 3543596 - RNA, 17 nt, Pseudomonas putida KT2440
aacggucacugagccag

SEQ ID NO: 3543597 - RNA, 19 nt, Pseudomonas putida KT2440
aacggucacugagccaggc

SEQ ID NO: 3543598 - RNA, 20 nt, Pseudomonas putida KT2440
aacggucacugagccaggcc

SEQ ID NO: 3543599 - RNA, 21 nt, Pseudomonas putida KT2440
aacggucagacgcggaacugg

SEQ ID NO: 3543600 - RNA, 12 nt, Pseudomonas putida KT2440
aacggugaacgg

SEQ ID NO: 3543601 - RNA, 15 nt, Pseudomonas putida KT2440
aacggugaacggcgg

SEQ ID NO: 3543602 - RNA, 17 nt, Pseudomonas putida KT2440
aacggugcugccgaggc

SEQ ID NO: 3543603 - RNA, 19 nt, Pseudomonas putida KT2440
aacgguggaaucggcucca

SEQ ID NO: 3543604 - RNA, 17 nt, Pseudomonas putida KT2440
aacgguguggccagugc

SEQ ID NO: 3543605 - RNA, 14 nt, Pseudomonas putida KT2440
aacguaccagccgc

SEQ ID NO: 3543606 - RNA, 15 nt, Pseudomonas putida KT2440
aacguagaaaggaga

SEQ ID NO: 3543607 - RNA, 20 nt, Pseudomonas putida KT2440
aacgucggcagccaugcugu

SEQ ID NO: 3543608 - RNA, 23 nt, Pseudomonas putida KT2440
aacgugaucacuucgccuuccuc

SEQ ID NO: 3543609 - RNA, 23 nt, Pseudomonas putida KT2440
aacgugcgggcuuguccgcgaag

SEQ ID NO: 3543610 - RNA, 16 nt, Pseudomonas putida KT2440
aacguggacagcagcu

SEQ ID NO: 3543611 - RNA, 16 nt, Pseudomonas putida KT2440
aacguucccaauguca

SEQ ID NO: 3543612 - RNA, 13 nt, Pseudomonas putida KT2440
aacucacccgccc

SEQ ID NO: 3543613 - RNA, 12 nt, Pseudomonas putida KT2440
aacucaggcuga

SEQ ID NO: 3543614 - RNA, 17 nt, Pseudomonas putida KT2440
aacuccacguucccgcc

SEQ ID NO: 3543615 - RNA, 17 nt, Pseudomonas putida KT2440
aacuccauggccagggc

SEQ ID NO: 3543616 - RNA, 13 nt, Pseudomonas putida KT2440
aacuccugcugca

SEQ ID NO: 3543617 - RNA, 16 nt, Pseudomonas putida KT2440
aacucgaucggcaccc

SEQ ID NO: 3543618 - RNA, 21 nt, Pseudomonas putida KT2440
aacucgccaaaccauggcguc

SEQ ID NO: 3543619 - RNA, 20 nt, Pseudomonas putida KT2440
aacucgcccgguuuggccug

SEQ ID NO: 3543620 - RNA, 20 nt, Pseudomonas putida KT2440
aacucgcgcauccagccaga

SEQ ID NO: 3543621 - RNA, 13 nt, Pseudomonas putida KT2440
aacucggcgagcc

SEQ ID NO: 3543622 - RNA, 17 nt, Pseudomonas putida KT2440
aacucguugaccacgaa

SEQ ID NO: 3543623 - RNA, 17 nt, Pseudomonas putida KT2440
aacucguuuucgcugau

SEQ ID NO: 3543624 - RNA, 17 nt, Pseudomonas putida KT2440
aacucuaccucacugac

SEQ ID NO: 3543625 - RNA, 15 nt, Pseudomonas putida KT2440
aacucuggcaacagc

SEQ ID NO: 3543626 - RNA, 14 nt, Pseudomonas putida KT2440
aacucuuccccgcc

SEQ ID NO: 3543627 - RNA, 13 nt, Pseudomonas putida KT2440
aacucuugagcug

SEQ ID NO: 3543628 - RNA, 13 nt, Pseudomonas putida KT2440
aacugaugaccgg

SEQ ID NO: 3543629 - RNA, 19 nt, Pseudomonas putida KT2440
aacugaugaccggccuggu

SEQ ID NO: 3543630 - RNA, 19 nt, Pseudomonas putida KT2440
aacugaugggucuugccgg

SEQ ID NO: 3543631 - RNA, 20 nt, Pseudomonas putida KT2440
aacugcagagccugcaccca

SEQ ID NO: 3543632 - RNA, 21 nt, Pseudomonas putida KT2440
aacugccgaccuugggccggc

SEQ ID NO: 3543633 - RNA, 19 nt, Pseudomonas putida KT2440
aacugcgcaccagagggaa

SEQ ID NO: 3543634 - RNA, 20 nt, Pseudomonas putida KT2440
aacugcgcucaaccagccgc

SEQ ID NO: 3543635 - RNA, 23 nt, Pseudomonas putida KT2440
aacugcgcugguacagcaggaac

SEQ ID NO: 3543636 - RNA, 21 nt, Pseudomonas putida KT2440
aacugcuccaggcagccugcc

SEQ ID NO: 3543637 - RNA, 16 nt, Pseudomonas putida KT2440
aacugcucgcugccac

SEQ ID NO: 3543638 - RNA, 15 nt, Pseudomonas putida KT2440
aacugcugcccguug

SEQ ID NO: 3543639 - RNA, 19 nt, Pseudomonas putida KT2440
aacugcuggaaaaagaaca

SEQ ID NO: 3543640 - RNA, 19 nt, Pseudomonas putida KT2440
aacuggaugauccagccca

SEQ ID NO: 3543641 - RNA, 16 nt, Pseudomonas putida KT2440
aacuggcaucggucac

SEQ ID NO: 3543642 - RNA, 12 nt, Pseudomonas putida KT2440
aacuggccagca

SEQ ID NO: 3543643 - RNA, 15 nt, Pseudomonas putida KT2440
aacuggccagcagcc

SEQ ID NO: 3543644 - RNA, 15 nt, Pseudomonas putida KT2440
aacuggccaggguac

SEQ ID NO: 3543645 - RNA, 16 nt, Pseudomonas putida KT2440
aacuggccaggguacu

SEQ ID NO: 3543646 - RNA, 13 nt, Pseudomonas putida KT2440
aacuggcccaccc

SEQ ID NO: 3543647 - RNA, 18 nt, Pseudomonas putida KT2440
aacuggcgcagcaggucc

SEQ ID NO: 3543648 - RNA, 22 nt, Pseudomonas putida KT2440
aacuggcgcaucuuccagcaca

SEQ ID NO: 3543649 - RNA, 20 nt, Pseudomonas putida KT2440
aacuggcgcccggcaucgcu

SEQ ID NO: 3543650 - RNA, 21 nt, Pseudomonas putida KT2440
aacuggcugccgcugaccacc

SEQ ID NO: 3543651 - RNA, 23 nt, Pseudomonas putida KT2440
aacuggggcugcaccgcagcccc

SEQ ID NO: 3543652 - RNA, 17 nt, Pseudomonas putida KT2440
aacuggucggccuugcc

SEQ ID NO: 3543653 - RNA, 17 nt, Pseudomonas putida KT2440
aacuggugaaucagccc

SEQ ID NO: 3543654 - RNA, 19 nt, Pseudomonas putida KT2440
aacugugggagcaggcaug

SEQ ID NO: 3543655 - RNA, 17 nt, Pseudomonas putida KT2440
aacuguuucugcucuuc

SEQ ID NO: 3543656 - RNA, 23 nt, Pseudomonas putida KT2440
aacuguuucugcucuucugccag

SEQ ID NO: 3543657 - RNA, 15 nt, Pseudomonas putida KT2440
aacuucacuucgguu

SEQ ID NO: 3543658 - RNA, 15 nt, Pseudomonas putida KT2440
aacuucgggcugucc

SEQ ID NO: 3543659 - RNA, 11 nt, Pseudomonas putida KT2440
aacuucuccag

SEQ ID NO: 3543660 - RNA, 13 nt, Pseudomonas putida KT2440
aacuucuccagcg

SEQ ID NO: 3543661 - RNA, 23 nt, Pseudomonas putida KT2440
aacuucucgccucagcgccaaua

SEQ ID NO: 3543662 - RNA, 23 nt, Pseudomonas putida KT2440
aacuugcccgcguacucggccag

SEQ ID NO: 3543663 - RNA, 15 nt, Pseudomonas putida KT2440
aacuugcgcucaagc

SEQ ID NO: 3543664 - RNA, 17 nt, Pseudomonas putida KT2440
aacuuggguaacacggu

SEQ ID NO: 3543665 - RNA, 15 nt, Pseudomonas putida KT2440
aacuugucuguacug

SEQ ID NO: 3543666 - RNA, 17 nt, Pseudomonas putida KT2440
aacuuuacggcugaugg

SEQ ID NO: 3543667 - RNA, 11 nt, Pseudomonas putida KT2440
aagaacaacac

SEQ ID NO: 3543668 - RNA, 15 nt, Pseudomonas putida KT2440
aagaacaccugcagc

SEQ ID NO: 3543669 - RNA, 13 nt, Pseudomonas putida KT2440
aagaacacggcuu

SEQ ID NO: 3543670 - RNA, 14 nt, Pseudomonas putida KT2440
aagaacagacccau

SEQ ID NO: 3543671 - RNA, 23 nt, Pseudomonas putida KT2440
aagaagcaaccgcugcauggccu

SEQ ID NO: 3543672 - RNA, 18 nt, Pseudomonas putida KT2440
aagaagccgacccacuug

SEQ ID NO: 3543673 - RNA, 21 nt, Pseudomonas putida KT2440
aagaagccggcaucgccaaca

SEQ ID NO: 3543674 - RNA, 17 nt, Pseudomonas putida KT2440
aagaagcuguagucacc

SEQ ID NO: 3543675 - RNA, 10 nt, Pseudomonas putida KT2440
aagaaggcau

SEQ ID NO: 3543676 - RNA, 13 nt, Pseudomonas putida KT2440
aagaaggcaucca

SEQ ID NO: 3543677 - RNA, 13 nt, Pseudomonas putida KT2440
aagaaggcgaaua

SEQ ID NO: 3543678 - RNA, 12 nt, Pseudomonas putida KT2440
aagaaggcgagc

SEQ ID NO: 3543679 - RNA, 18 nt, Pseudomonas putida KT2440
aagaagguucguccccuu

SEQ ID NO: 3543680 - RNA, 19 nt, Pseudomonas putida KT2440
aagaagucgccacaccaca

SEQ ID NO: 3543681 - RNA, 23 nt, Pseudomonas putida KT2440
aagaauugcugguugaucaacug

SEQ ID NO: 3543682 - RNA, 17 nt, Pseudomonas putida KT2440
aagacgaaguacggcuu

SEQ ID NO: 3543683 - RNA, 15 nt, Pseudomonas putida KT2440
aagacggcagaucag

SEQ ID NO: 3543684 - RNA, 18 nt, Pseudomonas putida KT2440
aagacuccgcuucaucag

SEQ ID NO: 3543685 - RNA, 20 nt, Pseudomonas putida KT2440
aagcuguugucgcgaguguc

SEQ ID NO: 3543686 - RNA, 15 nt, Pseudomonas putida KT2440
aagcuucagcgaccg

SEQ ID NO: 3543687 - RNA, 12 nt, Pseudomonas putida KT2440
aagcuuccaguu

SEQ ID NO: 3543688 - RNA, 15 nt, Pseudomonas putida KT2440
aagcuucuugcaaaa

SEQ ID NO: 3543689 - RNA, 16 nt, Pseudomonas putida KT2440
aagcuugccagcgucu

SEQ ID NO: 3543690 - RNA, 22 nt, Pseudomonas putida KT2440
aagcuuggggcgauguuggccg

SEQ ID NO: 3543691 - RNA, 14 nt, Pseudomonas putida KT2440
aaggacaucaccag

SEQ ID NO: 3543692 - RNA, 16 nt, Pseudomonas putida KT2440
aaggacugccugauca

SEQ ID NO: 3543693 - RNA, 21 nt, Pseudomonas putida KT2440
aaggagaauccacuugaagac

SEQ ID NO: 3543694 - RNA, 22 nt, Pseudomonas putida KT2440
aaggcaaugcccauggccaggc

SEQ ID NO: 3543695 - RNA, 23 nt, Pseudomonas putida KT2440
aaggcaaugcccauggccaggcu

SEQ ID NO: 3543696 - RNA, 18 nt, Pseudomonas putida KT2440
aaggcaccacggaaggcc

SEQ ID NO: 3543697 - RNA, 16 nt, Pseudomonas putida KT2440
aaggcaggucagcgag

SEQ ID NO: 3543698 - RNA, 15 nt, Pseudomonas putida KT2440
aaggcauccagggcg

SEQ ID NO: 3543699 - RNA, 13 nt, Pseudomonas putida KT2440
aaggcaugggcca

SEQ ID NO: 3543700 - RNA, 17 nt, Pseudomonas putida KT2440
aaggcauucagcucggc

SEQ ID NO: 3543701 - RNA, 16 nt, Pseudomonas putida KT2440
aaggccaaccacgccu

SEQ ID NO: 3543702 - RNA, 19 nt, Pseudomonas putida KT2440
aaggccaccacgguacuug

SEQ ID NO: 3543703 - RNA, 17 nt, Pseudomonas putida KT2440
aaggccagccgagccaa

SEQ ID NO: 3543704 - RNA, 16 nt, Pseudomonas putida KT2440
aaggccagcgccugcu

SEQ ID NO: 3543705 - RNA, 16 nt, Pseudomonas putida KT2440
aaggccauuucccugc

SEQ ID NO: 3543706 - RNA, 13 nt, Pseudomonas putida KT2440
aaggccgccaccu

SEQ ID NO: 3543707 - RNA, 19 nt, Pseudomonas putida KT2440
aaggccgcucccacagggc

SEQ ID NO: 3543708 - RNA, 14 nt, Pseudomonas putida KT2440
aaggccggcaccga

SEQ ID NO: 3543709 - RNA, 15 nt, Pseudomonas putida KT2440
aaggccggcagccag

SEQ ID NO: 3543710 - RNA, 19 nt, Pseudomonas putida KT2440
aaggccggcagccagggcc

SEQ ID NO: 3543711 - RNA, 21 nt, Pseudomonas putida KT2440
aaggccgguuuuuucaugcac

SEQ ID NO: 3543712 - RNA, 13 nt, Pseudomonas putida KT2440
aaggccguaggcc

SEQ ID NO: 3543713 - RNA, 19 nt, Pseudomonas putida KT2440
aaggccguggcaaggcccg

SEQ ID NO: 3543714 - RNA, 13 nt, Pseudomonas putida KT2440
aaggccuggccca

SEQ ID NO: 3543715 - RNA, 13 nt, Pseudomonas putida KT2440
aaggcgauguuug

SEQ ID NO: 3543716 - RNA, 16 nt, Pseudomonas putida KT2440
aaggcgcgucccccgg

SEQ ID NO: 3543717 - RNA, 13 nt, Pseudomonas putida KT2440
aaggcgcugucga

SEQ ID NO: 3543718 - RNA, 12 nt, Pseudomonas putida KT2440
aaggcggcccaa

SEQ ID NO: 3543719 - RNA, 15 nt, Pseudomonas putida KT2440
aaggcguauuugacc

SEQ ID NO: 3543720 - RNA, 12 nt, Pseudomonas putida KT2440
aaggcgucacgc

SEQ ID NO: 3543721 - RNA, 19 nt, Pseudomonas putida KT2440
aaggcguuuuccagguugu

SEQ ID NO: 3543722 - RNA, 17 nt, Pseudomonas putida KT2440
aaggcucaggccuugcc

SEQ ID NO: 3543723 - RNA, 17 nt, Pseudomonas putida KT2440
aaggcugacgccaguug

SEQ ID NO: 3543724 - RNA, 19 nt, Pseudomonas putida KT2440
aaggcugcccucgggcagc

SEQ ID NO: 3543725 - RNA, 21 nt, Pseudomonas putida KT2440
aaggcugcccucgggcagccu

SEQ ID NO: 3543726 - RNA, 24 nt, Pseudomonas putida KT2440
aaggcugcuucguucacguagcug

SEQ ID NO: 3543727 - RNA, 15 nt, Pseudomonas putida KT2440
aaggcuggccagacg

SEQ ID NO: 3543728 - RNA, 14 nt, Pseudomonas putida KT2440
aaggcuugcccuca

SEQ ID NO: 3543729 - RNA, 15 nt, Pseudomonas putida KT2440
aaggcuuggugcuca

SEQ ID NO: 3543730 - RNA, 14 nt, Pseudomonas putida KT2440
aagggauguuggaa

SEQ ID NO: 3543731 - RNA, 14 nt, Pseudomonas putida KT2440
aagggcaaugauca

SEQ ID NO: 3543732 - RNA, 22 nt, Pseudomonas putida KT2440
aagggcaggccuggguacgccg

SEQ ID NO: 3543733 - RNA, 14 nt, Pseudomonas putida KT2440
aagggcagggugau

SEQ ID NO: 3543734 - RNA, 14 nt, Pseudomonas putida KT2440
aagggccgccaagc

SEQ ID NO: 3543735 - RNA, 20 nt, Pseudomonas putida KT2440
aagggccgggccugcauuca

SEQ ID NO: 3543736 - RNA, 19 nt, Pseudomonas putida KT2440
aagggccugcaggcagcau

SEQ ID NO: 3543737 - RNA, 19 nt, Pseudomonas putida KT2440
aagggccugugccgggcca

SEQ ID NO: 3543738 - RNA, 14 nt, Pseudomonas putida KT2440
aagggcgaccgaag

SEQ ID NO: 3543739 - RNA, 15 nt, Pseudomonas putida KT2440
aagggcgaccgaagu

SEQ ID NO: 3543740 - RNA, 23 nt, Pseudomonas putida KT2440
aagggcgcugaucaagcccgcuc

SEQ ID NO: 3543741 - RNA, 18 nt, Pseudomonas putida KT2440
aagggcucaacgccaggg

SEQ ID NO: 3543742 - RNA, 12 nt, Pseudomonas putida KT2440
aagggcugguag

SEQ ID NO: 3543743 - RNA, 12 nt, Pseudomonas putida KT2440
aaggggcaaagu

SEQ ID NO: 3543744 - RNA, 21 nt, Pseudomonas putida KT2440
aaggggguauuaagggcaugg

SEQ ID NO: 3543745 - RNA, 15 nt, Pseudomonas putida KT2440
aagggugucaacagg

SEQ ID NO: 3543746 - RNA, 17 nt, Pseudomonas putida KT2440
aagggugucaacaggcu

SEQ ID NO: 3543747 - RNA, 13 nt, Pseudomonas putida KT2440
aagguaaccuggu

SEQ ID NO: 3543748 - RNA, 22 nt, Pseudomonas putida KT2440
aagguacugaucccuacccccu

SEQ ID NO: 3543749 - RNA, 16 nt, Pseudomonas putida KT2440
aagguaucggccaugg

SEQ ID NO: 3543750 - RNA, 18 nt, Pseudomonas putida KT2440
aaggucaaucagggauac

SEQ ID NO: 3543751 - RNA, 13 nt, Pseudomonas putida KT2440
aaggucagcaagc

SEQ ID NO: 3543752 - RNA, 19 nt, Pseudomonas putida KT2440
aaggucucuacgcccaugg

SEQ ID NO: 3543753 - RNA, 22 nt, Pseudomonas putida KT2440
aaggugggguugaccaggcagu

SEQ ID NO: 3543754 - RNA, 16 nt, Pseudomonas putida KT2440
aagguugacacccucu

SEQ ID NO: 3543755 - RNA, 22 nt, Pseudomonas putida KT2440
aagguugacacccucuugaauc

SEQ ID NO: 3543756 - RNA, 14 nt, Pseudomonas putida KT2440
aagguuuguuggca

SEQ ID NO: 3543757 - RNA, 17 nt, Pseudomonas putida KT2440
aagguuuguuggcaugg

SEQ ID NO: 3543758 - RNA, 16 nt, Pseudomonas putida KT2440
aaguacaccggcagca

SEQ ID NO: 3543759 - RNA, 13 nt, Pseudomonas putida KT2440
aaguacaccuugg

SEQ ID NO: 3543760 - RNA, 14 nt, Pseudomonas putida KT2440
aaguacuugcaggu

SEQ ID NO: 3543761 - RNA, 16 nt, Pseudomonas putida KT2440
aaguacuugcaggugc

SEQ ID NO: 3543762 - RNA, 14 nt, Pseudomonas putida KT2440
aaguagaaccacac

SEQ ID NO: 3543763 - RNA, 17 nt, Pseudomonas putida KT2440
aaguagaacuggcgcag

SEQ ID NO: 3543764 - RNA, 17 nt, Pseudomonas putida KT2440
aaguauuaauuugaaca

SEQ ID NO: 3543765 - RNA, 19 nt, Pseudomonas putida KT2440
aaguauuaauuugaacaau

SEQ ID NO: 3543766 - RNA, 23 nt, Pseudomonas putida KT2440
aagucagccagguuuuugauguc

SEQ ID NO: 3543767 - RNA, 18 nt, Pseudomonas putida KT2440
aagucagguaggugcuga

SEQ ID NO: 3543768 - RNA, 22 nt, Pseudomonas putida KT2440
aagucagguaggugcugaccgc

SEQ ID NO: 3543769 - RNA, 15 nt, Pseudomonas putida KT2440
aagucauccauggca

SEQ ID NO: 3543770 - RNA, 22 nt, Pseudomonas putida KT2440
aagucauccgccaggcucucca

SEQ ID NO: 3543771 - RNA, 17 nt, Pseudomonas putida KT2440
aagucauggcuauucuc

SEQ ID NO: 3543772 - RNA, 15 nt, Pseudomonas putida KT2440
aaguccaucaccggc

SEQ ID NO: 3543773 - RNA, 17 nt, Pseudomonas putida KT2440
aagucgaacuugacguc

SEQ ID NO: 3543774 - RNA, 14 nt, Pseudomonas putida KT2440
aagucgaccagcag

SEQ ID NO: 3543775 - RNA, 19 nt, Pseudomonas putida KT2440
aagucgccacaccacagcu

SEQ ID NO: 3543776 - RNA, 22 nt, Pseudomonas putida KT2440
aagucgccgcggguaccaccug

SEQ ID NO: 3543777 - RNA, 13 nt, Pseudomonas putida KT2440
aagugaccggaau

SEQ ID NO: 3543778 - RNA, 14 nt, Pseudomonas putida KT2440
aagugauggccugg

SEQ ID NO: 3543779 - RNA, 23 nt, Pseudomonas putida KT2440
aagugccgccucguugcgaagcg

SEQ ID NO: 3543780 - RNA, 17 nt, Pseudomonas putida KT2440
aagugccguccgcugcc

SEQ ID NO: 3543781 - RNA, 12 nt, Pseudomonas putida KT2440
aaguggaaggca

SEQ ID NO: 3543782 - RNA, 19 nt, Pseudomonas putida KT2440
aaguggauauccagcgagg

SEQ ID NO: 3543783 - RNA, 12 nt, Pseudomonas putida KT2440
aaguggccaagc

SEQ ID NO: 3543784 - RNA, 21 nt, Pseudomonas putida KT2440
aaguggcggcucgcugaacac

SEQ ID NO: 3543785 - RNA, 18 nt, Pseudomonas putida KT2440
aaguggugcccgccaggc

SEQ ID NO: 3543786 - RNA, 23 nt, Pseudomonas putida KT2440
aaguucagcgccucuuugcccug

SEQ ID NO: 3543787 - RNA, 17 nt, Pseudomonas putida KT2440
aaguugagugucagaaa

SEQ ID NO: 3543788 - RNA, 22 nt, Pseudomonas putida KT2440
aaguugcaggcaucgaacgccg

SEQ ID NO: 3543789 - RNA, 15 nt, Pseudomonas putida KT2440
aauaaaaacaacagg

SEQ ID NO: 3543790 - RNA, 12 nt, Pseudomonas putida KT2440
aauaauaaaaaa

SEQ ID NO: 3543791 - RNA, 18 nt, Pseudomonas putida KT2440
aaugcgccgcaccaaaga

SEQ ID NO: 3543792 - RNA, 18 nt, Pseudomonas putida KT2440
aaugcgcgcgaaggcccg

SEQ ID NO: 3543793 - RNA, 16 nt, Pseudomonas putida KT2440
aaugcuacagaagccu

SEQ ID NO: 3543794 - RNA, 15 nt, Pseudomonas putida KT2440
aaugcuccgccacca

SEQ ID NO: 3543795 - RNA, 18 nt, Pseudomonas putida KT2440
aaugcuccggcgacagcu

SEQ ID NO: 3543796 - RNA, 14 nt, Pseudomonas putida KT2440
aaugcucgccugcu

SEQ ID NO: 3543797 - RNA, 14 nt, Pseudomonas putida KT2440
aaugcugccaugca

SEQ ID NO: 3543798 - RNA, 18 nt, Pseudomonas putida KT2440
aaugcugccaugcaaggc

SEQ ID NO: 3543799 - RNA, 19 nt, Pseudomonas putida KT2440
aaugcugccaugcaaggca

SEQ ID NO: 3543800 - RNA, 17 nt, Pseudomonas putida KT2440
aaugcugccuuuuccug

SEQ ID NO: 3543801 - RNA, 22 nt, Pseudomonas putida KT2440
aaugcugccuuuuccugcugca

SEQ ID NO: 3543802 - RNA, 14 nt, Pseudomonas putida KT2440
aauggcaauccccc

SEQ ID NO: 3543803 - RNA, 22 nt, Pseudomonas putida KT2440
aauggcgaugaacacgccgucg

SEQ ID NO: 3543804 - RNA, 16 nt, Pseudomonas putida KT2440
aauggcgcgaacaggg

SEQ ID NO: 3543805 - RNA, 21 nt, Pseudomonas putida KT2440
aauggcgguuuugagacgcau

SEQ ID NO: 3543806 - RNA, 23 nt, Pseudomonas putida KT2440
aauggcgguuuugagacgcaugu

SEQ ID NO: 3543807 - RNA, 22 nt, Pseudomonas putida KT2440
aauggcgucuucgccaggugcg

SEQ ID NO: 3543808 - RNA, 20 nt, Pseudomonas putida KT2440
aaugggaugagugcaugcug

SEQ ID NO: 3543809 - RNA, 16 nt, Pseudomonas putida KT2440
aaugggcugcaaagca

SEQ ID NO: 3543810 - RNA, 21 nt, Pseudomonas putida KT2440
aaugggcugcaaagcagcccc

SEQ ID NO: 3543811 - RNA, 18 nt, Pseudomonas putida KT2440
aauggguacgcaccuugc

SEQ ID NO: 3543812 - RNA, 21 nt, Pseudomonas putida KT2440
aaugggucaggaugccgugcg

SEQ ID NO: 3543813 - RNA, 21 nt, Pseudomonas putida KT2440
aaugggucgcgaagcggcccc

SEQ ID NO: 3543814 - RNA, 14 nt, Pseudomonas putida KT2440
aauggguggcggca

SEQ ID NO: 3543815 - RNA, 18 nt, Pseudomonas putida KT2440
aauggucggggugagggg

SEQ ID NO: 3543816 - RNA, 15 nt, Pseudomonas putida KT2440
aauguacaaugcacu

SEQ ID NO: 3543817 - RNA, 23 nt, Pseudomonas putida KT2440
aauguaggaucaaguaccccuuu

SEQ ID NO: 3543818 - RNA, 16 nt, Pseudomonas putida KT2440
aaugucaccgcggcaa

SEQ ID NO: 3543819 - RNA, 12 nt, Pseudomonas putida KT2440
aaugucagcgcu

SEQ ID NO: 3543820 - RNA, 15 nt, Pseudomonas putida KT2440
aaugucagcgcucgg

SEQ ID NO: 3543821 - RNA, 18 nt, Pseudomonas putida KT2440
aaugucagcgcucggguu

SEQ ID NO: 3543822 - RNA, 17 nt, Pseudomonas putida KT2440
aauguccagauccucuu

SEQ ID NO: 3543823 - RNA, 20 nt, Pseudomonas putida KT2440
aaugucgacguacagcagcu

SEQ ID NO: 3543824 - RNA, 22 nt, Pseudomonas putida KT2440
aaugucgacguacagcagcuca

SEQ ID NO: 3543825 - RNA, 13 nt, Pseudomonas putida KT2440
aaugucgagcaug

SEQ ID NO: 3543826 - RNA, 21 nt, Pseudomonas putida KT2440
aaugucuucaaucgucaugau

SEQ ID NO: 3543827 - RNA, 17 nt, Pseudomonas putida KT2440
aauguggauagucccug

SEQ ID NO: 3543828 - RNA, 16 nt, Pseudomonas putida KT2440
aauguguauccacccc

SEQ ID NO: 3543829 - RNA, 15 nt, Pseudomonas putida KT2440
aauguugaagaugac

SEQ ID NO: 3543830 - RNA, 18 nt, Pseudomonas putida KT2440
aauuacagcuugccagcg

SEQ ID NO: 3543831 - RNA, 19 nt, Pseudomonas putida KT2440
aauuacuuggccugggcuu

SEQ ID NO: 3543832 - RNA, 16 nt, Pseudomonas putida KT2440
aauuaguuugacagcc

SEQ ID NO: 3543833 - RNA, 13 nt, Pseudomonas putida KT2440
aauuauuggccag

SEQ ID NO: 3543834 - RNA, 24 nt, Pseudomonas putida KT2440
aauucaacgcgguggcuggcaccg

SEQ ID NO: 3543835 - RNA, 13 nt, Pseudomonas putida KT2440
aauucaaugaguu

SEQ ID NO: 3543836 - RNA, 15 nt, Pseudomonas putida KT2440
aauucauaaggauca

SEQ ID NO: 3543837 - RNA, 18 nt, Pseudomonas putida KT2440
aauucauaaggaucauga

SEQ ID NO: 3543838 - RNA, 14 nt, Pseudomonas putida KT2440
aauucccuacugcg

SEQ ID NO: 3543839 - RNA, 16 nt, Pseudomonas putida KT2440
aauuccugccggggcg

SEQ ID NO: 3543840 - RNA, 14 nt, Pseudomonas putida KT2440
aauucgaccagcag

SEQ ID NO: 3543841 - RNA, 22 nt, Pseudomonas putida KT2440
aauucuggcuuagcgcgggccu

SEQ ID NO: 3543842 - RNA, 13 nt, Pseudomonas putida KT2440
aauugcacccgcg

SEQ ID NO: 3543843 - RNA, 20 nt, Pseudomonas putida KT2440
aauugcccgagcgcuuaaau

SEQ ID NO: 3543844 - RNA, 22 nt, Pseudomonas putida KT2440
aauugcccuuaccggaugcgcu

SEQ ID NO: 3543845 - RNA, 14 nt, Pseudomonas putida KT2440
aauuggagcggccu

SEQ ID NO: 3543846 - RNA, 19 nt, Pseudomonas putida KT2440
aauuggccggcgcugagcg

SEQ ID NO: 3543847 - RNA, 23 nt, Pseudomonas putida KT2440
aauuggcgagcaggcccgccccu

SEQ ID NO: 3543848 - RNA, 16 nt, Pseudomonas putida KT2440
aauuggcuuccaggug

SEQ ID NO: 3543849 - RNA, 17 nt, Pseudomonas putida KT2440
aauugguuaaaagccaa

SEQ ID NO: 3543850 - RNA, 17 nt, Pseudomonas putida KT2440
aauugucggggaaaugc

SEQ ID NO: 3543851 - RNA, 19 nt, Pseudomonas putida KT2440
aauuugccccuuccuugua

SEQ ID NO: 3543852 - RNA, 18 nt, Pseudomonas putida KT2440
aauuuucuugaaaacauu

SEQ ID NO: 3543853 - RNA, 11 nt, Pseudomonas putida KT2440
acaaaaacaac

SEQ ID NO: 3543854 - RNA, 13 nt, Pseudomonas putida KT2440
acaaaaacaacaa

SEQ ID NO: 3543855 - RNA, 17 nt, Pseudomonas putida KT2440
acaaaaacaacaauagg

SEQ ID NO: 3543856 - RNA, 17 nt, Pseudomonas putida KT2440
acaaaacccuucucuuc

SEQ ID NO: 3543857 - RNA, 19 nt, Pseudomonas putida KT2440
acaaacaccggccccccag

SEQ ID NO: 3543858 - RNA, 20 nt, Pseudomonas putida KT2440
acaaaccgacccugcugcug

SEQ ID NO: 3543859 - RNA, 17 nt, Pseudomonas putida KT2440
acaaacgccagcaugcu

SEQ ID NO: 3543860 - RNA, 22 nt, Pseudomonas putida KT2440
acaaacgccgggcacaucacca

SEQ ID NO: 3543861 - RNA, 17 nt, Pseudomonas putida KT2440
acaaacguaccagccgc

SEQ ID NO: 3543862 - RNA, 18 nt, Pseudomonas putida KT2440
acaaacugcugagucagc

SEQ ID NO: 3543863 - RNA, 17 nt, Pseudomonas putida KT2440
acaaagccccggcagcg

SEQ ID NO: 3543864 - RNA, 23 nt, Pseudomonas putida KT2440
acaaagccccggcagcgaugccg

SEQ ID NO: 3543865 - RNA, 18 nt, Pseudomonas putida KT2440
acaaagcggauuucgcca

SEQ ID NO: 3543866 - RNA, 17 nt, Pseudomonas putida KT2440
acaaaggccggcaccga

SEQ ID NO: 3543867 - RNA, 21 nt, Pseudomonas putida KT2440
acaaaggccggcaccgacagc

SEQ ID NO: 3543868 - RNA, 16 nt, Pseudomonas putida KT2440
acaaaggcgucgcugu

SEQ ID NO: 3543869 - RNA, 19 nt, Pseudomonas putida KT2440
acaaagggcgacuucgguc

SEQ ID NO: 3543870 - RNA, 13 nt, Pseudomonas putida KT2440
acaaauccaggac

SEQ ID NO: 3543871 - RNA, 12 nt, Pseudomonas putida KT2440
acaaaucggcag

SEQ ID NO: 3543872 - RNA, 18 nt, Pseudomonas putida KT2440
acaaaucuucccgcgucc

SEQ ID NO: 3543873 - RNA, 16 nt, Pseudomonas putida KT2440
acaacaaggacugccu

SEQ ID NO: 3543874 - RNA, 17 nt, Pseudomonas putida KT2440
acaacaaggacugccug

SEQ ID NO: 3543875 - RNA, 22 nt, Pseudomonas putida KT2440
acaacauaccgcugggcacccu

SEQ ID NO: 3543876 - RNA, 18 nt, Pseudomonas putida KT2440
acaaccaauccccccucc

SEQ ID NO: 3543877 - RNA, 12 nt, Pseudomonas putida KT2440
acaaccccaacc

SEQ ID NO: 3543878 - RNA, 14 nt, Pseudomonas putida KT2440
acaacccccacagg

SEQ ID NO: 3543879 - RNA, 17 nt, Pseudomonas putida KT2440
acaacccccacagggca

SEQ ID NO: 3543880 - RNA, 16 nt, Pseudomonas putida KT2440
acaaccccuugcucaa

SEQ ID NO: 3543881 - RNA, 18 nt, Pseudomonas putida KT2440
acaacccgaucaggugca

SEQ ID NO: 3543882 - RNA, 14 nt, Pseudomonas putida KT2440
acaacccgcgcugc

SEQ ID NO: 3543883 - RNA, 12 nt, Pseudomonas putida KT2440
acaaccggggca

SEQ ID NO: 3543884 - RNA, 19 nt, Pseudomonas putida KT2440
acaaccgugaaucgcgcuu

SEQ ID NO: 3543885 - RNA, 22 nt, Pseudomonas putida KT2440
acaaccugaacaaggccuggcc

SEQ ID NO: 3543886 - RNA, 18 nt, Pseudomonas putida KT2440
acaacgaucagcgccgaa

SEQ ID NO: 3543887 - RNA, 15 nt, Pseudomonas putida KT2440
acaacgaugugcgag

SEQ ID NO: 3543888 - RNA, 16 nt, Pseudomonas putida KT2440
acaacgcagccggcac

SEQ ID NO: 3543889 - RNA, 22 nt, Pseudomonas putida KT2440
acaacgcccgccgucaucgaac

SEQ ID NO: 3543890 - RNA, 17 nt, Pseudomonas putida KT2440
acaacgcgccaccgccg

SEQ ID NO: 3543891 - RNA, 21 nt, Pseudomonas putida KT2440
acaacgcgcgggcaauggcca

SEQ ID NO: 3543892 - RNA, 15 nt, Pseudomonas putida KT2440
acaacggccgcaaug

SEQ ID NO: 3543893 - RNA, 16 nt, Pseudomonas putida KT2440
acaacggcucacugcu

SEQ ID NO: 3543894 - RNA, 14 nt, Pseudomonas putida KT2440
acaacggcugugcc

SEQ ID NO: 3543895 - RNA, 17 nt, Pseudomonas putida KT2440
acaacuccaccccuucc

SEQ ID NO: 3543896 - RNA, 13 nt, Pseudomonas putida KT2440
acacgcuugucga

SEQ ID NO: 3543897 - RNA, 23 nt, Pseudomonas putida KT2440
acacggacucauagcucagcugg

SEQ ID NO: 3543898 - RNA, 15 nt, Pseudomonas putida KT2440
acacggcaagccacg

SEQ ID NO: 3543899 - RNA, 21 nt, Pseudomonas putida KT2440
acacggcgaugcgccccccag

SEQ ID NO: 3543900 - RNA, 21 nt, Pseudomonas putida KT2440
acacggcugccgacaggccgu

SEQ ID NO: 3543901 - RNA, 18 nt, Pseudomonas putida KT2440
acacgguaguccugccau

SEQ ID NO: 3543902 - RNA, 18 nt, Pseudomonas putida KT2440
acacgguaugcagguacc

SEQ ID NO: 3543903 - RNA, 15 nt, Pseudomonas putida KT2440
acacgguuuccaggc

SEQ ID NO: 3543904 - RNA, 18 nt, Pseudomonas putida KT2440
acacgucauacagcccga

SEQ ID NO: 3543905 - RNA, 20 nt, Pseudomonas putida KT2440
acacguccagccccgcaccg

SEQ ID NO: 3543906 - RNA, 17 nt, Pseudomonas putida KT2440
acacgucggcuggcagc

SEQ ID NO: 3543907 - RNA, 20 nt, Pseudomonas putida KT2440
acacgucggcuggcagcuug

SEQ ID NO: 3543908 - RNA, 12 nt, Pseudomonas putida KT2440
acacucaccgcg

SEQ ID NO: 3543909 - RNA, 19 nt, Pseudomonas putida KT2440
acacucagccgcugcgccu

SEQ ID NO: 3543910 - RNA, 20 nt, Pseudomonas putida KT2440
acacucagccgcugcgccug

SEQ ID NO: 3543911 - RNA, 15 nt, Pseudomonas putida KT2440
acacucgacgcugcc

SEQ ID NO: 3543912 - RNA, 12 nt, Pseudomonas putida KT2440
acacucgccagg

SEQ ID NO: 3543913 - RNA, 17 nt, Pseudomonas putida KT2440
acacucgcccccaucgc

SEQ ID NO: 3543914 - RNA, 13 nt, Pseudomonas putida KT2440
acacugagcacca

SEQ ID NO: 3543915 - RNA, 13 nt, Pseudomonas putida KT2440
acacugccaucuc

SEQ ID NO: 3543916 - RNA, 19 nt, Pseudomonas putida KT2440
acacuggcuuucccccagc

SEQ ID NO: 3543917 - RNA, 18 nt, Pseudomonas putida KT2440
acacugucccgaucaggu

SEQ ID NO: 3543918 - RNA, 16 nt, Pseudomonas putida KT2440
acacugucccggcaca

SEQ ID NO: 3543919 - RNA, 20 nt, Pseudomonas putida KT2440
acacugucccggcacaaccg

SEQ ID NO: 3543920 - RNA, 13 nt, Pseudomonas putida KT2440
acacuucacgcac

SEQ ID NO: 3543921 - RNA, 18 nt, Pseudomonas putida KT2440
acacuucaggcugcgccg

SEQ ID NO: 3543922 - RNA, 14 nt, Pseudomonas putida KT2440
acagaaaagcauca

SEQ ID NO: 3543923 - RNA, 14 nt, Pseudomonas putida KT2440
acagaaacagauuc

SEQ ID NO: 3543924 - RNA, 10 nt, Pseudomonas putida KT2440
acagaacaau

SEQ ID NO: 3543925 - RNA, 13 nt, Pseudomonas putida KT2440
acagaacaauaaa

SEQ ID NO: 3543926 - RNA, 15 nt, Pseudomonas putida KT2440
acagaacaccaccag

SEQ ID NO: 3543927 - RNA, 13 nt, Pseudomonas putida KT2440
acagacaacauca

SEQ ID NO: 3543928 - RNA, 18 nt, Pseudomonas putida KT2440
acagacaaucaucggcag

SEQ ID NO: 3543929 - RNA, 15 nt, Pseudomonas putida KT2440
acagaccgccgggcc

SEQ ID NO: 3543930 - RNA, 15 nt, Pseudomonas putida KT2440
acagacgggucggaa

SEQ ID NO: 3543931 - RNA, 14 nt, Pseudomonas putida KT2440
acagauaaaccugc

SEQ ID NO: 3543932 - RNA, 15 nt, Pseudomonas putida KT2440
acagauaaaccugcc

SEQ ID NO: 3543933 - RNA, 15 nt, Pseudomonas putida KT2440
acagaugcugcugca

SEQ ID NO: 3543934 - RNA, 16 nt, Pseudomonas putida KT2440
acagauggcaccccag

SEQ ID NO: 3543935 - RNA, 18 nt, Pseudomonas putida KT2440
acagauuccguaccaguu

SEQ ID NO: 3543936 - RNA, 22 nt, Pseudomonas putida KT2440
acagcacaaggcucaagcgcag

SEQ ID NO: 3543937 - RNA, 15 nt, Pseudomonas putida KT2440
acagcacaccuuccg

SEQ ID NO: 3543938 - RNA, 14 nt, Pseudomonas putida KT2440
acagcaccaugcgc

SEQ ID NO: 3543939 - RNA, 19 nt, Pseudomonas putida KT2440
acagcaccgccauggccag

SEQ ID NO: 3543940 - RNA, 23 nt, Pseudomonas putida KT2440
acagcaccgccauggccaggucg

SEQ ID NO: 3543941 - RNA, 14 nt, Pseudomonas putida KT2440
acagcaccggccag

SEQ ID NO: 3543942 - RNA, 18 nt, Pseudomonas putida KT2440
acagcacugcauuggcca

SEQ ID NO: 3543943 - RNA, 20 nt, Pseudomonas putida KT2440
acagcacugccagcccggcg

SEQ ID NO: 3543944 - RNA, 22 nt, Pseudomonas putida KT2440
acagcagcugcauuggcggcag

SEQ ID NO: 3543945 - RNA, 18 nt, Pseudomonas putida KT2440
acagcagcuugaacaacg

SEQ ID NO: 3543946 - RNA, 16 nt, Pseudomonas putida KT2440
acagcagcuugcgcgc

SEQ ID NO: 3543947 - RNA, 11 nt, Pseudomonas putida KT2440
acagcaggaac

SEQ ID NO: 3543948 - RNA, 12 nt, Pseudomonas putida KT2440
acagcaggaaca

SEQ ID NO: 3543949 - RNA, 19 nt, Pseudomonas putida KT2440
acagcaggaacagcggcag

SEQ ID NO: 3543950 - RNA, 19 nt, Pseudomonas putida KT2440
acagcaggcaaagaaugcc

SEQ ID NO: 3543951 - RNA, 19 nt, Pseudomonas putida KT2440
acagcaggccaaggaacgu

SEQ ID NO: 3543952 - RNA, 16 nt, Pseudomonas putida KT2440
acagcaguugcugcug

SEQ ID NO: 3543953 - RNA, 20 nt, Pseudomonas putida KT2440
acagcaucaaucgcuccagg

SEQ ID NO: 3543954 - RNA, 13 nt, Pseudomonas putida KT2440
acagcaucaucag

SEQ ID NO: 3543955 - RNA, 17 nt, Pseudomonas putida KT2440
acagcauccaaagccaa

SEQ ID NO: 3543956 - RNA, 17 nt, Pseudomonas putida KT2440
acagcaucggcagguca

SEQ ID NO: 3543957 - RNA, 20 nt, Pseudomonas putida KT2440
acagcaucugcaccaggaag

SEQ ID NO: 3543958 - RNA, 19 nt, Pseudomonas putida KT2440
acagcauuacgcggcagca

SEQ ID NO: 3543959 - RNA, 12 nt, Pseudomonas putida KT2440
acagccacgccc

SEQ ID NO: 3543960 - RNA, 16 nt, Pseudomonas putida KT2440
acagccagaaagccac

SEQ ID NO: 3543961 - RNA, 17 nt, Pseudomonas putida KT2440
acagcccaaggcuggcc

SEQ ID NO: 3543962 - RNA, 18 nt, Pseudomonas putida KT2440
acagccccaucaccagcc

SEQ ID NO: 3543963 - RNA, 20 nt, Pseudomonas putida KT2440
acagccccuuccccaggccg

SEQ ID NO: 3543964 - RNA, 13 nt, Pseudomonas putida KT2440
acagcccgggcau

SEQ ID NO: 3543965 - RNA, 14 nt, Pseudomonas putida KT2440
acagcccgggcaug

SEQ ID NO: 3543966 - RNA, 21 nt, Pseudomonas putida KT2440
acagcccuacgcagucagcca

SEQ ID NO: 3543967 - RNA, 22 nt, Pseudomonas putida KT2440
acagcccuacgcagucagccac

SEQ ID NO: 3543968 - RNA, 19 nt, Pseudomonas putida KT2440
acagcccugcaauccgaac

SEQ ID NO: 3543969 - RNA, 13 nt, Pseudomonas putida KT2440
acagccgcggcac

SEQ ID NO: 3543970 - RNA, 16 nt, Pseudomonas putida KT2440
acagccgcggcaccca

SEQ ID NO: 3543971 - RNA, 21 nt, Pseudomonas putida KT2440
acagccggcccuucugcugcu

SEQ ID NO: 3543972 - RNA, 19 nt, Pseudomonas putida KT2440
acagccuaagguugcuccu

SEQ ID NO: 3543973 - RNA, 18 nt, Pseudomonas putida KT2440
acagccuaccaacgcagc

SEQ ID NO: 3543974 - RNA, 22 nt, Pseudomonas putida KT2440
acagccuaccaacgcagcaugc

SEQ ID NO: 3543975 - RNA, 15 nt, Pseudomonas putida KT2440
acagccucaaggccg

SEQ ID NO: 3543976 - RNA, 16 nt, Pseudomonas putida KT2440
acagccucaaggccgg

SEQ ID NO: 3543977 - RNA, 16 nt, Pseudomonas putida KT2440
acagccuccaguugcu

SEQ ID NO: 3543978 - RNA, 22 nt, Pseudomonas putida KT2440
acagccuccaguugcuccaccu

SEQ ID NO: 3543979 - RNA, 17 nt, Pseudomonas putida KT2440
acagccuuggguaacca

SEQ ID NO: 3543980 - RNA, 19 nt, Pseudomonas putida KT2440
acagcgacaugccggccac

SEQ ID NO: 3543981 - RNA, 23 nt, Pseudomonas putida KT2440
acagcgcagccaccagcuucauc

SEQ ID NO: 3543982 - RNA, 17 nt, Pseudomonas putida KT2440
acagcgcauaggccaag

SEQ ID NO: 3543983 - RNA, 23 nt, Pseudomonas putida KT2440
acagcgccgcggccaacauucac

SEQ ID NO: 3543984 - RNA, 12 nt, Pseudomonas putida KT2440
acagcgccucca

SEQ ID NO: 3543985 - RNA, 13 nt, Pseudomonas putida KT2440
acagcgccuccag

SEQ ID NO: 3543986 - RNA, 15 nt, Pseudomonas putida KT2440
acagcgccugcugcu

SEQ ID NO: 3543987 - RNA, 21 nt, Pseudomonas putida KT2440
acagcgccugcugcuggauca

SEQ ID NO: 3543988 - RNA, 16 nt, Pseudomonas putida KT2440
acagcgccuggcgaga

SEQ ID NO: 3543989 - RNA, 20 nt, Pseudomonas putida KT2440
acagcgccuugaagcuggcc

SEQ ID NO: 3543990 - RNA, 13 nt, Pseudomonas putida KT2440
acagcgcgacgca

SEQ ID NO: 3543991 - RNA, 15 nt, Pseudomonas putida KT2440
acagcgcgccgccga

SEQ ID NO: 3543992 - RNA, 19 nt, Pseudomonas putida KT2440
acagcgcuaucucggacac

SEQ ID NO: 3543993 - RNA, 14 nt, Pseudomonas putida KT2440
acagcggccacagc

SEQ ID NO: 3543994 - RNA, 16 nt, Pseudomonas putida KT2440
acagcggccacagcgc

SEQ ID NO: 3543995 - RNA, 12 nt, Pseudomonas putida KT2440
acagcggcccca

SEQ ID NO: 3543996 - RNA, 21 nt, Pseudomonas putida KT2440
acagcgucaugcgguacagca

SEQ ID NO: 3543997 - RNA, 16 nt, Pseudomonas putida KT2440
acagcguccaguucaa

SEQ ID NO: 3543998 - RNA, 18 nt, Pseudomonas putida KT2440
acagcgugcgcucaggcg

SEQ ID NO: 3543999 - RNA, 17 nt, Pseudomonas putida KT2440
acagcguugcagaaacu

SEQ ID NO: 3544000 - RNA, 21 nt, Pseudomonas putida KT2440
acagcucaacccgccugacgc

SEQ ID NO: 3544001 - RNA, 20 nt, Pseudomonas putida KT2440
acagcucaagcccugccgcc

SEQ ID NO: 3544002 - RNA, 14 nt, Pseudomonas putida KT2440
acaucaucaucuuc

SEQ ID NO: 3544003 - RNA, 21 nt, Pseudomonas putida KT2440
acaucaucaucuucgagguca

SEQ ID NO: 3544004 - RNA, 15 nt, Pseudomonas putida KT2440
acauccaccaggcug

SEQ ID NO: 3544005 - RNA, 16 nt, Pseudomonas putida KT2440
acauccaccaggcugg

SEQ ID NO: 3544006 - RNA, 21 nt, Pseudomonas putida KT2440
acauccaccaggcuggccacc

SEQ ID NO: 3544007 - RNA, 13 nt, Pseudomonas putida KT2440
acauccagcgccu

SEQ ID NO: 3544008 - RNA, 20 nt, Pseudomonas putida KT2440
acauccccgccgccagcagc

SEQ ID NO: 3544009 - RNA, 14 nt, Pseudomonas putida KT2440
acauccgaccccag

SEQ ID NO: 3544010 - RNA, 22 nt, Pseudomonas putida KT2440
acauccucuuugcucuucaccu

SEQ ID NO: 3544011 - RNA, 15 nt, Pseudomonas putida KT2440
acaucgaagcagugc

SEQ ID NO: 3544012 - RNA, 15 nt, Pseudomonas putida KT2440
acaucgauuucgcca

SEQ ID NO: 3544013 - RNA, 17 nt, Pseudomonas putida KT2440
acaucgauuucgccauc

SEQ ID NO: 3544014 - RNA, 19 nt, Pseudomonas putida KT2440
acaucgccgucaucaccac

SEQ ID NO: 3544015 - RNA, 22 nt, Pseudomonas putida KT2440
acaucgcgguauccaucaccau

SEQ ID NO: 3544016 - RNA, 16 nt, Pseudomonas putida KT2440
acaucggccaccgccg

SEQ ID NO: 3544017 - RNA, 20 nt, Pseudomonas putida KT2440
acaucggugaucgcaaaaca

SEQ ID NO: 3544018 - RNA, 18 nt, Pseudomonas putida KT2440
acaucgguuucgccggug

SEQ ID NO: 3544019 - RNA, 13 nt, Pseudomonas putida KT2440
acaucuccacugc

SEQ ID NO: 3544020 - RNA, 22 nt, Pseudomonas putida KT2440
acaucugggguuggacccaggc

SEQ ID NO: 3544021 - RNA, 16 nt, Pseudomonas putida KT2440
acaugaaccacacacu

SEQ ID NO: 3544022 - RNA, 17 nt, Pseudomonas putida KT2440
acaugaucggguucuuc

SEQ ID NO: 3544023 - RNA, 17 nt, Pseudomonas putida KT2440
acaugcacgccacgccc

SEQ ID NO: 3544024 - RNA, 18 nt, Pseudomonas putida KT2440
acaugccaaagaaggacu

SEQ ID NO: 3544025 - RNA, 22 nt, Pseudomonas putida KT2440
acaugccacggccuucuucacg

SEQ ID NO: 3544026 - RNA, 18 nt, Pseudomonas putida KT2440
acaugcccgcggcucacc

SEQ ID NO: 3544027 - RNA, 18 nt, Pseudomonas putida KT2440
acaugccggccaccacac

SEQ ID NO: 3544028 - RNA, 14 nt, Pseudomonas putida KT2440
acaugccggcccaa

SEQ ID NO: 3544029 - RNA, 21 nt, Pseudomonas putida KT2440
acaugccggcccaaggcacca

SEQ ID NO: 3544030 - RNA, 15 nt, Pseudomonas putida KT2440
acaugccugcacugg

SEQ ID NO: 3544031 - RNA, 17 nt, Pseudomonas putida KT2440
acaugcgagccgcugcc

SEQ ID NO: 3544032 - RNA, 17 nt, Pseudomonas putida KT2440
acaugcggcaccgccag

SEQ ID NO: 3544033 - RNA, 21 nt, Pseudomonas putida KT2440
acaugcugcgccccagguugc

SEQ ID NO: 3544034 - RNA, 11 nt, Pseudomonas putida KT2440
acauggcgcuu

SEQ ID NO: 3544035 - RNA, 20 nt, Pseudomonas putida KT2440
acaugguguugggcagggug

SEQ ID NO: 3544036 - RNA, 14 nt, Pseudomonas putida KT2440
acauguaaugaaaa

SEQ ID NO: 3544037 - RNA, 21 nt, Pseudomonas putida KT2440
acauucaccagccaggcacag

SEQ ID NO: 3544038 - RNA, 22 nt, Pseudomonas putida KT2440
acauucaccagccaggcacaga

SEQ ID NO: 3544039 - RNA, 19 nt, Pseudomonas putida KT2440
acauucaccgccuaugaaa

SEQ ID NO: 3544040 - RNA, 20 nt, Pseudomonas putida KT2440
acauucagcagcgccugguc

SEQ ID NO: 3544041 - RNA, 21 nt, Pseudomonas putida KT2440
acauucaggaugcuucggcug

SEQ ID NO: 3544042 - RNA, 14 nt, Pseudomonas putida KT2440
acauugaagaagcc

SEQ ID NO: 3544043 - RNA, 14 nt, Pseudomonas putida KT2440
acauuucacagcaa

SEQ ID NO: 3544044 - RNA, 19 nt, Pseudomonas putida KT2440
acauuucacagcaaaaaau

SEQ ID NO: 3544045 - RNA, 19 nt, Pseudomonas putida KT2440
acauuuccagcaugauguc

SEQ ID NO: 3544046 - RNA, 22 nt, Pseudomonas putida KT2440
accaaaaaaagccccgccaguu

SEQ ID NO: 3544047 - RNA, 21 nt, Pseudomonas putida KT2440
accaaacacgcccuugcccca

SEQ ID NO: 3544048 - RNA, 17 nt, Pseudomonas putida KT2440
accaaagaaaaucgacc

SEQ ID NO: 3544049 - RNA, 20 nt, Pseudomonas putida KT2440
accaacaguugaccaaggaa

SEQ ID NO: 3544050 - RNA, 15 nt, Pseudomonas putida KT2440
accaaccccugcggc

SEQ ID NO: 3544051 - RNA, 20 nt, Pseudomonas putida KT2440
accaacgcauuuucaucaaa

SEQ ID NO: 3544052 - RNA, 21 nt, Pseudomonas putida KT2440
accaacggcuucacauccacc

SEQ ID NO: 3544053 - RNA, 18 nt, Pseudomonas putida KT2440
accaacuggucggccuug

SEQ ID NO: 3544054 - RNA, 14 nt, Pseudomonas putida KT2440
accaaggcuuccgc

SEQ ID NO: 3544055 - RNA, 23 nt, Pseudomonas putida KT2440
accaagggugucaacaggcuggc

SEQ ID NO: 3544056 - RNA, 18 nt, Pseudomonas putida KT2440
accaaggugcuaccggcg

SEQ ID NO: 3544057 - RNA, 19 nt, Pseudomonas putida KT2440
accaaggugcuaccggcgc

SEQ ID NO: 3544058 - RNA, 23 nt, Pseudomonas putida KT2440
accaagucgauuuucacgcccga

SEQ ID NO: 3544059 - RNA, 22 nt, Pseudomonas putida KT2440
accaaucaacgguggccagcag

SEQ ID NO: 3544060 - RNA, 13 nt, Pseudomonas putida KT2440
accaauccagccc

SEQ ID NO: 3544061 - RNA, 14 nt, Pseudomonas putida KT2440
accaauccccccuc

SEQ ID NO: 3544062 - RNA, 18 nt, Pseudomonas putida KT2440
accaaucugguuacccaa

SEQ ID NO: 3544063 - RNA, 21 nt, Pseudomonas putida KT2440
accaaucugguuacccaacag

SEQ ID NO: 3544064 - RNA, 16 nt, Pseudomonas putida KT2440
accaauggcaaucgcc

SEQ ID NO: 3544065 - RNA, 17 nt, Pseudomonas putida KT2440
accaauggcaaucgccu

SEQ ID NO: 3544066 - RNA, 17 nt, Pseudomonas putida KT2440
accaauugguuaaaagc

SEQ ID NO: 3544067 - RNA, 21 nt, Pseudomonas putida KT2440
accaauugguuaaaagccaac

SEQ ID NO: 3544068 - RNA, 15 nt, Pseudomonas putida KT2440
accacaaaccacagc

SEQ ID NO: 3544069 - RNA, 17 nt, Pseudomonas putida KT2440
accacaagaacugcgac

SEQ ID NO: 3544070 - RNA, 14 nt, Pseudomonas putida KT2440
accacacaccccag

SEQ ID NO: 3544071 - RNA, 17 nt, Pseudomonas putida KT2440
accacacaccccagaac

SEQ ID NO: 3544072 - RNA, 13 nt, Pseudomonas putida KT2440
accacacagaugc

SEQ ID NO: 3544073 - RNA, 22 nt, Pseudomonas putida KT2440
accacacagaugccgccgcugc

SEQ ID NO: 3544074 - RNA, 20 nt, Pseudomonas putida KT2440
accacacggcagccccaacc

SEQ ID NO: 3544075 - RNA, 14 nt, Pseudomonas putida KT2440
accacacuagcccc

SEQ ID NO: 3544076 - RNA, 20 nt, Pseudomonas putida KT2440
accacacugcucgucaaacc

SEQ ID NO: 3544077 - RNA, 22 nt, Pseudomonas putida KT2440
accacacuggucacgcucggcc

SEQ ID NO: 3544078 - RNA, 17 nt, Pseudomonas putida KT2440
accacagcacgccucgg

SEQ ID NO: 3544079 - RNA, 18 nt, Pseudomonas putida KT2440
accacagccauuggccca

SEQ ID NO: 3544080 - RNA, 15 nt, Pseudomonas putida KT2440
accacaggcgcuuga

SEQ ID NO: 3544081 - RNA, 21 nt, Pseudomonas putida KT2440
accacaggcgcuugaagaagc

SEQ ID NO: 3544082 - RNA, 19 nt, Pseudomonas putida KT2440
accacauccgaccccagca

SEQ ID NO: 3544083 - RNA, 17 nt, Pseudomonas putida KT2440
accacauccucuuugcu

SEQ ID NO: 3544084 - RNA, 20 nt, Pseudomonas putida KT2440
accacauggccguucuugau

SEQ ID NO: 3544085 - RNA, 14 nt, Pseudomonas putida KT2440
accacccaccagca

SEQ ID NO: 3544086 - RNA, 14 nt, Pseudomonas putida KT2440
accaccccggggcg

SEQ ID NO: 3544087 - RNA, 13 nt, Pseudomonas putida KT2440
accacccggggca

SEQ ID NO: 3544088 - RNA, 20 nt, Pseudomonas putida KT2440
accacccugaugcagcagug

SEQ ID NO: 3544089 - RNA, 13 nt, Pseudomonas putida KT2440
accaccgaccgca

SEQ ID NO: 3544090 - RNA, 13 nt, Pseudomonas putida KT2440
accaccgaccugu

SEQ ID NO: 3544091 - RNA, 21 nt, Pseudomonas putida KT2440
accaccgauguguguccacca

SEQ ID NO: 3544092 - RNA, 14 nt, Pseudomonas putida KT2440
accaccgcaggugc

SEQ ID NO: 3544093 - RNA, 17 nt, Pseudomonas putida KT2440
accaccgccaaggcacg

SEQ ID NO: 3544094 - RNA, 13 nt, Pseudomonas putida KT2440
accaccgcgaaac

SEQ ID NO: 3544095 - RNA, 21 nt, Pseudomonas putida KT2440
accaccgcgaaacacagcagg

SEQ ID NO: 3544096 - RNA, 19 nt, Pseudomonas putida KT2440
accaccgcguacagcugcu

SEQ ID NO: 3544097 - RNA, 22 nt, Pseudomonas putida KT2440
accaccggacgcuugccaccca

SEQ ID NO: 3544098 - RNA, 19 nt, Pseudomonas putida KT2440
accaccggccgacccgccu

SEQ ID NO: 3544099 - RNA, 15 nt, Pseudomonas putida KT2440
accaccguuacgccg

SEQ ID NO: 3544100 - RNA, 14 nt, Pseudomonas putida KT2440
accaccucaucccc

SEQ ID NO: 3544101 - RNA, 20 nt, Pseudomonas putida KT2440
accaccuccaccccgcaggc

SEQ ID NO: 3544102 - RNA, 13 nt, Pseudomonas putida KT2440
accaccugcaggg

SEQ ID NO: 3544103 - RNA, 19 nt, Pseudomonas putida KT2440
accaccugccaacgcaccg

SEQ ID NO: 3544104 - RNA, 13 nt, Pseudomonas putida KT2440
accaccugcucgg

SEQ ID NO: 3544105 - RNA, 21 nt, Pseudomonas putida KT2440
accaccugcucggcgcgguca

SEQ ID NO: 3544106 - RNA, 12 nt, Pseudomonas putida KT2440
accaccugggcc

SEQ ID NO: 3544107 - RNA, 16 nt, Pseudomonas putida KT2440
accaggcaguaggugc

SEQ ID NO: 3544108 - RNA, 15 nt, Pseudomonas putida KT2440
accaggcccagcagg

SEQ ID NO: 3544109 - RNA, 20 nt, Pseudomonas putida KT2440
accaggccgaucaccagcac

SEQ ID NO: 3544110 - RNA, 19 nt, Pseudomonas putida KT2440
accaggccguugaucagcg

SEQ ID NO: 3544111 - RNA, 22 nt, Pseudomonas putida KT2440
accaggccguugaucagcgaca

SEQ ID NO: 3544112 - RNA, 15 nt, Pseudomonas putida KT2440
accaggccuggaugc

SEQ ID NO: 3544113 - RNA, 17 nt, Pseudomonas putida KT2440
accaggcgcagcagcuc

SEQ ID NO: 3544114 - RNA, 15 nt, Pseudomonas putida KT2440
accaggcgcggcagc

SEQ ID NO: 3544115 - RNA, 23 nt, Pseudomonas putida KT2440
accagggccuuggccuggggcuu

SEQ ID NO: 3544116 - RNA, 14 nt, Pseudomonas putida KT2440
accagggcuggcag

SEQ ID NO: 3544117 - RNA, 23 nt, Pseudomonas putida KT2440
accaggguggcgauccacagcgg

SEQ ID NO: 3544118 - RNA, 19 nt, Pseudomonas putida KT2440
accaggucauaguucuggc

SEQ ID NO: 3544119 - RNA, 22 nt, Pseudomonas putida KT2440
accaggucauaguucuggcugc

SEQ ID NO: 3544120 - RNA, 17 nt, Pseudomonas putida KT2440
accagguccaccagcag

SEQ ID NO: 3544121 - RNA, 15 nt, Pseudomonas putida KT2440
accagguccagcgug

SEQ ID NO: 3544122 - RNA, 18 nt, Pseudomonas putida KT2440
accaggucgccagcacca

SEQ ID NO: 3544123 - RNA, 15 nt, Pseudomonas putida KT2440
accaggucgcggugc

SEQ ID NO: 3544124 - RNA, 22 nt, Pseudomonas putida KT2440
accaggucgcggugcagcggga

SEQ ID NO: 3544125 - RNA, 21 nt, Pseudomonas putida KT2440
accaggucgguagggaucacc

SEQ ID NO: 3544126 - RNA, 13 nt, Pseudomonas putida KT2440
accaggucuucaa

SEQ ID NO: 3544127 - RNA, 16 nt, Pseudomonas putida KT2440
accaggugcagguacu

SEQ ID NO: 3544128 - RNA, 13 nt, Pseudomonas putida KT2440
accaggugcuugc

SEQ ID NO: 3544129 - RNA, 19 nt, Pseudomonas putida KT2440
accaggugguaacuggcca

SEQ ID NO: 3544130 - RNA, 14 nt, Pseudomonas putida KT2440
accagguuggccgc

SEQ ID NO: 3544131 - RNA, 20 nt, Pseudomonas putida KT2440
accagguuggccgccgccag

SEQ ID NO: 3544132 - RNA, 16 nt, Pseudomonas putida KT2440
accagguuguggccca

SEQ ID NO: 3544133 - RNA, 16 nt, Pseudomonas putida KT2440
accaguaaugcagccg

SEQ ID NO: 3544134 - RNA, 15 nt, Pseudomonas putida KT2440
accaguaccgcgccu

SEQ ID NO: 3544135 - RNA, 18 nt, Pseudomonas putida KT2440
accaguaccgcgccucca

SEQ ID NO: 3544136 - RNA, 21 nt, Pseudomonas putida KT2440
accaguacgaacuacgcgcca

SEQ ID NO: 3544137 - RNA, 15 nt, Pseudomonas putida KT2440
accaguacugggcgu

SEQ ID NO: 3544138 - RNA, 21 nt, Pseudomonas putida KT2440
accaguaguucucgacagcca

SEQ ID NO: 3544139 - RNA, 22 nt, Pseudomonas putida KT2440
accaguaguucucgacagccac

SEQ ID NO: 3544140 - RNA, 17 nt, Pseudomonas putida KT2440
accagugcaacguucac

SEQ ID NO: 3544141 - RNA, 21 nt, Pseudomonas putida KT2440
accagugcaacguucaccguc

SEQ ID NO: 3544142 - RNA, 23 nt, Pseudomonas putida KT2440
accagugucaccgagacgaucac

SEQ ID NO: 3544143 - RNA, 12 nt, Pseudomonas putida KT2440
accagugucugc

SEQ ID NO: 3544144 - RNA, 20 nt, Pseudomonas putida KT2440
accaguucaccauccgccag

SEQ ID NO: 3544145 - RNA, 18 nt, Pseudomonas putida KT2440
accaguucagcgcccgca

SEQ ID NO: 3544146 - RNA, 14 nt, Pseudomonas putida KT2440
accaguuccaccgg

SEQ ID NO: 3544147 - RNA, 17 nt, Pseudomonas putida KT2440
accaguuccaccggcaa

SEQ ID NO: 3544148 - RNA, 16 nt, Pseudomonas putida KT2440
accaguucgccaucgc

SEQ ID NO: 3544149 - RNA, 15 nt, Pseudomonas putida KT2440
accaguucgggaagu

SEQ ID NO: 3544150 - RNA, 13 nt, Pseudomonas putida KT2440
accaguugcucgc

SEQ ID NO: 3544151 - RNA, 14 nt, Pseudomonas putida KT2440
accaguugguaaaa

SEQ ID NO: 3544152 - RNA, 20 nt, Pseudomonas putida KT2440
accaucaagucauccgccag

SEQ ID NO: 3544153 - RNA, 17 nt, Pseudomonas putida KT2440
accaucaccgccagcau

SEQ ID NO: 3544154 - RNA, 18 nt, Pseudomonas putida KT2440
accaucagagcgccagca

SEQ ID NO: 3544155 - RNA, 23 nt, Pseudomonas putida KT2440
accaucagccuguggguaugcca

SEQ ID NO: 3544156 - RNA, 17 nt, Pseudomonas putida KT2440
accaucaggcacaggcc

SEQ ID NO: 3544157 - RNA, 22 nt, Pseudomonas putida KT2440
accaucaucagacagaagccug

SEQ ID NO: 3544158 - RNA, 14 nt, Pseudomonas putida KT2440
accaucgaccuggc

SEQ ID NO: 3544159 - RNA, 18 nt, Pseudomonas putida KT2440
accaucgaccuggcccga

SEQ ID NO: 3544160 - RNA, 14 nt, Pseudomonas putida KT2440
accaucgccggcac

SEQ ID NO: 3544161 - RNA, 15 nt, Pseudomonas putida KT2440
accaucgccggcacg

SEQ ID NO: 3544162 - RNA, 15 nt, Pseudomonas putida KT2440
accaucggcuccagc

SEQ ID NO: 3544163 - RNA, 16 nt, Pseudomonas putida KT2440
accaucggcuccagcg

SEQ ID NO: 3544164 - RNA, 17 nt, Pseudomonas putida KT2440
accaugaaaaacaacaa

SEQ ID NO: 3544165 - RNA, 17 nt, Pseudomonas putida KT2440
accaugaauggcgucuu

SEQ ID NO: 3544166 - RNA, 15 nt, Pseudomonas putida KT2440
accaugcgccgcugc

SEQ ID NO: 3544167 - RNA, 21 nt, Pseudomonas putida KT2440
accaugcgcggguccgauccg

SEQ ID NO: 3544168 - RNA, 17 nt, Pseudomonas putida KT2440
accaugcggcucuguuu

SEQ ID NO: 3544169 - RNA, 15 nt, Pseudomonas putida KT2440
accaugcucggccag

SEQ ID NO: 3544170 - RNA, 17 nt, Pseudomonas putida KT2440
accauggcgaugaacug

SEQ ID NO: 3544171 - RNA, 15 nt, Pseudomonas putida KT2440
accauguacugcaga

SEQ ID NO: 3544172 - RNA, 19 nt, Pseudomonas putida KT2440
accauguacugcagacagu

SEQ ID NO: 3544173 - RNA, 13 nt, Pseudomonas putida KT2440
accauucccugca

SEQ ID NO: 3544174 - RNA, 20 nt, Pseudomonas putida KT2440
accauuggccaaccagccgg

SEQ ID NO: 3544175 - RNA, 22 nt, Pseudomonas putida KT2440
accauuggccaaccagccggca

SEQ ID NO: 3544176 - RNA, 21 nt, Pseudomonas putida KT2440
acccaacagcauccaaagcca

SEQ ID NO: 3544177 - RNA, 19 nt, Pseudomonas putida KT2440
acccaaccgcgccagcucc

SEQ ID NO: 3544178 - RNA, 14 nt, Pseudomonas putida KT2440
acccaaccugccga

SEQ ID NO: 3544179 - RNA, 14 nt, Pseudomonas putida KT2440
acccaacuccagcg

SEQ ID NO: 3544180 - RNA, 17 nt, Pseudomonas putida KT2440
acccaagcacaaggcca

SEQ ID NO: 3544181 - RNA, 19 nt, Pseudomonas putida KT2440
acccaagcacaaggccacu

SEQ ID NO: 3544182 - RNA, 14 nt, Pseudomonas putida KT2440
acccaaggcaucca

SEQ ID NO: 3544183 - RNA, 15 nt, Pseudomonas putida KT2440
acccaauaaaaacaa

SEQ ID NO: 3544184 - RNA, 16 nt, Pseudomonas putida KT2440
acccaauaaaaacaac

SEQ ID NO: 3544185 - RNA, 16 nt, Pseudomonas putida KT2440
acccaauagcccaccg

SEQ ID NO: 3544186 - RNA, 20 nt, Pseudomonas putida KT2440
acccaauagcccaccgucag

SEQ ID NO: 3544187 - RNA, 14 nt, Pseudomonas putida KT2440
acccacaagcgcag

SEQ ID NO: 3544188 - RNA, 14 nt, Pseudomonas putida KT2440
acccacacccgcgc

SEQ ID NO: 3544189 - RNA, 22 nt, Pseudomonas putida KT2440
acccacagcgccugcugcugga

SEQ ID NO: 3544190 - RNA, 15 nt, Pseudomonas putida KT2440
acccaccacggccug

SEQ ID NO: 3544191 - RNA, 16 nt, Pseudomonas putida KT2440
acccaccacggccugg

SEQ ID NO: 3544192 - RNA, 15 nt, Pseudomonas putida KT2440
acccaccagcacugc

SEQ ID NO: 3544193 - RNA, 15 nt, Pseudomonas putida KT2440
acccaccagcagugc

SEQ ID NO: 3544194 - RNA, 18 nt, Pseudomonas putida KT2440
acccaccagcagugcccc

SEQ ID NO: 3544195 - RNA, 13 nt, Pseudomonas putida KT2440
acccacccucgca

SEQ ID NO: 3544196 - RNA, 15 nt, Pseudomonas putida KT2440
acccaccgcagguca

SEQ ID NO: 3544197 - RNA, 23 nt, Pseudomonas putida KT2440
acccacggcaauucgccggcagc

SEQ ID NO: 3544198 - RNA, 17 nt, Pseudomonas putida KT2440
acccacuccccacuccu

SEQ ID NO: 3544199 - RNA, 14 nt, Pseudomonas putida KT2440
acccacuccgggug

SEQ ID NO: 3544200 - RNA, 13 nt, Pseudomonas putida KT2440
acccagaacagcc

SEQ ID NO: 3544201 - RNA, 15 nt, Pseudomonas putida KT2440
acccagaacagccac

SEQ ID NO: 3544202 - RNA, 21 nt, Pseudomonas putida KT2440
acccagacucaaucaggcagc

SEQ ID NO: 3544203 - RNA, 15 nt, Pseudomonas putida KT2440
acccagcacccgcag

SEQ ID NO: 3544204 - RNA, 18 nt, Pseudomonas putida KT2440
acccagcacuucguccag

SEQ ID NO: 3544205 - RNA, 14 nt, Pseudomonas putida KT2440
acccagcaggccga

SEQ ID NO: 3544206 - RNA, 12 nt, Pseudomonas putida KT2440
acccagccagcc

SEQ ID NO: 3544207 - RNA, 22 nt, Pseudomonas putida KT2440
acccagccagccacggaucacc

SEQ ID NO: 3544208 - RNA, 14 nt, Pseudomonas putida KT2440
acccagcgcgaagc

SEQ ID NO: 3544209 - RNA, 13 nt, Pseudomonas putida KT2440
acccagcgcuggu

SEQ ID NO: 3544210 - RNA, 22 nt, Pseudomonas putida KT2440
acccagcgcugguuuaucagca

SEQ ID NO: 3544211 - RNA, 23 nt, Pseudomonas putida KT2440
acccagcgcuugagaccaggccu

SEQ ID NO: 3544212 - RNA, 19 nt, Pseudomonas putida KT2440
acccagcggucagcaucuu

SEQ ID NO: 3544213 - RNA, 13 nt, Pseudomonas putida KT2440
acccgcgaacagg

SEQ ID NO: 3544214 - RNA, 20 nt, Pseudomonas putida KT2440
acccgcgaagaagacaccgc

SEQ ID NO: 3544215 - RNA, 16 nt, Pseudomonas putida KT2440
acccgcgaagaagccg

SEQ ID NO: 3544216 - RNA, 14 nt, Pseudomonas putida KT2440
acccgcgaagaggc

SEQ ID NO: 3544217 - RNA, 21 nt, Pseudomonas putida KT2440
acccgcgaagaggccaguacc

SEQ ID NO: 3544218 - RNA, 18 nt, Pseudomonas putida KT2440
acccgcgaagaggcccga

SEQ ID NO: 3544219 - RNA, 20 nt, Pseudomonas putida KT2440
acccgcgaagaggccggcaa

SEQ ID NO: 3544220 - RNA, 23 nt, Pseudomonas putida KT2440
acccgcgaagaggccggcaaagc

SEQ ID NO: 3544221 - RNA, 19 nt, Pseudomonas putida KT2440
acccgcgaagaggccggua

SEQ ID NO: 3544222 - RNA, 20 nt, Pseudomonas putida KT2440
acccgcgaagcaggcgacgc

SEQ ID NO: 3544223 - RNA, 14 nt, Pseudomonas putida KT2440
acccgcgaaugcgg

SEQ ID NO: 3544224 - RNA, 12 nt, Pseudomonas putida KT2440
acccgcgccagg

SEQ ID NO: 3544225 - RNA, 15 nt, Pseudomonas putida KT2440
acccgcgccuacagc

SEQ ID NO: 3544226 - RNA, 18 nt, Pseudomonas putida KT2440
acccgcgccuacaggcaa

SEQ ID NO: 3544227 - RNA, 14 nt, Pseudomonas putida KT2440
acccgcgccuacga

SEQ ID NO: 3544228 - RNA, 22 nt, Pseudomonas putida KT2440
acccgcgccuacgacgauugcg

SEQ ID NO: 3544229 - RNA, 13 nt, Pseudomonas putida KT2440
acccgcgcguugc

SEQ ID NO: 3544230 - RNA, 16 nt, Pseudomonas putida KT2440
acccgcgcguugcgga

SEQ ID NO: 3544231 - RNA, 13 nt, Pseudomonas putida KT2440
acccgcgcugccu

SEQ ID NO: 3544232 - RNA, 17 nt, Pseudomonas putida KT2440
acccgcgcugccucguc

SEQ ID NO: 3544233 - RNA, 18 nt, Pseudomonas putida KT2440
acccgcgucucgccgcug

SEQ ID NO: 3544234 - RNA, 19 nt, Pseudomonas putida KT2440
acccgcguuggcagcacca

SEQ ID NO: 3544235 - RNA, 20 nt, Pseudomonas putida KT2440
acccgcguuggcagcaccac

SEQ ID NO: 3544236 - RNA, 15 nt, Pseudomonas putida KT2440
acccgcguuugcaac

SEQ ID NO: 3544237 - RNA, 17 nt, Pseudomonas putida KT2440
acccgcuacaccggccu

SEQ ID NO: 3544238 - RNA, 14 nt, Pseudomonas putida KT2440
acccgcucaaagcg

SEQ ID NO: 3544239 - RNA, 23 nt, Pseudomonas putida KT2440
acccgcucccacaaaggaaaucc

SEQ ID NO: 3544240 - RNA, 22 nt, Pseudomonas putida KT2440
acccgcucccacagaaggcugc

SEQ ID NO: 3544241 - RNA, 19 nt, Pseudomonas putida KT2440
acccgcuccuacaaagcgg

SEQ ID NO: 3544242 - RNA, 18 nt, Pseudomonas putida KT2440
acccgcuccuacaggcga

SEQ ID NO: 3544243 - RNA, 21 nt, Pseudomonas putida KT2440
acccgcuccuacaggcgaccg

SEQ ID NO: 3544244 - RNA, 20 nt, Pseudomonas putida KT2440
acccgcuccuaccacguaca

SEQ ID NO: 3544245 - RNA, 21 nt, Pseudomonas putida KT2440
acccgcuccuacgacggccug

SEQ ID NO: 3544246 - RNA, 23 nt, Pseudomonas putida KT2440
acccgcuccuacgggcaaccgca

SEQ ID NO: 3544247 - RNA, 21 nt, Pseudomonas putida KT2440
acccgcuccuacuacggccug

SEQ ID NO: 3544248 - RNA, 12 nt, Pseudomonas putida KT2440
acccgcuccugc

SEQ ID NO: 3544249 - RNA, 23 nt, Pseudomonas putida KT2440
acccgcucggccuugucuggcac

SEQ ID NO: 3544250 - RNA, 18 nt, Pseudomonas putida KT2440
acccgcugccacccacag

SEQ ID NO: 3544251 - RNA, 21 nt, Pseudomonas putida KT2440
acccgcugccacccacaggca

SEQ ID NO: 3544252 - RNA, 17 nt, Pseudomonas putida KT2440
acccgcugcccguccgg

SEQ ID NO: 3544253 - RNA, 16 nt, Pseudomonas putida KT2440
acccgcuggaccuggc

SEQ ID NO: 3544254 - RNA, 15 nt, Pseudomonas putida KT2440
acccgcuggcgaccg

SEQ ID NO: 3544255 - RNA, 19 nt, Pseudomonas putida KT2440
acccgcuggcgaucaggca

SEQ ID NO: 3544256 - RNA, 13 nt, Pseudomonas putida KT2440
acccgcuucgccg

SEQ ID NO: 3544257 - RNA, 23 nt, Pseudomonas putida KT2440
acccgcuucgcucagaaucagcu

SEQ ID NO: 3544258 - RNA, 17 nt, Pseudomonas putida KT2440
acccgcuugccacggcg

SEQ ID NO: 3544259 - RNA, 18 nt, Pseudomonas putida KT2440
acccgcuugccacggcgu

SEQ ID NO: 3544260 - RNA, 22 nt, Pseudomonas putida KT2440
acccgcuugccuuccucggcca

SEQ ID NO: 3544261 - RNA, 15 nt, Pseudomonas putida KT2440
acccggaccagcgcc

SEQ ID NO: 3544262 - RNA, 13 nt, Pseudomonas putida KT2440
acccggacccugg

SEQ ID NO: 3544263 - RNA, 23 nt, Pseudomonas putida KT2440
acccggcaauggucacgcugauc

SEQ ID NO: 3544264 - RNA, 14 nt, Pseudomonas putida KT2440
acccggcagaauca

SEQ ID NO: 3544265 - RNA, 14 nt, Pseudomonas putida KT2440
acccggccaacgac

SEQ ID NO: 3544266 - RNA, 12 nt, Pseudomonas putida KT2440
acccggccagca

SEQ ID NO: 3544267 - RNA, 13 nt, Pseudomonas putida KT2440
acccggccagcag

SEQ ID NO: 3544268 - RNA, 15 nt, Pseudomonas putida KT2440
acccggccagcaggu

SEQ ID NO: 3544269 - RNA, 17 nt, Pseudomonas putida KT2440
acccggccagcagguca

SEQ ID NO: 3544270 - RNA, 15 nt, Pseudomonas putida KT2440
acccggccaggccgu

SEQ ID NO: 3544271 - RNA, 19 nt, Pseudomonas putida KT2440
acccggccgaggccggguu

SEQ ID NO: 3544272 - RNA, 13 nt, Pseudomonas putida KT2440
acccggccgcucc

SEQ ID NO: 3544273 - RNA, 16 nt, Pseudomonas putida KT2440
acccggccgcuccagc

SEQ ID NO: 3544274 - RNA, 21 nt, Pseudomonas putida KT2440
acccggccuuggccgcuggcc

SEQ ID NO: 3544275 - RNA, 19 nt, Pseudomonas putida KT2440
acccggcgcaagccggguu

SEQ ID NO: 3544276 - RNA, 12 nt, Pseudomonas putida KT2440
acccggcuggac

SEQ ID NO: 3544277 - RNA, 14 nt, Pseudomonas putida KT2440
acccggcuggucga

SEQ ID NO: 3544278 - RNA, 16 nt, Pseudomonas putida KT2440
acccgggcagcgggcu

SEQ ID NO: 3544279 - RNA, 19 nt, Pseudomonas putida KT2440
acccgguaaaaccgcucga

SEQ ID NO: 3544280 - RNA, 11 nt, Pseudomonas putida KT2440
acccggucagg

SEQ ID NO: 3544281 - RNA, 13 nt, Pseudomonas putida KT2440
acccggugcaccc

SEQ ID NO: 3544282 - RNA, 16 nt, Pseudomonas putida KT2440
acccgucgcugccaaa

SEQ ID NO: 3544283 - RNA, 16 nt, Pseudomonas putida KT2440
acccgugcccggcauc

SEQ ID NO: 3544284 - RNA, 14 nt, Pseudomonas putida KT2440
acccgugccugccu

SEQ ID NO: 3544285 - RNA, 18 nt, Pseudomonas putida KT2440
acccgugccugccugcaa

SEQ ID NO: 3544286 - RNA, 16 nt, Pseudomonas putida KT2440
acccgugcucuucacc

SEQ ID NO: 3544287 - RNA, 16 nt, Pseudomonas putida KT2440
acccgugcugcucgcc

SEQ ID NO: 3544288 - RNA, 23 nt, Pseudomonas putida KT2440
acccguuccuacgcaggcaccgc

SEQ ID NO: 3544289 - RNA, 20 nt, Pseudomonas putida KT2440
acccuacgaacaaauccgcg

SEQ ID NO: 3544290 - RNA, 12 nt, Pseudomonas putida KT2440
acccucaccaac

SEQ ID NO: 3544291 - RNA, 15 nt, Pseudomonas putida KT2440
acccucacgcgccag

SEQ ID NO: 3544292 - RNA, 16 nt, Pseudomonas putida KT2440
acccucacgcgccagg

SEQ ID NO: 3544293 - RNA, 20 nt, Pseudomonas putida KT2440
acccucacucgcggccauga

SEQ ID NO: 3544294 - RNA, 14 nt, Pseudomonas putida KT2440
acccucgaccucga

SEQ ID NO: 3544295 - RNA, 20 nt, Pseudomonas putida KT2440
acccucgccccgcgcaagcg

SEQ ID NO: 3544296 - RNA, 16 nt, Pseudomonas putida KT2440
acccucggcaucgaac

SEQ ID NO: 3544297 - RNA, 14 nt, Pseudomonas putida KT2440
acccucguccccgc

SEQ ID NO: 3544298 - RNA, 15 nt, Pseudomonas putida KT2440
acccucuuccuugug

SEQ ID NO: 3544299 - RNA, 19 nt, Pseudomonas putida KT2440
acccucuugaauccccuua

SEQ ID NO: 3544300 - RNA, 14 nt, Pseudomonas putida KT2440
acccugaaauggac

SEQ ID NO: 3544301 - RNA, 24 nt, Pseudomonas putida KT2440
acccugaaauggacgccacguccu

SEQ ID NO: 3544302 - RNA, 20 nt, Pseudomonas putida KT2440
acccugacgcugcacuucca

SEQ ID NO: 3544303 - RNA, 20 nt, Pseudomonas putida KT2440
acccugagggagcgggcuug

SEQ ID NO: 3544304 - RNA, 17 nt, Pseudomonas putida KT2440
acccugagucuggcgcc

SEQ ID NO: 3544305 - RNA, 17 nt, Pseudomonas putida KT2440
acccugaucgaugagcg

SEQ ID NO: 3544306 - RNA, 17 nt, Pseudomonas putida KT2440
acccugaugcagcagug

SEQ ID NO: 3544307 - RNA, 20 nt, Pseudomonas putida KT2440
acccugaugcagcagugcca

SEQ ID NO: 3544308 - RNA, 15 nt, Pseudomonas putida KT2440
acccugcgccaggca

SEQ ID NO: 3544309 - RNA, 22 nt, Pseudomonas putida KT2440
acccugcuauaucucugguaca

SEQ ID NO: 3544310 - RNA, 21 nt, Pseudomonas putida KT2440
acccuggcgguugaccagggc

SEQ ID NO: 3544311 - RNA, 17 nt, Pseudomonas putida KT2440
acccuggucacgcaguu

SEQ ID NO: 3544312 - RNA, 15 nt, Pseudomonas putida KT2440
acccuggucaugcag

SEQ ID NO: 3544313 - RNA, 14 nt, Pseudomonas putida KT2440
acccuguacccgcu

SEQ ID NO: 3544314 - RNA, 22 nt, Pseudomonas putida KT2440
acccugucgaucacgggcaaug

SEQ ID NO: 3544315 - RNA, 13 nt, Pseudomonas putida KT2440
acccuuccagccc

SEQ ID NO: 3544316 - RNA, 20 nt, Pseudomonas putida KT2440
acccuucgcggguaaacccg

SEQ ID NO: 3544317 - RNA, 16 nt, Pseudomonas putida KT2440
acccuugcagcgccug

SEQ ID NO: 3544318 - RNA, 14 nt, Pseudomonas putida KT2440
acccuugggcacca

SEQ ID NO: 3544319 - RNA, 23 nt, Pseudomonas putida KT2440
accgccgcacaggaaaacugcgg

SEQ ID NO: 3544320 - RNA, 14 nt, Pseudomonas putida KT2440
accgccgccaccau

SEQ ID NO: 3544321 - RNA, 17 nt, Pseudomonas putida KT2440
accgccgccaccaucga

SEQ ID NO: 3544322 - RNA, 14 nt, Pseudomonas putida KT2440
accgccgcccgguc

SEQ ID NO: 3544323 - RNA, 15 nt, Pseudomonas putida KT2440
accgccgccuggcuc

SEQ ID NO: 3544324 - RNA, 19 nt, Pseudomonas putida KT2440
accgccgcgaugaugauca

SEQ ID NO: 3544325 - RNA, 20 nt, Pseudomonas putida KT2440
accgccgcgccucgcggugc

SEQ ID NO: 3544326 - RNA, 20 nt, Pseudomonas putida KT2440
accgccgugccggucacugg

SEQ ID NO: 3544327 - RNA, 23 nt, Pseudomonas putida KT2440
accgccuccacggucagcaucca

SEQ ID NO: 3544328 - RNA, 12 nt, Pseudomonas putida KT2440
accgccucgauc

SEQ ID NO: 3544329 - RNA, 13 nt, Pseudomonas putida KT2440
accgccucgaucg

SEQ ID NO: 3544330 - RNA, 15 nt, Pseudomonas putida KT2440
accgccucuaccacg

SEQ ID NO: 3544331 - RNA, 23 nt, Pseudomonas putida KT2440
accgccuuguaauacggcgccga

SEQ ID NO: 3544332 - RNA, 15 nt, Pseudomonas putida KT2440
accgcgaagcaggcu

SEQ ID NO: 3544333 - RNA, 20 nt, Pseudomonas putida KT2440
accgcgacgaccgcacuccc

SEQ ID NO: 3544334 - RNA, 21 nt, Pseudomonas putida KT2440
accgcgauaucagcgccagca

SEQ ID NO: 3544335 - RNA, 14 nt, Pseudomonas putida KT2440
accgcgccagccug

SEQ ID NO: 3544336 - RNA, 17 nt, Pseudomonas putida KT2440
accgcgccagccugggc

SEQ ID NO: 3544337 - RNA, 15 nt, Pseudomonas putida KT2440
accgcgccaucaagg

SEQ ID NO: 3544338 - RNA, 21 nt, Pseudomonas putida KT2440
accgcgccaucaaggccgaca

SEQ ID NO: 3544339 - RNA, 13 nt, Pseudomonas putida KT2440
accgcgcccggcu

SEQ ID NO: 3544340 - RNA, 14 nt, Pseudomonas putida KT2440
accgcgccggucac

SEQ ID NO: 3544341 - RNA, 19 nt, Pseudomonas putida KT2440
accgcgccuccagcuggcc

SEQ ID NO: 3544342 - RNA, 13 nt, Pseudomonas putida KT2440
accgcgcgccagu

SEQ ID NO: 3544343 - RNA, 21 nt, Pseudomonas putida KT2440
accgcgcgguuaagcgccacc

SEQ ID NO: 3544344 - RNA, 16 nt, Pseudomonas putida KT2440
accgcgcugguaagcc

SEQ ID NO: 3544345 - RNA, 21 nt, Pseudomonas putida KT2440
accgcgcugguaagccucgag

SEQ ID NO: 3544346 - RNA, 17 nt, Pseudomonas putida KT2440
accgcggcugacgaagc

SEQ ID NO: 3544347 - RNA, 19 nt, Pseudomonas putida KT2440
accgcggugcugaccaccg

SEQ ID NO: 3544348 - RNA, 17 nt, Pseudomonas putida KT2440
accgcguaaccagucga

SEQ ID NO: 3544349 - RNA, 14 nt, Pseudomonas putida KT2440
accgcguacagcug

SEQ ID NO: 3544350 - RNA, 16 nt, Pseudomonas putida KT2440
accgcguacagcugcu

SEQ ID NO: 3544351 - RNA, 20 nt, Pseudomonas putida KT2440
accgcguacagcugcucacc

SEQ ID NO: 3544352 - RNA, 22 nt, Pseudomonas putida KT2440
accgcguccuggacccgcagca

SEQ ID NO: 3544353 - RNA, 23 nt, Pseudomonas putida KT2440
accgcguuaugacuggccucggc

SEQ ID NO: 3544354 - RNA, 23 nt, Pseudomonas putida KT2440
accgcuaugccaagccacuggcc

SEQ ID NO: 3544355 - RNA, 19 nt, Pseudomonas putida KT2440
accgcucaagucugcauag

SEQ ID NO: 3544356 - RNA, 16 nt, Pseudomonas putida KT2440
accgcuccgacaaaug

SEQ ID NO: 3544357 - RNA, 19 nt, Pseudomonas putida KT2440
accgcuccggguacuucuc

SEQ ID NO: 3544358 - RNA, 13 nt, Pseudomonas putida KT2440
accgcucgaacaa

SEQ ID NO: 3544359 - RNA, 18 nt, Pseudomonas putida KT2440
accgcucgacguuuaccu

SEQ ID NO: 3544360 - RNA, 23 nt, Pseudomonas putida KT2440
accgcucgacguuuaccugcagc

SEQ ID NO: 3544361 - RNA, 13 nt, Pseudomonas putida KT2440
accgcugaccaca

SEQ ID NO: 3544362 - RNA, 15 nt, Pseudomonas putida KT2440
accgcugaccacaaa

SEQ ID NO: 3544363 - RNA, 15 nt, Pseudomonas putida KT2440
accgcugccagcugc

SEQ ID NO: 3544364 - RNA, 20 nt, Pseudomonas putida KT2440
accgcugccagcugcgcugc

SEQ ID NO: 3544365 - RNA, 14 nt, Pseudomonas putida KT2440
accgcugcgcacca

SEQ ID NO: 3544366 - RNA, 15 nt, Pseudomonas putida KT2440
accgcuggccgccac

SEQ ID NO: 3544367 - RNA, 17 nt, Pseudomonas putida KT2440
accgcuggccgccacgg

SEQ ID NO: 3544368 - RNA, 21 nt, Pseudomonas putida KT2440
accgcugggcacccugaucga

SEQ ID NO: 3544369 - RNA, 22 nt, Pseudomonas putida KT2440
accgcugucggucacagcagug

SEQ ID NO: 3544370 - RNA, 19 nt, Pseudomonas putida KT2440
accgcuucacccucgcgca

SEQ ID NO: 3544371 - RNA, 19 nt, Pseudomonas putida KT2440
accgcuucaccgcgcaccu

SEQ ID NO: 3544372 - RNA, 14 nt, Pseudomonas putida KT2440
accgcuucuuuguu

SEQ ID NO: 3544373 - RNA, 20 nt, Pseudomonas putida KT2440
accggaauagaacacuggca

SEQ ID NO: 3544374 - RNA, 19 nt, Pseudomonas putida KT2440
accggaguccccaccggca

SEQ ID NO: 3544375 - RNA, 20 nt, Pseudomonas putida KT2440
accggaguccccaccggcac

SEQ ID NO: 3544376 - RNA, 23 nt, Pseudomonas putida KT2440
accggcaacccggcagucagggu

SEQ ID NO: 3544377 - RNA, 20 nt, Pseudomonas putida KT2440
accggcaacccuucggccag

SEQ ID NO: 3544378 - RNA, 22 nt, Pseudomonas putida KT2440
accggcaacccuucggccagca

SEQ ID NO: 3544379 - RNA, 17 nt, Pseudomonas putida KT2440
accggcaagcccauggc

SEQ ID NO: 3544380 - RNA, 21 nt, Pseudomonas putida KT2440
accggcaagcccauggcuggc

SEQ ID NO: 3544381 - RNA, 14 nt, Pseudomonas putida KT2440
accggcaaucgaca

SEQ ID NO: 3544382 - RNA, 18 nt, Pseudomonas putida KT2440
accggcacaagcgucccu

SEQ ID NO: 3544383 - RNA, 14 nt, Pseudomonas putida KT2440
accggcaccgccuc

SEQ ID NO: 3544384 - RNA, 18 nt, Pseudomonas putida KT2440
accggcaccugcuugccg

SEQ ID NO: 3544385 - RNA, 12 nt, Pseudomonas putida KT2440
accggcacggca

SEQ ID NO: 3544386 - RNA, 14 nt, Pseudomonas putida KT2440
accggcacugcaca

SEQ ID NO: 3544387 - RNA, 14 nt, Pseudomonas putida KT2440
accggcagcaccgg

SEQ ID NO: 3544388 - RNA, 13 nt, Pseudomonas putida KT2440
accggcagcgcaa

SEQ ID NO: 3544389 - RNA, 18 nt, Pseudomonas putida KT2440
accggcagcgcaaucacc

SEQ ID NO: 3544390 - RNA, 22 nt, Pseudomonas putida KT2440
accggcaguacauagaacagca

SEQ ID NO: 3544391 - RNA, 14 nt, Pseudomonas putida KT2440
accggcagugcgaa

SEQ ID NO: 3544392 - RNA, 15 nt, Pseudomonas putida KT2440
accggcagugcgaaa

SEQ ID NO: 3544393 - RNA, 15 nt, Pseudomonas putida KT2440
accggcauagcgcaa

SEQ ID NO: 3544394 - RNA, 22 nt, Pseudomonas putida KT2440
accggcaugcccaguucgcgug

SEQ ID NO: 3544395 - RNA, 16 nt, Pseudomonas putida KT2440
accggccaagcgccgg

SEQ ID NO: 3544396 - RNA, 17 nt, Pseudomonas putida KT2440
accggccaagcgccggu

SEQ ID NO: 3544397 - RNA, 23 nt, Pseudomonas putida KT2440
accggccaccaggcgcggcagca

SEQ ID NO: 3544398 - RNA, 16 nt, Pseudomonas putida KT2440
accggccacgcgcagu

SEQ ID NO: 3544399 - RNA, 19 nt, Pseudomonas putida KT2440
accggccacgcgcaguucg

SEQ ID NO: 3544400 - RNA, 17 nt, Pseudomonas putida KT2440
accggccacgcgcgccu

SEQ ID NO: 3544401 - RNA, 14 nt, Pseudomonas putida KT2440
accggccagcugcg

SEQ ID NO: 3544402 - RNA, 19 nt, Pseudomonas putida KT2440
accggccccccagccagca

SEQ ID NO: 3544403 - RNA, 22 nt, Pseudomonas putida KT2440
accggccccccagccagcagau

SEQ ID NO: 3544404 - RNA, 19 nt, Pseudomonas putida KT2440
accggcccugaaggccgcu

SEQ ID NO: 3544405 - RNA, 22 nt, Pseudomonas putida KT2440
accggccgacccgccuggugcc

SEQ ID NO: 3544406 - RNA, 22 nt, Pseudomonas putida KT2440
accggccgccgccagaccaccu

SEQ ID NO: 3544407 - RNA, 17 nt, Pseudomonas putida KT2440
accggccgggcuucaac

SEQ ID NO: 3544408 - RNA, 20 nt, Pseudomonas putida KT2440
accggccucuucgcgggcaa

SEQ ID NO: 3544409 - RNA, 22 nt, Pseudomonas putida KT2440
accggccuugccguagaugccg

SEQ ID NO: 3544410 - RNA, 14 nt, Pseudomonas putida KT2440
accggccuugcgca

SEQ ID NO: 3544411 - RNA, 19 nt, Pseudomonas putida KT2440
accggccuugcgcaaggca

SEQ ID NO: 3544412 - RNA, 20 nt, Pseudomonas putida KT2440
accggccuugcgcaaggcaa

SEQ ID NO: 3544413 - RNA, 19 nt, Pseudomonas putida KT2440
accggccuuuucgcgggca

SEQ ID NO: 3544414 - RNA, 21 nt, Pseudomonas putida KT2440
accggcgacgcggugcucgau

SEQ ID NO: 3544415 - RNA, 15 nt, Pseudomonas putida KT2440
accggcgcuuggccg

SEQ ID NO: 3544416 - RNA, 20 nt, Pseudomonas putida KT2440
accggcucaacagcaggugc

SEQ ID NO: 3544417 - RNA, 16 nt, Pseudomonas putida KT2440
accggcuuccagcuug

SEQ ID NO: 3544418 - RNA, 19 nt, Pseudomonas putida KT2440
accggcuuguagccggcag

SEQ ID NO: 3544419 - RNA, 22 nt, Pseudomonas putida KT2440
accggcuugucuuccaguucca

SEQ ID NO: 3544420 - RNA, 14 nt, Pseudomonas putida KT2440
accgggaagcaggu

SEQ ID NO: 3544421 - RNA, 17 nt, Pseudomonas putida KT2440
accgggauacugcgcac

SEQ ID NO: 3544422 - RNA, 16 nt, Pseudomonas putida KT2440
accgggaucuuggcgu

SEQ ID NO: 3544423 - RNA, 13 nt, Pseudomonas putida KT2440
accgggcaaaaaa

SEQ ID NO: 3544424 - RNA, 21 nt, Pseudomonas putida KT2440
accgggcagaccugcuggcac

SEQ ID NO: 3544425 - RNA, 21 nt, Pseudomonas putida KT2440
accgggcgcgauugccuuccu

SEQ ID NO: 3544426 - RNA, 13 nt, Pseudomonas putida KT2440
accgggcgggugc

SEQ ID NO: 3544427 - RNA, 13 nt, Pseudomonas putida KT2440
accgggcuggcau

SEQ ID NO: 3544428 - RNA, 15 nt, Pseudomonas putida KT2440
accggggcaccuuga

SEQ ID NO: 3544429 - RNA, 23 nt, Pseudomonas putida KT2440
accggggcuccggcgaauccagc

SEQ ID NO: 3544430 - RNA, 15 nt, Pseudomonas putida KT2440
accggguccagcaac

SEQ ID NO: 3544431 - RNA, 20 nt, Pseudomonas putida KT2440
accggguucuugaagaagcu

SEQ ID NO: 3544432 - RNA, 20 nt, Pseudomonas putida KT2440
accgguaccgcucugcgcca

SEQ ID NO: 3544433 - RNA, 13 nt, Pseudomonas putida KT2440
accgguauaacgc

SEQ ID NO: 3544434 - RNA, 15 nt, Pseudomonas putida KT2440
accgguauaacgcac

SEQ ID NO: 3544435 - RNA, 15 nt, Pseudomonas putida KT2440
accgguauagcgaca

SEQ ID NO: 3544436 - RNA, 21 nt, Pseudomonas putida KT2440
accggucagguccgccaaggu

SEQ ID NO: 3544437 - RNA, 21 nt, Pseudomonas putida KT2440
accggucauacauccagcuuc

SEQ ID NO: 3544438 - RNA, 18 nt, Pseudomonas putida KT2440
accggucauggcgcgcca

SEQ ID NO: 3544439 - RNA, 19 nt, Pseudomonas putida KT2440
accggucauggcgcgccau

SEQ ID NO: 3544440 - RNA, 16 nt, Pseudomonas putida KT2440
accggucggccaucga

SEQ ID NO: 3544441 - RNA, 18 nt, Pseudomonas putida KT2440
accggucggccaucgacg

SEQ ID NO: 3544442 - RNA, 16 nt, Pseudomonas putida KT2440
accgguggccugagcc

SEQ ID NO: 3544443 - RNA, 21 nt, Pseudomonas putida KT2440
accgguucgcccccacgggca

SEQ ID NO: 3544444 - RNA, 13 nt, Pseudomonas putida KT2440
accgguugcaggc

SEQ ID NO: 3544445 - RNA, 17 nt, Pseudomonas putida KT2440
accgguuugaagccaua

SEQ ID NO: 3544446 - RNA, 15 nt, Pseudomonas putida KT2440
accguacuugcugca

SEQ ID NO: 3544447 - RNA, 15 nt, Pseudomonas putida KT2440
accguagcggucaug

SEQ ID NO: 3544448 - RNA, 15 nt, Pseudomonas putida KT2440
accguauuaaggcaa

SEQ ID NO: 3544449 - RNA, 12 nt, Pseudomonas putida KT2440
accguccacacc

SEQ ID NO: 3544450 - RNA, 13 nt, Pseudomonas putida KT2440
accguccacaccg

SEQ ID NO: 3544451 - RNA, 14 nt, Pseudomonas putida KT2440
accguccagguagc

SEQ ID NO: 3544452 - RNA, 18 nt, Pseudomonas putida KT2440
accgucgaucagcuucug

SEQ ID NO: 3544453 - RNA, 19 nt, Pseudomonas putida KT2440
accgucgaugucggcgugg

SEQ ID NO: 3544454 - RNA, 13 nt, Pseudomonas putida KT2440
accgucgcuggac

SEQ ID NO: 3544455 - RNA, 14 nt, Pseudomonas putida KT2440
accgucguaggagc

SEQ ID NO: 3544456 - RNA, 20 nt, Pseudomonas putida KT2440
accgucuggacugggaaacc

SEQ ID NO: 3544457 - RNA, 19 nt, Pseudomonas putida KT2440
accgugaaaccgaaaaagc

SEQ ID NO: 3544458 - RNA, 23 nt, Pseudomonas putida KT2440
accgugagcauggcaaacagcac

SEQ ID NO: 3544459 - RNA, 20 nt, Pseudomonas putida KT2440
accgugcaccagcaccaccg

SEQ ID NO: 3544460 - RNA, 17 nt, Pseudomonas putida KT2440
accgugcacgucgauga

SEQ ID NO: 3544461 - RNA, 19 nt, Pseudomonas putida KT2440
accgugcauacacccgguc

SEQ ID NO: 3544462 - RNA, 19 nt, Pseudomonas putida KT2440
accgugcccgcccacgccg

SEQ ID NO: 3544463 - RNA, 22 nt, Pseudomonas putida KT2440
accgugcccgcccacgccgcug

SEQ ID NO: 3544464 - RNA, 11 nt, Pseudomonas putida KT2440
accgugcugca

SEQ ID NO: 3544465 - RNA, 20 nt, Pseudomonas putida KT2440
accgugcuugcgggcaaggu

SEQ ID NO: 3544466 - RNA, 18 nt, Pseudomonas putida KT2440
accguggcaaucuucuug

SEQ ID NO: 3544467 - RNA, 18 nt, Pseudomonas putida KT2440
accguggcguauugcugg

SEQ ID NO: 3544468 - RNA, 18 nt, Pseudomonas putida KT2440
accgugggcgcaacaucg

SEQ ID NO: 3544469 - RNA, 23 nt, Pseudomonas putida KT2440
accguguauccauacuuggccga

SEQ ID NO: 3544470 - RNA, 12 nt, Pseudomonas putida KT2440
accgugucgggc

SEQ ID NO: 3544471 - RNA, 19 nt, Pseudomonas putida KT2440
accguucacguucaacgcc

SEQ ID NO: 3544472 - RNA, 23 nt, Pseudomonas putida KT2440
accguugcgcucgagcccgccag

SEQ ID NO: 3544473 - RNA, 15 nt, Pseudomonas putida KT2440
accguuggucagcga

SEQ ID NO: 3544474 - RNA, 19 nt, Pseudomonas putida KT2440
accguuggucgcgccgaca

SEQ ID NO: 3544475 - RNA, 18 nt, Pseudomonas putida KT2440
accuacagggauugcgca

SEQ ID NO: 3544476 - RNA, 19 nt, Pseudomonas putida KT2440
accuacagggauugcgcag

SEQ ID NO: 3544477 - RNA, 24 nt, Pseudomonas putida KT2440
accuaucaggagcaacuaccauga

SEQ ID NO: 3544478 - RNA, 17 nt, Pseudomonas putida KT2440
accuaucgcugccgccu

SEQ ID NO: 3544479 - RNA, 13 nt, Pseudomonas putida KT2440
accucaaguuccc

SEQ ID NO: 3544480 - RNA, 14 nt, Pseudomonas putida KT2440
accucacacuggua

SEQ ID NO: 3544481 - RNA, 15 nt, Pseudomonas putida KT2440
accucaccgccggcu

SEQ ID NO: 3544482 - RNA, 16 nt, Pseudomonas putida KT2440
accucacuggcauccg

SEQ ID NO: 3544483 - RNA, 17 nt, Pseudomonas putida KT2440
accucauaguaaggcug

SEQ ID NO: 3544484 - RNA, 18 nt, Pseudomonas putida KT2440
accucauaguaaggcugg

SEQ ID NO: 3544485 - RNA, 16 nt, Pseudomonas putida KT2440
accucaucccccggcc

SEQ ID NO: 3544486 - RNA, 19 nt, Pseudomonas putida KT2440
accucaucggcauugcuga

SEQ ID NO: 3544487 - RNA, 21 nt, Pseudomonas putida KT2440
accucaucuacgugcagcuug

SEQ ID NO: 3544488 - RNA, 18 nt, Pseudomonas putida KT2440
accuccagaggugcccuu

SEQ ID NO: 3544489 - RNA, 14 nt, Pseudomonas putida KT2440
accuccagcccggc

SEQ ID NO: 3544490 - RNA, 19 nt, Pseudomonas putida KT2440
accuccagcccggcuucac

SEQ ID NO: 3544491 - RNA, 20 nt, Pseudomonas putida KT2440
accuccaggucauccgcacg

SEQ ID NO: 3544492 - RNA, 21 nt, Pseudomonas putida KT2440
accuccaggucauccgcacgc

SEQ ID NO: 3544493 - RNA, 22 nt, Pseudomonas putida KT2440
accuccaggucauccgcacgca

SEQ ID NO: 3544494 - RNA, 19 nt, Pseudomonas putida KT2440
accuccaguugccaguguu

SEQ ID NO: 3544495 - RNA, 13 nt, Pseudomonas putida KT2440
accuccaucacca

SEQ ID NO: 3544496 - RNA, 18 nt, Pseudomonas putida KT2440
accucccgcacugcugcc

SEQ ID NO: 3544497 - RNA, 19 nt, Pseudomonas putida KT2440
accucccgcacugcugccg

SEQ ID NO: 3544498 - RNA, 14 nt, Pseudomonas putida KT2440
accuccgccaacug

SEQ ID NO: 3544499 - RNA, 16 nt, Pseudomonas putida KT2440
accucgaacuugcccg

SEQ ID NO: 3544500 - RNA, 17 nt, Pseudomonas putida KT2440
accucgaccaggcgcuc

SEQ ID NO: 3544501 - RNA, 17 nt, Pseudomonas putida KT2440
accucgacccgcccgcc

SEQ ID NO: 3544502 - RNA, 15 nt, Pseudomonas putida KT2440
accucgaccgucgcu

SEQ ID NO: 3544503 - RNA, 17 nt, Pseudomonas putida KT2440
accucggaugccacgcu

SEQ ID NO: 3544504 - RNA, 13 nt, Pseudomonas putida KT2440
accucggcaccgc

SEQ ID NO: 3544505 - RNA, 14 nt, Pseudomonas putida KT2440
accucggccagguc

SEQ ID NO: 3544506 - RNA, 20 nt, Pseudomonas putida KT2440
accucggccagugcgcccga

SEQ ID NO: 3544507 - RNA, 22 nt, Pseudomonas putida KT2440
accucggccgcauccugcgugc

SEQ ID NO: 3544508 - RNA, 16 nt, Pseudomonas putida KT2440
accucgggcuuggcac

SEQ ID NO: 3544509 - RNA, 12 nt, Pseudomonas putida KT2440
accucugcggcc

SEQ ID NO: 3544510 - RNA, 19 nt, Pseudomonas putida KT2440
accucugguuuugucggcc

SEQ ID NO: 3544511 - RNA, 15 nt, Pseudomonas putida KT2440
accugaacaaggccu

SEQ ID NO: 3544512 - RNA, 16 nt, Pseudomonas putida KT2440
accugaacaaggccug

SEQ ID NO: 3544513 - RNA, 17 nt, Pseudomonas putida KT2440
accugaacaaggccugg

SEQ ID NO: 3544514 - RNA, 22 nt, Pseudomonas putida KT2440
accugaacaaggccuggcccag

SEQ ID NO: 3544515 - RNA, 16 nt, Pseudomonas putida KT2440
accugaccaucagccu

SEQ ID NO: 3544516 - RNA, 17 nt, Pseudomonas putida KT2440
accugaccaucagccug

SEQ ID NO: 3544517 - RNA, 22 nt, Pseudomonas putida KT2440
accugacgcaagcgcgccgcca

SEQ ID NO: 3544518 - RNA, 16 nt, Pseudomonas putida KT2440
accugagcuucaacgc

SEQ ID NO: 3544519 - RNA, 21 nt, Pseudomonas putida KT2440
accugagucaggcgcccugcc

SEQ ID NO: 3544520 - RNA, 16 nt, Pseudomonas putida KT2440
accugaugcaccaggc

SEQ ID NO: 3544521 - RNA, 17 nt, Pseudomonas putida KT2440
accugauguacaaggac

SEQ ID NO: 3544522 - RNA, 19 nt, Pseudomonas putida KT2440
accugauguacaaggaccu

SEQ ID NO: 3544523 - RNA, 23 nt, Pseudomonas putida KT2440
accugauguacaaggaccucaag

SEQ ID NO: 3544524 - RNA, 14 nt, Pseudomonas putida KT2440
accugauguccaaa

SEQ ID NO: 3544525 - RNA, 15 nt, Pseudomonas putida KT2440
accugauguccaaau

SEQ ID NO: 3544526 - RNA, 17 nt, Pseudomonas putida KT2440
accugauguccaaauug

SEQ ID NO: 3544527 - RNA, 20 nt, Pseudomonas putida KT2440
accugauguccaaauugggc

SEQ ID NO: 3544528 - RNA, 15 nt, Pseudomonas putida KT2440
accugcaacaccucc

SEQ ID NO: 3544529 - RNA, 14 nt, Pseudomonas putida KT2440
acgaacacguccag

SEQ ID NO: 3544530 - RNA, 23 nt, Pseudomonas putida KT2440
acgaacagauggugaugccccug

SEQ ID NO: 3544531 - RNA, 13 nt, Pseudomonas putida KT2440
acgaacagcaaca

SEQ ID NO: 3544532 - RNA, 16 nt, Pseudomonas putida KT2440
acgaacagccagaugc

SEQ ID NO: 3544533 - RNA, 14 nt, Pseudomonas putida KT2440
acgaacaggcgcuu

SEQ ID NO: 3544534 - RNA, 14 nt, Pseudomonas putida KT2440
acgaacaucagcag

SEQ ID NO: 3544535 - RNA, 15 nt, Pseudomonas putida KT2440
acgaacccuugaccu

SEQ ID NO: 3544536 - RNA, 18 nt, Pseudomonas putida KT2440
acgaaccugugcacagcc

SEQ ID NO: 3544537 - RNA, 12 nt, Pseudomonas putida KT2440
acgaagccaugu

SEQ ID NO: 3544538 - RNA, 14 nt, Pseudomonas putida KT2440
acgaagcgcggcaa

SEQ ID NO: 3544539 - RNA, 23 nt, Pseudomonas putida KT2440
acgaaggccgguuuuuucaugca

SEQ ID NO: 3544540 - RNA, 15 nt, Pseudomonas putida KT2440
acgaaggucuugccg

SEQ ID NO: 3544541 - RNA, 20 nt, Pseudomonas putida KT2440
acgaaguugagcaccggcag

SEQ ID NO: 3544542 - RNA, 21 nt, Pseudomonas putida KT2440
acgaaucauccucgacaccca

SEQ ID NO: 3544543 - RNA, 14 nt, Pseudomonas putida KT2440
acgaaucugcagug

SEQ ID NO: 3544544 - RNA, 16 nt, Pseudomonas putida KT2440
acgaaucugcagugcc

SEQ ID NO: 3544545 - RNA, 20 nt, Pseudomonas putida KT2440
acgacaaacuccuugaaauu

SEQ ID NO: 3544546 - RNA, 19 nt, Pseudomonas putida KT2440
acgacaaaucgacauacag

SEQ ID NO: 3544547 - RNA, 18 nt, Pseudomonas putida KT2440
acgacaagguacucagcg

SEQ ID NO: 3544548 - RNA, 21 nt, Pseudomonas putida KT2440
acgacaagguagcggccagcc

SEQ ID NO: 3544549 - RNA, 19 nt, Pseudomonas putida KT2440
acgacaggggcgcagagcg

SEQ ID NO: 3544550 - RNA, 22 nt, Pseudomonas putida KT2440
acgaccaauugguuaaaagcca

SEQ ID NO: 3544551 - RNA, 23 nt, Pseudomonas putida KT2440
acgacccggauaccgacccuaau

SEQ ID NO: 3544552 - RNA, 18 nt, Pseudomonas putida KT2440
acgacccugaagcccugg

SEQ ID NO: 3544553 - RNA, 15 nt, Pseudomonas putida KT2440
acgaccucggccagg

SEQ ID NO: 3544554 - RNA, 17 nt, Pseudomonas putida KT2440
acgaccucggccagguc

SEQ ID NO: 3544555 - RNA, 16 nt, Pseudomonas putida KT2440
acgaccuugccaaggu

SEQ ID NO: 3544556 - RNA, 22 nt, Pseudomonas putida KT2440
acgacgauggccaccagcaccu

SEQ ID NO: 3544557 - RNA, 13 nt, Pseudomonas putida KT2440
acgacgcaccagg

SEQ ID NO: 3544558 - RNA, 19 nt, Pseudomonas putida KT2440
acgacgcgauaauggguca

SEQ ID NO: 3544559 - RNA, 22 nt, Pseudomonas putida KT2440
acgacgggcugagcccaaccuc

SEQ ID NO: 3544560 - RNA, 18 nt, Pseudomonas putida KT2440
acgacugacguaguccuu

SEQ ID NO: 3544561 - RNA, 20 nt, Pseudomonas putida KT2440
acgacugccgcccugguccg

SEQ ID NO: 3544562 - RNA, 19 nt, Pseudomonas putida KT2440
acgacuggucauacuccag

SEQ ID NO: 3544563 - RNA, 19 nt, Pseudomonas putida KT2440
acgacuuguaauugaaguu

SEQ ID NO: 3544564 - RNA, 22 nt, Pseudomonas putida KT2440
acgacuuugaugccaacuucca

SEQ ID NO: 3544565 - RNA, 19 nt, Pseudomonas putida KT2440
acgagacgguggcugccag

SEQ ID NO: 3544566 - RNA, 15 nt, Pseudomonas putida KT2440
acgagagaucgcagc

SEQ ID NO: 3544567 - RNA, 16 nt, Pseudomonas putida KT2440
acgagcaugccgagga

SEQ ID NO: 3544568 - RNA, 15 nt, Pseudomonas putida KT2440
acgaggacugcacca

SEQ ID NO: 3544569 - RNA, 21 nt, Pseudomonas putida KT2440
acgaggauaagcaugggucag

SEQ ID NO: 3544570 - RNA, 21 nt, Pseudomonas putida KT2440
acgagguggucgaggcaaaga

SEQ ID NO: 3544571 - RNA, 18 nt, Pseudomonas putida KT2440
acgagucagcgugccaga

SEQ ID NO: 3544572 - RNA, 16 nt, Pseudomonas putida KT2440
acgauacuccggcaac

SEQ ID NO: 3544573 - RNA, 13 nt, Pseudomonas putida KT2440
acgaucagcagca

SEQ ID NO: 3544574 - RNA, 14 nt, Pseudomonas putida KT2440
acgaucagcagcaa

SEQ ID NO: 3544575 - RNA, 23 nt, Pseudomonas putida KT2440
acgaucagcgccgaaccagcaga

SEQ ID NO: 3544576 - RNA, 14 nt, Pseudomonas putida KT2440
acgauccccaccag

SEQ ID NO: 3544577 - RNA, 20 nt, Pseudomonas putida KT2440
acgaucgacuucaucaccuc

SEQ ID NO: 3544578 - RNA, 16 nt, Pseudomonas putida KT2440
acgaucgccagcccca

SEQ ID NO: 3544579 - RNA, 13 nt, Pseudomonas putida KT2440
acgaucuuggcca

SEQ ID NO: 3544580 - RNA, 18 nt, Pseudomonas putida KT2440
acgaugaaauacagcucg

SEQ ID NO: 3544581 - RNA, 13 nt, Pseudomonas putida KT2440
acgauggccacca

SEQ ID NO: 3544582 - RNA, 18 nt, Pseudomonas putida KT2440
acgauggccaccagcacc

SEQ ID NO: 3544583 - RNA, 18 nt, Pseudomonas putida KT2440
acgauggugaaggccagg

SEQ ID NO: 3544584 - RNA, 12 nt, Pseudomonas putida KT2440
acgauugcguuu

SEQ ID NO: 3544585 - RNA, 15 nt, Pseudomonas putida KT2440
acgauuucagcggua

SEQ ID NO: 3544586 - RNA, 13 nt, Pseudomonas putida KT2440
acgcaacaacccc

SEQ ID NO: 3544587 - RNA, 22 nt, Pseudomonas putida KT2440
acgcaacaggucgaccugcccg

SEQ ID NO: 3544588 - RNA, 13 nt, Pseudomonas putida KT2440
acgcaacuccacg

SEQ ID NO: 3544589 - RNA, 19 nt, Pseudomonas putida KT2440
acgcaagcgcgccgccaca

SEQ ID NO: 3544590 - RNA, 21 nt, Pseudomonas putida KT2440
acgcaaguucccgugcgccua

SEQ ID NO: 3544591 - RNA, 22 nt, Pseudomonas putida KT2440
acgcaaucucgacaagcgcauu

SEQ ID NO: 3544592 - RNA, 13 nt, Pseudomonas putida KT2440
acgcacagcugug

SEQ ID NO: 3544593 - RNA, 18 nt, Pseudomonas putida KT2440
acgcacaggcgcagcagc

SEQ ID NO: 3544594 - RNA, 14 nt, Pseudomonas putida KT2440
acgcacaucggcaa

SEQ ID NO: 3544595 - RNA, 19 nt, Pseudomonas putida KT2440
acgcaccagggcuggcagc

SEQ ID NO: 3544596 - RNA, 21 nt, Pseudomonas putida KT2440
acgcaccagggcuggcagcgg

SEQ ID NO: 3544597 - RNA, 14 nt, Pseudomonas putida KT2440
acgcacccgcacuu

SEQ ID NO: 3544598 - RNA, 18 nt, Pseudomonas putida KT2440
acgcacccgccuccggcg

SEQ ID NO: 3544599 - RNA, 16 nt, Pseudomonas putida KT2440
acgcaccgaucugcgg

SEQ ID NO: 3544600 - RNA, 19 nt, Pseudomonas putida KT2440
acgcacgaucucccggcuc

SEQ ID NO: 3544601 - RNA, 19 nt, Pseudomonas putida KT2440
acgcacggccuucccgccu

SEQ ID NO: 3544602 - RNA, 18 nt, Pseudomonas putida KT2440
acgcagacaaaacgcugc

SEQ ID NO: 3544603 - RNA, 19 nt, Pseudomonas putida KT2440
acgcagacaaaacgcugcg

SEQ ID NO: 3544604 - RNA, 13 nt, Pseudomonas putida KT2440
acgcagagcaugg

SEQ ID NO: 3544605 - RNA, 11 nt, Pseudomonas putida KT2440
acgcagcaugc

SEQ ID NO: 3544606 - RNA, 13 nt, Pseudomonas putida KT2440
acgcagccggcac

SEQ ID NO: 3544607 - RNA, 16 nt, Pseudomonas putida KT2440
acgcagccggcaccgc

SEQ ID NO: 3544608 - RNA, 17 nt, Pseudomonas putida KT2440
acgcagccggcaccgcc

SEQ ID NO: 3544609 - RNA, 18 nt, Pseudomonas putida KT2440
acgcagcuuccgccacca

SEQ ID NO: 3544610 - RNA, 22 nt, Pseudomonas putida KT2440
acgcagcuuccgccaccacgaa

SEQ ID NO: 3544611 - RNA, 13 nt, Pseudomonas putida KT2440
acgcaggcaccgc

SEQ ID NO: 3544612 - RNA, 16 nt, Pseudomonas putida KT2440
acgcaggcaccgcacc

SEQ ID NO: 3544613 - RNA, 22 nt, Pseudomonas putida KT2440
acgcaggcauacaggaccaggc

SEQ ID NO: 3544614 - RNA, 16 nt, Pseudomonas putida KT2440
acgcaggccagcgcac

SEQ ID NO: 3544615 - RNA, 13 nt, Pseudomonas putida KT2440
acgcaggcccagc

SEQ ID NO: 3544616 - RNA, 14 nt, Pseudomonas putida KT2440
acgcaggcccagca

SEQ ID NO: 3544617 - RNA, 16 nt, Pseudomonas putida KT2440
acgcaggcccagcagg

SEQ ID NO: 3544618 - RNA, 16 nt, Pseudomonas putida KT2440
acgcaggcgcaggugc

SEQ ID NO: 3544619 - RNA, 17 nt, Pseudomonas putida KT2440
acgcaggcgcaggugca

SEQ ID NO: 3544620 - RNA, 19 nt, Pseudomonas putida KT2440
acgcaggcgcaggugcagc

SEQ ID NO: 3544621 - RNA, 12 nt, Pseudomonas putida KT2440
acgcaggcgcga

SEQ ID NO: 3544622 - RNA, 22 nt, Pseudomonas putida KT2440
acgcaggcgcgacaugaucagc

SEQ ID NO: 3544623 - RNA, 20 nt, Pseudomonas putida KT2440
acgcaggcucugcgccagca

SEQ ID NO: 3544624 - RNA, 19 nt, Pseudomonas putida KT2440
acgcagggccucgaugcgg

SEQ ID NO: 3544625 - RNA, 15 nt, Pseudomonas putida KT2440
acgcagguacucgcc

SEQ ID NO: 3544626 - RNA, 20 nt, Pseudomonas putida KT2440
acgcaggugcgcacgcugcc

SEQ ID NO: 3544627 - RNA, 20 nt, Pseudomonas putida KT2440
acgcaguacgugaaagcccg

SEQ ID NO: 3544628 - RNA, 23 nt, Pseudomonas putida KT2440
acgcagucagccacauccucugc

SEQ ID NO: 3544629 - RNA, 13 nt, Pseudomonas putida KT2440
acgcauccaggcg

SEQ ID NO: 3544630 - RNA, 19 nt, Pseudomonas putida KT2440
acgcaucugcaccggcagc

SEQ ID NO: 3544631 - RNA, 18 nt, Pseudomonas putida KT2440
acgcauggccgaggucug

SEQ ID NO: 3544632 - RNA, 23 nt, Pseudomonas putida KT2440
acgcauggccgaggucugguacu

SEQ ID NO: 3544633 - RNA, 20 nt, Pseudomonas putida KT2440
acgcauggcguuguccagca

SEQ ID NO: 3544634 - RNA, 20 nt, Pseudomonas putida KT2440
acgcgugcaagggauaucag

SEQ ID NO: 3544635 - RNA, 17 nt, Pseudomonas putida KT2440
acgcguggucgccggcg

SEQ ID NO: 3544636 - RNA, 20 nt, Pseudomonas putida KT2440
acgcguugauuuagcaggca

SEQ ID NO: 3544637 - RNA, 23 nt, Pseudomonas putida KT2440
acgcguugauuuagcaggcaccc

SEQ ID NO: 3544638 - RNA, 17 nt, Pseudomonas putida KT2440
acgcguuucggcggccu

SEQ ID NO: 3544639 - RNA, 16 nt, Pseudomonas putida KT2440
acgcuaauacccuguu

SEQ ID NO: 3544640 - RNA, 20 nt, Pseudomonas putida KT2440
acgcuagucaagcugcgccg

SEQ ID NO: 3544641 - RNA, 17 nt, Pseudomonas putida KT2440
acgcucaugaacagcgc

SEQ ID NO: 3544642 - RNA, 20 nt, Pseudomonas putida KT2440
acgcucaugaacagcgccca

SEQ ID NO: 3544643 - RNA, 22 nt, Pseudomonas putida KT2440
acgcucaugaacagcgcccaga

SEQ ID NO: 3544644 - RNA, 20 nt, Pseudomonas putida KT2440
acgcuccugcaugccuuccu

SEQ ID NO: 3544645 - RNA, 14 nt, Pseudomonas putida KT2440
acgcuccuucgcca

SEQ ID NO: 3544646 - RNA, 21 nt, Pseudomonas putida KT2440
acgcuccuucgccacgaacag

SEQ ID NO: 3544647 - RNA, 16 nt, Pseudomonas putida KT2440
acgcucgacagcaacu

SEQ ID NO: 3544648 - RNA, 22 nt, Pseudomonas putida KT2440
acgcucgcgcaggaaccgcguc

SEQ ID NO: 3544649 - RNA, 23 nt, Pseudomonas putida KT2440
acgcucgcgcaggaaccgcguca

SEQ ID NO: 3544650 - RNA, 18 nt, Pseudomonas putida KT2440
acgcucguccaggcccug

SEQ ID NO: 3544651 - RNA, 17 nt, Pseudomonas putida KT2440
acgcucgugcaggcugu

SEQ ID NO: 3544652 - RNA, 20 nt, Pseudomonas putida KT2440
acgcucguuguccagcagca

SEQ ID NO: 3544653 - RNA, 21 nt, Pseudomonas putida KT2440
acgcucguuguccagcagcag

SEQ ID NO: 3544654 - RNA, 23 nt, Pseudomonas putida KT2440
acgcucguuguccagcagcagcg

SEQ ID NO: 3544655 - RNA, 20 nt, Pseudomonas putida KT2440
acgcugagcgaugcgcuggc

SEQ ID NO: 3544656 - RNA, 22 nt, Pseudomonas putida KT2440
acgcugagcgaugcgcuggcac

SEQ ID NO: 3544657 - RNA, 14 nt, Pseudomonas putida KT2440
acgcugcacuucca

SEQ ID NO: 3544658 - RNA, 20 nt, Pseudomonas putida KT2440
acgcugcacuuccacacccg

SEQ ID NO: 3544659 - RNA, 16 nt, Pseudomonas putida KT2440
acgcugccaugcgcug

SEQ ID NO: 3544660 - RNA, 20 nt, Pseudomonas putida KT2440
acgcugcccaggugccaggc

SEQ ID NO: 3544661 - RNA, 21 nt, Pseudomonas putida KT2440
acgcugcccaggugccaggcu

SEQ ID NO: 3544662 - RNA, 18 nt, Pseudomonas putida KT2440
acgcugccuccacaccga

SEQ ID NO: 3544663 - RNA, 15 nt, Pseudomonas putida KT2440
acgcugccuugccca

SEQ ID NO: 3544664 - RNA, 23 nt, Pseudomonas putida KT2440
acgcugcggcgaaagccagcagu

SEQ ID NO: 3544665 - RNA, 16 nt, Pseudomonas putida KT2440
acgcuggacuugccuu

SEQ ID NO: 3544666 - RNA, 16 nt, Pseudomonas putida KT2440
acgcuggaucaccacc

SEQ ID NO: 3544667 - RNA, 19 nt, Pseudomonas putida KT2440
acgcuggaucaccaccguc

SEQ ID NO: 3544668 - RNA, 18 nt, Pseudomonas putida KT2440
acgcuggcacccacgcgc

SEQ ID NO: 3544669 - RNA, 11 nt, Pseudomonas putida KT2440
acgcuggccaa

SEQ ID NO: 3544670 - RNA, 16 nt, Pseudomonas putida KT2440
acgcuggccaaggccu

SEQ ID NO: 3544671 - RNA, 19 nt, Pseudomonas putida KT2440
acgcuggugcaguggcugu

SEQ ID NO: 3544672 - RNA, 15 nt, Pseudomonas putida KT2440
acgcugucagaccuc

SEQ ID NO: 3544673 - RNA, 17 nt, Pseudomonas putida KT2440
acgcuguuggcagccac

SEQ ID NO: 3544674 - RNA, 17 nt, Pseudomonas putida KT2440
acgcuuaagucuucuca

SEQ ID NO: 3544675 - RNA, 15 nt, Pseudomonas putida KT2440
acgcuuauggcggcu

SEQ ID NO: 3544676 - RNA, 20 nt, Pseudomonas putida KT2440
acgcuuccuuguccgccaag

SEQ ID NO: 3544677 - RNA, 13 nt, Pseudomonas putida KT2440
acgcuucgaacac

SEQ ID NO: 3544678 - RNA, 16 nt, Pseudomonas putida KT2440
acgcuucgaacacccg

SEQ ID NO: 3544679 - RNA, 15 nt, Pseudomonas putida KT2440
acgcuucgauccgcg

SEQ ID NO: 3544680 - RNA, 22 nt, Pseudomonas putida KT2440
acgcuugccaaggcuagccacg

SEQ ID NO: 3544681 - RNA, 12 nt, Pseudomonas putida KT2440
acgcuuggccag

SEQ ID NO: 3544682 - RNA, 20 nt, Pseudomonas putida KT2440
acgcuuggcguaauccagcu

SEQ ID NO: 3544683 - RNA, 24 nt, Pseudomonas putida KT2440
acgcuuggcguaauccagcugcug

SEQ ID NO: 3544684 - RNA, 17 nt, Pseudomonas putida KT2440
acgcuugucuuccagcu

SEQ ID NO: 3544685 - RNA, 19 nt, Pseudomonas putida KT2440
acgcuugucuuccagcugc

SEQ ID NO: 3544686 - RNA, 17 nt, Pseudomonas putida KT2440
acgcuuucacaaauaga

SEQ ID NO: 3544687 - RNA, 17 nt, Pseudomonas putida KT2440
acggacgucccagcagg

SEQ ID NO: 3544688 - RNA, 15 nt, Pseudomonas putida KT2440
acggacgucgcgcug

SEQ ID NO: 3544689 - RNA, 20 nt, Pseudomonas putida KT2440
acggagacucgaaaccauca

SEQ ID NO: 3544690 - RNA, 13 nt, Pseudomonas putida KT2440
acggagucagugu

SEQ ID NO: 3544691 - RNA, 18 nt, Pseudomonas putida KT2440
acggauacaccagaaagc

SEQ ID NO: 3544692 - RNA, 23 nt, Pseudomonas putida KT2440
acggaucagccgcgggcgucgcg

SEQ ID NO: 3544693 - RNA, 12 nt, Pseudomonas putida KT2440
acggaucgccag

SEQ ID NO: 3544694 - RNA, 23 nt, Pseudomonas putida KT2440
acggaucggcacacgguuuccag

SEQ ID NO: 3544695 - RNA, 22 nt, Pseudomonas putida KT2440
acggauggcagcgaucaguucc

SEQ ID NO: 3544696 - RNA, 15 nt, Pseudomonas putida KT2440
acggcaacgccagca

SEQ ID NO: 3544697 - RNA, 12 nt, Pseudomonas putida KT2440
acggcaagccug

SEQ ID NO: 3544698 - RNA, 22 nt, Pseudomonas putida KT2440
acggcaaugaccaagcaacgca

SEQ ID NO: 3544699 - RNA, 13 nt, Pseudomonas putida KT2440
acggcaauucgcc

SEQ ID NO: 3544700 - RNA, 19 nt, Pseudomonas putida KT2440
acggcaauucgccggcagc

SEQ ID NO: 3544701 - RNA, 16 nt, Pseudomonas putida KT2440
acggcaauugccaccg

SEQ ID NO: 3544702 - RNA, 15 nt, Pseudomonas putida KT2440
acggcacacgcacca

SEQ ID NO: 3544703 - RNA, 19 nt, Pseudomonas putida KT2440
acggcaccuuugcaggugc

SEQ ID NO: 3544704 - RNA, 13 nt, Pseudomonas putida KT2440
acggcagaucagg

SEQ ID NO: 3544705 - RNA, 16 nt, Pseudomonas putida KT2440
acggcagaucaggcaa

SEQ ID NO: 3544706 - RNA, 17 nt, Pseudomonas putida KT2440
acggcagaucaggcaau

SEQ ID NO: 3544707 - RNA, 14 nt, Pseudomonas putida KT2440
acggcagcaggcca

SEQ ID NO: 3544708 - RNA, 22 nt, Pseudomonas putida KT2440
acggcagcaggccaaugcccau

SEQ ID NO: 3544709 - RNA, 21 nt, Pseudomonas putida KT2440
acggcagccguucccgggcag

SEQ ID NO: 3544710 - RNA, 19 nt, Pseudomonas putida KT2440
acggcagugcacccgcgag

SEQ ID NO: 3544711 - RNA, 17 nt, Pseudomonas putida KT2440
acggcauacccauggua

SEQ ID NO: 3544712 - RNA, 12 nt, Pseudomonas putida KT2440
acggcaucacgc

SEQ ID NO: 3544713 - RNA, 13 nt, Pseudomonas putida KT2440
acggcaucacgcu

SEQ ID NO: 3544714 - RNA, 19 nt, Pseudomonas putida KT2440
acggcaucacgcuggccau

SEQ ID NO: 3544715 - RNA, 16 nt, Pseudomonas putida KT2440
acggcauggccgaagc

SEQ ID NO: 3544716 - RNA, 20 nt, Pseudomonas putida KT2440
acggcauuuccagcgucagu

SEQ ID NO: 3544717 - RNA, 21 nt, Pseudomonas putida KT2440
acggccaauaucuggugcagg

SEQ ID NO: 3544718 - RNA, 17 nt, Pseudomonas putida KT2440
acggccaauggccggga

SEQ ID NO: 3544719 - RNA, 19 nt, Pseudomonas putida KT2440
acggccagcaccgaaccgg

SEQ ID NO: 3544720 - RNA, 24 nt, Pseudomonas putida KT2440
acggccagcaccgaaccggcgauc

SEQ ID NO: 3544721 - RNA, 14 nt, Pseudomonas putida KT2440
acggccagcagguu

SEQ ID NO: 3544722 - RNA, 20 nt, Pseudomonas putida KT2440
acggccagcagguugaacag

SEQ ID NO: 3544723 - RNA, 18 nt, Pseudomonas putida KT2440
acggccagccagcagcgu

SEQ ID NO: 3544724 - RNA, 14 nt, Pseudomonas putida KT2440
acggccagccguug

SEQ ID NO: 3544725 - RNA, 14 nt, Pseudomonas putida KT2440
acggccaucagcaa

SEQ ID NO: 3544726 - RNA, 16 nt, Pseudomonas putida KT2440
acggccaucagcaagc

SEQ ID NO: 3544727 - RNA, 16 nt, Pseudomonas putida KT2440
acggccgugcagggcg

SEQ ID NO: 3544728 - RNA, 20 nt, Pseudomonas putida KT2440
acggccugcauccacaccag

SEQ ID NO: 3544729 - RNA, 12 nt, Pseudomonas putida KT2440
acggccugcgcc

SEQ ID NO: 3544730 - RNA, 18 nt, Pseudomonas putida KT2440
acggccuucccgccuggc

SEQ ID NO: 3544731 - RNA, 20 nt, Pseudomonas putida KT2440
acggccuucccgccuggcgc

SEQ ID NO: 3544732 - RNA, 21 nt, Pseudomonas putida KT2440
acggccuucccgccuggcgcc

SEQ ID NO: 3544733 - RNA, 14 nt, Pseudomonas putida KT2440
acggccuucgaaga

SEQ ID NO: 3544734 - RNA, 20 nt, Pseudomonas putida KT2440
acggcgaggugauugaaggc

SEQ ID NO: 3544735 - RNA, 20 nt, Pseudomonas putida KT2440
acggcgaugcgccccccagg

SEQ ID NO: 3544736 - RNA, 23 nt, Pseudomonas putida KT2440
acggcgccgaccgaaccggcgcu

SEQ ID NO: 3544737 - RNA, 15 nt, Pseudomonas putida KT2440
acggcgcgcuucagg

SEQ ID NO: 3544738 - RNA, 17 nt, Pseudomonas putida KT2440
acggcgcugaccgauga

SEQ ID NO: 3544739 - RNA, 13 nt, Pseudomonas putida KT2440
acgugcgggcuug

SEQ ID NO: 3544740 - RNA, 13 nt, Pseudomonas putida KT2440
acguggacaugaa

SEQ ID NO: 3544741 - RNA, 22 nt, Pseudomonas putida KT2440
acgugggucguucggugcacgg

SEQ ID NO: 3544742 - RNA, 16 nt, Pseudomonas putida KT2440
acguuauccacagcgu

SEQ ID NO: 3544743 - RNA, 13 nt, Pseudomonas putida KT2440
acguuauccagcu

SEQ ID NO: 3544744 - RNA, 14 nt, Pseudomonas putida KT2440
acguuauccagcug

SEQ ID NO: 3544745 - RNA, 16 nt, Pseudomonas putida KT2440
acguuauccagcugca

SEQ ID NO: 3544746 - RNA, 19 nt, Pseudomonas putida KT2440
acguucacgcaagcgccug

SEQ ID NO: 3544747 - RNA, 13 nt, Pseudomonas putida KT2440
acguucagcgggu

SEQ ID NO: 3544748 - RNA, 15 nt, Pseudomonas putida KT2440
acguugagccaggcu

SEQ ID NO: 3544749 - RNA, 14 nt, Pseudomonas putida KT2440
acguugcugccugu

SEQ ID NO: 3544750 - RNA, 19 nt, Pseudomonas putida KT2440
acguuggccgccagcggca

SEQ ID NO: 3544751 - RNA, 23 nt, Pseudomonas putida KT2440
acguuggugccggucggcgucca

SEQ ID NO: 3544752 - RNA, 16 nt, Pseudomonas putida KT2440
acguuuaccugcagcu

SEQ ID NO: 3544753 - RNA, 15 nt, Pseudomonas putida KT2440
acguuuccagcaacc

SEQ ID NO: 3544754 - RNA, 20 nt, Pseudomonas putida KT2440
acguuuccagcaaccgcccc

SEQ ID NO: 3544755 - RNA, 12 nt, Pseudomonas putida KT2440
acguuucgcggc

SEQ ID NO: 3544756 - RNA, 18 nt, Pseudomonas putida KT2440
acguuuggcagugccaug

SEQ ID NO: 3544757 - RNA, 19 nt, Pseudomonas putida KT2440
acuaacaggugcucaccag

SEQ ID NO: 3544758 - RNA, 17 nt, Pseudomonas putida KT2440
acuaagcgaaacaccag

SEQ ID NO: 3544759 - RNA, 14 nt, Pseudomonas putida KT2440
acuaagggcaggcc

SEQ ID NO: 3544760 - RNA, 13 nt, Pseudomonas putida KT2440
acuacaugcggcc

SEQ ID NO: 3544761 - RNA, 16 nt, Pseudomonas putida KT2440
acuaccaacaccggcg

SEQ ID NO: 3544762 - RNA, 17 nt, Pseudomonas putida KT2440
acuaccaacaccggcga

SEQ ID NO: 3544763 - RNA, 23 nt, Pseudomonas putida KT2440
acuaccagguagccgucuuugag

SEQ ID NO: 3544764 - RNA, 21 nt, Pseudomonas putida KT2440
acuaccaugaaaaacaacaac

SEQ ID NO: 3544765 - RNA, 22 nt, Pseudomonas putida KT2440
acuacgccggccaaggucagca

SEQ ID NO: 3544766 - RNA, 20 nt, Pseudomonas putida KT2440
acuacgcgccagcauggacc

SEQ ID NO: 3544767 - RNA, 13 nt, Pseudomonas putida KT2440
acuagaggaucug

SEQ ID NO: 3544768 - RNA, 14 nt, Pseudomonas putida KT2440
acuagauggcugaa

SEQ ID NO: 3544769 - RNA, 14 nt, Pseudomonas putida KT2440
acuagcggugcaga

SEQ ID NO: 3544770 - RNA, 20 nt, Pseudomonas putida KT2440
acucaauuucccccaaaugc

SEQ ID NO: 3544771 - RNA, 12 nt, Pseudomonas putida KT2440
acucacccgccc

SEQ ID NO: 3544772 - RNA, 14 nt, Pseudomonas putida KT2440
acucacccgcccca

SEQ ID NO: 3544773 - RNA, 12 nt, Pseudomonas putida KT2440
acucacccgcuu

SEQ ID NO: 3544774 - RNA, 22 nt, Pseudomonas putida KT2440
acucacccgcuugccacggcgu

SEQ ID NO: 3544775 - RNA, 14 nt, Pseudomonas putida KT2440
acucaccgccgccc

SEQ ID NO: 3544776 - RNA, 22 nt, Pseudomonas putida KT2440
acucaccgccgccccgcaccag

SEQ ID NO: 3544777 - RNA, 13 nt, Pseudomonas putida KT2440
acucacgcauggc

SEQ ID NO: 3544778 - RNA, 17 nt, Pseudomonas putida KT2440
acucacgcgccaggguu

SEQ ID NO: 3544779 - RNA, 19 nt, Pseudomonas putida KT2440
acucacgcucguuguccag

SEQ ID NO: 3544780 - RNA, 20 nt, Pseudomonas putida KT2440
acucagcggccuuucugcuu

SEQ ID NO: 3544781 - RNA, 21 nt, Pseudomonas putida KT2440
acucaggugcacgacgucguc

SEQ ID NO: 3544782 - RNA, 19 nt, Pseudomonas putida KT2440
acucaguuaaucagcaacg

SEQ ID NO: 3544783 - RNA, 13 nt, Pseudomonas putida KT2440
acucaugguuuug

SEQ ID NO: 3544784 - RNA, 15 nt, Pseudomonas putida KT2440
acucaugguuuuguu

SEQ ID NO: 3544785 - RNA, 14 nt, Pseudomonas putida KT2440
acuccaccagccca

SEQ ID NO: 3544786 - RNA, 12 nt, Pseudomonas putida KT2440
acuccaccauca

SEQ ID NO: 3544787 - RNA, 19 nt, Pseudomonas putida KT2440
acuccacugugcccgccag

SEQ ID NO: 3544788 - RNA, 15 nt, Pseudomonas putida KT2440
acuccagaaaaucag

SEQ ID NO: 3544789 - RNA, 11 nt, Pseudomonas putida KT2440
acuccagcagc

SEQ ID NO: 3544790 - RNA, 14 nt, Pseudomonas putida KT2440
acuccagcagcgca

SEQ ID NO: 3544791 - RNA, 21 nt, Pseudomonas putida KT2440
acuccagcagcgcauccaccu

SEQ ID NO: 3544792 - RNA, 17 nt, Pseudomonas putida KT2440
acuccagcgaguggcca

SEQ ID NO: 3544793 - RNA, 15 nt, Pseudomonas putida KT2440
acuccagcgccagca

SEQ ID NO: 3544794 - RNA, 17 nt, Pseudomonas putida KT2440
acuccagggucugcgcu

SEQ ID NO: 3544795 - RNA, 17 nt, Pseudomonas putida KT2440
acucccacagauauugc

SEQ ID NO: 3544796 - RNA, 12 nt, Pseudomonas putida KT2440
acucccacagcg

SEQ ID NO: 3544797 - RNA, 18 nt, Pseudomonas putida KT2440
acucccacagcggcccca

SEQ ID NO: 3544798 - RNA, 19 nt, Pseudomonas putida KT2440
acucccauguagaccacca

SEQ ID NO: 3544799 - RNA, 16 nt, Pseudomonas putida KT2440
acuccccaucagcagc

SEQ ID NO: 3544800 - RNA, 17 nt, Pseudomonas putida KT2440
acuccccaucagcagcu

SEQ ID NO: 3544801 - RNA, 17 nt, Pseudomonas putida KT2440
acuccggcaaccccgcc

SEQ ID NO: 3544802 - RNA, 10 nt, Pseudomonas putida KT2440
acuccuccag

SEQ ID NO: 3544803 - RNA, 20 nt, Pseudomonas putida KT2440
acuccuccagccgacggcca

SEQ ID NO: 3544804 - RNA, 20 nt, Pseudomonas putida KT2440
acuccucgaucaccugcggc

SEQ ID NO: 3544805 - RNA, 19 nt, Pseudomonas putida KT2440
acuccugacauccugcucc

SEQ ID NO: 3544806 - RNA, 12 nt, Pseudomonas putida KT2440
acuccugcacca

SEQ ID NO: 3544807 - RNA, 19 nt, Pseudomonas putida KT2440
acuccugcguacccagccc

SEQ ID NO: 3544808 - RNA, 15 nt, Pseudomonas putida KT2440
acuccugguuggcca

SEQ ID NO: 3544809 - RNA, 16 nt, Pseudomonas putida KT2440
acuccugugcggcgua

SEQ ID NO: 3544810 - RNA, 19 nt, Pseudomonas putida KT2440
acuccugugggagcgggcg

SEQ ID NO: 3544811 - RNA, 22 nt, Pseudomonas putida KT2440
acuccuucucgcccacgaucuc

SEQ ID NO: 3544812 - RNA, 13 nt, Pseudomonas putida KT2440
acuccuugaaauu

SEQ ID NO: 3544813 - RNA, 19 nt, Pseudomonas putida KT2440
acuccuugcgcaucaagcg

SEQ ID NO: 3544814 - RNA, 22 nt, Pseudomonas putida KT2440
acuccuugcgcaucaagcggcu

SEQ ID NO: 3544815 - RNA, 14 nt, Pseudomonas putida KT2440
acuccuugucgcaa

SEQ ID NO: 3544816 - RNA, 16 nt, Pseudomonas putida KT2440
acuccuugucgcaaug

SEQ ID NO: 3544817 - RNA, 17 nt, Pseudomonas putida KT2440
acuccuugucgcaaugg

SEQ ID NO: 3544818 - RNA, 15 nt, Pseudomonas putida KT2440
acucgaacagcuuga

SEQ ID NO: 3544819 - RNA, 13 nt, Pseudomonas putida KT2440
acucgaccgccgc

SEQ ID NO: 3544820 - RNA, 16 nt, Pseudomonas putida KT2440
acucgaccgccgcaca

SEQ ID NO: 3544821 - RNA, 17 nt, Pseudomonas putida KT2440
acucgaucugugggagc

SEQ ID NO: 3544822 - RNA, 15 nt, Pseudomonas putida KT2440
acucgcccccaucgc

SEQ ID NO: 3544823 - RNA, 13 nt, Pseudomonas putida KT2440
acucgcccgccag

SEQ ID NO: 3544824 - RNA, 21 nt, Pseudomonas putida KT2440
acucgccgauaaagcgucgcc

SEQ ID NO: 3544825 - RNA, 19 nt, Pseudomonas putida KT2440
acucgcgcuguuccagccc

SEQ ID NO: 3544826 - RNA, 16 nt, Pseudomonas putida KT2440
acucgcggccggucac

SEQ ID NO: 3544827 - RNA, 19 nt, Pseudomonas putida KT2440
acucgcuuucgaucgagcc

SEQ ID NO: 3544828 - RNA, 14 nt, Pseudomonas putida KT2440
acucggacaaccaa

SEQ ID NO: 3544829 - RNA, 12 nt, Pseudomonas putida KT2440
acucggcaguga

SEQ ID NO: 3544830 - RNA, 13 nt, Pseudomonas putida KT2440
acucggcagugaa

SEQ ID NO: 3544831 - RNA, 18 nt, Pseudomonas putida KT2440
acucggcagugaacucca

SEQ ID NO: 3544832 - RNA, 17 nt, Pseudomonas putida KT2440
acucggcgagccgccag

SEQ ID NO: 3544833 - RNA, 18 nt, Pseudomonas putida KT2440
acucggcgcgugccgcau

SEQ ID NO: 3544834 - RNA, 17 nt, Pseudomonas putida KT2440
acucggcguagcaggua

SEQ ID NO: 3544835 - RNA, 14 nt, Pseudomonas putida KT2440
acucggcuaccgca

SEQ ID NO: 3544836 - RNA, 18 nt, Pseudomonas putida KT2440
acucggucggcuggcacu

SEQ ID NO: 3544837 - RNA, 20 nt, Pseudomonas putida KT2440
acucgucaauaccggugccc

SEQ ID NO: 3544838 - RNA, 22 nt, Pseudomonas putida KT2440
acucgucacccuccacgcguug

SEQ ID NO: 3544839 - RNA, 21 nt, Pseudomonas putida KT2440
acucguugaagcgguugaccg

SEQ ID NO: 3544840 - RNA, 14 nt, Pseudomonas putida KT2440
acucguugaccacg

SEQ ID NO: 3544841 - RNA, 22 nt, Pseudomonas putida KT2440
acucguugaccacgaaggcaau

SEQ ID NO: 3544842 - RNA, 15 nt, Pseudomonas putida KT2440
acucuaccucacuga

SEQ ID NO: 3544843 - RNA, 15 nt, Pseudomonas putida KT2440
acucuacugcccgca

SEQ ID NO: 3544844 - RNA, 14 nt, Pseudomonas putida KT2440
acucugcugcucug

SEQ ID NO: 3544845 - RNA, 13 nt, Pseudomonas putida KT2440
acuggcggggcuu

SEQ ID NO: 3544846 - RNA, 13 nt, Pseudomonas putida KT2440
acuggcuacagau

SEQ ID NO: 3544847 - RNA, 18 nt, Pseudomonas putida KT2440
acuggcuacagaucagcc

SEQ ID NO: 3544848 - RNA, 14 nt, Pseudomonas putida KT2440
acuggcuauccuuc

SEQ ID NO: 3544849 - RNA, 18 nt, Pseudomonas putida KT2440
acuggcuauccuucugcc

SEQ ID NO: 3544850 - RNA, 17 nt, Pseudomonas putida KT2440
acuggcucaugcgccag

SEQ ID NO: 3544851 - RNA, 18 nt, Pseudomonas putida KT2440
acuggcucaugcgccagg

SEQ ID NO: 3544852 - RNA, 22 nt, Pseudomonas putida KT2440
acuggcugaccagugucugcaa

SEQ ID NO: 3544853 - RNA, 15 nt, Pseudomonas putida KT2440
acuggcugccgcuga

SEQ ID NO: 3544854 - RNA, 13 nt, Pseudomonas putida KT2440
acuggcugcugcg

SEQ ID NO: 3544855 - RNA, 15 nt, Pseudomonas putida KT2440
acuggcuuccucuuc

SEQ ID NO: 3544856 - RNA, 18 nt, Pseudomonas putida KT2440
acuggcuucgaugaaggc

SEQ ID NO: 3544857 - RNA, 21 nt, Pseudomonas putida KT2440
acuggcuucgaugaaggcugc

SEQ ID NO: 3544858 - RNA, 20 nt, Pseudomonas putida KT2440
acuggcuuucccccagccaa

SEQ ID NO: 3544859 - RNA, 18 nt, Pseudomonas putida KT2440
acuggucaaacaaugcac

SEQ ID NO: 3544860 - RNA, 13 nt, Pseudomonas putida KT2440
acuggucgaggau

SEQ ID NO: 3544861 - RNA, 20 nt, Pseudomonas putida KT2440
acuggucgccucgacgcaga

SEQ ID NO: 3544862 - RNA, 14 nt, Pseudomonas putida KT2440
acuguaggcaaaca

SEQ ID NO: 3544863 - RNA, 16 nt, Pseudomonas putida KT2440
acuguaggcaaacagc

SEQ ID NO: 3544864 - RNA, 13 nt, Pseudomonas putida KT2440
acugucccggcac

SEQ ID NO: 3544865 - RNA, 17 nt, Pseudomonas putida KT2440
acugugcuggggccagc

SEQ ID NO: 3544866 - RNA, 16 nt, Pseudomonas putida KT2440
acugugggagcaggca

SEQ ID NO: 3544867 - RNA, 17 nt, Pseudomonas putida KT2440
acuguggucauccaggc

SEQ ID NO: 3544868 - RNA, 23 nt, Pseudomonas putida KT2440
acuguggucauccaggcuggcca

SEQ ID NO: 3544869 - RNA, 20 nt, Pseudomonas putida KT2440
acuguucagguaggccgcag

SEQ ID NO: 3544870 - RNA, 15 nt, Pseudomonas putida KT2440
acuguugcagcgcca

SEQ ID NO: 3544871 - RNA, 17 nt, Pseudomonas putida KT2440
acuguuggaauggcgca

SEQ ID NO: 3544872 - RNA, 21 nt, Pseudomonas putida KT2440
acuguuugagccggcgcuggg

SEQ ID NO: 3544873 - RNA, 11 nt, Pseudomonas putida KT2440
acuuagucucg

SEQ ID NO: 3544874 - RNA, 17 nt, Pseudomonas putida KT2440
acuuauaagcagcaagc

SEQ ID NO: 3544875 - RNA, 14 nt, Pseudomonas putida KT2440
acuuauccgcuggc

SEQ ID NO: 3544876 - RNA, 17 nt, Pseudomonas putida KT2440
acuucaaccgcacccgc

SEQ ID NO: 3544877 - RNA, 13 nt, Pseudomonas putida KT2440
acuucaauggcac

SEQ ID NO: 3544878 - RNA, 16 nt, Pseudomonas putida KT2440
acuucaauggcacccu

SEQ ID NO: 3544879 - RNA, 23 nt, Pseudomonas putida KT2440
acuucacccaaugcaugcaucag

SEQ ID NO: 3544880 - RNA, 16 nt, Pseudomonas putida KT2440
acuucacgugggucgu

SEQ ID NO: 3544881 - RNA, 15 nt, Pseudomonas putida KT2440
acuucaucaccucca

SEQ ID NO: 3544882 - RNA, 16 nt, Pseudomonas putida KT2440
acuuccacuccagccg

SEQ ID NO: 3544883 - RNA, 22 nt, Pseudomonas putida KT2440
acuuccagcgacaacggaacga

SEQ ID NO: 3544884 - RNA, 22 nt, Pseudomonas putida KT2440
acuuccagcgacaucggaacga

SEQ ID NO: 3544885 - RNA, 13 nt, Pseudomonas putida KT2440
acuucccccuccc

SEQ ID NO: 3544886 - RNA, 16 nt, Pseudomonas putida KT2440
acuucccccuccccau

SEQ ID NO: 3544887 - RNA, 13 nt, Pseudomonas putida KT2440
acuuccccggcgc

SEQ ID NO: 3544888 - RNA, 17 nt, Pseudomonas putida KT2440
acuuccuggccgccucc

SEQ ID NO: 3544889 - RNA, 16 nt, Pseudomonas putida KT2440
acuucgaagugccacg

SEQ ID NO: 3544890 - RNA, 18 nt, Pseudomonas putida KT2440
acuucgaagugccacgcc

SEQ ID NO: 3544891 - RNA, 22 nt, Pseudomonas putida KT2440
acuucucccgggcaaucaguaa

SEQ ID NO: 3544892 - RNA, 21 nt, Pseudomonas putida KT2440
acuucucgaccagcgccagcc

SEQ ID NO: 3544893 - RNA, 22 nt, Pseudomonas putida KT2440
acuucucgaccagcgccagcca

SEQ ID NO: 3544894 - RNA, 18 nt, Pseudomonas putida KT2440
acuucucgccucagcgcc

SEQ ID NO: 3544895 - RNA, 19 nt, Pseudomonas putida KT2440
acuucuggcugggcuucga

SEQ ID NO: 3544896 - RNA, 11 nt, Pseudomonas putida KT2440
acuugaagacc

SEQ ID NO: 3544897 - RNA, 14 nt, Pseudomonas putida KT2440
acuugcgcagcuug

SEQ ID NO: 3544898 - RNA, 22 nt, Pseudomonas putida KT2440
acuugcgcaguaacaggcgcac

SEQ ID NO: 3544899 - RNA, 23 nt, Pseudomonas putida KT2440
acuugcgggucagcagcaccgcc

SEQ ID NO: 3544900 - RNA, 15 nt, Pseudomonas putida KT2440
acuugcugcagggca

SEQ ID NO: 3544901 - RNA, 19 nt, Pseudomonas putida KT2440
acuugcuggauuccgacaa

SEQ ID NO: 3544902 - RNA, 13 nt, Pseudomonas putida KT2440
acuugcuggguac

SEQ ID NO: 3544903 - RNA, 21 nt, Pseudomonas putida KT2440
acuugcuggguaccgugcugc

SEQ ID NO: 3544904 - RNA, 22 nt, Pseudomonas putida KT2440
acuugcuggguaccgugcugca

SEQ ID NO: 3544905 - RNA, 20 nt, Pseudomonas putida KT2440
acuuggaaaacagcgcgcga

SEQ ID NO: 3544906 - RNA, 14 nt, Pseudomonas putida KT2440
acuuggcagccccg

SEQ ID NO: 3544907 - RNA, 15 nt, Pseudomonas putida KT2440
acuuggcagccccga

SEQ ID NO: 3544908 - RNA, 14 nt, Pseudomonas putida KT2440
acuuggccuccagc

SEQ ID NO: 3544909 - RNA, 13 nt, Pseudomonas putida KT2440
acuuggccugcug

SEQ ID NO: 3544910 - RNA, 21 nt, Pseudomonas putida KT2440
acuuggcgccgcccuggaugc

SEQ ID NO: 3544911 - RNA, 17 nt, Pseudomonas putida KT2440
acuugguccagggccau

SEQ ID NO: 3544912 - RNA, 20 nt, Pseudomonas putida KT2440
acuugucccggcccagccgc

SEQ ID NO: 3544913 - RNA, 13 nt, Pseudomonas putida KT2440
acuugucugccag

SEQ ID NO: 3544914 - RNA, 18 nt, Pseudomonas putida KT2440
acuugugugaacggcgcc

SEQ ID NO: 3544915 - RNA, 17 nt, Pseudomonas putida KT2440
acuugugugccugcucc

SEQ ID NO: 3544916 - RNA, 21 nt, Pseudomonas putida KT2440
acuuuacggcugauggugguc

SEQ ID NO: 3544917 - RNA, 23 nt, Pseudomonas putida KT2440
acuuuagcuuauucgaugcaggc

SEQ ID NO: 3544918 - RNA, 22 nt, Pseudomonas putida KT2440
acuuucccacauguaaugaaaa

SEQ ID NO: 3544919 - RNA, 17 nt, Pseudomonas putida KT2440
acuuugucgaugccugc

SEQ ID NO: 3544920 - RNA, 15 nt, Pseudomonas putida KT2440
acuuugucgccuacc

SEQ ID NO: 3544921 - RNA, 20 nt, Pseudomonas putida KT2440
acuuuguuaaggauugugag

SEQ ID NO: 3544922 - RNA, 21 nt, Pseudomonas putida KT2440
acuuuucgccacaacccauca

SEQ ID NO: 3544923 - RNA, 13 nt, Pseudomonas putida KT2440
agaaaagccgcug

SEQ ID NO: 3544924 - RNA, 23 nt, Pseudomonas putida KT2440
agaaacggcggcagauacaaccc

SEQ ID NO: 3544925 - RNA, 20 nt, Pseudomonas putida KT2440
agaaaguuugguuuuuucac

SEQ ID NO: 3544926 - RNA, 23 nt, Pseudomonas putida KT2440
agaaauggcuuccggcgcuggua

SEQ ID NO: 3544927 - RNA, 15 nt, Pseudomonas putida KT2440
agaacaacacggcag

SEQ ID NO: 3544928 - RNA, 14 nt, Pseudomonas putida KT2440
agaacaccugcagc

SEQ ID NO: 3544929 - RNA, 15 nt, Pseudomonas putida KT2440
agaacaccugcagcg

SEQ ID NO: 3544930 - RNA, 16 nt, Pseudomonas putida KT2440
agaacaccugcagcgc

SEQ ID NO: 3544931 - RNA, 13 nt, Pseudomonas putida KT2440
agaacacuggcag

SEQ ID NO: 3544932 - RNA, 15 nt, Pseudomonas putida KT2440
agaacacuggcaggc

SEQ ID NO: 3544933 - RNA, 22 nt, Pseudomonas putida KT2440
agaacagccacagcugcugcag

SEQ ID NO: 3544934 - RNA, 18 nt, Pseudomonas putida KT2440
agaacagcgaagccagca

SEQ ID NO: 3544935 - RNA, 20 nt, Pseudomonas putida KT2440
agaacagcgaagccagcacg

SEQ ID NO: 3544936 - RNA, 14 nt, Pseudomonas putida KT2440
agaacaggcggccc

SEQ ID NO: 3544937 - RNA, 22 nt, Pseudomonas putida KT2440
agaacaggcggcuguccggcgu

SEQ ID NO: 3544938 - RNA, 19 nt, Pseudomonas putida KT2440
agaacaucaggucugccag

SEQ ID NO: 3544939 - RNA, 16 nt, Pseudomonas putida KT2440
agaacaugaaagugac

SEQ ID NO: 3544940 - RNA, 16 nt, Pseudomonas putida KT2440
agaacaugaucaagcu

SEQ ID NO: 3544941 - RNA, 12 nt, Pseudomonas putida KT2440
agaacaugccac

SEQ ID NO: 3544942 - RNA, 19 nt, Pseudomonas putida KT2440
agaaccacuccagggucug

SEQ ID NO: 3544943 - RNA, 19 nt, Pseudomonas putida KT2440
agaaccugacaagcgaggu

SEQ ID NO: 3544944 - RNA, 23 nt, Pseudomonas putida KT2440
agaaccugaugcgagcuaccuga

SEQ ID NO: 3544945 - RNA, 14 nt, Pseudomonas putida KT2440
agaacguggugcgg

SEQ ID NO: 3544946 - RNA, 17 nt, Pseudomonas putida KT2440
agaacuggcgcagcagg

SEQ ID NO: 3544947 - RNA, 16 nt, Pseudomonas putida KT2440
agaacuugguccagaa

SEQ ID NO: 3544948 - RNA, 14 nt, Pseudomonas putida KT2440
agaagaagcuguag

SEQ ID NO: 3544949 - RNA, 14 nt, Pseudomonas putida KT2440
agaagacaccgcgg

SEQ ID NO: 3544950 - RNA, 18 nt, Pseudomonas putida KT2440
agcaccacccaccagcag

SEQ ID NO: 3544951 - RNA, 15 nt, Pseudomonas putida KT2440
agcaccacuggauga

SEQ ID NO: 3544952 - RNA, 19 nt, Pseudomonas putida KT2440
agcaccagcgacugcaagc

SEQ ID NO: 3544953 - RNA, 20 nt, Pseudomonas putida KT2440
agcaccagcgcgaucaccag

SEQ ID NO: 3544954 - RNA, 22 nt, Pseudomonas putida KT2440
agcaccagcgcgaucaccagcc

SEQ ID NO: 3544955 - RNA, 19 nt, Pseudomonas putida KT2440
agcaccagcgggcccagca

SEQ ID NO: 3544956 - RNA, 12 nt, Pseudomonas putida KT2440
agcaccagcucc

SEQ ID NO: 3544957 - RNA, 18 nt, Pseudomonas putida KT2440
agcaccagguuugcugcc

SEQ ID NO: 3544958 - RNA, 15 nt, Pseudomonas putida KT2440
agcaccaucagagcg

SEQ ID NO: 3544959 - RNA, 16 nt, Pseudomonas putida KT2440
agcaccaucagagcgc

SEQ ID NO: 3544960 - RNA, 19 nt, Pseudomonas putida KT2440
agcaccaucaggcacaggc

SEQ ID NO: 3544961 - RNA, 23 nt, Pseudomonas putida KT2440
agcaccaugaacucuuccccgcc

SEQ ID NO: 3544962 - RNA, 16 nt, Pseudomonas putida KT2440
agcaccauuugucuug

SEQ ID NO: 3544963 - RNA, 22 nt, Pseudomonas putida KT2440
agcaccauuugucuugaagaua

SEQ ID NO: 3544964 - RNA, 12 nt, Pseudomonas putida KT2440
agcacccacacc

SEQ ID NO: 3544965 - RNA, 14 nt, Pseudomonas putida KT2440
agcaccccagcacc

SEQ ID NO: 3544966 - RNA, 21 nt, Pseudomonas putida KT2440
agcaccccguccagccccaag

SEQ ID NO: 3544967 - RNA, 23 nt, Pseudomonas putida KT2440
agcacccgcaggcgacgagccag

SEQ ID NO: 3544968 - RNA, 14 nt, Pseudomonas putida KT2440
agcacccgcccauc

SEQ ID NO: 3544969 - RNA, 16 nt, Pseudomonas putida KT2440
agcacccgcccaucgc

SEQ ID NO: 3544970 - RNA, 21 nt, Pseudomonas putida KT2440
agcacccgcccaucgcacacc

SEQ ID NO: 3544971 - RNA, 11 nt, Pseudomonas putida KT2440
agcacccgcuu

SEQ ID NO: 3544972 - RNA, 18 nt, Pseudomonas putida KT2440
agcacccgcuuggccacc

SEQ ID NO: 3544973 - RNA, 18 nt, Pseudomonas putida KT2440
agcacccggucgccgacg

SEQ ID NO: 3544974 - RNA, 14 nt, Pseudomonas putida KT2440
agcaccgaucagcg

SEQ ID NO: 3544975 - RNA, 16 nt, Pseudomonas putida KT2440
agcaccgccacaaucc

SEQ ID NO: 3544976 - RNA, 23 nt, Pseudomonas putida KT2440
agcaccgccauggccaggucggu

SEQ ID NO: 3544977 - RNA, 20 nt, Pseudomonas putida KT2440
agcaccgccccggccagugc

SEQ ID NO: 3544978 - RNA, 17 nt, Pseudomonas putida KT2440
agcaccgcgacgaccgc

SEQ ID NO: 3544979 - RNA, 20 nt, Pseudomonas putida KT2440
agcaccgcgacgaccgcacu

SEQ ID NO: 3544980 - RNA, 18 nt, Pseudomonas putida KT2440
agcaccgcugccagcugc

SEQ ID NO: 3544981 - RNA, 20 nt, Pseudomonas putida KT2440
agcaccgcuucacccucgcg

SEQ ID NO: 3544982 - RNA, 23 nt, Pseudomonas putida KT2440
agcaccgcuucacccucgcgcag

SEQ ID NO: 3544983 - RNA, 23 nt, Pseudomonas putida KT2440
agcaccggcaacccuucggccag

SEQ ID NO: 3544984 - RNA, 13 nt, Pseudomonas putida KT2440
agcaccggccagg

SEQ ID NO: 3544985 - RNA, 14 nt, Pseudomonas putida KT2440
agcaccggccaggc

SEQ ID NO: 3544986 - RNA, 15 nt, Pseudomonas putida KT2440
agcaccggccaggcu

SEQ ID NO: 3544987 - RNA, 21 nt, Pseudomonas putida KT2440
agcaccgguaccgcucugcgc

SEQ ID NO: 3544988 - RNA, 12 nt, Pseudomonas putida KT2440
agcaccuccacc

SEQ ID NO: 3544989 - RNA, 13 nt, Pseudomonas putida KT2440
agcaccuccaccu

SEQ ID NO: 3544990 - RNA, 17 nt, Pseudomonas putida KT2440
agcaccuccugcacaua

SEQ ID NO: 3544991 - RNA, 16 nt, Pseudomonas putida KT2440
agcaccugacgcaagc

SEQ ID NO: 3544992 - RNA, 13 nt, Pseudomonas putida KT2440
agcaccugcaggu

SEQ ID NO: 3544993 - RNA, 18 nt, Pseudomonas putida KT2440
agcaccugcagguacagc

SEQ ID NO: 3544994 - RNA, 20 nt, Pseudomonas putida KT2440
agcaccugcagguacagcag

SEQ ID NO: 3544995 - RNA, 22 nt, Pseudomonas putida KT2440
agcaccugcagguacagcagcu

SEQ ID NO: 3544996 - RNA, 14 nt, Pseudomonas putida KT2440
agcaccugccgcug

SEQ ID NO: 3544997 - RNA, 14 nt, Pseudomonas putida KT2440
agcaccuggcggcc

SEQ ID NO: 3544998 - RNA, 23 nt, Pseudomonas putida KT2440
agcaccugggcgucaucacccgg

SEQ ID NO: 3544999 - RNA, 18 nt, Pseudomonas putida KT2440
agcacgaaacugcgcugg

SEQ ID NO: 3545000 - RNA, 21 nt, Pseudomonas putida KT2440
agcacgaaacugcgcugguac

SEQ ID NO: 3545001 - RNA, 22 nt, Pseudomonas putida KT2440
agcacgaaacugcgcugguaca

SEQ ID NO: 3545002 - RNA, 12 nt, Pseudomonas putida KT2440
agcacgaacagc

SEQ ID NO: 3545003 - RNA, 17 nt, Pseudomonas putida KT2440
agcacgaaggccagcaa

SEQ ID NO: 3545004 - RNA, 17 nt, Pseudomonas putida KT2440
agcacgaaguaacggcc

SEQ ID NO: 3545005 - RNA, 18 nt, Pseudomonas putida KT2440
agcacgaucagcgcggca

SEQ ID NO: 3545006 - RNA, 19 nt, Pseudomonas putida KT2440
agcacgaucucgucacugc

SEQ ID NO: 3545007 - RNA, 15 nt, Pseudomonas putida KT2440
agcacgaugacgaac

SEQ ID NO: 3545008 - RNA, 14 nt, Pseudomonas putida KT2440
agcacgauggcggu

SEQ ID NO: 3545009 - RNA, 19 nt, Pseudomonas putida KT2440
agcacgauggcggucgaac

SEQ ID NO: 3545010 - RNA, 15 nt, Pseudomonas putida KT2440
agcacgcaggccagc

SEQ ID NO: 3545011 - RNA, 14 nt, Pseudomonas putida KT2440
agcacgccgccgau

SEQ ID NO: 3545012 - RNA, 22 nt, Pseudomonas putida KT2440
agcacgccgccgauaccgaaca

SEQ ID NO: 3545013 - RNA, 18 nt, Pseudomonas putida KT2440
agcacgccggcauagaug

SEQ ID NO: 3545014 - RNA, 13 nt, Pseudomonas putida KT2440
agcacgcuggcca

SEQ ID NO: 3545015 - RNA, 16 nt, Pseudomonas putida KT2440
agcacgcuggccagag

SEQ ID NO: 3545016 - RNA, 24 nt, Pseudomonas putida KT2440
agcacggaaucacgcggcgucacc

SEQ ID NO: 3545017 - RNA, 15 nt, Pseudomonas putida KT2440
agcacgggcagcuug

SEQ ID NO: 3545018 - RNA, 16 nt, Pseudomonas putida KT2440
agcacgggcgcugaag

SEQ ID NO: 3545019 - RNA, 20 nt, Pseudomonas putida KT2440
agcacgggcgcugaagccag

SEQ ID NO: 3545020 - RNA, 14 nt, Pseudomonas putida KT2440
agcacguaguaauc

SEQ ID NO: 3545021 - RNA, 16 nt, Pseudomonas putida KT2440
agcacgucggcgccga

SEQ ID NO: 3545022 - RNA, 18 nt, Pseudomonas putida KT2440
agcacuacaucuaccuga

SEQ ID NO: 3545023 - RNA, 23 nt, Pseudomonas putida KT2440
agcacugcauuggccacgcccaa

SEQ ID NO: 3545024 - RNA, 16 nt, Pseudomonas putida KT2440
agcacugccugcaugc

SEQ ID NO: 3545025 - RNA, 14 nt, Pseudomonas putida KT2440
agcacugccuugcc

SEQ ID NO: 3545026 - RNA, 22 nt, Pseudomonas putida KT2440
agcacugccuugcccugcagcu

SEQ ID NO: 3545027 - RNA, 12 nt, Pseudomonas putida KT2440
agcacugcugcg

SEQ ID NO: 3545028 - RNA, 19 nt, Pseudomonas putida KT2440
agcacugcugcgcaguaca

SEQ ID NO: 3545029 - RNA, 15 nt, Pseudomonas putida KT2440
agcacugucgauggc

SEQ ID NO: 3545030 - RNA, 16 nt, Pseudomonas putida KT2440
agcacuucguccaggg

SEQ ID NO: 3545031 - RNA, 22 nt, Pseudomonas putida KT2440
agcagaacaucaggucugccag

SEQ ID NO: 3545032 - RNA, 12 nt, Pseudomonas putida KT2440
agcagacagcug

SEQ ID NO: 3545033 - RNA, 16 nt, Pseudomonas putida KT2440
agcagacagcugugcu

SEQ ID NO: 3545034 - RNA, 21 nt, Pseudomonas putida KT2440
agcagacccagaaucccaacc

SEQ ID NO: 3545035 - RNA, 17 nt, Pseudomonas putida KT2440
agcagaugaacccggca

SEQ ID NO: 3545036 - RNA, 13 nt, Pseudomonas putida KT2440
agcagcaccgagg

SEQ ID NO: 3545037 - RNA, 21 nt, Pseudomonas putida KT2440
agcagcaccgaggcgugauca

SEQ ID NO: 3545038 - RNA, 21 nt, Pseudomonas putida KT2440
agcagcaccgccaccaugcuc

SEQ ID NO: 3545039 - RNA, 14 nt, Pseudomonas putida KT2440
agcagcagccccag

SEQ ID NO: 3545040 - RNA, 14 nt, Pseudomonas putida KT2440
agcagcaggcgcga

SEQ ID NO: 3545041 - RNA, 19 nt, Pseudomonas putida KT2440
agcagcaguucggcaacau

SEQ ID NO: 3545042 - RNA, 19 nt, Pseudomonas putida KT2440
agcagcaugaauagcgcac

SEQ ID NO: 3545043 - RNA, 20 nt, Pseudomonas putida KT2440
agcagcccuucgcucaaccg

SEQ ID NO: 3545044 - RNA, 23 nt, Pseudomonas putida KT2440
agcagcgaagggcucaacgccag

SEQ ID NO: 3545045 - RNA, 18 nt, Pseudomonas putida KT2440
agcagcgaaugcagcucg

SEQ ID NO: 3545046 - RNA, 20 nt, Pseudomonas putida KT2440
agcagcgacacugacaacac

SEQ ID NO: 3545047 - RNA, 22 nt, Pseudomonas putida KT2440
agcagcgccgccaggcccacca

SEQ ID NO: 3545048 - RNA, 16 nt, Pseudomonas putida KT2440
agcagcgccugcagcg

SEQ ID NO: 3545049 - RNA, 16 nt, Pseudomonas putida KT2440
agcagcgccuggucau

SEQ ID NO: 3545050 - RNA, 15 nt, Pseudomonas putida KT2440
agcagcgcuaugccu

SEQ ID NO: 3545051 - RNA, 18 nt, Pseudomonas putida KT2440
agcagcguucucggugua

SEQ ID NO: 3545052 - RNA, 18 nt, Pseudomonas putida KT2440
agcagcucccgagccagg

SEQ ID NO: 3545053 - RNA, 19 nt, Pseudomonas putida KT2440
agcagcucccgagccagga

SEQ ID NO: 3545054 - RNA, 12 nt, Pseudomonas putida KT2440
agcagcugcauu

SEQ ID NO: 3545055 - RNA, 20 nt, Pseudomonas putida KT2440
agccacauccucugcccgca

SEQ ID NO: 3545056 - RNA, 22 nt, Pseudomonas putida KT2440
agccacauugauaguagccgcc

SEQ ID NO: 3545057 - RNA, 15 nt, Pseudomonas putida KT2440
agccaccaccaugcg

SEQ ID NO: 3545058 - RNA, 20 nt, Pseudomonas putida KT2440
agccaccacgguggcugcca

SEQ ID NO: 3545059 - RNA, 14 nt, Pseudomonas putida KT2440
agccacccuccgca

SEQ ID NO: 3545060 - RNA, 16 nt, Pseudomonas putida KT2440
agccacccuccgcaca

SEQ ID NO: 3545061 - RNA, 14 nt, Pseudomonas putida KT2440
agccaccgacgaac

SEQ ID NO: 3545062 - RNA, 18 nt, Pseudomonas putida KT2440
agccaccgcacucugcug

SEQ ID NO: 3545063 - RNA, 20 nt, Pseudomonas putida KT2440
agccaccgccaccaucggcc

SEQ ID NO: 3545064 - RNA, 13 nt, Pseudomonas putida KT2440
agccaccgcgagc

SEQ ID NO: 3545065 - RNA, 16 nt, Pseudomonas putida KT2440
agccaccgcgauggau

SEQ ID NO: 3545066 - RNA, 13 nt, Pseudomonas putida KT2440
agccaccggcaua

SEQ ID NO: 3545067 - RNA, 15 nt, Pseudomonas putida KT2440
agccaccgggcgagu

SEQ ID NO: 3545068 - RNA, 21 nt, Pseudomonas putida KT2440
agccaccucgacccccuugcc

SEQ ID NO: 3545069 - RNA, 14 nt, Pseudomonas putida KT2440
agccacgcaucugc

SEQ ID NO: 3545070 - RNA, 16 nt, Pseudomonas putida KT2440
agccacgcaucugcac

SEQ ID NO: 3545071 - RNA, 12 nt, Pseudomonas putida KT2440
agccacgcugcc

SEQ ID NO: 3545072 - RNA, 14 nt, Pseudomonas putida KT2440
agccacgcugccag

SEQ ID NO: 3545073 - RNA, 15 nt, Pseudomonas putida KT2440
agccacgcuggcacc

SEQ ID NO: 3545074 - RNA, 23 nt, Pseudomonas putida KT2440
agccacgcuggcacccacgcgcu

SEQ ID NO: 3545075 - RNA, 14 nt, Pseudomonas putida KT2440
agccacggaucacc

SEQ ID NO: 3545076 - RNA, 21 nt, Pseudomonas putida KT2440
agccacgggugcgggcuccac

SEQ ID NO: 3545077 - RNA, 19 nt, Pseudomonas putida KT2440
agccacucggcaaucugcu

SEQ ID NO: 3545078 - RNA, 11 nt, Pseudomonas putida KT2440
agccacuggcc

SEQ ID NO: 3545079 - RNA, 17 nt, Pseudomonas putida KT2440
agccacuggccagcaga

SEQ ID NO: 3545080 - RNA, 19 nt, Pseudomonas putida KT2440
agccacuggccagcagaug

SEQ ID NO: 3545081 - RNA, 11 nt, Pseudomonas putida KT2440
agccagcagcc

SEQ ID NO: 3545082 - RNA, 16 nt, Pseudomonas putida KT2440
agccagcagccugugc

SEQ ID NO: 3545083 - RNA, 21 nt, Pseudomonas putida KT2440
agccagcagcguacccagcuc

SEQ ID NO: 3545084 - RNA, 19 nt, Pseudomonas putida KT2440
agccagcaucucggccagu

SEQ ID NO: 3545085 - RNA, 18 nt, Pseudomonas putida KT2440
agccagccaccaccaugc

SEQ ID NO: 3545086 - RNA, 16 nt, Pseudomonas putida KT2440
agccagccacggauca

SEQ ID NO: 3545087 - RNA, 14 nt, Pseudomonas putida KT2440
agccagcccugccg

SEQ ID NO: 3545088 - RNA, 20 nt, Pseudomonas putida KT2440
agccagccuucgccaacugc

SEQ ID NO: 3545089 - RNA, 21 nt, Pseudomonas putida KT2440
agccagccuucgccaacugca

SEQ ID NO: 3545090 - RNA, 16 nt, Pseudomonas putida KT2440
agccagcgacagcauc

SEQ ID NO: 3545091 - RNA, 22 nt, Pseudomonas putida KT2440
agccagcgugggccgugcaggc

SEQ ID NO: 3545092 - RNA, 19 nt, Pseudomonas putida KT2440
agccaggaagaucacgucg

SEQ ID NO: 3545093 - RNA, 22 nt, Pseudomonas putida KT2440
agccaggagaacacccagcgca

SEQ ID NO: 3545094 - RNA, 15 nt, Pseudomonas putida KT2440
agccaggcacagauc

SEQ ID NO: 3545095 - RNA, 13 nt, Pseudomonas putida KT2440
agccaggccgaca

SEQ ID NO: 3545096 - RNA, 22 nt, Pseudomonas putida KT2440
agccaggcguauucggccacca

SEQ ID NO: 3545097 - RNA, 17 nt, Pseudomonas putida KT2440
agccaggcugagcccgg

SEQ ID NO: 3545098 - RNA, 14 nt, Pseudomonas putida KT2440
agccagggcaagca

SEQ ID NO: 3545099 - RNA, 14 nt, Pseudomonas putida KT2440
agccagggccugua

SEQ ID NO: 3545100 - RNA, 20 nt, Pseudomonas putida KT2440
agccagguauggccagagcg

SEQ ID NO: 3545101 - RNA, 15 nt, Pseudomonas putida KT2440
agccaguacgcaggc

SEQ ID NO: 3545102 - RNA, 21 nt, Pseudomonas putida KT2440
agccaguacgcgccugcaccu

SEQ ID NO: 3545103 - RNA, 16 nt, Pseudomonas putida KT2440
agccagucgcgcaacu

SEQ ID NO: 3545104 - RNA, 24 nt, Pseudomonas putida KT2440
agccagucgcgcaacugcccagga

SEQ ID NO: 3545105 - RNA, 18 nt, Pseudomonas putida KT2440
agccagucugcuccaccg

SEQ ID NO: 3545106 - RNA, 13 nt, Pseudomonas putida KT2440
agccagugcugcc

SEQ ID NO: 3545107 - RNA, 11 nt, Pseudomonas putida KT2440
agccaguucac

SEQ ID NO: 3545108 - RNA, 15 nt, Pseudomonas putida KT2440
agccaguucgacagg

SEQ ID NO: 3545109 - RNA, 17 nt, Pseudomonas putida KT2440
agccaguucgacagguu

SEQ ID NO: 3545110 - RNA, 19 nt, Pseudomonas putida KT2440
agccauaguuuugugccac

SEQ ID NO: 3545111 - RNA, 15 nt, Pseudomonas putida KT2440
agccauaucccgcca

SEQ ID NO: 3545112 - RNA, 22 nt, Pseudomonas putida KT2440
agccauaugaaaaggcccugca

SEQ ID NO: 3545113 - RNA, 17 nt, Pseudomonas putida KT2440
agccaucaucagguacg

SEQ ID NO: 3545114 - RNA, 19 nt, Pseudomonas putida KT2440
agccauccaccagccccag

SEQ ID NO: 3545115 - RNA, 13 nt, Pseudomonas putida KT2440
agccaucgcacca

SEQ ID NO: 3545116 - RNA, 16 nt, Pseudomonas putida KT2440
agccaugaaaaagccc

SEQ ID NO: 3545117 - RNA, 17 nt, Pseudomonas putida KT2440
agccaugaaaaagcccg

SEQ ID NO: 3545118 - RNA, 17 nt, Pseudomonas putida KT2440
agccaugaucagcgccu

SEQ ID NO: 3545119 - RNA, 17 nt, Pseudomonas putida KT2440
agccaugccggcaacga

SEQ ID NO: 3545120 - RNA, 21 nt, Pseudomonas putida KT2440
agccaugccguaagccgcagg

SEQ ID NO: 3545121 - RNA, 16 nt, Pseudomonas putida KT2440
agccaugggcaggucg

SEQ ID NO: 3545122 - RNA, 19 nt, Pseudomonas putida KT2440
agccauugacccgcuugca

SEQ ID NO: 3545123 - RNA, 22 nt, Pseudomonas putida KT2440
agccauugcggcugaauccuag

SEQ ID NO: 3545124 - RNA, 18 nt, Pseudomonas putida KT2440
agccauuggcccacgcuc

SEQ ID NO: 3545125 - RNA, 15 nt, Pseudomonas putida KT2440
agcccaaacagcauc

SEQ ID NO: 3545126 - RNA, 14 nt, Pseudomonas putida KT2440
agcccaaagggcug

SEQ ID NO: 3545127 - RNA, 12 nt, Pseudomonas putida KT2440
agcccaaggcug

SEQ ID NO: 3545128 - RNA, 12 nt, Pseudomonas putida KT2440
agcccaagggcu

SEQ ID NO: 3545129 - RNA, 15 nt, Pseudomonas putida KT2440
agcccacacaccgca

SEQ ID NO: 3545130 - RNA, 14 nt, Pseudomonas putida KT2440
agcccaccgagcuu

SEQ ID NO: 3545131 - RNA, 22 nt, Pseudomonas putida KT2440
agcccaccgucaggcucagcag

SEQ ID NO: 3545132 - RNA, 15 nt, Pseudomonas putida KT2440
agcccaccuucacgc

SEQ ID NO: 3545133 - RNA, 13 nt, Pseudomonas putida KT2440
agcccagcccgga

SEQ ID NO: 3545134 - RNA, 22 nt, Pseudomonas putida KT2440
agcccagcgccaguacggccau

SEQ ID NO: 3545135 - RNA, 13 nt, Pseudomonas putida KT2440
agcccagcgccgc

SEQ ID NO: 3545136 - RNA, 22 nt, Pseudomonas putida KT2440
agcccaguaccacuuccaacac

SEQ ID NO: 3545137 - RNA, 22 nt, Pseudomonas putida KT2440
agcccaguagaucgcgccaguu

SEQ ID NO: 3545138 - RNA, 19 nt, Pseudomonas putida KT2440
agcccaguucuuggcggcu

SEQ ID NO: 3545139 - RNA, 13 nt, Pseudomonas putida KT2440
agcccaguugcug

SEQ ID NO: 3545140 - RNA, 22 nt, Pseudomonas putida KT2440
agcccaguugcuggcuggucuc

SEQ ID NO: 3545141 - RNA, 16 nt, Pseudomonas putida KT2440
agcccauaaaccccag

SEQ ID NO: 3545142 - RNA, 23 nt, Pseudomonas putida KT2440
agcccauccagggcuuccugcgg

SEQ ID NO: 3545143 - RNA, 18 nt, Pseudomonas putida KT2440
agcccaugaacagcaagu

SEQ ID NO: 3545144 - RNA, 18 nt, Pseudomonas putida KT2440
agcccauggcuggcagca

SEQ ID NO: 3545145 - RNA, 14 nt, Pseudomonas putida KT2440
agcccauuucaccu

SEQ ID NO: 3545146 - RNA, 20 nt, Pseudomonas putida KT2440
agcccauuucaccugcucug

SEQ ID NO: 3545147 - RNA, 22 nt, Pseudomonas putida KT2440
agcccauuucgugggucacgca

SEQ ID NO: 3545148 - RNA, 18 nt, Pseudomonas putida KT2440
agccccaaaaaaccgggg

SEQ ID NO: 3545149 - RNA, 19 nt, Pseudomonas putida KT2440
agccccaaaaaaucuagcg

SEQ ID NO: 3545150 - RNA, 23 nt, Pseudomonas putida KT2440
agccccaaaaaaucuagcgcaac

SEQ ID NO: 3545151 - RNA, 19 nt, Pseudomonas putida KT2440
agccccaaccuuccagcaa

SEQ ID NO: 3545152 - RNA, 21 nt, Pseudomonas putida KT2440
agccccaaccuuccagcaaag

SEQ ID NO: 3545153 - RNA, 23 nt, Pseudomonas putida KT2440
agccccaaugguuuaguccugca

SEQ ID NO: 3545154 - RNA, 19 nt, Pseudomonas putida KT2440
agccccacgcccaggcggc

SEQ ID NO: 3545155 - RNA, 20 nt, Pseudomonas putida KT2440
agccccagcccgcccacaug

SEQ ID NO: 3545156 - RNA, 17 nt, Pseudomonas putida KT2440
agccccaucaccagccc

SEQ ID NO: 3545157 - RNA, 18 nt, Pseudomonas putida KT2440
agccccaucaccagcccg

SEQ ID NO: 3545158 - RNA, 21 nt, Pseudomonas putida KT2440
agccccaucaccagcccgaag

SEQ ID NO: 3545159 - RNA, 12 nt, Pseudomonas putida KT2440
agccccaugcga

SEQ ID NO: 3545160 - RNA, 14 nt, Pseudomonas putida KT2440
agccggcuuguucu

SEQ ID NO: 3545161 - RNA, 22 nt, Pseudomonas putida KT2440
agccgggccugauuggcaucgc

SEQ ID NO: 3545162 - RNA, 14 nt, Pseudomonas putida KT2440
agccgggcugcaaa

SEQ ID NO: 3545163 - RNA, 17 nt, Pseudomonas putida KT2440
agccggucaucacgcuc

SEQ ID NO: 3545164 - RNA, 16 nt, Pseudomonas putida KT2440
agccggucauccagca

SEQ ID NO: 3545165 - RNA, 20 nt, Pseudomonas putida KT2440
agccggucauccagcagcuc

SEQ ID NO: 3545166 - RNA, 18 nt, Pseudomonas putida KT2440
agccggucguugagcacg

SEQ ID NO: 3545167 - RNA, 14 nt, Pseudomonas putida KT2440
agccggucucccag

SEQ ID NO: 3545168 - RNA, 17 nt, Pseudomonas putida KT2440
agccggucucccagcgc

SEQ ID NO: 3545169 - RNA, 21 nt, Pseudomonas putida KT2440
agccgguuggcguaaggacca

SEQ ID NO: 3545170 - RNA, 19 nt, Pseudomonas putida KT2440
agccguaggagcgggcuug

SEQ ID NO: 3545171 - RNA, 13 nt, Pseudomonas putida KT2440
agccguccaggaa

SEQ ID NO: 3545172 - RNA, 22 nt, Pseudomonas putida KT2440
agccgucgauuacccagcgcga

SEQ ID NO: 3545173 - RNA, 21 nt, Pseudomonas putida KT2440
agccgucgccgcuucggcaug

SEQ ID NO: 3545174 - RNA, 15 nt, Pseudomonas putida KT2440
agccgugcggccaaa

SEQ ID NO: 3545175 - RNA, 22 nt, Pseudomonas putida KT2440
agccgugguuucgaagucgaac

SEQ ID NO: 3545176 - RNA, 16 nt, Pseudomonas putida KT2440
agccguucccgggcag

SEQ ID NO: 3545177 - RNA, 21 nt, Pseudomonas putida KT2440
agccguucccgggcagguucg

SEQ ID NO: 3545178 - RNA, 14 nt, Pseudomonas putida KT2440
agccguugaccagg

SEQ ID NO: 3545179 - RNA, 17 nt, Pseudomonas putida KT2440
agccguuguacaagcug

SEQ ID NO: 3545180 - RNA, 20 nt, Pseudomonas putida KT2440
agccuccagagaaccgcaca

SEQ ID NO: 3545181 - RNA, 17 nt, Pseudomonas putida KT2440
agccuccggcccauccc

SEQ ID NO: 3545182 - RNA, 15 nt, Pseudomonas putida KT2440
agccucgacccgcug

SEQ ID NO: 3545183 - RNA, 21 nt, Pseudomonas putida KT2440
agccucgacccgcuggcgacc

SEQ ID NO: 3545184 - RNA, 14 nt, Pseudomonas putida KT2440
agccucggcucucc

SEQ ID NO: 3545185 - RNA, 17 nt, Pseudomonas putida KT2440
agccucguucgggcacu

SEQ ID NO: 3545186 - RNA, 18 nt, Pseudomonas putida KT2440
agccucuucggccagcaa

SEQ ID NO: 3545187 - RNA, 20 nt, Pseudomonas putida KT2440
agccucuucggccagcaacu

SEQ ID NO: 3545188 - RNA, 18 nt, Pseudomonas putida KT2440
agccugacgcgccgccaa

SEQ ID NO: 3545189 - RNA, 20 nt, Pseudomonas putida KT2440
agccugacgcgccgccaacc

SEQ ID NO: 3545190 - RNA, 18 nt, Pseudomonas putida KT2440
agccugaggcugcgccga

SEQ ID NO: 3545191 - RNA, 17 nt, Pseudomonas putida KT2440
agccugcaaggaaaacc

SEQ ID NO: 3545192 - RNA, 11 nt, Pseudomonas putida KT2440
agccugcacca

SEQ ID NO: 3545193 - RNA, 14 nt, Pseudomonas putida KT2440
agccugcacccagc

SEQ ID NO: 3545194 - RNA, 23 nt, Pseudomonas putida KT2440
agccugcacccgcgcgcccgcgg

SEQ ID NO: 3545195 - RNA, 16 nt, Pseudomonas putida KT2440
agccugcacuggccuc

SEQ ID NO: 3545196 - RNA, 19 nt, Pseudomonas putida KT2440
agccugcacuggccucuuc

SEQ ID NO: 3545197 - RNA, 17 nt, Pseudomonas putida KT2440
agccugcagggccucca

SEQ ID NO: 3545198 - RNA, 20 nt, Pseudomonas putida KT2440
agccugcgcaggcgccgcca

SEQ ID NO: 3545199 - RNA, 22 nt, Pseudomonas putida KT2440
agccugcgcaggcgccgccagc

SEQ ID NO: 3545200 - RNA, 15 nt, Pseudomonas putida KT2440
agccugcuccagcac

SEQ ID NO: 3545201 - RNA, 17 nt, Pseudomonas putida KT2440
agccugcuccagcaccc

SEQ ID NO: 3545202 - RNA, 19 nt, Pseudomonas putida KT2440
agccugcuccagcacccgc

SEQ ID NO: 3545203 - RNA, 11 nt, Pseudomonas putida KT2440
agccuggccgg

SEQ ID NO: 3545204 - RNA, 24 nt, Pseudomonas putida KT2440
agccuggccgguguggccaaggcg

SEQ ID NO: 3545205 - RNA, 15 nt, Pseudomonas putida KT2440
agccugggucacggc

SEQ ID NO: 3545206 - RNA, 18 nt, Pseudomonas putida KT2440
agccuggugaguggcccu

SEQ ID NO: 3545207 - RNA, 19 nt, Pseudomonas putida KT2440
agccuggugaguggcccug

SEQ ID NO: 3545208 - RNA, 20 nt, Pseudomonas putida KT2440
agccuguggggcaacugcgc

SEQ ID NO: 3545209 - RNA, 22 nt, Pseudomonas putida KT2440
agccuguggggcaacugcgcga

SEQ ID NO: 3545210 - RNA, 13 nt, Pseudomonas putida KT2440
agccuucagcagg

SEQ ID NO: 3545211 - RNA, 13 nt, Pseudomonas putida KT2440
agccuucagcggc

SEQ ID NO: 3545212 - RNA, 18 nt, Pseudomonas putida KT2440
agccuucaggguuguggu

SEQ ID NO: 3545213 - RNA, 12 nt, Pseudomonas putida KT2440
agccuucagugc

SEQ ID NO: 3545214 - RNA, 16 nt, Pseudomonas putida KT2440
agccuucagugcuuca

SEQ ID NO: 3545215 - RNA, 17 nt, Pseudomonas putida KT2440
agccuucccccuccuga

SEQ ID NO: 3545216 - RNA, 16 nt, Pseudomonas putida KT2440
agccuuccgggcacug

SEQ ID NO: 3545217 - RNA, 20 nt, Pseudomonas putida KT2440
agccuuccgggcacuggcug

SEQ ID NO: 3545218 - RNA, 16 nt, Pseudomonas putida KT2440
agccuucgccaacugc

SEQ ID NO: 3545219 - RNA, 14 nt, Pseudomonas putida KT2440
agccuugcugauca

SEQ ID NO: 3545220 - RNA, 13 nt, Pseudomonas putida KT2440
agccuuggccagc

SEQ ID NO: 3545221 - RNA, 14 nt, Pseudomonas putida KT2440
agccuuggccagcg

SEQ ID NO: 3545222 - RNA, 22 nt, Pseudomonas putida KT2440
agccuugucucugaacacaugc

SEQ ID NO: 3545223 - RNA, 14 nt, Pseudomonas putida KT2440
agccuugugcugca

SEQ ID NO: 3545224 - RNA, 13 nt, Pseudomonas putida KT2440
agccuugugcugu

SEQ ID NO: 3545225 - RNA, 17 nt, Pseudomonas putida KT2440
agccuuuagcgcaucuu

SEQ ID NO: 3545226 - RNA, 20 nt, Pseudomonas putida KT2440
agccuuucgagagccgggca

SEQ ID NO: 3545227 - RNA, 21 nt, Pseudomonas putida KT2440
agccuuugaaacggucagcgg

SEQ ID NO: 3545228 - RNA, 14 nt, Pseudomonas putida KT2440
agccuuugcgccuu

SEQ ID NO: 3545229 - RNA, 14 nt, Pseudomonas putida KT2440
agccuuuuccagcu

SEQ ID NO: 3545230 - RNA, 22 nt, Pseudomonas putida KT2440
agccuuuuuucgggcugcugcc

SEQ ID NO: 3545231 - RNA, 16 nt, Pseudomonas putida KT2440
agcgaaacaccagcaa

SEQ ID NO: 3545232 - RNA, 18 nt, Pseudomonas putida KT2440
agcgaaacaccagcaaca

SEQ ID NO: 3545233 - RNA, 16 nt, Pseudomonas putida KT2440
agcgaaacccggcgca

SEQ ID NO: 3545234 - RNA, 18 nt, Pseudomonas putida KT2440
agcgaaauagguaaagcc

SEQ ID NO: 3545235 - RNA, 21 nt, Pseudomonas putida KT2440
agcgaaauagguaaagccacc

SEQ ID NO: 3545236 - RNA, 21 nt, Pseudomonas putida KT2440
agcgaagccagcacgccggca

SEQ ID NO: 3545237 - RNA, 13 nt, Pseudomonas putida KT2440
agcgaagggccac

SEQ ID NO: 3545238 - RNA, 14 nt, Pseudomonas putida KT2440
agcgaauagcaaca

SEQ ID NO: 3545239 - RNA, 14 nt, Pseudomonas putida KT2440
agcgaaugcagcuc

SEQ ID NO: 3545240 - RNA, 16 nt, Pseudomonas putida KT2440
agcgacaccaaugccu

SEQ ID NO: 3545241 - RNA, 15 nt, Pseudomonas putida KT2440
agcgacaccagcgca

SEQ ID NO: 3545242 - RNA, 18 nt, Pseudomonas putida KT2440
agcgacacccuggucaug

SEQ ID NO: 3545243 - RNA, 14 nt, Pseudomonas putida KT2440
agcgacaccgccaa

SEQ ID NO: 3545244 - RNA, 13 nt, Pseudomonas putida KT2440
agcgacacugaca

SEQ ID NO: 3545245 - RNA, 15 nt, Pseudomonas putida KT2440
agcgacagcaucugc

SEQ ID NO: 3545246 - RNA, 19 nt, Pseudomonas putida KT2440
agcgacaggcuugaagcug

SEQ ID NO: 3545247 - RNA, 22 nt, Pseudomonas putida KT2440
agcgacaggcuugaagcugcgc

SEQ ID NO: 3545248 - RNA, 22 nt, Pseudomonas putida KT2440
agcgacccugagucuggcgccu

SEQ ID NO: 3545249 - RNA, 21 nt, Pseudomonas putida KT2440
agcgaccgguuuucuguugcc

SEQ ID NO: 3545250 - RNA, 15 nt, Pseudomonas putida KT2440
agcgacgcgcuaccu

SEQ ID NO: 3545251 - RNA, 15 nt, Pseudomonas putida KT2440
agcgacgcugccgca

SEQ ID NO: 3545252 - RNA, 13 nt, Pseudomonas putida KT2440
agcgacugcagga

SEQ ID NO: 3545253 - RNA, 14 nt, Pseudomonas putida KT2440
agcgacugccaaug

SEQ ID NO: 3545254 - RNA, 15 nt, Pseudomonas putida KT2440
agcgacuucgaccac

SEQ ID NO: 3545255 - RNA, 18 nt, Pseudomonas putida KT2440
agcgagagcuucagaccu

SEQ ID NO: 3545256 - RNA, 19 nt, Pseudomonas putida KT2440
agcgagcaccggcaguaca

SEQ ID NO: 3545257 - RNA, 16 nt, Pseudomonas putida KT2440
agcgagcagccuggca

SEQ ID NO: 3545258 - RNA, 17 nt, Pseudomonas putida KT2440
agcgagcagccuggcau

SEQ ID NO: 3545259 - RNA, 17 nt, Pseudomonas putida KT2440
agcgagcccgcgcgcga

SEQ ID NO: 3545260 - RNA, 22 nt, Pseudomonas putida KT2440
agcgagcccgcgcgcgaugcgc

SEQ ID NO: 3545261 - RNA, 23 nt, Pseudomonas putida KT2440
agcgagcgguugcacggcccccg

SEQ ID NO: 3545262 - RNA, 12 nt, Pseudomonas putida KT2440
agcgagcuugcu

SEQ ID NO: 3545263 - RNA, 19 nt, Pseudomonas putida KT2440
agcgagcuugcucgcgaug

SEQ ID NO: 3545264 - RNA, 20 nt, Pseudomonas putida KT2440
agcgagcuugcucgcgaugc

SEQ ID NO: 3545265 - RNA, 18 nt, Pseudomonas putida KT2440
agcgaggguuccaggcca

SEQ ID NO: 3545266 - RNA, 15 nt, Pseudomonas putida KT2440
agcgcgcaucagccg

SEQ ID NO: 3545267 - RNA, 19 nt, Pseudomonas putida KT2440
agcgcgcaucagccgcgcc

SEQ ID NO: 3545268 - RNA, 18 nt, Pseudomonas putida KT2440
agcgcgcccccgaccacc

SEQ ID NO: 3545269 - RNA, 21 nt, Pseudomonas putida KT2440
agcgcgccgccgauagcagca

SEQ ID NO: 3545270 - RNA, 12 nt, Pseudomonas putida KT2440
agcgcgccggcg

SEQ ID NO: 3545271 - RNA, 16 nt, Pseudomonas putida KT2440
agcgcgccggcgucga

SEQ ID NO: 3545272 - RNA, 15 nt, Pseudomonas putida KT2440
agcgcgccuccagcu

SEQ ID NO: 3545273 - RNA, 16 nt, Pseudomonas putida KT2440
agcgcgccuccagcug

SEQ ID NO: 3545274 - RNA, 17 nt, Pseudomonas putida KT2440
agcgcgcgaaucaccac

SEQ ID NO: 3545275 - RNA, 17 nt, Pseudomonas putida KT2440
agcgcgcugagcagguu

SEQ ID NO: 3545276 - RNA, 14 nt, Pseudomonas putida KT2440
agcgcggaacacac

SEQ ID NO: 3545277 - RNA, 19 nt, Pseudomonas putida KT2440
agcgcggcaaagguggcac

SEQ ID NO: 3545278 - RNA, 13 nt, Pseudomonas putida KT2440
agcgcggcaaccu

SEQ ID NO: 3545279 - RNA, 16 nt, Pseudomonas putida KT2440
agcgcggcaaccugcu

SEQ ID NO: 3545280 - RNA, 20 nt, Pseudomonas putida KT2440
agcgcggcaaccugcucgcu

SEQ ID NO: 3545281 - RNA, 16 nt, Pseudomonas putida KT2440
agcgcggccacgcccu

SEQ ID NO: 3545282 - RNA, 16 nt, Pseudomonas putida KT2440
agcgcggcgcccagca

SEQ ID NO: 3545283 - RNA, 16 nt, Pseudomonas putida KT2440
agcgcgggucuuccac

SEQ ID NO: 3545284 - RNA, 16 nt, Pseudomonas putida KT2440
agcgcggugaccagcg

SEQ ID NO: 3545285 - RNA, 23 nt, Pseudomonas putida KT2440
agcgcguacagcgacaugccggc

SEQ ID NO: 3545286 - RNA, 18 nt, Pseudomonas putida KT2440
agcgcgucauccgccaac

SEQ ID NO: 3545287 - RNA, 15 nt, Pseudomonas putida KT2440
agcgcguccagcaac

SEQ ID NO: 3545288 - RNA, 18 nt, Pseudomonas putida KT2440
agcgcguccagcaacagc

SEQ ID NO: 3545289 - RNA, 21 nt, Pseudomonas putida KT2440
agcgcguccagcaacagcugc

SEQ ID NO: 3545290 - RNA, 22 nt, Pseudomonas putida KT2440
agcgcguuaggcgagaucgaca

SEQ ID NO: 3545291 - RNA, 15 nt, Pseudomonas putida KT2440
agcgcucccaggccu

SEQ ID NO: 3545292 - RNA, 14 nt, Pseudomonas putida KT2440
agcgcuccgccaaa

SEQ ID NO: 3545293 - RNA, 20 nt, Pseudomonas putida KT2440
agcgcuccgccaaaccccag

SEQ ID NO: 3545294 - RNA, 23 nt, Pseudomonas putida KT2440
agcgcuccgccaauugcgccagc

SEQ ID NO: 3545295 - RNA, 23 nt, Pseudomonas putida KT2440
agcgcucgagaaaugccucggca

SEQ ID NO: 3545296 - RNA, 13 nt, Pseudomonas putida KT2440
agcgcucgaugcg

SEQ ID NO: 3545297 - RNA, 19 nt, Pseudomonas putida KT2440
agcgcugacucagcggccu

SEQ ID NO: 3545298 - RNA, 20 nt, Pseudomonas putida KT2440
agcgcugacucagcggccuu

SEQ ID NO: 3545299 - RNA, 19 nt, Pseudomonas putida KT2440
agcgcugcaagcgcaccug

SEQ ID NO: 3545300 - RNA, 12 nt, Pseudomonas putida KT2440
agcgcugcaccg

SEQ ID NO: 3545301 - RNA, 17 nt, Pseudomonas putida KT2440
agcgcugcgaggcccca

SEQ ID NO: 3545302 - RNA, 21 nt, Pseudomonas putida KT2440
agcgcuggcuuuggagccugc

SEQ ID NO: 3545303 - RNA, 20 nt, Pseudomonas putida KT2440
agcgcugucccccagcccug

SEQ ID NO: 3545304 - RNA, 17 nt, Pseudomonas putida KT2440
agcgcuuaaaucaagag

SEQ ID NO: 3545305 - RNA, 15 nt, Pseudomonas putida KT2440
agcgcuucagcucgc

SEQ ID NO: 3545306 - RNA, 17 nt, Pseudomonas putida KT2440
agcgcuucagcucgcac

SEQ ID NO: 3545307 - RNA, 16 nt, Pseudomonas putida KT2440
agcgcuucgaucagcg

SEQ ID NO: 3545308 - RNA, 19 nt, Pseudomonas putida KT2440
agcgcuucgugcagguugc

SEQ ID NO: 3545309 - RNA, 20 nt, Pseudomonas putida KT2440
agcgcuugagaccaggccug

SEQ ID NO: 3545310 - RNA, 17 nt, Pseudomonas putida KT2440
agcgcuuggucccccac

SEQ ID NO: 3545311 - RNA, 23 nt, Pseudomonas putida KT2440
agcggaaguucacacucagccgc

SEQ ID NO: 3545312 - RNA, 16 nt, Pseudomonas putida KT2440
agcggaccaggugcag

SEQ ID NO: 3545313 - RNA, 14 nt, Pseudomonas putida KT2440
agcggaucaccgac

SEQ ID NO: 3545314 - RNA, 22 nt, Pseudomonas putida KT2440
agcggaucaccgacgugcagga

SEQ ID NO: 3545315 - RNA, 13 nt, Pseudomonas putida KT2440
agcggaucggccg

SEQ ID NO: 3545316 - RNA, 16 nt, Pseudomonas putida KT2440
agcggcaacaccagca

SEQ ID NO: 3545317 - RNA, 20 nt, Pseudomonas putida KT2440
agcggcaaggucaacggcaa

SEQ ID NO: 3545318 - RNA, 18 nt, Pseudomonas putida KT2440
agcggcagacacaggcgc

SEQ ID NO: 3545319 - RNA, 13 nt, Pseudomonas putida KT2440
agcggcagcaaca

SEQ ID NO: 3545320 - RNA, 15 nt, Pseudomonas putida KT2440
agcggcagcaacggu

SEQ ID NO: 3545321 - RNA, 13 nt, Pseudomonas putida KT2440
agcggcagcaagu

SEQ ID NO: 3545322 - RNA, 18 nt, Pseudomonas putida KT2440
agcggcagcaucgaccug

SEQ ID NO: 3545323 - RNA, 13 nt, Pseudomonas putida KT2440
agcggcagcgacg

SEQ ID NO: 3545324 - RNA, 14 nt, Pseudomonas putida KT2440
agcggcaggcuggc

SEQ ID NO: 3545325 - RNA, 16 nt, Pseudomonas putida KT2440
agcggcaggcuggcgu

SEQ ID NO: 3545326 - RNA, 19 nt, Pseudomonas putida KT2440
agcggcaggcuggcguggu

SEQ ID NO: 3545327 - RNA, 20 nt, Pseudomonas putida KT2440
agcggcaguugcaggcgcag

SEQ ID NO: 3545328 - RNA, 23 nt, Pseudomonas putida KT2440
agcggcaguugcaggcgcagggu

SEQ ID NO: 3545329 - RNA, 19 nt, Pseudomonas putida KT2440
agcggcaguugccugccuu

SEQ ID NO: 3545330 - RNA, 23 nt, Pseudomonas putida KT2440
agcggccaacgcugcucggccuc

SEQ ID NO: 3545331 - RNA, 19 nt, Pseudomonas putida KT2440
agcggccaaugaucgagcg

SEQ ID NO: 3545332 - RNA, 10 nt, Pseudomonas putida KT2440
agcggccaca

SEQ ID NO: 3545333 - RNA, 13 nt, Pseudomonas putida KT2440
agcggccaccugc

SEQ ID NO: 3545334 - RNA, 16 nt, Pseudomonas putida KT2440
agcggccagcccgcca

SEQ ID NO: 3545335 - RNA, 14 nt, Pseudomonas putida KT2440
agcggccagcgccu

SEQ ID NO: 3545336 - RNA, 22 nt, Pseudomonas putida KT2440
agcggccagcgccuggcgcagu

SEQ ID NO: 3545337 - RNA, 18 nt, Pseudomonas putida KT2440
agcggccaguaaggaucg

SEQ ID NO: 3545338 - RNA, 23 nt, Pseudomonas putida KT2440
agcggccaucgcagaaggccccg

SEQ ID NO: 3545339 - RNA, 23 nt, Pseudomonas putida KT2440
agcggccccaaugaaucagagcg

SEQ ID NO: 3545340 - RNA, 13 nt, Pseudomonas putida KT2440
agcggccccuucg

SEQ ID NO: 3545341 - RNA, 22 nt, Pseudomonas putida KT2440
agcggccgaaggggcgggugga

SEQ ID NO: 3545342 - RNA, 22 nt, Pseudomonas putida KT2440
agcggccgaggccgauuuggcc

SEQ ID NO: 3545343 - RNA, 23 nt, Pseudomonas putida KT2440
agcggccgcuugaucuuguccug

SEQ ID NO: 3545344 - RNA, 21 nt, Pseudomonas putida KT2440
agcggccggcacaggcccaaa

SEQ ID NO: 3545345 - RNA, 13 nt, Pseudomonas putida KT2440
agcggccggcccc

SEQ ID NO: 3545346 - RNA, 19 nt, Pseudomonas putida KT2440
agcggccugagaccaguuc

SEQ ID NO: 3545347 - RNA, 20 nt, Pseudomonas putida KT2440
agcggccuucagggccgguu

SEQ ID NO: 3545348 - RNA, 21 nt, Pseudomonas putida KT2440
agcggccuugcgucgcgaaag

SEQ ID NO: 3545349 - RNA, 17 nt, Pseudomonas putida KT2440
agcggccuugucgcgaa

SEQ ID NO: 3545350 - RNA, 22 nt, Pseudomonas putida KT2440
agcggccuugugucucgauggg

SEQ ID NO: 3545351 - RNA, 20 nt, Pseudomonas putida KT2440
agcggccuuguguugcgaug

SEQ ID NO: 3545352 - RNA, 12 nt, Pseudomonas putida KT2440
agcggccuuuga

SEQ ID NO: 3545353 - RNA, 19 nt, Pseudomonas putida KT2440
agcggcgaaggauggaccg

SEQ ID NO: 3545354 - RNA, 17 nt, Pseudomonas putida KT2440
agcggcgcagcgcugag

SEQ ID NO: 3545355 - RNA, 16 nt, Pseudomonas putida KT2440
agcggcgccacccaga

SEQ ID NO: 3545356 - RNA, 13 nt, Pseudomonas putida KT2440
agcggcgcgauca

SEQ ID NO: 3545357 - RNA, 13 nt, Pseudomonas putida KT2440
agcggcgcggccu

SEQ ID NO: 3545358 - RNA, 17 nt, Pseudomonas putida KT2440
agcggcgucaccuuccu

SEQ ID NO: 3545359 - RNA, 16 nt, Pseudomonas putida KT2440
agcggcguuguagccg

SEQ ID NO: 3545360 - RNA, 18 nt, Pseudomonas putida KT2440
agcggcguuguagccgaa

SEQ ID NO: 3545361 - RNA, 20 nt, Pseudomonas putida KT2440
agcggcuaccgcugcgcacc

SEQ ID NO: 3545362 - RNA, 12 nt, Pseudomonas putida KT2440
agcggcucgauu

SEQ ID NO: 3545363 - RNA, 12 nt, Pseudomonas putida KT2440
agcggcucucga

SEQ ID NO: 3545364 - RNA, 17 nt, Pseudomonas putida KT2440
agcggcuucuaccgcac

SEQ ID NO: 3545365 - RNA, 13 nt, Pseudomonas putida KT2440
agcggcuuggccg

SEQ ID NO: 3545366 - RNA, 14 nt, Pseudomonas putida KT2440
agcggcuuggccgc

SEQ ID NO: 3545367 - RNA, 21 nt, Pseudomonas putida KT2440
agcgggagucgaaccugcccg

SEQ ID NO: 3545368 - RNA, 14 nt, Pseudomonas putida KT2440
agcgggcacaggcc

SEQ ID NO: 3545369 - RNA, 17 nt, Pseudomonas putida KT2440
agcgggcacaggccgcg

SEQ ID NO: 3545370 - RNA, 16 nt, Pseudomonas putida KT2440
agcgggcccagcaggu

SEQ ID NO: 3545371 - RNA, 12 nt, Pseudomonas putida KT2440
agcucagguagc

SEQ ID NO: 3545372 - RNA, 19 nt, Pseudomonas putida KT2440
agcucagucgguagagcaa

SEQ ID NO: 3545373 - RNA, 14 nt, Pseudomonas putida KT2440
agcucauacgggug

SEQ ID NO: 3545374 - RNA, 16 nt, Pseudomonas putida KT2440
agcucauaucgcucgg

SEQ ID NO: 3545375 - RNA, 16 nt, Pseudomonas putida KT2440
agcucauccaggcugc

SEQ ID NO: 3545376 - RNA, 17 nt, Pseudomonas putida KT2440
agcucauccaggcugca

SEQ ID NO: 3545377 - RNA, 18 nt, Pseudomonas putida KT2440
agcucauccaggcugcac

SEQ ID NO: 3545378 - RNA, 14 nt, Pseudomonas putida KT2440
agcucauccaucac

SEQ ID NO: 3545379 - RNA, 16 nt, Pseudomonas putida KT2440
agcucaugggcuucga

SEQ ID NO: 3545380 - RNA, 16 nt, Pseudomonas putida KT2440
agcucauggucagccg

SEQ ID NO: 3545381 - RNA, 16 nt, Pseudomonas putida KT2440
agcuccaccaaauucc

SEQ ID NO: 3545382 - RNA, 20 nt, Pseudomonas putida KT2440
agcuccaccaaauuccgcuu

SEQ ID NO: 3545383 - RNA, 13 nt, Pseudomonas putida KT2440
agcuccaccagcg

SEQ ID NO: 3545384 - RNA, 10 nt, Pseudomonas putida KT2440
agcuccagca

SEQ ID NO: 3545385 - RNA, 12 nt, Pseudomonas putida KT2440
agcuccagcacc

SEQ ID NO: 3545386 - RNA, 14 nt, Pseudomonas putida KT2440
agcuccagcaccuc

SEQ ID NO: 3545387 - RNA, 14 nt, Pseudomonas putida KT2440
agcuccagcagugc

SEQ ID NO: 3545388 - RNA, 18 nt, Pseudomonas putida KT2440
agcuccagcccagcgcca

SEQ ID NO: 3545389 - RNA, 20 nt, Pseudomonas putida KT2440
agcuccagcguuugcacgga

SEQ ID NO: 3545390 - RNA, 11 nt, Pseudomonas putida KT2440
agcuccaggcg

SEQ ID NO: 3545391 - RNA, 13 nt, Pseudomonas putida KT2440
agcuccccagcaa

SEQ ID NO: 3545392 - RNA, 15 nt, Pseudomonas putida KT2440
agcuccccagcaacg

SEQ ID NO: 3545393 - RNA, 22 nt, Pseudomonas putida KT2440
agcucccucgguuucucacccc

SEQ ID NO: 3545394 - RNA, 22 nt, Pseudomonas putida KT2440
agcuccugauccaccucucagc

SEQ ID NO: 3545395 - RNA, 13 nt, Pseudomonas putida KT2440
agcuccuggcccg

SEQ ID NO: 3545396 - RNA, 14 nt, Pseudomonas putida KT2440
agcuccuggcccgc

SEQ ID NO: 3545397 - RNA, 20 nt, Pseudomonas putida KT2440
agcuccuggcccgcgcccuu

SEQ ID NO: 3545398 - RNA, 14 nt, Pseudomonas putida KT2440
agcuccuggcucag

SEQ ID NO: 3545399 - RNA, 22 nt, Pseudomonas putida KT2440
agcucgaaaccacagugggugg

SEQ ID NO: 3545400 - RNA, 16 nt, Pseudomonas putida KT2440
agcucgaagcgcucau

SEQ ID NO: 3545401 - RNA, 19 nt, Pseudomonas putida KT2440
agcucgaagcgcucaugca

SEQ ID NO: 3545402 - RNA, 15 nt, Pseudomonas putida KT2440
agcucgacaaacugc

SEQ ID NO: 3545403 - RNA, 20 nt, Pseudomonas putida KT2440
agcucgacaaaucccgcaca

SEQ ID NO: 3545404 - RNA, 20 nt, Pseudomonas putida KT2440
agcucgacaacccgcgcugc

SEQ ID NO: 3545405 - RNA, 18 nt, Pseudomonas putida KT2440
agcucgacccgcgucagc

SEQ ID NO: 3545406 - RNA, 13 nt, Pseudomonas putida KT2440
agcucgagcaugc

SEQ ID NO: 3545407 - RNA, 15 nt, Pseudomonas putida KT2440
agcucgaucugccug

SEQ ID NO: 3545408 - RNA, 18 nt, Pseudomonas putida KT2440
agcucgaucugccugccu

SEQ ID NO: 3545409 - RNA, 16 nt, Pseudomonas putida KT2440
agcucgauggccagga

SEQ ID NO: 3545410 - RNA, 15 nt, Pseudomonas putida KT2440
agcucgcacgcaugu

SEQ ID NO: 3545411 - RNA, 21 nt, Pseudomonas putida KT2440
agcucgccaaacaggaucucc

SEQ ID NO: 3545412 - RNA, 19 nt, Pseudomonas putida KT2440
agcucgccauucucgauca

SEQ ID NO: 3545413 - RNA, 13 nt, Pseudomonas putida KT2440
agcucgcccggca

SEQ ID NO: 3545414 - RNA, 16 nt, Pseudomonas putida KT2440
agcucgccguggggga

SEQ ID NO: 3545415 - RNA, 16 nt, Pseudomonas putida KT2440
agcucgcgcagggcau

SEQ ID NO: 3545416 - RNA, 12 nt, Pseudomonas putida KT2440
agcucgcgcugc

SEQ ID NO: 3545417 - RNA, 14 nt, Pseudomonas putida KT2440
agcucgcgcugcca

SEQ ID NO: 3545418 - RNA, 15 nt, Pseudomonas putida KT2440
agcucgcgcugccag

SEQ ID NO: 3545419 - RNA, 17 nt, Pseudomonas putida KT2440
agcucgcgcugccaggc

SEQ ID NO: 3545420 - RNA, 12 nt, Pseudomonas putida KT2440
agcucgcuggcc

SEQ ID NO: 3545421 - RNA, 21 nt, Pseudomonas putida KT2440
agcucgcuggccaccagcaug

SEQ ID NO: 3545422 - RNA, 23 nt, Pseudomonas putida KT2440
agcucgcuggccaccagcauggc

SEQ ID NO: 3545423 - RNA, 23 nt, Pseudomonas putida KT2440
agcucggcauguucaucaccggc

SEQ ID NO: 3545424 - RNA, 17 nt, Pseudomonas putida KT2440
agcucggccacccgcgu

SEQ ID NO: 3545425 - RNA, 18 nt, Pseudomonas putida KT2440
agcucggccgaugccagg

SEQ ID NO: 3545426 - RNA, 16 nt, Pseudomonas putida KT2440
agcucggcuggcuguc

SEQ ID NO: 3545427 - RNA, 23 nt, Pseudomonas putida KT2440
agcucggcuggcugucgaaggcu

SEQ ID NO: 3545428 - RNA, 15 nt, Pseudomonas putida KT2440
agcucgguauccccg

SEQ ID NO: 3545429 - RNA, 23 nt, Pseudomonas putida KT2440
agcucggugaacagguugcgcgc

SEQ ID NO: 3545430 - RNA, 17 nt, Pseudomonas putida KT2440
agcucguccugcagggc

SEQ ID NO: 3545431 - RNA, 14 nt, Pseudomonas putida KT2440
agcucguucaacac

SEQ ID NO: 3545432 - RNA, 21 nt, Pseudomonas putida KT2440
agcucguugaacacauccuca

SEQ ID NO: 3545433 - RNA, 13 nt, Pseudomonas putida KT2440
agcucuccagcag

SEQ ID NO: 3545434 - RNA, 18 nt, Pseudomonas putida KT2440
agcucugaucaauucagc

SEQ ID NO: 3545435 - RNA, 19 nt, Pseudomonas putida KT2440
agcucugcgacugaauaca

SEQ ID NO: 3545436 - RNA, 16 nt, Pseudomonas putida KT2440
agcucuggagguagcc

SEQ ID NO: 3545437 - RNA, 13 nt, Pseudomonas putida KT2440
agcucuggucacc

SEQ ID NO: 3545438 - RNA, 14 nt, Pseudomonas putida KT2440
agcucuggucaccu

SEQ ID NO: 3545439 - RNA, 22 nt, Pseudomonas putida KT2440
agcucuggucgaucuucagcgc

SEQ ID NO: 3545440 - RNA, 17 nt, Pseudomonas putida KT2440
agcucuugcggaucacu

SEQ ID NO: 3545441 - RNA, 21 nt, Pseudomonas putida KT2440
agcucuugcggaucacuucca

SEQ ID NO: 3545442 - RNA, 16 nt, Pseudomonas putida KT2440
agcucuugcuuguuau

SEQ ID NO: 3545443 - RNA, 15 nt, Pseudomonas putida KT2440
agcugaagugccaag

SEQ ID NO: 3545444 - RNA, 13 nt, Pseudomonas putida KT2440
agcugaccuugga

SEQ ID NO: 3545445 - RNA, 14 nt, Pseudomonas putida KT2440
agcugaccuuggac

SEQ ID NO: 3545446 - RNA, 23 nt, Pseudomonas putida KT2440
agcugacugucucgcccaugggc

SEQ ID NO: 3545447 - RNA, 17 nt, Pseudomonas putida KT2440
agcugagaaugcccucc

SEQ ID NO: 3545448 - RNA, 17 nt, Pseudomonas putida KT2440
agcugauccgccuggcc

SEQ ID NO: 3545449 - RNA, 23 nt, Pseudomonas putida KT2440
agcugcaacagaaaaugcccgcu

SEQ ID NO: 3545450 - RNA, 17 nt, Pseudomonas putida KT2440
agcugcaacagcggcga

SEQ ID NO: 3545451 - RNA, 16 nt, Pseudomonas putida KT2440
agcugcacaucuccac

SEQ ID NO: 3545452 - RNA, 19 nt, Pseudomonas putida KT2440
agcugcacaucuccacugc

SEQ ID NO: 3545453 - RNA, 14 nt, Pseudomonas putida KT2440
agcugcaccaccug

SEQ ID NO: 3545454 - RNA, 15 nt, Pseudomonas putida KT2440
agcugcaccaccugc

SEQ ID NO: 3545455 - RNA, 20 nt, Pseudomonas putida KT2440
agcugcaccaccugcuccug

SEQ ID NO: 3545456 - RNA, 17 nt, Pseudomonas putida KT2440
agcugcaccgccacccc

SEQ ID NO: 3545457 - RNA, 15 nt, Pseudomonas putida KT2440
agcugcagcagcuuc

SEQ ID NO: 3545458 - RNA, 11 nt, Pseudomonas putida KT2440
agcugcagcuu

SEQ ID NO: 3545459 - RNA, 15 nt, Pseudomonas putida KT2440
agcugcagugcuggg

SEQ ID NO: 3545460 - RNA, 22 nt, Pseudomonas putida KT2440
agcugcaucagguagcugggcc

SEQ ID NO: 3545461 - RNA, 19 nt, Pseudomonas putida KT2440
agcugcauuggcggcaggc

SEQ ID NO: 3545462 - RNA, 20 nt, Pseudomonas putida KT2440
agcugcauuggcggcaggcg

SEQ ID NO: 3545463 - RNA, 20 nt, Pseudomonas putida KT2440
agcugccacugcgcgcaaag

SEQ ID NO: 3545464 - RNA, 17 nt, Pseudomonas putida KT2440
agcugccauacagccag

SEQ ID NO: 3545465 - RNA, 22 nt, Pseudomonas putida KT2440
agcugccauuucuucagcagga

SEQ ID NO: 3545466 - RNA, 12 nt, Pseudomonas putida KT2440
agcugcccacca

SEQ ID NO: 3545467 - RNA, 13 nt, Pseudomonas putida KT2440
agcugcccaccaa

SEQ ID NO: 3545468 - RNA, 14 nt, Pseudomonas putida KT2440
agcugccggccagc

SEQ ID NO: 3545469 - RNA, 18 nt, Pseudomonas putida KT2440
agcugccggccagcgccu

SEQ ID NO: 3545470 - RNA, 16 nt, Pseudomonas putida KT2440
agcugcgcacgcagga

SEQ ID NO: 3545471 - RNA, 13 nt, Pseudomonas putida KT2440
agcugcgccugca

SEQ ID NO: 3545472 - RNA, 15 nt, Pseudomonas putida KT2440
agcugcggcuggguc

SEQ ID NO: 3545473 - RNA, 18 nt, Pseudomonas putida KT2440
agcugcugaccucgaccc

SEQ ID NO: 3545474 - RNA, 16 nt, Pseudomonas putida KT2440
agcugcugcggcaccu

SEQ ID NO: 3545475 - RNA, 22 nt, Pseudomonas putida KT2440
agcugcuggcgucauccugcgc

SEQ ID NO: 3545476 - RNA, 22 nt, Pseudomonas putida KT2440
agcugcuuaccagcuuggcgcc

SEQ ID NO: 3545477 - RNA, 13 nt, Pseudomonas putida KT2440
aggacaucaccag

SEQ ID NO: 3545478 - RNA, 14 nt, Pseudomonas putida KT2440
aggacaucaccagg

SEQ ID NO: 3545479 - RNA, 14 nt, Pseudomonas putida KT2440
aggaccaggccgau

SEQ ID NO: 3545480 - RNA, 21 nt, Pseudomonas putida KT2440
aggacggucaugcucagcugg

SEQ ID NO: 3545481 - RNA, 22 nt, Pseudomonas putida KT2440
aggacuacaucuucgcgcucga

SEQ ID NO: 3545482 - RNA, 18 nt, Pseudomonas putida KT2440
aggacucggcguagcagg

SEQ ID NO: 3545483 - RNA, 16 nt, Pseudomonas putida KT2440
aggacugcuucaggcc

SEQ ID NO: 3545484 - RNA, 14 nt, Pseudomonas putida KT2440
aggagaacacccag

SEQ ID NO: 3545485 - RNA, 19 nt, Pseudomonas putida KT2440
aggagaacacccagcgcau

SEQ ID NO: 3545486 - RNA, 22 nt, Pseudomonas putida KT2440
aggagcggccuucagggccggu

SEQ ID NO: 3545487 - RNA, 19 nt, Pseudomonas putida KT2440
aggagcgggcuuacccgcg

SEQ ID NO: 3545488 - RNA, 20 nt, Pseudomonas putida KT2440
aggagcgggcuuacccgcga

SEQ ID NO: 3545489 - RNA, 20 nt, Pseudomonas putida KT2440
aggagcgggcuugcccgcga

SEQ ID NO: 3545490 - RNA, 21 nt, Pseudomonas putida KT2440
aggagcgggcuugcccgcgaa

SEQ ID NO: 3545491 - RNA, 19 nt, Pseudomonas putida KT2440
aggagcgggucuacccgcg

SEQ ID NO: 3545492 - RNA, 20 nt, Pseudomonas putida KT2440
aggagcgggucuacccgcga

SEQ ID NO: 3545493 - RNA, 19 nt, Pseudomonas putida KT2440
aggagcggguucacccgcg

SEQ ID NO: 3545494 - RNA, 21 nt, Pseudomonas putida KT2440
aggagcggguucacccgcgaa

SEQ ID NO: 3545495 - RNA, 19 nt, Pseudomonas putida KT2440
aggagcggguuuacccgcg

SEQ ID NO: 3545496 - RNA, 20 nt, Pseudomonas putida KT2440
aggagcggguuuacccgcga

SEQ ID NO: 3545497 - RNA, 21 nt, Pseudomonas putida KT2440
aggagcggguuuacccgcgaa

SEQ ID NO: 3545498 - RNA, 13 nt, Pseudomonas putida KT2440
aggaggcugggga

SEQ ID NO: 3545499 - RNA, 13 nt, Pseudomonas putida KT2440
aggaguccagcug

SEQ ID NO: 3545500 - RNA, 18 nt, Pseudomonas putida KT2440
aggaguccagcugcauca

SEQ ID NO: 3545501 - RNA, 18 nt, Pseudomonas putida KT2440
aggaguucugcacagcgc

SEQ ID NO: 3545502 - RNA, 22 nt, Pseudomonas putida KT2440
aggauaagcaugggucagacuu

SEQ ID NO: 3545503 - RNA, 17 nt, Pseudomonas putida KT2440
aggauaccgcguuguag

SEQ ID NO: 3545504 - RNA, 19 nt, Pseudomonas putida KT2440
aggauacgacgcaucaggg

SEQ ID NO: 3545505 - RNA, 20 nt, Pseudomonas putida KT2440
aggaucaccaaggcuugagu

SEQ ID NO: 3545506 - RNA, 15 nt, Pseudomonas putida KT2440
aggaucacuggccug

SEQ ID NO: 3545507 - RNA, 14 nt, Pseudomonas putida KT2440
aggaucagcggcuu

SEQ ID NO: 3545508 - RNA, 17 nt, Pseudomonas putida KT2440
aggaucaugugcgccac

SEQ ID NO: 3545509 - RNA, 17 nt, Pseudomonas putida KT2440
aggaucggguuuacccg

SEQ ID NO: 3545510 - RNA, 19 nt, Pseudomonas putida KT2440
aggaucggguuuacccgcg

SEQ ID NO: 3545511 - RNA, 20 nt, Pseudomonas putida KT2440
aggaucggguuuacccgcga

SEQ ID NO: 3545512 - RNA, 22 nt, Pseudomonas putida KT2440
aggaucggguuuacccgcgaag

SEQ ID NO: 3545513 - RNA, 17 nt, Pseudomonas putida KT2440
aggaucuccucggccag

SEQ ID NO: 3545514 - RNA, 13 nt, Pseudomonas putida KT2440
aggaugccaagga

SEQ ID NO: 3545515 - RNA, 22 nt, Pseudomonas putida KT2440
aggaugcugaagcucuccagca

SEQ ID NO: 3545516 - RNA, 17 nt, Pseudomonas putida KT2440
aggauggugacugccag

SEQ ID NO: 3545517 - RNA, 19 nt, Pseudomonas putida KT2440
aggauuuucagcgcgaaac

SEQ ID NO: 3545518 - RNA, 19 nt, Pseudomonas putida KT2440
aggcaaacgcggucagcga

SEQ ID NO: 3545519 - RNA, 18 nt, Pseudomonas putida KT2440
aggcaaagaaacaccagg

SEQ ID NO: 3545520 - RNA, 16 nt, Pseudomonas putida KT2440
aggcaaagaagucgcc

SEQ ID NO: 3545521 - RNA, 19 nt, Pseudomonas putida KT2440
aggcaaagaagucgccaca

SEQ ID NO: 3545522 - RNA, 18 nt, Pseudomonas putida KT2440
aggcaaccgcauccccug

SEQ ID NO: 3545523 - RNA, 21 nt, Pseudomonas putida KT2440
aggcaauaccgauggccccgc

SEQ ID NO: 3545524 - RNA, 12 nt, Pseudomonas putida KT2440
aggcaaucacug

SEQ ID NO: 3545525 - RNA, 18 nt, Pseudomonas putida KT2440
aggcaaucagggcauccg

SEQ ID NO: 3545526 - RNA, 13 nt, Pseudomonas putida KT2440
aggcaaucgugau

SEQ ID NO: 3545527 - RNA, 18 nt, Pseudomonas putida KT2440
aggcaaugcccauggcca

SEQ ID NO: 3545528 - RNA, 21 nt, Pseudomonas putida KT2440
aggcaaugcccauggccaggc

SEQ ID NO: 3545529 - RNA, 21 nt, Pseudomonas putida KT2440
aggcaauugugccgcgccagc

SEQ ID NO: 3545530 - RNA, 22 nt, Pseudomonas putida KT2440
aggcacacaaacaccggccccc

SEQ ID NO: 3545531 - RNA, 16 nt, Pseudomonas putida KT2440
aggcacaggccagcca

SEQ ID NO: 3545532 - RNA, 18 nt, Pseudomonas putida KT2440
aggcacaggccagccagg

SEQ ID NO: 3545533 - RNA, 15 nt, Pseudomonas putida KT2440
aggcacaggcccagc

SEQ ID NO: 3545534 - RNA, 16 nt, Pseudomonas putida KT2440
aggcacaggcccagca

SEQ ID NO: 3545535 - RNA, 21 nt, Pseudomonas putida KT2440
aggcaccaacugcacccgcca

SEQ ID NO: 3545536 - RNA, 16 nt, Pseudomonas putida KT2440
aggcaccacggaaggc

SEQ ID NO: 3545537 - RNA, 13 nt, Pseudomonas putida KT2440
aggcacccagcca

SEQ ID NO: 3545538 - RNA, 21 nt, Pseudomonas putida KT2440
aggcacccagccagcgauuca

SEQ ID NO: 3545539 - RNA, 15 nt, Pseudomonas putida KT2440
aggcacgaugaccgu

SEQ ID NO: 3545540 - RNA, 18 nt, Pseudomonas putida KT2440
aggcacgcccgcucccac

SEQ ID NO: 3545541 - RNA, 16 nt, Pseudomonas putida KT2440
aggcacggcaccagca

SEQ ID NO: 3545542 - RNA, 17 nt, Pseudomonas putida KT2440
aggcacggcaccagcac

SEQ ID NO: 3545543 - RNA, 14 nt, Pseudomonas putida KT2440
aggcacgugauacc

SEQ ID NO: 3545544 - RNA, 23 nt, Pseudomonas putida KT2440
aggcacgugauaccugggcugga

SEQ ID NO: 3545545 - RNA, 20 nt, Pseudomonas putida KT2440
aggcacucggucggcuggca

SEQ ID NO: 3545546 - RNA, 13 nt, Pseudomonas putida KT2440
aggcacuggccag

SEQ ID NO: 3545547 - RNA, 19 nt, Pseudomonas putida KT2440
aggcacuugggaucgaugc

SEQ ID NO: 3545548 - RNA, 17 nt, Pseudomonas putida KT2440
aggcagaccacgcgcuc

SEQ ID NO: 3545549 - RNA, 11 nt, Pseudomonas putida KT2440
aggcagcagac

SEQ ID NO: 3545550 - RNA, 14 nt, Pseudomonas putida KT2440
aggcagcagcucuu

SEQ ID NO: 3545551 - RNA, 16 nt, Pseudomonas putida KT2440
aggcagccccugcaca

SEQ ID NO: 3545552 - RNA, 11 nt, Pseudomonas putida KT2440
aggcagccucg

SEQ ID NO: 3545553 - RNA, 14 nt, Pseudomonas putida KT2440
aggcagccugccag

SEQ ID NO: 3545554 - RNA, 13 nt, Pseudomonas putida KT2440
aggcagcugccuu

SEQ ID NO: 3545555 - RNA, 16 nt, Pseudomonas putida KT2440
aggcagcugccuuggc

SEQ ID NO: 3545556 - RNA, 13 nt, Pseudomonas putida KT2440
aggcaggccagca

SEQ ID NO: 3545557 - RNA, 20 nt, Pseudomonas putida KT2440
aggcaggccagcacggccag

SEQ ID NO: 3545558 - RNA, 16 nt, Pseudomonas putida KT2440
aggcaguaggccaccg

SEQ ID NO: 3545559 - RNA, 17 nt, Pseudomonas putida KT2440
aggcauacagcuggccu

SEQ ID NO: 3545560 - RNA, 15 nt, Pseudomonas putida KT2440
aggcauacaggacca

SEQ ID NO: 3545561 - RNA, 17 nt, Pseudomonas putida KT2440
aggcauacaggaccagg

SEQ ID NO: 3545562 - RNA, 15 nt, Pseudomonas putida KT2440
aggcauaccgcaaca

SEQ ID NO: 3545563 - RNA, 16 nt, Pseudomonas putida KT2440
aggcauaccgcaacac

SEQ ID NO: 3545564 - RNA, 20 nt, Pseudomonas putida KT2440
aggcauaccgcaacaccugc

SEQ ID NO: 3545565 - RNA, 21 nt, Pseudomonas putida KT2440
aggcauaccgcaacaccugcc

SEQ ID NO: 3545566 - RNA, 15 nt, Pseudomonas putida KT2440
aggcauaucaagaau

SEQ ID NO: 3545567 - RNA, 15 nt, Pseudomonas putida KT2440
aggcauccacacccu

SEQ ID NO: 3545568 - RNA, 13 nt, Pseudomonas putida KT2440
aggcauccagcuc

SEQ ID NO: 3545569 - RNA, 14 nt, Pseudomonas putida KT2440
aggcauccagcucg

SEQ ID NO: 3545570 - RNA, 19 nt, Pseudomonas putida KT2440
aggcauccagggcgucggc

SEQ ID NO: 3545571 - RNA, 22 nt, Pseudomonas putida KT2440
aggcaucguuguaagccaugau

SEQ ID NO: 3545572 - RNA, 17 nt, Pseudomonas putida KT2440
aggcaugccagcagcug

SEQ ID NO: 3545573 - RNA, 18 nt, Pseudomonas putida KT2440
aggcaugccagcagcugg

SEQ ID NO: 3545574 - RNA, 15 nt, Pseudomonas putida KT2440
aggcaugggccaggg

SEQ ID NO: 3545575 - RNA, 18 nt, Pseudomonas putida KT2440
aggcauucagcucggcca

SEQ ID NO: 3545576 - RNA, 20 nt, Pseudomonas putida KT2440
aggcauugagguugacggug

SEQ ID NO: 3545577 - RNA, 17 nt, Pseudomonas putida KT2440
aggcauugcggccguca

SEQ ID NO: 3545578 - RNA, 17 nt, Pseudomonas putida KT2440
aggcauuguugcaacgc

SEQ ID NO: 3545579 - RNA, 17 nt, Pseudomonas putida KT2440
aggcauuuucaaugcuu

SEQ ID NO: 3545580 - RNA, 21 nt, Pseudomonas putida KT2440
aggccaaccacgccugcgccg

SEQ ID NO: 3545581 - RNA, 19 nt, Pseudomonas putida KT2440
aggccaacgauuggcaguc

SEQ ID NO: 3545582 - RNA, 23 nt, Pseudomonas putida KT2440
aggccugcacugcacccucuucc

SEQ ID NO: 3545583 - RNA, 16 nt, Pseudomonas putida KT2440
aggccugcgaaaggcg

SEQ ID NO: 3545584 - RNA, 19 nt, Pseudomonas putida KT2440
aggccugcgaaaggcgcuc

SEQ ID NO: 3545585 - RNA, 21 nt, Pseudomonas putida KT2440
aggccugcgaaaggcgcucga

SEQ ID NO: 3545586 - RNA, 16 nt, Pseudomonas putida KT2440
aggccuggaugcguug

SEQ ID NO: 3545587 - RNA, 17 nt, Pseudomonas putida KT2440
aggccuucagcgcggca

SEQ ID NO: 3545588 - RNA, 19 nt, Pseudomonas putida KT2440
aggccuucagcgcggcaac

SEQ ID NO: 3545589 - RNA, 14 nt, Pseudomonas putida KT2440
aggccuucagguug

SEQ ID NO: 3545590 - RNA, 22 nt, Pseudomonas putida KT2440
aggccuucaugguguccggcau

SEQ ID NO: 3545591 - RNA, 14 nt, Pseudomonas putida KT2440
aggccuugccgcuc

SEQ ID NO: 3545592 - RNA, 15 nt, Pseudomonas putida KT2440
aggccuugccgcuca

SEQ ID NO: 3545593 - RNA, 23 nt, Pseudomonas putida KT2440
aggccuugcucgaaugccgcugc

SEQ ID NO: 3545594 - RNA, 15 nt, Pseudomonas putida KT2440
aggccuuggccaccu

SEQ ID NO: 3545595 - RNA, 18 nt, Pseudomonas putida KT2440
aggccuuggccaccucau

SEQ ID NO: 3545596 - RNA, 21 nt, Pseudomonas putida KT2440
aggccuuguuccacgcgcagg

SEQ ID NO: 3545597 - RNA, 20 nt, Pseudomonas putida KT2440
aggccuuucagcgcccagaa

SEQ ID NO: 3545598 - RNA, 15 nt, Pseudomonas putida KT2440
aggcgaauggcaggu

SEQ ID NO: 3545599 - RNA, 16 nt, Pseudomonas putida KT2440
aggcgaccgguggcgc

SEQ ID NO: 3545600 - RNA, 18 nt, Pseudomonas putida KT2440
aggcgaccgguggcgccu

SEQ ID NO: 3545601 - RNA, 19 nt, Pseudomonas putida KT2440
aggcgaccgguggcgccuu

SEQ ID NO: 3545602 - RNA, 18 nt, Pseudomonas putida KT2440
aggcgaccugccagccuu

SEQ ID NO: 3545603 - RNA, 21 nt, Pseudomonas putida KT2440
aggcgaccuggaucgcgccuu

SEQ ID NO: 3545604 - RNA, 21 nt, Pseudomonas putida KT2440
aggcgaccuucgggucgccuu

SEQ ID NO: 3545605 - RNA, 21 nt, Pseudomonas putida KT2440
aggcgacgaucaucgcgccga

SEQ ID NO: 3545606 - RNA, 15 nt, Pseudomonas putida KT2440
aggcgagguucagcg

SEQ ID NO: 3545607 - RNA, 20 nt, Pseudomonas putida KT2440
aggcgauaccgccaucgauc

SEQ ID NO: 3545608 - RNA, 15 nt, Pseudomonas putida KT2440
aggcgaucuggcgga

SEQ ID NO: 3545609 - RNA, 16 nt, Pseudomonas putida KT2440
aggcgaugcagggcug

SEQ ID NO: 3545610 - RNA, 18 nt, Pseudomonas putida KT2440
aggcgauggcauccacac

SEQ ID NO: 3545611 - RNA, 16 nt, Pseudomonas putida KT2440
aggcgauguuugcgau

SEQ ID NO: 3545612 - RNA, 19 nt, Pseudomonas putida KT2440
aggcgcaaaccacuaaacg

SEQ ID NO: 3545613 - RNA, 14 nt, Pseudomonas putida KT2440
aggcgcaacucgcg

SEQ ID NO: 3545614 - RNA, 12 nt, Pseudomonas putida KT2440
aggcgcacauac

SEQ ID NO: 3545615 - RNA, 12 nt, Pseudomonas putida KT2440
aggcgcagcugc

SEQ ID NO: 3545616 - RNA, 17 nt, Pseudomonas putida KT2440
aggcgcaggugcagcca

SEQ ID NO: 3545617 - RNA, 22 nt, Pseudomonas putida KT2440
aggcgcaucacgaaauccuggu

SEQ ID NO: 3545618 - RNA, 22 nt, Pseudomonas putida KT2440
aggcgccgacgauaccgcccag

SEQ ID NO: 3545619 - RNA, 17 nt, Pseudomonas putida KT2440
aggcgccgccagcugcu

SEQ ID NO: 3545620 - RNA, 12 nt, Pseudomonas putida KT2440
aggcgccgggcu

SEQ ID NO: 3545621 - RNA, 14 nt, Pseudomonas putida KT2440
aggcgcgcgccugg

SEQ ID NO: 3545622 - RNA, 19 nt, Pseudomonas putida KT2440
aggcgcggcagcaugaaca

SEQ ID NO: 3545623 - RNA, 21 nt, Pseudomonas putida KT2440
aggcgcggcagcaugaacagc

SEQ ID NO: 3545624 - RNA, 23 nt, Pseudomonas putida KT2440
aggcgcggcagcaugaacagcgc

SEQ ID NO: 3545625 - RNA, 20 nt, Pseudomonas putida KT2440
aggcgcucaccccgccccug

SEQ ID NO: 3545626 - RNA, 17 nt, Pseudomonas putida KT2440
aggcgcuccagcagggu

SEQ ID NO: 3545627 - RNA, 17 nt, Pseudomonas putida KT2440
aggcgcucgaaccaagg

SEQ ID NO: 3545628 - RNA, 19 nt, Pseudomonas putida KT2440
aggcgcucgggggugcaca

SEQ ID NO: 3545629 - RNA, 13 nt, Pseudomonas putida KT2440
aggcgcuggcgcc

SEQ ID NO: 3545630 - RNA, 14 nt, Pseudomonas putida KT2440
aggcgcuugaagaa

SEQ ID NO: 3545631 - RNA, 15 nt, Pseudomonas putida KT2440
aggcgcuugagcucg

SEQ ID NO: 3545632 - RNA, 18 nt, Pseudomonas putida KT2440
aggcgcuugagcucggca

SEQ ID NO: 3545633 - RNA, 19 nt, Pseudomonas putida KT2440
aggcgcuugggugccgaga

SEQ ID NO: 3545634 - RNA, 11 nt, Pseudomonas putida KT2440
aggcggccacg

SEQ ID NO: 3545635 - RNA, 14 nt, Pseudomonas putida KT2440
aggcggccacggcc

SEQ ID NO: 3545636 - RNA, 22 nt, Pseudomonas putida KT2440
aggcggcucuugcagcgagugc

SEQ ID NO: 3545637 - RNA, 14 nt, Pseudomonas putida KT2440
aggcggcugaccug

SEQ ID NO: 3545638 - RNA, 15 nt, Pseudomonas putida KT2440
aggcgggagagcagg

SEQ ID NO: 3545639 - RNA, 18 nt, Pseudomonas putida KT2440
aggcgggagagcagggcu

SEQ ID NO: 3545640 - RNA, 14 nt, Pseudomonas putida KT2440
aggcgguccagcaa

SEQ ID NO: 3545641 - RNA, 19 nt, Pseudomonas putida KT2440
aggcgguccagcaagcuca

SEQ ID NO: 3545642 - RNA, 20 nt, Pseudomonas putida KT2440
aggcgguccagcaagcucau

SEQ ID NO: 3545643 - RNA, 15 nt, Pseudomonas putida KT2440
aggcggucggccagc

SEQ ID NO: 3545644 - RNA, 19 nt, Pseudomonas putida KT2440
aggcggucggccagcggca

SEQ ID NO: 3545645 - RNA, 21 nt, Pseudomonas putida KT2440
aggcggucguagcccucgaug

SEQ ID NO: 3545646 - RNA, 22 nt, Pseudomonas putida KT2440
aggcgguggaguaccuguggga

SEQ ID NO: 3545647 - RNA, 18 nt, Pseudomonas putida KT2440
aggcguacaucagccucg

SEQ ID NO: 3545648 - RNA, 13 nt, Pseudomonas putida KT2440
aggcguaccugcc

SEQ ID NO: 3545649 - RNA, 23 nt, Pseudomonas putida KT2440
aggcguauuugaccagcccgcug

SEQ ID NO: 3545650 - RNA, 13 nt, Pseudomonas putida KT2440
aggcgucacccgc

SEQ ID NO: 3545651 - RNA, 14 nt, Pseudomonas putida KT2440
aggcgucacccgcg

SEQ ID NO: 3545652 - RNA, 15 nt, Pseudomonas putida KT2440
aggcgucacccgcgc

SEQ ID NO: 3545653 - RNA, 13 nt, Pseudomonas putida KT2440
aggcgucacgcag

SEQ ID NO: 3545654 - RNA, 16 nt, Pseudomonas putida KT2440
aggcgucacgcagggc

SEQ ID NO: 3545655 - RNA, 18 nt, Pseudomonas putida KT2440
aggcgucacgcagggcca

SEQ ID NO: 3545656 - RNA, 19 nt, Pseudomonas putida KT2440
aggcguggaaaaggcgcug

SEQ ID NO: 3545657 - RNA, 12 nt, Pseudomonas putida KT2440
aggcguggugca

SEQ ID NO: 3545658 - RNA, 14 nt, Pseudomonas putida KT2440
aggcguuggccaaa

SEQ ID NO: 3545659 - RNA, 16 nt, Pseudomonas putida KT2440
aggcuacgcagcaccc

SEQ ID NO: 3545660 - RNA, 20 nt, Pseudomonas putida KT2440
aggcuacgcagcacccgguc

SEQ ID NO: 3545661 - RNA, 20 nt, Pseudomonas putida KT2440
aggcuaugccggucagcagc

SEQ ID NO: 3545662 - RNA, 21 nt, Pseudomonas putida KT2440
aggcuaugccggucagcagca

SEQ ID NO: 3545663 - RNA, 14 nt, Pseudomonas putida KT2440
aggcucaacuaccc

SEQ ID NO: 3545664 - RNA, 20 nt, Pseudomonas putida KT2440
aggcucagcagguugaacag

SEQ ID NO: 3545665 - RNA, 21 nt, Pseudomonas putida KT2440
aggcucagcagguugaacagc

SEQ ID NO: 3545666 - RNA, 15 nt, Pseudomonas putida KT2440
aggcucagcugaugu

SEQ ID NO: 3545667 - RNA, 13 nt, Pseudomonas putida KT2440
aggcucaggccuu

SEQ ID NO: 3545668 - RNA, 21 nt, Pseudomonas putida KT2440
aggcucaggccuucgccacug

SEQ ID NO: 3545669 - RNA, 22 nt, Pseudomonas putida KT2440
aggcucagggcagcaacgccga

SEQ ID NO: 3545670 - RNA, 17 nt, Pseudomonas putida KT2440
aggcuccaaagccagcg

SEQ ID NO: 3545671 - RNA, 18 nt, Pseudomonas putida KT2440
aggcuccaucuccagcuc

SEQ ID NO: 3545672 - RNA, 19 nt, Pseudomonas putida KT2440
aggcuccaucuccagcuca

SEQ ID NO: 3545673 - RNA, 23 nt, Pseudomonas putida KT2440
aggcucguugaugaugcgcaccg

SEQ ID NO: 3545674 - RNA, 17 nt, Pseudomonas putida KT2440
aggcucuccagccgcug

SEQ ID NO: 3545675 - RNA, 19 nt, Pseudomonas putida KT2440
aggcucuccauugcgccug

SEQ ID NO: 3545676 - RNA, 21 nt, Pseudomonas putida KT2440
aggcucuccauugcgccuguc

SEQ ID NO: 3545677 - RNA, 23 nt, Pseudomonas putida KT2440
aggcucugaaugucagcgcucgg

SEQ ID NO: 3545678 - RNA, 14 nt, Pseudomonas putida KT2440
aggcucuugaacug

SEQ ID NO: 3545679 - RNA, 14 nt, Pseudomonas putida KT2440
aggcugcagcgaac

SEQ ID NO: 3545680 - RNA, 14 nt, Pseudomonas putida KT2440
aggcugccacggcg

SEQ ID NO: 3545681 - RNA, 14 nt, Pseudomonas putida KT2440
aggcugcccucggg

SEQ ID NO: 3545682 - RNA, 20 nt, Pseudomonas putida KT2440
aggcugcccucgggcagccu

SEQ ID NO: 3545683 - RNA, 22 nt, Pseudomonas putida KT2440
aggcugcccucgggcagccuuu

SEQ ID NO: 3545684 - RNA, 21 nt, Pseudomonas putida KT2440
aggcugcgcaucaggcugcgc

SEQ ID NO: 3545685 - RNA, 18 nt, Pseudomonas putida KT2440
aggcugcgcccgcacagc

SEQ ID NO: 3545686 - RNA, 22 nt, Pseudomonas putida KT2440
aggcugcgcccgcacagcacgu

SEQ ID NO: 3545687 - RNA, 20 nt, Pseudomonas putida KT2440
agggucgugagccugcaccc

SEQ ID NO: 3545688 - RNA, 16 nt, Pseudomonas putida KT2440
agggucucgcggcugg

SEQ ID NO: 3545689 - RNA, 15 nt, Pseudomonas putida KT2440
agggucuucucaggc

SEQ ID NO: 3545690 - RNA, 19 nt, Pseudomonas putida KT2440
agggucuucucaggcacca

SEQ ID NO: 3545691 - RNA, 17 nt, Pseudomonas putida KT2440
agggucuugcucgcgcu

SEQ ID NO: 3545692 - RNA, 21 nt, Pseudomonas putida KT2440
agggugaaguacucggcacgc

SEQ ID NO: 3545693 - RNA, 18 nt, Pseudomonas putida KT2440
agggugaucgcgcuggca

SEQ ID NO: 3545694 - RNA, 15 nt, Pseudomonas putida KT2440
agggugaugcccgca

SEQ ID NO: 3545695 - RNA, 18 nt, Pseudomonas putida KT2440
agggugcaaucaggucuc

SEQ ID NO: 3545696 - RNA, 22 nt, Pseudomonas putida KT2440
agggugcggauaccgcuggccg

SEQ ID NO: 3545697 - RNA, 17 nt, Pseudomonas putida KT2440
aggguggucuuggccaa

SEQ ID NO: 3545698 - RNA, 21 nt, Pseudomonas putida KT2440
aggguguauugccgccgggcc

SEQ ID NO: 3545699 - RNA, 17 nt, Pseudomonas putida KT2440
agggugucaacaggcug

SEQ ID NO: 3545700 - RNA, 24 nt, Pseudomonas putida KT2440
agggugucgguggcggccagcgca

SEQ ID NO: 3545701 - RNA, 18 nt, Pseudomonas putida KT2440
agggugugcugcugccaa

SEQ ID NO: 3545702 - RNA, 14 nt, Pseudomonas putida KT2440
aggguucgauccac

SEQ ID NO: 3545703 - RNA, 19 nt, Pseudomonas putida KT2440
aggguucgccgucagccuu

SEQ ID NO: 3545704 - RNA, 18 nt, Pseudomonas putida KT2440
aggguucgcuguccugau

SEQ ID NO: 3545705 - RNA, 17 nt, Pseudomonas putida KT2440
aggguugcaucgcgcac

SEQ ID NO: 3545706 - RNA, 24 nt, Pseudomonas putida KT2440
aggguugcaucgcgcacuugccag

SEQ ID NO: 3545707 - RNA, 14 nt, Pseudomonas putida KT2440
aggguugucccggu

SEQ ID NO: 3545708 - RNA, 11 nt, Pseudomonas putida KT2440
aggguuuucag

SEQ ID NO: 3545709 - RNA, 14 nt, Pseudomonas putida KT2440
agguaaacccgcgc

SEQ ID NO: 3545710 - RNA, 16 nt, Pseudomonas putida KT2440
agguacacccccaggu

SEQ ID NO: 3545711 - RNA, 22 nt, Pseudomonas putida KT2440
agguacacccccagguuaucca

SEQ ID NO: 3545712 - RNA, 14 nt, Pseudomonas putida KT2440
agguacagcagcug

SEQ ID NO: 3545713 - RNA, 21 nt, Pseudomonas putida KT2440
agguaccaggcugccacggcg

SEQ ID NO: 3545714 - RNA, 20 nt, Pseudomonas putida KT2440
agguaccccaccggccugga

SEQ ID NO: 3545715 - RNA, 21 nt, Pseudomonas putida KT2440
agguacgcgcaggcagcucga

SEQ ID NO: 3545716 - RNA, 22 nt, Pseudomonas putida KT2440
agguacggguucaagggcaggg

SEQ ID NO: 3545717 - RNA, 18 nt, Pseudomonas putida KT2440
agguacucagcggcuggc

SEQ ID NO: 3545718 - RNA, 18 nt, Pseudomonas putida KT2440
agguacucgcaagcucca

SEQ ID NO: 3545719 - RNA, 13 nt, Pseudomonas putida KT2440
agguagaucacac

SEQ ID NO: 3545720 - RNA, 19 nt, Pseudomonas putida KT2440
agguagccguggcugggga

SEQ ID NO: 3545721 - RNA, 20 nt, Pseudomonas putida KT2440
agguagcgcucgacauccag

SEQ ID NO: 3545722 - RNA, 17 nt, Pseudomonas putida KT2440
agguagcggggccgcuu

SEQ ID NO: 3545723 - RNA, 20 nt, Pseudomonas putida KT2440
agguagcgguaaacgucggc

SEQ ID NO: 3545724 - RNA, 21 nt, Pseudomonas putida KT2440
agguaggcaccccggccgcuu

SEQ ID NO: 3545725 - RNA, 22 nt, Pseudomonas putida KT2440
agguagguuuucggcuggagcu

SEQ ID NO: 3545726 - RNA, 14 nt, Pseudomonas putida KT2440
agguaguuggccgg

SEQ ID NO: 3545727 - RNA, 12 nt, Pseudomonas putida KT2440
agguaucgccgc

SEQ ID NO: 3545728 - RNA, 17 nt, Pseudomonas putida KT2440
agguaucgccgcccuug

SEQ ID NO: 3545729 - RNA, 12 nt, Pseudomonas putida KT2440
agguauggccag

SEQ ID NO: 3545730 - RNA, 15 nt, Pseudomonas putida KT2440
agguauggccagagc

SEQ ID NO: 3545731 - RNA, 18 nt, Pseudomonas putida KT2440
agguauuggucaccggga

SEQ ID NO: 3545732 - RNA, 17 nt, Pseudomonas putida KT2440
aggucaaacuccccccc

SEQ ID NO: 3545733 - RNA, 21 nt, Pseudomonas putida KT2440
aggucaacggcaacgccagca

SEQ ID NO: 3545734 - RNA, 22 nt, Pseudomonas putida KT2440
aggucaacggcaacgccagcaa

SEQ ID NO: 3545735 - RNA, 18 nt, Pseudomonas putida KT2440
aggucaccaucagccgcg

SEQ ID NO: 3545736 - RNA, 19 nt, Pseudomonas putida KT2440
aggucacguuguagcccac

SEQ ID NO: 3545737 - RNA, 12 nt, Pseudomonas putida KT2440
aggucagcaagc

SEQ ID NO: 3545738 - RNA, 16 nt, Pseudomonas putida KT2440
aggucagcaagccgcc

SEQ ID NO: 3545739 - RNA, 18 nt, Pseudomonas putida KT2440
aggucagcgcucaaaaaa

SEQ ID NO: 3545740 - RNA, 14 nt, Pseudomonas putida KT2440
aggucagcgguucg

SEQ ID NO: 3545741 - RNA, 16 nt, Pseudomonas putida KT2440
aggucaggacaucgcg

SEQ ID NO: 3545742 - RNA, 12 nt, Pseudomonas putida KT2440
aggucagugaug

SEQ ID NO: 3545743 - RNA, 16 nt, Pseudomonas putida KT2440
aggucauccgcacgca

SEQ ID NO: 3545744 - RNA, 16 nt, Pseudomonas putida KT2440
aggucaucgcugcggu

SEQ ID NO: 3545745 - RNA, 21 nt, Pseudomonas putida KT2440
aggucaucgggaucagcacgc

SEQ ID NO: 3545746 - RNA, 14 nt, Pseudomonas putida KT2440
aggucaugaugccc

SEQ ID NO: 3545747 - RNA, 20 nt, Pseudomonas putida KT2440
aggucauuggcgccaucgcc

SEQ ID NO: 3545748 - RNA, 18 nt, Pseudomonas putida KT2440
aggucauuugcagugcuu

SEQ ID NO: 3545749 - RNA, 13 nt, Pseudomonas putida KT2440
agguccagccgcc

SEQ ID NO: 3545750 - RNA, 15 nt, Pseudomonas putida KT2440
agguccagccgccau

SEQ ID NO: 3545751 - RNA, 17 nt, Pseudomonas putida KT2440
agguccagccgccauuu

SEQ ID NO: 3545752 - RNA, 13 nt, Pseudomonas putida KT2440
agguccaguucgc

SEQ ID NO: 3545753 - RNA, 17 nt, Pseudomonas putida KT2440
agguccauguugugcug

SEQ ID NO: 3545754 - RNA, 19 nt, Pseudomonas putida KT2440
agguccauguugugcuggc

SEQ ID NO: 3545755 - RNA, 23 nt, Pseudomonas putida KT2440
agguccauguugugcuggcggcu

SEQ ID NO: 3545756 - RNA, 14 nt, Pseudomonas putida KT2440
agguccgccaaggu

SEQ ID NO: 3545757 - RNA, 22 nt, Pseudomonas putida KT2440
aggucgacacccagcacccgca

SEQ ID NO: 3545758 - RNA, 20 nt, Pseudomonas putida KT2440
aggucgacaugcaccacgcc

SEQ ID NO: 3545759 - RNA, 20 nt, Pseudomonas putida KT2440
aggucgacccgcgccagggu

SEQ ID NO: 3545760 - RNA, 20 nt, Pseudomonas putida KT2440
aggucgauccgggugcuggc

SEQ ID NO: 3545761 - RNA, 20 nt, Pseudomonas putida KT2440
aggucgaugccuuccaggcg

SEQ ID NO: 3545762 - RNA, 17 nt, Pseudomonas putida KT2440
aggucgaugcugcugag

SEQ ID NO: 3545763 - RNA, 13 nt, Pseudomonas putida KT2440
aggucgccaggcu

SEQ ID NO: 3545764 - RNA, 16 nt, Pseudomonas putida KT2440
aggucgccgcuguuca

SEQ ID NO: 3545765 - RNA, 22 nt, Pseudomonas putida KT2440
aggucgccgcuguucagcccuu

SEQ ID NO: 3545766 - RNA, 22 nt, Pseudomonas putida KT2440
aggucgcgguucgacugccgcu

SEQ ID NO: 3545767 - RNA, 21 nt, Pseudomonas putida KT2440
aggucgcuaucggcaggcugg

SEQ ID NO: 3545768 - RNA, 19 nt, Pseudomonas putida KT2440
aggucggagaucgagugcu

SEQ ID NO: 3545769 - RNA, 11 nt, Pseudomonas putida KT2440
aggucggcgcg

SEQ ID NO: 3545770 - RNA, 22 nt, Pseudomonas putida KT2440
aggucggcucgucgaacagcau

SEQ ID NO: 3545771 - RNA, 23 nt, Pseudomonas putida KT2440
aggucggcucgucgaacagcaug

SEQ ID NO: 3545772 - RNA, 19 nt, Pseudomonas putida KT2440
aggucgggaauugcagccc

SEQ ID NO: 3545773 - RNA, 20 nt, Pseudomonas putida KT2440
aggucggggcgguagccgaa

SEQ ID NO: 3545774 - RNA, 23 nt, Pseudomonas putida KT2440
aggucgguagggaucaccgccag

SEQ ID NO: 3545775 - RNA, 17 nt, Pseudomonas putida KT2440
aggucggucagcaccgu

SEQ ID NO: 3545776 - RNA, 13 nt, Pseudomonas putida KT2440
aggucuaaccgcg

SEQ ID NO: 3545777 - RNA, 23 nt, Pseudomonas putida KT2440
aggucuaaccgcgcugguaagcc

SEQ ID NO: 3545778 - RNA, 16 nt, Pseudomonas putida KT2440
aggucucgaacgcugu

SEQ ID NO: 3545779 - RNA, 14 nt, Pseudomonas putida KT2440
aggucugcugcggc

SEQ ID NO: 3545780 - RNA, 21 nt, Pseudomonas putida KT2440
aggucuucaaaucgcugcgca

SEQ ID NO: 3545781 - RNA, 17 nt, Pseudomonas putida KT2440
aggucuucgaucucggc

SEQ ID NO: 3545782 - RNA, 22 nt, Pseudomonas putida KT2440
aggucuucgaucucggccagca

SEQ ID NO: 3545783 - RNA, 15 nt, Pseudomonas putida KT2440
aggucuucucggcag

SEQ ID NO: 3545784 - RNA, 21 nt, Pseudomonas putida KT2440
aggucuucucggcagacccuu

SEQ ID NO: 3545785 - RNA, 20 nt, Pseudomonas putida KT2440
aggugaaucagcggcaggcu

SEQ ID NO: 3545786 - RNA, 16 nt, Pseudomonas putida KT2440
aggugacaagcugcgc

SEQ ID NO: 3545787 - RNA, 18 nt, Pseudomonas putida KT2440
aggugauagacguggcug

SEQ ID NO: 3545788 - RNA, 24 nt, Pseudomonas putida KT2440
aggugaucguugcgcgccagggca

SEQ ID NO: 3545789 - RNA, 14 nt, Pseudomonas putida KT2440
aggugaugcaggca

SEQ ID NO: 3545790 - RNA, 17 nt, Pseudomonas putida KT2440
aggugauguugcccggc

SEQ ID NO: 3545791 - RNA, 17 nt, Pseudomonas putida KT2440
aggugcaacccggccuu

SEQ ID NO: 3545792 - RNA, 21 nt, Pseudomonas putida KT2440
aguagcgcucuuugccacuca

SEQ ID NO: 3545793 - RNA, 19 nt, Pseudomonas putida KT2440
aguagcuccagcccagcgc

SEQ ID NO: 3545794 - RNA, 20 nt, Pseudomonas putida KT2440
aguagcuuaaucccgcaagu

SEQ ID NO: 3545795 - RNA, 12 nt, Pseudomonas putida KT2440
aguaggcacgau

SEQ ID NO: 3545796 - RNA, 12 nt, Pseudomonas putida KT2440
aguaggugcagg

SEQ ID NO: 3545797 - RNA, 20 nt, Pseudomonas putida KT2440
aguaucgccccggucagcag

SEQ ID NO: 3545798 - RNA, 16 nt, Pseudomonas putida KT2440
aguauuaauuugaaca

SEQ ID NO: 3545799 - RNA, 20 nt, Pseudomonas putida KT2440
aguauucgcuaaccucugca

SEQ ID NO: 3545800 - RNA, 13 nt, Pseudomonas putida KT2440
agucaacacggcu

SEQ ID NO: 3545801 - RNA, 14 nt, Pseudomonas putida KT2440
agucaacacggcug

SEQ ID NO: 3545802 - RNA, 16 nt, Pseudomonas putida KT2440
agucaacaggguaggu

SEQ ID NO: 3545803 - RNA, 18 nt, Pseudomonas putida KT2440
agucaccuugcuccacca

SEQ ID NO: 3545804 - RNA, 21 nt, Pseudomonas putida KT2440
agucagaaaguuugguuuuuu

SEQ ID NO: 3545805 - RNA, 14 nt, Pseudomonas putida KT2440
agucagaagcagcu

SEQ ID NO: 3545806 - RNA, 16 nt, Pseudomonas putida KT2440
agucagacuccuuuga

SEQ ID NO: 3545807 - RNA, 15 nt, Pseudomonas putida KT2440
agucagccagccggc

SEQ ID NO: 3545808 - RNA, 20 nt, Pseudomonas putida KT2440
agucaggccgaugggcaggc

SEQ ID NO: 3545809 - RNA, 23 nt, Pseudomonas putida KT2440
agucaggccgaugggcaggccau

SEQ ID NO: 3545810 - RNA, 18 nt, Pseudomonas putida KT2440
agucaggcugcacaaggu

SEQ ID NO: 3545811 - RNA, 17 nt, Pseudomonas putida KT2440
agucagggucucggcca

SEQ ID NO: 3545812 - RNA, 20 nt, Pseudomonas putida KT2440
agucagugugaccuucaacc

SEQ ID NO: 3545813 - RNA, 22 nt, Pseudomonas putida KT2440
agucauccgccaggcucuccag

SEQ ID NO: 3545814 - RNA, 22 nt, Pseudomonas putida KT2440
agucauccgggccgucaccgcu

SEQ ID NO: 3545815 - RNA, 17 nt, Pseudomonas putida KT2440
agucauccucaggggua

SEQ ID NO: 3545816 - RNA, 15 nt, Pseudomonas putida KT2440
agucaugggccaugc

SEQ ID NO: 3545817 - RNA, 16 nt, Pseudomonas putida KT2440
aguccagcaucagcac

SEQ ID NO: 3545818 - RNA, 23 nt, Pseudomonas putida KT2440
aguccagcaucagcacacccagc

SEQ ID NO: 3545819 - RNA, 12 nt, Pseudomonas putida KT2440
aguccagcugca

SEQ ID NO: 3545820 - RNA, 13 nt, Pseudomonas putida KT2440
aguccagcugcau

SEQ ID NO: 3545821 - RNA, 20 nt, Pseudomonas putida KT2440
aguccaggucgcggagccaa

SEQ ID NO: 3545822 - RNA, 23 nt, Pseudomonas putida KT2440
aguccaggucgcggagccagaca

SEQ ID NO: 3545823 - RNA, 15 nt, Pseudomonas putida KT2440
aguccaucaccggcg

SEQ ID NO: 3545824 - RNA, 16 nt, Pseudomonas putida KT2440
aguccaucugcuucug

SEQ ID NO: 3545825 - RNA, 14 nt, Pseudomonas putida KT2440
aguccccaccggca

SEQ ID NO: 3545826 - RNA, 15 nt, Pseudomonas putida KT2440
aguccccaccggcac

SEQ ID NO: 3545827 - RNA, 17 nt, Pseudomonas putida KT2440
aguccccaccggcacca

SEQ ID NO: 3545828 - RNA, 15 nt, Pseudomonas putida KT2440
agucccguuggcccg

SEQ ID NO: 3545829 - RNA, 19 nt, Pseudomonas putida KT2440
agucccugauacuucugac

SEQ ID NO: 3545830 - RNA, 15 nt, Pseudomonas putida KT2440
aguccgaagcgaaca

SEQ ID NO: 3545831 - RNA, 17 nt, Pseudomonas putida KT2440
aguccgccucgucgaug

SEQ ID NO: 3545832 - RNA, 16 nt, Pseudomonas putida KT2440
aguccggcgaagcacu

SEQ ID NO: 3545833 - RNA, 20 nt, Pseudomonas putida KT2440
aguccgguaacgaaggccug

SEQ ID NO: 3545834 - RNA, 17 nt, Pseudomonas putida KT2440
aguccugauagcgcuuu

SEQ ID NO: 3545835 - RNA, 12 nt, Pseudomonas putida KT2440
aguccugcaaag

SEQ ID NO: 3545836 - RNA, 18 nt, Pseudomonas putida KT2440
aguccugcaacucggccu

SEQ ID NO: 3545837 - RNA, 15 nt, Pseudomonas putida KT2440
aguccugcagcggca

SEQ ID NO: 3545838 - RNA, 17 nt, Pseudomonas putida KT2440
aguccugcagcggcaag

SEQ ID NO: 3545839 - RNA, 18 nt, Pseudomonas putida KT2440
aguccuugcgugccucag

SEQ ID NO: 3545840 - RNA, 18 nt, Pseudomonas putida KT2440
aguccuuggccaaugcca

SEQ ID NO: 3545841 - RNA, 20 nt, Pseudomonas putida KT2440
aguccuuggccaaugccagg

SEQ ID NO: 3545842 - RNA, 17 nt, Pseudomonas putida KT2440
agucgaaggggaucagc

SEQ ID NO: 3545843 - RNA, 18 nt, Pseudomonas putida KT2440
agucgaaggggaucagca

SEQ ID NO: 3545844 - RNA, 19 nt, Pseudomonas putida KT2440
agucgacaauuuggggcug

SEQ ID NO: 3545845 - RNA, 19 nt, Pseudomonas putida KT2440
agucgaccagaagggcgca

SEQ ID NO: 3545846 - RNA, 17 nt, Pseudomonas putida KT2440
agucgauaaaccgugca

SEQ ID NO: 3545847 - RNA, 17 nt, Pseudomonas putida KT2440
agucgaucagcgacacc

SEQ ID NO: 3545848 - RNA, 22 nt, Pseudomonas putida KT2440
agucgaucccgaggucagcagu

SEQ ID NO: 3545849 - RNA, 16 nt, Pseudomonas putida KT2440
agucgauguucagcac

SEQ ID NO: 3545850 - RNA, 19 nt, Pseudomonas putida KT2440
agucgcacagguccagccg

SEQ ID NO: 3545851 - RNA, 19 nt, Pseudomonas putida KT2440
agucgcacaugaagccgcg

SEQ ID NO: 3545852 - RNA, 20 nt, Pseudomonas putida KT2440
agucgcacaugaagccgcgc

SEQ ID NO: 3545853 - RNA, 21 nt, Pseudomonas putida KT2440
agucgccaaccgccagcaguu

SEQ ID NO: 3545854 - RNA, 20 nt, Pseudomonas putida KT2440
agucgccacaccacagcugc

SEQ ID NO: 3545855 - RNA, 22 nt, Pseudomonas putida KT2440
agucgccacaccacagcugcac

SEQ ID NO: 3545856 - RNA, 17 nt, Pseudomonas putida KT2440
agucgcccaguuccaug

SEQ ID NO: 3545857 - RNA, 17 nt, Pseudomonas putida KT2440
agucgcgcaccaccuga

SEQ ID NO: 3545858 - RNA, 23 nt, Pseudomonas putida KT2440
agucgcgcaccaccugaugcacc

SEQ ID NO: 3545859 - RNA, 21 nt, Pseudomonas putida KT2440
agucgcucaggcggcgcaggu

SEQ ID NO: 3545860 - RNA, 22 nt, Pseudomonas putida KT2440
agucgcucaggcggcgcagguu

SEQ ID NO: 3545861 - RNA, 19 nt, Pseudomonas putida KT2440
agucggccugaugccucau

SEQ ID NO: 3545862 - RNA, 13 nt, Pseudomonas putida KT2440
agucggcgcugga

SEQ ID NO: 3545863 - RNA, 20 nt, Pseudomonas putida KT2440
agucggcucuucuuucaggu

SEQ ID NO: 3545864 - RNA, 19 nt, Pseudomonas putida KT2440
agucgguaugcgcccaucu

SEQ ID NO: 3545865 - RNA, 17 nt, Pseudomonas putida KT2440
agucguacuagcggugc

SEQ ID NO: 3545866 - RNA, 14 nt, Pseudomonas putida KT2440
agucguugcgcugg

SEQ ID NO: 3545867 - RNA, 22 nt, Pseudomonas putida KT2440
agucuauggaugccagcggugc

SEQ ID NO: 3545868 - RNA, 21 nt, Pseudomonas putida KT2440
agucucgacccgucgcugcca

SEQ ID NO: 3545869 - RNA, 23 nt, Pseudomonas putida KT2440
agucucgacccgucgcugccaaa

SEQ ID NO: 3545870 - RNA, 13 nt, Pseudomonas putida KT2440
agucugaaaacaa

SEQ ID NO: 3545871 - RNA, 15 nt, Pseudomonas putida KT2440
agucugcuccaccgc

SEQ ID NO: 3545872 - RNA, 19 nt, Pseudomonas putida KT2440
agucuucaagcucgaagcg

SEQ ID NO: 3545873 - RNA, 17 nt, Pseudomonas putida KT2440
agucuuccccuuggcga

SEQ ID NO: 3545874 - RNA, 14 nt, Pseudomonas putida KT2440
agugaacaggcgua

SEQ ID NO: 3545875 - RNA, 13 nt, Pseudomonas putida KT2440
agugaacuccaac

SEQ ID NO: 3545876 - RNA, 19 nt, Pseudomonas putida KT2440
agugaauuccuugcuggug

SEQ ID NO: 3545877 - RNA, 22 nt, Pseudomonas putida KT2440
agugaccgguuuuggcaggccg

SEQ ID NO: 3545878 - RNA, 18 nt, Pseudomonas putida KT2440
agugagccucacacagca

SEQ ID NO: 3545879 - RNA, 22 nt, Pseudomonas putida KT2440
agugagcuaaaccgcgaugcug

SEQ ID NO: 3545880 - RNA, 23 nt, Pseudomonas putida KT2440
agugagcuaaaccgcgaugcugc

SEQ ID NO: 3545881 - RNA, 22 nt, Pseudomonas putida KT2440
agugauaacgcgccgcugccug

SEQ ID NO: 3545882 - RNA, 13 nt, Pseudomonas putida KT2440
agugaucaucaca

SEQ ID NO: 3545883 - RNA, 15 nt, Pseudomonas putida KT2440
agugaugcaucagcu

SEQ ID NO: 3545884 - RNA, 19 nt, Pseudomonas putida KT2440
agugauuguuaucugugaa

SEQ ID NO: 3545885 - RNA, 17 nt, Pseudomonas putida KT2440
agugcaauaccagccug

SEQ ID NO: 3545886 - RNA, 22 nt, Pseudomonas putida KT2440
agugcaccaacgccgauagcca

SEQ ID NO: 3545887 - RNA, 18 nt, Pseudomonas putida KT2440
agugcaucgaagcaggcc

SEQ ID NO: 3545888 - RNA, 21 nt, Pseudomonas putida KT2440
agugcauuucgucgagcucga

SEQ ID NO: 3545889 - RNA, 19 nt, Pseudomonas putida KT2440
agugccaagaauucguuuu

SEQ ID NO: 3545890 - RNA, 21 nt, Pseudomonas putida KT2440
agugccaaggcuuuuugauug

SEQ ID NO: 3545891 - RNA, 22 nt, Pseudomonas putida KT2440
agugcccccgccacaggugaca

SEQ ID NO: 3545892 - RNA, 23 nt, Pseudomonas putida KT2440
agugccgcaagcagucccagcac

SEQ ID NO: 3545893 - RNA, 14 nt, Pseudomonas putida KT2440
agugccgccugguu

SEQ ID NO: 3545894 - RNA, 15 nt, Pseudomonas putida KT2440
agugccgucagaaag

SEQ ID NO: 3545895 - RNA, 23 nt, Pseudomonas putida KT2440
agugccgucagaaagaauggaaa

SEQ ID NO: 3545896 - RNA, 23 nt, Pseudomonas putida KT2440
auaaaccagcagcgccugcagcg

SEQ ID NO: 3545897 - RNA, 16 nt, Pseudomonas putida KT2440
auaaaccgugcaaaca

SEQ ID NO: 3545898 - RNA, 23 nt, Pseudomonas putida KT2440
auaaacgccgcccccuucacuga

SEQ ID NO: 3545899 - RNA, 21 nt, Pseudomonas putida KT2440
auaacaagaacaacacggcag

SEQ ID NO: 3545900 - RNA, 16 nt, Pseudomonas putida KT2440
auaacaccccccagca

SEQ ID NO: 3545901 - RNA, 19 nt, Pseudomonas putida KT2440
auaacaccccccagcagcg

SEQ ID NO: 3545902 - RNA, 23 nt, Pseudomonas putida KT2440
auaacaccccccagcagcgggca

SEQ ID NO: 3545903 - RNA, 23 nt, Pseudomonas putida KT2440
auaagcccaauacccaacagcau

SEQ ID NO: 3545904 - RNA, 18 nt, Pseudomonas putida KT2440
auaagcgacaaaggcguc

SEQ ID NO: 3545905 - RNA, 12 nt, Pseudomonas putida KT2440
auaauaaaaaaa

SEQ ID NO: 3545906 - RNA, 17 nt, Pseudomonas putida KT2440
auaauucuuauuaccag

SEQ ID NO: 3545907 - RNA, 21 nt, Pseudomonas putida KT2440
auacaacgaucagcgccgaac

SEQ ID NO: 3545908 - RNA, 11 nt, Pseudomonas putida KT2440
auacaccaacg

SEQ ID NO: 3545909 - RNA, 19 nt, Pseudomonas putida KT2440
auacaccagcuugaugcug

SEQ ID NO: 3545910 - RNA, 21 nt, Pseudomonas putida KT2440
auacagcgcacucucccgcag

SEQ ID NO: 3545911 - RNA, 12 nt, Pseudomonas putida KT2440
auacagcgccuc

SEQ ID NO: 3545912 - RNA, 17 nt, Pseudomonas putida KT2440
auacagcucccgcgcau

SEQ ID NO: 3545913 - RNA, 14 nt, Pseudomonas putida KT2440
auacaggaccaggc

SEQ ID NO: 3545914 - RNA, 23 nt, Pseudomonas putida KT2440
auacagguucggguaguccucca

SEQ ID NO: 3545915 - RNA, 16 nt, Pseudomonas putida KT2440
auacauagcgaucgau

SEQ ID NO: 3545916 - RNA, 19 nt, Pseudomonas putida KT2440
auaccaccucacacuggua

SEQ ID NO: 3545917 - RNA, 22 nt, Pseudomonas putida KT2440
auaccacgcgauuuuuuugaaa

SEQ ID NO: 3545918 - RNA, 18 nt, Pseudomonas putida KT2440
auaccacggucguaguca

SEQ ID NO: 3545919 - RNA, 22 nt, Pseudomonas putida KT2440
auaccaggcccgcuauccucga

SEQ ID NO: 3545920 - RNA, 17 nt, Pseudomonas putida KT2440
auacccaauaaaaacaa

SEQ ID NO: 3545921 - RNA, 21 nt, Pseudomonas putida KT2440
auacccaauaaaaacaacagg

SEQ ID NO: 3545922 - RNA, 13 nt, Pseudomonas putida KT2440
auacccagcgccg

SEQ ID NO: 3545923 - RNA, 14 nt, Pseudomonas putida KT2440
auaccccgcugccu

SEQ ID NO: 3545924 - RNA, 16 nt, Pseudomonas putida KT2440
auaccgauugccucag

SEQ ID NO: 3545925 - RNA, 20 nt, Pseudomonas putida KT2440
auaccgcaucccaaugugga

SEQ ID NO: 3545926 - RNA, 23 nt, Pseudomonas putida KT2440
auaccgcgcacgcaucugcaccg

SEQ ID NO: 3545927 - RNA, 13 nt, Pseudomonas putida KT2440
auaccgcugggca

SEQ ID NO: 3545928 - RNA, 18 nt, Pseudomonas putida KT2440
auaccggcgcuucggcac

SEQ ID NO: 3545929 - RNA, 16 nt, Pseudomonas putida KT2440
auaccggggcaccuug

SEQ ID NO: 3545930 - RNA, 15 nt, Pseudomonas putida KT2440
auaccgguagccucg

SEQ ID NO: 3545931 - RNA, 16 nt, Pseudomonas putida KT2440
auaccggugccccggu

SEQ ID NO: 3545932 - RNA, 20 nt, Pseudomonas putida KT2440
auaccguuucgaucgaggcg

SEQ ID NO: 3545933 - RNA, 21 nt, Pseudomonas putida KT2440
auaccucccgcacugcugccg

SEQ ID NO: 3545934 - RNA, 16 nt, Pseudomonas putida KT2440
auaccugcuugcugac

SEQ ID NO: 3545935 - RNA, 17 nt, Pseudomonas putida KT2440
auaccugcuugcugacu

SEQ ID NO: 3545936 - RNA, 12 nt, Pseudomonas putida KT2440
auacgacgcauc

SEQ ID NO: 3545937 - RNA, 16 nt, Pseudomonas putida KT2440
auacgauauccgcagc

SEQ ID NO: 3545938 - RNA, 22 nt, Pseudomonas putida KT2440
auacgcaguacgugaaagcccg

SEQ ID NO: 3545939 - RNA, 16 nt, Pseudomonas putida KT2440
auacgcugcugguccu

SEQ ID NO: 3545940 - RNA, 17 nt, Pseudomonas putida KT2440
auacgcugugcucuggc

SEQ ID NO: 3545941 - RNA, 22 nt, Pseudomonas putida KT2440
auacggcgcacucucgucaccu

SEQ ID NO: 3545942 - RNA, 23 nt, Pseudomonas putida KT2440
auacggcuugauauccagcaccg

SEQ ID NO: 3545943 - RNA, 18 nt, Pseudomonas putida KT2440
auacgguaagccgccgug

SEQ ID NO: 3545944 - RNA, 22 nt, Pseudomonas putida KT2440
auacggucuuuuccccuuauau

SEQ ID NO: 3545945 - RNA, 23 nt, Pseudomonas putida KT2440
auacucacccgcuugccacggcg

SEQ ID NO: 3545946 - RNA, 20 nt, Pseudomonas putida KT2440
auacuccagcgucaccacca

SEQ ID NO: 3545947 - RNA, 20 nt, Pseudomonas putida KT2440
auacuggcccggcgggagga

SEQ ID NO: 3545948 - RNA, 17 nt, Pseudomonas putida KT2440
auacuggcgcugaucau

SEQ ID NO: 3545949 - RNA, 22 nt, Pseudomonas putida KT2440
auacuggcgcugaucaucgaca

SEQ ID NO: 3545950 - RNA, 16 nt, Pseudomonas putida KT2440
auacuucugaccaauc

SEQ ID NO: 3545951 - RNA, 19 nt, Pseudomonas putida KT2440
auagaacacuggcaggcuc

SEQ ID NO: 3545952 - RNA, 15 nt, Pseudomonas putida KT2440
auagaacagcaucaa

SEQ ID NO: 3545953 - RNA, 15 nt, Pseudomonas putida KT2440
auagaacgacuugua

SEQ ID NO: 3545954 - RNA, 21 nt, Pseudomonas putida KT2440
auagacaaaaaaaucggccgc

SEQ ID NO: 3545955 - RNA, 13 nt, Pseudomonas putida KT2440
auagaccauuucg

SEQ ID NO: 3545956 - RNA, 19 nt, Pseudomonas putida KT2440
auagaccucgagaauccgu

SEQ ID NO: 3545957 - RNA, 15 nt, Pseudomonas putida KT2440
auagaguacucggcu

SEQ ID NO: 3545958 - RNA, 11 nt, Pseudomonas putida KT2440
auagaucagcg

SEQ ID NO: 3545959 - RNA, 15 nt, Pseudomonas putida KT2440
auagcaacacaugua

SEQ ID NO: 3545960 - RNA, 17 nt, Pseudomonas putida KT2440
auagcaggaucuagccc

SEQ ID NO: 3545961 - RNA, 18 nt, Pseudomonas putida KT2440
auagcaucgcuagaaaac

SEQ ID NO: 3545962 - RNA, 16 nt, Pseudomonas putida KT2440
auagccagcuggccac

SEQ ID NO: 3545963 - RNA, 18 nt, Pseudomonas putida KT2440
auagccagcuggccaccu

SEQ ID NO: 3545964 - RNA, 16 nt, Pseudomonas putida KT2440
auagccagggccugua

SEQ ID NO: 3545965 - RNA, 16 nt, Pseudomonas putida KT2440
auagccaugcaccguc

SEQ ID NO: 3545966 - RNA, 17 nt, Pseudomonas putida KT2440
auagccauugcggcuga

SEQ ID NO: 3545967 - RNA, 13 nt, Pseudomonas putida KT2440
auagcccaccguc

SEQ ID NO: 3545968 - RNA, 21 nt, Pseudomonas putida KT2440
auagcccaccgucaggcucag

SEQ ID NO: 3545969 - RNA, 22 nt, Pseudomonas putida KT2440
auagcccaccgucaggcucagc

SEQ ID NO: 3545970 - RNA, 18 nt, Pseudomonas putida KT2440
auagcccgcuggccgcac

SEQ ID NO: 3545971 - RNA, 13 nt, Pseudomonas putida KT2440
auagcccugcccu

SEQ ID NO: 3545972 - RNA, 20 nt, Pseudomonas putida KT2440
auagccgccagcaucacgcc

SEQ ID NO: 3545973 - RNA, 19 nt, Pseudomonas putida KT2440
auagccggccucagcagcg

SEQ ID NO: 3545974 - RNA, 14 nt, Pseudomonas putida KT2440
auagccggugccga

SEQ ID NO: 3545975 - RNA, 13 nt, Pseudomonas putida KT2440
auagccugcugcu

SEQ ID NO: 3545976 - RNA, 18 nt, Pseudomonas putida KT2440
auagccugcugcucccca

SEQ ID NO: 3545977 - RNA, 15 nt, Pseudomonas putida KT2440
auagcgcugcaccga

SEQ ID NO: 3545978 - RNA, 16 nt, Pseudomonas putida KT2440
auagcgugcuuccacc

SEQ ID NO: 3545979 - RNA, 18 nt, Pseudomonas putida KT2440
auagcgugcuuccaccuc

SEQ ID NO: 3545980 - RNA, 16 nt, Pseudomonas putida KT2440
auagcuuucaggcgca

SEQ ID NO: 3545981 - RNA, 20 nt, Pseudomonas putida KT2440
auagcuuucaggcgcagcac

SEQ ID NO: 3545982 - RNA, 22 nt, Pseudomonas putida KT2440
auagcuuuuuuggcguaguaau

SEQ ID NO: 3545983 - RNA, 19 nt, Pseudomonas putida KT2440
auaggacugcuucaggccu

SEQ ID NO: 3545984 - RNA, 13 nt, Pseudomonas putida KT2440
auaggagcggguu

SEQ ID NO: 3545985 - RNA, 23 nt, Pseudomonas putida KT2440
auaggccaagguugccaccagca

SEQ ID NO: 3545986 - RNA, 11 nt, Pseudomonas putida KT2440
auaggccgcaa

SEQ ID NO: 3545987 - RNA, 23 nt, Pseudomonas putida KT2440
auaggccuuggcuucacuguuca

SEQ ID NO: 3545988 - RNA, 17 nt, Pseudomonas putida KT2440
auaggcugucacgauga

SEQ ID NO: 3545989 - RNA, 20 nt, Pseudomonas putida KT2440
auagggccagcggcuuuucu

SEQ ID NO: 3545990 - RNA, 20 nt, Pseudomonas putida KT2440
auagggcuacguggaccaga

SEQ ID NO: 3545991 - RNA, 22 nt, Pseudomonas putida KT2440
auagguccagcucuggucaccu

SEQ ID NO: 3545992 - RNA, 13 nt, Pseudomonas putida KT2440
auaggugguguug

SEQ ID NO: 3545993 - RNA, 18 nt, Pseudomonas putida KT2440
auaggugucgaacaccac

SEQ ID NO: 3545994 - RNA, 15 nt, Pseudomonas putida KT2440
auagguuauccacac

SEQ ID NO: 3545995 - RNA, 20 nt, Pseudomonas putida KT2440
auaguagaagcagaucauca

SEQ ID NO: 3545996 - RNA, 24 nt, Pseudomonas putida KT2440
auagucccugauacuucugaccaa

SEQ ID NO: 3545997 - RNA, 14 nt, Pseudomonas putida KT2440
auagucgaaggcuu

SEQ ID NO: 3545998 - RNA, 17 nt, Pseudomonas putida KT2440
auagucgauacccaggc

SEQ ID NO: 3545999 - RNA, 17 nt, Pseudomonas putida KT2440
auaguggcuagccucau

SEQ ID NO: 3546000 - RNA, 15 nt, Pseudomonas putida KT2440
auaguugaccagcac

SEQ ID NO: 3546001 - RNA, 18 nt, Pseudomonas putida KT2440
aucagauaggcgccgugc

SEQ ID NO: 3546002 - RNA, 17 nt, Pseudomonas putida KT2440
aucagcaacccggccag

SEQ ID NO: 3546003 - RNA, 18 nt, Pseudomonas putida KT2440
aucagcaacccggccagg

SEQ ID NO: 3546004 - RNA, 19 nt, Pseudomonas putida KT2440
aucagcaacccggccaggc

SEQ ID NO: 3546005 - RNA, 16 nt, Pseudomonas putida KT2440
aucagcaaccugcugg

SEQ ID NO: 3546006 - RNA, 22 nt, Pseudomonas putida KT2440
aucagcaaugaugaaagcaggu

SEQ ID NO: 3546007 - RNA, 17 nt, Pseudomonas putida KT2440
aucagcacacccagcac

SEQ ID NO: 3546008 - RNA, 20 nt, Pseudomonas putida KT2440
aucagcacacgcccgugcuc

SEQ ID NO: 3546009 - RNA, 16 nt, Pseudomonas putida KT2440
aucagcacgccgccga

SEQ ID NO: 3546010 - RNA, 18 nt, Pseudomonas putida KT2440
aucagcacgcgaucggca

SEQ ID NO: 3546011 - RNA, 13 nt, Pseudomonas putida KT2440
aucagcagcugcc

SEQ ID NO: 3546012 - RNA, 18 nt, Pseudomonas putida KT2440
aucagcagcugccggaac

SEQ ID NO: 3546013 - RNA, 17 nt, Pseudomonas putida KT2440
aucagcagcuguugcug

SEQ ID NO: 3546014 - RNA, 16 nt, Pseudomonas putida KT2440
aucagcaggucggcgu

SEQ ID NO: 3546015 - RNA, 18 nt, Pseudomonas putida KT2440
aucagcaggucggcguca

SEQ ID NO: 3546016 - RNA, 17 nt, Pseudomonas putida KT2440
aucagcaugcccagcgc

SEQ ID NO: 3546017 - RNA, 22 nt, Pseudomonas putida KT2440
aucagcaugcccagcgccaccg

SEQ ID NO: 3546018 - RNA, 16 nt, Pseudomonas putida KT2440
aucagccaacacccuc

SEQ ID NO: 3546019 - RNA, 18 nt, Pseudomonas putida KT2440
aucagccaacacccucac

SEQ ID NO: 3546020 - RNA, 21 nt, Pseudomonas putida KT2440
aucagccagauaccgccuaug

SEQ ID NO: 3546021 - RNA, 22 nt, Pseudomonas putida KT2440
aucagccagccuucgccaacug

SEQ ID NO: 3546022 - RNA, 21 nt, Pseudomonas putida KT2440
aucagccgcgccauuggccgc

SEQ ID NO: 3546023 - RNA, 21 nt, Pseudomonas putida KT2440
aucagccggucucccagcgcu

SEQ ID NO: 3546024 - RNA, 20 nt, Pseudomonas putida KT2440
aucagccgugacaguucgug

SEQ ID NO: 3546025 - RNA, 12 nt, Pseudomonas putida KT2440
aucagcgacacc

SEQ ID NO: 3546026 - RNA, 13 nt, Pseudomonas putida KT2440
aucagcgacacca

SEQ ID NO: 3546027 - RNA, 14 nt, Pseudomonas putida KT2440
aucagcgcacccuu

SEQ ID NO: 3546028 - RNA, 16 nt, Pseudomonas putida KT2440
aucagcgcagcaucuu

SEQ ID NO: 3546029 - RNA, 14 nt, Pseudomonas putida KT2440
aucagcgccagcac

SEQ ID NO: 3546030 - RNA, 18 nt, Pseudomonas putida KT2440
aucagcgccagcacgcag

SEQ ID NO: 3546031 - RNA, 14 nt, Pseudomonas putida KT2440
aucagcgccucgcc

SEQ ID NO: 3546032 - RNA, 18 nt, Pseudomonas putida KT2440
aucagcgccugcucaucc

SEQ ID NO: 3546033 - RNA, 18 nt, Pseudomonas putida KT2440
aucagcgcggugaccagc

SEQ ID NO: 3546034 - RNA, 21 nt, Pseudomonas putida KT2440
aucagcgcggugaccagcggc

SEQ ID NO: 3546035 - RNA, 23 nt, Pseudomonas putida KT2440
aucagcgcggugaccagcggcag

SEQ ID NO: 3546036 - RNA, 18 nt, Pseudomonas putida KT2440
aucagcgcguccagcaac

SEQ ID NO: 3546037 - RNA, 20 nt, Pseudomonas putida KT2440
aucagcgcguccagcaacag

SEQ ID NO: 3546038 - RNA, 22 nt, Pseudomonas putida KT2440
aucagcgcguccagcaacagcu

SEQ ID NO: 3546039 - RNA, 16 nt, Pseudomonas putida KT2440
aucagcggcaggcugg

SEQ ID NO: 3546040 - RNA, 16 nt, Pseudomonas putida KT2440
aucagcggcgccaccc

SEQ ID NO: 3546041 - RNA, 20 nt, Pseudomonas putida KT2440
aucagcggcgccacccagaa

SEQ ID NO: 3546042 - RNA, 21 nt, Pseudomonas putida KT2440
aucagcggcuuguucagcugg

SEQ ID NO: 3546043 - RNA, 23 nt, Pseudomonas putida KT2440
aucagcggcuuguucagcuggug

SEQ ID NO: 3546044 - RNA, 17 nt, Pseudomonas putida KT2440
aucagcucacaggcuca

SEQ ID NO: 3546045 - RNA, 17 nt, Pseudomonas putida KT2440
aucagcucauacgggug

SEQ ID NO: 3546046 - RNA, 21 nt, Pseudomonas putida KT2440
aucagcucauagaaauggcuu

SEQ ID NO: 3546047 - RNA, 14 nt, Pseudomonas putida KT2440
aucagcucggaaag

SEQ ID NO: 3546048 - RNA, 13 nt, Pseudomonas putida KT2440
aucagcuggucga

SEQ ID NO: 3546049 - RNA, 20 nt, Pseudomonas putida KT2440
aucagcuuaacgcuuggcca

SEQ ID NO: 3546050 - RNA, 13 nt, Pseudomonas putida KT2440
aucagcuucugcu

SEQ ID NO: 3546051 - RNA, 23 nt, Pseudomonas putida KT2440
aucaggaacagcucgauggccag

SEQ ID NO: 3546052 - RNA, 20 nt, Pseudomonas putida KT2440
aucaggaaggcaccacggaa

SEQ ID NO: 3546053 - RNA, 19 nt, Pseudomonas putida KT2440
aucaggauugccgcagcug

SEQ ID NO: 3546054 - RNA, 21 nt, Pseudomonas putida KT2440
aucaggauugccgcagcugcg

SEQ ID NO: 3546055 - RNA, 14 nt, Pseudomonas putida KT2440
aucaggcacaggcc

SEQ ID NO: 3546056 - RNA, 18 nt, Pseudomonas putida KT2440
aucaggcaugccagcagc

SEQ ID NO: 3546057 - RNA, 19 nt, Pseudomonas putida KT2440
aucaggcaugccagcagcu

SEQ ID NO: 3546058 - RNA, 19 nt, Pseudomonas putida KT2440
aucaggccgaugccaagca

SEQ ID NO: 3546059 - RNA, 17 nt, Pseudomonas putida KT2440
aucaggcgauucaggcu

SEQ ID NO: 3546060 - RNA, 20 nt, Pseudomonas putida KT2440
aucaggcucuguuccauuuc

SEQ ID NO: 3546061 - RNA, 17 nt, Pseudomonas putida KT2440
aucaggcugaucaccgc

SEQ ID NO: 3546062 - RNA, 22 nt, Pseudomonas putida KT2440
aucaggcugaucaccgccgcca

SEQ ID NO: 3546063 - RNA, 22 nt, Pseudomonas putida KT2440
aucaggcuggcgacgccacccc

SEQ ID NO: 3546064 - RNA, 22 nt, Pseudomonas putida KT2440
aucagggauacugcugaaccug

SEQ ID NO: 3546065 - RNA, 22 nt, Pseudomonas putida KT2440
aucaggggccgcgcagcggccc

SEQ ID NO: 3546066 - RNA, 20 nt, Pseudomonas putida KT2440
aucagggucagggccaggcc

SEQ ID NO: 3546067 - RNA, 20 nt, Pseudomonas putida KT2440
aucaggguuugcagcucacc

SEQ ID NO: 3546068 - RNA, 18 nt, Pseudomonas putida KT2440
aucagguaauccggcaug

SEQ ID NO: 3546069 - RNA, 24 nt, Pseudomonas putida KT2440
aucaggucggcggccucgguccac

SEQ ID NO: 3546070 - RNA, 15 nt, Pseudomonas putida KT2440
aucaggugcaggagc

SEQ ID NO: 3546071 - RNA, 13 nt, Pseudomonas putida KT2440
aucagguggauca

SEQ ID NO: 3546072 - RNA, 16 nt, Pseudomonas putida KT2440
aucagguggaucagcc

SEQ ID NO: 3546073 - RNA, 20 nt, Pseudomonas putida KT2440
aucagguugagcaccgggca

SEQ ID NO: 3546074 - RNA, 20 nt, Pseudomonas putida KT2440
aucagguugcccagcaugcg

SEQ ID NO: 3546075 - RNA, 18 nt, Pseudomonas putida KT2440
aucagguugcccgcaugc

SEQ ID NO: 3546076 - RNA, 16 nt, Pseudomonas putida KT2440
aucaguaaguugaaug

SEQ ID NO: 3546077 - RNA, 13 nt, Pseudomonas putida KT2440
aucaguaccaggc

SEQ ID NO: 3546078 - RNA, 21 nt, Pseudomonas putida KT2440
aucaguacgaugcugcgggcg

SEQ ID NO: 3546079 - RNA, 24 nt, Pseudomonas putida KT2440
aucagugaccgguuuuggcaggcc

SEQ ID NO: 3546080 - RNA, 23 nt, Pseudomonas putida KT2440
aucagugcaggugcacuguugcu

SEQ ID NO: 3546081 - RNA, 17 nt, Pseudomonas putida KT2440
aucagugcccccgccac

SEQ ID NO: 3546082 - RNA, 17 nt, Pseudomonas putida KT2440
aucagugucugcgccug

SEQ ID NO: 3546083 - RNA, 17 nt, Pseudomonas putida KT2440
aucauaucgaaccagca

SEQ ID NO: 3546084 - RNA, 14 nt, Pseudomonas putida KT2440
aucaucaacgccgc

SEQ ID NO: 3546085 - RNA, 13 nt, Pseudomonas putida KT2440
aucaucacgcgca

SEQ ID NO: 3546086 - RNA, 22 nt, Pseudomonas putida KT2440
aucaucagcgccgguagcggcu

SEQ ID NO: 3546087 - RNA, 17 nt, Pseudomonas putida KT2440
aucaucaucggcaugca

SEQ ID NO: 3546088 - RNA, 17 nt, Pseudomonas putida KT2440
aucaucaucuucgaggu

SEQ ID NO: 3546089 - RNA, 13 nt, Pseudomonas putida KT2440
aucaucaugccca

SEQ ID NO: 3546090 - RNA, 19 nt, Pseudomonas putida KT2440
aucauccacaaucagcacu

SEQ ID NO: 3546091 - RNA, 20 nt, Pseudomonas putida KT2440
aucauccugcuggcccgcga

SEQ ID NO: 3546092 - RNA, 21 nt, Pseudomonas putida KT2440
aucaucgccaccggcauuccc

SEQ ID NO: 3546093 - RNA, 15 nt, Pseudomonas putida KT2440
aucaucggcacgccc

SEQ ID NO: 3546094 - RNA, 21 nt, Pseudomonas putida KT2440
aucaucggcacgcccagcaac

SEQ ID NO: 3546095 - RNA, 22 nt, Pseudomonas putida KT2440
aucaucggcacgcccagcaacu

SEQ ID NO: 3546096 - RNA, 14 nt, Pseudomonas putida KT2440
aucaucucgcgaug

SEQ ID NO: 3546097 - RNA, 21 nt, Pseudomonas putida KT2440
aucaugaacgaggacugcacc

SEQ ID NO: 3546098 - RNA, 15 nt, Pseudomonas putida KT2440
aucaugcuggccagg

SEQ ID NO: 3546099 - RNA, 12 nt, Pseudomonas putida KT2440
aucaugguguuc

SEQ ID NO: 3546100 - RNA, 17 nt, Pseudomonas putida KT2440
aucauucaggcacggca

SEQ ID NO: 3546101 - RNA, 16 nt, Pseudomonas putida KT2440
aucauuucaucgccaa

SEQ ID NO: 3546102 - RNA, 14 nt, Pseudomonas putida KT2440
auccaacgcugccu

SEQ ID NO: 3546103 - RNA, 15 nt, Pseudomonas putida KT2440
auccacaaucagcac

SEQ ID NO: 3546104 - RNA, 17 nt, Pseudomonas putida KT2440
auccacacccucguccc

SEQ ID NO: 3546105 - RNA, 21 nt, Pseudomonas putida KT2440
auccuuggcgaaggcugccug

SEQ ID NO: 3546106 - RNA, 22 nt, Pseudomonas putida KT2440
auccuuggugcaugcaagcagc

SEQ ID NO: 3546107 - RNA, 22 nt, Pseudomonas putida KT2440
aucgaaagcugcgcacauugac

SEQ ID NO: 3546108 - RNA, 15 nt, Pseudomonas putida KT2440
aucgaaaucagccuu

SEQ ID NO: 3546109 - RNA, 19 nt, Pseudomonas putida KT2440
aucgaacaguuugcuuuuu

SEQ ID NO: 3546110 - RNA, 18 nt, Pseudomonas putida KT2440
aucgaaccagcagcaccu

SEQ ID NO: 3546111 - RNA, 20 nt, Pseudomonas putida KT2440
aucgaaccagcagcaccugc

SEQ ID NO: 3546112 - RNA, 15 nt, Pseudomonas putida KT2440
aucgaagcagcagcu

SEQ ID NO: 3546113 - RNA, 22 nt, Pseudomonas putida KT2440
aucgaagcagcagcuugcagcg

SEQ ID NO: 3546114 - RNA, 17 nt, Pseudomonas putida KT2440
aucgaagcaggccgguu

SEQ ID NO: 3546115 - RNA, 22 nt, Pseudomonas putida KT2440
aucgaagccaguacgcaggcau

SEQ ID NO: 3546116 - RNA, 16 nt, Pseudomonas putida KT2440
aucgaauagcccaccu

SEQ ID NO: 3546117 - RNA, 20 nt, Pseudomonas putida KT2440
aucgacaacauggucacaug

SEQ ID NO: 3546118 - RNA, 18 nt, Pseudomonas putida KT2440
aucgacaaccccagcccg

SEQ ID NO: 3546119 - RNA, 20 nt, Pseudomonas putida KT2440
aucgacaaccccagcccgaa

SEQ ID NO: 3546120 - RNA, 15 nt, Pseudomonas putida KT2440
aucgacaaucggcuc

SEQ ID NO: 3546121 - RNA, 13 nt, Pseudomonas putida KT2440
aucgaccugcagg

SEQ ID NO: 3546122 - RNA, 12 nt, Pseudomonas putida KT2440
aucgacgcaaug

SEQ ID NO: 3546123 - RNA, 17 nt, Pseudomonas putida KT2440
aucgacucaaggauguc

SEQ ID NO: 3546124 - RNA, 16 nt, Pseudomonas putida KT2440
aucgacuucaaugccc

SEQ ID NO: 3546125 - RNA, 13 nt, Pseudomonas putida KT2440
aucgagccacuga

SEQ ID NO: 3546126 - RNA, 18 nt, Pseudomonas putida KT2440
aucgagccggucacgauc

SEQ ID NO: 3546127 - RNA, 15 nt, Pseudomonas putida KT2440
aucgaggaaagggca

SEQ ID NO: 3546128 - RNA, 14 nt, Pseudomonas putida KT2440
aucgaggaaggcau

SEQ ID NO: 3546129 - RNA, 15 nt, Pseudomonas putida KT2440
aucgaggaaggcauc

SEQ ID NO: 3546130 - RNA, 22 nt, Pseudomonas putida KT2440
aucgauggucuucgccgccaug

SEQ ID NO: 3546131 - RNA, 18 nt, Pseudomonas putida KT2440
aucgauguacucgaacag

SEQ ID NO: 3546132 - RNA, 22 nt, Pseudomonas putida KT2440
aucgcaagcuggcgcaagccgu

SEQ ID NO: 3546133 - RNA, 15 nt, Pseudomonas putida KT2440
aucgcaauccccucc

SEQ ID NO: 3546134 - RNA, 22 nt, Pseudomonas putida KT2440
aucgcaccacguccggccagca

SEQ ID NO: 3546135 - RNA, 18 nt, Pseudomonas putida KT2440
aucgcagaaggccccguc

SEQ ID NO: 3546136 - RNA, 21 nt, Pseudomonas putida KT2440
aucgcagggucgcgccccaag

SEQ ID NO: 3546137 - RNA, 22 nt, Pseudomonas putida KT2440
aucgcagggucgcgccccaagc

SEQ ID NO: 3546138 - RNA, 14 nt, Pseudomonas putida KT2440
aucgcauacagcgc

SEQ ID NO: 3546139 - RNA, 16 nt, Pseudomonas putida KT2440
aucgcauucgccggca

SEQ ID NO: 3546140 - RNA, 19 nt, Pseudomonas putida KT2440
aucgccaaccccaacccgg

SEQ ID NO: 3546141 - RNA, 21 nt, Pseudomonas putida KT2440
aucgccaaccccaacccgguc

SEQ ID NO: 3546142 - RNA, 16 nt, Pseudomonas putida KT2440
aucgccacaacggcgc

SEQ ID NO: 3546143 - RNA, 23 nt, Pseudomonas putida KT2440
aucgccacaacggcgcgcccggc

SEQ ID NO: 3546144 - RNA, 13 nt, Pseudomonas putida KT2440
aucgccagcccca

SEQ ID NO: 3546145 - RNA, 14 nt, Pseudomonas putida KT2440
aucgccagccccag

SEQ ID NO: 3546146 - RNA, 16 nt, Pseudomonas putida KT2440
aucgccagccccagcc

SEQ ID NO: 3546147 - RNA, 20 nt, Pseudomonas putida KT2440
aucgccagccccagcccggu

SEQ ID NO: 3546148 - RNA, 21 nt, Pseudomonas putida KT2440
aucgccagccccagcccggug

SEQ ID NO: 3546149 - RNA, 11 nt, Pseudomonas putida KT2440
aucgccaggcc

SEQ ID NO: 3546150 - RNA, 11 nt, Pseudomonas putida KT2440
aucgccaggug

SEQ ID NO: 3546151 - RNA, 17 nt, Pseudomonas putida KT2440
aucgccaggugcucagc

SEQ ID NO: 3546152 - RNA, 22 nt, Pseudomonas putida KT2440
aucgccagguggaagcgcgcau

SEQ ID NO: 3546153 - RNA, 16 nt, Pseudomonas putida KT2440
aucgcccccgcugcac

SEQ ID NO: 3546154 - RNA, 21 nt, Pseudomonas putida KT2440
aucgccgcaucguuauccagc

SEQ ID NO: 3546155 - RNA, 20 nt, Pseudomonas putida KT2440
aucgccgcgcugauaucgau

SEQ ID NO: 3546156 - RNA, 14 nt, Pseudomonas putida KT2440
aucgccgucgacca

SEQ ID NO: 3546157 - RNA, 16 nt, Pseudomonas putida KT2440
aucgccuccagcgcau

SEQ ID NO: 3546158 - RNA, 13 nt, Pseudomonas putida KT2440
aucgccuccaggc

SEQ ID NO: 3546159 - RNA, 12 nt, Pseudomonas putida KT2440
aucgccucgauc

SEQ ID NO: 3546160 - RNA, 14 nt, Pseudomonas putida KT2440
aucgccucgcuggc

SEQ ID NO: 3546161 - RNA, 16 nt, Pseudomonas putida KT2440
aucgccucggcacugc

SEQ ID NO: 3546162 - RNA, 17 nt, Pseudomonas putida KT2440
aucgccucggcacugca

SEQ ID NO: 3546163 - RNA, 20 nt, Pseudomonas putida KT2440
aucgccugcuuggccgacug

SEQ ID NO: 3546164 - RNA, 19 nt, Pseudomonas putida KT2440
aucgccuucagcgccccau

SEQ ID NO: 3546165 - RNA, 22 nt, Pseudomonas putida KT2440
aucgcgaaacgcggcaaccugc

SEQ ID NO: 3546166 - RNA, 22 nt, Pseudomonas putida KT2440
aucgcgacggucauaccucgac

SEQ ID NO: 3546167 - RNA, 19 nt, Pseudomonas putida KT2440
aucgcgcaagccuuugcgc

SEQ ID NO: 3546168 - RNA, 15 nt, Pseudomonas putida KT2440
aucgcgcacuugcca

SEQ ID NO: 3546169 - RNA, 16 nt, Pseudomonas putida KT2440
aucgcgcacuugccag

SEQ ID NO: 3546170 - RNA, 19 nt, Pseudomonas putida KT2440
aucgcgcacuugccagccg

SEQ ID NO: 3546171 - RNA, 13 nt, Pseudomonas putida KT2440
aucgcgcccggug

SEQ ID NO: 3546172 - RNA, 20 nt, Pseudomonas putida KT2440
aucgcgguauccaucaccau

SEQ ID NO: 3546173 - RNA, 23 nt, Pseudomonas putida KT2440
aucgcucaccguucuucuccaac

SEQ ID NO: 3546174 - RNA, 17 nt, Pseudomonas putida KT2440
aucgcucaugccccgca

SEQ ID NO: 3546175 - RNA, 15 nt, Pseudomonas putida KT2440
aucgcucuggcacuc

SEQ ID NO: 3546176 - RNA, 19 nt, Pseudomonas putida KT2440
aucgcugacuuccagcagc

SEQ ID NO: 3546177 - RNA, 13 nt, Pseudomonas putida KT2440
aucgcugcgcaug

SEQ ID NO: 3546178 - RNA, 19 nt, Pseudomonas putida KT2440
aucgcugcggccgucggua

SEQ ID NO: 3546179 - RNA, 23 nt, Pseudomonas putida KT2440
aucgcugcggccgucgguaaaca

SEQ ID NO: 3546180 - RNA, 21 nt, Pseudomonas putida KT2440
aucgcuguccuuggccaacug

SEQ ID NO: 3546181 - RNA, 22 nt, Pseudomonas putida KT2440
aucgcuguccuuggccaacugc

SEQ ID NO: 3546182 - RNA, 13 nt, Pseudomonas putida KT2440
aucgcuuacagau

SEQ ID NO: 3546183 - RNA, 16 nt, Pseudomonas putida KT2440
aucgcuuacagauguc

SEQ ID NO: 3546184 - RNA, 21 nt, Pseudomonas putida KT2440
aucggcaaacacauccagcgc

SEQ ID NO: 3546185 - RNA, 23 nt, Pseudomonas putida KT2440
aucggcacacgguuuccaggcgu

SEQ ID NO: 3546186 - RNA, 18 nt, Pseudomonas putida KT2440
aucggcacgccagcagcg

SEQ ID NO: 3546187 - RNA, 16 nt, Pseudomonas putida KT2440
aucggcacgcccagca

SEQ ID NO: 3546188 - RNA, 17 nt, Pseudomonas putida KT2440
aucggcaggccggccac

SEQ ID NO: 3546189 - RNA, 22 nt, Pseudomonas putida KT2440
aucggcaggcgguccagcaagc

SEQ ID NO: 3546190 - RNA, 14 nt, Pseudomonas putida KT2440
aucggcaugcagcg

SEQ ID NO: 3546191 - RNA, 20 nt, Pseudomonas putida KT2440
aucggcaugcagcggccagu

SEQ ID NO: 3546192 - RNA, 11 nt, Pseudomonas putida KT2440
aucggccaccg

SEQ ID NO: 3546193 - RNA, 14 nt, Pseudomonas putida KT2440
aucggccagcaaac

SEQ ID NO: 3546194 - RNA, 12 nt, Pseudomonas putida KT2440
aucggccagccg

SEQ ID NO: 3546195 - RNA, 20 nt, Pseudomonas putida KT2440
aucggccaggaaaagguugc

SEQ ID NO: 3546196 - RNA, 17 nt, Pseudomonas putida KT2440
aucggccgccagaucau

SEQ ID NO: 3546197 - RNA, 20 nt, Pseudomonas putida KT2440
aucggccucuucgcggguaa

SEQ ID NO: 3546198 - RNA, 13 nt, Pseudomonas putida KT2440
aucggccuggggc

SEQ ID NO: 3546199 - RNA, 23 nt, Pseudomonas putida KT2440
aucggccuguggguaacccugcu

SEQ ID NO: 3546200 - RNA, 19 nt, Pseudomonas putida KT2440
aucggccuugcgcugggca

SEQ ID NO: 3546201 - RNA, 14 nt, Pseudomonas putida KT2440
aucggcgccccgca

SEQ ID NO: 3546202 - RNA, 16 nt, Pseudomonas putida KT2440
aucggcgccggccgca

SEQ ID NO: 3546203 - RNA, 22 nt, Pseudomonas putida KT2440
aucggcggcagcacgaucucgu

SEQ ID NO: 3546204 - RNA, 19 nt, Pseudomonas putida KT2440
aucggcguugcggugcaga

SEQ ID NO: 3546205 - RNA, 20 nt, Pseudomonas putida KT2440
aucggcuccaggcacaggcg

SEQ ID NO: 3546206 - RNA, 19 nt, Pseudomonas putida KT2440
aucggcuuucauugaguug

SEQ ID NO: 3546207 - RNA, 15 nt, Pseudomonas putida KT2440
aucgggaucaugccg

SEQ ID NO: 3546208 - RNA, 21 nt, Pseudomonas putida KT2440
aucgggauguucaggucgcgc

SEQ ID NO: 3546209 - RNA, 16 nt, Pseudomonas putida KT2440
aucgggauuacaugau

SEQ ID NO: 3546210 - RNA, 12 nt, Pseudomonas putida KT2440
aucuucuugccg

SEQ ID NO: 3546211 - RNA, 15 nt, Pseudomonas putida KT2440
aucuugcgcgccagc

SEQ ID NO: 3546212 - RNA, 22 nt, Pseudomonas putida KT2440
aucuugcgcgccagcgcaugca

SEQ ID NO: 3546213 - RNA, 14 nt, Pseudomonas putida KT2440
aucuugcugcucug

SEQ ID NO: 3546214 - RNA, 14 nt, Pseudomonas putida KT2440
aucuugcuggccgg

SEQ ID NO: 3546215 - RNA, 12 nt, Pseudomonas putida KT2440
aucuuggccagg

SEQ ID NO: 3546216 - RNA, 13 nt, Pseudomonas putida KT2440
aucuuggccaggg

SEQ ID NO: 3546217 - RNA, 19 nt, Pseudomonas putida KT2440
aucuugggcaaggccguug

SEQ ID NO: 3546218 - RNA, 15 nt, Pseudomonas putida KT2440
aucuuguauuggcca

SEQ ID NO: 3546219 - RNA, 22 nt, Pseudomonas putida KT2440
aucuuguguuuugccuccagcu

SEQ ID NO: 3546220 - RNA, 19 nt, Pseudomonas putida KT2440
aucuuguuggucaggccau

SEQ ID NO: 3546221 - RNA, 16 nt, Pseudomonas putida KT2440
aucuuuccggagaugu

SEQ ID NO: 3546222 - RNA, 14 nt, Pseudomonas putida KT2440
augaaaaacaacaa

SEQ ID NO: 3546223 - RNA, 17 nt, Pseudomonas putida KT2440
augaaaaagccccgcca

SEQ ID NO: 3546224 - RNA, 21 nt, Pseudomonas putida KT2440
augaaaccgagcgccgcgcgg

SEQ ID NO: 3546225 - RNA, 15 nt, Pseudomonas putida KT2440
augaaauccaccagc

SEQ ID NO: 3546226 - RNA, 16 nt, Pseudomonas putida KT2440
augaacaccaccgcga

SEQ ID NO: 3546227 - RNA, 12 nt, Pseudomonas putida KT2440
augaacagcacg

SEQ ID NO: 3546228 - RNA, 13 nt, Pseudomonas putida KT2440
augaacagccggc

SEQ ID NO: 3546229 - RNA, 16 nt, Pseudomonas putida KT2440
augaacagcgcccaga

SEQ ID NO: 3546230 - RNA, 13 nt, Pseudomonas putida KT2440
augaacagcgcug

SEQ ID NO: 3546231 - RNA, 12 nt, Pseudomonas putida KT2440
augaacccgcga

SEQ ID NO: 3546232 - RNA, 22 nt, Pseudomonas putida KT2440
augaacgaaaacgaaacgccag

SEQ ID NO: 3546233 - RNA, 14 nt, Pseudomonas putida KT2440
augaacuggaugau

SEQ ID NO: 3546234 - RNA, 14 nt, Pseudomonas putida KT2440
augaagccaugggc

SEQ ID NO: 3546235 - RNA, 17 nt, Pseudomonas putida KT2440
augaaggacaucaccag

SEQ ID NO: 3546236 - RNA, 14 nt, Pseudomonas putida KT2440
augaaggcccagcu

SEQ ID NO: 3546237 - RNA, 18 nt, Pseudomonas putida KT2440
augaaggcggggagcgaa

SEQ ID NO: 3546238 - RNA, 20 nt, Pseudomonas putida KT2440
augaaggcggggagcgaacu

SEQ ID NO: 3546239 - RNA, 13 nt, Pseudomonas putida KT2440
augaagucagcca

SEQ ID NO: 3546240 - RNA, 22 nt, Pseudomonas putida KT2440
augaauaaccugguuauuuuuu

SEQ ID NO: 3546241 - RNA, 12 nt, Pseudomonas putida KT2440
augaauaaugcu

SEQ ID NO: 3546242 - RNA, 20 nt, Pseudomonas putida KT2440
augaauaaugcuccagcgaa

SEQ ID NO: 3546243 - RNA, 22 nt, Pseudomonas putida KT2440
augacaaacgccagcaugcugg

SEQ ID NO: 3546244 - RNA, 23 nt, Pseudomonas putida KT2440
augacaauugucgguacuggcua

SEQ ID NO: 3546245 - RNA, 15 nt, Pseudomonas putida KT2440
augaccaagcaacgc

SEQ ID NO: 3546246 - RNA, 15 nt, Pseudomonas putida KT2440
augaccggccgggcu

SEQ ID NO: 3546247 - RNA, 22 nt, Pseudomonas putida KT2440
augaccguccacguuggucucg

SEQ ID NO: 3546248 - RNA, 23 nt, Pseudomonas putida KT2440
augacuguuaaucauuggguccc

SEQ ID NO: 3546249 - RNA, 14 nt, Pseudomonas putida KT2440
augagccggggcuu

SEQ ID NO: 3546250 - RNA, 19 nt, Pseudomonas putida KT2440
augagccuacagcaaccgc

SEQ ID NO: 3546251 - RNA, 12 nt, Pseudomonas putida KT2440
augagccuucac

SEQ ID NO: 3546252 - RNA, 15 nt, Pseudomonas putida KT2440
augagccuucacugu

SEQ ID NO: 3546253 - RNA, 13 nt, Pseudomonas putida KT2440
augaggcccuccc

SEQ ID NO: 3546254 - RNA, 18 nt, Pseudomonas putida KT2440
augaggcgaugcagggcu

SEQ ID NO: 3546255 - RNA, 18 nt, Pseudomonas putida KT2440
augagggugaccuuuucu

SEQ ID NO: 3546256 - RNA, 16 nt, Pseudomonas putida KT2440
augaguaaagccgauc

SEQ ID NO: 3546257 - RNA, 15 nt, Pseudomonas putida KT2440
augagugagcuaaac

SEQ ID NO: 3546258 - RNA, 13 nt, Pseudomonas putida KT2440
augagugcaggca

SEQ ID NO: 3546259 - RNA, 21 nt, Pseudomonas putida KT2440
augaguuccguugcuacugcu

SEQ ID NO: 3546260 - RNA, 15 nt, Pseudomonas putida KT2440
augauacggggaggc

SEQ ID NO: 3546261 - RNA, 18 nt, Pseudomonas putida KT2440
augauauccauguagcac

SEQ ID NO: 3546262 - RNA, 23 nt, Pseudomonas putida KT2440
augaucaauaucaucacugccac

SEQ ID NO: 3546263 - RNA, 16 nt, Pseudomonas putida KT2440
augaucaggccgcuca

SEQ ID NO: 3546264 - RNA, 21 nt, Pseudomonas putida KT2440
augaucgaagcgacagcggcc

SEQ ID NO: 3546265 - RNA, 22 nt, Pseudomonas putida KT2440
augaucgaagcgacagcggcca

SEQ ID NO: 3546266 - RNA, 23 nt, Pseudomonas putida KT2440
augaucgaaugguuuucggcggu

SEQ ID NO: 3546267 - RNA, 18 nt, Pseudomonas putida KT2440
augaucgagcgcaccugg

SEQ ID NO: 3546268 - RNA, 14 nt, Pseudomonas putida KT2440
augaucgccuggcc

SEQ ID NO: 3546269 - RNA, 22 nt, Pseudomonas putida KT2440
augaucgccuggccggccgggc

SEQ ID NO: 3546270 - RNA, 12 nt, Pseudomonas putida KT2440
augaucgcgcuu

SEQ ID NO: 3546271 - RNA, 23 nt, Pseudomonas putida KT2440
augaucgcggcguugucagccuu

SEQ ID NO: 3546272 - RNA, 16 nt, Pseudomonas putida KT2440
augaucgcuucggcgc

SEQ ID NO: 3546273 - RNA, 17 nt, Pseudomonas putida KT2440
augaucggguucuucca

SEQ ID NO: 3546274 - RNA, 14 nt, Pseudomonas putida KT2440
augaugaaagcagg

SEQ ID NO: 3546275 - RNA, 19 nt, Pseudomonas putida KT2440
augaugauaccgaacagca

SEQ ID NO: 3546276 - RNA, 18 nt, Pseudomonas putida KT2440
augaugaucaauaucauc

SEQ ID NO: 3546277 - RNA, 19 nt, Pseudomonas putida KT2440
augaugaucaauaucauca

SEQ ID NO: 3546278 - RNA, 15 nt, Pseudomonas putida KT2440
augaugcuauggcuu

SEQ ID NO: 3546279 - RNA, 20 nt, Pseudomonas putida KT2440
augauggccguugcugcgcg

SEQ ID NO: 3546280 - RNA, 14 nt, Pseudomonas putida KT2440
augauguggcuggu

SEQ ID NO: 3546281 - RNA, 13 nt, Pseudomonas putida KT2440
augauuucagggu

SEQ ID NO: 3546282 - RNA, 12 nt, Pseudomonas putida KT2440
augcaacccgca

SEQ ID NO: 3546283 - RNA, 17 nt, Pseudomonas putida KT2440
augcaaccgaugcccag

SEQ ID NO: 3546284 - RNA, 12 nt, Pseudomonas putida KT2440
augcaagcagcc

SEQ ID NO: 3546285 - RNA, 13 nt, Pseudomonas putida KT2440
augcaagcagcca

SEQ ID NO: 3546286 - RNA, 15 nt, Pseudomonas putida KT2440
augcacagcgcucga

SEQ ID NO: 3546287 - RNA, 18 nt, Pseudomonas putida KT2440
augcacagcucgcgcugc

SEQ ID NO: 3546288 - RNA, 22 nt, Pseudomonas putida KT2440
augcacagcucgcgcugccagg

SEQ ID NO: 3546289 - RNA, 23 nt, Pseudomonas putida KT2440
augcacagcucgcgcugccaggc

SEQ ID NO: 3546290 - RNA, 15 nt, Pseudomonas putida KT2440
augcaccacgcgcaa

SEQ ID NO: 3546291 - RNA, 18 nt, Pseudomonas putida KT2440
augcaccacgcgcaaaug

SEQ ID NO: 3546292 - RNA, 21 nt, Pseudomonas putida KT2440
augcaccacgcgcaaaugcuu

SEQ ID NO: 3546293 - RNA, 15 nt, Pseudomonas putida KT2440
augcacgcagcaauu

SEQ ID NO: 3546294 - RNA, 15 nt, Pseudomonas putida KT2440
augcacgccacgccc

SEQ ID NO: 3546295 - RNA, 21 nt, Pseudomonas putida KT2440
augcacucgccgauaaagcgu

SEQ ID NO: 3546296 - RNA, 14 nt, Pseudomonas putida KT2440
augcacugccugca

SEQ ID NO: 3546297 - RNA, 16 nt, Pseudomonas putida KT2440
augcacuuccaggaag

SEQ ID NO: 3546298 - RNA, 14 nt, Pseudomonas putida KT2440
augcagcaagcugg

SEQ ID NO: 3546299 - RNA, 17 nt, Pseudomonas putida KT2440
augcagcagugccagca

SEQ ID NO: 3546300 - RNA, 19 nt, Pseudomonas putida KT2440
augcagcagugccagcaac

SEQ ID NO: 3546301 - RNA, 22 nt, Pseudomonas putida KT2440
augcagcagugccagcaacaag

SEQ ID NO: 3546302 - RNA, 13 nt, Pseudomonas putida KT2440
augcagcggccag

SEQ ID NO: 3546303 - RNA, 15 nt, Pseudomonas putida KT2440
augcagcggccagua

SEQ ID NO: 3546304 - RNA, 19 nt, Pseudomonas putida KT2440
augcagcgucggcagagcg

SEQ ID NO: 3546305 - RNA, 20 nt, Pseudomonas putida KT2440
augcagcguggccuucucuu

SEQ ID NO: 3546306 - RNA, 22 nt, Pseudomonas putida KT2440
augcaggcaguaggccaccguu

SEQ ID NO: 3546307 - RNA, 20 nt, Pseudomonas putida KT2440
augcaggucaucgaacaccu

SEQ ID NO: 3546308 - RNA, 15 nt, Pseudomonas putida KT2440
augcaggucgaccug

SEQ ID NO: 3546309 - RNA, 19 nt, Pseudomonas putida KT2440
augcaggucgaccugccag

SEQ ID NO: 3546310 - RNA, 17 nt, Pseudomonas putida KT2440
augcagguucgaccaga

SEQ ID NO: 3546311 - RNA, 21 nt, Pseudomonas putida KT2440
augcagguugcccucggccac

SEQ ID NO: 3546312 - RNA, 24 nt, Pseudomonas putida KT2440
augcaguucuaccagcagcucaug

SEQ ID NO: 3546313 - RNA, 17 nt, Pseudomonas putida KT2440
augcaucagggucugag

SEQ ID NO: 3546314 - RNA, 20 nt, Pseudomonas putida KT2440
augcaucugcgccccgcucg

SEQ ID NO: 3546315 - RNA, 20 nt, Pseudomonas putida KT2440
augcaugcguugcacgugca

SEQ ID NO: 3546316 - RNA, 16 nt, Pseudomonas putida KT2440
augcuccgccaccaga

SEQ ID NO: 3546317 - RNA, 19 nt, Pseudomonas putida KT2440
augcuccugcgccaccucg

SEQ ID NO: 3546318 - RNA, 22 nt, Pseudomonas putida KT2440
augcucgauaccguacugguaa

SEQ ID NO: 3546319 - RNA, 22 nt, Pseudomonas putida KT2440
augcucgcgggccuggagcaag

SEQ ID NO: 3546320 - RNA, 17 nt, Pseudomonas putida KT2440
augcucggccagcucgc

SEQ ID NO: 3546321 - RNA, 16 nt, Pseudomonas putida KT2440
augcucgucagccccu

SEQ ID NO: 3546322 - RNA, 18 nt, Pseudomonas putida KT2440
augcucugcgcaaaggcu

SEQ ID NO: 3546323 - RNA, 20 nt, Pseudomonas putida KT2440
augcugcagaaccgccagca

SEQ ID NO: 3546324 - RNA, 19 nt, Pseudomonas putida KT2440
augcugccuccgccaagca

SEQ ID NO: 3546325 - RNA, 22 nt, Pseudomonas putida KT2440
augcugccuuuuccugcugcaa

SEQ ID NO: 3546326 - RNA, 14 nt, Pseudomonas putida KT2440
augcugcgccagga

SEQ ID NO: 3546327 - RNA, 18 nt, Pseudomonas putida KT2440
augcugcgccccagguug

SEQ ID NO: 3546328 - RNA, 22 nt, Pseudomonas putida KT2440
augcugcucgcccgcccgcuuc

SEQ ID NO: 3546329 - RNA, 16 nt, Pseudomonas putida KT2440
augcugcugcagcacu

SEQ ID NO: 3546330 - RNA, 12 nt, Pseudomonas putida KT2440
augcugcugccc

SEQ ID NO: 3546331 - RNA, 19 nt, Pseudomonas putida KT2440
augcuggcaauccagcgug

SEQ ID NO: 3546332 - RNA, 14 nt, Pseudomonas putida KT2440
augcuggccaaggu

SEQ ID NO: 3546333 - RNA, 14 nt, Pseudomonas putida KT2440
augcuggucgccgu

SEQ ID NO: 3546334 - RNA, 18 nt, Pseudomonas putida KT2440
augcuggugguggcccug

SEQ ID NO: 3546335 - RNA, 16 nt, Pseudomonas putida KT2440
augcugguguguugaa

SEQ ID NO: 3546336 - RNA, 19 nt, Pseudomonas putida KT2440
augcugguguguugaaguc

SEQ ID NO: 3546337 - RNA, 20 nt, Pseudomonas putida KT2440
augcuguuggcggggggaga

SEQ ID NO: 3546338 - RNA, 22 nt, Pseudomonas putida KT2440
augcuguuugugccggccucuu

SEQ ID NO: 3546339 - RNA, 12 nt, Pseudomonas putida KT2440
augcuucgcggg

SEQ ID NO: 3546340 - RNA, 20 nt, Pseudomonas putida KT2440
augcuucggcugaucucuuc

SEQ ID NO: 3546341 - RNA, 23 nt, Pseudomonas putida KT2440
augcuugcgcggcaccggcuuga

SEQ ID NO: 3546342 - RNA, 13 nt, Pseudomonas putida KT2440
augcuuuccaggu

SEQ ID NO: 3546343 - RNA, 16 nt, Pseudomonas putida KT2440
augcuuuuaugauccu

SEQ ID NO: 3546344 - RNA, 19 nt, Pseudomonas putida KT2440
auggaagcuguggggcuga

SEQ ID NO: 3546345 - RNA, 12 nt, Pseudomonas putida KT2440
auggacgcgcaa

SEQ ID NO: 3546346 - RNA, 14 nt, Pseudomonas putida KT2440
auggauuccucgcg

SEQ ID NO: 3546347 - RNA, 18 nt, Pseudomonas putida KT2440
auggcaaacagcaccagc

SEQ ID NO: 3546348 - RNA, 16 nt, Pseudomonas putida KT2440
auggcaaagcgcagca

SEQ ID NO: 3546349 - RNA, 16 nt, Pseudomonas putida KT2440
auggcaaucgccuggc

SEQ ID NO: 3546350 - RNA, 19 nt, Pseudomonas putida KT2440
auggcacccucaccaacug

SEQ ID NO: 3546351 - RNA, 23 nt, Pseudomonas putida KT2440
auggcacccucaccaacugccug

SEQ ID NO: 3546352 - RNA, 13 nt, Pseudomonas putida KT2440
auggcaccgauca

SEQ ID NO: 3546353 - RNA, 13 nt, Pseudomonas putida KT2440
auggcaccggcag

SEQ ID NO: 3546354 - RNA, 15 nt, Pseudomonas putida KT2440
auggcagacaagucc

SEQ ID NO: 3546355 - RNA, 19 nt, Pseudomonas putida KT2440
auggcaggugaucguugcg

SEQ ID NO: 3546356 - RNA, 14 nt, Pseudomonas putida KT2440
auggcauucgccac

SEQ ID NO: 3546357 - RNA, 19 nt, Pseudomonas putida KT2440
auggccacacgcugcugcu

SEQ ID NO: 3546358 - RNA, 21 nt, Pseudomonas putida KT2440
auggccaccaggguggcgauc

SEQ ID NO: 3546359 - RNA, 23 nt, Pseudomonas putida KT2440
auggccacggugucggacagguu

SEQ ID NO: 3546360 - RNA, 15 nt, Pseudomonas putida KT2440
auggcccagccagcg

SEQ ID NO: 3546361 - RNA, 19 nt, Pseudomonas putida KT2440
auggccgaaaccagccccu

SEQ ID NO: 3546362 - RNA, 16 nt, Pseudomonas putida KT2440
auggccgagccaagag

SEQ ID NO: 3546363 - RNA, 23 nt, Pseudomonas putida KT2440
auggccgagcugauccgccuggc

SEQ ID NO: 3546364 - RNA, 19 nt, Pseudomonas putida KT2440
auggccgccaaggcgaugc

SEQ ID NO: 3546365 - RNA, 17 nt, Pseudomonas putida KT2440
auggccgcccugcggcu

SEQ ID NO: 3546366 - RNA, 13 nt, Pseudomonas putida KT2440
auggccguucuug

SEQ ID NO: 3546367 - RNA, 22 nt, Pseudomonas putida KT2440
auggccugagggucgugagccu

SEQ ID NO: 3546368 - RNA, 19 nt, Pseudomonas putida KT2440
auggccugcaugucggcag

SEQ ID NO: 3546369 - RNA, 14 nt, Pseudomonas putida KT2440
auggccuggcgggu

SEQ ID NO: 3546370 - RNA, 20 nt, Pseudomonas putida KT2440
auggccuuuacaccgaugcc

SEQ ID NO: 3546371 - RNA, 14 nt, Pseudomonas putida KT2440
auggcgacuucgug

SEQ ID NO: 3546372 - RNA, 19 nt, Pseudomonas putida KT2440
auggcgaugaacacgccgu

SEQ ID NO: 3546373 - RNA, 14 nt, Pseudomonas putida KT2440
auggcgcacagggc

SEQ ID NO: 3546374 - RNA, 17 nt, Pseudomonas putida KT2440
auggcgcagcuccacug

SEQ ID NO: 3546375 - RNA, 18 nt, Pseudomonas putida KT2440
auggcgcgaacagggccu

SEQ ID NO: 3546376 - RNA, 13 nt, Pseudomonas putida KT2440
auggcgcggugag

SEQ ID NO: 3546377 - RNA, 16 nt, Pseudomonas putida KT2440
auggcggaucagcgcg

SEQ ID NO: 3546378 - RNA, 14 nt, Pseudomonas putida KT2440
auggcggcccagcc

SEQ ID NO: 3546379 - RNA, 16 nt, Pseudomonas putida KT2440
auggcggcccagccag

SEQ ID NO: 3546380 - RNA, 21 nt, Pseudomonas putida KT2440
auggcggucgaacccagcuug

SEQ ID NO: 3546381 - RNA, 23 nt, Pseudomonas putida KT2440
auggcgguggccuucaucgcugc

SEQ ID NO: 3546382 - RNA, 22 nt, Pseudomonas putida KT2440
auggcuagggucguccugggua

SEQ ID NO: 3546383 - RNA, 16 nt, Pseudomonas putida KT2440
auggcucacacccagg

SEQ ID NO: 3546384 - RNA, 15 nt, Pseudomonas putida KT2440
auggcucaucgccgu

SEQ ID NO: 3546385 - RNA, 16 nt, Pseudomonas putida KT2440
auggcuccaccacagc

SEQ ID NO: 3546386 - RNA, 14 nt, Pseudomonas putida KT2440
auggcucgcagcca

SEQ ID NO: 3546387 - RNA, 12 nt, Pseudomonas putida KT2440
auggcugaaauc

SEQ ID NO: 3546388 - RNA, 15 nt, Pseudomonas putida KT2440
auggcugcggcaggu

SEQ ID NO: 3546389 - RNA, 17 nt, Pseudomonas putida KT2440
auggcugcggcagguag

SEQ ID NO: 3546390 - RNA, 17 nt, Pseudomonas putida KT2440
auggcuugagcuuagcg

SEQ ID NO: 3546391 - RNA, 23 nt, Pseudomonas putida KT2440
augggcaccggccaccaggcgcg

SEQ ID NO: 3546392 - RNA, 18 nt, Pseudomonas putida KT2440
augggccaugcccaccgc

SEQ ID NO: 3546393 - RNA, 22 nt, Pseudomonas putida KT2440
augggcgaaguugaagcgccgg

SEQ ID NO: 3546394 - RNA, 20 nt, Pseudomonas putida KT2440
augggcguaauacugcuucc

SEQ ID NO: 3546395 - RNA, 22 nt, Pseudomonas putida KT2440
augggcguaauacugcuuccag

SEQ ID NO: 3546396 - RNA, 16 nt, Pseudomonas putida KT2440
augggcugcaaagcag

SEQ ID NO: 3546397 - RNA, 21 nt, Pseudomonas putida KT2440
augggcuuuucguuggccagc

SEQ ID NO: 3546398 - RNA, 18 nt, Pseudomonas putida KT2440
auggggccgcugugggag

SEQ ID NO: 3546399 - RNA, 19 nt, Pseudomonas putida KT2440
auggggccgcugugggagu

SEQ ID NO: 3546400 - RNA, 23 nt, Pseudomonas putida KT2440
auggggcugcauugcagccccaa

SEQ ID NO: 3546401 - RNA, 19 nt, Pseudomonas putida KT2440
augggugucggcauacagc

SEQ ID NO: 3546402 - RNA, 15 nt, Pseudomonas putida KT2440
auggucaacagcccg

SEQ ID NO: 3546403 - RNA, 22 nt, Pseudomonas putida KT2440
auggucacaugucgaggcuuga

SEQ ID NO: 3546404 - RNA, 23 nt, Pseudomonas putida KT2440
auggucacccgcgaccacaggcg

SEQ ID NO: 3546405 - RNA, 19 nt, Pseudomonas putida KT2440
auggucaccuuguccagca

SEQ ID NO: 3546406 - RNA, 22 nt, Pseudomonas putida KT2440
auggucacgccauccccccagc

SEQ ID NO: 3546407 - RNA, 19 nt, Pseudomonas putida KT2440
auggucagauaacccuugg

SEQ ID NO: 3546408 - RNA, 20 nt, Pseudomonas putida KT2440
auggucauugaaggccagug

SEQ ID NO: 3546409 - RNA, 19 nt, Pseudomonas putida KT2440
augguccugguaacccggu

SEQ ID NO: 3546410 - RNA, 23 nt, Pseudomonas putida KT2440
augguccuugaacggcauuucca

SEQ ID NO: 3546411 - RNA, 16 nt, Pseudomonas putida KT2440
auggucgcguuguuca

SEQ ID NO: 3546412 - RNA, 22 nt, Pseudomonas putida KT2440
auggucgcguuguucagcagcg

SEQ ID NO: 3546413 - RNA, 16 nt, Pseudomonas putida KT2440
auggugaaggccagga

SEQ ID NO: 3546414 - RNA, 22 nt, Pseudomonas putida KT2440
auggugaaggccaggaacagcg

SEQ ID NO: 3546415 - RNA, 13 nt, Pseudomonas putida KT2440
auggugacugcca

SEQ ID NO: 3546416 - RNA, 14 nt, Pseudomonas putida KT2440
auggugacugccag

SEQ ID NO: 3546417 - RNA, 16 nt, Pseudomonas putida KT2440
auggugacugccagca

SEQ ID NO: 3546418 - RNA, 13 nt, Pseudomonas putida KT2440
auggugcaggggg

SEQ ID NO: 3546419 - RNA, 12 nt, Pseudomonas putida KT2440
augguggucagc

SEQ ID NO: 3546420 - RNA, 20 nt, Pseudomonas putida KT2440
auggugguuuauccggcaca

SEQ ID NO: 3546421 - RNA, 20 nt, Pseudomonas putida KT2440
auugagcgacgcugccgcac

SEQ ID NO: 3546422 - RNA, 13 nt, Pseudomonas putida KT2440
auugaugcucagg

SEQ ID NO: 3546423 - RNA, 18 nt, Pseudomonas putida KT2440
auugcaccacccccagcg

SEQ ID NO: 3546424 - RNA, 21 nt, Pseudomonas putida KT2440
auugcaccacccccagcgccu

SEQ ID NO: 3546425 - RNA, 14 nt, Pseudomonas putida KT2440
auugcagccccaau

SEQ ID NO: 3546426 - RNA, 18 nt, Pseudomonas putida KT2440
auugcaggaacaaccuga

SEQ ID NO: 3546427 - RNA, 22 nt, Pseudomonas putida KT2440
auugccaacagcaguugcugcu

SEQ ID NO: 3546428 - RNA, 21 nt, Pseudomonas putida KT2440
auugccccuguaggaucgggu

SEQ ID NO: 3546429 - RNA, 22 nt, Pseudomonas putida KT2440
auugcccgcgacgaaacccagu

SEQ ID NO: 3546430 - RNA, 14 nt, Pseudomonas putida KT2440
auugccgcagcugc

SEQ ID NO: 3546431 - RNA, 20 nt, Pseudomonas putida KT2440
auugccggucgggcaaggcc

SEQ ID NO: 3546432 - RNA, 21 nt, Pseudomonas putida KT2440
auugcgaguugaucucaagcu

SEQ ID NO: 3546433 - RNA, 20 nt, Pseudomonas putida KT2440
auugcgcgucacugcaccuc

SEQ ID NO: 3546434 - RNA, 16 nt, Pseudomonas putida KT2440
auugcgggcuuucugg

SEQ ID NO: 3546435 - RNA, 14 nt, Pseudomonas putida KT2440
auugcguucuugcc

SEQ ID NO: 3546436 - RNA, 20 nt, Pseudomonas putida KT2440
auugcucacugaccaccugg

SEQ ID NO: 3546437 - RNA, 21 nt, Pseudomonas putida KT2440
auugcuccauauguagcgguc

SEQ ID NO: 3546438 - RNA, 19 nt, Pseudomonas putida KT2440
auugcugaucccugccccc

SEQ ID NO: 3546439 - RNA, 20 nt, Pseudomonas putida KT2440
auugcugccgaccugcgccg

SEQ ID NO: 3546440 - RNA, 21 nt, Pseudomonas putida KT2440
auugcugcgguaccggccagc

SEQ ID NO: 3546441 - RNA, 13 nt, Pseudomonas putida KT2440
auuggagcggccu

SEQ ID NO: 3546442 - RNA, 18 nt, Pseudomonas putida KT2440
auuggcaaacgccuguuu

SEQ ID NO: 3546443 - RNA, 14 nt, Pseudomonas putida KT2440
auuggcaucgcugc

SEQ ID NO: 3546444 - RNA, 15 nt, Pseudomonas putida KT2440
auuggcaucgcugcc

SEQ ID NO: 3546445 - RNA, 21 nt, Pseudomonas putida KT2440
auuggccacgcccaaccccag

SEQ ID NO: 3546446 - RNA, 16 nt, Pseudomonas putida KT2440
auuggccagcagggcc

SEQ ID NO: 3546447 - RNA, 14 nt, Pseudomonas putida KT2440
auuggccaggucuu

SEQ ID NO: 3546448 - RNA, 16 nt, Pseudomonas putida KT2440
auuggcgccaucgccc

SEQ ID NO: 3546449 - RNA, 17 nt, Pseudomonas putida KT2440
auuggcgccaucgccca

SEQ ID NO: 3546450 - RNA, 15 nt, Pseudomonas putida KT2440
auuggcggcaggcgc

SEQ ID NO: 3546451 - RNA, 13 nt, Pseudomonas putida KT2440
auugggcugggcg

SEQ ID NO: 3546452 - RNA, 16 nt, Pseudomonas putida KT2440
auuggugccagcgcca

SEQ ID NO: 3546453 - RNA, 19 nt, Pseudomonas putida KT2440
auugucaugcgggaagcca

SEQ ID NO: 3546454 - RNA, 16 nt, Pseudomonas putida KT2440
auugucauugcccaag

SEQ ID NO: 3546455 - RNA, 14 nt, Pseudomonas putida KT2440
auugugcgcccccc

SEQ ID NO: 3546456 - RNA, 22 nt, Pseudomonas putida KT2440
auuguggccggcgcgucucauu

SEQ ID NO: 3546457 - RNA, 16 nt, Pseudomonas putida KT2440
auuguucccacaggga

SEQ ID NO: 3546458 - RNA, 15 nt, Pseudomonas putida KT2440
auuuacugcagaaca

SEQ ID NO: 3546459 - RNA, 19 nt, Pseudomonas putida KT2440
auuuagcaggcacccugag

SEQ ID NO: 3546460 - RNA, 19 nt, Pseudomonas putida KT2440
auuucaauuaugagugcca

SEQ ID NO: 3546461 - RNA, 13 nt, Pseudomonas putida KT2440
auuucacagcaaa

SEQ ID NO: 3546462 - RNA, 16 nt, Pseudomonas putida KT2440
auuucacgcacggccu

SEQ ID NO: 3546463 - RNA, 12 nt, Pseudomonas putida KT2440
auuucacuggcu

SEQ ID NO: 3546464 - RNA, 16 nt, Pseudomonas putida KT2440
auuucacuuucuugaa

SEQ ID NO: 3546465 - RNA, 21 nt, Pseudomonas putida KT2440
auuucauccacauaggccagc

SEQ ID NO: 3546466 - RNA, 19 nt, Pseudomonas putida KT2440
auuuccgggcaaugcaggc

SEQ ID NO: 3546467 - RNA, 16 nt, Pseudomonas putida KT2440
auuuccucuucaccgu

SEQ ID NO: 3546468 - RNA, 20 nt, Pseudomonas putida KT2440
auuucgaagggauguuggaa

SEQ ID NO: 3546469 - RNA, 20 nt, Pseudomonas putida KT2440
auuucggugaagaucgccgc

SEQ ID NO: 3546470 - RNA, 14 nt, Pseudomonas putida KT2440
auuucgucaccgau

SEQ ID NO: 3546471 - RNA, 14 nt, Pseudomonas putida KT2440
auuucguccaggcu

SEQ ID NO: 3546472 - RNA, 15 nt, Pseudomonas putida KT2440
auuucguccaggcuc

SEQ ID NO: 3546473 - RNA, 13 nt, Pseudomonas putida KT2440
auuucguggguca

SEQ ID NO: 3546474 - RNA, 14 nt, Pseudomonas putida KT2440
auuucuacccgccg

SEQ ID NO: 3546475 - RNA, 17 nt, Pseudomonas putida KT2440
auuucuuucagcucggc

SEQ ID NO: 3546476 - RNA, 21 nt, Pseudomonas putida KT2440
auuugaagguauggccuuucu

SEQ ID NO: 3546477 - RNA, 14 nt, Pseudomonas putida KT2440
auuugaucggccgc

SEQ ID NO: 3546478 - RNA, 23 nt, Pseudomonas putida KT2440
auuugcagcacaaggcuguucca

SEQ ID NO: 3546479 - RNA, 18 nt, Pseudomonas putida KT2440
auuugccacucaggcgca

SEQ ID NO: 3546480 - RNA, 21 nt, Pseudomonas putida KT2440
auuugccagcgugaaccggcu

SEQ ID NO: 3546481 - RNA, 17 nt, Pseudomonas putida KT2440
auuugcuccagggcauu

SEQ ID NO: 3546482 - RNA, 22 nt, Pseudomonas putida KT2440
auuuguacgggugcuccaccaa

SEQ ID NO: 3546483 - RNA, 13 nt, Pseudomonas putida KT2440
auuuucaaugcuu

SEQ ID NO: 3546484 - RNA, 17 nt, Pseudomonas putida KT2440
auuuucuugaaaacauu

SEQ ID NO: 3546485 - RNA, 21 nt, Pseudomonas putida KT2440
auuuucuugaaaacauugcua

SEQ ID NO: 3546486 - RNA, 16 nt, Pseudomonas putida KT2440
auuuuguucuccagca

SEQ ID NO: 3546487 - RNA, 18 nt, Pseudomonas putida KT2440
auuuuuuaacaaggcacg

SEQ ID NO: 3546488 - RNA, 13 nt, Pseudomonas putida KT2440
caaaaaaucgggu

SEQ ID NO: 3546489 - RNA, 17 nt, Pseudomonas putida KT2440
caaaaaaugugcgcauc

SEQ ID NO: 3546490 - RNA, 13 nt, Pseudomonas putida KT2440
caaaaacaacaau

SEQ ID NO: 3546491 - RNA, 19 nt, Pseudomonas putida KT2440
caaaaacgaauaucgccga

SEQ ID NO: 3546492 - RNA, 22 nt, Pseudomonas putida KT2440
caaaaccucaguuuuucuccgc

SEQ ID NO: 3546493 - RNA, 11 nt, Pseudomonas putida KT2440
caaaaccugcc

SEQ ID NO: 3546494 - RNA, 14 nt, Pseudomonas putida KT2440
caaaaccuguucca

SEQ ID NO: 3546495 - RNA, 22 nt, Pseudomonas putida KT2440
caaaacgguuguuucagccuug

SEQ ID NO: 3546496 - RNA, 15 nt, Pseudomonas putida KT2440
caaaagaaaaagggc

SEQ ID NO: 3546497 - RNA, 18 nt, Pseudomonas putida KT2440
caaaaguuggcugaccgg

SEQ ID NO: 3546498 - RNA, 17 nt, Pseudomonas putida KT2440
caaaauagucgaaggcu

SEQ ID NO: 3546499 - RNA, 23 nt, Pseudomonas putida KT2440
caaaaugcagcaagcuggcaccg

SEQ ID NO: 3546500 - RNA, 15 nt, Pseudomonas putida KT2440
caaaaugugccggcu

SEQ ID NO: 3546501 - RNA, 16 nt, Pseudomonas putida KT2440
caaacaaaaagcaccu

SEQ ID NO: 3546502 - RNA, 11 nt, Pseudomonas putida KT2440
caaacacaucc

SEQ ID NO: 3546503 - RNA, 15 nt, Pseudomonas putida KT2440
caaacacauccagcg

SEQ ID NO: 3546504 - RNA, 18 nt, Pseudomonas putida KT2440
caaacacauccagcgccg

SEQ ID NO: 3546505 - RNA, 13 nt, Pseudomonas putida KT2440
caaacacccagcu

SEQ ID NO: 3546506 - RNA, 21 nt, Pseudomonas putida KT2440
caaacaccggccccccagcca

SEQ ID NO: 3546507 - RNA, 15 nt, Pseudomonas putida KT2440
caaacagcaccagcc

SEQ ID NO: 3546508 - RNA, 11 nt, Pseudomonas putida KT2440
caaacagcauc

SEQ ID NO: 3546509 - RNA, 14 nt, Pseudomonas putida KT2440
caaacagccgccca

SEQ ID NO: 3546510 - RNA, 17 nt, Pseudomonas putida KT2440
caaacagcucacuggca

SEQ ID NO: 3546511 - RNA, 14 nt, Pseudomonas putida KT2440
caaacagcucgaca

SEQ ID NO: 3546512 - RNA, 19 nt, Pseudomonas putida KT2440
caaacagcucgacaacccg

SEQ ID NO: 3546513 - RNA, 20 nt, Pseudomonas putida KT2440
caaacaggaucuccucggcc

SEQ ID NO: 3546514 - RNA, 23 nt, Pseudomonas putida KT2440
caaacaggaucuccucggccagc

SEQ ID NO: 3546515 - RNA, 20 nt, Pseudomonas putida KT2440
caaacaggcugauguugaug

SEQ ID NO: 3546516 - RNA, 14 nt, Pseudomonas putida KT2440
caaaccaauuacuu

SEQ ID NO: 3546517 - RNA, 14 nt, Pseudomonas putida KT2440
caaaccacagcggc

SEQ ID NO: 3546518 - RNA, 21 nt, Pseudomonas putida KT2440
caaaccaggccguugaucagc

SEQ ID NO: 3546519 - RNA, 18 nt, Pseudomonas putida KT2440
caaaccauggaagcucag

SEQ ID NO: 3546520 - RNA, 14 nt, Pseudomonas putida KT2440
caaaccccccaugc

SEQ ID NO: 3546521 - RNA, 23 nt, Pseudomonas putida KT2440
caaaccccuucauagaacuuaaa

SEQ ID NO: 3546522 - RNA, 20 nt, Pseudomonas putida KT2440
caaacccgcgccuacaggca

SEQ ID NO: 3546523 - RNA, 20 nt, Pseudomonas putida KT2440
caaacccggccagcagguca

SEQ ID NO: 3546524 - RNA, 14 nt, Pseudomonas putida KT2440
caaacccucggcca

SEQ ID NO: 3546525 - RNA, 15 nt, Pseudomonas putida KT2440
caaaccgacccugcu

SEQ ID NO: 3546526 - RNA, 15 nt, Pseudomonas putida KT2440
caaaccgcacccggc

SEQ ID NO: 3546527 - RNA, 18 nt, Pseudomonas putida KT2440
caacagcacccgcccauc

SEQ ID NO: 3546528 - RNA, 18 nt, Pseudomonas putida KT2440
caacagcaguugcugcug

SEQ ID NO: 3546529 - RNA, 15 nt, Pseudomonas putida KT2440
caacagccacgcccg

SEQ ID NO: 3546530 - RNA, 14 nt, Pseudomonas putida KT2440
caacagcccgguga

SEQ ID NO: 3546531 - RNA, 22 nt, Pseudomonas putida KT2440
caacagcccggugaagucaccg

SEQ ID NO: 3546532 - RNA, 13 nt, Pseudomonas putida KT2440
caacagccgcggc

SEQ ID NO: 3546533 - RNA, 17 nt, Pseudomonas putida KT2440
caacagccgcggcaccc

SEQ ID NO: 3546534 - RNA, 23 nt, Pseudomonas putida KT2440
caacagccgcggcacccaauagc

SEQ ID NO: 3546535 - RNA, 22 nt, Pseudomonas putida KT2440
caacagcgcgacgcagcagcgc

SEQ ID NO: 3546536 - RNA, 23 nt, Pseudomonas putida KT2440
caacagcgcggagagguggcaga

SEQ ID NO: 3546537 - RNA, 15 nt, Pseudomonas putida KT2440
caacagcucaacccg

SEQ ID NO: 3546538 - RNA, 18 nt, Pseudomonas putida KT2440
caacagcucaacccgccu

SEQ ID NO: 3546539 - RNA, 20 nt, Pseudomonas putida KT2440
caacagcucauccaggcugc

SEQ ID NO: 3546540 - RNA, 11 nt, Pseudomonas putida KT2440
caacagcugcg

SEQ ID NO: 3546541 - RNA, 18 nt, Pseudomonas putida KT2440
caacagcuucuugcaccg

SEQ ID NO: 3546542 - RNA, 16 nt, Pseudomonas putida KT2440
caacaggucgaccugc

SEQ ID NO: 3546543 - RNA, 14 nt, Pseudomonas putida KT2440
caacaggucggcgc

SEQ ID NO: 3546544 - RNA, 19 nt, Pseudomonas putida KT2440
caacaggucggcgcgcgca

SEQ ID NO: 3546545 - RNA, 12 nt, Pseudomonas putida KT2440
caacagugcccc

SEQ ID NO: 3546546 - RNA, 19 nt, Pseudomonas putida KT2440
caacaguuucuugccuucc

SEQ ID NO: 3546547 - RNA, 20 nt, Pseudomonas putida KT2440
caacaguuuucaaugcugcu

SEQ ID NO: 3546548 - RNA, 21 nt, Pseudomonas putida KT2440
caacaguuuucaaugcugcuc

SEQ ID NO: 3546549 - RNA, 18 nt, Pseudomonas putida KT2440
caacauaccgcugggcac

SEQ ID NO: 3546550 - RNA, 23 nt, Pseudomonas putida KT2440
caacaucggugaucgcaaaacaa

SEQ ID NO: 3546551 - RNA, 21 nt, Pseudomonas putida KT2440
caacaugaagccaugggcaga

SEQ ID NO: 3546552 - RNA, 23 nt, Pseudomonas putida KT2440
caacaugccggcccaaggcacca

SEQ ID NO: 3546553 - RNA, 19 nt, Pseudomonas putida KT2440
caacauggucacaugucga

SEQ ID NO: 3546554 - RNA, 15 nt, Pseudomonas putida KT2440
caaccaaaggaggcu

SEQ ID NO: 3546555 - RNA, 16 nt, Pseudomonas putida KT2440
caaccaaaggaggcug

SEQ ID NO: 3546556 - RNA, 15 nt, Pseudomonas putida KT2440
caaccaacaggcucu

SEQ ID NO: 3546557 - RNA, 18 nt, Pseudomonas putida KT2440
caaccaacaggcucucca

SEQ ID NO: 3546558 - RNA, 16 nt, Pseudomonas putida KT2440
caaccaauccccccuc

SEQ ID NO: 3546559 - RNA, 18 nt, Pseudomonas putida KT2440
caaccaauccccccuccu

SEQ ID NO: 3546560 - RNA, 13 nt, Pseudomonas putida KT2440
caaccacagcccg

SEQ ID NO: 3546561 - RNA, 21 nt, Pseudomonas putida KT2440
caaccaccgaccuguguccac

SEQ ID NO: 3546562 - RNA, 15 nt, Pseudomonas putida KT2440
caaccaccuccccaa

SEQ ID NO: 3546563 - RNA, 22 nt, Pseudomonas putida KT2440
caaccaccucuaucaccuguuc

SEQ ID NO: 3546564 - RNA, 15 nt, Pseudomonas putida KT2440
caaccacgaccggcu

SEQ ID NO: 3546565 - RNA, 16 nt, Pseudomonas putida KT2440
caaccacgaccggcuc

SEQ ID NO: 3546566 - RNA, 16 nt, Pseudomonas putida KT2440
caaccacgccugcgcc

SEQ ID NO: 3546567 - RNA, 17 nt, Pseudomonas putida KT2440
caaccacgccugcgccg

SEQ ID NO: 3546568 - RNA, 15 nt, Pseudomonas putida KT2440
caaccacgcuuggcu

SEQ ID NO: 3546569 - RNA, 13 nt, Pseudomonas putida KT2440
caaccagccagcc

SEQ ID NO: 3546570 - RNA, 16 nt, Pseudomonas putida KT2440
caaccagccagccacc

SEQ ID NO: 3546571 - RNA, 13 nt, Pseudomonas putida KT2440
caaccaggcgccg

SEQ ID NO: 3546572 - RNA, 14 nt, Pseudomonas putida KT2440
caaccaggcgccga

SEQ ID NO: 3546573 - RNA, 18 nt, Pseudomonas putida KT2440
caaccaggugugccacuu

SEQ ID NO: 3546574 - RNA, 15 nt, Pseudomonas putida KT2440
caaccagucauccuc

SEQ ID NO: 3546575 - RNA, 18 nt, Pseudomonas putida KT2440
caacccaccagcacugcu

SEQ ID NO: 3546576 - RNA, 22 nt, Pseudomonas putida KT2440
caacccaccagcacugcugcgc

SEQ ID NO: 3546577 - RNA, 18 nt, Pseudomonas putida KT2440
caaccccaaaccgcucga

SEQ ID NO: 3546578 - RNA, 15 nt, Pseudomonas putida KT2440
caaccccacgccugu

SEQ ID NO: 3546579 - RNA, 15 nt, Pseudomonas putida KT2440
caaccccagcccgaa

SEQ ID NO: 3546580 - RNA, 22 nt, Pseudomonas putida KT2440
caaccccagcccgaagccggca

SEQ ID NO: 3546581 - RNA, 15 nt, Pseudomonas putida KT2440
caaccccagcgcauu

SEQ ID NO: 3546582 - RNA, 15 nt, Pseudomonas putida KT2440
caaccccaggcgcac

SEQ ID NO: 3546583 - RNA, 15 nt, Pseudomonas putida KT2440
caaccccaggugcug

SEQ ID NO: 3546584 - RNA, 20 nt, Pseudomonas putida KT2440
caaccccaggugcugaugcc

SEQ ID NO: 3546585 - RNA, 18 nt, Pseudomonas putida KT2440
caaccccaucaccuuggc

SEQ ID NO: 3546586 - RNA, 14 nt, Pseudomonas putida KT2440
caacccccacaggg

SEQ ID NO: 3546587 - RNA, 20 nt, Pseudomonas putida KT2440
caaccccugcaaggccagcg

SEQ ID NO: 3546588 - RNA, 20 nt, Pseudomonas putida KT2440
caaccccugcggcgugcgcc

SEQ ID NO: 3546589 - RNA, 12 nt, Pseudomonas putida KT2440
caaccccuggaa

SEQ ID NO: 3546590 - RNA, 14 nt, Pseudomonas putida KT2440
caaccccuggaaac

SEQ ID NO: 3546591 - RNA, 14 nt, Pseudomonas putida KT2440
caacccgaucaggu

SEQ ID NO: 3546592 - RNA, 20 nt, Pseudomonas putida KT2440
caacccgaucaggugcagga

SEQ ID NO: 3546593 - RNA, 21 nt, Pseudomonas putida KT2440
caacccgauuccuugcagcgc

SEQ ID NO: 3546594 - RNA, 18 nt, Pseudomonas putida KT2440
caacccgcauuccuucug

SEQ ID NO: 3546595 - RNA, 17 nt, Pseudomonas putida KT2440
caacccgccuccugaag

SEQ ID NO: 3546596 - RNA, 14 nt, Pseudomonas putida KT2440
caacccggccaggc

SEQ ID NO: 3546597 - RNA, 21 nt, Pseudomonas putida KT2440
caacccggccaggccgugcuu

SEQ ID NO: 3546598 - RNA, 22 nt, Pseudomonas putida KT2440
caacccggccuuggccgcuggc

SEQ ID NO: 3546599 - RNA, 17 nt, Pseudomonas putida KT2440
caacccggucccgcccu

SEQ ID NO: 3546600 - RNA, 21 nt, Pseudomonas putida KT2440
caacccggucccgcccuccag

SEQ ID NO: 3546601 - RNA, 16 nt, Pseudomonas putida KT2440
caacccuaucagggcu

SEQ ID NO: 3546602 - RNA, 17 nt, Pseudomonas putida KT2440
caacccuucggccagca

SEQ ID NO: 3546603 - RNA, 21 nt, Pseudomonas putida KT2440
caacccuugcagcgccuguga

SEQ ID NO: 3546604 - RNA, 24 nt, Pseudomonas putida KT2440
caacccuugcagugccugugagau

SEQ ID NO: 3546605 - RNA, 14 nt, Pseudomonas putida KT2440
caaccgaacccgcu

SEQ ID NO: 3546606 - RNA, 19 nt, Pseudomonas putida KT2440
caaccgaacccgcuggcga

SEQ ID NO: 3546607 - RNA, 12 nt, Pseudomonas putida KT2440
caaccgaccagc

SEQ ID NO: 3546608 - RNA, 21 nt, Pseudomonas putida KT2440
caaccgacggguuacccuggu

SEQ ID NO: 3546609 - RNA, 16 nt, Pseudomonas putida KT2440
caaccgagaucucggu

SEQ ID NO: 3546610 - RNA, 17 nt, Pseudomonas putida KT2440
caaccgauagcgugaag

SEQ ID NO: 3546611 - RNA, 13 nt, Pseudomonas putida KT2440
caaccgcaucccc

SEQ ID NO: 3546612 - RNA, 19 nt, Pseudomonas putida KT2440
caaccgcgugacgcggagc

SEQ ID NO: 3546613 - RNA, 18 nt, Pseudomonas putida KT2440
caaccgcgugcuucaucg

SEQ ID NO: 3546614 - RNA, 19 nt, Pseudomonas putida KT2440
caaccgcuuucacuucauc

SEQ ID NO: 3546615 - RNA, 22 nt, Pseudomonas putida KT2440
caaccggagcgacuucgaccac

SEQ ID NO: 3546616 - RNA, 13 nt, Pseudomonas putida KT2440
caaccggccagug

SEQ ID NO: 3546617 - RNA, 20 nt, Pseudomonas putida KT2440
caaccggcuuguagccggca

SEQ ID NO: 3546618 - RNA, 17 nt, Pseudomonas putida KT2440
caaccgggucggcgcca

SEQ ID NO: 3546619 - RNA, 15 nt, Pseudomonas putida KT2440
caaccggguuugaag

SEQ ID NO: 3546620 - RNA, 19 nt, Pseudomonas putida KT2440
caaccguacccuuccugga

SEQ ID NO: 3546621 - RNA, 20 nt, Pseudomonas putida KT2440
caaccgugaaucgcgcuugc

SEQ ID NO: 3546622 - RNA, 23 nt, Pseudomonas putida KT2440
caaccgugcccgcccacgccgcu

SEQ ID NO: 3546623 - RNA, 15 nt, Pseudomonas putida KT2440
caaccucaacgccuc

SEQ ID NO: 3546624 - RNA, 19 nt, Pseudomonas putida KT2440
caaccucaggccugcacug

SEQ ID NO: 3546625 - RNA, 20 nt, Pseudomonas putida KT2440
caaccuccaggucauccgca

SEQ ID NO: 3546626 - RNA, 19 nt, Pseudomonas putida KT2440
caaccugaacaaggccugg

SEQ ID NO: 3546627 - RNA, 23 nt, Pseudomonas putida KT2440
caaccugaacaaggccuggccca

SEQ ID NO: 3546628 - RNA, 13 nt, Pseudomonas putida KT2440
caaccugcucgcu

SEQ ID NO: 3546629 - RNA, 20 nt, Pseudomonas putida KT2440
caaccugggcaaccacaugg

SEQ ID NO: 3546630 - RNA, 16 nt, Pseudomonas putida KT2440
caaccugggugugccg

SEQ ID NO: 3546631 - RNA, 17 nt, Pseudomonas putida KT2440
caaccuguuccggccuc

SEQ ID NO: 3546632 - RNA, 14 nt, Pseudomonas putida KT2440
caacugugccuggg

SEQ ID NO: 3546633 - RNA, 15 nt, Pseudomonas putida KT2440
caacuguucaggccu

SEQ ID NO: 3546634 - RNA, 15 nt, Pseudomonas putida KT2440
caacuguuucugcuc

SEQ ID NO: 3546635 - RNA, 23 nt, Pseudomonas putida KT2440
caacuguuucugcucuucugcca

SEQ ID NO: 3546636 - RNA, 15 nt, Pseudomonas putida KT2440
caacuucgguggcuc

SEQ ID NO: 3546637 - RNA, 16 nt, Pseudomonas putida KT2440
caacuugcgcagcuug

SEQ ID NO: 3546638 - RNA, 20 nt, Pseudomonas putida KT2440
caacuugcgggucagcagca

SEQ ID NO: 3546639 - RNA, 17 nt, Pseudomonas putida KT2440
caacuugugcaucaagu

SEQ ID NO: 3546640 - RNA, 15 nt, Pseudomonas putida KT2440
caacuuuugcuggcu

SEQ ID NO: 3546641 - RNA, 19 nt, Pseudomonas putida KT2440
caagaaacguaacgauugc

SEQ ID NO: 3546642 - RNA, 17 nt, Pseudomonas putida KT2440
caagaaaucgggucauc

SEQ ID NO: 3546643 - RNA, 12 nt, Pseudomonas putida KT2440
caagaacaacac

SEQ ID NO: 3546644 - RNA, 16 nt, Pseudomonas putida KT2440
caagaacaacacggca

SEQ ID NO: 3546645 - RNA, 18 nt, Pseudomonas putida KT2440
caagaacaacacggcaga

SEQ ID NO: 3546646 - RNA, 19 nt, Pseudomonas putida KT2440
caagaacaacacggcagag

SEQ ID NO: 3546647 - RNA, 17 nt, Pseudomonas putida KT2440
caagaacugcgacgaac

SEQ ID NO: 3546648 - RNA, 20 nt, Pseudomonas putida KT2440
caagaagcauuacuucuugg

SEQ ID NO: 3546649 - RNA, 21 nt, Pseudomonas putida KT2440
caagaaucucccgggccaugu

SEQ ID NO: 3546650 - RNA, 13 nt, Pseudomonas putida KT2440
caagaaugcccgg

SEQ ID NO: 3546651 - RNA, 17 nt, Pseudomonas putida KT2440
caagacgggaucaccgu

SEQ ID NO: 3546652 - RNA, 13 nt, Pseudomonas putida KT2440
caagacugcugug

SEQ ID NO: 3546653 - RNA, 20 nt, Pseudomonas putida KT2440
caagacugcuguggaacagc

SEQ ID NO: 3546654 - RNA, 15 nt, Pseudomonas putida KT2440
caagaguuguuguuc

SEQ ID NO: 3546655 - RNA, 22 nt, Pseudomonas putida KT2440
caagaguuguuguuccaucaug

SEQ ID NO: 3546656 - RNA, 20 nt, Pseudomonas putida KT2440
caagauaacaccccccagca

SEQ ID NO: 3546657 - RNA, 14 nt, Pseudomonas putida KT2440
caagcacgcacagu

SEQ ID NO: 3546658 - RNA, 20 nt, Pseudomonas putida KT2440
caagcacuacaucuaccuga

SEQ ID NO: 3546659 - RNA, 19 nt, Pseudomonas putida KT2440
caagcagccacccuccgca

SEQ ID NO: 3546660 - RNA, 20 nt, Pseudomonas putida KT2440
caagcagccacccuccgcac

SEQ ID NO: 3546661 - RNA, 19 nt, Pseudomonas putida KT2440
caagcagcgaaugcagcuc

SEQ ID NO: 3546662 - RNA, 18 nt, Pseudomonas putida KT2440
caagcagguaaccgcugc

SEQ ID NO: 3546663 - RNA, 14 nt, Pseudomonas putida KT2440
caagcaggugcgca

SEQ ID NO: 3546664 - RNA, 16 nt, Pseudomonas putida KT2440
caagcagucccagcac

SEQ ID NO: 3546665 - RNA, 17 nt, Pseudomonas putida KT2440
caagcagucccagcacc

SEQ ID NO: 3546666 - RNA, 14 nt, Pseudomonas putida KT2440
caagccaaaguccu

SEQ ID NO: 3546667 - RNA, 22 nt, Pseudomonas putida KT2440
caagccaaaguccugcaaaggc

SEQ ID NO: 3546668 - RNA, 20 nt, Pseudomonas putida KT2440
caagccaaugguauugcccg

SEQ ID NO: 3546669 - RNA, 16 nt, Pseudomonas putida KT2440
caagccacgcaccucg

SEQ ID NO: 3546670 - RNA, 15 nt, Pseudomonas putida KT2440
caagccaugugccug

SEQ ID NO: 3546671 - RNA, 17 nt, Pseudomonas putida KT2440
caagcccauggcuggca

SEQ ID NO: 3546672 - RNA, 18 nt, Pseudomonas putida KT2440
caagcccauggcuggcag

SEQ ID NO: 3546673 - RNA, 22 nt, Pseudomonas putida KT2440
caagcccauggcuggcagcacg

SEQ ID NO: 3546674 - RNA, 23 nt, Pseudomonas putida KT2440
caagcccauggcuggcagcacga

SEQ ID NO: 3546675 - RNA, 13 nt, Pseudomonas putida KT2440
caagccccuccua

SEQ ID NO: 3546676 - RNA, 15 nt, Pseudomonas putida KT2440
caagccccuggaagc

SEQ ID NO: 3546677 - RNA, 17 nt, Pseudomonas putida KT2440
caagcccgcacccacag

SEQ ID NO: 3546678 - RNA, 19 nt, Pseudomonas putida KT2440
caagcccgcguucaugccg

SEQ ID NO: 3546679 - RNA, 15 nt, Pseudomonas putida KT2440
caagcccgcucccac

SEQ ID NO: 3546680 - RNA, 17 nt, Pseudomonas putida KT2440
caagcccgcucgccaca

SEQ ID NO: 3546681 - RNA, 15 nt, Pseudomonas putida KT2440
caagccgacaaaaac

SEQ ID NO: 3546682 - RNA, 19 nt, Pseudomonas putida KT2440
caagccgacaaaaacaaca

SEQ ID NO: 3546683 - RNA, 23 nt, Pseudomonas putida KT2440
caagccgacuagauaaccaaccc

SEQ ID NO: 3546684 - RNA, 22 nt, Pseudomonas putida KT2440
caagccgccauugcccagccug

SEQ ID NO: 3546685 - RNA, 14 nt, Pseudomonas putida KT2440
caagccgcugccac

SEQ ID NO: 3546686 - RNA, 16 nt, Pseudomonas putida KT2440
caagccgcugggcuuc

SEQ ID NO: 3546687 - RNA, 20 nt, Pseudomonas putida KT2440
caagccggcgaacagcacug

SEQ ID NO: 3546688 - RNA, 20 nt, Pseudomonas putida KT2440
caagccggcgcucagcgggc

SEQ ID NO: 3546689 - RNA, 22 nt, Pseudomonas putida KT2440
caagccuacgcccccagccuug

SEQ ID NO: 3546690 - RNA, 24 nt, Pseudomonas putida KT2440
caagccucgcgcaacaccgccagc

SEQ ID NO: 3546691 - RNA, 16 nt, Pseudomonas putida KT2440
caagccugacucagcc

SEQ ID NO: 3546692 - RNA, 20 nt, Pseudomonas putida KT2440
caagccuucgucgcuggcca

SEQ ID NO: 3546693 - RNA, 22 nt, Pseudomonas putida KT2440
caagccuucgucgcuggccagc

SEQ ID NO: 3546694 - RNA, 23 nt, Pseudomonas putida KT2440
caagcgacauaaaaaagccccgg

SEQ ID NO: 3546695 - RNA, 16 nt, Pseudomonas putida KT2440
caagcgaugcacgcca

SEQ ID NO: 3546696 - RNA, 13 nt, Pseudomonas putida KT2440
caagcgcaccugc

SEQ ID NO: 3546697 - RNA, 14 nt, Pseudomonas putida KT2440
caagcgcagccuug

SEQ ID NO: 3546698 - RNA, 20 nt, Pseudomonas putida KT2440
caagcgcaggcgguuggcca

SEQ ID NO: 3546699 - RNA, 15 nt, Pseudomonas putida KT2440
caagcgcaugguggu

SEQ ID NO: 3546700 - RNA, 13 nt, Pseudomonas putida KT2440
caagcgccgucga

SEQ ID NO: 3546701 - RNA, 15 nt, Pseudomonas putida KT2440
caagcgccugacgca

SEQ ID NO: 3546702 - RNA, 15 nt, Pseudomonas putida KT2440
caagcgcgcgcccac

SEQ ID NO: 3546703 - RNA, 19 nt, Pseudomonas putida KT2440
caagcggcagaacacaucg

SEQ ID NO: 3546704 - RNA, 15 nt, Pseudomonas putida KT2440
caagcggccccagau

SEQ ID NO: 3546705 - RNA, 14 nt, Pseudomonas putida KT2440
caagcgggccaagg

SEQ ID NO: 3546706 - RNA, 15 nt, Pseudomonas putida KT2440
caagcgggccaaggu

SEQ ID NO: 3546707 - RNA, 20 nt, Pseudomonas putida KT2440
caagcgggccaaggucaucg

SEQ ID NO: 3546708 - RNA, 22 nt, Pseudomonas putida KT2440
caagcgggccaaggucaucggg

SEQ ID NO: 3546709 - RNA, 14 nt, Pseudomonas putida KT2440
caagcgguugcccg

SEQ ID NO: 3546710 - RNA, 17 nt, Pseudomonas putida KT2440
caagcgucccugcccga

SEQ ID NO: 3546711 - RNA, 15 nt, Pseudomonas putida KT2440
caagcgucggccacc

SEQ ID NO: 3546712 - RNA, 14 nt, Pseudomonas putida KT2440
caagcguuuuuugg

SEQ ID NO: 3546713 - RNA, 20 nt, Pseudomonas putida KT2440
caagcucagguuacgcacca

SEQ ID NO: 3546714 - RNA, 16 nt, Pseudomonas putida KT2440
caagcucaucaccagg

SEQ ID NO: 3546715 - RNA, 15 nt, Pseudomonas putida KT2440
caagcuccccagcaa

SEQ ID NO: 3546716 - RNA, 16 nt, Pseudomonas putida KT2440
caagcucgaagcgcuc

SEQ ID NO: 3546717 - RNA, 17 nt, Pseudomonas putida KT2440
caagcucguccugcagg

SEQ ID NO: 3546718 - RNA, 21 nt, Pseudomonas putida KT2440
caagcucuuccuugaucuuca

SEQ ID NO: 3546719 - RNA, 16 nt, Pseudomonas putida KT2440
caagcugcaccgccac

SEQ ID NO: 3546720 - RNA, 14 nt, Pseudomonas putida KT2440
caagcugcgccgca

SEQ ID NO: 3546721 - RNA, 18 nt, Pseudomonas putida KT2440
caagcuggaugaagcccg

SEQ ID NO: 3546722 - RNA, 16 nt, Pseudomonas putida KT2440
caagcuggcaccggcg

SEQ ID NO: 3546723 - RNA, 18 nt, Pseudomonas putida KT2440
caagcuggcacgugcagg

SEQ ID NO: 3546724 - RNA, 12 nt, Pseudomonas putida KT2440
caagcuggucag

SEQ ID NO: 3546725 - RNA, 13 nt, Pseudomonas putida KT2440
caagcuucaccuc

SEQ ID NO: 3546726 - RNA, 12 nt, Pseudomonas putida KT2440
caaggaucagcu

SEQ ID NO: 3546727 - RNA, 13 nt, Pseudomonas putida KT2440
caaggaucagcuc

SEQ ID NO: 3546728 - RNA, 20 nt, Pseudomonas putida KT2440
caaggcaauaccgauggccc

SEQ ID NO: 3546729 - RNA, 21 nt, Pseudomonas putida KT2440
caaggcaaugcccauggccag

SEQ ID NO: 3546730 - RNA, 23 nt, Pseudomonas putida KT2440
caaggcaaugcccauggccaggc

SEQ ID NO: 3546731 - RNA, 22 nt, Pseudomonas putida KT2440
caaggcacgugauaccugggcu

SEQ ID NO: 3546732 - RNA, 15 nt, Pseudomonas putida KT2440
caaggcauaaaaaag

SEQ ID NO: 3546733 - RNA, 19 nt, Pseudomonas putida KT2440
caaggcauccaccugcagg

SEQ ID NO: 3546734 - RNA, 16 nt, Pseudomonas putida KT2440
caaggcaucggcgccu

SEQ ID NO: 3546735 - RNA, 20 nt, Pseudomonas putida KT2440
caaggcauuuucaaugcuuu

SEQ ID NO: 3546736 - RNA, 21 nt, Pseudomonas putida KT2440
caaggcauuuucaaugcuuug

SEQ ID NO: 3546737 - RNA, 17 nt, Pseudomonas putida KT2440
caaucaucgccagcagc

SEQ ID NO: 3546738 - RNA, 19 nt, Pseudomonas putida KT2440
caaucaucggcaguagagc

SEQ ID NO: 3546739 - RNA, 13 nt, Pseudomonas putida KT2440
caauccagcccuc

SEQ ID NO: 3546740 - RNA, 21 nt, Pseudomonas putida KT2440
caaucccgccccaaaggaagu

SEQ ID NO: 3546741 - RNA, 21 nt, Pseudomonas putida KT2440
caaucccuaacggggggcuca

SEQ ID NO: 3546742 - RNA, 13 nt, Pseudomonas putida KT2440
caauccuggguga

SEQ ID NO: 3546743 - RNA, 22 nt, Pseudomonas putida KT2440
caaucgacaacauggucacaug

SEQ ID NO: 3546744 - RNA, 16 nt, Pseudomonas putida KT2440
caaucgagauguaguc

SEQ ID NO: 3546745 - RNA, 16 nt, Pseudomonas putida KT2440
caaucgaucacuucca

SEQ ID NO: 3546746 - RNA, 21 nt, Pseudomonas putida KT2440
caaucgccacacaagcccccc

SEQ ID NO: 3546747 - RNA, 15 nt, Pseudomonas putida KT2440
caaucgccgccugga

SEQ ID NO: 3546748 - RNA, 19 nt, Pseudomonas putida KT2440
caaucgccgggcgcaccac

SEQ ID NO: 3546749 - RNA, 14 nt, Pseudomonas putida KT2440
caaucgcugugcaa

SEQ ID NO: 3546750 - RNA, 22 nt, Pseudomonas putida KT2440
caaucgcugugcgugauuugaa

SEQ ID NO: 3546751 - RNA, 15 nt, Pseudomonas putida KT2440
caaucggcagcgcgc

SEQ ID NO: 3546752 - RNA, 23 nt, Pseudomonas putida KT2440
caaucggcgccaggaucgagacc

SEQ ID NO: 3546753 - RNA, 20 nt, Pseudomonas putida KT2440
caaucggcucaacagccacg

SEQ ID NO: 3546754 - RNA, 22 nt, Pseudomonas putida KT2440
caaucgggauggcaccggcagu

SEQ ID NO: 3546755 - RNA, 14 nt, Pseudomonas putida KT2440
caaucggguaaaac

SEQ ID NO: 3546756 - RNA, 21 nt, Pseudomonas putida KT2440
caaucggugccggcgagugca

SEQ ID NO: 3546757 - RNA, 23 nt, Pseudomonas putida KT2440
caaucggugccggcgagugcauu

SEQ ID NO: 3546758 - RNA, 20 nt, Pseudomonas putida KT2440
caaucgucaugaucgcuaca

SEQ ID NO: 3546759 - RNA, 15 nt, Pseudomonas putida KT2440
caaucgucggugaug

SEQ ID NO: 3546760 - RNA, 17 nt, Pseudomonas putida KT2440
caaucgucguaggcgcg

SEQ ID NO: 3546761 - RNA, 15 nt, Pseudomonas putida KT2440
caaucuccagcccga

SEQ ID NO: 3546762 - RNA, 18 nt, Pseudomonas putida KT2440
caaucucggucugucaac

SEQ ID NO: 3546763 - RNA, 22 nt, Pseudomonas putida KT2440
caaucugguuacccaacagacc

SEQ ID NO: 3546764 - RNA, 21 nt, Pseudomonas putida KT2440
caaucugugaggccagcggga

SEQ ID NO: 3546765 - RNA, 12 nt, Pseudomonas putida KT2440
caaucuucuuca

SEQ ID NO: 3546766 - RNA, 16 nt, Pseudomonas putida KT2440
caaucuuguggcggau

SEQ ID NO: 3546767 - RNA, 14 nt, Pseudomonas putida KT2440
caaugacuccgccc

SEQ ID NO: 3546768 - RNA, 15 nt, Pseudomonas putida KT2440
caaugaucgggcaga

SEQ ID NO: 3546769 - RNA, 19 nt, Pseudomonas putida KT2440
caaugcaauguuuucauac

SEQ ID NO: 3546770 - RNA, 13 nt, Pseudomonas putida KT2440
caaugcacagcgc

SEQ ID NO: 3546771 - RNA, 14 nt, Pseudomonas putida KT2440
caaugcacagcgcu

SEQ ID NO: 3546772 - RNA, 18 nt, Pseudomonas putida KT2440
caaugcacagcgcucgau

SEQ ID NO: 3546773 - RNA, 19 nt, Pseudomonas putida KT2440
caaugcagcuuugaggcuc

SEQ ID NO: 3546774 - RNA, 13 nt, Pseudomonas putida KT2440
caaugccagcagu

SEQ ID NO: 3546775 - RNA, 21 nt, Pseudomonas putida KT2440
caaugccagcaguucgcagcc

SEQ ID NO: 3546776 - RNA, 16 nt, Pseudomonas putida KT2440
caaugccggcacagcc

SEQ ID NO: 3546777 - RNA, 14 nt, Pseudomonas putida KT2440
caaugcgguccucc

SEQ ID NO: 3546778 - RNA, 18 nt, Pseudomonas putida KT2440
caaugcgguccuccuugg

SEQ ID NO: 3546779 - RNA, 21 nt, Pseudomonas putida KT2440
caaugcggugugcugcggcca

SEQ ID NO: 3546780 - RNA, 15 nt, Pseudomonas putida KT2440
caaugcgugggucgu

SEQ ID NO: 3546781 - RNA, 13 nt, Pseudomonas putida KT2440
caaugcucgccug

SEQ ID NO: 3546782 - RNA, 17 nt, Pseudomonas putida KT2440
caaugcugccuuuuccu

SEQ ID NO: 3546783 - RNA, 15 nt, Pseudomonas putida KT2440
caaugcuuucaguug

SEQ ID NO: 3546784 - RNA, 16 nt, Pseudomonas putida KT2440
caaugcuuucaguuga

SEQ ID NO: 3546785 - RNA, 22 nt, Pseudomonas putida KT2440
caaugcuuugauaccugcuugc

SEQ ID NO: 3546786 - RNA, 16 nt, Pseudomonas putida KT2440
caauggcaaucgccug

SEQ ID NO: 3546787 - RNA, 20 nt, Pseudomonas putida KT2440
caauggcacccucaccaacu

SEQ ID NO: 3546788 - RNA, 15 nt, Pseudomonas putida KT2440
caauggccugcaugu

SEQ ID NO: 3546789 - RNA, 20 nt, Pseudomonas putida KT2440
caauggccugcaugucggca

SEQ ID NO: 3546790 - RNA, 19 nt, Pseudomonas putida KT2440
caauggcgaaccgcuguuc

SEQ ID NO: 3546791 - RNA, 21 nt, Pseudomonas putida KT2440
caauggcgaugaacacgccgu

SEQ ID NO: 3546792 - RNA, 18 nt, Pseudomonas putida KT2440
caauggcgcgaacagggc

SEQ ID NO: 3546793 - RNA, 22 nt, Pseudomonas putida KT2440
caauggcgguuuugagacgcau

SEQ ID NO: 3546794 - RNA, 14 nt, Pseudomonas putida KT2440
caauggcguaucca

SEQ ID NO: 3546795 - RNA, 16 nt, Pseudomonas putida KT2440
caauggcgucacagac

SEQ ID NO: 3546796 - RNA, 15 nt, Pseudomonas putida KT2440
caaugggccgaucac

SEQ ID NO: 3546797 - RNA, 15 nt, Pseudomonas putida KT2440
caaugggcuucccca

SEQ ID NO: 3546798 - RNA, 21 nt, Pseudomonas putida KT2440
caaugucacuucuuucagcuc

SEQ ID NO: 3546799 - RNA, 16 nt, Pseudomonas putida KT2440
caaugucguauugagc

SEQ ID NO: 3546800 - RNA, 18 nt, Pseudomonas putida KT2440
caauguugaagaugacug

SEQ ID NO: 3546801 - RNA, 15 nt, Pseudomonas putida KT2440
caauucagcacaggc

SEQ ID NO: 3546802 - RNA, 16 nt, Pseudomonas putida KT2440
caauucgccggcagca

SEQ ID NO: 3546803 - RNA, 15 nt, Pseudomonas putida KT2440
caauucggccggcca

SEQ ID NO: 3546804 - RNA, 16 nt, Pseudomonas putida KT2440
caauugccggucgggc

SEQ ID NO: 3546805 - RNA, 15 nt, Pseudomonas putida KT2440
caauugcgccagccg

SEQ ID NO: 3546806 - RNA, 16 nt, Pseudomonas putida KT2440
caauugcgccagccgc

SEQ ID NO: 3546807 - RNA, 22 nt, Pseudomonas putida KT2440
caauugcgccagccgcucagcc

SEQ ID NO: 3546808 - RNA, 22 nt, Pseudomonas putida KT2440
caauugcggguguggccacacu

SEQ ID NO: 3546809 - RNA, 22 nt, Pseudomonas putida KT2440
caauuggcgguuuuuugccuga

SEQ ID NO: 3546810 - RNA, 17 nt, Pseudomonas putida KT2440
caauuuccugcgcggcc

SEQ ID NO: 3546811 - RNA, 21 nt, Pseudomonas putida KT2440
caauuucuaaaagcuggcgcg

SEQ ID NO: 3546812 - RNA, 15 nt, Pseudomonas putida KT2440
caauuucuacccgcc

SEQ ID NO: 3546813 - RNA, 21 nt, Pseudomonas putida KT2440
caauuucuugaggcacaaaaa

SEQ ID NO: 3546814 - RNA, 12 nt, Pseudomonas putida KT2440
caauuuggccag

SEQ ID NO: 3546815 - RNA, 13 nt, Pseudomonas putida KT2440
caauuuggccagc

SEQ ID NO: 3546816 - RNA, 18 nt, Pseudomonas putida KT2440
caauuuucgaccaaggcu

SEQ ID NO: 3546817 - RNA, 13 nt, Pseudomonas putida KT2440
cacaaaaaacccg

SEQ ID NO: 3546818 - RNA, 21 nt, Pseudomonas putida KT2440
cacaaaaccucaguuuuucuc

SEQ ID NO: 3546819 - RNA, 16 nt, Pseudomonas putida KT2440
cacaaacaaccgugaa

SEQ ID NO: 3546820 - RNA, 12 nt, Pseudomonas putida KT2440
cacaaaccacag

SEQ ID NO: 3546821 - RNA, 20 nt, Pseudomonas putida KT2440
cacaaaccacagcggccaca

SEQ ID NO: 3546822 - RNA, 16 nt, Pseudomonas putida KT2440
cacaaagcccaagggc

SEQ ID NO: 3546823 - RNA, 13 nt, Pseudomonas putida KT2440
cacaaagccuucc

SEQ ID NO: 3546824 - RNA, 20 nt, Pseudomonas putida KT2440
cacaaauccaggacaaacca

SEQ ID NO: 3546825 - RNA, 22 nt, Pseudomonas putida KT2440
cacaaaugcgcgaguuuccggc

SEQ ID NO: 3546826 - RNA, 14 nt, Pseudomonas putida KT2440
cacaaccacugcaa

SEQ ID NO: 3546827 - RNA, 18 nt, Pseudomonas putida KT2440
cacaacccuugcagcgcc

SEQ ID NO: 3546828 - RNA, 15 nt, Pseudomonas putida KT2440
cacaacggcgcgccc

SEQ ID NO: 3546829 - RNA, 14 nt, Pseudomonas putida KT2440
cacaagcugcugau

SEQ ID NO: 3546830 - RNA, 14 nt, Pseudomonas putida KT2440
cacaaggccgcucc

SEQ ID NO: 3546831 - RNA, 16 nt, Pseudomonas putida KT2440
cacaaggccgcuccca

SEQ ID NO: 3546832 - RNA, 23 nt, Pseudomonas putida KT2440
cacaaggcuguuccacagcaguc

SEQ ID NO: 3546833 - RNA, 14 nt, Pseudomonas putida KT2440
cacaagggccaggu

SEQ ID NO: 3546834 - RNA, 15 nt, Pseudomonas putida KT2440
cacaagggccagguc

SEQ ID NO: 3546835 - RNA, 15 nt, Pseudomonas putida KT2440
cacaauaagaugcgg

SEQ ID NO: 3546836 - RNA, 14 nt, Pseudomonas putida KT2440
cacaaucagcucgu

SEQ ID NO: 3546837 - RNA, 15 nt, Pseudomonas putida KT2440
cacacaaacaccggc

SEQ ID NO: 3546838 - RNA, 19 nt, Pseudomonas putida KT2440
cacacaacuguuuucaguu

SEQ ID NO: 3546839 - RNA, 13 nt, Pseudomonas putida KT2440
cacacagaugccg

SEQ ID NO: 3546840 - RNA, 22 nt, Pseudomonas putida KT2440
cacacagaugccgccgcugcca

SEQ ID NO: 3546841 - RNA, 15 nt, Pseudomonas putida KT2440
cacacauaucagcca

SEQ ID NO: 3546842 - RNA, 16 nt, Pseudomonas putida KT2440
cacacauaucagccaa

SEQ ID NO: 3546843 - RNA, 21 nt, Pseudomonas putida KT2440
cacagguacugcgcaaucccu

SEQ ID NO: 3546844 - RNA, 15 nt, Pseudomonas putida KT2440
cacagguaguucacu

SEQ ID NO: 3546845 - RNA, 23 nt, Pseudomonas putida KT2440
cacagguaguucacuggccagca

SEQ ID NO: 3546846 - RNA, 16 nt, Pseudomonas putida KT2440
cacagguaucgccgcc

SEQ ID NO: 3546847 - RNA, 18 nt, Pseudomonas putida KT2440
cacagguaucgccgcccu

SEQ ID NO: 3546848 - RNA, 21 nt, Pseudomonas putida KT2440
cacagguaucgccgcccuugg

SEQ ID NO: 3546849 - RNA, 21 nt, Pseudomonas putida KT2440
cacaggucauuugcagugcuu

SEQ ID NO: 3546850 - RNA, 16 nt, Pseudomonas putida KT2440
cacagguccagccgcc

SEQ ID NO: 3546851 - RNA, 17 nt, Pseudomonas putida KT2440
cacagguccagccgcca

SEQ ID NO: 3546852 - RNA, 19 nt, Pseudomonas putida KT2440
cacagguccagcgcaggcu

SEQ ID NO: 3546853 - RNA, 19 nt, Pseudomonas putida KT2440
cacagguuuagcgcuggcu

SEQ ID NO: 3546854 - RNA, 21 nt, Pseudomonas putida KT2440
cacagguuuagcgcuggcuuu

SEQ ID NO: 3546855 - RNA, 22 nt, Pseudomonas putida KT2440
cacagguuuagcgcuggcuuug

SEQ ID NO: 3546856 - RNA, 15 nt, Pseudomonas putida KT2440
cacagugcggcggca

SEQ ID NO: 3546857 - RNA, 20 nt, Pseudomonas putida KT2440
cacagugguguacagcaaca

SEQ ID NO: 3546858 - RNA, 21 nt, Pseudomonas putida KT2440
cacaguucauuguucuggcca

SEQ ID NO: 3546859 - RNA, 16 nt, Pseudomonas putida KT2440
cacauacuccaccgcc

SEQ ID NO: 3546860 - RNA, 20 nt, Pseudomonas putida KT2440
cacauacugcuucugccguu

SEQ ID NO: 3546861 - RNA, 14 nt, Pseudomonas putida KT2440
cacauaucagccaa

SEQ ID NO: 3546862 - RNA, 11 nt, Pseudomonas putida KT2440
cacaucaccag

SEQ ID NO: 3546863 - RNA, 13 nt, Pseudomonas putida KT2440
cacaucaccagca

SEQ ID NO: 3546864 - RNA, 13 nt, Pseudomonas putida KT2440
cacauccacagcc

SEQ ID NO: 3546865 - RNA, 15 nt, Pseudomonas putida KT2440
cacauccacagccuc

SEQ ID NO: 3546866 - RNA, 16 nt, Pseudomonas putida KT2440
cacauccacagccucc

SEQ ID NO: 3546867 - RNA, 16 nt, Pseudomonas putida KT2440
cacauccacauccggu

SEQ ID NO: 3546868 - RNA, 20 nt, Pseudomonas putida KT2440
cacauccaccaggcuggcca

SEQ ID NO: 3546869 - RNA, 15 nt, Pseudomonas putida KT2440
cacauccagcgccgc

SEQ ID NO: 3546870 - RNA, 18 nt, Pseudomonas putida KT2440
cacauccagcgccucccc

SEQ ID NO: 3546871 - RNA, 23 nt, Pseudomonas putida KT2440
cacaucccagaacuucaccccgu

SEQ ID NO: 3546872 - RNA, 15 nt, Pseudomonas putida KT2440
cacauccccgccgcc

SEQ ID NO: 3546873 - RNA, 16 nt, Pseudomonas putida KT2440
cacauccgaccccagc

SEQ ID NO: 3546874 - RNA, 17 nt, Pseudomonas putida KT2440
cacauccgaccccagca

SEQ ID NO: 3546875 - RNA, 20 nt, Pseudomonas putida KT2440
cacauccucaaaggcagccu

SEQ ID NO: 3546876 - RNA, 13 nt, Pseudomonas putida KT2440
cacauccucugcc

SEQ ID NO: 3546877 - RNA, 14 nt, Pseudomonas putida KT2440
cacaucgaucaggu

SEQ ID NO: 3546878 - RNA, 21 nt, Pseudomonas putida KT2440
cacaucgccaggugcucagcc

SEQ ID NO: 3546879 - RNA, 15 nt, Pseudomonas putida KT2440
cacaucgcuucugca

SEQ ID NO: 3546880 - RNA, 21 nt, Pseudomonas putida KT2440
cacaucggucggccccucgac

SEQ ID NO: 3546881 - RNA, 18 nt, Pseudomonas putida KT2440
cacaucgguuucgccggu

SEQ ID NO: 3546882 - RNA, 23 nt, Pseudomonas putida KT2440
cacaucuugccccggugcccauu

SEQ ID NO: 3546883 - RNA, 21 nt, Pseudomonas putida KT2440
cacaugaaggccguaggccag

SEQ ID NO: 3546884 - RNA, 21 nt, Pseudomonas putida KT2440
cacaugcaaacccuggcccug

SEQ ID NO: 3546885 - RNA, 13 nt, Pseudomonas putida KT2440
cacaugcccgcgg

SEQ ID NO: 3546886 - RNA, 15 nt, Pseudomonas putida KT2440
cacaugccugcacug

SEQ ID NO: 3546887 - RNA, 23 nt, Pseudomonas putida KT2440
cacaugcgagccgcugccaaagu

SEQ ID NO: 3546888 - RNA, 16 nt, Pseudomonas putida KT2440
cacaugcgccacaccc

SEQ ID NO: 3546889 - RNA, 20 nt, Pseudomonas putida KT2440
cacaugcgccacacccgcua

SEQ ID NO: 3546890 - RNA, 13 nt, Pseudomonas putida KT2440
cacaugcugcgcc

SEQ ID NO: 3546891 - RNA, 15 nt, Pseudomonas putida KT2440
cacauguaaugaaaa

SEQ ID NO: 3546892 - RNA, 21 nt, Pseudomonas putida KT2440
cacauuaccgcguguggcauu

SEQ ID NO: 3546893 - RNA, 17 nt, Pseudomonas putida KT2440
cacauuauccaccaggc

SEQ ID NO: 3546894 - RNA, 13 nt, Pseudomonas putida KT2440
cacauucagcagc

SEQ ID NO: 3546895 - RNA, 14 nt, Pseudomonas putida KT2440
cacauucagcagcg

SEQ ID NO: 3546896 - RNA, 24 nt, Pseudomonas putida KT2440
cacauugggcacuucgcucaugga

SEQ ID NO: 3546897 - RNA, 13 nt, Pseudomonas putida KT2440
caccaaacacgcc

SEQ ID NO: 3546898 - RNA, 20 nt, Pseudomonas putida KT2440
caccaacacuuccagcaucg

SEQ ID NO: 3546899 - RNA, 13 nt, Pseudomonas putida KT2440
caccaacagcacc

SEQ ID NO: 3546900 - RNA, 16 nt, Pseudomonas putida KT2440
caccaacagcaccggc

SEQ ID NO: 3546901 - RNA, 16 nt, Pseudomonas putida KT2440
caccaacccacggcaa

SEQ ID NO: 3546902 - RNA, 21 nt, Pseudomonas putida KT2440
caccaacgccgauagccagcu

SEQ ID NO: 3546903 - RNA, 20 nt, Pseudomonas putida KT2440
caccaacuggucggccuugc

SEQ ID NO: 3546904 - RNA, 21 nt, Pseudomonas putida KT2440
caccaagucgauuuucacgcc

SEQ ID NO: 3546905 - RNA, 21 nt, Pseudomonas putida KT2440
caccaaugaaagugucggccg

SEQ ID NO: 3546906 - RNA, 20 nt, Pseudomonas putida KT2440
caccaaugacuccgccccaa

SEQ ID NO: 3546907 - RNA, 12 nt, Pseudomonas putida KT2440
caccaauggcca

SEQ ID NO: 3546908 - RNA, 13 nt, Pseudomonas putida KT2440
caccaauggccau

SEQ ID NO: 3546909 - RNA, 14 nt, Pseudomonas putida KT2440
caccaauggccaua

SEQ ID NO: 3546910 - RNA, 15 nt, Pseudomonas putida KT2440
caccaauuugcggcc

SEQ ID NO: 3546911 - RNA, 13 nt, Pseudomonas putida KT2440
caccacaaaaccu

SEQ ID NO: 3546912 - RNA, 17 nt, Pseudomonas putida KT2440
caccacaaaaccucagu

SEQ ID NO: 3546913 - RNA, 18 nt, Pseudomonas putida KT2440
caccacaaaaccucaguu

SEQ ID NO: 3546914 - RNA, 19 nt, Pseudomonas putida KT2440
caccacaaaccacagcggc

SEQ ID NO: 3546915 - RNA, 21 nt, Pseudomonas putida KT2440
caccacaaaccacagcggcca

SEQ ID NO: 3546916 - RNA, 13 nt, Pseudomonas putida KT2440
caccacacccggc

SEQ ID NO: 3546917 - RNA, 14 nt, Pseudomonas putida KT2440
caccacacggcagc

SEQ ID NO: 3546918 - RNA, 16 nt, Pseudomonas putida KT2440
caccacacuagccccu

SEQ ID NO: 3546919 - RNA, 14 nt, Pseudomonas putida KT2440
caccacagcugcac

SEQ ID NO: 3546920 - RNA, 20 nt, Pseudomonas putida KT2440
caccacagcugcacaucucc

SEQ ID NO: 3546921 - RNA, 21 nt, Pseudomonas putida KT2440
caccacagcugcacaucucca

SEQ ID NO: 3546922 - RNA, 14 nt, Pseudomonas putida KT2440
caccacaguucauu

SEQ ID NO: 3546923 - RNA, 16 nt, Pseudomonas putida KT2440
caccacauacggcgca

SEQ ID NO: 3546924 - RNA, 19 nt, Pseudomonas putida KT2440
caccacauccgaccccagc

SEQ ID NO: 3546925 - RNA, 22 nt, Pseudomonas putida KT2440
caccacauccgaccccagcaug

SEQ ID NO: 3546926 - RNA, 15 nt, Pseudomonas putida KT2440
caccacaugcacggc

SEQ ID NO: 3546927 - RNA, 16 nt, Pseudomonas putida KT2440
caccaccagcaacacg

SEQ ID NO: 3546928 - RNA, 11 nt, Pseudomonas putida KT2440
caccaccagcc

SEQ ID NO: 3546929 - RNA, 18 nt, Pseudomonas putida KT2440
caccaccagcgcccuuca

SEQ ID NO: 3546930 - RNA, 14 nt, Pseudomonas putida KT2440
caccaccaggugcu

SEQ ID NO: 3546931 - RNA, 14 nt, Pseudomonas putida KT2440
caccacccccagcg

SEQ ID NO: 3546932 - RNA, 17 nt, Pseudomonas putida KT2440
caccacccccagcgacc

SEQ ID NO: 3546933 - RNA, 16 nt, Pseudomonas putida KT2440
caccacccccagcgcc

SEQ ID NO: 3546934 - RNA, 17 nt, Pseudomonas putida KT2440
caccacccccagcgccu

SEQ ID NO: 3546935 - RNA, 20 nt, Pseudomonas putida KT2440
caccacccccagcgccucca

SEQ ID NO: 3546936 - RNA, 20 nt, Pseudomonas putida KT2440
caccaccccggggcgcucca

SEQ ID NO: 3546937 - RNA, 23 nt, Pseudomonas putida KT2440
caccaccccggggcgcuccagca

SEQ ID NO: 3546938 - RNA, 19 nt, Pseudomonas putida KT2440
caccacccggucggccagc

SEQ ID NO: 3546939 - RNA, 20 nt, Pseudomonas putida KT2440
caccacccuggcaugccccu

SEQ ID NO: 3546940 - RNA, 17 nt, Pseudomonas putida KT2440
caccaccgaccgcaccg

SEQ ID NO: 3546941 - RNA, 19 nt, Pseudomonas putida KT2440
caccaccgagccuuccggg

SEQ ID NO: 3546942 - RNA, 14 nt, Pseudomonas putida KT2440
caccaccgauccgg

SEQ ID NO: 3546943 - RNA, 21 nt, Pseudomonas putida KT2440
caccaccgcgaaacacagcag

SEQ ID NO: 3546944 - RNA, 23 nt, Pseudomonas putida KT2440
caccaccggccgacccgccuggu

SEQ ID NO: 3546945 - RNA, 20 nt, Pseudomonas putida KT2440
caccaccugcagggucaggc

SEQ ID NO: 3546946 - RNA, 19 nt, Pseudomonas putida KT2440
caccaccugugccggcagc

SEQ ID NO: 3546947 - RNA, 19 nt, Pseudomonas putida KT2440
caccacgaacgcccccagc

SEQ ID NO: 3546948 - RNA, 15 nt, Pseudomonas putida KT2440
caccaugagccccgc

SEQ ID NO: 3546949 - RNA, 13 nt, Pseudomonas putida KT2440
caccaugcccaca

SEQ ID NO: 3546950 - RNA, 14 nt, Pseudomonas putida KT2440
caccaugcucagga

SEQ ID NO: 3546951 - RNA, 15 nt, Pseudomonas putida KT2440
caccaugcucggcca

SEQ ID NO: 3546952 - RNA, 20 nt, Pseudomonas putida KT2440
caccauguacugcagacagu

SEQ ID NO: 3546953 - RNA, 15 nt, Pseudomonas putida KT2440
cacccaaccugccga

SEQ ID NO: 3546954 - RNA, 20 nt, Pseudomonas putida KT2440
cacccaacgaacggaacagg

SEQ ID NO: 3546955 - RNA, 12 nt, Pseudomonas putida KT2440
cacccaaggcau

SEQ ID NO: 3546956 - RNA, 17 nt, Pseudomonas putida KT2440
cacccaaggcauccagc

SEQ ID NO: 3546957 - RNA, 15 nt, Pseudomonas putida KT2440
cacccaauagcccac

SEQ ID NO: 3546958 - RNA, 13 nt, Pseudomonas putida KT2440
cacccacacccgc

SEQ ID NO: 3546959 - RNA, 12 nt, Pseudomonas putida KT2440
cacccacaccuc

SEQ ID NO: 3546960 - RNA, 16 nt, Pseudomonas putida KT2440
cacccacaccucgacc

SEQ ID NO: 3546961 - RNA, 20 nt, Pseudomonas putida KT2440
cacccacagagacaccgcag

SEQ ID NO: 3546962 - RNA, 19 nt, Pseudomonas putida KT2440
cacccacaggcacgacuga

SEQ ID NO: 3546963 - RNA, 12 nt, Pseudomonas putida KT2440
cacccaccagcc

SEQ ID NO: 3546964 - RNA, 14 nt, Pseudomonas putida KT2440
cacccaccagccaa

SEQ ID NO: 3546965 - RNA, 16 nt, Pseudomonas putida KT2440
cacccaccgcagguca

SEQ ID NO: 3546966 - RNA, 19 nt, Pseudomonas putida KT2440
cacccaccuuggcccuucc

SEQ ID NO: 3546967 - RNA, 20 nt, Pseudomonas putida KT2440
cacccaccuuggcccuuccu

SEQ ID NO: 3546968 - RNA, 13 nt, Pseudomonas putida KT2440
cacccacuggccg

SEQ ID NO: 3546969 - RNA, 17 nt, Pseudomonas putida KT2440
cacccagaucaucaucg

SEQ ID NO: 3546970 - RNA, 13 nt, Pseudomonas putida KT2440
cacccagaugcgg

SEQ ID NO: 3546971 - RNA, 20 nt, Pseudomonas putida KT2440
cacccagcacccgcaggcga

SEQ ID NO: 3546972 - RNA, 18 nt, Pseudomonas putida KT2440
cacccagcacgaaggcca

SEQ ID NO: 3546973 - RNA, 14 nt, Pseudomonas putida KT2440
cacccagcaggccg

SEQ ID NO: 3546974 - RNA, 23 nt, Pseudomonas putida KT2440
cacccagcgcuugagaccaggcc

SEQ ID NO: 3546975 - RNA, 22 nt, Pseudomonas putida KT2440
cacccagcguauagccaccggg

SEQ ID NO: 3546976 - RNA, 14 nt, Pseudomonas putida KT2440
cacccagcucgcca

SEQ ID NO: 3546977 - RNA, 16 nt, Pseudomonas putida KT2440
cacccagcucgccaac

SEQ ID NO: 3546978 - RNA, 19 nt, Pseudomonas putida KT2440
cacccagcucgccaacacc

SEQ ID NO: 3546979 - RNA, 22 nt, Pseudomonas putida KT2440
cacccaggcccugacgccagcg

SEQ ID NO: 3546980 - RNA, 15 nt, Pseudomonas putida KT2440
cacccaggcucgccc

SEQ ID NO: 3546981 - RNA, 18 nt, Pseudomonas putida KT2440
cacccagucgccccgcca

SEQ ID NO: 3546982 - RNA, 21 nt, Pseudomonas putida KT2440
cacccaucggcgcgaagguca

SEQ ID NO: 3546983 - RNA, 20 nt, Pseudomonas putida KT2440
caccccagaacggcacgccc

SEQ ID NO: 3546984 - RNA, 14 nt, Pseudomonas putida KT2440
caccccagccgcuc

SEQ ID NO: 3546985 - RNA, 18 nt, Pseudomonas putida KT2440
caccccauagggccagcg

SEQ ID NO: 3546986 - RNA, 21 nt, Pseudomonas putida KT2440
caccccauagggccagcggcu

SEQ ID NO: 3546987 - RNA, 22 nt, Pseudomonas putida KT2440
caccccauagggccagcggcuu

SEQ ID NO: 3546988 - RNA, 19 nt, Pseudomonas putida KT2440
cacccccagcgccuccacc

SEQ ID NO: 3546989 - RNA, 18 nt, Pseudomonas putida KT2440
cacccccagguuauccac

SEQ ID NO: 3546990 - RNA, 18 nt, Pseudomonas putida KT2440
cacccccaucagcgggcg

SEQ ID NO: 3546991 - RNA, 13 nt, Pseudomonas putida KT2440
caccccccagcag

SEQ ID NO: 3546992 - RNA, 14 nt, Pseudomonas putida KT2440
caccccccagcagc

SEQ ID NO: 3546993 - RNA, 16 nt, Pseudomonas putida KT2440
caccccccagcagcgg

SEQ ID NO: 3546994 - RNA, 14 nt, Pseudomonas putida KT2440
cacccccgccgcca

SEQ ID NO: 3546995 - RNA, 15 nt, Pseudomonas putida KT2440
caccccgaccaaggc

SEQ ID NO: 3546996 - RNA, 20 nt, Pseudomonas putida KT2440
caccccgaccaaggccaacu

SEQ ID NO: 3546997 - RNA, 21 nt, Pseudomonas putida KT2440
caccccgaguguuucaaaaaa

SEQ ID NO: 3546998 - RNA, 17 nt, Pseudomonas putida KT2440
caccccgauucacagca

SEQ ID NO: 3546999 - RNA, 19 nt, Pseudomonas putida KT2440
caccccgcaaagcccugcc

SEQ ID NO: 3547000 - RNA, 12 nt, Pseudomonas putida KT2440
caccccggcagu

SEQ ID NO: 3547001 - RNA, 17 nt, Pseudomonas putida KT2440
caccccggcagugccug

SEQ ID NO: 3547002 - RNA, 22 nt, Pseudomonas putida KT2440
caccccggcagugccuggaugc

SEQ ID NO: 3547003 - RNA, 18 nt, Pseudomonas putida KT2440
caccccggcguucagccg

SEQ ID NO: 3547004 - RNA, 14 nt, Pseudomonas putida KT2440
caccccggugcagg

SEQ ID NO: 3547005 - RNA, 21 nt, Pseudomonas putida KT2440
caccccggugcagguuggagc

SEQ ID NO: 3547006 - RNA, 19 nt, Pseudomonas putida KT2440
caccccucggcucacgccc

SEQ ID NO: 3547007 - RNA, 16 nt, Pseudomonas putida KT2440
caccccuugcaguauc

SEQ ID NO: 3547008 - RNA, 17 nt, Pseudomonas putida KT2440
caccccuuucuccagca

SEQ ID NO: 3547009 - RNA, 18 nt, Pseudomonas putida KT2440
cacccgacgccaccuucg

SEQ ID NO: 3547010 - RNA, 19 nt, Pseudomonas putida KT2440
cacccgcccaucgcacacc

SEQ ID NO: 3547011 - RNA, 21 nt, Pseudomonas putida KT2440
cacccgcccaucgcacacccu

SEQ ID NO: 3547012 - RNA, 16 nt, Pseudomonas putida KT2440
cacccgccccucuucc

SEQ ID NO: 3547013 - RNA, 17 nt, Pseudomonas putida KT2440
cacccgcgaaugcggua

SEQ ID NO: 3547014 - RNA, 18 nt, Pseudomonas putida KT2440
cacccgcgaaugcuacag

SEQ ID NO: 3547015 - RNA, 20 nt, Pseudomonas putida KT2440
cacccgcgaccacaggcgcu

SEQ ID NO: 3547016 - RNA, 14 nt, Pseudomonas putida KT2440
cacccgcgccacca

SEQ ID NO: 3547017 - RNA, 17 nt, Pseudomonas putida KT2440
cacccgcgccaccagcc

SEQ ID NO: 3547018 - RNA, 14 nt, Pseudomonas putida KT2440
cacccgcgcgcuga

SEQ ID NO: 3547019 - RNA, 16 nt, Pseudomonas putida KT2440
cacccgcuccaacaaa

SEQ ID NO: 3547020 - RNA, 22 nt, Pseudomonas putida KT2440
cacccgcugcacgucgcgcagg

SEQ ID NO: 3547021 - RNA, 17 nt, Pseudomonas putida KT2440
cacccgcugggcuucuu

SEQ ID NO: 3547022 - RNA, 19 nt, Pseudomonas putida KT2440
cacccgcuugccacggcgu

SEQ ID NO: 3547023 - RNA, 22 nt, Pseudomonas putida KT2440
cacccgcuugccuuccucggcc

SEQ ID NO: 3547024 - RNA, 14 nt, Pseudomonas putida KT2440
cacccgcuuguagc

SEQ ID NO: 3547025 - RNA, 15 nt, Pseudomonas putida KT2440
cacccggacccuggu

SEQ ID NO: 3547026 - RNA, 15 nt, Pseudomonas putida KT2440
cacccggcgcgcagc

SEQ ID NO: 3547027 - RNA, 22 nt, Pseudomonas putida KT2440
cacccggcugaaauggcggccc

SEQ ID NO: 3547028 - RNA, 12 nt, Pseudomonas putida KT2440
cacccggcugca

SEQ ID NO: 3547029 - RNA, 18 nt, Pseudomonas putida KT2440
cacccgggaacagcagca

SEQ ID NO: 3547030 - RNA, 14 nt, Pseudomonas putida KT2440
cacccgggcccgcu

SEQ ID NO: 3547031 - RNA, 14 nt, Pseudomonas putida KT2440
cacccggggcagca

SEQ ID NO: 3547032 - RNA, 20 nt, Pseudomonas putida KT2440
cacccggggcagcaucacca

SEQ ID NO: 3547033 - RNA, 22 nt, Pseudomonas putida KT2440
cacccggggcagcaucaccacg

SEQ ID NO: 3547034 - RNA, 16 nt, Pseudomonas putida KT2440
cacccggucccgcccg

SEQ ID NO: 3547035 - RNA, 18 nt, Pseudomonas putida KT2440
cacccgguccugguccga

SEQ ID NO: 3547036 - RNA, 18 nt, Pseudomonas putida KT2440
cacccggucggccagcug

SEQ ID NO: 3547037 - RNA, 20 nt, Pseudomonas putida KT2440
cacccggucggccagcugcu

SEQ ID NO: 3547038 - RNA, 15 nt, Pseudomonas putida KT2440
cacccgugcagggcu

SEQ ID NO: 3547039 - RNA, 22 nt, Pseudomonas putida KT2440
cacccgugcaggggucugugca

SEQ ID NO: 3547040 - RNA, 13 nt, Pseudomonas putida KT2440
cacccgugccugc

SEQ ID NO: 3547041 - RNA, 16 nt, Pseudomonas putida KT2440
cacccgugccugccug

SEQ ID NO: 3547042 - RNA, 18 nt, Pseudomonas putida KT2440
cacccguggcagcccccc

SEQ ID NO: 3547043 - RNA, 23 nt, Pseudomonas putida KT2440
cacccguggcagcccccccagca

SEQ ID NO: 3547044 - RNA, 14 nt, Pseudomonas putida KT2440
cacccucaccaacu

SEQ ID NO: 3547045 - RNA, 13 nt, Pseudomonas putida KT2440
cacccucacccac

SEQ ID NO: 3547046 - RNA, 20 nt, Pseudomonas putida KT2440
cacccucacgaugacccuuc

SEQ ID NO: 3547047 - RNA, 20 nt, Pseudomonas putida KT2440
cacccuccgggucaggccga

SEQ ID NO: 3547048 - RNA, 16 nt, Pseudomonas putida KT2440
cacccucgcaccacag

SEQ ID NO: 3547049 - RNA, 16 nt, Pseudomonas putida KT2440
cacccucgccccgcgc

SEQ ID NO: 3547050 - RNA, 18 nt, Pseudomonas putida KT2440
cacccucguaacgagccu

SEQ ID NO: 3547051 - RNA, 21 nt, Pseudomonas putida KT2440
cacccucguaacgagccuugg

SEQ ID NO: 3547052 - RNA, 21 nt, Pseudomonas putida KT2440
cacccugaucgaugagcgagc

SEQ ID NO: 3547053 - RNA, 17 nt, Pseudomonas putida KT2440
cacccugcaccacggca

SEQ ID NO: 3547054 - RNA, 14 nt, Pseudomonas putida KT2440
caccggcaaucgac

SEQ ID NO: 3547055 - RNA, 21 nt, Pseudomonas putida KT2440
caccggcaaucgacucaagga

SEQ ID NO: 3547056 - RNA, 14 nt, Pseudomonas putida KT2440
caccggcaccaucu

SEQ ID NO: 3547057 - RNA, 14 nt, Pseudomonas putida KT2440
caccggcaccugcu

SEQ ID NO: 3547058 - RNA, 13 nt, Pseudomonas putida KT2440
caccggcagcagc

SEQ ID NO: 3547059 - RNA, 15 nt, Pseudomonas putida KT2440
caccggcagcagcaa

SEQ ID NO: 3547060 - RNA, 16 nt, Pseudomonas putida KT2440
caccggcaucgaaggu

SEQ ID NO: 3547061 - RNA, 22 nt, Pseudomonas putida KT2440
caccggcaucgaaggugguagc

SEQ ID NO: 3547062 - RNA, 20 nt, Pseudomonas putida KT2440
caccggcauucccggcgcca

SEQ ID NO: 3547063 - RNA, 15 nt, Pseudomonas putida KT2440
caccggccagcgcgc

SEQ ID NO: 3547064 - RNA, 19 nt, Pseudomonas putida KT2440
caccggccccccagccagc

SEQ ID NO: 3547065 - RNA, 13 nt, Pseudomonas putida KT2440
caccggccgaccc

SEQ ID NO: 3547066 - RNA, 12 nt, Pseudomonas putida KT2440
caccggccgcca

SEQ ID NO: 3547067 - RNA, 15 nt, Pseudomonas putida KT2440
caccggccgccagga

SEQ ID NO: 3547068 - RNA, 16 nt, Pseudomonas putida KT2440
caccggccgccgccag

SEQ ID NO: 3547069 - RNA, 20 nt, Pseudomonas putida KT2440
caccggccgccgccagacca

SEQ ID NO: 3547070 - RNA, 21 nt, Pseudomonas putida KT2440
caccggccucuucgcgggcaa

SEQ ID NO: 3547071 - RNA, 22 nt, Pseudomonas putida KT2440
caccggccuugccguagaugcc

SEQ ID NO: 3547072 - RNA, 18 nt, Pseudomonas putida KT2440
caccggccuuggccagcu

SEQ ID NO: 3547073 - RNA, 21 nt, Pseudomonas putida KT2440
caccggccuuggccagcucau

SEQ ID NO: 3547074 - RNA, 19 nt, Pseudomonas putida KT2440
caccggcgaguccugccuu

SEQ ID NO: 3547075 - RNA, 13 nt, Pseudomonas putida KT2440
caccggcgaugcc

SEQ ID NO: 3547076 - RNA, 21 nt, Pseudomonas putida KT2440
caccggcgccaaucaucgcca

SEQ ID NO: 3547077 - RNA, 22 nt, Pseudomonas putida KT2440
caccggcgccaaucaucgccag

SEQ ID NO: 3547078 - RNA, 21 nt, Pseudomonas putida KT2440
caccggcgugccgucgagcag

SEQ ID NO: 3547079 - RNA, 22 nt, Pseudomonas putida KT2440
caccggcuccaccugcuccagc

SEQ ID NO: 3547080 - RNA, 20 nt, Pseudomonas putida KT2440
caccggcucugccgguguuc

SEQ ID NO: 3547081 - RNA, 18 nt, Pseudomonas putida KT2440
caccggcugcgccggugu

SEQ ID NO: 3547082 - RNA, 20 nt, Pseudomonas putida KT2440
caccggcuucgccgguguuc

SEQ ID NO: 3547083 - RNA, 21 nt, Pseudomonas putida KT2440
caccggcuucgucggcgcgga

SEQ ID NO: 3547084 - RNA, 16 nt, Pseudomonas putida KT2440
caccggcuucuaccac

SEQ ID NO: 3547085 - RNA, 17 nt, Pseudomonas putida KT2440
caccgggauacugcgca

SEQ ID NO: 3547086 - RNA, 16 nt, Pseudomonas putida KT2440
caccgggaugcucugc

SEQ ID NO: 3547087 - RNA, 21 nt, Pseudomonas putida KT2440
caccgggaugcucugcagcag

SEQ ID NO: 3547088 - RNA, 22 nt, Pseudomonas putida KT2440
caccgggauggcggcgccugcc

SEQ ID NO: 3547089 - RNA, 22 nt, Pseudomonas putida KT2440
caccgggcacuuggcauuggcc

SEQ ID NO: 3547090 - RNA, 23 nt, Pseudomonas putida KT2440
caccgggcuggcauaguccagga

SEQ ID NO: 3547091 - RNA, 18 nt, Pseudomonas putida KT2440
caccgguacauugcgcac

SEQ ID NO: 3547092 - RNA, 19 nt, Pseudomonas putida KT2440
caccgguacauugcgcacc

SEQ ID NO: 3547093 - RNA, 21 nt, Pseudomonas putida KT2440
caccgguaccgcucugcgcca

SEQ ID NO: 3547094 - RNA, 18 nt, Pseudomonas putida KT2440
caccgguagcggcguugu

SEQ ID NO: 3547095 - RNA, 16 nt, Pseudomonas putida KT2440
caccgguauagcgaca

SEQ ID NO: 3547096 - RNA, 21 nt, Pseudomonas putida KT2440
caccgguauagcgacaggcuu

SEQ ID NO: 3547097 - RNA, 18 nt, Pseudomonas putida KT2440
caccgguaucgaugcaca

SEQ ID NO: 3547098 - RNA, 20 nt, Pseudomonas putida KT2440
caccggucgccuguaggagc

SEQ ID NO: 3547099 - RNA, 15 nt, Pseudomonas putida KT2440
caccgguuacaccca

SEQ ID NO: 3547100 - RNA, 23 nt, Pseudomonas putida KT2440
caccgguucgcccccacgggcau

SEQ ID NO: 3547101 - RNA, 15 nt, Pseudomonas putida KT2440
caccguacuugcugc

SEQ ID NO: 3547102 - RNA, 19 nt, Pseudomonas putida KT2440
caccguagcgagcaccggc

SEQ ID NO: 3547103 - RNA, 22 nt, Pseudomonas putida KT2440
caccguagcgagcaccggcagu

SEQ ID NO: 3547104 - RNA, 11 nt, Pseudomonas putida KT2440
caccgucgaug

SEQ ID NO: 3547105 - RNA, 15 nt, Pseudomonas putida KT2440
caccgucgaugucgg

SEQ ID NO: 3547106 - RNA, 18 nt, Pseudomonas putida KT2440
caccgucgaugucggcgu

SEQ ID NO: 3547107 - RNA, 12 nt, Pseudomonas putida KT2440
caccgucggcgc

SEQ ID NO: 3547108 - RNA, 23 nt, Pseudomonas putida KT2440
caccgugagcauggcaaacagca

SEQ ID NO: 3547109 - RNA, 20 nt, Pseudomonas putida KT2440
caccgugcaccagcaccacc

SEQ ID NO: 3547110 - RNA, 14 nt, Pseudomonas putida KT2440
caccgugcuguguu

SEQ ID NO: 3547111 - RNA, 13 nt, Pseudomonas putida KT2440
caccguggcagca

SEQ ID NO: 3547112 - RNA, 18 nt, Pseudomonas putida KT2440
caccguucuucuccaaca

SEQ ID NO: 3547113 - RNA, 15 nt, Pseudomonas putida KT2440
caccguugccgccac

SEQ ID NO: 3547114 - RNA, 19 nt, Pseudomonas putida KT2440
caccguugcgcucgagccc

SEQ ID NO: 3547115 - RNA, 21 nt, Pseudomonas putida KT2440
caccguugcgcucgagcccgc

SEQ ID NO: 3547116 - RNA, 23 nt, Pseudomonas putida KT2440
caccguugcgcucgagcccgcca

SEQ ID NO: 3547117 - RNA, 15 nt, Pseudomonas putida KT2440
caccuaucgcugccg

SEQ ID NO: 3547118 - RNA, 20 nt, Pseudomonas putida KT2440
caccucaauguucuguagcc

SEQ ID NO: 3547119 - RNA, 17 nt, Pseudomonas putida KT2440
caccucaucccccggcc

SEQ ID NO: 3547120 - RNA, 18 nt, Pseudomonas putida KT2440
caccucaucgacccuggc

SEQ ID NO: 3547121 - RNA, 21 nt, Pseudomonas putida KT2440
caccucaucggcauugcugaa

SEQ ID NO: 3547122 - RNA, 22 nt, Pseudomonas putida KT2440
caccucaucggcauugcugaag

SEQ ID NO: 3547123 - RNA, 18 nt, Pseudomonas putida KT2440
caccuccaccccgcaggc

SEQ ID NO: 3547124 - RNA, 14 nt, Pseudomonas putida KT2440
caccuccaccuuca

SEQ ID NO: 3547125 - RNA, 10 nt, Pseudomonas putida KT2440
caccuccaga

SEQ ID NO: 3547126 - RNA, 11 nt, Pseudomonas putida KT2440
caccuccagag

SEQ ID NO: 3547127 - RNA, 18 nt, Pseudomonas putida KT2440
caccucccgcgcauccuc

SEQ ID NO: 3547128 - RNA, 19 nt, Pseudomonas putida KT2440
caccucccgcgcauccucc

SEQ ID NO: 3547129 - RNA, 14 nt, Pseudomonas putida KT2440
caccuccgcccggu

SEQ ID NO: 3547130 - RNA, 18 nt, Pseudomonas putida KT2440
caccucgacccccuugcc

SEQ ID NO: 3547131 - RNA, 17 nt, Pseudomonas putida KT2440
caccucgaugguuaucu

SEQ ID NO: 3547132 - RNA, 22 nt, Pseudomonas putida KT2440
caccucggaugccacgcugaac

SEQ ID NO: 3547133 - RNA, 15 nt, Pseudomonas putida KT2440
caccucggcaccgca

SEQ ID NO: 3547134 - RNA, 16 nt, Pseudomonas putida KT2440
caccucggcaccgcac

SEQ ID NO: 3547135 - RNA, 23 nt, Pseudomonas putida KT2440
caccucgguaaaggugcccugcu

SEQ ID NO: 3547136 - RNA, 16 nt, Pseudomonas putida KT2440
caccucguaaggccug

SEQ ID NO: 3547137 - RNA, 20 nt, Pseudomonas putida KT2440
caccucguccagguugagca

SEQ ID NO: 3547138 - RNA, 18 nt, Pseudomonas putida KT2440
caccucuaucaccuguuc

SEQ ID NO: 3547139 - RNA, 19 nt, Pseudomonas putida KT2440
caccucuaucaccuguucc

SEQ ID NO: 3547140 - RNA, 16 nt, Pseudomonas putida KT2440
caccucuggguagugc

SEQ ID NO: 3547141 - RNA, 20 nt, Pseudomonas putida KT2440
caccugacacauaggcagcc

SEQ ID NO: 3547142 - RNA, 22 nt, Pseudomonas putida KT2440
caccugacacauaggcagccac

SEQ ID NO: 3547143 - RNA, 16 nt, Pseudomonas putida KT2440
caccugaccaucagcc

SEQ ID NO: 3547144 - RNA, 23 nt, Pseudomonas putida KT2440
caccugacgcaagcgcgccgcca

SEQ ID NO: 3547145 - RNA, 14 nt, Pseudomonas putida KT2440
caccugacgcgcca

SEQ ID NO: 3547146 - RNA, 15 nt, Pseudomonas putida KT2440
caccugcaacaccuc

SEQ ID NO: 3547147 - RNA, 17 nt, Pseudomonas putida KT2440
caccugcaacaccucca

SEQ ID NO: 3547148 - RNA, 14 nt, Pseudomonas putida KT2440
caccugcagcgcgu

SEQ ID NO: 3547149 - RNA, 19 nt, Pseudomonas putida KT2440
caccugcagguacagcagc

SEQ ID NO: 3547150 - RNA, 23 nt, Pseudomonas putida KT2440
caccugcagguacagcagcugca

SEQ ID NO: 3547151 - RNA, 19 nt, Pseudomonas putida KT2440
caccugccaacgcaccgac

SEQ ID NO: 3547152 - RNA, 20 nt, Pseudomonas putida KT2440
caccugccaacgcaccgacc

SEQ ID NO: 3547153 - RNA, 20 nt, Pseudomonas putida KT2440
caccugccacacacccgggc

SEQ ID NO: 3547154 - RNA, 14 nt, Pseudomonas putida KT2440
caccugccagcccc

SEQ ID NO: 3547155 - RNA, 18 nt, Pseudomonas putida KT2440
caccugccagccccgcac

SEQ ID NO: 3547156 - RNA, 22 nt, Pseudomonas putida KT2440
caccugccccagcgucacccgu

SEQ ID NO: 3547157 - RNA, 15 nt, Pseudomonas putida KT2440
caccugcccgcccuc

SEQ ID NO: 3547158 - RNA, 12 nt, Pseudomonas putida KT2440
cacgcagcucgg

SEQ ID NO: 3547159 - RNA, 15 nt, Pseudomonas putida KT2440
cacgcaggccagcgc

SEQ ID NO: 3547160 - RNA, 15 nt, Pseudomonas putida KT2440
cacgcaggcccagca

SEQ ID NO: 3547161 - RNA, 19 nt, Pseudomonas putida KT2440
cacgcaggcccagcaggua

SEQ ID NO: 3547162 - RNA, 12 nt, Pseudomonas putida KT2440
cacgcaggcgca

SEQ ID NO: 3547163 - RNA, 14 nt, Pseudomonas putida KT2440
cacgcagggccaga

SEQ ID NO: 3547164 - RNA, 16 nt, Pseudomonas putida KT2440
cacgcaggucuugccc

SEQ ID NO: 3547165 - RNA, 16 nt, Pseudomonas putida KT2440
cacgcaguuggccauc

SEQ ID NO: 3547166 - RNA, 15 nt, Pseudomonas putida KT2440
cacgcaucugcaccu

SEQ ID NO: 3547167 - RNA, 14 nt, Pseudomonas putida KT2440
cacgcaucugcgcu

SEQ ID NO: 3547168 - RNA, 18 nt, Pseudomonas putida KT2440
cacgcaugccgaugucgg

SEQ ID NO: 3547169 - RNA, 21 nt, Pseudomonas putida KT2440
cacgcaugcgcgacagcauca

SEQ ID NO: 3547170 - RNA, 19 nt, Pseudomonas putida KT2440
cacgcauguccuuggccca

SEQ ID NO: 3547171 - RNA, 16 nt, Pseudomonas putida KT2440
cacgccaaucaccugc

SEQ ID NO: 3547172 - RNA, 19 nt, Pseudomonas putida KT2440
cacgccaaucaccugcaca

SEQ ID NO: 3547173 - RNA, 16 nt, Pseudomonas putida KT2440
cacgccaccgcgcgcc

SEQ ID NO: 3547174 - RNA, 14 nt, Pseudomonas putida KT2440
cacgccacggaaca

SEQ ID NO: 3547175 - RNA, 19 nt, Pseudomonas putida KT2440
cacgccacggaacaucgag

SEQ ID NO: 3547176 - RNA, 18 nt, Pseudomonas putida KT2440
cacgccagaaccugacaa

SEQ ID NO: 3547177 - RNA, 19 nt, Pseudomonas putida KT2440
cacgccagcagcguuguuc

SEQ ID NO: 3547178 - RNA, 16 nt, Pseudomonas putida KT2440
cacgccagccguugau

SEQ ID NO: 3547179 - RNA, 22 nt, Pseudomonas putida KT2440
cacgccauguaccgggcggcca

SEQ ID NO: 3547180 - RNA, 19 nt, Pseudomonas putida KT2440
cacgcccaacccagccagc

SEQ ID NO: 3547181 - RNA, 15 nt, Pseudomonas putida KT2440
cacgcccaaccccag

SEQ ID NO: 3547182 - RNA, 14 nt, Pseudomonas putida KT2440
cacgcccaggcgcu

SEQ ID NO: 3547183 - RNA, 17 nt, Pseudomonas putida KT2440
cacgcccaucaggaaca

SEQ ID NO: 3547184 - RNA, 23 nt, Pseudomonas putida KT2440
cacgcccaucaggaacagcucga

SEQ ID NO: 3547185 - RNA, 16 nt, Pseudomonas putida KT2440
cacgcccauggcucca

SEQ ID NO: 3547186 - RNA, 20 nt, Pseudomonas putida KT2440
cacgccccuuggcacggcca

SEQ ID NO: 3547187 - RNA, 20 nt, Pseudomonas putida KT2440
cacgcccgaccggucggcca

SEQ ID NO: 3547188 - RNA, 14 nt, Pseudomonas putida KT2440
cacgcccgccggca

SEQ ID NO: 3547189 - RNA, 23 nt, Pseudomonas putida KT2440
cacgcccgcgugcuucaagccau

SEQ ID NO: 3547190 - RNA, 17 nt, Pseudomonas putida KT2440
cacgcccgcucccacag

SEQ ID NO: 3547191 - RNA, 19 nt, Pseudomonas putida KT2440
cacgcccgcucccacaggc

SEQ ID NO: 3547192 - RNA, 22 nt, Pseudomonas putida KT2440
cacgcccgcucccacaggugca

SEQ ID NO: 3547193 - RNA, 18 nt, Pseudomonas putida KT2440
cacgcccgcugcaugcuc

SEQ ID NO: 3547194 - RNA, 14 nt, Pseudomonas putida KT2440
cacgcccggcaccu

SEQ ID NO: 3547195 - RNA, 16 nt, Pseudomonas putida KT2440
cacgcccggcaccugc

SEQ ID NO: 3547196 - RNA, 22 nt, Pseudomonas putida KT2440
cacgcccggcaccugccgggca

SEQ ID NO: 3547197 - RNA, 11 nt, Pseudomonas putida KT2440
cacgcccggcc

SEQ ID NO: 3547198 - RNA, 13 nt, Pseudomonas putida KT2440
cacgcccgucacc

SEQ ID NO: 3547199 - RNA, 15 nt, Pseudomonas putida KT2440
cacgcccgugcucac

SEQ ID NO: 3547200 - RNA, 21 nt, Pseudomonas putida KT2440
cacgcccuggcccgccgccac

SEQ ID NO: 3547201 - RNA, 23 nt, Pseudomonas putida KT2440
cacgcccuggcccgccgccacca

SEQ ID NO: 3547202 - RNA, 13 nt, Pseudomonas putida KT2440
cacgcccuuggcu

SEQ ID NO: 3547203 - RNA, 23 nt, Pseudomonas putida KT2440
cacgcccuuuuucaccaggcggu

SEQ ID NO: 3547204 - RNA, 22 nt, Pseudomonas putida KT2440
cacgccgaagcgcgccuggucg

SEQ ID NO: 3547205 - RNA, 13 nt, Pseudomonas putida KT2440
cacgccgcugcca

SEQ ID NO: 3547206 - RNA, 19 nt, Pseudomonas putida KT2440
cacgccgcugccaaccggc

SEQ ID NO: 3547207 - RNA, 20 nt, Pseudomonas putida KT2440
cacgccgcugccaaccggcu

SEQ ID NO: 3547208 - RNA, 14 nt, Pseudomonas putida KT2440
cacgccgcugcggc

SEQ ID NO: 3547209 - RNA, 18 nt, Pseudomonas putida KT2440
cacgccgguaucacccag

SEQ ID NO: 3547210 - RNA, 13 nt, Pseudomonas putida KT2440
cacgccgucgacc

SEQ ID NO: 3547211 - RNA, 14 nt, Pseudomonas putida KT2440
cacgccgucgaccu

SEQ ID NO: 3547212 - RNA, 16 nt, Pseudomonas putida KT2440
cacgccgucgaccuug

SEQ ID NO: 3547213 - RNA, 14 nt, Pseudomonas putida KT2440
cacgccucaugauc

SEQ ID NO: 3547214 - RNA, 12 nt, Pseudomonas putida KT2440
cacgccugcgcc

SEQ ID NO: 3547215 - RNA, 16 nt, Pseudomonas putida KT2440
cacgccugcgccgcuc

SEQ ID NO: 3547216 - RNA, 19 nt, Pseudomonas putida KT2440
cacgccugcgccgcucgug

SEQ ID NO: 3547217 - RNA, 17 nt, Pseudomonas putida KT2440
cacgccuuaguucaccc

SEQ ID NO: 3547218 - RNA, 15 nt, Pseudomonas putida KT2440
cacgccuuccaccgg

SEQ ID NO: 3547219 - RNA, 22 nt, Pseudomonas putida KT2440
cacgccuuggucgaaccgcaac

SEQ ID NO: 3547220 - RNA, 19 nt, Pseudomonas putida KT2440
cacgcgaaucgccagggcu

SEQ ID NO: 3547221 - RNA, 16 nt, Pseudomonas putida KT2440
cacgcgaccucagccg

SEQ ID NO: 3547222 - RNA, 22 nt, Pseudomonas putida KT2440
cacgcgacgggaagugcacugc

SEQ ID NO: 3547223 - RNA, 20 nt, Pseudomonas putida KT2440
cacgcgcaaaugcuugcccg

SEQ ID NO: 3547224 - RNA, 15 nt, Pseudomonas putida KT2440
cacgcgccaaccgcg

SEQ ID NO: 3547225 - RNA, 21 nt, Pseudomonas putida KT2440
cacgcgccacauagcuggcac

SEQ ID NO: 3547226 - RNA, 14 nt, Pseudomonas putida KT2440
cacgcgccagcagc

SEQ ID NO: 3547227 - RNA, 15 nt, Pseudomonas putida KT2440
cacgcgccagcagcg

SEQ ID NO: 3547228 - RNA, 19 nt, Pseudomonas putida KT2440
cacgcgccagcagcgcgug

SEQ ID NO: 3547229 - RNA, 12 nt, Pseudomonas putida KT2440
cacgcgccaggu

SEQ ID NO: 3547230 - RNA, 15 nt, Pseudomonas putida KT2440
cacgcgccaggucgg

SEQ ID NO: 3547231 - RNA, 18 nt, Pseudomonas putida KT2440
cacgcgcccugugggagc

SEQ ID NO: 3547232 - RNA, 13 nt, Pseudomonas putida KT2440
cacgcgcuuuucc

SEQ ID NO: 3547233 - RNA, 19 nt, Pseudomonas putida KT2440
cacgcggcaauccgcugga

SEQ ID NO: 3547234 - RNA, 15 nt, Pseudomonas putida KT2440
cacgcggguccagcg

SEQ ID NO: 3547235 - RNA, 16 nt, Pseudomonas putida KT2440
cacgcggguccagcgc

SEQ ID NO: 3547236 - RNA, 21 nt, Pseudomonas putida KT2440
cacgcggguccagcgcggcca

SEQ ID NO: 3547237 - RNA, 16 nt, Pseudomonas putida KT2440
cacgcgguaccugugg

SEQ ID NO: 3547238 - RNA, 20 nt, Pseudomonas putida KT2440
cacgcggugggucgacgaac

SEQ ID NO: 3547239 - RNA, 15 nt, Pseudomonas putida KT2440
cacgcguaccccugg

SEQ ID NO: 3547240 - RNA, 16 nt, Pseudomonas putida KT2440
cacgcguaccccuggc

SEQ ID NO: 3547241 - RNA, 14 nt, Pseudomonas putida KT2440
cacgcguugggggu

SEQ ID NO: 3547242 - RNA, 23 nt, Pseudomonas putida KT2440
cacgcguugggggugcuuuuccu

SEQ ID NO: 3547243 - RNA, 13 nt, Pseudomonas putida KT2440
cacgcuaauaccc

SEQ ID NO: 3547244 - RNA, 18 nt, Pseudomonas putida KT2440
cacgcuaccaccuggcuc

SEQ ID NO: 3547245 - RNA, 17 nt, Pseudomonas putida KT2440
cacgcucaugaacagcg

SEQ ID NO: 3547246 - RNA, 19 nt, Pseudomonas putida KT2440
cacgcucaugaacagcgcc

SEQ ID NO: 3547247 - RNA, 21 nt, Pseudomonas putida KT2440
cacgcucaugaacagcgccca

SEQ ID NO: 3547248 - RNA, 19 nt, Pseudomonas putida KT2440
cacgcucguuguccagcag

SEQ ID NO: 3547249 - RNA, 20 nt, Pseudomonas putida KT2440
cacgcucguuguccagcagc

SEQ ID NO: 3547250 - RNA, 20 nt, Pseudomonas putida KT2440
cacgcucuguaucgaacagg

SEQ ID NO: 3547251 - RNA, 22 nt, Pseudomonas putida KT2440
cacgcugaucugaaaguucagc

SEQ ID NO: 3547252 - RNA, 15 nt, Pseudomonas putida KT2440
cacgcugcugcguac

SEQ ID NO: 3547253 - RNA, 16 nt, Pseudomonas putida KT2440
cacgcugcugcuggcc

SEQ ID NO: 3547254 - RNA, 16 nt, Pseudomonas putida KT2440
cacgcuuacagguagu

SEQ ID NO: 3547255 - RNA, 19 nt, Pseudomonas putida KT2440
cacgcuucgauccgcgccc

SEQ ID NO: 3547256 - RNA, 20 nt, Pseudomonas putida KT2440
cacgcuucgauccgcgccca

SEQ ID NO: 3547257 - RNA, 17 nt, Pseudomonas putida KT2440
cacgcuugagcgcgccg

SEQ ID NO: 3547258 - RNA, 19 nt, Pseudomonas putida KT2440
cacgcuugagcgcgccgcc

SEQ ID NO: 3547259 - RNA, 16 nt, Pseudomonas putida KT2440
cacgcuugccaaggcu

SEQ ID NO: 3547260 - RNA, 18 nt, Pseudomonas putida KT2440
cacgcuuggcucaucacc

SEQ ID NO: 3547261 - RNA, 14 nt, Pseudomonas putida KT2440
cacgcuuucacaaa

SEQ ID NO: 3547262 - RNA, 17 nt, Pseudomonas putida KT2440
cacggaucaccuggccg

SEQ ID NO: 3547263 - RNA, 20 nt, Pseudomonas putida KT2440
cacggaucagccgcgggcgu

SEQ ID NO: 3547264 - RNA, 15 nt, Pseudomonas putida KT2440
cacugacaaagccug

SEQ ID NO: 3547265 - RNA, 22 nt, Pseudomonas putida KT2440
cacugacaaagccugcacccag

SEQ ID NO: 3547266 - RNA, 12 nt, Pseudomonas putida KT2440
cacugacagcau

SEQ ID NO: 3547267 - RNA, 16 nt, Pseudomonas putida KT2440
cacugacagcaugccc

SEQ ID NO: 3547268 - RNA, 19 nt, Pseudomonas putida KT2440
cacugaccagcccggcucc

SEQ ID NO: 3547269 - RNA, 12 nt, Pseudomonas putida KT2440
cacugaccaggu

SEQ ID NO: 3547270 - RNA, 18 nt, Pseudomonas putida KT2440
cacugacccucaagugcc

SEQ ID NO: 3547271 - RNA, 21 nt, Pseudomonas putida KT2440
cacugaguaacucaccugguu

SEQ ID NO: 3547272 - RNA, 22 nt, Pseudomonas putida KT2440
cacugaugcgccaguacgccag

SEQ ID NO: 3547273 - RNA, 19 nt, Pseudomonas putida KT2440
cacugaugucguugaccgu

SEQ ID NO: 3547274 - RNA, 21 nt, Pseudomonas putida KT2440
cacugaugucguugaccgugu

SEQ ID NO: 3547275 - RNA, 13 nt, Pseudomonas putida KT2440
cacugaugucuuc

SEQ ID NO: 3547276 - RNA, 14 nt, Pseudomonas putida KT2440
cacugcaaauaccc

SEQ ID NO: 3547277 - RNA, 23 nt, Pseudomonas putida KT2440
cacugcaccaaugacuccgcccc

SEQ ID NO: 3547278 - RNA, 20 nt, Pseudomonas putida KT2440
cacugcacccgugcagggcu

SEQ ID NO: 3547279 - RNA, 17 nt, Pseudomonas putida KT2440
cacugcacccucuuccu

SEQ ID NO: 3547280 - RNA, 18 nt, Pseudomonas putida KT2440
cacugcaccucccgccac

SEQ ID NO: 3547281 - RNA, 22 nt, Pseudomonas putida KT2440
cacugcacgcuucgauccgcgc

SEQ ID NO: 3547282 - RNA, 16 nt, Pseudomonas putida KT2440
cacugcagaucaccag

SEQ ID NO: 3547283 - RNA, 13 nt, Pseudomonas putida KT2440
cacugcaggagcg

SEQ ID NO: 3547284 - RNA, 16 nt, Pseudomonas putida KT2440
cacugcaggagcgggc

SEQ ID NO: 3547285 - RNA, 23 nt, Pseudomonas putida KT2440
cacugcaggugcagguucgacca

SEQ ID NO: 3547286 - RNA, 19 nt, Pseudomonas putida KT2440
cacugcauuggccacgccc

SEQ ID NO: 3547287 - RNA, 12 nt, Pseudomonas putida KT2440
cacugccaccgu

SEQ ID NO: 3547288 - RNA, 17 nt, Pseudomonas putida KT2440
cacugccagcaccuggc

SEQ ID NO: 3547289 - RNA, 17 nt, Pseudomonas putida KT2440
cacugccagcccggcgg

SEQ ID NO: 3547290 - RNA, 20 nt, Pseudomonas putida KT2440
cacugccagcccggcggcca

SEQ ID NO: 3547291 - RNA, 18 nt, Pseudomonas putida KT2440
cacugccagcgccucacc

SEQ ID NO: 3547292 - RNA, 14 nt, Pseudomonas putida KT2440
cacugccaucucgc

SEQ ID NO: 3547293 - RNA, 19 nt, Pseudomonas putida KT2440
cacugccaucucgccaagc

SEQ ID NO: 3547294 - RNA, 20 nt, Pseudomonas putida KT2440
cacugccaucucgccaagca

SEQ ID NO: 3547295 - RNA, 19 nt, Pseudomonas putida KT2440
cacugcccaagccauccac

SEQ ID NO: 3547296 - RNA, 13 nt, Pseudomonas putida KT2440
cacugcccagcag

SEQ ID NO: 3547297 - RNA, 19 nt, Pseudomonas putida KT2440
cacugcccagcagccccac

SEQ ID NO: 3547298 - RNA, 20 nt, Pseudomonas putida KT2440
cacugccgugaucgccgggc

SEQ ID NO: 3547299 - RNA, 22 nt, Pseudomonas putida KT2440
cacugccgugaucgccgggcgc

SEQ ID NO: 3547300 - RNA, 23 nt, Pseudomonas putida KT2440
cacugccgugaucgccgggcgca

SEQ ID NO: 3547301 - RNA, 15 nt, Pseudomonas putida KT2440
cacugccugcacggc

SEQ ID NO: 3547302 - RNA, 16 nt, Pseudomonas putida KT2440
cacugccugcacggca

SEQ ID NO: 3547303 - RNA, 17 nt, Pseudomonas putida KT2440
cacugccugcacggcaa

SEQ ID NO: 3547304 - RNA, 14 nt, Pseudomonas putida KT2440
cacugccugcaugc

SEQ ID NO: 3547305 - RNA, 15 nt, Pseudomonas putida KT2440
cacugccugcaugcg

SEQ ID NO: 3547306 - RNA, 17 nt, Pseudomonas putida KT2440
cacugccuggccacugu

SEQ ID NO: 3547307 - RNA, 20 nt, Pseudomonas putida KT2440
cacugccuggcucaggcgcu

SEQ ID NO: 3547308 - RNA, 23 nt, Pseudomonas putida KT2440
cacugccuugcccugcagcuucc

SEQ ID NO: 3547309 - RNA, 15 nt, Pseudomonas putida KT2440
cacugcgaagcccag

SEQ ID NO: 3547310 - RNA, 19 nt, Pseudomonas putida KT2440
cacugcgcagcccucccag

SEQ ID NO: 3547311 - RNA, 14 nt, Pseudomonas putida KT2440
cacugcgcgccguu

SEQ ID NO: 3547312 - RNA, 15 nt, Pseudomonas putida KT2440
cacugcgcgccguug

SEQ ID NO: 3547313 - RNA, 16 nt, Pseudomonas putida KT2440
cacugcgcgccguugc

SEQ ID NO: 3547314 - RNA, 18 nt, Pseudomonas putida KT2440
cacugcgcgccguugcac

SEQ ID NO: 3547315 - RNA, 23 nt, Pseudomonas putida KT2440
cacugcgcuacgacccaccgacc

SEQ ID NO: 3547316 - RNA, 22 nt, Pseudomonas putida KT2440
cacugcgcuugcgaccgaugcc

SEQ ID NO: 3547317 - RNA, 23 nt, Pseudomonas putida KT2440
cacugcguauuuuugcgccaggc

SEQ ID NO: 3547318 - RNA, 14 nt, Pseudomonas putida KT2440
cacugcucagugcu

SEQ ID NO: 3547319 - RNA, 22 nt, Pseudomonas putida KT2440
cacugcuguuccagaagcggcu

SEQ ID NO: 3547320 - RNA, 14 nt, Pseudomonas putida KT2440
cacugcuucugagc

SEQ ID NO: 3547321 - RNA, 22 nt, Pseudomonas putida KT2440
cacugcuucugagccagccgcg

SEQ ID NO: 3547322 - RNA, 13 nt, Pseudomonas putida KT2440
cacuggcaggccu

SEQ ID NO: 3547323 - RNA, 19 nt, Pseudomonas putida KT2440
cacuggcaggcucagggca

SEQ ID NO: 3547324 - RNA, 12 nt, Pseudomonas putida KT2440
cacuggcaugcg

SEQ ID NO: 3547325 - RNA, 17 nt, Pseudomonas putida KT2440
cacuggccaacucccca

SEQ ID NO: 3547326 - RNA, 22 nt, Pseudomonas putida KT2440
cacuggccaacuccccacccag

SEQ ID NO: 3547327 - RNA, 21 nt, Pseudomonas putida KT2440
cacuggccagcagggccgccc

SEQ ID NO: 3547328 - RNA, 12 nt, Pseudomonas putida KT2440
cacuggccucuu

SEQ ID NO: 3547329 - RNA, 15 nt, Pseudomonas putida KT2440
cacuggcgacagccc

SEQ ID NO: 3547330 - RNA, 23 nt, Pseudomonas putida KT2440
cacuggcgauguagcaauggccc

SEQ ID NO: 3547331 - RNA, 19 nt, Pseudomonas putida KT2440
cacuggcugauagccgcca

SEQ ID NO: 3547332 - RNA, 14 nt, Pseudomonas putida KT2440
cacuggcugcugcg

SEQ ID NO: 3547333 - RNA, 11 nt, Pseudomonas putida KT2440
cacuggcuucc

SEQ ID NO: 3547334 - RNA, 17 nt, Pseudomonas putida KT2440
cacuggcuuucccccag

SEQ ID NO: 3547335 - RNA, 19 nt, Pseudomonas putida KT2440
cacuggcuuucccccagcc

SEQ ID NO: 3547336 - RNA, 20 nt, Pseudomonas putida KT2440
cacugggcgauggcgucgac

SEQ ID NO: 3547337 - RNA, 16 nt, Pseudomonas putida KT2440
cacuggggguucgcca

SEQ ID NO: 3547338 - RNA, 14 nt, Pseudomonas putida KT2440
cacuguagcgcccu

SEQ ID NO: 3547339 - RNA, 21 nt, Pseudomonas putida KT2440
cacuguaggcaaacagcucga

SEQ ID NO: 3547340 - RNA, 17 nt, Pseudomonas putida KT2440
cacugucccgaucaggu

SEQ ID NO: 3547341 - RNA, 14 nt, Pseudomonas putida KT2440
cacugucccggcac

SEQ ID NO: 3547342 - RNA, 19 nt, Pseudomonas putida KT2440
cacugucccggcacaaccg

SEQ ID NO: 3547343 - RNA, 23 nt, Pseudomonas putida KT2440
cacuguccuggguuacggcggcc

SEQ ID NO: 3547344 - RNA, 20 nt, Pseudomonas putida KT2440
cacugugcccgccaggcgca

SEQ ID NO: 3547345 - RNA, 19 nt, Pseudomonas putida KT2440
cacuguucagauacgccug

SEQ ID NO: 3547346 - RNA, 14 nt, Pseudomonas putida KT2440
cacuguugcagcgc

SEQ ID NO: 3547347 - RNA, 15 nt, Pseudomonas putida KT2440
cacuguugcagcgcc

SEQ ID NO: 3547348 - RNA, 23 nt, Pseudomonas putida KT2440
cacuguugcagcgccaguuaccc

SEQ ID NO: 3547349 - RNA, 21 nt, Pseudomonas putida KT2440
cacuuacacgcaagccccccg

SEQ ID NO: 3547350 - RNA, 19 nt, Pseudomonas putida KT2440
cacuucaauggcacccuca

SEQ ID NO: 3547351 - RNA, 15 nt, Pseudomonas putida KT2440
cacuuccaacacccg

SEQ ID NO: 3547352 - RNA, 17 nt, Pseudomonas putida KT2440
cacuuccaacacccgga

SEQ ID NO: 3547353 - RNA, 11 nt, Pseudomonas putida KT2440
cacuuccacac

SEQ ID NO: 3547354 - RNA, 14 nt, Pseudomonas putida KT2440
cacuuccagcagcu

SEQ ID NO: 3547355 - RNA, 21 nt, Pseudomonas putida KT2440
cacuuccaggaaggccucgcc

SEQ ID NO: 3547356 - RNA, 14 nt, Pseudomonas putida KT2440
cacuucgacauggc

SEQ ID NO: 3547357 - RNA, 22 nt, Pseudomonas putida KT2440
cacuucgaucaggcagucuuca

SEQ ID NO: 3547358 - RNA, 23 nt, Pseudomonas putida KT2440
cacuucgguuucuuucucaggcg

SEQ ID NO: 3547359 - RNA, 20 nt, Pseudomonas putida KT2440
cacuucugcggccagggcau

SEQ ID NO: 3547360 - RNA, 15 nt, Pseudomonas putida KT2440
cacuugaagugcccg

SEQ ID NO: 3547361 - RNA, 22 nt, Pseudomonas putida KT2440
cacuugauugggcuuggcagca

SEQ ID NO: 3547362 - RNA, 17 nt, Pseudomonas putida KT2440
cacuugcguucgccgcu

SEQ ID NO: 3547363 - RNA, 18 nt, Pseudomonas putida KT2440
cacuugcucggugcugcu

SEQ ID NO: 3547364 - RNA, 22 nt, Pseudomonas putida KT2440
cacuugcucggugcugcugcca

SEQ ID NO: 3547365 - RNA, 17 nt, Pseudomonas putida KT2440
cacuugcuugacagcgu

SEQ ID NO: 3547366 - RNA, 16 nt, Pseudomonas putida KT2440
cacuuggaaaacagcg

SEQ ID NO: 3547367 - RNA, 22 nt, Pseudomonas putida KT2440
cacuuggccugcugauuagagu

SEQ ID NO: 3547368 - RNA, 16 nt, Pseudomonas putida KT2440
cacuugggaucgaugc

SEQ ID NO: 3547369 - RNA, 18 nt, Pseudomonas putida KT2440
cagaucagaacgaggcgu

SEQ ID NO: 3547370 - RNA, 20 nt, Pseudomonas putida KT2440
cagaucagaacgaggcguug

SEQ ID NO: 3547371 - RNA, 14 nt, Pseudomonas putida KT2440
cagaucagccacgg

SEQ ID NO: 3547372 - RNA, 17 nt, Pseudomonas putida KT2440
cagaucaucaucggcau

SEQ ID NO: 3547373 - RNA, 14 nt, Pseudomonas putida KT2440
cagauccaggugcc

SEQ ID NO: 3547374 - RNA, 15 nt, Pseudomonas putida KT2440
cagauccaucggcgu

SEQ ID NO: 3547375 - RNA, 15 nt, Pseudomonas putida KT2440
cagaucccgcuccuc

SEQ ID NO: 3547376 - RNA, 13 nt, Pseudomonas putida KT2440
cagauccugcagc

SEQ ID NO: 3547377 - RNA, 18 nt, Pseudomonas putida KT2440
cagauccugcagccgcac

SEQ ID NO: 3547378 - RNA, 24 nt, Pseudomonas putida KT2440
cagauccuugaucaacugacgcag

SEQ ID NO: 3547379 - RNA, 14 nt, Pseudomonas putida KT2440
cagaucgagcgccc

SEQ ID NO: 3547380 - RNA, 16 nt, Pseudomonas putida KT2440
cagaucgagcgccgcc

SEQ ID NO: 3547381 - RNA, 19 nt, Pseudomonas putida KT2440
cagaucgagcgccgcccgg

SEQ ID NO: 3547382 - RNA, 15 nt, Pseudomonas putida KT2440
cagaugaccaaagau

SEQ ID NO: 3547383 - RNA, 17 nt, Pseudomonas putida KT2440
cagaugccgccgcugcc

SEQ ID NO: 3547384 - RNA, 16 nt, Pseudomonas putida KT2440
cagaugcgggcccugg

SEQ ID NO: 3547385 - RNA, 14 nt, Pseudomonas putida KT2440
cagaugcugcugca

SEQ ID NO: 3547386 - RNA, 16 nt, Pseudomonas putida KT2440
cagaugcugcugcagu

SEQ ID NO: 3547387 - RNA, 18 nt, Pseudomonas putida KT2440
cagaugcugcugcagugc

SEQ ID NO: 3547388 - RNA, 20 nt, Pseudomonas putida KT2440
cagaugcugcugcagugccu

SEQ ID NO: 3547389 - RNA, 20 nt, Pseudomonas putida KT2440
cagauggcagacaaguccuu

SEQ ID NO: 3547390 - RNA, 22 nt, Pseudomonas putida KT2440
cagauggccgcuugcugaucaa

SEQ ID NO: 3547391 - RNA, 22 nt, Pseudomonas putida KT2440
cagaugguggcauagcgcggcg

SEQ ID NO: 3547392 - RNA, 13 nt, Pseudomonas putida KT2440
cagaugucuggca

SEQ ID NO: 3547393 - RNA, 16 nt, Pseudomonas putida KT2440
cagaugucuggcauca

SEQ ID NO: 3547394 - RNA, 19 nt, Pseudomonas putida KT2440
cagauuacgcgucaucugc

SEQ ID NO: 3547395 - RNA, 14 nt, Pseudomonas putida KT2440
cagauucaagcccg

SEQ ID NO: 3547396 - RNA, 19 nt, Pseudomonas putida KT2440
cagauuucgugggucaugu

SEQ ID NO: 3547397 - RNA, 16 nt, Pseudomonas putida KT2440
cagcaaaccgaccagg

SEQ ID NO: 3547398 - RNA, 22 nt, Pseudomonas putida KT2440
cagcaaagaauguucgacgaac

SEQ ID NO: 3547399 - RNA, 24 nt, Pseudomonas putida KT2440
cagcaaauacgguugcagcacacu

SEQ ID NO: 3547400 - RNA, 17 nt, Pseudomonas putida KT2440
cagcaacaagcuggaca

SEQ ID NO: 3547401 - RNA, 23 nt, Pseudomonas putida KT2440
cagcaacacauacuccaccgcca

SEQ ID NO: 3547402 - RNA, 12 nt, Pseudomonas putida KT2440
cagcaacaccgc

SEQ ID NO: 3547403 - RNA, 18 nt, Pseudomonas putida KT2440
cagcaacacgacgauggc

SEQ ID NO: 3547404 - RNA, 20 nt, Pseudomonas putida KT2440
cagcaacacgacgauggcca

SEQ ID NO: 3547405 - RNA, 21 nt, Pseudomonas putida KT2440
cagcaacacgacgauggccac

SEQ ID NO: 3547406 - RNA, 18 nt, Pseudomonas putida KT2440
cagcaacacgcagucgaa

SEQ ID NO: 3547407 - RNA, 14 nt, Pseudomonas putida KT2440
cagcaacagcccca

SEQ ID NO: 3547408 - RNA, 17 nt, Pseudomonas putida KT2440
cagcaacagcugccggg

SEQ ID NO: 3547409 - RNA, 13 nt, Pseudomonas putida KT2440
cagcaacaucgcc

SEQ ID NO: 3547410 - RNA, 13 nt, Pseudomonas putida KT2440
cagcaacaucugc

SEQ ID NO: 3547411 - RNA, 18 nt, Pseudomonas putida KT2440
cagcaacaugccggccca

SEQ ID NO: 3547412 - RNA, 19 nt, Pseudomonas putida KT2440
cagcaacaugccggcccaa

SEQ ID NO: 3547413 - RNA, 19 nt, Pseudomonas putida KT2440
cagcaaccacgcuuggcuc

SEQ ID NO: 3547414 - RNA, 16 nt, Pseudomonas putida KT2440
cagcaaccugcugggc

SEQ ID NO: 3547415 - RNA, 17 nt, Pseudomonas putida KT2440
cagcaaccugcugggca

SEQ ID NO: 3547416 - RNA, 15 nt, Pseudomonas putida KT2440
cagcaacgcagccag

SEQ ID NO: 3547417 - RNA, 16 nt, Pseudomonas putida KT2440
cagcaacgcagccagg

SEQ ID NO: 3547418 - RNA, 15 nt, Pseudomonas putida KT2440
cagcaacgccaccag

SEQ ID NO: 3547419 - RNA, 15 nt, Pseudomonas putida KT2440
cagcaacgcccgcaa

SEQ ID NO: 3547420 - RNA, 21 nt, Pseudomonas putida KT2440
cagcaacgcccgcaacaaccu

SEQ ID NO: 3547421 - RNA, 14 nt, Pseudomonas putida KT2440
cagcaacgccgagc

SEQ ID NO: 3547422 - RNA, 15 nt, Pseudomonas putida KT2440
cagcaacgccgagca

SEQ ID NO: 3547423 - RNA, 19 nt, Pseudomonas putida KT2440
cagcaacggccgcgccgcg

SEQ ID NO: 3547424 - RNA, 22 nt, Pseudomonas putida KT2440
cagcaacggccgcgccgcgccc

SEQ ID NO: 3547425 - RNA, 20 nt, Pseudomonas putida KT2440
cagcaacggugaaaaacgcg

SEQ ID NO: 3547426 - RNA, 14 nt, Pseudomonas putida KT2440
cagcaacucccccc

SEQ ID NO: 3547427 - RNA, 22 nt, Pseudomonas putida KT2440
cagcaacuccccccgcgccaga

SEQ ID NO: 3547428 - RNA, 23 nt, Pseudomonas putida KT2440
cagcaacugcgccguggccgcca

SEQ ID NO: 3547429 - RNA, 14 nt, Pseudomonas putida KT2440
cagcaacuucucgg

SEQ ID NO: 3547430 - RNA, 22 nt, Pseudomonas putida KT2440
cagcaagaccagaaacccaggg

SEQ ID NO: 3547431 - RNA, 22 nt, Pseudomonas putida KT2440
cagcaagccgccgaccaggugg

SEQ ID NO: 3547432 - RNA, 12 nt, Pseudomonas putida KT2440
cagcaagccugc

SEQ ID NO: 3547433 - RNA, 16 nt, Pseudomonas putida KT2440
cagcaagcgcauaggc

SEQ ID NO: 3547434 - RNA, 21 nt, Pseudomonas putida KT2440
cagcaagcucaucaccaggcc

SEQ ID NO: 3547435 - RNA, 18 nt, Pseudomonas putida KT2440
cagcaagcuggcaccggc

SEQ ID NO: 3547436 - RNA, 22 nt, Pseudomonas putida KT2440
cagcaagcuggcaccggcgcca

SEQ ID NO: 3547437 - RNA, 15 nt, Pseudomonas putida KT2440
cagcaaggcauccag

SEQ ID NO: 3547438 - RNA, 17 nt, Pseudomonas putida KT2440
cagcaaggcauccagcg

SEQ ID NO: 3547439 - RNA, 19 nt, Pseudomonas putida KT2440
cagcaaggcauccagcggu

SEQ ID NO: 3547440 - RNA, 13 nt, Pseudomonas putida KT2440
cagcaagggccug

SEQ ID NO: 3547441 - RNA, 21 nt, Pseudomonas putida KT2440
cagcaagucccccaucggcac

SEQ ID NO: 3547442 - RNA, 18 nt, Pseudomonas putida KT2440
cagcaaguugaagaacag

SEQ ID NO: 3547443 - RNA, 20 nt, Pseudomonas putida KT2440
cagcaaguugaagaacagug

SEQ ID NO: 3547444 - RNA, 15 nt, Pseudomonas putida KT2440
cagcaauacgcacag

SEQ ID NO: 3547445 - RNA, 23 nt, Pseudomonas putida KT2440
cagcaaucccgccccaaaggaag

SEQ ID NO: 3547446 - RNA, 12 nt, Pseudomonas putida KT2440
cagcaaucggca

SEQ ID NO: 3547447 - RNA, 15 nt, Pseudomonas putida KT2440
cagcaaucugcuggu

SEQ ID NO: 3547448 - RNA, 18 nt, Pseudomonas putida KT2440
cagcaaucugcugguuca

SEQ ID NO: 3547449 - RNA, 20 nt, Pseudomonas putida KT2440
cagcaaugaugaaagcaggu

SEQ ID NO: 3547450 - RNA, 18 nt, Pseudomonas putida KT2440
cagcaaugcccgcucgcu

SEQ ID NO: 3547451 - RNA, 12 nt, Pseudomonas putida KT2440
cagcacaagccg

SEQ ID NO: 3547452 - RNA, 14 nt, Pseudomonas putida KT2440
cagcacaagccgac

SEQ ID NO: 3547453 - RNA, 12 nt, Pseudomonas putida KT2440
cagcacaaggcu

SEQ ID NO: 3547454 - RNA, 23 nt, Pseudomonas putida KT2440
cagcacaaggcucaagcgcagcc

SEQ ID NO: 3547455 - RNA, 14 nt, Pseudomonas putida KT2440
cagcacaaggcugu

SEQ ID NO: 3547456 - RNA, 18 nt, Pseudomonas putida KT2440
cagcacaaggcuguucca

SEQ ID NO: 3547457 - RNA, 16 nt, Pseudomonas putida KT2440
cagcacacccagcacg

SEQ ID NO: 3547458 - RNA, 13 nt, Pseudomonas putida KT2440
cagcacacugagc

SEQ ID NO: 3547459 - RNA, 18 nt, Pseudomonas putida KT2440
cagcacagauaaaccugc

SEQ ID NO: 3547460 - RNA, 14 nt, Pseudomonas putida KT2440
cagcacaucacaca

SEQ ID NO: 3547461 - RNA, 16 nt, Pseudomonas putida KT2440
cagcacaucacacagc

SEQ ID NO: 3547462 - RNA, 14 nt, Pseudomonas putida KT2440
cagcaccaaccgcg

SEQ ID NO: 3547463 - RNA, 22 nt, Pseudomonas putida KT2440
cagcaccaaugaaagugucggc

SEQ ID NO: 3547464 - RNA, 11 nt, Pseudomonas putida KT2440
cagcaccaccc

SEQ ID NO: 3547465 - RNA, 18 nt, Pseudomonas putida KT2440
cagcaccacccaccagca

SEQ ID NO: 3547466 - RNA, 11 nt, Pseudomonas putida KT2440
cagcaccagcg

SEQ ID NO: 3547467 - RNA, 12 nt, Pseudomonas putida KT2440
cagcaccagcgc

SEQ ID NO: 3547468 - RNA, 14 nt, Pseudomonas putida KT2440
cagcaccagcucau

SEQ ID NO: 3547469 - RNA, 16 nt, Pseudomonas putida KT2440
cagcaccagcuccugg

SEQ ID NO: 3547470 - RNA, 17 nt, Pseudomonas putida KT2440
cagcaccagcuccuggc

SEQ ID NO: 3547471 - RNA, 12 nt, Pseudomonas putida KT2440
cagcaccaucag

SEQ ID NO: 3547472 - RNA, 19 nt, Pseudomonas putida KT2440
cagcaccaucagagcgcca

SEQ ID NO: 3547473 - RNA, 21 nt, Pseudomonas putida KT2440
cagcaccaucagagcgccagc

SEQ ID NO: 3547474 - RNA, 13 nt, Pseudomonas putida KT2440
cagcaccaucagg

SEQ ID NO: 3547475 - RNA, 22 nt, Pseudomonas putida KT2440
cagcagcuugaacaacggcgcu

SEQ ID NO: 3547476 - RNA, 15 nt, Pseudomonas putida KT2440
cagcagcuugcgcgc

SEQ ID NO: 3547477 - RNA, 18 nt, Pseudomonas putida KT2440
cagcaggaaauacgccgc

SEQ ID NO: 3547478 - RNA, 20 nt, Pseudomonas putida KT2440
cagcaggaaauacgccgcca

SEQ ID NO: 3547479 - RNA, 13 nt, Pseudomonas putida KT2440
cagcaggaacagc

SEQ ID NO: 3547480 - RNA, 16 nt, Pseudomonas putida KT2440
cagcaggaacagcggc

SEQ ID NO: 3547481 - RNA, 18 nt, Pseudomonas putida KT2440
cagcaggaacagcggcag

SEQ ID NO: 3547482 - RNA, 19 nt, Pseudomonas putida KT2440
cagcaggaacagcggcagc

SEQ ID NO: 3547483 - RNA, 17 nt, Pseudomonas putida KT2440
cagcaggacccggcugg

SEQ ID NO: 3547484 - RNA, 13 nt, Pseudomonas putida KT2440
cagcaggacgaua

SEQ ID NO: 3547485 - RNA, 14 nt, Pseudomonas putida KT2440
cagcaggauggcca

SEQ ID NO: 3547486 - RNA, 22 nt, Pseudomonas putida KT2440
cagcaggauggccaugaucgcc

SEQ ID NO: 3547487 - RNA, 14 nt, Pseudomonas putida KT2440
cagcaggccaagga

SEQ ID NO: 3547488 - RNA, 13 nt, Pseudomonas putida KT2440
cagcaggccaccg

SEQ ID NO: 3547489 - RNA, 14 nt, Pseudomonas putida KT2440
cagcaggccaccgg

SEQ ID NO: 3547490 - RNA, 18 nt, Pseudomonas putida KT2440
cagcaggccaccggcagc

SEQ ID NO: 3547491 - RNA, 23 nt, Pseudomonas putida KT2440
cagcaggccaccggcagcaccug

SEQ ID NO: 3547492 - RNA, 13 nt, Pseudomonas putida KT2440
cagcaggccauac

SEQ ID NO: 3547493 - RNA, 21 nt, Pseudomonas putida KT2440
cagcaggccauauugcugagc

SEQ ID NO: 3547494 - RNA, 23 nt, Pseudomonas putida KT2440
cagcaggccauauugcugagcca

SEQ ID NO: 3547495 - RNA, 14 nt, Pseudomonas putida KT2440
cagcaggcccgcca

SEQ ID NO: 3547496 - RNA, 14 nt, Pseudomonas putida KT2440
cagcaggcccggcc

SEQ ID NO: 3547497 - RNA, 16 nt, Pseudomonas putida KT2440
cagcaggcccggccca

SEQ ID NO: 3547498 - RNA, 21 nt, Pseudomonas putida KT2440
cagcaggcgcgagccuugcca

SEQ ID NO: 3547499 - RNA, 22 nt, Pseudomonas putida KT2440
cagcaggcgcggcguggccuca

SEQ ID NO: 3547500 - RNA, 13 nt, Pseudomonas putida KT2440
cagcaggcugcgu

SEQ ID NO: 3547501 - RNA, 22 nt, Pseudomonas putida KT2440
cagcaggcugcgugccugcugc

SEQ ID NO: 3547502 - RNA, 23 nt, Pseudomonas putida KT2440
cagcaggcugcgugccugcugcu

SEQ ID NO: 3547503 - RNA, 17 nt, Pseudomonas putida KT2440
cagcaggcuggcggcca

SEQ ID NO: 3547504 - RNA, 16 nt, Pseudomonas putida KT2440
cagcaggcuggcgggg

SEQ ID NO: 3547505 - RNA, 15 nt, Pseudomonas putida KT2440
cagcaggcuugccag

SEQ ID NO: 3547506 - RNA, 23 nt, Pseudomonas putida KT2440
cagcaggcuugccagcuugguca

SEQ ID NO: 3547507 - RNA, 20 nt, Pseudomonas putida KT2440
cagcagggcaggggacagcc

SEQ ID NO: 3547508 - RNA, 14 nt, Pseudomonas putida KT2440
cagcagggccaacg

SEQ ID NO: 3547509 - RNA, 19 nt, Pseudomonas putida KT2440
cagcagggccaacgacacu

SEQ ID NO: 3547510 - RNA, 19 nt, Pseudomonas putida KT2440
cagcagggccaucaucugc

SEQ ID NO: 3547511 - RNA, 20 nt, Pseudomonas putida KT2440
cagcagggccaucaucugcu

SEQ ID NO: 3547512 - RNA, 17 nt, Pseudomonas putida KT2440
cagcaggggcagaugcu

SEQ ID NO: 3547513 - RNA, 21 nt, Pseudomonas putida KT2440
cagcagggucgccugaacgcu

SEQ ID NO: 3547514 - RNA, 13 nt, Pseudomonas putida KT2440
cagcaggguggcc

SEQ ID NO: 3547515 - RNA, 13 nt, Pseudomonas putida KT2440
cagcagguacacc

SEQ ID NO: 3547516 - RNA, 15 nt, Pseudomonas putida KT2440
cagcagguacaccgc

SEQ ID NO: 3547517 - RNA, 12 nt, Pseudomonas putida KT2440
cagcaggucagg

SEQ ID NO: 3547518 - RNA, 16 nt, Pseudomonas putida KT2440
cagcagguccagcucc

SEQ ID NO: 3547519 - RNA, 17 nt, Pseudomonas putida KT2440
cagcaggucggcacgca

SEQ ID NO: 3547520 - RNA, 20 nt, Pseudomonas putida KT2440
cagcaggucggcacgcaccu

SEQ ID NO: 3547521 - RNA, 15 nt, Pseudomonas putida KT2440
cagcagguucaacgg

SEQ ID NO: 3547522 - RNA, 19 nt, Pseudomonas putida KT2440
cagcagguugaacagcagc

SEQ ID NO: 3547523 - RNA, 21 nt, Pseudomonas putida KT2440
cagcagguugaacagcagcgc

SEQ ID NO: 3547524 - RNA, 22 nt, Pseudomonas putida KT2440
cagcagguugaacagcagcgcc

SEQ ID NO: 3547525 - RNA, 19 nt, Pseudomonas putida KT2440
cagcagguuggacagcgcc

SEQ ID NO: 3547526 - RNA, 19 nt, Pseudomonas putida KT2440
cagcagguuuuccagcccg

SEQ ID NO: 3547527 - RNA, 19 nt, Pseudomonas putida KT2440
cagcagugaucaucacacu

SEQ ID NO: 3547528 - RNA, 12 nt, Pseudomonas putida KT2440
cagcagugcacc

SEQ ID NO: 3547529 - RNA, 19 nt, Pseudomonas putida KT2440
cagcagugcaucgaagcag

SEQ ID NO: 3547530 - RNA, 14 nt, Pseudomonas putida KT2440
cagcagugccagca

SEQ ID NO: 3547531 - RNA, 20 nt, Pseudomonas putida KT2440
cagcagugccaucgccucgg

SEQ ID NO: 3547532 - RNA, 22 nt, Pseudomonas putida KT2440
cagcagugcccccgucagcggc

SEQ ID NO: 3547533 - RNA, 14 nt, Pseudomonas putida KT2440
cagcagugccgccu

SEQ ID NO: 3547534 - RNA, 18 nt, Pseudomonas putida KT2440
cagcagugccguggcagg

SEQ ID NO: 3547535 - RNA, 15 nt, Pseudomonas putida KT2440
cagcaguggcaagcc

SEQ ID NO: 3547536 - RNA, 17 nt, Pseudomonas putida KT2440
cagcaguucgcgcacca

SEQ ID NO: 3547537 - RNA, 14 nt, Pseudomonas putida KT2440
cagcaguugcugcu

SEQ ID NO: 3547538 - RNA, 17 nt, Pseudomonas putida KT2440
cagcaguugcugcugcc

SEQ ID NO: 3547539 - RNA, 18 nt, Pseudomonas putida KT2440
cagcaguugcugcugcca

SEQ ID NO: 3547540 - RNA, 17 nt, Pseudomonas putida KT2440
cagcaguuggcugccgg

SEQ ID NO: 3547541 - RNA, 16 nt, Pseudomonas putida KT2440
cagcaguuucagcggc

SEQ ID NO: 3547542 - RNA, 17 nt, Pseudomonas putida KT2440
cagcaguuugcugcgcu

SEQ ID NO: 3547543 - RNA, 16 nt, Pseudomonas putida KT2440
cagcaucaacgcugcc

SEQ ID NO: 3547544 - RNA, 19 nt, Pseudomonas putida KT2440
cagcaucaacgcugccaug

SEQ ID NO: 3547545 - RNA, 20 nt, Pseudomonas putida KT2440
cagcaucaaucgcuccaggc

SEQ ID NO: 3547546 - RNA, 15 nt, Pseudomonas putida KT2440
cagcaucaccacgcc

SEQ ID NO: 3547547 - RNA, 16 nt, Pseudomonas putida KT2440
cagcaucaccacgccc

SEQ ID NO: 3547548 - RNA, 13 nt, Pseudomonas putida KT2440
cagcaucaccgcg

SEQ ID NO: 3547549 - RNA, 23 nt, Pseudomonas putida KT2440
cagcaucaccgcgccggucacuu

SEQ ID NO: 3547550 - RNA, 17 nt, Pseudomonas putida KT2440
cagcaucacgccgcgcu

SEQ ID NO: 3547551 - RNA, 20 nt, Pseudomonas putida KT2440
cagcaucacgccgcgcuggc

SEQ ID NO: 3547552 - RNA, 23 nt, Pseudomonas putida KT2440
cagcaucagcacacccagcacga

SEQ ID NO: 3547553 - RNA, 14 nt, Pseudomonas putida KT2440
cagcaucagcgagg

SEQ ID NO: 3547554 - RNA, 19 nt, Pseudomonas putida KT2440
cagcaucagugcaggugca

SEQ ID NO: 3547555 - RNA, 23 nt, Pseudomonas putida KT2440
cagcaucagugcaggugcacugu

SEQ ID NO: 3547556 - RNA, 12 nt, Pseudomonas putida KT2440
cagcaucaucuc

SEQ ID NO: 3547557 - RNA, 20 nt, Pseudomonas putida KT2440
cagcaucaucucugccgaga

SEQ ID NO: 3547558 - RNA, 22 nt, Pseudomonas putida KT2440
cagcaucaucucugccgagagg

SEQ ID NO: 3547559 - RNA, 16 nt, Pseudomonas putida KT2440
cagcauccaaagccaa

SEQ ID NO: 3547560 - RNA, 18 nt, Pseudomonas putida KT2440
cagcauccagccauucca

SEQ ID NO: 3547561 - RNA, 16 nt, Pseudomonas putida KT2440
cagcaucugcaccagg

SEQ ID NO: 3547562 - RNA, 17 nt, Pseudomonas putida KT2440
cagcaucugcaccagga

SEQ ID NO: 3547563 - RNA, 19 nt, Pseudomonas putida KT2440
cagcaucugcaccaggaag

SEQ ID NO: 3547564 - RNA, 14 nt, Pseudomonas putida KT2440
cagcaucugcacgu

SEQ ID NO: 3547565 - RNA, 12 nt, Pseudomonas putida KT2440
cagcaucuucuu

SEQ ID NO: 3547566 - RNA, 23 nt, Pseudomonas putida KT2440
cagcaucuucuucacguccagcc

SEQ ID NO: 3547567 - RNA, 13 nt, Pseudomonas putida KT2440
cagcaugaacagc

SEQ ID NO: 3547568 - RNA, 16 nt, Pseudomonas putida KT2440
cagcaugaacagcgcu

SEQ ID NO: 3547569 - RNA, 16 nt, Pseudomonas putida KT2440
cagcaugaaccgcucc

SEQ ID NO: 3547570 - RNA, 21 nt, Pseudomonas putida KT2440
cagcaugaacgcagcuuccgc

SEQ ID NO: 3547571 - RNA, 19 nt, Pseudomonas putida KT2440
cagcaugaauagcgcacug

SEQ ID NO: 3547572 - RNA, 19 nt, Pseudomonas putida KT2440
cagcaugacaguggcaggu

SEQ ID NO: 3547573 - RNA, 14 nt, Pseudomonas putida KT2440
cagcaugaucuugg

SEQ ID NO: 3547574 - RNA, 15 nt, Pseudomonas putida KT2440
cagcaugcccagcgc

SEQ ID NO: 3547575 - RNA, 16 nt, Pseudomonas putida KT2440
cagcaugcccagcgcc

SEQ ID NO: 3547576 - RNA, 16 nt, Pseudomonas putida KT2440
cagcaugcgcuugagc

SEQ ID NO: 3547577 - RNA, 18 nt, Pseudomonas putida KT2440
cagcaugcgcuugagcga

SEQ ID NO: 3547578 - RNA, 13 nt, Pseudomonas putida KT2440
cagcaugcugguu

SEQ ID NO: 3547579 - RNA, 16 nt, Pseudomonas putida KT2440
cagcauggccaguucc

SEQ ID NO: 3547580 - RNA, 13 nt, Pseudomonas putida KT2440
cagccccccuucc

SEQ ID NO: 3547581 - RNA, 23 nt, Pseudomonas putida KT2440
cagcccccggauggugugcagca

SEQ ID NO: 3547582 - RNA, 14 nt, Pseudomonas putida KT2440
cagccccgcaugcu

SEQ ID NO: 3547583 - RNA, 15 nt, Pseudomonas putida KT2440
cagccccgcaugcuc

SEQ ID NO: 3547584 - RNA, 15 nt, Pseudomonas putida KT2440
cagccccgccgcccc

SEQ ID NO: 3547585 - RNA, 16 nt, Pseudomonas putida KT2440
cagccccgccgccccc

SEQ ID NO: 3547586 - RNA, 19 nt, Pseudomonas putida KT2440
cagccccgccgccccccag

SEQ ID NO: 3547587 - RNA, 14 nt, Pseudomonas putida KT2440
cagccccuagcgca

SEQ ID NO: 3547588 - RNA, 17 nt, Pseudomonas putida KT2440
cagccccucaggcacau

SEQ ID NO: 3547589 - RNA, 17 nt, Pseudomonas putida KT2440
cagccccuuccccaggc

SEQ ID NO: 3547590 - RNA, 16 nt, Pseudomonas putida KT2440
cagccccuucuauuaa

SEQ ID NO: 3547591 - RNA, 12 nt, Pseudomonas putida KT2440
cagcccgaagcc

SEQ ID NO: 3547592 - RNA, 18 nt, Pseudomonas putida KT2440
cagcccgaagccggcaug

SEQ ID NO: 3547593 - RNA, 15 nt, Pseudomonas putida KT2440
cagcccgaagcgcag

SEQ ID NO: 3547594 - RNA, 20 nt, Pseudomonas putida KT2440
cagcccgaagcgcaggucca

SEQ ID NO: 3547595 - RNA, 21 nt, Pseudomonas putida KT2440
cagcccgacgauuucucccca

SEQ ID NO: 3547596 - RNA, 20 nt, Pseudomonas putida KT2440
cagcccgccaagggucgaca

SEQ ID NO: 3547597 - RNA, 12 nt, Pseudomonas putida KT2440
cagcccgccacc

SEQ ID NO: 3547598 - RNA, 13 nt, Pseudomonas putida KT2440
cagcccgccugcu

SEQ ID NO: 3547599 - RNA, 23 nt, Pseudomonas putida KT2440
cagcccggacugcaccaggucca

SEQ ID NO: 3547600 - RNA, 14 nt, Pseudomonas putida KT2440
cagcccggcaaacu

SEQ ID NO: 3547601 - RNA, 20 nt, Pseudomonas putida KT2440
cagcccggcaaacuccacug

SEQ ID NO: 3547602 - RNA, 21 nt, Pseudomonas putida KT2440
cagcccggcaauuucauccac

SEQ ID NO: 3547603 - RNA, 14 nt, Pseudomonas putida KT2440
cagcccggcgccga

SEQ ID NO: 3547604 - RNA, 17 nt, Pseudomonas putida KT2440
cagcccggcggccagca

SEQ ID NO: 3547605 - RNA, 14 nt, Pseudomonas putida KT2440
cagcccggugcccu

SEQ ID NO: 3547606 - RNA, 19 nt, Pseudomonas putida KT2440
cagcccggugcccuugccg

SEQ ID NO: 3547607 - RNA, 23 nt, Pseudomonas putida KT2440
cagcccggugcccuugccgcccc

SEQ ID NO: 3547608 - RNA, 17 nt, Pseudomonas putida KT2440
cagcccgucacgugccu

SEQ ID NO: 3547609 - RNA, 12 nt, Pseudomonas putida KT2440
cagcccguccgc

SEQ ID NO: 3547610 - RNA, 13 nt, Pseudomonas putida KT2440
cagcccucagugc

SEQ ID NO: 3547611 - RNA, 15 nt, Pseudomonas putida KT2440
cagcccugaacacgu

SEQ ID NO: 3547612 - RNA, 16 nt, Pseudomonas putida KT2440
cagcccugccgaggcc

SEQ ID NO: 3547613 - RNA, 15 nt, Pseudomonas putida KT2440
cagcccugcucgcca

SEQ ID NO: 3547614 - RNA, 14 nt, Pseudomonas putida KT2440
cagcccuggcgacg

SEQ ID NO: 3547615 - RNA, 15 nt, Pseudomonas putida KT2440
cagcccuucacugug

SEQ ID NO: 3547616 - RNA, 14 nt, Pseudomonas putida KT2440
cagcccuucgcagg

SEQ ID NO: 3547617 - RNA, 15 nt, Pseudomonas putida KT2440
cagcccuucgcaggc

SEQ ID NO: 3547618 - RNA, 21 nt, Pseudomonas putida KT2440
cagcccuucgcaggcacgccc

SEQ ID NO: 3547619 - RNA, 18 nt, Pseudomonas putida KT2440
cagcccuucgcggcaagc

SEQ ID NO: 3547620 - RNA, 19 nt, Pseudomonas putida KT2440
cagcccuucgcggcaagcc

SEQ ID NO: 3547621 - RNA, 18 nt, Pseudomonas putida KT2440
cagcccuucgcucaaccg

SEQ ID NO: 3547622 - RNA, 21 nt, Pseudomonas putida KT2440
cagcccuucggcaucggccug

SEQ ID NO: 3547623 - RNA, 17 nt, Pseudomonas putida KT2440
cagcccuugcucggcca

SEQ ID NO: 3547624 - RNA, 20 nt, Pseudomonas putida KT2440
cagcccuugcucggccagcc

SEQ ID NO: 3547625 - RNA, 16 nt, Pseudomonas putida KT2440
cagcccuugcugcagc

SEQ ID NO: 3547626 - RNA, 17 nt, Pseudomonas putida KT2440
cagcccuugcugcagca

SEQ ID NO: 3547627 - RNA, 18 nt, Pseudomonas putida KT2440
cagcccuugcugcagcag

SEQ ID NO: 3547628 - RNA, 19 nt, Pseudomonas putida KT2440
cagcccuugcugcagcagg

SEQ ID NO: 3547629 - RNA, 16 nt, Pseudomonas putida KT2440
cagcccuuucagggua

SEQ ID NO: 3547630 - RNA, 14 nt, Pseudomonas putida KT2440
cagccgaacuuguc

SEQ ID NO: 3547631 - RNA, 15 nt, Pseudomonas putida KT2440
cagccgaagcugucg

SEQ ID NO: 3547632 - RNA, 12 nt, Pseudomonas putida KT2440
cagccgacggcc

SEQ ID NO: 3547633 - RNA, 17 nt, Pseudomonas putida KT2440
cagccgacugacaggug

SEQ ID NO: 3547634 - RNA, 19 nt, Pseudomonas putida KT2440
cagccgagccaaccgcuuc

SEQ ID NO: 3547635 - RNA, 19 nt, Pseudomonas putida KT2440
cagccgagggcaugggcca

SEQ ID NO: 3547636 - RNA, 22 nt, Pseudomonas putida KT2440
cagccgagggguguaacccggg

SEQ ID NO: 3547637 - RNA, 15 nt, Pseudomonas putida KT2440
cagccgaucacuucc

SEQ ID NO: 3547638 - RNA, 22 nt, Pseudomonas putida KT2440
cagccgaucacuuccuggccgc

SEQ ID NO: 3547639 - RNA, 14 nt, Pseudomonas putida KT2440
cagccgcacccagg

SEQ ID NO: 3547640 - RNA, 17 nt, Pseudomonas putida KT2440
cagccgcacccaggcca

SEQ ID NO: 3547641 - RNA, 19 nt, Pseudomonas putida KT2440
cagccgcacccaggccacg

SEQ ID NO: 3547642 - RNA, 16 nt, Pseudomonas putida KT2440
cagccgcaggcgcccc

SEQ ID NO: 3547643 - RNA, 13 nt, Pseudomonas putida KT2440
cagccgcccgccc

SEQ ID NO: 3547644 - RNA, 14 nt, Pseudomonas putida KT2440
cagccgccgccugu

SEQ ID NO: 3547645 - RNA, 11 nt, Pseudomonas putida KT2440
cagccgcgaac

SEQ ID NO: 3547646 - RNA, 20 nt, Pseudomonas putida KT2440
cagccgcgaacgccccgaac

SEQ ID NO: 3547647 - RNA, 15 nt, Pseudomonas putida KT2440
cagccgcgccacucc

SEQ ID NO: 3547648 - RNA, 14 nt, Pseudomonas putida KT2440
cagccgcgccaggu

SEQ ID NO: 3547649 - RNA, 17 nt, Pseudomonas putida KT2440
cagccgcgccaggucgg

SEQ ID NO: 3547650 - RNA, 17 nt, Pseudomonas putida KT2440
cagccgcgcccucuucc

SEQ ID NO: 3547651 - RNA, 12 nt, Pseudomonas putida KT2440
cagccgcgcuga

SEQ ID NO: 3547652 - RNA, 16 nt, Pseudomonas putida KT2440
cagccgcgcugacgca

SEQ ID NO: 3547653 - RNA, 12 nt, Pseudomonas putida KT2440
cagccgcggcac

SEQ ID NO: 3547654 - RNA, 17 nt, Pseudomonas putida KT2440
cagccgcggcacccaau

SEQ ID NO: 3547655 - RNA, 24 nt, Pseudomonas putida KT2440
cagccgcgggcgucgcgaucacgc

SEQ ID NO: 3547656 - RNA, 14 nt, Pseudomonas putida KT2440
cagccgcgggcucg

SEQ ID NO: 3547657 - RNA, 22 nt, Pseudomonas putida KT2440
cagccgcucgagaaacgccagc

SEQ ID NO: 3547658 - RNA, 15 nt, Pseudomonas putida KT2440
cagccgcugcgccug

SEQ ID NO: 3547659 - RNA, 15 nt, Pseudomonas putida KT2440
cagccgcugcugcag

SEQ ID NO: 3547660 - RNA, 14 nt, Pseudomonas putida KT2440
cagccgcuguucug

SEQ ID NO: 3547661 - RNA, 19 nt, Pseudomonas putida KT2440
cagccgcuguucugcaguc

SEQ ID NO: 3547662 - RNA, 16 nt, Pseudomonas putida KT2440
cagccggcaccgccau

SEQ ID NO: 3547663 - RNA, 21 nt, Pseudomonas putida KT2440
cagccggcagcaaggcaucca

SEQ ID NO: 3547664 - RNA, 14 nt, Pseudomonas putida KT2440
cagccggccccugc

SEQ ID NO: 3547665 - RNA, 14 nt, Pseudomonas putida KT2440
cagccggcccggcu

SEQ ID NO: 3547666 - RNA, 17 nt, Pseudomonas putida KT2440
cagccggcccggcuggc

SEQ ID NO: 3547667 - RNA, 19 nt, Pseudomonas putida KT2440
cagccggcccuucugcugc

SEQ ID NO: 3547668 - RNA, 13 nt, Pseudomonas putida KT2440
cagccggccuugc

SEQ ID NO: 3547669 - RNA, 14 nt, Pseudomonas putida KT2440
cagccggccuugcu

SEQ ID NO: 3547670 - RNA, 17 nt, Pseudomonas putida KT2440
cagccggcuaucggcca

SEQ ID NO: 3547671 - RNA, 16 nt, Pseudomonas putida KT2440
cagccggcuuccagcg

SEQ ID NO: 3547672 - RNA, 17 nt, Pseudomonas putida KT2440
cagccggcuuccagcga

SEQ ID NO: 3547673 - RNA, 22 nt, Pseudomonas putida KT2440
cagccgggccaacuugcgcagu

SEQ ID NO: 3547674 - RNA, 23 nt, Pseudomonas putida KT2440
cagccgggcgguugucgaccugg

SEQ ID NO: 3547675 - RNA, 19 nt, Pseudomonas putida KT2440
cagccggucauccagcagc

SEQ ID NO: 3547676 - RNA, 17 nt, Pseudomonas putida KT2440
cagccggucucccagcg

SEQ ID NO: 3547677 - RNA, 20 nt, Pseudomonas putida KT2440
cagccggucucccagcgcug

SEQ ID NO: 3547678 - RNA, 18 nt, Pseudomonas putida KT2440
cagccguccucgacccag

SEQ ID NO: 3547679 - RNA, 21 nt, Pseudomonas putida KT2440
cagccgucgauuacccagcgc

SEQ ID NO: 3547680 - RNA, 14 nt, Pseudomonas putida KT2440
cagccgucgccgcu

SEQ ID NO: 3547681 - RNA, 23 nt, Pseudomonas putida KT2440
cagccgucggcgucaacgguaac

SEQ ID NO: 3547682 - RNA, 16 nt, Pseudomonas putida KT2440
cagccgugccuuccag

SEQ ID NO: 3547683 - RNA, 19 nt, Pseudomonas putida KT2440
cagccguggcaacgccaca

SEQ ID NO: 3547684 - RNA, 21 nt, Pseudomonas putida KT2440
cagccguggcaacgccacacu

SEQ ID NO: 3547685 - RNA, 17 nt, Pseudomonas putida KT2440
cagccguucaccuuuga

SEQ ID NO: 3547686 - RNA, 20 nt, Pseudomonas putida KT2440
cagcgccaguacggccauca

SEQ ID NO: 3547687 - RNA, 15 nt, Pseudomonas putida KT2440
cagcgcccagaacac

SEQ ID NO: 3547688 - RNA, 19 nt, Pseudomonas putida KT2440
cagcgcccagaucagcagc

SEQ ID NO: 3547689 - RNA, 23 nt, Pseudomonas putida KT2440
cagcgcccagaucagcagcaccg

SEQ ID NO: 3547690 - RNA, 15 nt, Pseudomonas putida KT2440
cagcgccccaucauu

SEQ ID NO: 3547691 - RNA, 14 nt, Pseudomonas putida KT2440
cagcgccccgccgc

SEQ ID NO: 3547692 - RNA, 16 nt, Pseudomonas putida KT2440
cagcgcccgcugcgcc

SEQ ID NO: 3547693 - RNA, 14 nt, Pseudomonas putida KT2440
cagcgcccggcgca

SEQ ID NO: 3547694 - RNA, 16 nt, Pseudomonas putida KT2440
cagcgcccggcgcagc

SEQ ID NO: 3547695 - RNA, 17 nt, Pseudomonas putida KT2440
cagcgcccggcgcagca

SEQ ID NO: 3547696 - RNA, 15 nt, Pseudomonas putida KT2440
cagcgcccgguucca

SEQ ID NO: 3547697 - RNA, 19 nt, Pseudomonas putida KT2440
cagcgccgaaauaugcagu

SEQ ID NO: 3547698 - RNA, 16 nt, Pseudomonas putida KT2440
cagcgccgauggccaa

SEQ ID NO: 3547699 - RNA, 19 nt, Pseudomonas putida KT2440
cagcgccgcaacggccgaa

SEQ ID NO: 3547700 - RNA, 20 nt, Pseudomonas putida KT2440
cagcgccgcauccagcacug

SEQ ID NO: 3547701 - RNA, 16 nt, Pseudomonas putida KT2440
cagcgccgcaucgcca

SEQ ID NO: 3547702 - RNA, 15 nt, Pseudomonas putida KT2440
cagcgccgccaacuc

SEQ ID NO: 3547703 - RNA, 17 nt, Pseudomonas putida KT2440
cagcgccgccaggccca

SEQ ID NO: 3547704 - RNA, 20 nt, Pseudomonas putida KT2440
cagcgccgccaggcccacca

SEQ ID NO: 3547705 - RNA, 13 nt, Pseudomonas putida KT2440
cagcgccgccaug

SEQ ID NO: 3547706 - RNA, 14 nt, Pseudomonas putida KT2440
cagcgccgccggcu

SEQ ID NO: 3547707 - RNA, 14 nt, Pseudomonas putida KT2440
cagcgccgcgccac

SEQ ID NO: 3547708 - RNA, 19 nt, Pseudomonas putida KT2440
cagcgccgcgccaccgauc

SEQ ID NO: 3547709 - RNA, 11 nt, Pseudomonas putida KT2440
cagcgccgcgg

SEQ ID NO: 3547710 - RNA, 16 nt, Pseudomonas putida KT2440
cagcgccgcggccaac

SEQ ID NO: 3547711 - RNA, 13 nt, Pseudomonas putida KT2440
cagcgccgcuuca

SEQ ID NO: 3547712 - RNA, 17 nt, Pseudomonas putida KT2440
cagcgccgcuucagccu

SEQ ID NO: 3547713 - RNA, 13 nt, Pseudomonas putida KT2440
cagcgccggcagu

SEQ ID NO: 3547714 - RNA, 17 nt, Pseudomonas putida KT2440
cagcgccggcaguugcu

SEQ ID NO: 3547715 - RNA, 15 nt, Pseudomonas putida KT2440
cagcgccucaccgac

SEQ ID NO: 3547716 - RNA, 12 nt, Pseudomonas putida KT2440
cagcgccuccac

SEQ ID NO: 3547717 - RNA, 14 nt, Pseudomonas putida KT2440
cagcgccuccaccu

SEQ ID NO: 3547718 - RNA, 13 nt, Pseudomonas putida KT2440
cagcgccuccagc

SEQ ID NO: 3547719 - RNA, 14 nt, Pseudomonas putida KT2440
cagcgccuccagca

SEQ ID NO: 3547720 - RNA, 17 nt, Pseudomonas putida KT2440
cagcgccuccagcaggg

SEQ ID NO: 3547721 - RNA, 14 nt, Pseudomonas putida KT2440
cagcgccucgcccu

SEQ ID NO: 3547722 - RNA, 19 nt, Pseudomonas putida KT2440
cagcgccucgcccuuguca

SEQ ID NO: 3547723 - RNA, 13 nt, Pseudomonas putida KT2440
cagcgccugcagc

SEQ ID NO: 3547724 - RNA, 14 nt, Pseudomonas putida KT2440
cagcgccugcagcg

SEQ ID NO: 3547725 - RNA, 16 nt, Pseudomonas putida KT2440
cagcgccugcaggccc

SEQ ID NO: 3547726 - RNA, 17 nt, Pseudomonas putida KT2440
cagcgccugcaggccca

SEQ ID NO: 3547727 - RNA, 22 nt, Pseudomonas putida KT2440
cagcgccugcaggcccaggugu

SEQ ID NO: 3547728 - RNA, 15 nt, Pseudomonas putida KT2440
cagcgccugccuggc

SEQ ID NO: 3547729 - RNA, 17 nt, Pseudomonas putida KT2440
cagcgccugcucaucca

SEQ ID NO: 3547730 - RNA, 21 nt, Pseudomonas putida KT2440
cagcgccugcucauccaccac

SEQ ID NO: 3547731 - RNA, 22 nt, Pseudomonas putida KT2440
cagcgccugcugcuggaucagu

SEQ ID NO: 3547732 - RNA, 14 nt, Pseudomonas putida KT2440
cagcgccuggcgca

SEQ ID NO: 3547733 - RNA, 16 nt, Pseudomonas putida KT2440
cagcgccuggcgcagu

SEQ ID NO: 3547734 - RNA, 16 nt, Pseudomonas putida KT2440
cagcgccuugaagcug

SEQ ID NO: 3547735 - RNA, 20 nt, Pseudomonas putida KT2440
cagcgccuugaagcuggccg

SEQ ID NO: 3547736 - RNA, 21 nt, Pseudomonas putida KT2440
cagcgccuuggccugcucacc

SEQ ID NO: 3547737 - RNA, 22 nt, Pseudomonas putida KT2440
cagcgcgaaacccucacgcgcc

SEQ ID NO: 3547738 - RNA, 23 nt, Pseudomonas putida KT2440
cagcgcgaaacccucacgcgcca

SEQ ID NO: 3547739 - RNA, 23 nt, Pseudomonas putida KT2440
cagcgcgaagcccagcuugccca

SEQ ID NO: 3547740 - RNA, 17 nt, Pseudomonas putida KT2440
cagcgcgacgcagcagc

SEQ ID NO: 3547741 - RNA, 21 nt, Pseudomonas putida KT2440
cagcgcgaucaccagccccuc

SEQ ID NO: 3547742 - RNA, 22 nt, Pseudomonas putida KT2440
cagcgcgcaggucgugcuugac

SEQ ID NO: 3547743 - RNA, 13 nt, Pseudomonas putida KT2440
cagcgcgccagca

SEQ ID NO: 3547744 - RNA, 18 nt, Pseudomonas putida KT2440
cagcgcgccagcaggucc

SEQ ID NO: 3547745 - RNA, 19 nt, Pseudomonas putida KT2440
cagcgcgccagcaggucca

SEQ ID NO: 3547746 - RNA, 13 nt, Pseudomonas putida KT2440
cagcgcgccgaac

SEQ ID NO: 3547747 - RNA, 19 nt, Pseudomonas putida KT2440
cagcgcgccgaacuugccg

SEQ ID NO: 3547748 - RNA, 17 nt, Pseudomonas putida KT2440
cagcgcggaacacacgc

SEQ ID NO: 3547749 - RNA, 18 nt, Pseudomonas putida KT2440
cagcgcggaacacacgcu

SEQ ID NO: 3547750 - RNA, 14 nt, Pseudomonas putida KT2440
cagcgcggagaggu

SEQ ID NO: 3547751 - RNA, 18 nt, Pseudomonas putida KT2440
cagcgcggagagguggca

SEQ ID NO: 3547752 - RNA, 21 nt, Pseudomonas putida KT2440
cagcgcggagagguggcagaa

SEQ ID NO: 3547753 - RNA, 19 nt, Pseudomonas putida KT2440
cagcgcggcaaagguggca

SEQ ID NO: 3547754 - RNA, 21 nt, Pseudomonas putida KT2440
cagcgcggcaaccugcucgcu

SEQ ID NO: 3547755 - RNA, 17 nt, Pseudomonas putida KT2440
cagcgcggccgggucga

SEQ ID NO: 3547756 - RNA, 14 nt, Pseudomonas putida KT2440
cagcgcggugacca

SEQ ID NO: 3547757 - RNA, 17 nt, Pseudomonas putida KT2440
cagcgcggugaccagcg

SEQ ID NO: 3547758 - RNA, 21 nt, Pseudomonas putida KT2440
cagcgcggugaccagcggcag

SEQ ID NO: 3547759 - RNA, 23 nt, Pseudomonas putida KT2440
cagcgcggugaccagcggcagca

SEQ ID NO: 3547760 - RNA, 16 nt, Pseudomonas putida KT2440
cagcgcguacagcgac

SEQ ID NO: 3547761 - RNA, 16 nt, Pseudomonas putida KT2440
cagcgcgucauccgcc

SEQ ID NO: 3547762 - RNA, 17 nt, Pseudomonas putida KT2440
cagcgcgucauccgcca

SEQ ID NO: 3547763 - RNA, 16 nt, Pseudomonas putida KT2440
cagcgcguccagcaac

SEQ ID NO: 3547764 - RNA, 17 nt, Pseudomonas putida KT2440
cagcgcucaaaaaaaua

SEQ ID NO: 3547765 - RNA, 15 nt, Pseudomonas putida KT2440
cagcgcuccagcaac

SEQ ID NO: 3547766 - RNA, 22 nt, Pseudomonas putida KT2440
cagcgcuccgccaaaccccagc

SEQ ID NO: 3547767 - RNA, 23 nt, Pseudomonas putida KT2440
cagcgcuccgccaaaccccagca

SEQ ID NO: 3547768 - RNA, 23 nt, Pseudomonas putida KT2440
cagcgcucgagaaaugccucggc

SEQ ID NO: 3547769 - RNA, 20 nt, Pseudomonas putida KT2440
cagcgcucggguugcccugu

SEQ ID NO: 3547770 - RNA, 16 nt, Pseudomonas putida KT2440
cagcgcugacucagcg

SEQ ID NO: 3547771 - RNA, 19 nt, Pseudomonas putida KT2440
cagcgcugacucagcggcc

SEQ ID NO: 3547772 - RNA, 13 nt, Pseudomonas putida KT2440
cagcgcugccgcc

SEQ ID NO: 3547773 - RNA, 14 nt, Pseudomonas putida KT2440
cagcgcugccgccu

SEQ ID NO: 3547774 - RNA, 22 nt, Pseudomonas putida KT2440
cagcgcuucgaucagcgccugc

SEQ ID NO: 3547775 - RNA, 18 nt, Pseudomonas putida KT2440
cagcgcuucgaucgccgg

SEQ ID NO: 3547776 - RNA, 20 nt, Pseudomonas putida KT2440
cagcgcuucgaucgccggca

SEQ ID NO: 3547777 - RNA, 22 nt, Pseudomonas putida KT2440
cagcgcuucgaucgccggcagc

SEQ ID NO: 3547778 - RNA, 16 nt, Pseudomonas putida KT2440
cagcggaccaggugca

SEQ ID NO: 3547779 - RNA, 19 nt, Pseudomonas putida KT2440
cagcggcaacaccagcagc

SEQ ID NO: 3547780 - RNA, 22 nt, Pseudomonas putida KT2440
cagcggcaacaccagcagccac

SEQ ID NO: 3547781 - RNA, 21 nt, Pseudomonas putida KT2440
cagcggcaaccugacccgcgc

SEQ ID NO: 3547782 - RNA, 23 nt, Pseudomonas putida KT2440
cagcggcaagguagccugcugac

SEQ ID NO: 3547783 - RNA, 18 nt, Pseudomonas putida KT2440
cagcggcacggccaccau

SEQ ID NO: 3547784 - RNA, 17 nt, Pseudomonas putida KT2440
cagcggcacgucacugc

SEQ ID NO: 3547785 - RNA, 20 nt, Pseudomonas putida KT2440
cagcggcagcaacacgacga

SEQ ID NO: 3547786 - RNA, 17 nt, Pseudomonas putida KT2440
cagcggcagcaucgacc

SEQ ID NO: 3547787 - RNA, 20 nt, Pseudomonas putida KT2440
cagcggcagcaucgaccugc

SEQ ID NO: 3547788 - RNA, 17 nt, Pseudomonas putida KT2440
cagcggccacagcgcca

SEQ ID NO: 3547789 - RNA, 18 nt, Pseudomonas putida KT2440
cagcggccagcgccuggc

SEQ ID NO: 3547790 - RNA, 18 nt, Pseudomonas putida KT2440
cagcggccaguaaggauc

SEQ ID NO: 3547791 - RNA, 18 nt, Pseudomonas putida KT2440
cagcucgacaacccgcgc

SEQ ID NO: 3547792 - RNA, 13 nt, Pseudomonas putida KT2440
cagcucgaucagg

SEQ ID NO: 3547793 - RNA, 16 nt, Pseudomonas putida KT2440
cagcucgaucaggcuc

SEQ ID NO: 3547794 - RNA, 19 nt, Pseudomonas putida KT2440
cagcucgaucaggcucugu

SEQ ID NO: 3547795 - RNA, 20 nt, Pseudomonas putida KT2440
cagcucgaucucccgcgaac

SEQ ID NO: 3547796 - RNA, 23 nt, Pseudomonas putida KT2440
cagcucgaucucccgcgaacgcc

SEQ ID NO: 3547797 - RNA, 17 nt, Pseudomonas putida KT2440
cagcucgaugccuuugc

SEQ ID NO: 3547798 - RNA, 12 nt, Pseudomonas putida KT2440
cagcucgauggc

SEQ ID NO: 3547799 - RNA, 17 nt, Pseudomonas putida KT2440
cagcucgauggccagga

SEQ ID NO: 3547800 - RNA, 20 nt, Pseudomonas putida KT2440
cagcucgauggccaggaaca

SEQ ID NO: 3547801 - RNA, 23 nt, Pseudomonas putida KT2440
cagcucgcagguauccgggucca

SEQ ID NO: 3547802 - RNA, 13 nt, Pseudomonas putida KT2440
cagcucgccaaac

SEQ ID NO: 3547803 - RNA, 18 nt, Pseudomonas putida KT2440
cagcucgccaacaccgcc

SEQ ID NO: 3547804 - RNA, 15 nt, Pseudomonas putida KT2440
cagcucgccgcccag

SEQ ID NO: 3547805 - RNA, 17 nt, Pseudomonas putida KT2440
cagcucgcgcagggcau

SEQ ID NO: 3547806 - RNA, 14 nt, Pseudomonas putida KT2440
cagcucgcgcugcc

SEQ ID NO: 3547807 - RNA, 16 nt, Pseudomonas putida KT2440
cagcucgcgcugccag

SEQ ID NO: 3547808 - RNA, 18 nt, Pseudomonas putida KT2440
cagcucgcgcugccaggc

SEQ ID NO: 3547809 - RNA, 16 nt, Pseudomonas putida KT2440
cagcucgcgcugcgca

SEQ ID NO: 3547810 - RNA, 12 nt, Pseudomonas putida KT2440
cagcucgcuggc

SEQ ID NO: 3547811 - RNA, 13 nt, Pseudomonas putida KT2440
cagcucgcuggcc

SEQ ID NO: 3547812 - RNA, 14 nt, Pseudomonas putida KT2440
cagcucgcuggcca

SEQ ID NO: 3547813 - RNA, 14 nt, Pseudomonas putida KT2440
cagcucggcacugu

SEQ ID NO: 3547814 - RNA, 16 nt, Pseudomonas putida KT2440
cagcucggccgaugcc

SEQ ID NO: 3547815 - RNA, 21 nt, Pseudomonas putida KT2440
cagcucggcuggcugucgaag

SEQ ID NO: 3547816 - RNA, 23 nt, Pseudomonas putida KT2440
cagcucggcuggcugucgaaggc

SEQ ID NO: 3547817 - RNA, 15 nt, Pseudomonas putida KT2440
cagcucgucagccac

SEQ ID NO: 3547818 - RNA, 14 nt, Pseudomonas putida KT2440
cagcucguccaugu

SEQ ID NO: 3547819 - RNA, 18 nt, Pseudomonas putida KT2440
cagcucgucgagcaacuu

SEQ ID NO: 3547820 - RNA, 17 nt, Pseudomonas putida KT2440
cagcucgugggucaucu

SEQ ID NO: 3547821 - RNA, 19 nt, Pseudomonas putida KT2440
cagcucgugggucaucuug

SEQ ID NO: 3547822 - RNA, 19 nt, Pseudomonas putida KT2440
cagcucucaacguucaucc

SEQ ID NO: 3547823 - RNA, 15 nt, Pseudomonas putida KT2440
cagcucugcgacuga

SEQ ID NO: 3547824 - RNA, 18 nt, Pseudomonas putida KT2440
cagcucuggcagcagugc

SEQ ID NO: 3547825 - RNA, 15 nt, Pseudomonas putida KT2440
cagcucuggucaccu

SEQ ID NO: 3547826 - RNA, 17 nt, Pseudomonas putida KT2440
cagcucuggucaccuuc

SEQ ID NO: 3547827 - RNA, 18 nt, Pseudomonas putida KT2440
cagcucuggucaccuucg

SEQ ID NO: 3547828 - RNA, 16 nt, Pseudomonas putida KT2440
cagcucuugucgacag

SEQ ID NO: 3547829 - RNA, 17 nt, Pseudomonas putida KT2440
cagcucuugucgacagu

SEQ ID NO: 3547830 - RNA, 16 nt, Pseudomonas putida KT2440
cagcucuuugggggug

SEQ ID NO: 3547831 - RNA, 19 nt, Pseudomonas putida KT2440
cagcucuuugggggugcug

SEQ ID NO: 3547832 - RNA, 23 nt, Pseudomonas putida KT2440
cagcugagcgccauccaccugug

SEQ ID NO: 3547833 - RNA, 19 nt, Pseudomonas putida KT2440
cagcugaucgccgucgacc

SEQ ID NO: 3547834 - RNA, 15 nt, Pseudomonas putida KT2440
cagcugcaccaccug

SEQ ID NO: 3547835 - RNA, 15 nt, Pseudomonas putida KT2440
cagcugcaccgaccg

SEQ ID NO: 3547836 - RNA, 14 nt, Pseudomonas putida KT2440
cagcugcagugcug

SEQ ID NO: 3547837 - RNA, 16 nt, Pseudomonas putida KT2440
cagcugcauuggcggc

SEQ ID NO: 3547838 - RNA, 19 nt, Pseudomonas putida KT2440
cagcugcauuggcggcagg

SEQ ID NO: 3547839 - RNA, 12 nt, Pseudomonas putida KT2440
cagcugccacuc

SEQ ID NO: 3547840 - RNA, 16 nt, Pseudomonas putida KT2440
cagcugccacucuuca

SEQ ID NO: 3547841 - RNA, 21 nt, Pseudomonas putida KT2440
cagcugccacucuucaccaug

SEQ ID NO: 3547842 - RNA, 22 nt, Pseudomonas putida KT2440
cagcugccacucuucaccaugg

SEQ ID NO: 3547843 - RNA, 15 nt, Pseudomonas putida KT2440
cagcugccggccagc

SEQ ID NO: 3547844 - RNA, 13 nt, Pseudomonas putida KT2440
cagcugccgggcc

SEQ ID NO: 3547845 - RNA, 15 nt, Pseudomonas putida KT2440
cagcugccgggccgg

SEQ ID NO: 3547846 - RNA, 14 nt, Pseudomonas putida KT2440
cagcugcgcacgca

SEQ ID NO: 3547847 - RNA, 14 nt, Pseudomonas putida KT2440
cagcugcgccugca

SEQ ID NO: 3547848 - RNA, 15 nt, Pseudomonas putida KT2440
cagcugcgcugccug

SEQ ID NO: 3547849 - RNA, 13 nt, Pseudomonas putida KT2440
cagcugcggucga

SEQ ID NO: 3547850 - RNA, 22 nt, Pseudomonas putida KT2440
cagcugcggucgagcugcccac

SEQ ID NO: 3547851 - RNA, 18 nt, Pseudomonas putida KT2440
cagcugcugaccucgacc

SEQ ID NO: 3547852 - RNA, 22 nt, Pseudomonas putida KT2440
cagcugcugaccucgacccgcc

SEQ ID NO: 3547853 - RNA, 16 nt, Pseudomonas putida KT2440
cagcugcugcagggcc

SEQ ID NO: 3547854 - RNA, 17 nt, Pseudomonas putida KT2440
cagcugcugcagggccc

SEQ ID NO: 3547855 - RNA, 17 nt, Pseudomonas putida KT2440
cagcugcugccccaugc

SEQ ID NO: 3547856 - RNA, 22 nt, Pseudomonas putida KT2440
cagcugcugcucuuucggcagc

SEQ ID NO: 3547857 - RNA, 23 nt, Pseudomonas putida KT2440
cagcugcuggauugccugaucaa

SEQ ID NO: 3547858 - RNA, 20 nt, Pseudomonas putida KT2440
cagcugcugucgagcaucca

SEQ ID NO: 3547859 - RNA, 15 nt, Pseudomonas putida KT2440
cagcuggccaccuug

SEQ ID NO: 3547860 - RNA, 11 nt, Pseudomonas putida KT2440
cagcuggccau

SEQ ID NO: 3547861 - RNA, 16 nt, Pseudomonas putida KT2440
cagcuggccaucgacc

SEQ ID NO: 3547862 - RNA, 22 nt, Pseudomonas putida KT2440
cagcuggccaucgacccgcugc

SEQ ID NO: 3547863 - RNA, 20 nt, Pseudomonas putida KT2440
cagcuggccuugcggcaagc

SEQ ID NO: 3547864 - RNA, 22 nt, Pseudomonas putida KT2440
cagcuggcgcaaauugcccggc

SEQ ID NO: 3547865 - RNA, 23 nt, Pseudomonas putida KT2440
cagcuggcgcaaauugcccggcc

SEQ ID NO: 3547866 - RNA, 22 nt, Pseudomonas putida KT2440
cagcuggcgcaugacuuccagg

SEQ ID NO: 3547867 - RNA, 18 nt, Pseudomonas putida KT2440
cagcuggcuggugacaac

SEQ ID NO: 3547868 - RNA, 18 nt, Pseudomonas putida KT2440
cagcugggugacaaagcg

SEQ ID NO: 3547869 - RNA, 18 nt, Pseudomonas putida KT2440
cagcuggucgaggcggcu

SEQ ID NO: 3547870 - RNA, 23 nt, Pseudomonas putida KT2440
cagcuggugagcguccaucuugg

SEQ ID NO: 3547871 - RNA, 23 nt, Pseudomonas putida KT2440
cagcugguucugcugcagccaac

SEQ ID NO: 3547872 - RNA, 17 nt, Pseudomonas putida KT2440
cagcuguacgcuggcca

SEQ ID NO: 3547873 - RNA, 19 nt, Pseudomonas putida KT2440
cagcuguacgcuggccaag

SEQ ID NO: 3547874 - RNA, 22 nt, Pseudomonas putida KT2440
cagcuguacgcuggccaaggcc

SEQ ID NO: 3547875 - RNA, 23 nt, Pseudomonas putida KT2440
cagcuguacgcuggccaaggccu

SEQ ID NO: 3547876 - RNA, 21 nt, Pseudomonas putida KT2440
cagcugucauuacccggcaga

SEQ ID NO: 3547877 - RNA, 22 nt, Pseudomonas putida KT2440
cagcugugcugccauaagccca

SEQ ID NO: 3547878 - RNA, 23 nt, Pseudomonas putida KT2440
cagcugugcugccauaagcccaa

SEQ ID NO: 3547879 - RNA, 20 nt, Pseudomonas putida KT2440
cagcugugugucgucacggc

SEQ ID NO: 3547880 - RNA, 14 nt, Pseudomonas putida KT2440
cagcuguugcuguu

SEQ ID NO: 3547881 - RNA, 21 nt, Pseudomonas putida KT2440
cagcuuaacgcuuggccagac

SEQ ID NO: 3547882 - RNA, 23 nt, Pseudomonas putida KT2440
cagcuuaacgcuuggccagacuc

SEQ ID NO: 3547883 - RNA, 12 nt, Pseudomonas putida KT2440
cagcuucaacaa

SEQ ID NO: 3547884 - RNA, 17 nt, Pseudomonas putida KT2440
cagcuucaacuccacca

SEQ ID NO: 3547885 - RNA, 18 nt, Pseudomonas putida KT2440
cagcuucaacuccaccau

SEQ ID NO: 3547886 - RNA, 20 nt, Pseudomonas putida KT2440
cagcuucaacuccaccauca

SEQ ID NO: 3547887 - RNA, 18 nt, Pseudomonas putida KT2440
cagcuucauggcgccgau

SEQ ID NO: 3547888 - RNA, 20 nt, Pseudomonas putida KT2440
cagcuucccggccuggcgca

SEQ ID NO: 3547889 - RNA, 16 nt, Pseudomonas putida KT2440
cagcuuccgccaccac

SEQ ID NO: 3547890 - RNA, 17 nt, Pseudomonas putida KT2440
cagcuuccgccaccacg

SEQ ID NO: 3547891 - RNA, 20 nt, Pseudomonas putida KT2440
cagcuuccgccaccacgaac

SEQ ID NO: 3547892 - RNA, 13 nt, Pseudomonas putida KT2440
cagcuuccugugc

SEQ ID NO: 3547893 - RNA, 17 nt, Pseudomonas putida KT2440
cagcuucuccagcaagc

SEQ ID NO: 3547894 - RNA, 21 nt, Pseudomonas putida KT2440
cagcuucucgcggcgaaugcu

SEQ ID NO: 3547895 - RNA, 19 nt, Pseudomonas putida KT2440
cagcuucugcuugcucugu

SEQ ID NO: 3547896 - RNA, 16 nt, Pseudomonas putida KT2440
caggcagccugccagg

SEQ ID NO: 3547897 - RNA, 17 nt, Pseudomonas putida KT2440
caggcagccugccaggu

SEQ ID NO: 3547898 - RNA, 23 nt, Pseudomonas putida KT2440
caggcagcgaucagugccuugac

SEQ ID NO: 3547899 - RNA, 17 nt, Pseudomonas putida KT2440
caggcaggaacuggcug

SEQ ID NO: 3547900 - RNA, 20 nt, Pseudomonas putida KT2440
caggcaggaacuggcugccg

SEQ ID NO: 3547901 - RNA, 13 nt, Pseudomonas putida KT2440
caggcaggccagc

SEQ ID NO: 3547902 - RNA, 15 nt, Pseudomonas putida KT2440
caggcaggccagcac

SEQ ID NO: 3547903 - RNA, 23 nt, Pseudomonas putida KT2440
caggcaggccagcacggccagca

SEQ ID NO: 3547904 - RNA, 15 nt, Pseudomonas putida KT2440
caggcaguaggccac

SEQ ID NO: 3547905 - RNA, 16 nt, Pseudomonas putida KT2440
caggcaguaggccacc

SEQ ID NO: 3547906 - RNA, 18 nt, Pseudomonas putida KT2440
caggcaguaggccaccgu

SEQ ID NO: 3547907 - RNA, 20 nt, Pseudomonas putida KT2440
caggcaguccugcaacucgg

SEQ ID NO: 3547908 - RNA, 19 nt, Pseudomonas putida KT2440
caggcagucuucaagcucg

SEQ ID NO: 3547909 - RNA, 19 nt, Pseudomonas putida KT2440
caggcaguucgagcgccug

SEQ ID NO: 3547910 - RNA, 20 nt, Pseudomonas putida KT2440
caggcaguucgagcgccuga

SEQ ID NO: 3547911 - RNA, 16 nt, Pseudomonas putida KT2440
caggcaguuucaggcg

SEQ ID NO: 3547912 - RNA, 20 nt, Pseudomonas putida KT2440
caggcaguuucaggcgcuca

SEQ ID NO: 3547913 - RNA, 17 nt, Pseudomonas putida KT2440
caggcauacaggaccag

SEQ ID NO: 3547914 - RNA, 19 nt, Pseudomonas putida KT2440
caggcauaccgcaacaccu

SEQ ID NO: 3547915 - RNA, 19 nt, Pseudomonas putida KT2440
caggcauacgaggccgucg

SEQ ID NO: 3547916 - RNA, 18 nt, Pseudomonas putida KT2440
caggcaucacgucacagc

SEQ ID NO: 3547917 - RNA, 12 nt, Pseudomonas putida KT2440
caggcaugccag

SEQ ID NO: 3547918 - RNA, 16 nt, Pseudomonas putida KT2440
caggcaugccagcagc

SEQ ID NO: 3547919 - RNA, 21 nt, Pseudomonas putida KT2440
caggcaugccagcagcuggcu

SEQ ID NO: 3547920 - RNA, 15 nt, Pseudomonas putida KT2440
caggcauuccccggu

SEQ ID NO: 3547921 - RNA, 19 nt, Pseudomonas putida KT2440
caggcauuguugcaacgca

SEQ ID NO: 3547922 - RNA, 19 nt, Pseudomonas putida KT2440
caggccaaguacggccagc

SEQ ID NO: 3547923 - RNA, 19 nt, Pseudomonas putida KT2440
caggccaaugcccaugccc

SEQ ID NO: 3547924 - RNA, 16 nt, Pseudomonas putida KT2440
caggccacgguccagu

SEQ ID NO: 3547925 - RNA, 18 nt, Pseudomonas putida KT2440
caggccacugguacagcu

SEQ ID NO: 3547926 - RNA, 22 nt, Pseudomonas putida KT2440
caggccagcacggccagcaccg

SEQ ID NO: 3547927 - RNA, 22 nt, Pseudomonas putida KT2440
caggccagccccagcggcagca

SEQ ID NO: 3547928 - RNA, 16 nt, Pseudomonas putida KT2440
caggccagcgucgugu

SEQ ID NO: 3547929 - RNA, 21 nt, Pseudomonas putida KT2440
caggccaguuccucggccuga

SEQ ID NO: 3547930 - RNA, 22 nt, Pseudomonas putida KT2440
caggccauauugcugagccagu

SEQ ID NO: 3547931 - RNA, 14 nt, Pseudomonas putida KT2440
caggccauccagcg

SEQ ID NO: 3547932 - RNA, 16 nt, Pseudomonas putida KT2440
caggccauccagcggc

SEQ ID NO: 3547933 - RNA, 23 nt, Pseudomonas putida KT2440
caggccauccagcggcgacaggu

SEQ ID NO: 3547934 - RNA, 22 nt, Pseudomonas putida KT2440
caggccaucuaagccuccagag

SEQ ID NO: 3547935 - RNA, 20 nt, Pseudomonas putida KT2440
caggccaugcccgcccgggc

SEQ ID NO: 3547936 - RNA, 22 nt, Pseudomonas putida KT2440
caggccaugcccuugccuucgg

SEQ ID NO: 3547937 - RNA, 15 nt, Pseudomonas putida KT2440
caggcccaacagcgc

SEQ ID NO: 3547938 - RNA, 13 nt, Pseudomonas putida KT2440
caggcccaacggg

SEQ ID NO: 3547939 - RNA, 11 nt, Pseudomonas putida KT2440
caggcccacca

SEQ ID NO: 3547940 - RNA, 12 nt, Pseudomonas putida KT2440
caggcccaccag

SEQ ID NO: 3547941 - RNA, 21 nt, Pseudomonas putida KT2440
caggcccaccagucugcucag

SEQ ID NO: 3547942 - RNA, 23 nt, Pseudomonas putida KT2440
caggcccaccagucugcucagcc

SEQ ID NO: 3547943 - RNA, 14 nt, Pseudomonas putida KT2440
caggcccacggcgu

SEQ ID NO: 3547944 - RNA, 17 nt, Pseudomonas putida KT2440
caggcccacggcgucca

SEQ ID NO: 3547945 - RNA, 15 nt, Pseudomonas putida KT2440
caggcccagcaacag

SEQ ID NO: 3547946 - RNA, 23 nt, Pseudomonas putida KT2440
caggcccagcagguacagcaccc

SEQ ID NO: 3547947 - RNA, 14 nt, Pseudomonas putida KT2440
caggcccagcauga

SEQ ID NO: 3547948 - RNA, 12 nt, Pseudomonas putida KT2440
caggcccagccc

SEQ ID NO: 3547949 - RNA, 16 nt, Pseudomonas putida KT2440
caggcccagccgggcc

SEQ ID NO: 3547950 - RNA, 17 nt, Pseudomonas putida KT2440
caggcccagccgggcca

SEQ ID NO: 3547951 - RNA, 14 nt, Pseudomonas putida KT2440
caggccccaggcca

SEQ ID NO: 3547952 - RNA, 15 nt, Pseudomonas putida KT2440
caggccccaggccau

SEQ ID NO: 3547953 - RNA, 19 nt, Pseudomonas putida KT2440
caggccccaggccauccag

SEQ ID NO: 3547954 - RNA, 20 nt, Pseudomonas putida KT2440
caggccccgauacagcgcgc

SEQ ID NO: 3547955 - RNA, 17 nt, Pseudomonas putida KT2440
caggccccugcaacagg

SEQ ID NO: 3547956 - RNA, 19 nt, Pseudomonas putida KT2440
caggccccugcaacagggc

SEQ ID NO: 3547957 - RNA, 22 nt, Pseudomonas putida KT2440
caggccccuuggccaacggcau

SEQ ID NO: 3547958 - RNA, 17 nt, Pseudomonas putida KT2440
caggcccgacuccaccg

SEQ ID NO: 3547959 - RNA, 19 nt, Pseudomonas putida KT2440
caggcccgacuccaccgcg

SEQ ID NO: 3547960 - RNA, 16 nt, Pseudomonas putida KT2440
caggcccgccagagca

SEQ ID NO: 3547961 - RNA, 21 nt, Pseudomonas putida KT2440
caggcccgcuauccucgaucg

SEQ ID NO: 3547962 - RNA, 13 nt, Pseudomonas putida KT2440
caggcccggccca

SEQ ID NO: 3547963 - RNA, 21 nt, Pseudomonas putida KT2440
caggcccggcccuuucgcggg

SEQ ID NO: 3547964 - RNA, 23 nt, Pseudomonas putida KT2440
caggcccggcccuuucgcgggua

SEQ ID NO: 3547965 - RNA, 21 nt, Pseudomonas putida KT2440
caggcccgugacgaaggcggu

SEQ ID NO: 3547966 - RNA, 17 nt, Pseudomonas putida KT2440
caggcccugacaggcga

SEQ ID NO: 3547967 - RNA, 22 nt, Pseudomonas putida KT2440
caggcccugacaggcgaucagu

SEQ ID NO: 3547968 - RNA, 18 nt, Pseudomonas putida KT2440
caggcccugacgccagcg

SEQ ID NO: 3547969 - RNA, 19 nt, Pseudomonas putida KT2440
caggccgaaggccagccga

SEQ ID NO: 3547970 - RNA, 15 nt, Pseudomonas putida KT2440
caggccgacaacagc

SEQ ID NO: 3547971 - RNA, 16 nt, Pseudomonas putida KT2440
caggccgacaacagca

SEQ ID NO: 3547972 - RNA, 18 nt, Pseudomonas putida KT2440
caggccgacaacagcaug

SEQ ID NO: 3547973 - RNA, 19 nt, Pseudomonas putida KT2440
caggccgacaacagcaugc

SEQ ID NO: 3547974 - RNA, 13 nt, Pseudomonas putida KT2440
caggccgaucacc

SEQ ID NO: 3547975 - RNA, 14 nt, Pseudomonas putida KT2440
caggccgaugccaa

SEQ ID NO: 3547976 - RNA, 20 nt, Pseudomonas putida KT2440
caggccgaugccaagcaccg

SEQ ID NO: 3547977 - RNA, 19 nt, Pseudomonas putida KT2440
caggccgaugcggucgaag

SEQ ID NO: 3547978 - RNA, 17 nt, Pseudomonas putida KT2440
caggccgaugggcaggc

SEQ ID NO: 3547979 - RNA, 17 nt, Pseudomonas putida KT2440
caggccgcacgcgccuc

SEQ ID NO: 3547980 - RNA, 12 nt, Pseudomonas putida KT2440
caggccgcagcc

SEQ ID NO: 3547981 - RNA, 13 nt, Pseudomonas putida KT2440
caggccgcagccu

SEQ ID NO: 3547982 - RNA, 15 nt, Pseudomonas putida KT2440
caggccgcagccucu

SEQ ID NO: 3547983 - RNA, 22 nt, Pseudomonas putida KT2440
caggccgcauuucgacgcagag

SEQ ID NO: 3547984 - RNA, 18 nt, Pseudomonas putida KT2440
caggccgcccacccacca

SEQ ID NO: 3547985 - RNA, 12 nt, Pseudomonas putida KT2440
caggccgccuug

SEQ ID NO: 3547986 - RNA, 16 nt, Pseudomonas putida KT2440
caggccgcggccgaaa

SEQ ID NO: 3547987 - RNA, 21 nt, Pseudomonas putida KT2440
caggccgcugaacaacuccgg

SEQ ID NO: 3547988 - RNA, 14 nt, Pseudomonas putida KT2440
caggccggccacca

SEQ ID NO: 3547989 - RNA, 18 nt, Pseudomonas putida KT2440
caggccggccaccagugc

SEQ ID NO: 3547990 - RNA, 14 nt, Pseudomonas putida KT2440
caggccggguccug

SEQ ID NO: 3547991 - RNA, 20 nt, Pseudomonas putida KT2440
caggccguagcgcugaccau

SEQ ID NO: 3547992 - RNA, 22 nt, Pseudomonas putida KT2440
caggccguaguaggagcggguu

SEQ ID NO: 3547993 - RNA, 17 nt, Pseudomonas putida KT2440
caggccucaagccucgc

SEQ ID NO: 3547994 - RNA, 17 nt, Pseudomonas putida KT2440
caggccugaaacgcccu

SEQ ID NO: 3547995 - RNA, 19 nt, Pseudomonas putida KT2440
caggccugaaacgcccuug

SEQ ID NO: 3547996 - RNA, 13 nt, Pseudomonas putida KT2440
caggccugcacug

SEQ ID NO: 3547997 - RNA, 18 nt, Pseudomonas putida KT2440
caggccugcacugcaccc

SEQ ID NO: 3547998 - RNA, 14 nt, Pseudomonas putida KT2440
caggccugcggcca

SEQ ID NO: 3547999 - RNA, 18 nt, Pseudomonas putida KT2440
caggccugcggccaggcc

SEQ ID NO: 3548000 - RNA, 17 nt, Pseudomonas putida KT2440
caggccuucaucggccu

SEQ ID NO: 3548001 - RNA, 23 nt, Pseudomonas putida KT2440
caggcuuguccuugagcgccgcg

SEQ ID NO: 3548002 - RNA, 14 nt, Pseudomonas putida KT2440
caggcuuucggcca

SEQ ID NO: 3548003 - RNA, 18 nt, Pseudomonas putida KT2440
caggcuuucggccacccg

SEQ ID NO: 3548004 - RNA, 15 nt, Pseudomonas putida KT2440
caggcuuugcugcag

SEQ ID NO: 3548005 - RNA, 16 nt, Pseudomonas putida KT2440
caggcuuugcugcagg

SEQ ID NO: 3548006 - RNA, 14 nt, Pseudomonas putida KT2440
cagggaaacaaauc

SEQ ID NO: 3548007 - RNA, 15 nt, Pseudomonas putida KT2440
cagggaacugcgcga

SEQ ID NO: 3548008 - RNA, 19 nt, Pseudomonas putida KT2440
cagggaacugcgcgagcca

SEQ ID NO: 3548009 - RNA, 22 nt, Pseudomonas putida KT2440
cagggaagaauugcugguugau

SEQ ID NO: 3548010 - RNA, 18 nt, Pseudomonas putida KT2440
cagggaagguggccggca

SEQ ID NO: 3548011 - RNA, 22 nt, Pseudomonas putida KT2440
cagggaagguggccggcaacgg

SEQ ID NO: 3548012 - RNA, 15 nt, Pseudomonas putida KT2440
cagggaccgugcagg

SEQ ID NO: 3548013 - RNA, 15 nt, Pseudomonas putida KT2440
cagggauacugcuga

SEQ ID NO: 3548014 - RNA, 13 nt, Pseudomonas putida KT2440
cagggaucgaugc

SEQ ID NO: 3548015 - RNA, 21 nt, Pseudomonas putida KT2440
cagggauuccuuggucagguc

SEQ ID NO: 3548016 - RNA, 20 nt, Pseudomonas putida KT2440
cagggcaaaaugcagcaagc

SEQ ID NO: 3548017 - RNA, 22 nt, Pseudomonas putida KT2440
cagggcaaacaccuugccccgc

SEQ ID NO: 3548018 - RNA, 15 nt, Pseudomonas putida KT2440
cagggcaaagcccag

SEQ ID NO: 3548019 - RNA, 23 nt, Pseudomonas putida KT2440
cagggcaacggcaauggccgggu

SEQ ID NO: 3548020 - RNA, 14 nt, Pseudomonas putida KT2440
cagggcaaucgcca

SEQ ID NO: 3548021 - RNA, 19 nt, Pseudomonas putida KT2440
cagggcacacuucgccgug

SEQ ID NO: 3548022 - RNA, 21 nt, Pseudomonas putida KT2440
cagggcacacuucgccgugcu

SEQ ID NO: 3548023 - RNA, 15 nt, Pseudomonas putida KT2440
cagggcacggcugcc

SEQ ID NO: 3548024 - RNA, 18 nt, Pseudomonas putida KT2440
cagggcagcaacgccgag

SEQ ID NO: 3548025 - RNA, 15 nt, Pseudomonas putida KT2440
cagggcaggcugaug

SEQ ID NO: 3548026 - RNA, 21 nt, Pseudomonas putida KT2440
cagggcaggggacagccacau

SEQ ID NO: 3548027 - RNA, 23 nt, Pseudomonas putida KT2440
cagggcaggggacagccacaugc

SEQ ID NO: 3548028 - RNA, 12 nt, Pseudomonas putida KT2440
cagggcagguca

SEQ ID NO: 3548029 - RNA, 21 nt, Pseudomonas putida KT2440
cagggcaucgaucccuggggc

SEQ ID NO: 3548030 - RNA, 16 nt, Pseudomonas putida KT2440
cagggcaucggacagg

SEQ ID NO: 3548031 - RNA, 17 nt, Pseudomonas putida KT2440
cagggcaucggacaggu

SEQ ID NO: 3548032 - RNA, 19 nt, Pseudomonas putida KT2440
cagggcaucggcgccccgc

SEQ ID NO: 3548033 - RNA, 18 nt, Pseudomonas putida KT2440
cagggcauugcgcaugcg

SEQ ID NO: 3548034 - RNA, 15 nt, Pseudomonas putida KT2440
cagggcccagccacc

SEQ ID NO: 3548035 - RNA, 24 nt, Pseudomonas putida KT2440
cagggcccagccaccgacgaacag

SEQ ID NO: 3548036 - RNA, 20 nt, Pseudomonas putida KT2440
cagggcccgggcacgggcca

SEQ ID NO: 3548037 - RNA, 14 nt, Pseudomonas putida KT2440
cagggcccucaacc

SEQ ID NO: 3548038 - RNA, 22 nt, Pseudomonas putida KT2440
cagggcccucaacccucgccca

SEQ ID NO: 3548039 - RNA, 12 nt, Pseudomonas putida KT2440
cagggccgcgcu

SEQ ID NO: 3548040 - RNA, 16 nt, Pseudomonas putida KT2440
cagggccggcccuuuc

SEQ ID NO: 3548041 - RNA, 16 nt, Pseudomonas putida KT2440
cagggccucgaugcgg

SEQ ID NO: 3548042 - RNA, 19 nt, Pseudomonas putida KT2440
cagggccuuggccuggggc

SEQ ID NO: 3548043 - RNA, 15 nt, Pseudomonas putida KT2440
cagggcgaagaucgg

SEQ ID NO: 3548044 - RNA, 15 nt, Pseudomonas putida KT2440
cagggcgagcacacc

SEQ ID NO: 3548045 - RNA, 19 nt, Pseudomonas putida KT2440
cagggcgaucuccugcagg

SEQ ID NO: 3548046 - RNA, 15 nt, Pseudomonas putida KT2440
cagggcgcccguuac

SEQ ID NO: 3548047 - RNA, 13 nt, Pseudomonas putida KT2440
cagggcgccguug

SEQ ID NO: 3548048 - RNA, 18 nt, Pseudomonas putida KT2440
cagggcgcgaaaagccug

SEQ ID NO: 3548049 - RNA, 21 nt, Pseudomonas putida KT2440
cagggcgcgaaaagccugcac

SEQ ID NO: 3548050 - RNA, 22 nt, Pseudomonas putida KT2440
cagggcgcguguagcccgcuga

SEQ ID NO: 3548051 - RNA, 17 nt, Pseudomonas putida KT2440
cagggcgcuugcccgcg

SEQ ID NO: 3548052 - RNA, 16 nt, Pseudomonas putida KT2440
cagggcggccucggcc

SEQ ID NO: 3548053 - RNA, 18 nt, Pseudomonas putida KT2440
cagggcgucgaacacggc

SEQ ID NO: 3548054 - RNA, 20 nt, Pseudomonas putida KT2440
cagggcguugccgaucaggu

SEQ ID NO: 3548055 - RNA, 17 nt, Pseudomonas putida KT2440
cagggcguugggcacga

SEQ ID NO: 3548056 - RNA, 16 nt, Pseudomonas putida KT2440
cagggcugcaaggugu

SEQ ID NO: 3548057 - RNA, 19 nt, Pseudomonas putida KT2440
cagggcugguuaugagccu

SEQ ID NO: 3548058 - RNA, 15 nt, Pseudomonas putida KT2440
cagggcugguuccug

SEQ ID NO: 3548059 - RNA, 16 nt, Pseudomonas putida KT2440
cagggcuuucuucucu

SEQ ID NO: 3548060 - RNA, 22 nt, Pseudomonas putida KT2440
cagggcuuucuucucuugcccg

SEQ ID NO: 3548061 - RNA, 13 nt, Pseudomonas putida KT2440
caggggacagcca

SEQ ID NO: 3548062 - RNA, 16 nt, Pseudomonas putida KT2440
caggggacagccacau

SEQ ID NO: 3548063 - RNA, 20 nt, Pseudomonas putida KT2440
caggggacagccacaugcca

SEQ ID NO: 3548064 - RNA, 18 nt, Pseudomonas putida KT2440
caggggcccuuggccuca

SEQ ID NO: 3548065 - RNA, 12 nt, Pseudomonas putida KT2440
caggggccgcgc

SEQ ID NO: 3548066 - RNA, 13 nt, Pseudomonas putida KT2440
caggggccgcgca

SEQ ID NO: 3548067 - RNA, 15 nt, Pseudomonas putida KT2440
caggggccgcgcagc

SEQ ID NO: 3548068 - RNA, 18 nt, Pseudomonas putida KT2440
caggggcgcagagcgccc

SEQ ID NO: 3548069 - RNA, 22 nt, Pseudomonas putida KT2440
caggggcguuuaaaccuucaac

SEQ ID NO: 3548070 - RNA, 21 nt, Pseudomonas putida KT2440
caggggcuguauagcccugcc

SEQ ID NO: 3548071 - RNA, 15 nt, Pseudomonas putida KT2440
cagggggcagcugcu

SEQ ID NO: 3548072 - RNA, 17 nt, Pseudomonas putida KT2440
cagggggguaaggcugg

SEQ ID NO: 3548073 - RNA, 19 nt, Pseudomonas putida KT2440
cagggggguaaggcuggcu

SEQ ID NO: 3548074 - RNA, 15 nt, Pseudomonas putida KT2440
caggggucugugcag

SEQ ID NO: 3548075 - RNA, 20 nt, Pseudomonas putida KT2440
caggggucuuugaacgaggu

SEQ ID NO: 3548076 - RNA, 12 nt, Pseudomonas putida KT2440
caggggugacca

SEQ ID NO: 3548077 - RNA, 19 nt, Pseudomonas putida KT2440
cagggguucgaguccccua

SEQ ID NO: 3548078 - RNA, 16 nt, Pseudomonas putida KT2440
cagggguucgccccgc

SEQ ID NO: 3548079 - RNA, 18 nt, Pseudomonas putida KT2440
caggguacgauagggcgg

SEQ ID NO: 3548080 - RNA, 14 nt, Pseudomonas putida KT2440
cagggucagggcca

SEQ ID NO: 3548081 - RNA, 18 nt, Pseudomonas putida KT2440
cagggucgcgccccaagc

SEQ ID NO: 3548082 - RNA, 16 nt, Pseudomonas putida KT2440
cagggucgggcacagg

SEQ ID NO: 3548083 - RNA, 17 nt, Pseudomonas putida KT2440
cagggucgggcacaggc

SEQ ID NO: 3548084 - RNA, 20 nt, Pseudomonas putida KT2440
cagggucgggcacaggccca

SEQ ID NO: 3548085 - RNA, 23 nt, Pseudomonas putida KT2440
cagggucgggcacaggcccagca

SEQ ID NO: 3548086 - RNA, 17 nt, Pseudomonas putida KT2440
cagggucugcgcuucaa

SEQ ID NO: 3548087 - RNA, 23 nt, Pseudomonas putida KT2440
cagggugaucgcgcuggcacugc

SEQ ID NO: 3548088 - RNA, 14 nt, Pseudomonas putida KT2440
cagggugccagacc

SEQ ID NO: 3548089 - RNA, 16 nt, Pseudomonas putida KT2440
cagggugccgccaugu

SEQ ID NO: 3548090 - RNA, 24 nt, Pseudomonas putida KT2440
cagggugccggccagcggcaugug

SEQ ID NO: 3548091 - RNA, 14 nt, Pseudomonas putida KT2440
caggguggccagca

SEQ ID NO: 3548092 - RNA, 19 nt, Pseudomonas putida KT2440
caggguggcgauccacagc

SEQ ID NO: 3548093 - RNA, 22 nt, Pseudomonas putida KT2440
cagggugucgguggcggccagc

SEQ ID NO: 3548094 - RNA, 17 nt, Pseudomonas putida KT2440
cagggugugcugcugcc

SEQ ID NO: 3548095 - RNA, 20 nt, Pseudomonas putida KT2440
caggguucgccgucagccuu

SEQ ID NO: 3548096 - RNA, 21 nt, Pseudomonas putida KT2440
caggguucgcuguccugaugu

SEQ ID NO: 3548097 - RNA, 19 nt, Pseudomonas putida KT2440
caggguuguggugagcccu

SEQ ID NO: 3548098 - RNA, 19 nt, Pseudomonas putida KT2440
caggguuuucagcgccgca

SEQ ID NO: 3548099 - RNA, 20 nt, Pseudomonas putida KT2440
cagguaaacccgcgccugca

SEQ ID NO: 3548100 - RNA, 18 nt, Pseudomonas putida KT2440
cagguaaaccugccugau

SEQ ID NO: 3548101 - RNA, 21 nt, Pseudomonas putida KT2440
cagguaacugccgaccuuggg

SEQ ID NO: 3548102 - RNA, 15 nt, Pseudomonas putida KT2440
cagguaaugcacaag

SEQ ID NO: 3548103 - RNA, 18 nt, Pseudomonas putida KT2440
cagguaaugcgccgcacc

SEQ ID NO: 3548104 - RNA, 20 nt, Pseudomonas putida KT2440
cagguacacgggcaugccau

SEQ ID NO: 3548105 - RNA, 13 nt, Pseudomonas putida KT2440
cagguacagcagc

SEQ ID NO: 3548106 - RNA, 17 nt, Pseudomonas putida KT2440
cagguacgaagccaugu

SEQ ID NO: 3548107 - RNA, 22 nt, Pseudomonas putida KT2440
cagguacgaagccaugucuuca

SEQ ID NO: 3548108 - RNA, 22 nt, Pseudomonas putida KT2440
cagguacgcgcaggcagcucga

SEQ ID NO: 3548109 - RNA, 17 nt, Pseudomonas putida KT2440
cagguacucgcgacuga

SEQ ID NO: 3548110 - RNA, 20 nt, Pseudomonas putida KT2440
cagguagccuuccagcuccu

SEQ ID NO: 3548111 - RNA, 19 nt, Pseudomonas putida KT2440
cagguagcgauugcggccu

SEQ ID NO: 3548112 - RNA, 20 nt, Pseudomonas putida KT2440
cagguagcgucgcgcgccca

SEQ ID NO: 3548113 - RNA, 15 nt, Pseudomonas putida KT2440
cagguaggcagcaac

SEQ ID NO: 3548114 - RNA, 19 nt, Pseudomonas putida KT2440
cagguaggcgccacgccgc

SEQ ID NO: 3548115 - RNA, 17 nt, Pseudomonas putida KT2440
cagguagugcgcggccg

SEQ ID NO: 3548116 - RNA, 19 nt, Pseudomonas putida KT2440
cagguagugcgcggccgug

SEQ ID NO: 3548117 - RNA, 15 nt, Pseudomonas putida KT2440
cagguaguuggccgg

SEQ ID NO: 3548118 - RNA, 15 nt, Pseudomonas putida KT2440
cagguauccgggucc

SEQ ID NO: 3548119 - RNA, 20 nt, Pseudomonas putida KT2440
caggucaaacguauccgccg

SEQ ID NO: 3548120 - RNA, 20 nt, Pseudomonas putida KT2440
caggucauaguucuggcugc

SEQ ID NO: 3548121 - RNA, 15 nt, Pseudomonas putida KT2440
caggucaugaugccc

SEQ ID NO: 3548122 - RNA, 16 nt, Pseudomonas putida KT2440
caggucaugaugcccg

SEQ ID NO: 3548123 - RNA, 17 nt, Pseudomonas putida KT2440
caggucauguagcgccu

SEQ ID NO: 3548124 - RNA, 23 nt, Pseudomonas putida KT2440
caggucauuggcgccaucgccca

SEQ ID NO: 3548125 - RNA, 18 nt, Pseudomonas putida KT2440
caggucauuugcagugcu

SEQ ID NO: 3548126 - RNA, 15 nt, Pseudomonas putida KT2440
cagguccaccagcag

SEQ ID NO: 3548127 - RNA, 18 nt, Pseudomonas putida KT2440
cagguccaccugguucug

SEQ ID NO: 3548128 - RNA, 16 nt, Pseudomonas putida KT2440
cagguccagccgccau

SEQ ID NO: 3548129 - RNA, 16 nt, Pseudomonas putida KT2440
cagguccagcgcaggc

SEQ ID NO: 3548130 - RNA, 13 nt, Pseudomonas putida KT2440
cagguccaggcca

SEQ ID NO: 3548131 - RNA, 16 nt, Pseudomonas putida KT2440
cagguccaggccagcu

SEQ ID NO: 3548132 - RNA, 17 nt, Pseudomonas putida KT2440
cagguccaggccagcuu

SEQ ID NO: 3548133 - RNA, 22 nt, Pseudomonas putida KT2440
cagguccggaaacucacgcgcc

SEQ ID NO: 3548134 - RNA, 18 nt, Pseudomonas putida KT2440
cagguccgguaacuggcc

SEQ ID NO: 3548135 - RNA, 19 nt, Pseudomonas putida KT2440
cagguccgguaacuggccc

SEQ ID NO: 3548136 - RNA, 20 nt, Pseudomonas putida KT2440
cagguccgguaacuggccca

SEQ ID NO: 3548137 - RNA, 19 nt, Pseudomonas putida KT2440
cagguccugcuccacccgu

SEQ ID NO: 3548138 - RNA, 14 nt, Pseudomonas putida KT2440
caggucgacaccca

SEQ ID NO: 3548139 - RNA, 17 nt, Pseudomonas putida KT2440
caggucgacacccagca

SEQ ID NO: 3548140 - RNA, 20 nt, Pseudomonas putida KT2440
caggucgacacccagcaccc

SEQ ID NO: 3548141 - RNA, 20 nt, Pseudomonas putida KT2440
caggucgacaugcaccacgc

SEQ ID NO: 3548142 - RNA, 20 nt, Pseudomonas putida KT2440
caggucgacccgcgccaggg

SEQ ID NO: 3548143 - RNA, 17 nt, Pseudomonas putida KT2440
caggucgaccgagaagc

SEQ ID NO: 3548144 - RNA, 14 nt, Pseudomonas putida KT2440
caggucgaccugcc

SEQ ID NO: 3548145 - RNA, 16 nt, Pseudomonas putida KT2440
caggucgaccugccag

SEQ ID NO: 3548146 - RNA, 17 nt, Pseudomonas putida KT2440
caggucgaccugccagu

SEQ ID NO: 3548147 - RNA, 21 nt, Pseudomonas putida KT2440
caggucgaccugccagucgca

SEQ ID NO: 3548148 - RNA, 20 nt, Pseudomonas putida KT2440
caggucgaucccgccgagca

SEQ ID NO: 3548149 - RNA, 13 nt, Pseudomonas putida KT2440
caggucgauccgg

SEQ ID NO: 3548150 - RNA, 18 nt, Pseudomonas putida KT2440
caggucgauccgggugcu

SEQ ID NO: 3548151 - RNA, 20 nt, Pseudomonas putida KT2440
caggucgaugaucgccgccg

SEQ ID NO: 3548152 - RNA, 14 nt, Pseudomonas putida KT2440
caggucgaugccuu

SEQ ID NO: 3548153 - RNA, 17 nt, Pseudomonas putida KT2440
caggucgauguccaggc

SEQ ID NO: 3548154 - RNA, 19 nt, Pseudomonas putida KT2440
caggucgauguccaggccg

SEQ ID NO: 3548155 - RNA, 20 nt, Pseudomonas putida KT2440
caggucgauguccaggccga

SEQ ID NO: 3548156 - RNA, 14 nt, Pseudomonas putida KT2440
caggucgccagcac

SEQ ID NO: 3548157 - RNA, 21 nt, Pseudomonas putida KT2440
caggucgccagcaccaucagg

SEQ ID NO: 3548158 - RNA, 14 nt, Pseudomonas putida KT2440
caggucgccaggcu

SEQ ID NO: 3548159 - RNA, 15 nt, Pseudomonas putida KT2440
caggucgccaggcuu

SEQ ID NO: 3548160 - RNA, 22 nt, Pseudomonas putida KT2440
caggucgccgcuguucagcccu

SEQ ID NO: 3548161 - RNA, 14 nt, Pseudomonas putida KT2440
caggucgcgcugca

SEQ ID NO: 3548162 - RNA, 20 nt, Pseudomonas putida KT2440
caggucgcgguucgacugcc

SEQ ID NO: 3548163 - RNA, 17 nt, Pseudomonas putida KT2440
caggucgcuaucggcag

SEQ ID NO: 3548164 - RNA, 18 nt, Pseudomonas putida KT2440
caggucgcugugcggcgu

SEQ ID NO: 3548165 - RNA, 14 nt, Pseudomonas putida KT2440
caggucggcaacca

SEQ ID NO: 3548166 - RNA, 15 nt, Pseudomonas putida KT2440
caggucggcaaccau

SEQ ID NO: 3548167 - RNA, 18 nt, Pseudomonas putida KT2440
caggucggcaaccauggc

SEQ ID NO: 3548168 - RNA, 13 nt, Pseudomonas putida KT2440
caggucggcacgc

SEQ ID NO: 3548169 - RNA, 12 nt, Pseudomonas putida KT2440
caggucggccag

SEQ ID NO: 3548170 - RNA, 14 nt, Pseudomonas putida KT2440
caggucggccagcu

SEQ ID NO: 3548171 - RNA, 17 nt, Pseudomonas putida KT2440
caggucggccagcucgg

SEQ ID NO: 3548172 - RNA, 14 nt, Pseudomonas putida KT2440
caggucggcgcgcg

SEQ ID NO: 3548173 - RNA, 11 nt, Pseudomonas putida KT2440
caggucggcgg

SEQ ID NO: 3548174 - RNA, 16 nt, Pseudomonas putida KT2440
caggucggcggccucg

SEQ ID NO: 3548175 - RNA, 21 nt, Pseudomonas putida KT2440
caggucggcggggcccggaca

SEQ ID NO: 3548176 - RNA, 21 nt, Pseudomonas putida KT2440
caggucgguagggaucaccgc

SEQ ID NO: 3548177 - RNA, 17 nt, Pseudomonas putida KT2440
caggucggucagcaccg

SEQ ID NO: 3548178 - RNA, 21 nt, Pseudomonas putida KT2440
caggucggugauauagcaccg

SEQ ID NO: 3548179 - RNA, 19 nt, Pseudomonas putida KT2440
caggucgugauagaccugc

SEQ ID NO: 3548180 - RNA, 18 nt, Pseudomonas putida KT2440
caggucguugacgaucug

SEQ ID NO: 3548181 - RNA, 22 nt, Pseudomonas putida KT2440
caggucuucaaaucgcugcgca

SEQ ID NO: 3548182 - RNA, 16 nt, Pseudomonas putida KT2440
caggugaaucagcggc

SEQ ID NO: 3548183 - RNA, 21 nt, Pseudomonas putida KT2440
caggugaaucagcggcaggcu

SEQ ID NO: 3548184 - RNA, 16 nt, Pseudomonas putida KT2440
caggugacaagcugcg

SEQ ID NO: 3548185 - RNA, 20 nt, Pseudomonas putida KT2440
caggugacaagcugcgcccu

SEQ ID NO: 3548186 - RNA, 13 nt, Pseudomonas putida KT2440
caggugacccugg

SEQ ID NO: 3548187 - RNA, 17 nt, Pseudomonas putida KT2440
caggugacccuggaaaa

SEQ ID NO: 3548188 - RNA, 20 nt, Pseudomonas putida KT2440
caggugauaguccagcaacu

SEQ ID NO: 3548189 - RNA, 14 nt, Pseudomonas putida KT2440
caggugaugcaggc

SEQ ID NO: 3548190 - RNA, 14 nt, Pseudomonas putida KT2440
caggugauuuccuc

SEQ ID NO: 3548191 - RNA, 16 nt, Pseudomonas putida KT2440
caggugauuuccucuu

SEQ ID NO: 3548192 - RNA, 14 nt, Pseudomonas putida KT2440
caggugcaccuccg

SEQ ID NO: 3548193 - RNA, 15 nt, Pseudomonas putida KT2440
caggugcaccuccgc

SEQ ID NO: 3548194 - RNA, 23 nt, Pseudomonas putida KT2440
caggugcagcaacagguacaugu

SEQ ID NO: 3548195 - RNA, 13 nt, Pseudomonas putida KT2440
caggugcagcaca

SEQ ID NO: 3548196 - RNA, 16 nt, Pseudomonas putida KT2440
caggugcagccagccc

SEQ ID NO: 3548197 - RNA, 17 nt, Pseudomonas putida KT2440
caggugcagccagcccc

SEQ ID NO: 3548198 - RNA, 22 nt, Pseudomonas putida KT2440
caggugcagccagccccaaccc

SEQ ID NO: 3548199 - RNA, 14 nt, Pseudomonas putida KT2440
caggugcaggagca

SEQ ID NO: 3548200 - RNA, 22 nt, Pseudomonas putida KT2440
caggugcaggagcaaacagccu

SEQ ID NO: 3548201 - RNA, 12 nt, Pseudomonas putida KT2440
caggugcaggcu

SEQ ID NO: 3548202 - RNA, 16 nt, Pseudomonas putida KT2440
caggugcaggcucggc

SEQ ID NO: 3548203 - RNA, 22 nt, Pseudomonas putida KT2440
caggugcagguacugcaugugc

SEQ ID NO: 3548204 - RNA, 18 nt, Pseudomonas putida KT2440
caggugcagguucgacca

SEQ ID NO: 3548205 - RNA, 14 nt, Pseudomonas putida KT2440
caggugccaacggu

SEQ ID NO: 3548206 - RNA, 15 nt, Pseudomonas putida KT2440
caggugccaggcuca

SEQ ID NO: 3548207 - RNA, 17 nt, Pseudomonas putida KT2440
caggugccaggcucagg

SEQ ID NO: 3548208 - RNA, 23 nt, Pseudomonas putida KT2440
caggugcccaugaucuugcugcc

SEQ ID NO: 3548209 - RNA, 17 nt, Pseudomonas putida KT2440
caggugccucugcugcg

SEQ ID NO: 3548210 - RNA, 16 nt, Pseudomonas putida KT2440
caggugcgcaccuugg

SEQ ID NO: 3548211 - RNA, 17 nt, Pseudomonas putida KT2440
cagucagugcgucggcc

SEQ ID NO: 3548212 - RNA, 16 nt, Pseudomonas putida KT2440
cagucauccagaaagc

SEQ ID NO: 3548213 - RNA, 16 nt, Pseudomonas putida KT2440
cagucauccgggccgu

SEQ ID NO: 3548214 - RNA, 19 nt, Pseudomonas putida KT2440
caguccaaccgcaagcggc

SEQ ID NO: 3548215 - RNA, 15 nt, Pseudomonas putida KT2440
caguccacuugcguu

SEQ ID NO: 3548216 - RNA, 13 nt, Pseudomonas putida KT2440
caguccaggccaa

SEQ ID NO: 3548217 - RNA, 20 nt, Pseudomonas putida KT2440
caguccgguagcgcgccugc

SEQ ID NO: 3548218 - RNA, 23 nt, Pseudomonas putida KT2440
caguccgguagcgcgccugcuuu

SEQ ID NO: 3548219 - RNA, 19 nt, Pseudomonas putida KT2440
caguccgucucuucagccg

SEQ ID NO: 3548220 - RNA, 14 nt, Pseudomonas putida KT2440
caguccuuggccaa

SEQ ID NO: 3548221 - RNA, 20 nt, Pseudomonas putida KT2440
cagucgaaggggaucagcac

SEQ ID NO: 3548222 - RNA, 12 nt, Pseudomonas putida KT2440
cagucgaagucu

SEQ ID NO: 3548223 - RNA, 15 nt, Pseudomonas putida KT2440
cagucgaccgggcag

SEQ ID NO: 3548224 - RNA, 17 nt, Pseudomonas putida KT2440
cagucgaccgggcagac

SEQ ID NO: 3548225 - RNA, 18 nt, Pseudomonas putida KT2440
cagucgaccgggcagacc

SEQ ID NO: 3548226 - RNA, 19 nt, Pseudomonas putida KT2440
cagucgaccgggcagaccu

SEQ ID NO: 3548227 - RNA, 15 nt, Pseudomonas putida KT2440
cagucgagucgacag

SEQ ID NO: 3548228 - RNA, 16 nt, Pseudomonas putida KT2440
cagucgagucgacagu

SEQ ID NO: 3548229 - RNA, 19 nt, Pseudomonas putida KT2440
cagucgagucgacagugac

SEQ ID NO: 3548230 - RNA, 19 nt, Pseudomonas putida KT2440
cagucgaucagcgacacca

SEQ ID NO: 3548231 - RNA, 22 nt, Pseudomonas putida KT2440
cagucgaucccgaggucagcag

SEQ ID NO: 3548232 - RNA, 21 nt, Pseudomonas putida KT2440
cagucgaugggcccgagcccc

SEQ ID NO: 3548233 - RNA, 21 nt, Pseudomonas putida KT2440
cagucgcacagguccagccgc

SEQ ID NO: 3548234 - RNA, 22 nt, Pseudomonas putida KT2440
cagucgcacagguccagccgcc

SEQ ID NO: 3548235 - RNA, 17 nt, Pseudomonas putida KT2440
cagucgccccgccagcg

SEQ ID NO: 3548236 - RNA, 18 nt, Pseudomonas putida KT2440
cagucgcgcaacugccca

SEQ ID NO: 3548237 - RNA, 13 nt, Pseudomonas putida KT2440
cagucggcgcugg

SEQ ID NO: 3548238 - RNA, 18 nt, Pseudomonas putida KT2440
cagucucgaccacuuccc

SEQ ID NO: 3548239 - RNA, 20 nt, Pseudomonas putida KT2440
cagucucgaccacuucccac

SEQ ID NO: 3548240 - RNA, 16 nt, Pseudomonas putida KT2440
cagucucuuucaacag

SEQ ID NO: 3548241 - RNA, 15 nt, Pseudomonas putida KT2440
cagucugcuccaccg

SEQ ID NO: 3548242 - RNA, 23 nt, Pseudomonas putida KT2440
cagucuucaagcucgaagcgcuc

SEQ ID NO: 3548243 - RNA, 21 nt, Pseudomonas putida KT2440
cagugaacuccaacgccggca

SEQ ID NO: 3548244 - RNA, 18 nt, Pseudomonas putida KT2440
cagugaauuccuugcugg

SEQ ID NO: 3548245 - RNA, 21 nt, Pseudomonas putida KT2440
cagugaauuccuugcuggugu

SEQ ID NO: 3548246 - RNA, 23 nt, Pseudomonas putida KT2440
cagugaccgguuuuggcaggccg

SEQ ID NO: 3548247 - RNA, 18 nt, Pseudomonas putida KT2440
cagugagccucacacagc

SEQ ID NO: 3548248 - RNA, 13 nt, Pseudomonas putida KT2440
cagugaucaucac

SEQ ID NO: 3548249 - RNA, 12 nt, Pseudomonas putida KT2440
cagugaugccgu

SEQ ID NO: 3548250 - RNA, 16 nt, Pseudomonas putida KT2440
cagugaugcuugcgcg

SEQ ID NO: 3548251 - RNA, 15 nt, Pseudomonas putida KT2440
cagugcaacguucac

SEQ ID NO: 3548252 - RNA, 14 nt, Pseudomonas putida KT2440
cagugcacuugcgg

SEQ ID NO: 3548253 - RNA, 16 nt, Pseudomonas putida KT2440
cagugcaggugcacug

SEQ ID NO: 3548254 - RNA, 20 nt, Pseudomonas putida KT2440
cagugcaucgaagcaggccg

SEQ ID NO: 3548255 - RNA, 22 nt, Pseudomonas putida KT2440
cagugcauuggcaaacgccugu

SEQ ID NO: 3548256 - RNA, 22 nt, Pseudomonas putida KT2440
cagugccaaggaccagacccgc

SEQ ID NO: 3548257 - RNA, 13 nt, Pseudomonas putida KT2440
cagugccagcaac

SEQ ID NO: 3548258 - RNA, 22 nt, Pseudomonas putida KT2440
cagugccaucgccucggcacug

SEQ ID NO: 3548259 - RNA, 19 nt, Pseudomonas putida KT2440
cagugccaugaacaccacc

SEQ ID NO: 3548260 - RNA, 20 nt, Pseudomonas putida KT2440
cagugccaugaacaccaccg

SEQ ID NO: 3548261 - RNA, 21 nt, Pseudomonas putida KT2440
cagugccaugaacaccaccgc

SEQ ID NO: 3548262 - RNA, 15 nt, Pseudomonas putida KT2440
cagugccauguaguu

SEQ ID NO: 3548263 - RNA, 18 nt, Pseudomonas putida KT2440
cagugcccagucgauggg

SEQ ID NO: 3548264 - RNA, 21 nt, Pseudomonas putida KT2440
cagugcccccgucagcggcaa

SEQ ID NO: 3548265 - RNA, 17 nt, Pseudomonas putida KT2440
cagugccgccaccuggc

SEQ ID NO: 3548266 - RNA, 19 nt, Pseudomonas putida KT2440
cagugccgccaccuggcug

SEQ ID NO: 3548267 - RNA, 16 nt, Pseudomonas putida KT2440
cagugccgccugguug

SEQ ID NO: 3548268 - RNA, 17 nt, Pseudomonas putida KT2440
cagugccguggcaggca

SEQ ID NO: 3548269 - RNA, 15 nt, Pseudomonas putida KT2440
cagugccugaccggu

SEQ ID NO: 3548270 - RNA, 16 nt, Pseudomonas putida KT2440
cagugccuggaugcgg

SEQ ID NO: 3548271 - RNA, 14 nt, Pseudomonas putida KT2440
cagugccuggguca

SEQ ID NO: 3548272 - RNA, 15 nt, Pseudomonas putida KT2440
cagugccugggucag

SEQ ID NO: 3548273 - RNA, 19 nt, Pseudomonas putida KT2440
cagugccugggucagcucc

SEQ ID NO: 3548274 - RNA, 15 nt, Pseudomonas putida KT2440
cagugcgcagguacg

SEQ ID NO: 3548275 - RNA, 20 nt, Pseudomonas putida KT2440
cagugcgcgcaacagugccc

SEQ ID NO: 3548276 - RNA, 22 nt, Pseudomonas putida KT2440
cagugcggcaaccaccaacagc

SEQ ID NO: 3548277 - RNA, 18 nt, Pseudomonas putida KT2440
cagugcggcggcacugau

SEQ ID NO: 3548278 - RNA, 17 nt, Pseudomonas putida KT2440
cagugcggucaggccaa

SEQ ID NO: 3548279 - RNA, 20 nt, Pseudomonas putida KT2440
cagugcgucggccaccaccg

SEQ ID NO: 3548280 - RNA, 23 nt, Pseudomonas putida KT2440
cagugcugccugcugcagcucga

SEQ ID NO: 3548281 - RNA, 19 nt, Pseudomonas putida KT2440
cagugcugucacccuuggg

SEQ ID NO: 3548282 - RNA, 23 nt, Pseudomonas putida KT2440
cagugcuucacagcguugcagaa

SEQ ID NO: 3548283 - RNA, 16 nt, Pseudomonas putida KT2440
cagugcuucacugccg

SEQ ID NO: 3548284 - RNA, 14 nt, Pseudomonas putida KT2440
cagugcuuccagca

SEQ ID NO: 3548285 - RNA, 17 nt, Pseudomonas putida KT2440
cagugcuuccagcagga

SEQ ID NO: 3548286 - RNA, 22 nt, Pseudomonas putida KT2440
cagugcuuccagcaggacccgg

SEQ ID NO: 3548287 - RNA, 16 nt, Pseudomonas putida KT2440
caguggcaagccgagc

SEQ ID NO: 3548288 - RNA, 19 nt, Pseudomonas putida KT2440
caguggcacaccaugggca

SEQ ID NO: 3548289 - RNA, 23 nt, Pseudomonas putida KT2440
caguggcacccacagcgccugcu

SEQ ID NO: 3548290 - RNA, 15 nt, Pseudomonas putida KT2440
caguggcagguucga

SEQ ID NO: 3548291 - RNA, 15 nt, Pseudomonas putida KT2440
caguggcccgaugau

SEQ ID NO: 3548292 - RNA, 16 nt, Pseudomonas putida KT2440
caguggcuccauggua

SEQ ID NO: 3548293 - RNA, 19 nt, Pseudomonas putida KT2440
caguggcuguaccaggucu

SEQ ID NO: 3548294 - RNA, 15 nt, Pseudomonas putida KT2440
caguggugcucagcg

SEQ ID NO: 3548295 - RNA, 16 nt, Pseudomonas putida KT2440
cagugguguacagcaa

SEQ ID NO: 3548296 - RNA, 17 nt, Pseudomonas putida KT2440
cagugguugugcuggcc

SEQ ID NO: 3548297 - RNA, 18 nt, Pseudomonas putida KT2440
caguguaaauagcugcca

SEQ ID NO: 3548298 - RNA, 20 nt, Pseudomonas putida KT2440
caguguagacaugaggcccu

SEQ ID NO: 3548299 - RNA, 17 nt, Pseudomonas putida KT2440
cagugucagcccaucca

SEQ ID NO: 3548300 - RNA, 22 nt, Pseudomonas putida KT2440
cagugucagcggcgcagcgcug

SEQ ID NO: 3548301 - RNA, 16 nt, Pseudomonas putida KT2440
cagugucccggccagg

SEQ ID NO: 3548302 - RNA, 19 nt, Pseudomonas putida KT2440
cagugucugcaacugccca

SEQ ID NO: 3548303 - RNA, 20 nt, Pseudomonas putida KT2440
cagugucugcaacugcccac

SEQ ID NO: 3548304 - RNA, 16 nt, Pseudomonas putida KT2440
cagugucugcgccugc

SEQ ID NO: 3548305 - RNA, 18 nt, Pseudomonas putida KT2440
caguguggugcggcuggg

SEQ ID NO: 3548306 - RNA, 20 nt, Pseudomonas putida KT2440
caguuacccuguacccgcug

SEQ ID NO: 3548307 - RNA, 13 nt, Pseudomonas putida KT2440
caguucaaagcga

SEQ ID NO: 3548308 - RNA, 17 nt, Pseudomonas putida KT2440
caguucaccauccgcca

SEQ ID NO: 3548309 - RNA, 23 nt, Pseudomonas putida KT2440
caguucacgcaggcgcaggugca

SEQ ID NO: 3548310 - RNA, 17 nt, Pseudomonas putida KT2440
caguucacggaucgcca

SEQ ID NO: 3548311 - RNA, 19 nt, Pseudomonas putida KT2440
caguucacggaucgccagg

SEQ ID NO: 3548312 - RNA, 14 nt, Pseudomonas putida KT2440
caguucagcgcccg

SEQ ID NO: 3548313 - RNA, 17 nt, Pseudomonas putida KT2440
caguucagcgcccgcaa

SEQ ID NO: 3548314 - RNA, 14 nt, Pseudomonas putida KT2440
caguuccaccggca

SEQ ID NO: 3548315 - RNA, 16 nt, Pseudomonas putida KT2440
caguuccaccggcaag

SEQ ID NO: 3548316 - RNA, 15 nt, Pseudomonas putida KT2440
cauagcaggaacacc

SEQ ID NO: 3548317 - RNA, 13 nt, Pseudomonas putida KT2440
cauagcccugcuc

SEQ ID NO: 3548318 - RNA, 14 nt, Pseudomonas putida KT2440
cauagccugcugcu

SEQ ID NO: 3548319 - RNA, 21 nt, Pseudomonas putida KT2440
cauagcgccaucgcucaccgu

SEQ ID NO: 3548320 - RNA, 17 nt, Pseudomonas putida KT2440
cauagcgcucgcgcagg

SEQ ID NO: 3548321 - RNA, 18 nt, Pseudomonas putida KT2440
cauagcgguacagcaccc

SEQ ID NO: 3548322 - RNA, 19 nt, Pseudomonas putida KT2440
cauagcgguacagcaccca

SEQ ID NO: 3548323 - RNA, 18 nt, Pseudomonas putida KT2440
cauagcguugucgacugc

SEQ ID NO: 3548324 - RNA, 13 nt, Pseudomonas putida KT2440
cauagcucagcug

SEQ ID NO: 3548325 - RNA, 14 nt, Pseudomonas putida KT2440
cauagcucagcugg

SEQ ID NO: 3548326 - RNA, 15 nt, Pseudomonas putida KT2440
cauagcuuucaggcg

SEQ ID NO: 3548327 - RNA, 17 nt, Pseudomonas putida KT2440
cauagcuuucaggcgca

SEQ ID NO: 3548328 - RNA, 23 nt, Pseudomonas putida KT2440
cauaggagcggguucacccgcga

SEQ ID NO: 3548329 - RNA, 23 nt, Pseudomonas putida KT2440
cauaggccaagguugccaccagc

SEQ ID NO: 3548330 - RNA, 14 nt, Pseudomonas putida KT2440
cauaggccagcucc

SEQ ID NO: 3548331 - RNA, 15 nt, Pseudomonas putida KT2440
cauaggccagcuccu

SEQ ID NO: 3548332 - RNA, 22 nt, Pseudomonas putida KT2440
cauaggcugucacgaugaugcu

SEQ ID NO: 3548333 - RNA, 22 nt, Pseudomonas putida KT2440
cauaguaaggcuggucgcugcc

SEQ ID NO: 3548334 - RNA, 22 nt, Pseudomonas putida KT2440
cauaguccaggaagcaggcgua

SEQ ID NO: 3548335 - RNA, 21 nt, Pseudomonas putida KT2440
cauagucgauacccaggcgcg

SEQ ID NO: 3548336 - RNA, 13 nt, Pseudomonas putida KT2440
cauaguggguaua

SEQ ID NO: 3548337 - RNA, 17 nt, Pseudomonas putida KT2440
cauaguugaccagcacc

SEQ ID NO: 3548338 - RNA, 21 nt, Pseudomonas putida KT2440
cauauacgcacacgaccuugg

SEQ ID NO: 3548339 - RNA, 15 nt, Pseudomonas putida KT2440
cauaucaggauugcc

SEQ ID NO: 3548340 - RNA, 15 nt, Pseudomonas putida KT2440
cauaucaggcaugcc

SEQ ID NO: 3548341 - RNA, 22 nt, Pseudomonas putida KT2440
cauaucgaaccagcagcaccug

SEQ ID NO: 3548342 - RNA, 16 nt, Pseudomonas putida KT2440
cauaucgcugaucacg

SEQ ID NO: 3548343 - RNA, 19 nt, Pseudomonas putida KT2440
cauaugcagggccuuuuca

SEQ ID NO: 3548344 - RNA, 14 nt, Pseudomonas putida KT2440
cauaugccccaggc

SEQ ID NO: 3548345 - RNA, 23 nt, Pseudomonas putida KT2440
cauauggcgcuuucacuggcgau

SEQ ID NO: 3548346 - RNA, 16 nt, Pseudomonas putida KT2440
caucaaaagccccccu

SEQ ID NO: 3548347 - RNA, 18 nt, Pseudomonas putida KT2440
caucaaagacuccgcuuc

SEQ ID NO: 3548348 - RNA, 19 nt, Pseudomonas putida KT2440
caucaacgaaucauccucg

SEQ ID NO: 3548349 - RNA, 15 nt, Pseudomonas putida KT2440
caucaagucauccgc

SEQ ID NO: 3548350 - RNA, 14 nt, Pseudomonas putida KT2440
caucaauaccggca

SEQ ID NO: 3548351 - RNA, 15 nt, Pseudomonas putida KT2440
caucaauauccagcc

SEQ ID NO: 3548352 - RNA, 20 nt, Pseudomonas putida KT2440
caucaaucgcuccaggcggc

SEQ ID NO: 3548353 - RNA, 15 nt, Pseudomonas putida KT2440
caucaaugcaauguu

SEQ ID NO: 3548354 - RNA, 20 nt, Pseudomonas putida KT2440
caucaaugcaggaucuggcu

SEQ ID NO: 3548355 - RNA, 20 nt, Pseudomonas putida KT2440
caucaauggcugggggcgcu

SEQ ID NO: 3548356 - RNA, 15 nt, Pseudomonas putida KT2440
caucacacucgcccc

SEQ ID NO: 3548357 - RNA, 16 nt, Pseudomonas putida KT2440
caucacacucgccccc

SEQ ID NO: 3548358 - RNA, 21 nt, Pseudomonas putida KT2440
caucaccacaaaaccuuccau

SEQ ID NO: 3548359 - RNA, 21 nt, Pseudomonas putida KT2440
caucaccaccauuugaagcac

SEQ ID NO: 3548360 - RNA, 14 nt, Pseudomonas putida KT2440
caucaccaccccca

SEQ ID NO: 3548361 - RNA, 22 nt, Pseudomonas putida KT2440
caucaccacccccagcgaccag

SEQ ID NO: 3548362 - RNA, 14 nt, Pseudomonas putida KT2440
caucaccagcagcu

SEQ ID NO: 3548363 - RNA, 13 nt, Pseudomonas putida KT2440
caucaccagcccg

SEQ ID NO: 3548364 - RNA, 18 nt, Pseudomonas putida KT2440
caucaccagcccgaagcg

SEQ ID NO: 3548365 - RNA, 12 nt, Pseudomonas putida KT2440
caucaccaggcc

SEQ ID NO: 3548366 - RNA, 13 nt, Pseudomonas putida KT2440
caucaccaggccc

SEQ ID NO: 3548367 - RNA, 14 nt, Pseudomonas putida KT2440
caucaccaggcccg

SEQ ID NO: 3548368 - RNA, 13 nt, Pseudomonas putida KT2440
caucaccauggcu

SEQ ID NO: 3548369 - RNA, 14 nt, Pseudomonas putida KT2440
caucacccgccccu

SEQ ID NO: 3548370 - RNA, 23 nt, Pseudomonas putida KT2440
caucacccgggaacagcagcacc

SEQ ID NO: 3548371 - RNA, 16 nt, Pseudomonas putida KT2440
caucaccgccagcaug

SEQ ID NO: 3548372 - RNA, 17 nt, Pseudomonas putida KT2440
caucaccgcccgcgccg

SEQ ID NO: 3548373 - RNA, 21 nt, Pseudomonas putida KT2440
caucaccggcgaguccugccu

SEQ ID NO: 3548374 - RNA, 22 nt, Pseudomonas putida KT2440
caucaccggcgaguccugccuu

SEQ ID NO: 3548375 - RNA, 14 nt, Pseudomonas putida KT2440
caucaccuuggccg

SEQ ID NO: 3548376 - RNA, 13 nt, Pseudomonas putida KT2440
caucacgaaaucc

SEQ ID NO: 3548377 - RNA, 14 nt, Pseudomonas putida KT2440
caucacgaaauccu

SEQ ID NO: 3548378 - RNA, 13 nt, Pseudomonas putida KT2440
caucacggccugc

SEQ ID NO: 3548379 - RNA, 21 nt, Pseudomonas putida KT2440
caucacggccugcgaugcacg

SEQ ID NO: 3548380 - RNA, 17 nt, Pseudomonas putida KT2440
caucacggcgcaggccg

SEQ ID NO: 3548381 - RNA, 16 nt, Pseudomonas putida KT2440
caucacguuacgccag

SEQ ID NO: 3548382 - RNA, 18 nt, Pseudomonas putida KT2440
caucacguuuggcagugc

SEQ ID NO: 3548383 - RNA, 12 nt, Pseudomonas putida KT2440
caucacuacucc

SEQ ID NO: 3548384 - RNA, 16 nt, Pseudomonas putida KT2440
caucacugccaccgug

SEQ ID NO: 3548385 - RNA, 15 nt, Pseudomonas putida KT2440
caucacuuggcgauc

SEQ ID NO: 3548386 - RNA, 13 nt, Pseudomonas putida KT2440
caucagagcgcca

SEQ ID NO: 3548387 - RNA, 17 nt, Pseudomonas putida KT2440
caucagagcgugaagcg

SEQ ID NO: 3548388 - RNA, 19 nt, Pseudomonas putida KT2440
caucagauggcccgguccc

SEQ ID NO: 3548389 - RNA, 16 nt, Pseudomonas putida KT2440
caucagcaacccggcc

SEQ ID NO: 3548390 - RNA, 16 nt, Pseudomonas putida KT2440
caucagcaagccgccg

SEQ ID NO: 3548391 - RNA, 18 nt, Pseudomonas putida KT2440
caucagcagcuguugcug

SEQ ID NO: 3548392 - RNA, 14 nt, Pseudomonas putida KT2440
caucagccgcgccc

SEQ ID NO: 3548393 - RNA, 16 nt, Pseudomonas putida KT2440
caucagccgcgcccuc

SEQ ID NO: 3548394 - RNA, 14 nt, Pseudomonas putida KT2440
caucagccggcuuc

SEQ ID NO: 3548395 - RNA, 18 nt, Pseudomonas putida KT2440
caucagccggucucccag

SEQ ID NO: 3548396 - RNA, 11 nt, Pseudomonas putida KT2440
caucagccucg

SEQ ID NO: 3548397 - RNA, 15 nt, Pseudomonas putida KT2440
caucagcgccgccaa

SEQ ID NO: 3548398 - RNA, 20 nt, Pseudomonas putida KT2440
caucagcgccgccaauaaca

SEQ ID NO: 3548399 - RNA, 22 nt, Pseudomonas putida KT2440
caucagcgggcgauugccaggg

SEQ ID NO: 3548400 - RNA, 23 nt, Pseudomonas putida KT2440
caucagcgggcgauugccagggu

SEQ ID NO: 3548401 - RNA, 14 nt, Pseudomonas putida KT2440
caucaggaacagcu

SEQ ID NO: 3548402 - RNA, 12 nt, Pseudomonas putida KT2440
caucaggccgau

SEQ ID NO: 3548403 - RNA, 16 nt, Pseudomonas putida KT2440
caucagguagcugggc

SEQ ID NO: 3548404 - RNA, 19 nt, Pseudomonas putida KT2440
caucagguagcugggcccg

SEQ ID NO: 3548405 - RNA, 13 nt, Pseudomonas putida KT2440
caucaggucugcc

SEQ ID NO: 3548406 - RNA, 17 nt, Pseudomonas putida KT2440
caucaggucugccagug

SEQ ID NO: 3548407 - RNA, 18 nt, Pseudomonas putida KT2440
caucaggugcagcaacag

SEQ ID NO: 3548408 - RNA, 14 nt, Pseudomonas putida KT2440
caucagugcccccg

SEQ ID NO: 3548409 - RNA, 13 nt, Pseudomonas putida KT2440
caucaucaaagac

SEQ ID NO: 3548410 - RNA, 13 nt, Pseudomonas putida KT2440
caucaucacgcgc

SEQ ID NO: 3548411 - RNA, 16 nt, Pseudomonas putida KT2440
caucaucagcaggcag

SEQ ID NO: 3548412 - RNA, 17 nt, Pseudomonas putida KT2440
caucaucagcaggcagu

SEQ ID NO: 3548413 - RNA, 12 nt, Pseudomonas putida KT2440
caucaucaucuu

SEQ ID NO: 3548414 - RNA, 18 nt, Pseudomonas putida KT2440
caucauccaccacccugg

SEQ ID NO: 3548415 - RNA, 19 nt, Pseudomonas putida KT2440
caucauccaccacccuggc

SEQ ID NO: 3548416 - RNA, 22 nt, Pseudomonas putida KT2440
caucauccgagcugagcagcgg

SEQ ID NO: 3548417 - RNA, 14 nt, Pseudomonas putida KT2440
caucauccugcugg

SEQ ID NO: 3548418 - RNA, 16 nt, Pseudomonas putida KT2440
caucauccugcuggcc

SEQ ID NO: 3548419 - RNA, 14 nt, Pseudomonas putida KT2440
caucaucucgcgau

SEQ ID NO: 3548420 - RNA, 14 nt, Pseudomonas putida KT2440
caucaucugcugau

SEQ ID NO: 3548421 - RNA, 23 nt, Pseudomonas putida KT2440
caucaugccgcccaugccaccca

SEQ ID NO: 3548422 - RNA, 21 nt, Pseudomonas putida KT2440
caucgauggucuucgccgcca

SEQ ID NO: 3548423 - RNA, 15 nt, Pseudomonas putida KT2440
caucgauguacaccc

SEQ ID NO: 3548424 - RNA, 20 nt, Pseudomonas putida KT2440
caucgauguacaccccgacc

SEQ ID NO: 3548425 - RNA, 14 nt, Pseudomonas putida KT2440
caucgcacacccug

SEQ ID NO: 3548426 - RNA, 18 nt, Pseudomonas putida KT2440
caucgcagggucgcgccc

SEQ ID NO: 3548427 - RNA, 17 nt, Pseudomonas putida KT2440
caucgcauacagcgcac

SEQ ID NO: 3548428 - RNA, 17 nt, Pseudomonas putida KT2440
caucgcauaugccccag

SEQ ID NO: 3548429 - RNA, 19 nt, Pseudomonas putida KT2440
caucgcauaugccccaggc

SEQ ID NO: 3548430 - RNA, 19 nt, Pseudomonas putida KT2440
caucgccaacagaggccuc

SEQ ID NO: 3548431 - RNA, 14 nt, Pseudomonas putida KT2440
caucgccaagccgc

SEQ ID NO: 3548432 - RNA, 16 nt, Pseudomonas putida KT2440
caucgccaagccgcca

SEQ ID NO: 3548433 - RNA, 17 nt, Pseudomonas putida KT2440
caucgccaagccgccau

SEQ ID NO: 3548434 - RNA, 18 nt, Pseudomonas putida KT2440
caucgccacgggcgugac

SEQ ID NO: 3548435 - RNA, 16 nt, Pseudomonas putida KT2440
caucgccaggugcuca

SEQ ID NO: 3548436 - RNA, 17 nt, Pseudomonas putida KT2440
caucgcccccgcugcac

SEQ ID NO: 3548437 - RNA, 23 nt, Pseudomonas putida KT2440
caucgcccucgagugcgcugauc

SEQ ID NO: 3548438 - RNA, 14 nt, Pseudomonas putida KT2440
caucgccgggucca

SEQ ID NO: 3548439 - RNA, 16 nt, Pseudomonas putida KT2440
caucgccgucaucacc

SEQ ID NO: 3548440 - RNA, 21 nt, Pseudomonas putida KT2440
caucgccgucuugaguuucau

SEQ ID NO: 3548441 - RNA, 16 nt, Pseudomonas putida KT2440
caucgccuccagcgca

SEQ ID NO: 3548442 - RNA, 17 nt, Pseudomonas putida KT2440
caucgcgcacuugccag

SEQ ID NO: 3548443 - RNA, 15 nt, Pseudomonas putida KT2440
caucgcgccgaccag

SEQ ID NO: 3548444 - RNA, 17 nt, Pseudomonas putida KT2440
caucgcgggccaggugg

SEQ ID NO: 3548445 - RNA, 23 nt, Pseudomonas putida KT2440
caucgcgguauccaucaccauca

SEQ ID NO: 3548446 - RNA, 18 nt, Pseudomonas putida KT2440
caucgcucaccguucuuc

SEQ ID NO: 3548447 - RNA, 12 nt, Pseudomonas putida KT2440
caucgcugacuu

SEQ ID NO: 3548448 - RNA, 15 nt, Pseudomonas putida KT2440
caucgcugacuucca

SEQ ID NO: 3548449 - RNA, 18 nt, Pseudomonas putida KT2440
caucgcugacuuccagca

SEQ ID NO: 3548450 - RNA, 20 nt, Pseudomonas putida KT2440
caucgcugacuuccagcagc

SEQ ID NO: 3548451 - RNA, 23 nt, Pseudomonas putida KT2440
caucgcugacuuccagcagcaca

SEQ ID NO: 3548452 - RNA, 13 nt, Pseudomonas putida KT2440
caucgcuguccuu

SEQ ID NO: 3548453 - RNA, 20 nt, Pseudomonas putida KT2440
caucgcuguccuuggccaac

SEQ ID NO: 3548454 - RNA, 22 nt, Pseudomonas putida KT2440
caucgcuguccuuggccaacug

SEQ ID NO: 3548455 - RNA, 20 nt, Pseudomonas putida KT2440
caucgcuucugcacucccgc

SEQ ID NO: 3548456 - RNA, 18 nt, Pseudomonas putida KT2440
caucggauaucugcgcca

SEQ ID NO: 3548457 - RNA, 21 nt, Pseudomonas putida KT2440
caucggauaucugcgccaccg

SEQ ID NO: 3548458 - RNA, 12 nt, Pseudomonas putida KT2440
caucggcaaaca

SEQ ID NO: 3548459 - RNA, 21 nt, Pseudomonas putida KT2440
caucggcaaucgccgggcgca

SEQ ID NO: 3548460 - RNA, 17 nt, Pseudomonas putida KT2440
caucggcaccgacggcg

SEQ ID NO: 3548461 - RNA, 17 nt, Pseudomonas putida KT2440
caucggcacgcccagca

SEQ ID NO: 3548462 - RNA, 22 nt, Pseudomonas putida KT2440
caucggcaggucauuggcgcca

SEQ ID NO: 3548463 - RNA, 21 nt, Pseudomonas putida KT2440
caucggcaguagagcccccag

SEQ ID NO: 3548464 - RNA, 17 nt, Pseudomonas putida KT2440
caucggcaugcagcggc

SEQ ID NO: 3548465 - RNA, 15 nt, Pseudomonas putida KT2440
caucggcauugcuga

SEQ ID NO: 3548466 - RNA, 17 nt, Pseudomonas putida KT2440
caucggccgagccgguc

SEQ ID NO: 3548467 - RNA, 17 nt, Pseudomonas putida KT2440
caucggccggcucgaac

SEQ ID NO: 3548468 - RNA, 12 nt, Pseudomonas putida KT2440
caucggccucuc

SEQ ID NO: 3548469 - RNA, 14 nt, Pseudomonas putida KT2440
caucggccucucuc

SEQ ID NO: 3548470 - RNA, 21 nt, Pseudomonas putida KT2440
caucggcgccuucgcccgacc

SEQ ID NO: 3548471 - RNA, 14 nt, Pseudomonas putida KT2440
caucggcgcgaagg

SEQ ID NO: 3548472 - RNA, 15 nt, Pseudomonas putida KT2440
caucggcgcgacagc

SEQ ID NO: 3548473 - RNA, 17 nt, Pseudomonas putida KT2440
caucggcuccagcgcac

SEQ ID NO: 3548474 - RNA, 14 nt, Pseudomonas putida KT2440
caucgggaucagca

SEQ ID NO: 3548475 - RNA, 18 nt, Pseudomonas putida KT2440
caucggucggccccucga

SEQ ID NO: 3548476 - RNA, 21 nt, Pseudomonas putida KT2440
caucggucggccccucgacca

SEQ ID NO: 3548477 - RNA, 18 nt, Pseudomonas putida KT2440
caucggugcuuucugcug

SEQ ID NO: 3548478 - RNA, 19 nt, Pseudomonas putida KT2440
caucggugcuuucugcugu

SEQ ID NO: 3548479 - RNA, 24 nt, Pseudomonas putida KT2440
caucgguuucgccgguguucuuca

SEQ ID NO: 3548480 - RNA, 22 nt, Pseudomonas putida KT2440
caucgguuuuuccaugcgcgca

SEQ ID NO: 3548481 - RNA, 20 nt, Pseudomonas putida KT2440
caucguaauggccuacgcac

SEQ ID NO: 3548482 - RNA, 18 nt, Pseudomonas putida KT2440
caucguccuugcagggca

SEQ ID NO: 3548483 - RNA, 21 nt, Pseudomonas putida KT2440
caucguccuugcagggcacca

SEQ ID NO: 3548484 - RNA, 22 nt, Pseudomonas putida KT2440
caucgugaagcaccgccacaau

SEQ ID NO: 3548485 - RNA, 17 nt, Pseudomonas putida KT2440
caucguuauccagcacc

SEQ ID NO: 3548486 - RNA, 20 nt, Pseudomonas putida KT2440
caucuaccugauguccaaau

SEQ ID NO: 3548487 - RNA, 12 nt, Pseudomonas putida KT2440
caucuccaaugc

SEQ ID NO: 3548488 - RNA, 19 nt, Pseudomonas putida KT2440
caucuccagcucgccgccc

SEQ ID NO: 3548489 - RNA, 20 nt, Pseudomonas putida KT2440
caucuccagcucgccgccca

SEQ ID NO: 3548490 - RNA, 21 nt, Pseudomonas putida KT2440
caucuccagcucgccgcccag

SEQ ID NO: 3548491 - RNA, 15 nt, Pseudomonas putida KT2440
caucuccauagguua

SEQ ID NO: 3548492 - RNA, 19 nt, Pseudomonas putida KT2440
caucuccauagguuaucca

SEQ ID NO: 3548493 - RNA, 20 nt, Pseudomonas putida KT2440
caucuccauagguuauccac

SEQ ID NO: 3548494 - RNA, 20 nt, Pseudomonas putida KT2440
caucucgaucaugucgccgu

SEQ ID NO: 3548495 - RNA, 18 nt, Pseudomonas putida KT2440
caucucgcaaacggucaa

SEQ ID NO: 3548496 - RNA, 15 nt, Pseudomonas putida KT2440
caucucgcgaugcuu

SEQ ID NO: 3548497 - RNA, 14 nt, Pseudomonas putida KT2440
caucucggucgaca

SEQ ID NO: 3548498 - RNA, 19 nt, Pseudomonas putida KT2440
caucucuuugagaugcccu

SEQ ID NO: 3548499 - RNA, 22 nt, Pseudomonas putida KT2440
caucugccgggucggccugcuc

SEQ ID NO: 3548500 - RNA, 16 nt, Pseudomonas putida KT2440
caucugcgccugugca

SEQ ID NO: 3548501 - RNA, 15 nt, Pseudomonas putida KT2440
caucugcucccccag

SEQ ID NO: 3548502 - RNA, 19 nt, Pseudomonas putida KT2440
caucugcucgccaucuggc

SEQ ID NO: 3548503 - RNA, 18 nt, Pseudomonas putida KT2440
caucugcucggcguacuc

SEQ ID NO: 3548504 - RNA, 15 nt, Pseudomonas putida KT2440
caucugcugcggcag

SEQ ID NO: 3548505 - RNA, 16 nt, Pseudomonas putida KT2440
caucugucagcgccag

SEQ ID NO: 3548506 - RNA, 18 nt, Pseudomonas putida KT2440
caucuuccagccugcagc

SEQ ID NO: 3548507 - RNA, 23 nt, Pseudomonas putida KT2440
caucuuccagccugcagcacccu

SEQ ID NO: 3548508 - RNA, 15 nt, Pseudomonas putida KT2440
caucuuccggcaccc

SEQ ID NO: 3548509 - RNA, 14 nt, Pseudomonas putida KT2440
caucuuccugccac

SEQ ID NO: 3548510 - RNA, 18 nt, Pseudomonas putida KT2440
caucuuccugccacucgu

SEQ ID NO: 3548511 - RNA, 21 nt, Pseudomonas putida KT2440
caucuucgacaguucaagcac

SEQ ID NO: 3548512 - RNA, 17 nt, Pseudomonas putida KT2440
caucuucgaggucaucg

SEQ ID NO: 3548513 - RNA, 13 nt, Pseudomonas putida KT2440
caucuucgcgcuc

SEQ ID NO: 3548514 - RNA, 16 nt, Pseudomonas putida KT2440
caucuucugcagccac

SEQ ID NO: 3548515 - RNA, 19 nt, Pseudomonas putida KT2440
caucuucugcagccaccac

SEQ ID NO: 3548516 - RNA, 16 nt, Pseudomonas putida KT2440
caucuucuugcaguuc

SEQ ID NO: 3548517 - RNA, 14 nt, Pseudomonas putida KT2440
caucuugcugcucu

SEQ ID NO: 3548518 - RNA, 14 nt, Pseudomonas putida KT2440
caugaacagcacgc

SEQ ID NO: 3548519 - RNA, 16 nt, Pseudomonas putida KT2440
caugaacagcacgccc

SEQ ID NO: 3548520 - RNA, 24 nt, Pseudomonas putida KT2440
caugaacagcgcccagaucagcag

SEQ ID NO: 3548521 - RNA, 19 nt, Pseudomonas putida KT2440
caugaacgaggacugcacc

SEQ ID NO: 3548522 - RNA, 12 nt, Pseudomonas putida KT2440
caugaagccaug

SEQ ID NO: 3548523 - RNA, 13 nt, Pseudomonas putida KT2440
caugaagccaugg

SEQ ID NO: 3548524 - RNA, 18 nt, Pseudomonas putida KT2440
caugaagccaugggcaga

SEQ ID NO: 3548525 - RNA, 19 nt, Pseudomonas putida KT2440
caugaagccaugggcagag

SEQ ID NO: 3548526 - RNA, 15 nt, Pseudomonas putida KT2440
caugaaggcccagcu

SEQ ID NO: 3548527 - RNA, 16 nt, Pseudomonas putida KT2440
caugcugcagaaccgc

SEQ ID NO: 3548528 - RNA, 17 nt, Pseudomonas putida KT2440
caugcugccaggcaaag

SEQ ID NO: 3548529 - RNA, 18 nt, Pseudomonas putida KT2440
caugcugccaggcaaagu

SEQ ID NO: 3548530 - RNA, 17 nt, Pseudomonas putida KT2440
caugcugcgccccaggu

SEQ ID NO: 3548531 - RNA, 15 nt, Pseudomonas putida KT2440
caugcugcugcagca

SEQ ID NO: 3548532 - RNA, 18 nt, Pseudomonas putida KT2440
caugcuggccaaggucuc

SEQ ID NO: 3548533 - RNA, 19 nt, Pseudomonas putida KT2440
caugcuggccaggaugcca

SEQ ID NO: 3548534 - RNA, 16 nt, Pseudomonas putida KT2440
caugcugucgaugucu

SEQ ID NO: 3548535 - RNA, 11 nt, Pseudomonas putida KT2440
caugcugugcc

SEQ ID NO: 3548536 - RNA, 15 nt, Pseudomonas putida KT2440
cauggaucagcucau

SEQ ID NO: 3548537 - RNA, 17 nt, Pseudomonas putida KT2440
cauggcaaacagcacca

SEQ ID NO: 3548538 - RNA, 22 nt, Pseudomonas putida KT2440
cauggcaaucgggccggcguug

SEQ ID NO: 3548539 - RNA, 20 nt, Pseudomonas putida KT2440
cauggcauucgccacuugcu

SEQ ID NO: 3548540 - RNA, 21 nt, Pseudomonas putida KT2440
cauggcauucgccacuugcug

SEQ ID NO: 3548541 - RNA, 22 nt, Pseudomonas putida KT2440
cauggccacggugucggacagg

SEQ ID NO: 3548542 - RNA, 13 nt, Pseudomonas putida KT2440
cauggccagccgg

SEQ ID NO: 3548543 - RNA, 15 nt, Pseudomonas putida KT2440
cauggccaguuccug

SEQ ID NO: 3548544 - RNA, 18 nt, Pseudomonas putida KT2440
cauggccaguuccuggca

SEQ ID NO: 3548545 - RNA, 20 nt, Pseudomonas putida KT2440
cauggcccaugaucgcggca

SEQ ID NO: 3548546 - RNA, 21 nt, Pseudomonas putida KT2440
cauggccgaaaccagccccuu

SEQ ID NO: 3548547 - RNA, 22 nt, Pseudomonas putida KT2440
cauggccgaagcggucguugau

SEQ ID NO: 3548548 - RNA, 21 nt, Pseudomonas putida KT2440
cauggccgagccaagaggcag

SEQ ID NO: 3548549 - RNA, 21 nt, Pseudomonas putida KT2440
cauggccgccaaggcgaugcu

SEQ ID NO: 3548550 - RNA, 22 nt, Pseudomonas putida KT2440
cauggccgccacaugcugcgcc

SEQ ID NO: 3548551 - RNA, 16 nt, Pseudomonas putida KT2440
cauggccguucuugau

SEQ ID NO: 3548552 - RNA, 20 nt, Pseudomonas putida KT2440
cauggcgacaauggcgcgga

SEQ ID NO: 3548553 - RNA, 17 nt, Pseudomonas putida KT2440
cauggcgaucucuuccc

SEQ ID NO: 3548554 - RNA, 15 nt, Pseudomonas putida KT2440
cauggcgcgccaugc

SEQ ID NO: 3548555 - RNA, 16 nt, Pseudomonas putida KT2440
cauggcgcgccaugcc

SEQ ID NO: 3548556 - RNA, 15 nt, Pseudomonas putida KT2440
cauggcgcugaccgg

SEQ ID NO: 3548557 - RNA, 21 nt, Pseudomonas putida KT2440
cauggcgguauucacaccugc

SEQ ID NO: 3548558 - RNA, 17 nt, Pseudomonas putida KT2440
cauggcgugcccggcaa

SEQ ID NO: 3548559 - RNA, 17 nt, Pseudomonas putida KT2440
cauggcguuguccagca

SEQ ID NO: 3548560 - RNA, 16 nt, Pseudomonas putida KT2440
cauggcuaagccaagc

SEQ ID NO: 3548561 - RNA, 21 nt, Pseudomonas putida KT2440
cauggcuaagccaagccggcu

SEQ ID NO: 3548562 - RNA, 17 nt, Pseudomonas putida KT2440
cauggcucaacuggcag

SEQ ID NO: 3548563 - RNA, 19 nt, Pseudomonas putida KT2440
cauggcucaacuggcaggg

SEQ ID NO: 3548564 - RNA, 20 nt, Pseudomonas putida KT2440
cauggcucaacuggcagggu

SEQ ID NO: 3548565 - RNA, 22 nt, Pseudomonas putida KT2440
cauggcucaacuggcaggguuc

SEQ ID NO: 3548566 - RNA, 19 nt, Pseudomonas putida KT2440
cauggcuugcguuucuuca

SEQ ID NO: 3548567 - RNA, 22 nt, Pseudomonas putida KT2440
cauggcuugcguuucuucaucc

SEQ ID NO: 3548568 - RNA, 19 nt, Pseudomonas putida KT2440
caugggcaggcccagguaa

SEQ ID NO: 3548569 - RNA, 20 nt, Pseudomonas putida KT2440
cauggggucaguucagccag

SEQ ID NO: 3548570 - RNA, 23 nt, Pseudomonas putida KT2440
cauggguuguggcuuggcccagu

SEQ ID NO: 3548571 - RNA, 23 nt, Pseudomonas putida KT2440
cauggucgcguuguucagcagcg

SEQ ID NO: 3548572 - RNA, 17 nt, Pseudomonas putida KT2440
cauggucguguugagca

SEQ ID NO: 3548573 - RNA, 20 nt, Pseudomonas putida KT2440
cauggugcagggcguugccg

SEQ ID NO: 3548574 - RNA, 13 nt, Pseudomonas putida KT2440
caugguggauggu

SEQ ID NO: 3548575 - RNA, 16 nt, Pseudomonas putida KT2440
caugguggauggucag

SEQ ID NO: 3548576 - RNA, 17 nt, Pseudomonas putida KT2440
cauggugggucguguag

SEQ ID NO: 3548577 - RNA, 14 nt, Pseudomonas putida KT2440
caugguguccggca

SEQ ID NO: 3548578 - RNA, 19 nt, Pseudomonas putida KT2440
cauguacgucaaguaggca

SEQ ID NO: 3548579 - RNA, 16 nt, Pseudomonas putida KT2440
cauguacucuucgacg

SEQ ID NO: 3548580 - RNA, 20 nt, Pseudomonas putida KT2440
cauguacucuucgacggucg

SEQ ID NO: 3548581 - RNA, 23 nt, Pseudomonas putida KT2440
cauguagaacguggugcgggcca

SEQ ID NO: 3548582 - RNA, 15 nt, Pseudomonas putida KT2440
cauguagaccaccag

SEQ ID NO: 3548583 - RNA, 16 nt, Pseudomonas putida KT2440
cauguagaccaccagc

SEQ ID NO: 3548584 - RNA, 17 nt, Pseudomonas putida KT2440
cauguagaccaccagcg

SEQ ID NO: 3548585 - RNA, 23 nt, Pseudomonas putida KT2440
cauguagccaaucaucuugccau

SEQ ID NO: 3548586 - RNA, 15 nt, Pseudomonas putida KT2440
cauguagcgccuggc

SEQ ID NO: 3548587 - RNA, 22 nt, Pseudomonas putida KT2440
cauguagcgccuggccugcaga

SEQ ID NO: 3548588 - RNA, 21 nt, Pseudomonas putida KT2440
cauguaggagauucuauggcc

SEQ ID NO: 3548589 - RNA, 15 nt, Pseudomonas putida KT2440
cauguccagucaggc

SEQ ID NO: 3548590 - RNA, 16 nt, Pseudomonas putida KT2440
cauguccauggcaauc

SEQ ID NO: 3548591 - RNA, 14 nt, Pseudomonas putida KT2440
caugucccaguuca

SEQ ID NO: 3548592 - RNA, 24 nt, Pseudomonas putida KT2440
caugucccggguuucggugcgcug

SEQ ID NO: 3548593 - RNA, 22 nt, Pseudomonas putida KT2440
cauguccggggucaucaggacg

SEQ ID NO: 3548594 - RNA, 16 nt, Pseudomonas putida KT2440
cauguccuugcugcgc

SEQ ID NO: 3548595 - RNA, 14 nt, Pseudomonas putida KT2440
caugucgaucagcg

SEQ ID NO: 3548596 - RNA, 16 nt, Pseudomonas putida KT2440
caugucgaugcggugc

SEQ ID NO: 3548597 - RNA, 15 nt, Pseudomonas putida KT2440
caugucgcuuugggg

SEQ ID NO: 3548598 - RNA, 17 nt, Pseudomonas putida KT2440
caugucggaagccugca

SEQ ID NO: 3548599 - RNA, 16 nt, Pseudomonas putida KT2440
caugucggcagccagg

SEQ ID NO: 3548600 - RNA, 20 nt, Pseudomonas putida KT2440
caugucggcagucuugcuga

SEQ ID NO: 3548601 - RNA, 13 nt, Pseudomonas putida KT2440
caugucuucacga

SEQ ID NO: 3548602 - RNA, 20 nt, Pseudomonas putida KT2440
caugugcacuggcaggccuu

SEQ ID NO: 3548603 - RNA, 12 nt, Pseudomonas putida KT2440
caugugccaggu

SEQ ID NO: 3548604 - RNA, 20 nt, Pseudomonas putida KT2440
caugugccuggcccggcccg

SEQ ID NO: 3548605 - RNA, 16 nt, Pseudomonas putida KT2440
caugugcgccacuucc

SEQ ID NO: 3548606 - RNA, 23 nt, Pseudomonas putida KT2440
cauguucaacgcaaugggcacaa

SEQ ID NO: 3548607 - RNA, 14 nt, Pseudomonas putida KT2440
cauguucagcuugu

SEQ ID NO: 3548608 - RNA, 14 nt, Pseudomonas putida KT2440
cauguucaggucgu

SEQ ID NO: 3548609 - RNA, 17 nt, Pseudomonas putida KT2440
cauguucaggucgugau

SEQ ID NO: 3548610 - RNA, 22 nt, Pseudomonas putida KT2440
cauguucaucaccggccagcac

SEQ ID NO: 3548611 - RNA, 21 nt, Pseudomonas putida KT2440
cauguugcgcagcaauccgcu

SEQ ID NO: 3548612 - RNA, 14 nt, Pseudomonas putida KT2440
cauguugcgcucgu

SEQ ID NO: 3548613 - RNA, 19 nt, Pseudomonas putida KT2440
cauguuggaaaugaacagc

SEQ ID NO: 3548614 - RNA, 18 nt, Pseudomonas putida KT2440
cauguugucacccagcac

SEQ ID NO: 3548615 - RNA, 13 nt, Pseudomonas putida KT2440
cauuaccagcacc

SEQ ID NO: 3548616 - RNA, 15 nt, Pseudomonas putida KT2440
cauuaccauccauca

SEQ ID NO: 3548617 - RNA, 18 nt, Pseudomonas putida KT2440
cauuaccauccaucacca

SEQ ID NO: 3548618 - RNA, 17 nt, Pseudomonas putida KT2440
cauuaccugcaggcgcg

SEQ ID NO: 3548619 - RNA, 16 nt, Pseudomonas putida KT2440
cauuacgcggcagcag

SEQ ID NO: 3548620 - RNA, 17 nt, Pseudomonas putida KT2440
cauuacgcggcagcagc

SEQ ID NO: 3548621 - RNA, 18 nt, Pseudomonas putida KT2440
cauuacgcggcagcagca

SEQ ID NO: 3548622 - RNA, 15 nt, Pseudomonas putida KT2440
cauuagaaaauggcu

SEQ ID NO: 3548623 - RNA, 20 nt, Pseudomonas putida KT2440
cauuagcagguaaacccgcg

SEQ ID NO: 3548624 - RNA, 19 nt, Pseudomonas putida KT2440
cauuauccaccaggccgau

SEQ ID NO: 3548625 - RNA, 21 nt, Pseudomonas putida KT2440
cauuauccaccaggccgauca

SEQ ID NO: 3548626 - RNA, 15 nt, Pseudomonas putida KT2440
cauucaaagccugcu

SEQ ID NO: 3548627 - RNA, 21 nt, Pseudomonas putida KT2440
cauucaaagccugcuccagca

SEQ ID NO: 3548628 - RNA, 19 nt, Pseudomonas putida KT2440
cauucaccagccaggcaca

SEQ ID NO: 3548629 - RNA, 20 nt, Pseudomonas putida KT2440
cauucacggcgucgagcagg

SEQ ID NO: 3548630 - RNA, 17 nt, Pseudomonas putida KT2440
cauucagcagcgccugg

SEQ ID NO: 3548631 - RNA, 19 nt, Pseudomonas putida KT2440
cauucagcuuuggcuauca

SEQ ID NO: 3548632 - RNA, 19 nt, Pseudomonas putida KT2440
ccaaugcugccuuuuccug

SEQ ID NO: 3548633 - RNA, 21 nt, Pseudomonas putida KT2440
ccaauggacgcgcaagccgcu

SEQ ID NO: 3548634 - RNA, 14 nt, Pseudomonas putida KT2440
ccaauggcaaucgc

SEQ ID NO: 3548635 - RNA, 20 nt, Pseudomonas putida KT2440
ccaauggcaaucgccuggcg

SEQ ID NO: 3548636 - RNA, 19 nt, Pseudomonas putida KT2440
ccaauggcgaaccccaguu

SEQ ID NO: 3548637 - RNA, 23 nt, Pseudomonas putida KT2440
ccaaugggcaccggccaccaggc

SEQ ID NO: 3548638 - RNA, 22 nt, Pseudomonas putida KT2440
ccaaugucgacguacagcagcu

SEQ ID NO: 3548639 - RNA, 14 nt, Pseudomonas putida KT2440
ccaauuacuuggcc

SEQ ID NO: 3548640 - RNA, 15 nt, Pseudomonas putida KT2440
ccaauuggucguagg

SEQ ID NO: 3548641 - RNA, 18 nt, Pseudomonas putida KT2440
ccaauugguuaaaagcca

SEQ ID NO: 3548642 - RNA, 21 nt, Pseudomonas putida KT2440
ccaauuugcggccauugaggu

SEQ ID NO: 3548643 - RNA, 18 nt, Pseudomonas putida KT2440
ccaauuuggccagcuucu

SEQ ID NO: 3548644 - RNA, 21 nt, Pseudomonas putida KT2440
ccacaaaaaagcagggccgcg

SEQ ID NO: 3548645 - RNA, 16 nt, Pseudomonas putida KT2440
ccacaaaaccuuccau

SEQ ID NO: 3548646 - RNA, 20 nt, Pseudomonas putida KT2440
ccacaacccuugcagcgccu

SEQ ID NO: 3548647 - RNA, 21 nt, Pseudomonas putida KT2440
ccacaacccuugcagcgccug

SEQ ID NO: 3548648 - RNA, 16 nt, Pseudomonas putida KT2440
ccacaauaagaugcgg

SEQ ID NO: 3548649 - RNA, 13 nt, Pseudomonas putida KT2440
ccacaauggcgca

SEQ ID NO: 3548650 - RNA, 19 nt, Pseudomonas putida KT2440
ccacaauggcgcacagggc

SEQ ID NO: 3548651 - RNA, 16 nt, Pseudomonas putida KT2440
ccacacaccccagaac

SEQ ID NO: 3548652 - RNA, 15 nt, Pseudomonas putida KT2440
ccacacacccgggcc

SEQ ID NO: 3548653 - RNA, 18 nt, Pseudomonas putida KT2440
ccacacaccgcaacccag

SEQ ID NO: 3548654 - RNA, 19 nt, Pseudomonas putida KT2440
ccacacaccgcaacccagc

SEQ ID NO: 3548655 - RNA, 12 nt, Pseudomonas putida KT2440
ccacaccagcgg

SEQ ID NO: 3548656 - RNA, 15 nt, Pseudomonas putida KT2440
ccacaccagcggcgc

SEQ ID NO: 3548657 - RNA, 13 nt, Pseudomonas putida KT2440
ccacacccgcuac

SEQ ID NO: 3548658 - RNA, 18 nt, Pseudomonas putida KT2440
ccacacccggcuugaccg

SEQ ID NO: 3548659 - RNA, 21 nt, Pseudomonas putida KT2440
ccacacccucguccccgcgcu

SEQ ID NO: 3548660 - RNA, 22 nt, Pseudomonas putida KT2440
ccacaccgaagcuugcagucac

SEQ ID NO: 3548661 - RNA, 18 nt, Pseudomonas putida KT2440
ccacaccguacugcuuca

SEQ ID NO: 3548662 - RNA, 11 nt, Pseudomonas putida KT2440
ccacaccucga

SEQ ID NO: 3548663 - RNA, 17 nt, Pseudomonas putida KT2440
ccacacgcccgcgugag

SEQ ID NO: 3548664 - RNA, 15 nt, Pseudomonas putida KT2440
ccacacgcugcugcg

SEQ ID NO: 3548665 - RNA, 15 nt, Pseudomonas putida KT2440
ccacacggcaagcca

SEQ ID NO: 3548666 - RNA, 12 nt, Pseudomonas putida KT2440
ccacacggcagc

SEQ ID NO: 3548667 - RNA, 14 nt, Pseudomonas putida KT2440
ccacacggcagccc

SEQ ID NO: 3548668 - RNA, 22 nt, Pseudomonas putida KT2440
ccacacguuguccgacagcuug

SEQ ID NO: 3548669 - RNA, 18 nt, Pseudomonas putida KT2440
ccacacugcucagugcug

SEQ ID NO: 3548670 - RNA, 22 nt, Pseudomonas putida KT2440
ccacacugcucagugcuggcgu

SEQ ID NO: 3548671 - RNA, 22 nt, Pseudomonas putida KT2440
ccacacugcucgucaaaccggc

SEQ ID NO: 3548672 - RNA, 19 nt, Pseudomonas putida KT2440
ccacagccaugccggcaac

SEQ ID NO: 3548673 - RNA, 22 nt, Pseudomonas putida KT2440
ccacagccgagggcaugggcca

SEQ ID NO: 3548674 - RNA, 13 nt, Pseudomonas putida KT2440
ccacagccuccag

SEQ ID NO: 3548675 - RNA, 14 nt, Pseudomonas putida KT2440
ccacagcgccugcu

SEQ ID NO: 3548676 - RNA, 15 nt, Pseudomonas putida KT2440
ccacagcgccugcug

SEQ ID NO: 3548677 - RNA, 16 nt, Pseudomonas putida KT2440
ccacagcgccugcugc

SEQ ID NO: 3548678 - RNA, 18 nt, Pseudomonas putida KT2440
ccacagcggccacagcgc

SEQ ID NO: 3548679 - RNA, 22 nt, Pseudomonas putida KT2440
ccacagcggccacagcgccaac

SEQ ID NO: 3548680 - RNA, 14 nt, Pseudomonas putida KT2440
ccacagcgggucga

SEQ ID NO: 3548681 - RNA, 16 nt, Pseudomonas putida KT2440
ccacagcugcacaucu

SEQ ID NO: 3548682 - RNA, 18 nt, Pseudomonas putida KT2440
ccacagcugcgccagccg

SEQ ID NO: 3548683 - RNA, 21 nt, Pseudomonas putida KT2440
ccacagcugcugcagggccca

SEQ ID NO: 3548684 - RNA, 14 nt, Pseudomonas putida KT2440
ccacaggaaucacc

SEQ ID NO: 3548685 - RNA, 21 nt, Pseudomonas putida KT2440
ccacaggaaugucaccgcggc

SEQ ID NO: 3548686 - RNA, 23 nt, Pseudomonas putida KT2440
ccacaggaauuacgcaggcucca

SEQ ID NO: 3548687 - RNA, 13 nt, Pseudomonas putida KT2440
ccacaggcacagg

SEQ ID NO: 3548688 - RNA, 14 nt, Pseudomonas putida KT2440
ccacaggcacaggc

SEQ ID NO: 3548689 - RNA, 20 nt, Pseudomonas putida KT2440
ccacaggcacaggcccagca

SEQ ID NO: 3548690 - RNA, 21 nt, Pseudomonas putida KT2440
ccacaggcacaggcccagcaa

SEQ ID NO: 3548691 - RNA, 23 nt, Pseudomonas putida KT2440
ccacaggcacaggcccagcaaca

SEQ ID NO: 3548692 - RNA, 17 nt, Pseudomonas putida KT2440
ccacagggaccgcaucu

SEQ ID NO: 3548693 - RNA, 18 nt, Pseudomonas putida KT2440
ccacagggaccucacagc

SEQ ID NO: 3548694 - RNA, 15 nt, Pseudomonas putida KT2440
ccacagggaggauug

SEQ ID NO: 3548695 - RNA, 11 nt, Pseudomonas putida KT2440
ccacagggcaa

SEQ ID NO: 3548696 - RNA, 22 nt, Pseudomonas putida KT2440
ccacagggcaaacaccuugccc

SEQ ID NO: 3548697 - RNA, 17 nt, Pseudomonas putida KT2440
ccacagguaauacgcug

SEQ ID NO: 3548698 - RNA, 16 nt, Pseudomonas putida KT2440
ccacagguaccaggcu

SEQ ID NO: 3548699 - RNA, 17 nt, Pseudomonas putida KT2440
ccacagguacucgcaag

SEQ ID NO: 3548700 - RNA, 14 nt, Pseudomonas putida KT2440
ccacagguccagcg

SEQ ID NO: 3548701 - RNA, 15 nt, Pseudomonas putida KT2440
ccacagguccagcgc

SEQ ID NO: 3548702 - RNA, 20 nt, Pseudomonas putida KT2440
ccacagguccagcgcaggcu

SEQ ID NO: 3548703 - RNA, 21 nt, Pseudomonas putida KT2440
ccacaggugacaagcugcgcc

SEQ ID NO: 3548704 - RNA, 22 nt, Pseudomonas putida KT2440
ccacaggugacaagcugcgccc

SEQ ID NO: 3548705 - RNA, 15 nt, Pseudomonas putida KT2440
ccacaggugcagcac

SEQ ID NO: 3548706 - RNA, 18 nt, Pseudomonas putida KT2440
ccacagguuuagcgcugg

SEQ ID NO: 3548707 - RNA, 22 nt, Pseudomonas putida KT2440
ccacagugucccggccagggcu

SEQ ID NO: 3548708 - RNA, 16 nt, Pseudomonas putida KT2440
ccacauaacugccggc

SEQ ID NO: 3548709 - RNA, 18 nt, Pseudomonas putida KT2440
ccacauacugcuucugcc

SEQ ID NO: 3548710 - RNA, 16 nt, Pseudomonas putida KT2440
ccacauagcuggcacu

SEQ ID NO: 3548711 - RNA, 21 nt, Pseudomonas putida KT2440
ccacaucaaaagggugaugcc

SEQ ID NO: 3548712 - RNA, 13 nt, Pseudomonas putida KT2440
ccacauccagcgc

SEQ ID NO: 3548713 - RNA, 15 nt, Pseudomonas putida KT2440
ccacauccagcgccu

SEQ ID NO: 3548714 - RNA, 21 nt, Pseudomonas putida KT2440
ccacauccagcgccuccccca

SEQ ID NO: 3548715 - RNA, 20 nt, Pseudomonas putida KT2440
ccacauccccgccgccagca

SEQ ID NO: 3548716 - RNA, 18 nt, Pseudomonas putida KT2440
ccacauccgaccccagca

SEQ ID NO: 3548717 - RNA, 21 nt, Pseudomonas putida KT2440
ccacauccgaccccagcauga

SEQ ID NO: 3548718 - RNA, 14 nt, Pseudomonas putida KT2440
ccacauccucugcc

SEQ ID NO: 3548719 - RNA, 17 nt, Pseudomonas putida KT2440
ccacauccucugcccgc

SEQ ID NO: 3548720 - RNA, 19 nt, Pseudomonas putida KT2440
ccacaugcgagccgcugcc

SEQ ID NO: 3548721 - RNA, 20 nt, Pseudomonas putida KT2440
ccaccaaaggccuugaucgc

SEQ ID NO: 3548722 - RNA, 22 nt, Pseudomonas putida KT2440
ccaccaacagcaccggccaggc

SEQ ID NO: 3548723 - RNA, 14 nt, Pseudomonas putida KT2440
ccaccaaccggcca

SEQ ID NO: 3548724 - RNA, 13 nt, Pseudomonas putida KT2440
ccaccaagcccuu

SEQ ID NO: 3548725 - RNA, 22 nt, Pseudomonas putida KT2440
ccaccaaggcuucaaggucggu

SEQ ID NO: 3548726 - RNA, 18 nt, Pseudomonas putida KT2440
ccaccaagggugucaaca

SEQ ID NO: 3548727 - RNA, 18 nt, Pseudomonas putida KT2440
ccaccaauuugcggccau

SEQ ID NO: 3548728 - RNA, 21 nt, Pseudomonas putida KT2440
ccaccacaaaccacagcggcc

SEQ ID NO: 3548729 - RNA, 22 nt, Pseudomonas putida KT2440
ccaccacaaaccacagcggcca

SEQ ID NO: 3548730 - RNA, 24 nt, Pseudomonas putida KT2440
ccaccacaaaccacagcggccaca

SEQ ID NO: 3548731 - RNA, 21 nt, Pseudomonas putida KT2440
ccaccacauccgaccccagca

SEQ ID NO: 3548732 - RNA, 15 nt, Pseudomonas putida KT2440
ccaccaccagcaaca

SEQ ID NO: 3548733 - RNA, 14 nt, Pseudomonas putida KT2440
ccaccacccgcugg

SEQ ID NO: 3548734 - RNA, 13 nt, Pseudomonas putida KT2440
ccaccacccuggc

SEQ ID NO: 3548735 - RNA, 12 nt, Pseudomonas putida KT2440
ccaccacccugu

SEQ ID NO: 3548736 - RNA, 15 nt, Pseudomonas putida KT2440
ccaccacccugucgu

SEQ ID NO: 3548737 - RNA, 18 nt, Pseudomonas putida KT2440
ccaccgcggugucuucuu

SEQ ID NO: 3548738 - RNA, 18 nt, Pseudomonas putida KT2440
ccaccgcucaaacccggc

SEQ ID NO: 3548739 - RNA, 16 nt, Pseudomonas putida KT2440
ccaccgcucgcgccgc

SEQ ID NO: 3548740 - RNA, 13 nt, Pseudomonas putida KT2440
ccaccgcugcaau

SEQ ID NO: 3548741 - RNA, 13 nt, Pseudomonas putida KT2440
ccaccggcaagcc

SEQ ID NO: 3548742 - RNA, 15 nt, Pseudomonas putida KT2440
ccaccggcaccaucu

SEQ ID NO: 3548743 - RNA, 20 nt, Pseudomonas putida KT2440
ccaccggcagcaccugccag

SEQ ID NO: 3548744 - RNA, 14 nt, Pseudomonas putida KT2440
ccaccggccuggaa

SEQ ID NO: 3548745 - RNA, 15 nt, Pseudomonas putida KT2440
ccaccggccuggaac

SEQ ID NO: 3548746 - RNA, 15 nt, Pseudomonas putida KT2440
ccaccggcuccaccu

SEQ ID NO: 3548747 - RNA, 18 nt, Pseudomonas putida KT2440
ccaccggcuccaccugcu

SEQ ID NO: 3548748 - RNA, 23 nt, Pseudomonas putida KT2440
ccaccgggauggcggcgccugcc

SEQ ID NO: 3548749 - RNA, 23 nt, Pseudomonas putida KT2440
ccaccguauuaaggcaaguggaa

SEQ ID NO: 3548750 - RNA, 16 nt, Pseudomonas putida KT2440
ccaccgucaggcucag

SEQ ID NO: 3548751 - RNA, 18 nt, Pseudomonas putida KT2440
ccaccgucaggcucagca

SEQ ID NO: 3548752 - RNA, 17 nt, Pseudomonas putida KT2440
ccaccgugagcauggca

SEQ ID NO: 3548753 - RNA, 14 nt, Pseudomonas putida KT2440
ccaccuaucaggag

SEQ ID NO: 3548754 - RNA, 14 nt, Pseudomonas putida KT2440
ccaccuccaccccg

SEQ ID NO: 3548755 - RNA, 15 nt, Pseudomonas putida KT2440
ccaccuccaccccgc

SEQ ID NO: 3548756 - RNA, 20 nt, Pseudomonas putida KT2440
ccaccucgacccccuugcca

SEQ ID NO: 3548757 - RNA, 15 nt, Pseudomonas putida KT2440
ccaccucucagcacc

SEQ ID NO: 3548758 - RNA, 14 nt, Pseudomonas putida KT2440
ccaccucugcggcc

SEQ ID NO: 3548759 - RNA, 15 nt, Pseudomonas putida KT2440
ccaccucugcggccu

SEQ ID NO: 3548760 - RNA, 19 nt, Pseudomonas putida KT2440
ccaccugaugcaccaggcc

SEQ ID NO: 3548761 - RNA, 22 nt, Pseudomonas putida KT2440
ccaccugauguacaaggaccuc

SEQ ID NO: 3548762 - RNA, 17 nt, Pseudomonas putida KT2440
ccaccugcagggucagg

SEQ ID NO: 3548763 - RNA, 23 nt, Pseudomonas putida KT2440
ccaccugcagggucaggcggauu

SEQ ID NO: 3548764 - RNA, 12 nt, Pseudomonas putida KT2440
ccaccugcccca

SEQ ID NO: 3548765 - RNA, 14 nt, Pseudomonas putida KT2440
ccaccugcccgggc

SEQ ID NO: 3548766 - RNA, 15 nt, Pseudomonas putida KT2440
ccaccugcggcaggu

SEQ ID NO: 3548767 - RNA, 17 nt, Pseudomonas putida KT2440
ccaccugcuccagcacc

SEQ ID NO: 3548768 - RNA, 13 nt, Pseudomonas putida KT2440
ccaccuggccacc

SEQ ID NO: 3548769 - RNA, 16 nt, Pseudomonas putida KT2440
ccaccuggccacccgg

SEQ ID NO: 3548770 - RNA, 15 nt, Pseudomonas putida KT2440
ccaccuggccuucca

SEQ ID NO: 3548771 - RNA, 22 nt, Pseudomonas putida KT2440
ccaccuggcucggugugcaccu

SEQ ID NO: 3548772 - RNA, 20 nt, Pseudomonas putida KT2440
ccaccuggcugcgggugccc

SEQ ID NO: 3548773 - RNA, 21 nt, Pseudomonas putida KT2440
ccaccugggcgcuuugcaccc

SEQ ID NO: 3548774 - RNA, 21 nt, Pseudomonas putida KT2440
ccaccuggucgaaugcgugca

SEQ ID NO: 3548775 - RNA, 23 nt, Pseudomonas putida KT2440
ccaccuggucgaaugcgugcaac

SEQ ID NO: 3548776 - RNA, 15 nt, Pseudomonas putida KT2440
ccaccugugccggca

SEQ ID NO: 3548777 - RNA, 21 nt, Pseudomonas putida KT2440
ccaccugugccggcagcgagc

SEQ ID NO: 3548778 - RNA, 17 nt, Pseudomonas putida KT2440
ccaccuguugccgcuuc

SEQ ID NO: 3548779 - RNA, 20 nt, Pseudomonas putida KT2440
ccaccuuacuugcacauccc

SEQ ID NO: 3548780 - RNA, 13 nt, Pseudomonas putida KT2440
ccaccuucagcgg

SEQ ID NO: 3548781 - RNA, 17 nt, Pseudomonas putida KT2440
ccaccuuccacucuucc

SEQ ID NO: 3548782 - RNA, 19 nt, Pseudomonas putida KT2440
ccaccuugccaucggccau

SEQ ID NO: 3548783 - RNA, 15 nt, Pseudomonas putida KT2440
ccaccuuggcccuuc

SEQ ID NO: 3548784 - RNA, 19 nt, Pseudomonas putida KT2440
ccaccuugugcggcccucg

SEQ ID NO: 3548785 - RNA, 13 nt, Pseudomonas putida KT2440
ccacgaaccugug

SEQ ID NO: 3548786 - RNA, 18 nt, Pseudomonas putida KT2440
ccacgaacgcccccagcc

SEQ ID NO: 3548787 - RNA, 12 nt, Pseudomonas putida KT2440
ccacgaaggccg

SEQ ID NO: 3548788 - RNA, 20 nt, Pseudomonas putida KT2440
ccacgaaucgauaccugggu

SEQ ID NO: 3548789 - RNA, 16 nt, Pseudomonas putida KT2440
ccacgacgugucagug

SEQ ID NO: 3548790 - RNA, 23 nt, Pseudomonas putida KT2440
ccacgauagcgucagcagggcca

SEQ ID NO: 3548791 - RNA, 24 nt, Pseudomonas putida KT2440
ccacgauagcgucagcagggccaa

SEQ ID NO: 3548792 - RNA, 16 nt, Pseudomonas putida KT2440
ccacgaucacgcccgg

SEQ ID NO: 3548793 - RNA, 20 nt, Pseudomonas putida KT2440
ccacgaucgacaaccccagc

SEQ ID NO: 3548794 - RNA, 22 nt, Pseudomonas putida KT2440
ccacgaucgacaaccccagccc

SEQ ID NO: 3548795 - RNA, 15 nt, Pseudomonas putida KT2440
ccacgaucucacgcg

SEQ ID NO: 3548796 - RNA, 16 nt, Pseudomonas putida KT2440
ccacgaucucacgcgc

SEQ ID NO: 3548797 - RNA, 20 nt, Pseudomonas putida KT2440
ccacgaucucacgcgccaca

SEQ ID NO: 3548798 - RNA, 16 nt, Pseudomonas putida KT2440
ccacgaucuuggccag

SEQ ID NO: 3548799 - RNA, 21 nt, Pseudomonas putida KT2440
ccacgaugcccauggcgcagc

SEQ ID NO: 3548800 - RNA, 14 nt, Pseudomonas putida KT2440
ccacgaugccuggg

SEQ ID NO: 3548801 - RNA, 21 nt, Pseudomonas putida KT2440
ccacgaugccugggcgguccu

SEQ ID NO: 3548802 - RNA, 15 nt, Pseudomonas putida KT2440
ccacgcacagcugug

SEQ ID NO: 3548803 - RNA, 19 nt, Pseudomonas putida KT2440
ccacgcacaucacguuugg

SEQ ID NO: 3548804 - RNA, 20 nt, Pseudomonas putida KT2440
ccacgcacaucguccgccgc

SEQ ID NO: 3548805 - RNA, 13 nt, Pseudomonas putida KT2440
ccacgcaccaggg

SEQ ID NO: 3548806 - RNA, 16 nt, Pseudomonas putida KT2440
ccacgcaucugcaccu

SEQ ID NO: 3548807 - RNA, 14 nt, Pseudomonas putida KT2440
ccacgccagaaccu

SEQ ID NO: 3548808 - RNA, 21 nt, Pseudomonas putida KT2440
ccacgccagaaccugacaagc

SEQ ID NO: 3548809 - RNA, 18 nt, Pseudomonas putida KT2440
ccacgcccaacccagcca

SEQ ID NO: 3548810 - RNA, 21 nt, Pseudomonas putida KT2440
ccacgcccaacccagccagcg

SEQ ID NO: 3548811 - RNA, 15 nt, Pseudomonas putida KT2440
ccacgcccaacccca

SEQ ID NO: 3548812 - RNA, 16 nt, Pseudomonas putida KT2440
ccacgcccaaccccag

SEQ ID NO: 3548813 - RNA, 14 nt, Pseudomonas putida KT2440
ccacgcccauggcu

SEQ ID NO: 3548814 - RNA, 12 nt, Pseudomonas putida KT2440
ccacgcccggcc

SEQ ID NO: 3548815 - RNA, 22 nt, Pseudomonas putida KT2440
ccacgcccgucaccuugccauc

SEQ ID NO: 3548816 - RNA, 14 nt, Pseudomonas putida KT2440
ccacgcccuggccc

SEQ ID NO: 3548817 - RNA, 23 nt, Pseudomonas putida KT2440
ccacgcccuuuuucaccaggcgg

SEQ ID NO: 3548818 - RNA, 11 nt, Pseudomonas putida KT2440
ccacgccgcca

SEQ ID NO: 3548819 - RNA, 18 nt, Pseudomonas putida KT2440
ccacgccgcugguacagg

SEQ ID NO: 3548820 - RNA, 12 nt, Pseudomonas putida KT2440
ccacgccugcgc

SEQ ID NO: 3548821 - RNA, 13 nt, Pseudomonas putida KT2440
ccacgccugcgcc

SEQ ID NO: 3548822 - RNA, 14 nt, Pseudomonas putida KT2440
ccacgccuuccacc

SEQ ID NO: 3548823 - RNA, 16 nt, Pseudomonas putida KT2440
ccacgccuuccaccgg

SEQ ID NO: 3548824 - RNA, 18 nt, Pseudomonas putida KT2440
ccacgcgcaaaugcuugc

SEQ ID NO: 3548825 - RNA, 14 nt, Pseudomonas putida KT2440
ccacgcgcaggcca

SEQ ID NO: 3548826 - RNA, 15 nt, Pseudomonas putida KT2440
ccacgcgcaggccac

SEQ ID NO: 3548827 - RNA, 16 nt, Pseudomonas putida KT2440
ccacgcgcaggccacg

SEQ ID NO: 3548828 - RNA, 19 nt, Pseudomonas putida KT2440
ccacgcgggcuaugcgauu

SEQ ID NO: 3548829 - RNA, 15 nt, Pseudomonas putida KT2440
ccacgcggguccagc

SEQ ID NO: 3548830 - RNA, 16 nt, Pseudomonas putida KT2440
ccacgcggguccagcg

SEQ ID NO: 3548831 - RNA, 17 nt, Pseudomonas putida KT2440
ccacgcggguccagcgc

SEQ ID NO: 3548832 - RNA, 20 nt, Pseudomonas putida KT2440
ccacgcggguccagcgcggc

SEQ ID NO: 3548833 - RNA, 16 nt, Pseudomonas putida KT2440
ccacgcuagucaagcu

SEQ ID NO: 3548834 - RNA, 13 nt, Pseudomonas putida KT2440
ccacgcucgugca

SEQ ID NO: 3548835 - RNA, 15 nt, Pseudomonas putida KT2440
ccacgcucgugcagg

SEQ ID NO: 3548836 - RNA, 17 nt, Pseudomonas putida KT2440
ccacgcucgugcaggcu

SEQ ID NO: 3548837 - RNA, 20 nt, Pseudomonas putida KT2440
ccacgcucuguaucgaacag

SEQ ID NO: 3548838 - RNA, 15 nt, Pseudomonas putida KT2440
ccacgcugaacacgc

SEQ ID NO: 3548839 - RNA, 16 nt, Pseudomonas putida KT2440
ccacgcugccaggacc

SEQ ID NO: 3548840 - RNA, 20 nt, Pseudomonas putida KT2440
ccacgcuggcacccacgcgc

SEQ ID NO: 3548841 - RNA, 21 nt, Pseudomonas putida KT2440
ccacggaucaccacgucuucc

SEQ ID NO: 3548842 - RNA, 15 nt, Pseudomonas putida KT2440
ccacggaucaccugg

SEQ ID NO: 3548843 - RNA, 15 nt, Pseudomonas putida KT2440
ccagacgggcauggu

SEQ ID NO: 3548844 - RNA, 13 nt, Pseudomonas putida KT2440
ccagacucagcgc

SEQ ID NO: 3548845 - RNA, 22 nt, Pseudomonas putida KT2440
ccagacucagcgcuugccgcug

SEQ ID NO: 3548846 - RNA, 13 nt, Pseudomonas putida KT2440
ccagacucagcug

SEQ ID NO: 3548847 - RNA, 19 nt, Pseudomonas putida KT2440
ccagagaauuucuccccag

SEQ ID NO: 3548848 - RNA, 15 nt, Pseudomonas putida KT2440
ccagagagcugagau

SEQ ID NO: 3548849 - RNA, 23 nt, Pseudomonas putida KT2440
ccagagcauggccagccggcagc

SEQ ID NO: 3548850 - RNA, 13 nt, Pseudomonas putida KT2440
ccagagcgcgcca

SEQ ID NO: 3548851 - RNA, 15 nt, Pseudomonas putida KT2440
ccagagcgcgccacg

SEQ ID NO: 3548852 - RNA, 19 nt, Pseudomonas putida KT2440
ccagagcgcgccacgcacc

SEQ ID NO: 3548853 - RNA, 12 nt, Pseudomonas putida KT2440
ccagaggcgcgu

SEQ ID NO: 3548854 - RNA, 15 nt, Pseudomonas putida KT2440
ccagaggcgcguagu

SEQ ID NO: 3548855 - RNA, 22 nt, Pseudomonas putida KT2440
ccagaucacuuccaccugcgcc

SEQ ID NO: 3548856 - RNA, 23 nt, Pseudomonas putida KT2440
ccagaucacuuccaccugcgccu

SEQ ID NO: 3548857 - RNA, 14 nt, Pseudomonas putida KT2440
ccagaucagcagca

SEQ ID NO: 3548858 - RNA, 14 nt, Pseudomonas putida KT2440
ccagaucauuuucu

SEQ ID NO: 3548859 - RNA, 19 nt, Pseudomonas putida KT2440
ccagaucauuuucuacgau

SEQ ID NO: 3548860 - RNA, 21 nt, Pseudomonas putida KT2440
ccagaucggcagugccgcagu

SEQ ID NO: 3548861 - RNA, 15 nt, Pseudomonas putida KT2440
ccagaucggccagcu

SEQ ID NO: 3548862 - RNA, 15 nt, Pseudomonas putida KT2440
ccagaucucgcgcuu

SEQ ID NO: 3548863 - RNA, 23 nt, Pseudomonas putida KT2440
ccagaugaaguagaacuggcgca

SEQ ID NO: 3548864 - RNA, 13 nt, Pseudomonas putida KT2440
ccagauucaagcc

SEQ ID NO: 3548865 - RNA, 14 nt, Pseudomonas putida KT2440
ccagauucaagccc

SEQ ID NO: 3548866 - RNA, 15 nt, Pseudomonas putida KT2440
ccagauucaagcccg

SEQ ID NO: 3548867 - RNA, 17 nt, Pseudomonas putida KT2440
ccagauucaagcccggc

SEQ ID NO: 3548868 - RNA, 18 nt, Pseudomonas putida KT2440
ccagcaaagugcgcaugc

SEQ ID NO: 3548869 - RNA, 15 nt, Pseudomonas putida KT2440
ccagcaacaacgccu

SEQ ID NO: 3548870 - RNA, 19 nt, Pseudomonas putida KT2440
ccagcaacaacgccuuggc

SEQ ID NO: 3548871 - RNA, 13 nt, Pseudomonas putida KT2440
ccagcaacaagcu

SEQ ID NO: 3548872 - RNA, 17 nt, Pseudomonas putida KT2440
ccagcaacaagcuggac

SEQ ID NO: 3548873 - RNA, 15 nt, Pseudomonas putida KT2440
ccagcaacagcugcc

SEQ ID NO: 3548874 - RNA, 16 nt, Pseudomonas putida KT2440
ccagcaacagcugccg

SEQ ID NO: 3548875 - RNA, 22 nt, Pseudomonas putida KT2440
ccagcaacagcugccgggccgg

SEQ ID NO: 3548876 - RNA, 14 nt, Pseudomonas putida KT2440
ccagcaacaugccg

SEQ ID NO: 3548877 - RNA, 17 nt, Pseudomonas putida KT2440
ccagcaacaugccggcc

SEQ ID NO: 3548878 - RNA, 14 nt, Pseudomonas putida KT2440
ccagcaacgcagcc

SEQ ID NO: 3548879 - RNA, 15 nt, Pseudomonas putida KT2440
ccagcaacgcagcca

SEQ ID NO: 3548880 - RNA, 18 nt, Pseudomonas putida KT2440
ccagcaacgcagccagga

SEQ ID NO: 3548881 - RNA, 16 nt, Pseudomonas putida KT2440
ccagcaacggguucag

SEQ ID NO: 3548882 - RNA, 15 nt, Pseudomonas putida KT2440
ccagcaacugcgccc

SEQ ID NO: 3548883 - RNA, 22 nt, Pseudomonas putida KT2440
ccagcaacuggugaaucagccc

SEQ ID NO: 3548884 - RNA, 20 nt, Pseudomonas putida KT2440
ccagcaagcgcauaggcaau

SEQ ID NO: 3548885 - RNA, 20 nt, Pseudomonas putida KT2440
ccagcaagcucaucaccagg

SEQ ID NO: 3548886 - RNA, 12 nt, Pseudomonas putida KT2440
ccagcaaggcaa

SEQ ID NO: 3548887 - RNA, 14 nt, Pseudomonas putida KT2440
ccagcaagggccug

SEQ ID NO: 3548888 - RNA, 19 nt, Pseudomonas putida KT2440
ccagcaagggccugugccg

SEQ ID NO: 3548889 - RNA, 22 nt, Pseudomonas putida KT2440
ccagcaagggccugugccgaac

SEQ ID NO: 3548890 - RNA, 19 nt, Pseudomonas putida KT2440
ccagcaagucccccaucgg

SEQ ID NO: 3548891 - RNA, 18 nt, Pseudomonas putida KT2440
ccagcaauccuuggcgca

SEQ ID NO: 3548892 - RNA, 20 nt, Pseudomonas putida KT2440
ccagcaauugcgagguaccg

SEQ ID NO: 3548893 - RNA, 14 nt, Pseudomonas putida KT2440
ccagcacaagccga

SEQ ID NO: 3548894 - RNA, 15 nt, Pseudomonas putida KT2440
ccagcacacgguagg

SEQ ID NO: 3548895 - RNA, 13 nt, Pseudomonas putida KT2440
ccagcacacugag

SEQ ID NO: 3548896 - RNA, 20 nt, Pseudomonas putida KT2440
ccagcacacugagcaccaca

SEQ ID NO: 3548897 - RNA, 20 nt, Pseudomonas putida KT2440
ccagcacagauaaaccugcc

SEQ ID NO: 3548898 - RNA, 16 nt, Pseudomonas putida KT2440
ccagcaccacccacca

SEQ ID NO: 3548899 - RNA, 19 nt, Pseudomonas putida KT2440
ccagcaccacccaccagca

SEQ ID NO: 3548900 - RNA, 17 nt, Pseudomonas putida KT2440
ccagcaccaccugugcc

SEQ ID NO: 3548901 - RNA, 23 nt, Pseudomonas putida KT2440
ccagcaccaccugugccggcagc

SEQ ID NO: 3548902 - RNA, 20 nt, Pseudomonas putida KT2440
ccagcaccagcgcgaucacc

SEQ ID NO: 3548903 - RNA, 18 nt, Pseudomonas putida KT2440
ccagcaccaucagagcgc

SEQ ID NO: 3548904 - RNA, 18 nt, Pseudomonas putida KT2440
ccagcaccaucaggcaca

SEQ ID NO: 3548905 - RNA, 22 nt, Pseudomonas putida KT2440
ccagcaccaucaggcacaggcc

SEQ ID NO: 3548906 - RNA, 15 nt, Pseudomonas putida KT2440
ccagcaccccagcac

SEQ ID NO: 3548907 - RNA, 14 nt, Pseudomonas putida KT2440
ccagcacccgcuug

SEQ ID NO: 3548908 - RNA, 16 nt, Pseudomonas putida KT2440
ccagcaccgaaccggc

SEQ ID NO: 3548909 - RNA, 17 nt, Pseudomonas putida KT2440
ccagcaccgaaccggcg

SEQ ID NO: 3548910 - RNA, 21 nt, Pseudomonas putida KT2440
ccagcaccgccccggccagug

SEQ ID NO: 3548911 - RNA, 20 nt, Pseudomonas putida KT2440
ccagcaccugacgcaagcgc

SEQ ID NO: 3548912 - RNA, 20 nt, Pseudomonas putida KT2440
ccagcaccuggcggcccgcc

SEQ ID NO: 3548913 - RNA, 18 nt, Pseudomonas putida KT2440
ccagcacgaacagcaaca

SEQ ID NO: 3548914 - RNA, 17 nt, Pseudomonas putida KT2440
ccagcacgaaggccagc

SEQ ID NO: 3548915 - RNA, 18 nt, Pseudomonas putida KT2440
ccagcacgaaggccagca

SEQ ID NO: 3548916 - RNA, 19 nt, Pseudomonas putida KT2440
ccagcacgaaggccagcaa

SEQ ID NO: 3548917 - RNA, 14 nt, Pseudomonas putida KT2440
ccagcacgcaggcc

SEQ ID NO: 3548918 - RNA, 15 nt, Pseudomonas putida KT2440
ccagcacgcaggcca

SEQ ID NO: 3548919 - RNA, 17 nt, Pseudomonas putida KT2440
ccagcacgcaggccagc

SEQ ID NO: 3548920 - RNA, 18 nt, Pseudomonas putida KT2440
ccagcacgcaggccagcg

SEQ ID NO: 3548921 - RNA, 19 nt, Pseudomonas putida KT2440
ccagcacgcaggccagcgc

SEQ ID NO: 3548922 - RNA, 22 nt, Pseudomonas putida KT2440
ccagcacgcaggccagcgcaca

SEQ ID NO: 3548923 - RNA, 15 nt, Pseudomonas putida KT2440
ccagcacggccagca

SEQ ID NO: 3548924 - RNA, 22 nt, Pseudomonas putida KT2440
ccagcacguucucgcucagcgu

SEQ ID NO: 3548925 - RNA, 18 nt, Pseudomonas putida KT2440
ccagcacuacgccggcca

SEQ ID NO: 3548926 - RNA, 20 nt, Pseudomonas putida KT2440
ccagcacuacgccggccaag

SEQ ID NO: 3548927 - RNA, 17 nt, Pseudomonas putida KT2440
ccagcacugccuggcca

SEQ ID NO: 3548928 - RNA, 22 nt, Pseudomonas putida KT2440
ccagcacugccuggccacuguu

SEQ ID NO: 3548929 - RNA, 21 nt, Pseudomonas putida KT2440
ccagcacugccuugcccugca

SEQ ID NO: 3548930 - RNA, 14 nt, Pseudomonas putida KT2440
ccagcacugcugcg

SEQ ID NO: 3548931 - RNA, 18 nt, Pseudomonas putida KT2440
ccagcacugcugcgcagu

SEQ ID NO: 3548932 - RNA, 21 nt, Pseudomonas putida KT2440
ccagcacugcugcgcaguaca

SEQ ID NO: 3548933 - RNA, 18 nt, Pseudomonas putida KT2440
ccagcacuuuugccacca

SEQ ID NO: 3548934 - RNA, 23 nt, Pseudomonas putida KT2440
ccagcacuuuugccaccacccgg

SEQ ID NO: 3548935 - RNA, 14 nt, Pseudomonas putida KT2440
ccagcagcacacgc

SEQ ID NO: 3548936 - RNA, 20 nt, Pseudomonas putida KT2440
ccagcagcacacgcuugucu

SEQ ID NO: 3548937 - RNA, 16 nt, Pseudomonas putida KT2440
ccagcagcacaucccg

SEQ ID NO: 3548938 - RNA, 14 nt, Pseudomonas putida KT2440
ccagcagcaccugc

SEQ ID NO: 3548939 - RNA, 16 nt, Pseudomonas putida KT2440
ccagcagcaccugccg

SEQ ID NO: 3548940 - RNA, 17 nt, Pseudomonas putida KT2440
ccagcagcaccugccgc

SEQ ID NO: 3548941 - RNA, 13 nt, Pseudomonas putida KT2440
ccagcagcagcgc

SEQ ID NO: 3548942 - RNA, 15 nt, Pseudomonas putida KT2440
ccagcagcagcgcac

SEQ ID NO: 3548943 - RNA, 19 nt, Pseudomonas putida KT2440
ccagcagcaguggcaagcc

SEQ ID NO: 3548944 - RNA, 18 nt, Pseudomonas putida KT2440
ccagcagccccacgccca

SEQ ID NO: 3548945 - RNA, 12 nt, Pseudomonas putida KT2440
ccagcagccccc

SEQ ID NO: 3548946 - RNA, 14 nt, Pseudomonas putida KT2440
ccagcagccgggcc

SEQ ID NO: 3548947 - RNA, 15 nt, Pseudomonas putida KT2440
ccagcagccgggccu

SEQ ID NO: 3548948 - RNA, 14 nt, Pseudomonas putida KT2440
ccagcccugccgag

SEQ ID NO: 3548949 - RNA, 22 nt, Pseudomonas putida KT2440
ccagccgcaaccgggucggcgc

SEQ ID NO: 3548950 - RNA, 20 nt, Pseudomonas putida KT2440
ccagccgccacgaccacgac

SEQ ID NO: 3548951 - RNA, 15 nt, Pseudomonas putida KT2440
ccagccgcgccaggu

SEQ ID NO: 3548952 - RNA, 16 nt, Pseudomonas putida KT2440
ccagccgcgccagguc

SEQ ID NO: 3548953 - RNA, 14 nt, Pseudomonas putida KT2440
ccagccgcgucucg

SEQ ID NO: 3548954 - RNA, 17 nt, Pseudomonas putida KT2440
ccagccgcucagccacc

SEQ ID NO: 3548955 - RNA, 14 nt, Pseudomonas putida KT2440
ccagccggcccggc

SEQ ID NO: 3548956 - RNA, 21 nt, Pseudomonas putida KT2440
ccagccggcgcaucagugccg

SEQ ID NO: 3548957 - RNA, 14 nt, Pseudomonas putida KT2440
ccagccgggcugca

SEQ ID NO: 3548958 - RNA, 13 nt, Pseudomonas putida KT2440
ccagccguccucg

SEQ ID NO: 3548959 - RNA, 16 nt, Pseudomonas putida KT2440
ccagccguggcaacgc

SEQ ID NO: 3548960 - RNA, 20 nt, Pseudomonas putida KT2440
ccagccguuguuugucaccc

SEQ ID NO: 3548961 - RNA, 13 nt, Pseudomonas putida KT2440
ccagccucagcug

SEQ ID NO: 3548962 - RNA, 13 nt, Pseudomonas putida KT2440
ccagccucuucuu

SEQ ID NO: 3548963 - RNA, 14 nt, Pseudomonas putida KT2440
ccagccugcagcac

SEQ ID NO: 3548964 - RNA, 15 nt, Pseudomonas putida KT2440
ccagccugcagcacc

SEQ ID NO: 3548965 - RNA, 16 nt, Pseudomonas putida KT2440
ccagccugcagcaccc

SEQ ID NO: 3548966 - RNA, 16 nt, Pseudomonas putida KT2440
ccagccuggccccacc

SEQ ID NO: 3548967 - RNA, 17 nt, Pseudomonas putida KT2440
ccagccuggccccaccc

SEQ ID NO: 3548968 - RNA, 18 nt, Pseudomonas putida KT2440
ccagccuggccccaccca

SEQ ID NO: 3548969 - RNA, 17 nt, Pseudomonas putida KT2440
ccagccuucgccaacug

SEQ ID NO: 3548970 - RNA, 15 nt, Pseudomonas putida KT2440
ccagccuugaggcug

SEQ ID NO: 3548971 - RNA, 16 nt, Pseudomonas putida KT2440
ccagcgaauagcaaca

SEQ ID NO: 3548972 - RNA, 16 nt, Pseudomonas putida KT2440
ccagcgacagcaucgg

SEQ ID NO: 3548973 - RNA, 20 nt, Pseudomonas putida KT2440
ccagcgacugcaagcgaugc

SEQ ID NO: 3548974 - RNA, 20 nt, Pseudomonas putida KT2440
ccagcgauaaaccagcagcg

SEQ ID NO: 3548975 - RNA, 21 nt, Pseudomonas putida KT2440
ccagcgauaaaccagcagcgc

SEQ ID NO: 3548976 - RNA, 20 nt, Pseudomonas putida KT2440
ccagcgauggcggaucagcg

SEQ ID NO: 3548977 - RNA, 17 nt, Pseudomonas putida KT2440
ccagcgcacagcugccg

SEQ ID NO: 3548978 - RNA, 15 nt, Pseudomonas putida KT2440
ccagcgcaccacugu

SEQ ID NO: 3548979 - RNA, 16 nt, Pseudomonas putida KT2440
ccagcgcaccacuguu

SEQ ID NO: 3548980 - RNA, 23 nt, Pseudomonas putida KT2440
ccagcgcaugcaucugcgccccg

SEQ ID NO: 3548981 - RNA, 15 nt, Pseudomonas putida KT2440
ccagcgccaaucgca

SEQ ID NO: 3548982 - RNA, 18 nt, Pseudomonas putida KT2440
ccagcgccaaucgcaugc

SEQ ID NO: 3548983 - RNA, 15 nt, Pseudomonas putida KT2440
ccagcgccaccgcgc

SEQ ID NO: 3548984 - RNA, 16 nt, Pseudomonas putida KT2440
ccagcgccaccggcag

SEQ ID NO: 3548985 - RNA, 12 nt, Pseudomonas putida KT2440
ccagcgccagca

SEQ ID NO: 3548986 - RNA, 17 nt, Pseudomonas putida KT2440
ccagcgccaguacggcc

SEQ ID NO: 3548987 - RNA, 13 nt, Pseudomonas putida KT2440
ccagcgccccgcc

SEQ ID NO: 3548988 - RNA, 16 nt, Pseudomonas putida KT2440
ccagcgccccgccgca

SEQ ID NO: 3548989 - RNA, 16 nt, Pseudomonas putida KT2440
ccagcgccgccaugca

SEQ ID NO: 3548990 - RNA, 16 nt, Pseudomonas putida KT2440
ccagcgccgccggcug

SEQ ID NO: 3548991 - RNA, 13 nt, Pseudomonas putida KT2440
ccagcgccgcgcc

SEQ ID NO: 3548992 - RNA, 20 nt, Pseudomonas putida KT2440
ccagcgccgcgccaccgauc

SEQ ID NO: 3548993 - RNA, 12 nt, Pseudomonas putida KT2440
ccagcgccucca

SEQ ID NO: 3548994 - RNA, 14 nt, Pseudomonas putida KT2440
ccagcgccuccccc

SEQ ID NO: 3548995 - RNA, 15 nt, Pseudomonas putida KT2440
ccagcgccuccccca

SEQ ID NO: 3548996 - RNA, 16 nt, Pseudomonas putida KT2440
ccagcgccugcaggcc

SEQ ID NO: 3548997 - RNA, 12 nt, Pseudomonas putida KT2440
ccagcgccugcu

SEQ ID NO: 3548998 - RNA, 15 nt, Pseudomonas putida KT2440
ccagcgccugcugcc

SEQ ID NO: 3548999 - RNA, 20 nt, Pseudomonas putida KT2440
ccagcgccugcugccaggcc

SEQ ID NO: 3549000 - RNA, 14 nt, Pseudomonas putida KT2440
ccagcgcgccagca

SEQ ID NO: 3549001 - RNA, 16 nt, Pseudomonas putida KT2440
ccagcgcgccagcagg

SEQ ID NO: 3549002 - RNA, 22 nt, Pseudomonas putida KT2440
ccagcgcgcgcagacgggcgac

SEQ ID NO: 3549003 - RNA, 12 nt, Pseudomonas putida KT2440
ccagcgcggcaa

SEQ ID NO: 3549004 - RNA, 22 nt, Pseudomonas putida KT2440
ccagcgcguacagcgacaugcc

SEQ ID NO: 3549005 - RNA, 18 nt, Pseudomonas putida KT2440
ccagcgcuccagcaacgg

SEQ ID NO: 3549006 - RNA, 18 nt, Pseudomonas putida KT2440
ccagcgcucguaggcuuc

SEQ ID NO: 3549007 - RNA, 19 nt, Pseudomonas putida KT2440
ccagcgcugauaccgaacu

SEQ ID NO: 3549008 - RNA, 22 nt, Pseudomonas putida KT2440
ccagcgcugucccccagcccug

SEQ ID NO: 3549009 - RNA, 23 nt, Pseudomonas putida KT2440
ccagcgcuugagaccaggccugg

SEQ ID NO: 3549010 - RNA, 16 nt, Pseudomonas putida KT2440
ccagcggaauggucga

SEQ ID NO: 3549011 - RNA, 16 nt, Pseudomonas putida KT2440
ccagcggaucaccgac

SEQ ID NO: 3549012 - RNA, 21 nt, Pseudomonas putida KT2440
ccagcggaucaccgacgugca

SEQ ID NO: 3549013 - RNA, 15 nt, Pseudomonas putida KT2440
ccagcggcagcaagu

SEQ ID NO: 3549014 - RNA, 16 nt, Pseudomonas putida KT2440
ccagcggccacuuaca

SEQ ID NO: 3549015 - RNA, 13 nt, Pseudomonas putida KT2440
ccagcggccagcg

SEQ ID NO: 3549016 - RNA, 14 nt, Pseudomonas putida KT2440
ccagcggccagcgc

SEQ ID NO: 3549017 - RNA, 22 nt, Pseudomonas putida KT2440
ccagcggccagcgccuggcgca

SEQ ID NO: 3549018 - RNA, 14 nt, Pseudomonas putida KT2440
ccagcggcgcggcc

SEQ ID NO: 3549019 - RNA, 20 nt, Pseudomonas putida KT2440
ccagcgggaugcagucgacc

SEQ ID NO: 3549020 - RNA, 20 nt, Pseudomonas putida KT2440
ccagcggucagcaucuucuu

SEQ ID NO: 3549021 - RNA, 13 nt, Pseudomonas putida KT2440
ccagcggugccag

SEQ ID NO: 3549022 - RNA, 16 nt, Pseudomonas putida KT2440
ccagcgguugagauga

SEQ ID NO: 3549023 - RNA, 14 nt, Pseudomonas putida KT2440
ccagcguaagcugg

SEQ ID NO: 3549024 - RNA, 16 nt, Pseudomonas putida KT2440
ccagcguauagccacc

SEQ ID NO: 3549025 - RNA, 15 nt, Pseudomonas putida KT2440
ccagcgucaccccuc

SEQ ID NO: 3549026 - RNA, 17 nt, Pseudomonas putida KT2440
ccagcgucacccguggc

SEQ ID NO: 3549027 - RNA, 23 nt, Pseudomonas putida KT2440
ccagcgucacccguggcagcccc

SEQ ID NO: 3549028 - RNA, 13 nt, Pseudomonas putida KT2440
ccagcgucccggu

SEQ ID NO: 3549029 - RNA, 17 nt, Pseudomonas putida KT2440
ccagcgucccggucaac

SEQ ID NO: 3549030 - RNA, 20 nt, Pseudomonas putida KT2440
ccagcgucguguucgccugu

SEQ ID NO: 3549031 - RNA, 23 nt, Pseudomonas putida KT2440
ccagcgucguguucgccuguccg

SEQ ID NO: 3549032 - RNA, 15 nt, Pseudomonas putida KT2440
ccagcgugcccgcca

SEQ ID NO: 3549033 - RNA, 19 nt, Pseudomonas putida KT2440
ccagcgugcccgccacacc

SEQ ID NO: 3549034 - RNA, 15 nt, Pseudomonas putida KT2440
ccagcguggccgcca

SEQ ID NO: 3549035 - RNA, 22 nt, Pseudomonas putida KT2440
ccagcguggccgccaacagcgc

SEQ ID NO: 3549036 - RNA, 13 nt, Pseudomonas putida KT2440
ccagcguggccug

SEQ ID NO: 3549037 - RNA, 18 nt, Pseudomonas putida KT2440
ccagcguggccugcaagc

SEQ ID NO: 3549038 - RNA, 14 nt, Pseudomonas putida KT2440
ccagcgugggccgu

SEQ ID NO: 3549039 - RNA, 22 nt, Pseudomonas putida KT2440
ccagcgugggccgugcaggcgg

SEQ ID NO: 3549040 - RNA, 14 nt, Pseudomonas putida KT2440
ccagcguuccuggg

SEQ ID NO: 3549041 - RNA, 17 nt, Pseudomonas putida KT2440
ccagcguucggccagca

SEQ ID NO: 3549042 - RNA, 17 nt, Pseudomonas putida KT2440
ccagcguucgggucaac

SEQ ID NO: 3549043 - RNA, 17 nt, Pseudomonas putida KT2440
ccagcguucucgcucag

SEQ ID NO: 3549044 - RNA, 16 nt, Pseudomonas putida KT2440
ccagcguugucccgcc

SEQ ID NO: 3549045 - RNA, 14 nt, Pseudomonas putida KT2440
ccagcguuuccggg

SEQ ID NO: 3549046 - RNA, 19 nt, Pseudomonas putida KT2440
ccagcuacgcgagccaccg

SEQ ID NO: 3549047 - RNA, 15 nt, Pseudomonas putida KT2440
ccagcucaccggcua

SEQ ID NO: 3549048 - RNA, 22 nt, Pseudomonas putida KT2440
ccagcucacgcaagcggcccug

SEQ ID NO: 3549049 - RNA, 23 nt, Pseudomonas putida KT2440
ccagcucacgcaagcggcccuga

SEQ ID NO: 3549050 - RNA, 20 nt, Pseudomonas putida KT2440
ccagcucauccagccgcguc

SEQ ID NO: 3549051 - RNA, 20 nt, Pseudomonas putida KT2440
ccagcuccaccuuccacucu

SEQ ID NO: 3549052 - RNA, 14 nt, Pseudomonas putida KT2440
ccagcuccagcacc

SEQ ID NO: 3549053 - RNA, 23 nt, Pseudomonas putida KT2440
ccagcuccuggcccgcgcccuug

SEQ ID NO: 3549054 - RNA, 14 nt, Pseudomonas putida KT2440
ccaggcccgccaga

SEQ ID NO: 3549055 - RNA, 15 nt, Pseudomonas putida KT2440
ccaggcccgccagag

SEQ ID NO: 3549056 - RNA, 21 nt, Pseudomonas putida KT2440
ccaggcccgcuauccucgauc

SEQ ID NO: 3549057 - RNA, 15 nt, Pseudomonas putida KT2440
ccaggcccugacgcc

SEQ ID NO: 3549058 - RNA, 16 nt, Pseudomonas putida KT2440
ccaggcccugcagcgc

SEQ ID NO: 3549059 - RNA, 17 nt, Pseudomonas putida KT2440
ccaggcccugcagcgcu

SEQ ID NO: 3549060 - RNA, 19 nt, Pseudomonas putida KT2440
ccaggccgaucaccagcac

SEQ ID NO: 3549061 - RNA, 17 nt, Pseudomonas putida KT2440
ccaggccgauggcgaug

SEQ ID NO: 3549062 - RNA, 15 nt, Pseudomonas putida KT2440
ccaggccgcacgcgc

SEQ ID NO: 3549063 - RNA, 20 nt, Pseudomonas putida KT2440
ccaggccgcacgcgccucuu

SEQ ID NO: 3549064 - RNA, 14 nt, Pseudomonas putida KT2440
ccaggccgcccacc

SEQ ID NO: 3549065 - RNA, 18 nt, Pseudomonas putida KT2440
ccaggccgcccacccacc

SEQ ID NO: 3549066 - RNA, 15 nt, Pseudomonas putida KT2440
ccaggccucaagccu

SEQ ID NO: 3549067 - RNA, 19 nt, Pseudomonas putida KT2440
ccaggccucaagccucgcg

SEQ ID NO: 3549068 - RNA, 22 nt, Pseudomonas putida KT2440
ccaggccucaagccucgcgcaa

SEQ ID NO: 3549069 - RNA, 23 nt, Pseudomonas putida KT2440
ccaggccucaagccucgcgcaac

SEQ ID NO: 3549070 - RNA, 14 nt, Pseudomonas putida KT2440
ccaggccuggaugc

SEQ ID NO: 3549071 - RNA, 20 nt, Pseudomonas putida KT2440
ccaggccuggaugcguugcu

SEQ ID NO: 3549072 - RNA, 18 nt, Pseudomonas putida KT2440
ccaggccuuucagcgccc

SEQ ID NO: 3549073 - RNA, 21 nt, Pseudomonas putida KT2440
ccaggccuuucagcgcccaga

SEQ ID NO: 3549074 - RNA, 23 nt, Pseudomonas putida KT2440
ccaggccuuucagcgcccagaac

SEQ ID NO: 3549075 - RNA, 19 nt, Pseudomonas putida KT2440
ccaggccuuucugcucgaa

SEQ ID NO: 3549076 - RNA, 15 nt, Pseudomonas putida KT2440
ccaggcgaccaugcg

SEQ ID NO: 3549077 - RNA, 20 nt, Pseudomonas putida KT2440
ccaggcgacggaacggccgc

SEQ ID NO: 3549078 - RNA, 15 nt, Pseudomonas putida KT2440
ccaggcgcaagccuu

SEQ ID NO: 3549079 - RNA, 18 nt, Pseudomonas putida KT2440
ccaggcgcaaguagaacc

SEQ ID NO: 3549080 - RNA, 13 nt, Pseudomonas putida KT2440
ccaggcgcagcag

SEQ ID NO: 3549081 - RNA, 15 nt, Pseudomonas putida KT2440
ccaggcgcagcagcu

SEQ ID NO: 3549082 - RNA, 21 nt, Pseudomonas putida KT2440
ccaggcgcaucacgaaauccu

SEQ ID NO: 3549083 - RNA, 13 nt, Pseudomonas putida KT2440
ccaggcgccgagc

SEQ ID NO: 3549084 - RNA, 12 nt, Pseudomonas putida KT2440
ccaggcgcgccu

SEQ ID NO: 3549085 - RNA, 16 nt, Pseudomonas putida KT2440
ccaggcgcgccugcac

SEQ ID NO: 3549086 - RNA, 18 nt, Pseudomonas putida KT2440
ccaggcgcggcagcauga

SEQ ID NO: 3549087 - RNA, 15 nt, Pseudomonas putida KT2440
ccaggcgcgguucga

SEQ ID NO: 3549088 - RNA, 15 nt, Pseudomonas putida KT2440
ccaggcggccagcca

SEQ ID NO: 3549089 - RNA, 16 nt, Pseudomonas putida KT2440
ccaggcggccagccaa

SEQ ID NO: 3549090 - RNA, 14 nt, Pseudomonas putida KT2440
ccaggcggucggcc

SEQ ID NO: 3549091 - RNA, 17 nt, Pseudomonas putida KT2440
ccaggcggucggccagc

SEQ ID NO: 3549092 - RNA, 22 nt, Pseudomonas putida KT2440
ccaggcggucggccagcggcac

SEQ ID NO: 3549093 - RNA, 23 nt, Pseudomonas putida KT2440
ccaggcggugcacggccugcauc

SEQ ID NO: 3549094 - RNA, 17 nt, Pseudomonas putida KT2440
ccaggcguaaacccagg

SEQ ID NO: 3549095 - RNA, 13 nt, Pseudomonas putida KT2440
ccaggcuagccgg

SEQ ID NO: 3549096 - RNA, 21 nt, Pseudomonas putida KT2440
ccaggcuagccggucaccgac

SEQ ID NO: 3549097 - RNA, 13 nt, Pseudomonas putida KT2440
ccaggcucagcuc

SEQ ID NO: 3549098 - RNA, 14 nt, Pseudomonas putida KT2440
ccaggcucagcucg

SEQ ID NO: 3549099 - RNA, 19 nt, Pseudomonas putida KT2440
ccaggcucgcccgggucag

SEQ ID NO: 3549100 - RNA, 20 nt, Pseudomonas putida KT2440
ccaggcucgcccgggucagg

SEQ ID NO: 3549101 - RNA, 15 nt, Pseudomonas putida KT2440
ccaggcucucagccc

SEQ ID NO: 3549102 - RNA, 15 nt, Pseudomonas putida KT2440
ccaggcucuccagcc

SEQ ID NO: 3549103 - RNA, 17 nt, Pseudomonas putida KT2440
ccaggcugagcccggca

SEQ ID NO: 3549104 - RNA, 13 nt, Pseudomonas putida KT2440
ccaggcugcacug

SEQ ID NO: 3549105 - RNA, 14 nt, Pseudomonas putida KT2440
ccaggcugcgcauc

SEQ ID NO: 3549106 - RNA, 19 nt, Pseudomonas putida KT2440
ccaggcugcgcgccauggc

SEQ ID NO: 3549107 - RNA, 21 nt, Pseudomonas putida KT2440
ccaggcugcgcgccauggcga

SEQ ID NO: 3549108 - RNA, 12 nt, Pseudomonas putida KT2440
ccaggcuggcca

SEQ ID NO: 3549109 - RNA, 16 nt, Pseudomonas putida KT2440
ccaggcuggccaccac

SEQ ID NO: 3549110 - RNA, 18 nt, Pseudomonas putida KT2440
ccaggcuggccagcaagu

SEQ ID NO: 3549111 - RNA, 20 nt, Pseudomonas putida KT2440
ccaggcuggccagcaagugc

SEQ ID NO: 3549112 - RNA, 13 nt, Pseudomonas putida KT2440
ccaggcuggcgcu

SEQ ID NO: 3549113 - RNA, 21 nt, Pseudomonas putida KT2440
ccaggcuggcgcuaccccugu

SEQ ID NO: 3549114 - RNA, 21 nt, Pseudomonas putida KT2440
ccaggcuggcgcuuccuuccu

SEQ ID NO: 3549115 - RNA, 21 nt, Pseudomonas putida KT2440
ccaggcuugguuuggccucug

SEQ ID NO: 3549116 - RNA, 22 nt, Pseudomonas putida KT2440
ccaggcuugguuuggccucugg

SEQ ID NO: 3549117 - RNA, 16 nt, Pseudomonas putida KT2440
ccaggcuuuccagguc

SEQ ID NO: 3549118 - RNA, 17 nt, Pseudomonas putida KT2440
ccagggaaauuggccag

SEQ ID NO: 3549119 - RNA, 20 nt, Pseudomonas putida KT2440
ccagggaaauuggccagcag

SEQ ID NO: 3549120 - RNA, 18 nt, Pseudomonas putida KT2440
ccagggaagaauugcugg

SEQ ID NO: 3549121 - RNA, 23 nt, Pseudomonas putida KT2440
ccagggacgaacccuugaccuug

SEQ ID NO: 3549122 - RNA, 21 nt, Pseudomonas putida KT2440
ccagggcaaaaugcagcaagc

SEQ ID NO: 3549123 - RNA, 13 nt, Pseudomonas putida KT2440
ccagggcaagcaa

SEQ ID NO: 3549124 - RNA, 14 nt, Pseudomonas putida KT2440
ccagggcaucgacc

SEQ ID NO: 3549125 - RNA, 14 nt, Pseudomonas putida KT2440
ccagggcaucgauc

SEQ ID NO: 3549126 - RNA, 15 nt, Pseudomonas putida KT2440
ccagggcaucggaca

SEQ ID NO: 3549127 - RNA, 16 nt, Pseudomonas putida KT2440
ccagggcaucggcgcc

SEQ ID NO: 3549128 - RNA, 19 nt, Pseudomonas putida KT2440
ccagggcaucggcgccccg

SEQ ID NO: 3549129 - RNA, 13 nt, Pseudomonas putida KT2440
ccagggcccgccg

SEQ ID NO: 3549130 - RNA, 18 nt, Pseudomonas putida KT2440
ccagggcccucaacccuc

SEQ ID NO: 3549131 - RNA, 21 nt, Pseudomonas putida KT2440
ccagggcccucaacccucgcc

SEQ ID NO: 3549132 - RNA, 20 nt, Pseudomonas putida KT2440
ccagggccugaccgcccagc

SEQ ID NO: 3549133 - RNA, 16 nt, Pseudomonas putida KT2440
ccagggccuuggccug

SEQ ID NO: 3549134 - RNA, 18 nt, Pseudomonas putida KT2440
ccagggccuuggccuggg

SEQ ID NO: 3549135 - RNA, 18 nt, Pseudomonas putida KT2440
ccagggcgcaacgcccgc

SEQ ID NO: 3549136 - RNA, 18 nt, Pseudomonas putida KT2440
ccagggcgcgcuggcgca

SEQ ID NO: 3549137 - RNA, 12 nt, Pseudomonas putida KT2440
ccagggcgcugu

SEQ ID NO: 3549138 - RNA, 14 nt, Pseudomonas putida KT2440
ccagggcgucggca

SEQ ID NO: 3549139 - RNA, 21 nt, Pseudomonas putida KT2440
ccagggcugauugagcagcug

SEQ ID NO: 3549140 - RNA, 14 nt, Pseudomonas putida KT2440
ccagggcugcuuca

SEQ ID NO: 3549141 - RNA, 19 nt, Pseudomonas putida KT2440
ccagggcuggcagcgggua

SEQ ID NO: 3549142 - RNA, 22 nt, Pseudomonas putida KT2440
ccaggguacuugugugccugcu

SEQ ID NO: 3549143 - RNA, 16 nt, Pseudomonas putida KT2440
ccagggugccagacca

SEQ ID NO: 3549144 - RNA, 22 nt, Pseudomonas putida KT2440
ccaggguggcgauccacagcgg

SEQ ID NO: 3549145 - RNA, 16 nt, Pseudomonas putida KT2440
ccagguaaucaguucg

SEQ ID NO: 3549146 - RNA, 23 nt, Pseudomonas putida KT2440
ccagguaaucaguucgcagccca

SEQ ID NO: 3549147 - RNA, 14 nt, Pseudomonas putida KT2440
ccagguacaggcaa

SEQ ID NO: 3549148 - RNA, 15 nt, Pseudomonas putida KT2440
ccagguacaggcaaa

SEQ ID NO: 3549149 - RNA, 15 nt, Pseudomonas putida KT2440
ccagguaguacggca

SEQ ID NO: 3549150 - RNA, 20 nt, Pseudomonas putida KT2440
ccagguaguacggcaggcga

SEQ ID NO: 3549151 - RNA, 18 nt, Pseudomonas putida KT2440
ccagguaucgcaccgugc

SEQ ID NO: 3549152 - RNA, 14 nt, Pseudomonas putida KT2440
ccagguauucggca

SEQ ID NO: 3549153 - RNA, 17 nt, Pseudomonas putida KT2440
ccaggucacgguccauc

SEQ ID NO: 3549154 - RNA, 13 nt, Pseudomonas putida KT2440
ccagguccaccag

SEQ ID NO: 3549155 - RNA, 14 nt, Pseudomonas putida KT2440
ccagguccaccagc

SEQ ID NO: 3549156 - RNA, 18 nt, Pseudomonas putida KT2440
ccagguccgguaacuggc

SEQ ID NO: 3549157 - RNA, 19 nt, Pseudomonas putida KT2440
ccagguccgguaacuggcc

SEQ ID NO: 3549158 - RNA, 15 nt, Pseudomonas putida KT2440
ccagguccugcucca

SEQ ID NO: 3549159 - RNA, 14 nt, Pseudomonas putida KT2440
ccaggucgccagca

SEQ ID NO: 3549160 - RNA, 16 nt, Pseudomonas putida KT2440
ccaguuccucggccug

SEQ ID NO: 3549161 - RNA, 14 nt, Pseudomonas putida KT2440
ccaguuccugcuug

SEQ ID NO: 3549162 - RNA, 19 nt, Pseudomonas putida KT2440
ccaguucgacgcugcuguc

SEQ ID NO: 3549163 - RNA, 23 nt, Pseudomonas putida KT2440
ccaguucgcggcgcaccgcuugc

SEQ ID NO: 3549164 - RNA, 19 nt, Pseudomonas putida KT2440
ccaguucggacaggcgcuu

SEQ ID NO: 3549165 - RNA, 16 nt, Pseudomonas putida KT2440
ccaguucuccggcagg

SEQ ID NO: 3549166 - RNA, 18 nt, Pseudomonas putida KT2440
ccaguugcuccaccugcc

SEQ ID NO: 3549167 - RNA, 15 nt, Pseudomonas putida KT2440
ccaguugcuucugca

SEQ ID NO: 3549168 - RNA, 12 nt, Pseudomonas putida KT2440
ccaguuggcagg

SEQ ID NO: 3549169 - RNA, 19 nt, Pseudomonas putida KT2440
ccaguuggcggcgcagcgc

SEQ ID NO: 3549170 - RNA, 21 nt, Pseudomonas putida KT2440
ccaguuggcggcgcagcgcac

SEQ ID NO: 3549171 - RNA, 22 nt, Pseudomonas putida KT2440
ccaguuggcguauuuuggcagg

SEQ ID NO: 3549172 - RNA, 21 nt, Pseudomonas putida KT2440
ccaguuguugggcagccacgc

SEQ ID NO: 3549173 - RNA, 17 nt, Pseudomonas putida KT2440
ccaguuucaccugacca

SEQ ID NO: 3549174 - RNA, 23 nt, Pseudomonas putida KT2440
ccauaaaaaaacccgcugaucgc

SEQ ID NO: 3549175 - RNA, 20 nt, Pseudomonas putida KT2440
ccauaaaagccucagcgccc

SEQ ID NO: 3549176 - RNA, 21 nt, Pseudomonas putida KT2440
ccauaaaagccucagcgcccg

SEQ ID NO: 3549177 - RNA, 15 nt, Pseudomonas putida KT2440
ccauaaaccccagcc

SEQ ID NO: 3549178 - RNA, 16 nt, Pseudomonas putida KT2440
ccauaaaccccagccu

SEQ ID NO: 3549179 - RNA, 16 nt, Pseudomonas putida KT2440
ccauaacgcccacguu

SEQ ID NO: 3549180 - RNA, 14 nt, Pseudomonas putida KT2440
ccauaacuccagcg

SEQ ID NO: 3549181 - RNA, 17 nt, Pseudomonas putida KT2440
ccauaacuccagcgcca

SEQ ID NO: 3549182 - RNA, 18 nt, Pseudomonas putida KT2440
ccauaacuccagcgccag

SEQ ID NO: 3549183 - RNA, 17 nt, Pseudomonas putida KT2440
ccauaccaauggcaauc

SEQ ID NO: 3549184 - RNA, 19 nt, Pseudomonas putida KT2440
ccauaccucccgcacugcu

SEQ ID NO: 3549185 - RNA, 22 nt, Pseudomonas putida KT2440
ccauaccucccgcacugcugcc

SEQ ID NO: 3549186 - RNA, 15 nt, Pseudomonas putida KT2440
ccauaccucuucacu

SEQ ID NO: 3549187 - RNA, 14 nt, Pseudomonas putida KT2440
ccauagcaccagcg

SEQ ID NO: 3549188 - RNA, 15 nt, Pseudomonas putida KT2440
ccauagcaccagcgg

SEQ ID NO: 3549189 - RNA, 18 nt, Pseudomonas putida KT2440
ccauagcaccagcgggcc

SEQ ID NO: 3549190 - RNA, 20 nt, Pseudomonas putida KT2440
ccauagccugcugcucccca

SEQ ID NO: 3549191 - RNA, 17 nt, Pseudomonas putida KT2440
ccauagcgcugcaccga

SEQ ID NO: 3549192 - RNA, 21 nt, Pseudomonas putida KT2440
ccauagcguugucgacugcac

SEQ ID NO: 3549193 - RNA, 16 nt, Pseudomonas putida KT2440
ccauaggccgccugcc

SEQ ID NO: 3549194 - RNA, 14 nt, Pseudomonas putida KT2440
ccauaguugaccag

SEQ ID NO: 3549195 - RNA, 18 nt, Pseudomonas putida KT2440
ccauaugaaaaggcccug

SEQ ID NO: 3549196 - RNA, 14 nt, Pseudomonas putida KT2440
ccaucaaggccgac

SEQ ID NO: 3549197 - RNA, 23 nt, Pseudomonas putida KT2440
ccaucaauaccggcaugcccagu

SEQ ID NO: 3549198 - RNA, 14 nt, Pseudomonas putida KT2440
ccaucaccaaaggc

SEQ ID NO: 3549199 - RNA, 14 nt, Pseudomonas putida KT2440
ccaucaccagcccg

SEQ ID NO: 3549200 - RNA, 22 nt, Pseudomonas putida KT2440
ccaucaccaguuuuuguaccug

SEQ ID NO: 3549201 - RNA, 13 nt, Pseudomonas putida KT2440
ccaucaccgccag

SEQ ID NO: 3549202 - RNA, 18 nt, Pseudomonas putida KT2440
ccaucaccgccagcaugg

SEQ ID NO: 3549203 - RNA, 14 nt, Pseudomonas putida KT2440
ccaucaccgcccgc

SEQ ID NO: 3549204 - RNA, 13 nt, Pseudomonas putida KT2440
ccaucacggccug

SEQ ID NO: 3549205 - RNA, 20 nt, Pseudomonas putida KT2440
ccaucacuuccggcugcagc

SEQ ID NO: 3549206 - RNA, 15 nt, Pseudomonas putida KT2440
ccaucagagcgccag

SEQ ID NO: 3549207 - RNA, 15 nt, Pseudomonas putida KT2440
ccaucagcagcugcc

SEQ ID NO: 3549208 - RNA, 16 nt, Pseudomonas putida KT2440
ccaucagcagcugccg

SEQ ID NO: 3549209 - RNA, 12 nt, Pseudomonas putida KT2440
ccaucagcgccg

SEQ ID NO: 3549210 - RNA, 14 nt, Pseudomonas putida KT2440
ccaucaggaacagc

SEQ ID NO: 3549211 - RNA, 19 nt, Pseudomonas putida KT2440
ccaucaggaacagcucgau

SEQ ID NO: 3549212 - RNA, 17 nt, Pseudomonas putida KT2440
ccaucaggcacaggcca

SEQ ID NO: 3549213 - RNA, 18 nt, Pseudomonas putida KT2440
ccaucaggcacaggccag

SEQ ID NO: 3549214 - RNA, 21 nt, Pseudomonas putida KT2440
ccaucaggcacaggccagcca

SEQ ID NO: 3549215 - RNA, 14 nt, Pseudomonas putida KT2440
ccaucaggcagcuc

SEQ ID NO: 3549216 - RNA, 22 nt, Pseudomonas putida KT2440
ccaucagguauugcgcaaggcc

SEQ ID NO: 3549217 - RNA, 18 nt, Pseudomonas putida KT2440
ccaucagugcccccgcca

SEQ ID NO: 3549218 - RNA, 20 nt, Pseudomonas putida KT2440
ccaucagugcccccgccaca

SEQ ID NO: 3549219 - RNA, 18 nt, Pseudomonas putida KT2440
ccaucaguugcagcaacg

SEQ ID NO: 3549220 - RNA, 20 nt, Pseudomonas putida KT2440
ccaucaguugcagcaacgcc

SEQ ID NO: 3549221 - RNA, 14 nt, Pseudomonas putida KT2440
ccauccaacgcauc

SEQ ID NO: 3549222 - RNA, 17 nt, Pseudomonas putida KT2440
ccauccacaucgccagg

SEQ ID NO: 3549223 - RNA, 17 nt, Pseudomonas putida KT2440
ccauccaccagccccag

SEQ ID NO: 3549224 - RNA, 15 nt, Pseudomonas putida KT2440
ccauccaccgcgcca

SEQ ID NO: 3549225 - RNA, 16 nt, Pseudomonas putida KT2440
ccauccaccgcgccag

SEQ ID NO: 3549226 - RNA, 17 nt, Pseudomonas putida KT2440
ccauccaccgcgccagc

SEQ ID NO: 3549227 - RNA, 20 nt, Pseudomonas putida KT2440
ccauccagcggcgacaggug

SEQ ID NO: 3549228 - RNA, 16 nt, Pseudomonas putida KT2440
ccauccagggcuuccu

SEQ ID NO: 3549229 - RNA, 17 nt, Pseudomonas putida KT2440
ccauccagggcuuccug

SEQ ID NO: 3549230 - RNA, 18 nt, Pseudomonas putida KT2440
ccauccagggcuuccugc

SEQ ID NO: 3549231 - RNA, 17 nt, Pseudomonas putida KT2440
ccauccaguccgccagc

SEQ ID NO: 3549232 - RNA, 17 nt, Pseudomonas putida KT2440
ccauccagucggcgcug

SEQ ID NO: 3549233 - RNA, 18 nt, Pseudomonas putida KT2440
ccauccaguucauugcga

SEQ ID NO: 3549234 - RNA, 13 nt, Pseudomonas putida KT2440
ccaucccgcuucg

SEQ ID NO: 3549235 - RNA, 15 nt, Pseudomonas putida KT2440
ccaucccgcuucgcc

SEQ ID NO: 3549236 - RNA, 18 nt, Pseudomonas putida KT2440
ccaucccgcuucgccagc

SEQ ID NO: 3549237 - RNA, 19 nt, Pseudomonas putida KT2440
ccaucccgcuucgccagcg

SEQ ID NO: 3549238 - RNA, 23 nt, Pseudomonas putida KT2440
ccaucccgcuucgccagcgccac

SEQ ID NO: 3549239 - RNA, 16 nt, Pseudomonas putida KT2440
ccauccucggccaggc

SEQ ID NO: 3549240 - RNA, 18 nt, Pseudomonas putida KT2440
ccauccucggccaggccc

SEQ ID NO: 3549241 - RNA, 12 nt, Pseudomonas putida KT2440
ccauccugcugu

SEQ ID NO: 3549242 - RNA, 20 nt, Pseudomonas putida KT2440
ccauccuugaagaacaccug

SEQ ID NO: 3549243 - RNA, 13 nt, Pseudomonas putida KT2440
ccaucgaccuggc

SEQ ID NO: 3549244 - RNA, 18 nt, Pseudomonas putida KT2440
ccaucgaggaaguggcag

SEQ ID NO: 3549245 - RNA, 20 nt, Pseudomonas putida KT2440
ccaucgaguaucgccucgau

SEQ ID NO: 3549246 - RNA, 19 nt, Pseudomonas putida KT2440
ccaucgauauggaucccac

SEQ ID NO: 3549247 - RNA, 15 nt, Pseudomonas putida KT2440
ccaucgcacacccug

SEQ ID NO: 3549248 - RNA, 15 nt, Pseudomonas putida KT2440
ccaucgcagaaggcc

SEQ ID NO: 3549249 - RNA, 23 nt, Pseudomonas putida KT2440
ccaucgcagggucgcgccccaag

SEQ ID NO: 3549250 - RNA, 16 nt, Pseudomonas putida KT2440
ccaucgcccacggcga

SEQ ID NO: 3549251 - RNA, 13 nt, Pseudomonas putida KT2440
ccaucggccagga

SEQ ID NO: 3549252 - RNA, 13 nt, Pseudomonas putida KT2440
ccaucggccggcu

SEQ ID NO: 3549253 - RNA, 15 nt, Pseudomonas putida KT2440
ccaucuaagccucca

SEQ ID NO: 3549254 - RNA, 16 nt, Pseudomonas putida KT2440
ccaucuaagccuccag

SEQ ID NO: 3549255 - RNA, 18 nt, Pseudomonas putida KT2440
ccaucucaggcccaccag

SEQ ID NO: 3549256 - RNA, 15 nt, Pseudomonas putida KT2440
ccaucuccagcucaa

SEQ ID NO: 3549257 - RNA, 21 nt, Pseudomonas putida KT2440
ccaucuccagcucgccgccca

SEQ ID NO: 3549258 - RNA, 21 nt, Pseudomonas putida KT2440
ccaucuucucgcgcaggcggu

SEQ ID NO: 3549259 - RNA, 15 nt, Pseudomonas putida KT2440
ccaucuucugcagcc

SEQ ID NO: 3549260 - RNA, 20 nt, Pseudomonas putida KT2440
ccaucuucugcagccaccac

SEQ ID NO: 3549261 - RNA, 14 nt, Pseudomonas putida KT2440
ccaucuugcccagg

SEQ ID NO: 3549262 - RNA, 23 nt, Pseudomonas putida KT2440
ccaucuugcgugcaugggccagg

SEQ ID NO: 3549263 - RNA, 12 nt, Pseudomonas putida KT2440
ccaucuugcugc

SEQ ID NO: 3549264 - RNA, 13 nt, Pseudomonas putida KT2440
ccaucuugcugcu

SEQ ID NO: 3549265 - RNA, 15 nt, Pseudomonas putida KT2440
ccaucuugcugcucu

SEQ ID NO: 3549266 - RNA, 22 nt, Pseudomonas putida KT2440
cccaagcggcacuaccaggccc

SEQ ID NO: 3549267 - RNA, 12 nt, Pseudomonas putida KT2440
cccaagcgggcc

SEQ ID NO: 3549268 - RNA, 19 nt, Pseudomonas putida KT2440
cccaaggccugcaccauuu

SEQ ID NO: 3549269 - RNA, 22 nt, Pseudomonas putida KT2440
cccaaggcugccaaucaacccg

SEQ ID NO: 3549270 - RNA, 22 nt, Pseudomonas putida KT2440
cccaaguacaacugccacccuc

SEQ ID NO: 3549271 - RNA, 15 nt, Pseudomonas putida KT2440
cccaaguacaccggc

SEQ ID NO: 3549272 - RNA, 19 nt, Pseudomonas putida KT2440
cccaaguacaccggcagca

SEQ ID NO: 3549273 - RNA, 18 nt, Pseudomonas putida KT2440
cccaagugccagaaccag

SEQ ID NO: 3549274 - RNA, 23 nt, Pseudomonas putida KT2440
cccaauaaaaaaccggccaagcg

SEQ ID NO: 3549275 - RNA, 15 nt, Pseudomonas putida KT2440
cccaauaaaaacaac

SEQ ID NO: 3549276 - RNA, 17 nt, Pseudomonas putida KT2440
cccaauaauaaaaaaag

SEQ ID NO: 3549277 - RNA, 14 nt, Pseudomonas putida KT2440
cccaaucaccagga

SEQ ID NO: 3549278 - RNA, 18 nt, Pseudomonas putida KT2440
cccaaucggguaaaacgc

SEQ ID NO: 3549279 - RNA, 13 nt, Pseudomonas putida KT2440
cccaaucuccagc

SEQ ID NO: 3549280 - RNA, 20 nt, Pseudomonas putida KT2440
cccaauggacgcgcaagccg

SEQ ID NO: 3549281 - RNA, 16 nt, Pseudomonas putida KT2440
cccaaugggcaccggc

SEQ ID NO: 3549282 - RNA, 20 nt, Pseudomonas putida KT2440
cccaaugggcaccggccacc

SEQ ID NO: 3549283 - RNA, 14 nt, Pseudomonas putida KT2440
cccacaaaggccgc

SEQ ID NO: 3549284 - RNA, 14 nt, Pseudomonas putida KT2440
cccacacaccgcaa

SEQ ID NO: 3549285 - RNA, 15 nt, Pseudomonas putida KT2440
cccacacccgcgcgu

SEQ ID NO: 3549286 - RNA, 20 nt, Pseudomonas putida KT2440
cccacacccgcgcguugcgg

SEQ ID NO: 3549287 - RNA, 13 nt, Pseudomonas putida KT2440
cccacagagccgc

SEQ ID NO: 3549288 - RNA, 13 nt, Pseudomonas putida KT2440
cccacagcgccug

SEQ ID NO: 3549289 - RNA, 20 nt, Pseudomonas putida KT2440
cccacagcgccugcugcugg

SEQ ID NO: 3549290 - RNA, 19 nt, Pseudomonas putida KT2440
cccacaggaaucaccagac

SEQ ID NO: 3549291 - RNA, 17 nt, Pseudomonas putida KT2440
cccacaggaauuacgca

SEQ ID NO: 3549292 - RNA, 13 nt, Pseudomonas putida KT2440
cccacaggcacag

SEQ ID NO: 3549293 - RNA, 16 nt, Pseudomonas putida KT2440
cccacaggcacaggcc

SEQ ID NO: 3549294 - RNA, 22 nt, Pseudomonas putida KT2440
cccacaggcacaggcccagcaa

SEQ ID NO: 3549295 - RNA, 21 nt, Pseudomonas putida KT2440
cccacaggcacgacugaacac

SEQ ID NO: 3549296 - RNA, 15 nt, Pseudomonas putida KT2440
cccacagggaccgca

SEQ ID NO: 3549297 - RNA, 21 nt, Pseudomonas putida KT2440
cccacagggaucgcgccagcu

SEQ ID NO: 3549298 - RNA, 13 nt, Pseudomonas putida KT2440
cccacagguccag

SEQ ID NO: 3549299 - RNA, 16 nt, Pseudomonas putida KT2440
cccacagguccagcgc

SEQ ID NO: 3549300 - RNA, 18 nt, Pseudomonas putida KT2440
cccacaggugcagcacag

SEQ ID NO: 3549301 - RNA, 20 nt, Pseudomonas putida KT2440
cccacaggugcagcacaggu

SEQ ID NO: 3549302 - RNA, 20 nt, Pseudomonas putida KT2440
cccacagugucccggccagg

SEQ ID NO: 3549303 - RNA, 19 nt, Pseudomonas putida KT2440
cccacauagcgcacuugca

SEQ ID NO: 3549304 - RNA, 19 nt, Pseudomonas putida KT2440
cccacauguaaugaaaauc

SEQ ID NO: 3549305 - RNA, 22 nt, Pseudomonas putida KT2440
cccaccaagggugucaacaggc

SEQ ID NO: 3549306 - RNA, 23 nt, Pseudomonas putida KT2440
cccaccaauuacucggcccauuc

SEQ ID NO: 3549307 - RNA, 18 nt, Pseudomonas putida KT2440
cccaccacaaaccacagc

SEQ ID NO: 3549308 - RNA, 23 nt, Pseudomonas putida KT2440
cccaccacaaaccacagcggcca

SEQ ID NO: 3549309 - RNA, 21 nt, Pseudomonas putida KT2440
cccaccacgaacgcccccagc

SEQ ID NO: 3549310 - RNA, 18 nt, Pseudomonas putida KT2440
cccaccacggccuggccu

SEQ ID NO: 3549311 - RNA, 15 nt, Pseudomonas putida KT2440
cccaccagcacugcc

SEQ ID NO: 3549312 - RNA, 22 nt, Pseudomonas putida KT2440
cccaccagcacugccuugcccu

SEQ ID NO: 3549313 - RNA, 16 nt, Pseudomonas putida KT2440
cccaccagcacugcug

SEQ ID NO: 3549314 - RNA, 21 nt, Pseudomonas putida KT2440
cccaccagcacugcugcgcag

SEQ ID NO: 3549315 - RNA, 22 nt, Pseudomonas putida KT2440
cccaccagcacugcugcgcagu

SEQ ID NO: 3549316 - RNA, 13 nt, Pseudomonas putida KT2440
cccaccagcucca

SEQ ID NO: 3549317 - RNA, 18 nt, Pseudomonas putida KT2440
cccaccagcugcaccacc

SEQ ID NO: 3549318 - RNA, 18 nt, Pseudomonas putida KT2440
cccaccaggauuggccgc

SEQ ID NO: 3549319 - RNA, 20 nt, Pseudomonas putida KT2440
cccaccaggauuggccgcaa

SEQ ID NO: 3549320 - RNA, 12 nt, Pseudomonas putida KT2440
cccaccaggcac

SEQ ID NO: 3549321 - RNA, 13 nt, Pseudomonas putida KT2440
cccaccaggcacc

SEQ ID NO: 3549322 - RNA, 21 nt, Pseudomonas putida KT2440
cccaccagucugcucagccaa

SEQ ID NO: 3549323 - RNA, 14 nt, Pseudomonas putida KT2440
cccacccaaccgcg

SEQ ID NO: 3549324 - RNA, 22 nt, Pseudomonas putida KT2440
cccacccauuccgccgucaccg

SEQ ID NO: 3549325 - RNA, 14 nt, Pseudomonas putida KT2440
cccaccccagcguu

SEQ ID NO: 3549326 - RNA, 18 nt, Pseudomonas putida KT2440
cccaccccagcguuccug

SEQ ID NO: 3549327 - RNA, 21 nt, Pseudomonas putida KT2440
cccacccucgcacuccgcccg

SEQ ID NO: 3549328 - RNA, 22 nt, Pseudomonas putida KT2440
cccacccucguaacgagccuug

SEQ ID NO: 3549329 - RNA, 18 nt, Pseudomonas putida KT2440
cccaccgcaggucacugc

SEQ ID NO: 3549330 - RNA, 19 nt, Pseudomonas putida KT2440
cccaccgcguuggccaggu

SEQ ID NO: 3549331 - RNA, 17 nt, Pseudomonas putida KT2440
cccaccggccgccgcca

SEQ ID NO: 3549332 - RNA, 17 nt, Pseudomonas putida KT2440
cccacgaucucacgcgc

SEQ ID NO: 3549333 - RNA, 23 nt, Pseudomonas putida KT2440
cccacgcacaucguccgccgcgc

SEQ ID NO: 3549334 - RNA, 12 nt, Pseudomonas putida KT2440
cccacgccaugu

SEQ ID NO: 3549335 - RNA, 16 nt, Pseudomonas putida KT2440
cccacgcccaggcggc

SEQ ID NO: 3549336 - RNA, 11 nt, Pseudomonas putida KT2440
cccacgccgac

SEQ ID NO: 3549337 - RNA, 15 nt, Pseudomonas putida KT2440
cccacgccggcaacc

SEQ ID NO: 3549338 - RNA, 15 nt, Pseudomonas putida KT2440
cccacgcggguccag

SEQ ID NO: 3549339 - RNA, 22 nt, Pseudomonas putida KT2440
cccacgcucuguaucgaacagg

SEQ ID NO: 3549340 - RNA, 13 nt, Pseudomonas putida KT2440
cccacggccgcca

SEQ ID NO: 3549341 - RNA, 14 nt, Pseudomonas putida KT2440
cccacggcguccag

SEQ ID NO: 3549342 - RNA, 18 nt, Pseudomonas putida KT2440
cccacggcguccaggccc

SEQ ID NO: 3549343 - RNA, 19 nt, Pseudomonas putida KT2440
cccacuucaauggcacccu

SEQ ID NO: 3549344 - RNA, 19 nt, Pseudomonas putida KT2440
cccacuucugcggccaggg

SEQ ID NO: 3549345 - RNA, 20 nt, Pseudomonas putida KT2440
cccacuuggaaaacagcgcg

SEQ ID NO: 3549346 - RNA, 23 nt, Pseudomonas putida KT2440
cccacuuggaaaacagcgcgcga

SEQ ID NO: 3549347 - RNA, 17 nt, Pseudomonas putida KT2440
cccagaacagccacagc

SEQ ID NO: 3549348 - RNA, 18 nt, Pseudomonas putida KT2440
cccagaacagccacagcu

SEQ ID NO: 3549349 - RNA, 21 nt, Pseudomonas putida KT2440
cccagaacuucaccccguaca

SEQ ID NO: 3549350 - RNA, 18 nt, Pseudomonas putida KT2440
cccagaauguugcaagga

SEQ ID NO: 3549351 - RNA, 19 nt, Pseudomonas putida KT2440
cccagauagccauugcggc

SEQ ID NO: 3549352 - RNA, 16 nt, Pseudomonas putida KT2440
cccagaucagcagcac

SEQ ID NO: 3549353 - RNA, 20 nt, Pseudomonas putida KT2440
cccagaugcgggcccugguc

SEQ ID NO: 3549354 - RNA, 17 nt, Pseudomonas putida KT2440
cccagauucuggcaggc

SEQ ID NO: 3549355 - RNA, 12 nt, Pseudomonas putida KT2440
cccagcaacagc

SEQ ID NO: 3549356 - RNA, 14 nt, Pseudomonas putida KT2440
cccagcaacagccc

SEQ ID NO: 3549357 - RNA, 14 nt, Pseudomonas putida KT2440
cccagcaacggauu

SEQ ID NO: 3549358 - RNA, 15 nt, Pseudomonas putida KT2440
cccagcaacugcgcc

SEQ ID NO: 3549359 - RNA, 17 nt, Pseudomonas putida KT2440
cccagcaacugcgccca

SEQ ID NO: 3549360 - RNA, 20 nt, Pseudomonas putida KT2440
cccagcaauucagaagucca

SEQ ID NO: 3549361 - RNA, 21 nt, Pseudomonas putida KT2440
cccagcacagauaaaccugcc

SEQ ID NO: 3549362 - RNA, 19 nt, Pseudomonas putida KT2440
cccagcaccacccaccagc

SEQ ID NO: 3549363 - RNA, 18 nt, Pseudomonas putida KT2440
cccagcacccgcaggcga

SEQ ID NO: 3549364 - RNA, 12 nt, Pseudomonas putida KT2440
cccagcacuucg

SEQ ID NO: 3549365 - RNA, 19 nt, Pseudomonas putida KT2440
cccagcagcaacgcaucga

SEQ ID NO: 3549366 - RNA, 15 nt, Pseudomonas putida KT2440
cccagcagccaacgc

SEQ ID NO: 3549367 - RNA, 14 nt, Pseudomonas putida KT2440
cccagcagcgggca

SEQ ID NO: 3549368 - RNA, 15 nt, Pseudomonas putida KT2440
cccagcagcgggcac

SEQ ID NO: 3549369 - RNA, 22 nt, Pseudomonas putida KT2440
cccagcagcgggcacaggccgc

SEQ ID NO: 3549370 - RNA, 18 nt, Pseudomonas putida KT2440
cccagcagguacaccgcc

SEQ ID NO: 3549371 - RNA, 22 nt, Pseudomonas putida KT2440
cccaguggcacaccaugggcaa

SEQ ID NO: 3549372 - RNA, 20 nt, Pseudomonas putida KT2440
cccagugugcaaacacccag

SEQ ID NO: 3549373 - RNA, 21 nt, Pseudomonas putida KT2440
cccagugugcaaacacccagc

SEQ ID NO: 3549374 - RNA, 18 nt, Pseudomonas putida KT2440
cccaguucacgcaggcgc

SEQ ID NO: 3549375 - RNA, 18 nt, Pseudomonas putida KT2440
cccaguuccaguucgcca

SEQ ID NO: 3549376 - RNA, 14 nt, Pseudomonas putida KT2440
cccaguuccaugcg

SEQ ID NO: 3549377 - RNA, 19 nt, Pseudomonas putida KT2440
cccaguucgcggaucugcu

SEQ ID NO: 3549378 - RNA, 19 nt, Pseudomonas putida KT2440
cccaguucguccaccgacg

SEQ ID NO: 3549379 - RNA, 15 nt, Pseudomonas putida KT2440
cccaguucuccggca

SEQ ID NO: 3549380 - RNA, 16 nt, Pseudomonas putida KT2440
cccaguucuuggcggc

SEQ ID NO: 3549381 - RNA, 17 nt, Pseudomonas putida KT2440
cccaguucuuggcggcu

SEQ ID NO: 3549382 - RNA, 20 nt, Pseudomonas putida KT2440
cccaguugaucaacccgugc

SEQ ID NO: 3549383 - RNA, 14 nt, Pseudomonas putida KT2440
cccauaaaagccuc

SEQ ID NO: 3549384 - RNA, 15 nt, Pseudomonas putida KT2440
cccauaaaagccuca

SEQ ID NO: 3549385 - RNA, 16 nt, Pseudomonas putida KT2440
cccauaaaccccagcc

SEQ ID NO: 3549386 - RNA, 17 nt, Pseudomonas putida KT2440
cccauaccucuucacug

SEQ ID NO: 3549387 - RNA, 19 nt, Pseudomonas putida KT2440
cccauaccucuucacugcu

SEQ ID NO: 3549388 - RNA, 21 nt, Pseudomonas putida KT2440
cccauaccucuucacugcuca

SEQ ID NO: 3549389 - RNA, 22 nt, Pseudomonas putida KT2440
cccauaccucuucacugcucau

SEQ ID NO: 3549390 - RNA, 19 nt, Pseudomonas putida KT2440
cccauagggccagcggcuu

SEQ ID NO: 3549391 - RNA, 23 nt, Pseudomonas putida KT2440
cccauaucaggcaugccagcagc

SEQ ID NO: 3549392 - RNA, 19 nt, Pseudomonas putida KT2440
cccaucaccagcccgaagc

SEQ ID NO: 3549393 - RNA, 15 nt, Pseudomonas putida KT2440
cccaucaccggcacc

SEQ ID NO: 3549394 - RNA, 14 nt, Pseudomonas putida KT2440
cccaucacgcggua

SEQ ID NO: 3549395 - RNA, 13 nt, Pseudomonas putida KT2440
cccaucagcagcu

SEQ ID NO: 3549396 - RNA, 13 nt, Pseudomonas putida KT2440
cccaucagcgccg

SEQ ID NO: 3549397 - RNA, 15 nt, Pseudomonas putida KT2440
cccaucagcgccgcc

SEQ ID NO: 3549398 - RNA, 16 nt, Pseudomonas putida KT2440
cccaucagcgccgcca

SEQ ID NO: 3549399 - RNA, 20 nt, Pseudomonas putida KT2440
cccaucauucgauagccugc

SEQ ID NO: 3549400 - RNA, 16 nt, Pseudomonas putida KT2440
cccaucccgcuucgcc

SEQ ID NO: 3549401 - RNA, 15 nt, Pseudomonas putida KT2440
cccaucgcacacccu

SEQ ID NO: 3549402 - RNA, 21 nt, Pseudomonas putida KT2440
cccaucggcacccgcacaugc

SEQ ID NO: 3549403 - RNA, 15 nt, Pseudomonas putida KT2440
cccaucugcucgcca

SEQ ID NO: 3549404 - RNA, 14 nt, Pseudomonas putida KT2440
cccaugaagcggcc

SEQ ID NO: 3549405 - RNA, 19 nt, Pseudomonas putida KT2440
cccaugacguucuucggca

SEQ ID NO: 3549406 - RNA, 22 nt, Pseudomonas putida KT2440
cccaugacguucuucggcaggu

SEQ ID NO: 3549407 - RNA, 18 nt, Pseudomonas putida KT2440
cccaugaucgcggcaaug

SEQ ID NO: 3549408 - RNA, 15 nt, Pseudomonas putida KT2440
cccaugaucuugcug

SEQ ID NO: 3549409 - RNA, 18 nt, Pseudomonas putida KT2440
cccaugaucuugcugccg

SEQ ID NO: 3549410 - RNA, 13 nt, Pseudomonas putida KT2440
cccaugccaagcc

SEQ ID NO: 3549411 - RNA, 19 nt, Pseudomonas putida KT2440
cccaugccaagcccacaca

SEQ ID NO: 3549412 - RNA, 19 nt, Pseudomonas putida KT2440
cccaugcccagcucgcugg

SEQ ID NO: 3549413 - RNA, 21 nt, Pseudomonas putida KT2440
cccaugcgaccaguaccgcgc

SEQ ID NO: 3549414 - RNA, 21 nt, Pseudomonas putida KT2440
cccaugcugcagaaccgccag

SEQ ID NO: 3549415 - RNA, 13 nt, Pseudomonas putida KT2440
cccauggccaggc

SEQ ID NO: 3549416 - RNA, 22 nt, Pseudomonas putida KT2440
cccauggccaggcugucggcgu

SEQ ID NO: 3549417 - RNA, 14 nt, Pseudomonas putida KT2440
cccauggcgcagcu

SEQ ID NO: 3549418 - RNA, 16 nt, Pseudomonas putida KT2440
cccauggcuccaccca

SEQ ID NO: 3549419 - RNA, 15 nt, Pseudomonas putida KT2440
cccauggcuggcagc

SEQ ID NO: 3549420 - RNA, 19 nt, Pseudomonas putida KT2440
cccauguagaccaccagcg

SEQ ID NO: 3549421 - RNA, 18 nt, Pseudomonas putida KT2440
cccaugucgaucagcggc

SEQ ID NO: 3549422 - RNA, 19 nt, Pseudomonas putida KT2440
cccauucgcgggcaagccc

SEQ ID NO: 3549423 - RNA, 21 nt, Pseudomonas putida KT2440
cccauucgcggguaaacccgc

SEQ ID NO: 3549424 - RNA, 23 nt, Pseudomonas putida KT2440
cccauucgcggguaaacccgcgc

SEQ ID NO: 3549425 - RNA, 20 nt, Pseudomonas putida KT2440
ccccaaaaaaucuagcgcaa

SEQ ID NO: 3549426 - RNA, 15 nt, Pseudomonas putida KT2440
ccccaaaccaggccg

SEQ ID NO: 3549427 - RNA, 13 nt, Pseudomonas putida KT2440
ccccaacaacagu

SEQ ID NO: 3549428 - RNA, 13 nt, Pseudomonas putida KT2440
ccccaacccacca

SEQ ID NO: 3549429 - RNA, 12 nt, Pseudomonas putida KT2440
ccccaacccggu

SEQ ID NO: 3549430 - RNA, 15 nt, Pseudomonas putida KT2440
ccccaacccgguccc

SEQ ID NO: 3549431 - RNA, 21 nt, Pseudomonas putida KT2440
ccccaaccuuccagcaaagug

SEQ ID NO: 3549432 - RNA, 13 nt, Pseudomonas putida KT2440
ccccaagcgccug

SEQ ID NO: 3549433 - RNA, 15 nt, Pseudomonas putida KT2440
ccccaagcuucaccu

SEQ ID NO: 3549434 - RNA, 14 nt, Pseudomonas putida KT2440
ccccaaggcugcca

SEQ ID NO: 3549435 - RNA, 16 nt, Pseudomonas putida KT2440
ccccaaggcugccaau

SEQ ID NO: 3549436 - RNA, 17 nt, Pseudomonas putida KT2440
ccccaaucccaacucca

SEQ ID NO: 3549437 - RNA, 20 nt, Pseudomonas putida KT2440
ccccaauggcgaaccccagu

SEQ ID NO: 3549438 - RNA, 16 nt, Pseudomonas putida KT2440
ccccacaacggccgca

SEQ ID NO: 3549439 - RNA, 20 nt, Pseudomonas putida KT2440
ccccacagagccgcaaagcg

SEQ ID NO: 3549440 - RNA, 13 nt, Pseudomonas putida KT2440
ccccaccagcacu

SEQ ID NO: 3549441 - RNA, 12 nt, Pseudomonas putida KT2440
ccccaccaggca

SEQ ID NO: 3549442 - RNA, 13 nt, Pseudomonas putida KT2440
ccccaccaggcaa

SEQ ID NO: 3549443 - RNA, 17 nt, Pseudomonas putida KT2440
ccccaccggcaccaucu

SEQ ID NO: 3549444 - RNA, 14 nt, Pseudomonas putida KT2440
ccccaccggccgcc

SEQ ID NO: 3549445 - RNA, 23 nt, Pseudomonas putida KT2440
ccccaccuggcccugcucacgca

SEQ ID NO: 3549446 - RNA, 15 nt, Pseudomonas putida KT2440
ccccacgccgaccgc

SEQ ID NO: 3549447 - RNA, 17 nt, Pseudomonas putida KT2440
ccccacucgcgcagcac

SEQ ID NO: 3549448 - RNA, 10 nt, Pseudomonas putida KT2440
ccccagaacg

SEQ ID NO: 3549449 - RNA, 16 nt, Pseudomonas putida KT2440
ccccagaccaucaggu

SEQ ID NO: 3549450 - RNA, 19 nt, Pseudomonas putida KT2440
ccccagauuucucagcugg

SEQ ID NO: 3549451 - RNA, 20 nt, Pseudomonas putida KT2440
ccccagauuucucagcugga

SEQ ID NO: 3549452 - RNA, 12 nt, Pseudomonas putida KT2440
ccccagcaacgg

SEQ ID NO: 3549453 - RNA, 23 nt, Pseudomonas putida KT2440
ccccagcaacggguucagguaca

SEQ ID NO: 3549454 - RNA, 15 nt, Pseudomonas putida KT2440
ccccagcauggccga

SEQ ID NO: 3549455 - RNA, 14 nt, Pseudomonas putida KT2440
ccccagccaacgcc

SEQ ID NO: 3549456 - RNA, 12 nt, Pseudomonas putida KT2440
ccccagcccgaa

SEQ ID NO: 3549457 - RNA, 20 nt, Pseudomonas putida KT2440
ccccagccggucauccagca

SEQ ID NO: 3549458 - RNA, 13 nt, Pseudomonas putida KT2440
ccccagccucagc

SEQ ID NO: 3549459 - RNA, 16 nt, Pseudomonas putida KT2440
ccccagcgccuccacc

SEQ ID NO: 3549460 - RNA, 19 nt, Pseudomonas putida KT2440
ccccagcgccuccaccugg

SEQ ID NO: 3549461 - RNA, 20 nt, Pseudomonas putida KT2440
ccccagcgccuccaccugga

SEQ ID NO: 3549462 - RNA, 16 nt, Pseudomonas putida KT2440
ccccagcgcgccagca

SEQ ID NO: 3549463 - RNA, 17 nt, Pseudomonas putida KT2440
ccccagcgucacccgug

SEQ ID NO: 3549464 - RNA, 18 nt, Pseudomonas putida KT2440
ccccaggccauccagcgg

SEQ ID NO: 3549465 - RNA, 13 nt, Pseudomonas putida KT2440
ccccaggcgcaca

SEQ ID NO: 3549466 - RNA, 23 nt, Pseudomonas putida KT2440
ccccaggcugccaaaccgcccca

SEQ ID NO: 3549467 - RNA, 17 nt, Pseudomonas putida KT2440
ccccagggaucgaugcc

SEQ ID NO: 3549468 - RNA, 15 nt, Pseudomonas putida KT2440
ccccagggcccucaa

SEQ ID NO: 3549469 - RNA, 20 nt, Pseudomonas putida KT2440
ccccagggcucuaccccuuc

SEQ ID NO: 3549470 - RNA, 21 nt, Pseudomonas putida KT2440
ccccaggguguuguucacggg

SEQ ID NO: 3549471 - RNA, 18 nt, Pseudomonas putida KT2440
ccccaggugcugaugccc

SEQ ID NO: 3549472 - RNA, 18 nt, Pseudomonas putida KT2440
ccccaguccgucucuuca

SEQ ID NO: 3549473 - RNA, 15 nt, Pseudomonas putida KT2440
ccccaguucacgcag

SEQ ID NO: 3549474 - RNA, 20 nt, Pseudomonas putida KT2440
ccccaguucacgcaggcgca

SEQ ID NO: 3549475 - RNA, 22 nt, Pseudomonas putida KT2440
ccccaguucacgcaggcgcagg

SEQ ID NO: 3549476 - RNA, 18 nt, Pseudomonas putida KT2440
ccccaguugaucaacccg

SEQ ID NO: 3549477 - RNA, 19 nt, Pseudomonas putida KT2440
ccccuccacccaccuuggc

SEQ ID NO: 3549478 - RNA, 12 nt, Pseudomonas putida KT2440
ccccuccacugu

SEQ ID NO: 3549479 - RNA, 14 nt, Pseudomonas putida KT2440
ccccuccucaccgc

SEQ ID NO: 3549480 - RNA, 14 nt, Pseudomonas putida KT2440
ccccuccuccagca

SEQ ID NO: 3549481 - RNA, 20 nt, Pseudomonas putida KT2440
ccccuccuccagcauggcga

SEQ ID NO: 3549482 - RNA, 21 nt, Pseudomonas putida KT2440
ccccuccugauguaggagcgg

SEQ ID NO: 3549483 - RNA, 22 nt, Pseudomonas putida KT2440
ccccucgaccacgcacagcugu

SEQ ID NO: 3549484 - RNA, 12 nt, Pseudomonas putida KT2440
ccccucgacgcc

SEQ ID NO: 3549485 - RNA, 14 nt, Pseudomonas putida KT2440
ccccugcaacaggg

SEQ ID NO: 3549486 - RNA, 15 nt, Pseudomonas putida KT2440
ccccugccagcacca

SEQ ID NO: 3549487 - RNA, 13 nt, Pseudomonas putida KT2440
ccccugcgccgcc

SEQ ID NO: 3549488 - RNA, 16 nt, Pseudomonas putida KT2440
ccccuggaaccccauc

SEQ ID NO: 3549489 - RNA, 15 nt, Pseudomonas putida KT2440
ccccuguaggagcgg

SEQ ID NO: 3549490 - RNA, 18 nt, Pseudomonas putida KT2440
ccccuguaggagcgggcu

SEQ ID NO: 3549491 - RNA, 20 nt, Pseudomonas putida KT2440
ccccuguaggaucggguuua

SEQ ID NO: 3549492 - RNA, 19 nt, Pseudomonas putida KT2440
ccccuucaaggggccccug

SEQ ID NO: 3549493 - RNA, 19 nt, Pseudomonas putida KT2440
ccccuuccagcuucugcaa

SEQ ID NO: 3549494 - RNA, 13 nt, Pseudomonas putida KT2440
ccccuuccaugcc

SEQ ID NO: 3549495 - RNA, 17 nt, Pseudomonas putida KT2440
ccccuuccccaggccgc

SEQ ID NO: 3549496 - RNA, 19 nt, Pseudomonas putida KT2440
ccccuuccccaggccgccc

SEQ ID NO: 3549497 - RNA, 19 nt, Pseudomonas putida KT2440
ccccuuccgaccggucaua

SEQ ID NO: 3549498 - RNA, 15 nt, Pseudomonas putida KT2440
ccccuucgauucagg

SEQ ID NO: 3549499 - RNA, 19 nt, Pseudomonas putida KT2440
ccccuuuagcaggcaagcc

SEQ ID NO: 3549500 - RNA, 17 nt, Pseudomonas putida KT2440
ccccuuucuccagcaac

SEQ ID NO: 3549501 - RNA, 23 nt, Pseudomonas putida KT2440
ccccuuuggccuaccgcccgcgc

SEQ ID NO: 3549502 - RNA, 16 nt, Pseudomonas putida KT2440
cccgaaagggccgcaa

SEQ ID NO: 3549503 - RNA, 20 nt, Pseudomonas putida KT2440
cccgaaagggccgcaaagcg

SEQ ID NO: 3549504 - RNA, 14 nt, Pseudomonas putida KT2440
cccgaacaacaggu

SEQ ID NO: 3549505 - RNA, 18 nt, Pseudomonas putida KT2440
cccgaacgacacggcagg

SEQ ID NO: 3549506 - RNA, 17 nt, Pseudomonas putida KT2440
cccgaacgcgguaagca

SEQ ID NO: 3549507 - RNA, 23 nt, Pseudomonas putida KT2440
cccgaagcgcagguccaggcgca

SEQ ID NO: 3549508 - RNA, 21 nt, Pseudomonas putida KT2440
cccgaagcuaucgccagcagg

SEQ ID NO: 3549509 - RNA, 19 nt, Pseudomonas putida KT2440
cccgaauugguaguuccug

SEQ ID NO: 3549510 - RNA, 15 nt, Pseudomonas putida KT2440
cccgacaacagcugc

SEQ ID NO: 3549511 - RNA, 19 nt, Pseudomonas putida KT2440
cccgacaagccacgcaccu

SEQ ID NO: 3549512 - RNA, 16 nt, Pseudomonas putida KT2440
cccgacaccggccuug

SEQ ID NO: 3549513 - RNA, 17 nt, Pseudomonas putida KT2440
cccgacaccggccuugc

SEQ ID NO: 3549514 - RNA, 20 nt, Pseudomonas putida KT2440
cccgaccaaggccaacugcg

SEQ ID NO: 3549515 - RNA, 21 nt, Pseudomonas putida KT2440
cccgaccacccggugacggca

SEQ ID NO: 3549516 - RNA, 18 nt, Pseudomonas putida KT2440
cccgaccaccgccucgau

SEQ ID NO: 3549517 - RNA, 15 nt, Pseudomonas putida KT2440
cccgaccgccagccc

SEQ ID NO: 3549518 - RNA, 19 nt, Pseudomonas putida KT2440
cccgacgauuucuccccag

SEQ ID NO: 3549519 - RNA, 20 nt, Pseudomonas putida KT2440
cccgacgauuucuccccagu

SEQ ID NO: 3549520 - RNA, 13 nt, Pseudomonas putida KT2440
cccgacgccaccu

SEQ ID NO: 3549521 - RNA, 15 nt, Pseudomonas putida KT2440
cccgacgccaccuuc

SEQ ID NO: 3549522 - RNA, 19 nt, Pseudomonas putida KT2440
cccgacgccggccugccgc

SEQ ID NO: 3549523 - RNA, 14 nt, Pseudomonas putida KT2440
cccgacugacgcua

SEQ ID NO: 3549524 - RNA, 21 nt, Pseudomonas putida KT2440
cccgacugacgcuacgccgcc

SEQ ID NO: 3549525 - RNA, 12 nt, Pseudomonas putida KT2440
cccgaggcaauc

SEQ ID NO: 3549526 - RNA, 17 nt, Pseudomonas putida KT2440
cccgauacagcgcgccg

SEQ ID NO: 3549527 - RNA, 15 nt, Pseudomonas putida KT2440
cccgaucggguacuc

SEQ ID NO: 3549528 - RNA, 21 nt, Pseudomonas putida KT2440
cccgaucggguacuccaccac

SEQ ID NO: 3549529 - RNA, 23 nt, Pseudomonas putida KT2440
cccgaucuccccaccaucaauac

SEQ ID NO: 3549530 - RNA, 18 nt, Pseudomonas putida KT2440
cccgaugaucaggccgcu

SEQ ID NO: 3549531 - RNA, 19 nt, Pseudomonas putida KT2440
cccgaugcgcuugaggcuu

SEQ ID NO: 3549532 - RNA, 15 nt, Pseudomonas putida KT2440
cccgauggccuugau

SEQ ID NO: 3549533 - RNA, 20 nt, Pseudomonas putida KT2440
cccgauuacaagggccugug

SEQ ID NO: 3549534 - RNA, 20 nt, Pseudomonas putida KT2440
cccgauuccuugcagcgccg

SEQ ID NO: 3549535 - RNA, 22 nt, Pseudomonas putida KT2440
cccgauuccuugcagcgccgca

SEQ ID NO: 3549536 - RNA, 15 nt, Pseudomonas putida KT2440
cccgcaacaaccugg

SEQ ID NO: 3549537 - RNA, 19 nt, Pseudomonas putida KT2440
cccgcaacaaccuggccgg

SEQ ID NO: 3549538 - RNA, 14 nt, Pseudomonas putida KT2440
cccgcaacgcaucg

SEQ ID NO: 3549539 - RNA, 14 nt, Pseudomonas putida KT2440
cccgcaagccagcc

SEQ ID NO: 3549540 - RNA, 17 nt, Pseudomonas putida KT2440
cccgcaagccagccucc

SEQ ID NO: 3549541 - RNA, 12 nt, Pseudomonas putida KT2440
cccgcaagcgcc

SEQ ID NO: 3549542 - RNA, 14 nt, Pseudomonas putida KT2440
cccgcaaucgucga

SEQ ID NO: 3549543 - RNA, 22 nt, Pseudomonas putida KT2440
cccgcaaucgucgaccaccgcc

SEQ ID NO: 3549544 - RNA, 15 nt, Pseudomonas putida KT2440
cccgcacaugccugc

SEQ ID NO: 3549545 - RNA, 18 nt, Pseudomonas putida KT2440
cccgcacaugccugcacu

SEQ ID NO: 3549546 - RNA, 22 nt, Pseudomonas putida KT2440
cccgcacaugccugcacugggc

SEQ ID NO: 3549547 - RNA, 13 nt, Pseudomonas putida KT2440
cccgcacccacag

SEQ ID NO: 3549548 - RNA, 15 nt, Pseudomonas putida KT2440
cccgcacccggcgga

SEQ ID NO: 3549549 - RNA, 18 nt, Pseudomonas putida KT2440
cccgcaccucacaacgcg

SEQ ID NO: 3549550 - RNA, 22 nt, Pseudomonas putida KT2440
cccgcaccucacaacgcgcauc

SEQ ID NO: 3549551 - RNA, 12 nt, Pseudomonas putida KT2440
cccgcacugcug

SEQ ID NO: 3549552 - RNA, 15 nt, Pseudomonas putida KT2440
cccgcacugcugccg

SEQ ID NO: 3549553 - RNA, 13 nt, Pseudomonas putida KT2440
cccgcagacagcu

SEQ ID NO: 3549554 - RNA, 18 nt, Pseudomonas putida KT2440
cccgcagcuucaacucca

SEQ ID NO: 3549555 - RNA, 20 nt, Pseudomonas putida KT2440
cccgcagcuucaacuccacc

SEQ ID NO: 3549556 - RNA, 14 nt, Pseudomonas putida KT2440
cccgcaggccgcag

SEQ ID NO: 3549557 - RNA, 17 nt, Pseudomonas putida KT2440
cccgcauaaccaccacc

SEQ ID NO: 3549558 - RNA, 17 nt, Pseudomonas putida KT2440
cccgcaucguuugaugc

SEQ ID NO: 3549559 - RNA, 20 nt, Pseudomonas putida KT2440
cccgccaacaacaagcgcug

SEQ ID NO: 3549560 - RNA, 16 nt, Pseudomonas putida KT2440
cccgccaaccccuccu

SEQ ID NO: 3549561 - RNA, 13 nt, Pseudomonas putida KT2440
cccgccacaccga

SEQ ID NO: 3549562 - RNA, 15 nt, Pseudomonas putida KT2440
cccgccaccccaggc

SEQ ID NO: 3549563 - RNA, 20 nt, Pseudomonas putida KT2440
cccgccacccccgccgccag

SEQ ID NO: 3549564 - RNA, 15 nt, Pseudomonas putida KT2440
cccgccaccgccucg

SEQ ID NO: 3549565 - RNA, 16 nt, Pseudomonas putida KT2440
cccgccagcaauugcg

SEQ ID NO: 3549566 - RNA, 20 nt, Pseudomonas putida KT2440
cccgccagcaggccaccggc

SEQ ID NO: 3549567 - RNA, 14 nt, Pseudomonas putida KT2440
cccgccaggcgcaa

SEQ ID NO: 3549568 - RNA, 19 nt, Pseudomonas putida KT2440
cccgccaguaggcugcagc

SEQ ID NO: 3549569 - RNA, 21 nt, Pseudomonas putida KT2440
cccgccaguaggcugcagccu

SEQ ID NO: 3549570 - RNA, 16 nt, Pseudomonas putida KT2440
cccgccagugaccgcu

SEQ ID NO: 3549571 - RNA, 19 nt, Pseudomonas putida KT2440
cccgccaguuugcacuggc

SEQ ID NO: 3549572 - RNA, 19 nt, Pseudomonas putida KT2440
cccgccauaucaggauugc

SEQ ID NO: 3549573 - RNA, 19 nt, Pseudomonas putida KT2440
cccgccaugcaacugcaug

SEQ ID NO: 3549574 - RNA, 17 nt, Pseudomonas putida KT2440
cccgccauucuucucca

SEQ ID NO: 3549575 - RNA, 17 nt, Pseudomonas putida KT2440
cccgccauugcaccacg

SEQ ID NO: 3549576 - RNA, 24 nt, Pseudomonas putida KT2440
cccgccauugcaccacgccauagc

SEQ ID NO: 3549577 - RNA, 17 nt, Pseudomonas putida KT2440
cccgcccacaugcgagc

SEQ ID NO: 3549578 - RNA, 12 nt, Pseudomonas putida KT2440
cccgcccaccac

SEQ ID NO: 3549579 - RNA, 17 nt, Pseudomonas putida KT2440
cccgcccaccaccagcc

SEQ ID NO: 3549580 - RNA, 14 nt, Pseudomonas putida KT2440
cccgcccacgccgc

SEQ ID NO: 3549581 - RNA, 12 nt, Pseudomonas putida KT2440
cccgcccagcug

SEQ ID NO: 3549582 - RNA, 13 nt, Pseudomonas putida KT2440
cccgcccagcugg

SEQ ID NO: 3549583 - RNA, 15 nt, Pseudomonas putida KT2440
cccgcgucagcucaa

SEQ ID NO: 3549584 - RNA, 20 nt, Pseudomonas putida KT2440
cccgcgucagcucaagcgcu

SEQ ID NO: 3549585 - RNA, 17 nt, Pseudomonas putida KT2440
cccgcguccagggcagg

SEQ ID NO: 3549586 - RNA, 17 nt, Pseudomonas putida KT2440
cccgcgucucgccgcug

SEQ ID NO: 3549587 - RNA, 14 nt, Pseudomonas putida KT2440
cccgcgugcgccca

SEQ ID NO: 3549588 - RNA, 23 nt, Pseudomonas putida KT2440
cccgcguucaugccggccccaga

SEQ ID NO: 3549589 - RNA, 14 nt, Pseudomonas putida KT2440
cccgcguuggcagc

SEQ ID NO: 3549590 - RNA, 18 nt, Pseudomonas putida KT2440
cccgcguuugcaacuggc

SEQ ID NO: 3549591 - RNA, 22 nt, Pseudomonas putida KT2440
cccgcguuugcaacuggcgcag

SEQ ID NO: 3549592 - RNA, 14 nt, Pseudomonas putida KT2440
cccgcucacgcagc

SEQ ID NO: 3549593 - RNA, 13 nt, Pseudomonas putida KT2440
cccgcucccacag

SEQ ID NO: 3549594 - RNA, 21 nt, Pseudomonas putida KT2440
cccgcucccacagaaggcugc

SEQ ID NO: 3549595 - RNA, 16 nt, Pseudomonas putida KT2440
cccgcucccacaggga

SEQ ID NO: 3549596 - RNA, 18 nt, Pseudomonas putida KT2440
cccgcucccacagggacc

SEQ ID NO: 3549597 - RNA, 15 nt, Pseudomonas putida KT2440
cccgcucccacaggu

SEQ ID NO: 3549598 - RNA, 21 nt, Pseudomonas putida KT2440
cccgcucccacagguaaguca

SEQ ID NO: 3549599 - RNA, 21 nt, Pseudomonas putida KT2440
cccgcucccacagguaaugca

SEQ ID NO: 3549600 - RNA, 19 nt, Pseudomonas putida KT2440
cccgcucccacagguacuc

SEQ ID NO: 3549601 - RNA, 20 nt, Pseudomonas putida KT2440
cccgcucccacagguacuga

SEQ ID NO: 3549602 - RNA, 20 nt, Pseudomonas putida KT2440
cccgcucccacagguccagc

SEQ ID NO: 3549603 - RNA, 20 nt, Pseudomonas putida KT2440
cccgcucccacaggugcagc

SEQ ID NO: 3549604 - RNA, 20 nt, Pseudomonas putida KT2440
cccgcucccacagguuuagc

SEQ ID NO: 3549605 - RNA, 19 nt, Pseudomonas putida KT2440
cccgcuccgacauugaucg

SEQ ID NO: 3549606 - RNA, 10 nt, Pseudomonas putida KT2440
cccgcuccua

SEQ ID NO: 3549607 - RNA, 19 nt, Pseudomonas putida KT2440
cccgcuccuacaaagcggc

SEQ ID NO: 3549608 - RNA, 19 nt, Pseudomonas putida KT2440
cccgcuccuacaacggcug

SEQ ID NO: 3549609 - RNA, 22 nt, Pseudomonas putida KT2440
cccgcuccuacaggauggccgc

SEQ ID NO: 3549610 - RNA, 19 nt, Pseudomonas putida KT2440
cccgcuccuacaggcgacc

SEQ ID NO: 3549611 - RNA, 20 nt, Pseudomonas putida KT2440
cccgcuccuacagguucugc

SEQ ID NO: 3549612 - RNA, 14 nt, Pseudomonas putida KT2440
cccgcuccuaccac

SEQ ID NO: 3549613 - RNA, 20 nt, Pseudomonas putida KT2440
cccgcuccuacgacggccug

SEQ ID NO: 3549614 - RNA, 20 nt, Pseudomonas putida KT2440
cccgcuccuacgacgggcug

SEQ ID NO: 3549615 - RNA, 21 nt, Pseudomonas putida KT2440
cccgcuccuacgacggucugc

SEQ ID NO: 3549616 - RNA, 22 nt, Pseudomonas putida KT2440
cccgcuccuacgacggucugcg

SEQ ID NO: 3549617 - RNA, 23 nt, Pseudomonas putida KT2440
cccgcuccuacgcggggcagcgc

SEQ ID NO: 3549618 - RNA, 19 nt, Pseudomonas putida KT2440
cccgcuccuacggccgaca

SEQ ID NO: 3549619 - RNA, 17 nt, Pseudomonas putida KT2440
cccgcuccuacgggcaa

SEQ ID NO: 3549620 - RNA, 18 nt, Pseudomonas putida KT2440
cccgcuccuacgggcaac

SEQ ID NO: 3549621 - RNA, 19 nt, Pseudomonas putida KT2440
cccgcuccuacgggcaacc

SEQ ID NO: 3549622 - RNA, 21 nt, Pseudomonas putida KT2440
cccgcuccuacgggcaaccgc

SEQ ID NO: 3549623 - RNA, 22 nt, Pseudomonas putida KT2440
cccgcuccuacgggggguucac

SEQ ID NO: 3549624 - RNA, 21 nt, Pseudomonas putida KT2440
cccgcuccuacggggguucac

SEQ ID NO: 3549625 - RNA, 20 nt, Pseudomonas putida KT2440
cccgcuccuacuacggccug

SEQ ID NO: 3549626 - RNA, 18 nt, Pseudomonas putida KT2440
cccgcuccugcaggguuc

SEQ ID NO: 3549627 - RNA, 20 nt, Pseudomonas putida KT2440
cccgcucggucagggcggca

SEQ ID NO: 3549628 - RNA, 16 nt, Pseudomonas putida KT2440
cccgcucucacaggga

SEQ ID NO: 3549629 - RNA, 18 nt, Pseudomonas putida KT2440
cccgcugcacaggccagc

SEQ ID NO: 3549630 - RNA, 23 nt, Pseudomonas putida KT2440
cccgcugcacaggccagccccag

SEQ ID NO: 3549631 - RNA, 20 nt, Pseudomonas putida KT2440
cccgcugcacgucgcgcagg

SEQ ID NO: 3549632 - RNA, 22 nt, Pseudomonas putida KT2440
cccgcugcaugcucggcggugc

SEQ ID NO: 3549633 - RNA, 16 nt, Pseudomonas putida KT2440
cccgcugccacccaca

SEQ ID NO: 3549634 - RNA, 19 nt, Pseudomonas putida KT2440
cccgcugccacccacaggc

SEQ ID NO: 3549635 - RNA, 21 nt, Pseudomonas putida KT2440
cccgcugccaccuuccagguc

SEQ ID NO: 3549636 - RNA, 23 nt, Pseudomonas putida KT2440
cccgcugccaccuuccaggucga

SEQ ID NO: 3549637 - RNA, 15 nt, Pseudomonas putida KT2440
cccgcugcgccgcuc

SEQ ID NO: 3549638 - RNA, 20 nt, Pseudomonas putida KT2440
cccgcugcgccgcucugccc

SEQ ID NO: 3549639 - RNA, 23 nt, Pseudomonas putida KT2440
cccgcugcucgaggaagcuguug

SEQ ID NO: 3549640 - RNA, 12 nt, Pseudomonas putida KT2440
cccgcugcugcg

SEQ ID NO: 3549641 - RNA, 17 nt, Pseudomonas putida KT2440
cccgcugcugcggcaac

SEQ ID NO: 3549642 - RNA, 15 nt, Pseudomonas putida KT2440
cccgcugcuuccggc

SEQ ID NO: 3549643 - RNA, 15 nt, Pseudomonas putida KT2440
cccgcuggccgcacc

SEQ ID NO: 3549644 - RNA, 14 nt, Pseudomonas putida KT2440
cccgcuggcgaccg

SEQ ID NO: 3549645 - RNA, 16 nt, Pseudomonas putida KT2440
cccgcugggcuucuuc

SEQ ID NO: 3549646 - RNA, 19 nt, Pseudomonas putida KT2440
cccgcuguugagcagcagc

SEQ ID NO: 3549647 - RNA, 21 nt, Pseudomonas putida KT2440
cccgcuguugagcagcagccc

SEQ ID NO: 3549648 - RNA, 16 nt, Pseudomonas putida KT2440
cccgcuucgccagcgc

SEQ ID NO: 3549649 - RNA, 21 nt, Pseudomonas putida KT2440
cccgcuucgccagcgccaccg

SEQ ID NO: 3549650 - RNA, 22 nt, Pseudomonas putida KT2440
cccgcuugcggcgacgcacuuc

SEQ ID NO: 3549651 - RNA, 12 nt, Pseudomonas putida KT2440
cccgcuuggcca

SEQ ID NO: 3549652 - RNA, 21 nt, Pseudomonas putida KT2440
cccgcuuguagcucagguaga

SEQ ID NO: 3549653 - RNA, 21 nt, Pseudomonas putida KT2440
cccgcuuuuggcugugcaccc

SEQ ID NO: 3549654 - RNA, 23 nt, Pseudomonas putida KT2440
cccggaagcuucucgagcggccu

SEQ ID NO: 3549655 - RNA, 24 nt, Pseudomonas putida KT2440
cccggaagcuucucgagcggccug

SEQ ID NO: 3549656 - RNA, 13 nt, Pseudomonas putida KT2440
cccggaaucggcu

SEQ ID NO: 3549657 - RNA, 18 nt, Pseudomonas putida KT2440
cccggacaacuuggcacc

SEQ ID NO: 3549658 - RNA, 21 nt, Pseudomonas putida KT2440
cccggacaacuuggcaccgac

SEQ ID NO: 3549659 - RNA, 14 nt, Pseudomonas putida KT2440
cccggaccagcgcc

SEQ ID NO: 3549660 - RNA, 15 nt, Pseudomonas putida KT2440
cccggaccagcgccg

SEQ ID NO: 3549661 - RNA, 17 nt, Pseudomonas putida KT2440
cccggaccagcgccgca

SEQ ID NO: 3549662 - RNA, 20 nt, Pseudomonas putida KT2440
cccggacugcaccaggucca

SEQ ID NO: 3549663 - RNA, 17 nt, Pseudomonas putida KT2440
cccggauaguguucgag

SEQ ID NO: 3549664 - RNA, 20 nt, Pseudomonas putida KT2440
cccggauggcggugaugcgc

SEQ ID NO: 3549665 - RNA, 18 nt, Pseudomonas putida KT2440
cccggauggugugcagca

SEQ ID NO: 3549666 - RNA, 15 nt, Pseudomonas putida KT2440
cccggcaaucgccag

SEQ ID NO: 3549667 - RNA, 16 nt, Pseudomonas putida KT2440
cccggcaaucgccagg

SEQ ID NO: 3549668 - RNA, 23 nt, Pseudomonas putida KT2440
cccggcacaaccgaacccgcugc

SEQ ID NO: 3549669 - RNA, 19 nt, Pseudomonas putida KT2440
cccggcagaucgagcgccg

SEQ ID NO: 3549670 - RNA, 21 nt, Pseudomonas putida KT2440
cccggcagaucgagcgccgcc

SEQ ID NO: 3549671 - RNA, 22 nt, Pseudomonas putida KT2440
cccggcagaucgagcgccgccc

SEQ ID NO: 3549672 - RNA, 15 nt, Pseudomonas putida KT2440
cccggcagccaccgc

SEQ ID NO: 3549673 - RNA, 18 nt, Pseudomonas putida KT2440
cccggcagugccuggaug

SEQ ID NO: 3549674 - RNA, 13 nt, Pseudomonas putida KT2440
cccggcauccgcc

SEQ ID NO: 3549675 - RNA, 16 nt, Pseudomonas putida KT2440
cccggcaucgcugccg

SEQ ID NO: 3549676 - RNA, 13 nt, Pseudomonas putida KT2440
cccggccaacaac

SEQ ID NO: 3549677 - RNA, 13 nt, Pseudomonas putida KT2440
cccggccagcagg

SEQ ID NO: 3549678 - RNA, 14 nt, Pseudomonas putida KT2440
cccggccagcaggu

SEQ ID NO: 3549679 - RNA, 15 nt, Pseudomonas putida KT2440
cccggccagcagguc

SEQ ID NO: 3549680 - RNA, 13 nt, Pseudomonas putida KT2440
cccggccagcgac

SEQ ID NO: 3549681 - RNA, 16 nt, Pseudomonas putida KT2440
cccggccagcgacccu

SEQ ID NO: 3549682 - RNA, 18 nt, Pseudomonas putida KT2440
cccggccaggccggcggu

SEQ ID NO: 3549683 - RNA, 14 nt, Pseudomonas putida KT2440
cccggccaggccgu

SEQ ID NO: 3549684 - RNA, 16 nt, Pseudomonas putida KT2440
cccggccaggccgugc

SEQ ID NO: 3549685 - RNA, 18 nt, Pseudomonas putida KT2440
cccggcccagccccgagc

SEQ ID NO: 3549686 - RNA, 14 nt, Pseudomonas putida KT2440
cccggcccagccgc

SEQ ID NO: 3549687 - RNA, 13 nt, Pseudomonas putida KT2440
cccucacucaccg

SEQ ID NO: 3549688 - RNA, 16 nt, Pseudomonas putida KT2440
cccucagcccaguacc

SEQ ID NO: 3549689 - RNA, 12 nt, Pseudomonas putida KT2440
cccucaggcaca

SEQ ID NO: 3549690 - RNA, 15 nt, Pseudomonas putida KT2440
cccucauucaaagcc

SEQ ID NO: 3549691 - RNA, 16 nt, Pseudomonas putida KT2440
cccucauucgcccgca

SEQ ID NO: 3549692 - RNA, 17 nt, Pseudomonas putida KT2440
cccucauucgcccgcac

SEQ ID NO: 3549693 - RNA, 22 nt, Pseudomonas putida KT2440
cccuccacccggucccgcccgg

SEQ ID NO: 3549694 - RNA, 22 nt, Pseudomonas putida KT2440
cccuccagccgcgaacgccccg

SEQ ID NO: 3549695 - RNA, 22 nt, Pseudomonas putida KT2440
cccuccccauacgaaguccggg

SEQ ID NO: 3549696 - RNA, 16 nt, Pseudomonas putida KT2440
cccuccccgcgccgcc

SEQ ID NO: 3549697 - RNA, 17 nt, Pseudomonas putida KT2440
cccuccgccugcggcac

SEQ ID NO: 3549698 - RNA, 18 nt, Pseudomonas putida KT2440
cccuccgccugcggcacc

SEQ ID NO: 3549699 - RNA, 18 nt, Pseudomonas putida KT2440
cccuccgguucugccggg

SEQ ID NO: 3549700 - RNA, 22 nt, Pseudomonas putida KT2440
cccuccuaucgcgacacaaggc

SEQ ID NO: 3549701 - RNA, 15 nt, Pseudomonas putida KT2440
cccuccucaccgcag

SEQ ID NO: 3549702 - RNA, 19 nt, Pseudomonas putida KT2440
cccuccuccagcauggcga

SEQ ID NO: 3549703 - RNA, 22 nt, Pseudomonas putida KT2440
cccuccuucagguaauccacca

SEQ ID NO: 3549704 - RNA, 14 nt, Pseudomonas putida KT2440
cccucgaacagcgc

SEQ ID NO: 3549705 - RNA, 15 nt, Pseudomonas putida KT2440
cccucgaacagcgcc

SEQ ID NO: 3549706 - RNA, 18 nt, Pseudomonas putida KT2440
cccucgaccacgcacagc

SEQ ID NO: 3549707 - RNA, 20 nt, Pseudomonas putida KT2440
cccucgaccacgcacagcug

SEQ ID NO: 3549708 - RNA, 15 nt, Pseudomonas putida KT2440
cccucgcaccacagu

SEQ ID NO: 3549709 - RNA, 18 nt, Pseudomonas putida KT2440
cccucgcccacucacgca

SEQ ID NO: 3549710 - RNA, 19 nt, Pseudomonas putida KT2440
cccucgcgcguugcagcca

SEQ ID NO: 3549711 - RNA, 20 nt, Pseudomonas putida KT2440
cccucgcugcccaacgccug

SEQ ID NO: 3549712 - RNA, 22 nt, Pseudomonas putida KT2440
cccucggccaccuggccuucca

SEQ ID NO: 3549713 - RNA, 14 nt, Pseudomonas putida KT2440
cccucggcgccaua

SEQ ID NO: 3549714 - RNA, 15 nt, Pseudomonas putida KT2440
cccucguaacgagcc

SEQ ID NO: 3549715 - RNA, 11 nt, Pseudomonas putida KT2440
cccucuugaau

SEQ ID NO: 3549716 - RNA, 19 nt, Pseudomonas putida KT2440
cccugaacuuggccuccag

SEQ ID NO: 3549717 - RNA, 20 nt, Pseudomonas putida KT2440
cccugaacuuggccuccagc

SEQ ID NO: 3549718 - RNA, 14 nt, Pseudomonas putida KT2440
cccugaagcccugg

SEQ ID NO: 3549719 - RNA, 21 nt, Pseudomonas putida KT2440
cccugacaggcgaucagucag

SEQ ID NO: 3549720 - RNA, 13 nt, Pseudomonas putida KT2440
cccugacucgacc

SEQ ID NO: 3549721 - RNA, 15 nt, Pseudomonas putida KT2440
cccugaucauacgca

SEQ ID NO: 3549722 - RNA, 14 nt, Pseudomonas putida KT2440
cccugaucgaugag

SEQ ID NO: 3549723 - RNA, 14 nt, Pseudomonas putida KT2440
cccugaucgccucc

SEQ ID NO: 3549724 - RNA, 16 nt, Pseudomonas putida KT2440
cccugaucgccuccag

SEQ ID NO: 3549725 - RNA, 21 nt, Pseudomonas putida KT2440
cccugaucgguuggguuggca

SEQ ID NO: 3549726 - RNA, 20 nt, Pseudomonas putida KT2440
cccugaucugccccucgauc

SEQ ID NO: 3549727 - RNA, 18 nt, Pseudomonas putida KT2440
cccugaugcagcagugcc

SEQ ID NO: 3549728 - RNA, 13 nt, Pseudomonas putida KT2440
cccugcaacaggg

SEQ ID NO: 3549729 - RNA, 17 nt, Pseudomonas putida KT2440
cccugcaauuucuugag

SEQ ID NO: 3549730 - RNA, 19 nt, Pseudomonas putida KT2440
cccugcauaugcagggccu

SEQ ID NO: 3549731 - RNA, 13 nt, Pseudomonas putida KT2440
cccugccagcacc

SEQ ID NO: 3549732 - RNA, 18 nt, Pseudomonas putida KT2440
cccugcccccaaagccgc

SEQ ID NO: 3549733 - RNA, 20 nt, Pseudomonas putida KT2440
cccugcccccaaagccgcca

SEQ ID NO: 3549734 - RNA, 23 nt, Pseudomonas putida KT2440
cccugcccccaaagccgccaugu

SEQ ID NO: 3549735 - RNA, 22 nt, Pseudomonas putida KT2440
cccugcccgaucgccucgcugg

SEQ ID NO: 3549736 - RNA, 13 nt, Pseudomonas putida KT2440
cccugcccucgac

SEQ ID NO: 3549737 - RNA, 13 nt, Pseudomonas putida KT2440
cccugccgaggcc

SEQ ID NO: 3549738 - RNA, 18 nt, Pseudomonas putida KT2440
cccugccgccuucuccag

SEQ ID NO: 3549739 - RNA, 22 nt, Pseudomonas putida KT2440
cccugccgccuucuccagcucg

SEQ ID NO: 3549740 - RNA, 16 nt, Pseudomonas putida KT2440
cccugccgcugaccug

SEQ ID NO: 3549741 - RNA, 17 nt, Pseudomonas putida KT2440
cccugccgcugaccugg

SEQ ID NO: 3549742 - RNA, 14 nt, Pseudomonas putida KT2440
cccugccuaccacc

SEQ ID NO: 3549743 - RNA, 21 nt, Pseudomonas putida KT2440
cccugccuaccaccgcauccg

SEQ ID NO: 3549744 - RNA, 23 nt, Pseudomonas putida KT2440
cccugccuaccaccgcauccgca

SEQ ID NO: 3549745 - RNA, 22 nt, Pseudomonas putida KT2440
cccugcgaagucagguaggugc

SEQ ID NO: 3549746 - RNA, 16 nt, Pseudomonas putida KT2440
cccugcgccaggcauu

SEQ ID NO: 3549747 - RNA, 16 nt, Pseudomonas putida KT2440
cccugcgccgccaccu

SEQ ID NO: 3549748 - RNA, 18 nt, Pseudomonas putida KT2440
cccugcgccgccaccugc

SEQ ID NO: 3549749 - RNA, 14 nt, Pseudomonas putida KT2440
cccugcggcugccc

SEQ ID NO: 3549750 - RNA, 17 nt, Pseudomonas putida KT2440
cccugcggcugccccaa

SEQ ID NO: 3549751 - RNA, 21 nt, Pseudomonas putida KT2440
cccugcggcuguucgcagcac

SEQ ID NO: 3549752 - RNA, 17 nt, Pseudomonas putida KT2440
cccugcgggagcgggcg

SEQ ID NO: 3549753 - RNA, 24 nt, Pseudomonas putida KT2440
cccugcgggagcgggcgugcccgc

SEQ ID NO: 3549754 - RNA, 20 nt, Pseudomonas putida KT2440
cccugcguccccggguccac

SEQ ID NO: 3549755 - RNA, 20 nt, Pseudomonas putida KT2440
cccugcucgccaucgccccg

SEQ ID NO: 3549756 - RNA, 19 nt, Pseudomonas putida KT2440
cccugcucguccaucaccg

SEQ ID NO: 3549757 - RNA, 20 nt, Pseudomonas putida KT2440
cccugcucguccaucaccgc

SEQ ID NO: 3549758 - RNA, 20 nt, Pseudomonas putida KT2440
cccugcucuucgauccgcgc

SEQ ID NO: 3549759 - RNA, 16 nt, Pseudomonas putida KT2440
cccugcugcuggcacg

SEQ ID NO: 3549760 - RNA, 17 nt, Pseudomonas putida KT2440
cccugcugcuggcacgc

SEQ ID NO: 3549761 - RNA, 16 nt, Pseudomonas putida KT2440
cccugcuugaccaugg

SEQ ID NO: 3549762 - RNA, 21 nt, Pseudomonas putida KT2440
cccuggaaacccuugcgcaac

SEQ ID NO: 3549763 - RNA, 20 nt, Pseudomonas putida KT2440
cccuggaggccggcccugcc

SEQ ID NO: 3549764 - RNA, 22 nt, Pseudomonas putida KT2440
cccuggaguaccgucgucguca

SEQ ID NO: 3549765 - RNA, 23 nt, Pseudomonas putida KT2440
cccuggcacgcccggcaccugcc

SEQ ID NO: 3549766 - RNA, 16 nt, Pseudomonas putida KT2440
cccuggcaugcugaug

SEQ ID NO: 3549767 - RNA, 12 nt, Pseudomonas putida KT2440
cccuggcccuua

SEQ ID NO: 3549768 - RNA, 17 nt, Pseudomonas putida KT2440
cccuggccuggccaagc

SEQ ID NO: 3549769 - RNA, 20 nt, Pseudomonas putida KT2440
cccuggcgguugaccagggc

SEQ ID NO: 3549770 - RNA, 16 nt, Pseudomonas putida KT2440
cccugggauuucggcg

SEQ ID NO: 3549771 - RNA, 23 nt, Pseudomonas putida KT2440
cccugggauuucggcggcgaugc

SEQ ID NO: 3549772 - RNA, 20 nt, Pseudomonas putida KT2440
cccugggccuucgcccgccg

SEQ ID NO: 3549773 - RNA, 16 nt, Pseudomonas putida KT2440
cccugggcgagcaggu

SEQ ID NO: 3549774 - RNA, 14 nt, Pseudomonas putida KT2440
cccuggggggcucc

SEQ ID NO: 3549775 - RNA, 17 nt, Pseudomonas putida KT2440
cccuggguuuauuucuc

SEQ ID NO: 3549776 - RNA, 22 nt, Pseudomonas putida KT2440
cccuggguuuauuucucuuccu

SEQ ID NO: 3549777 - RNA, 21 nt, Pseudomonas putida KT2440
cccugguacagauggcacccc

SEQ ID NO: 3549778 - RNA, 18 nt, Pseudomonas putida KT2440
cccuggucauccaguggc

SEQ ID NO: 3549779 - RNA, 23 nt, Pseudomonas putida KT2440
cccuggucauccaguggcgugug

SEQ ID NO: 3549780 - RNA, 15 nt, Pseudomonas putida KT2440
cccugguucgagucc

SEQ ID NO: 3549781 - RNA, 18 nt, Pseudomonas putida KT2440
cccugguuuuccaccggc

SEQ ID NO: 3549782 - RNA, 20 nt, Pseudomonas putida KT2440
cccugguuuuccaccggcac

SEQ ID NO: 3549783 - RNA, 16 nt, Pseudomonas putida KT2440
cccuguagagcgccuu

SEQ ID NO: 3549784 - RNA, 12 nt, Pseudomonas putida KT2440
cccuguaggagc

SEQ ID NO: 3549785 - RNA, 23 nt, Pseudomonas putida KT2440
cccuguaggcgcaacucagcgca

SEQ ID NO: 3549786 - RNA, 19 nt, Pseudomonas putida KT2440
cccuguaggugcggcuuua

SEQ ID NO: 3549787 - RNA, 20 nt, Pseudomonas putida KT2440
cccugucgaucacgggcaau

SEQ ID NO: 3549788 - RNA, 22 nt, Pseudomonas putida KT2440
cccugucguuauccugcagcac

SEQ ID NO: 3549789 - RNA, 14 nt, Pseudomonas putida KT2440
cccuguggcugugg

SEQ ID NO: 3549790 - RNA, 15 nt, Pseudomonas putida KT2440
cccugugggagcaca

SEQ ID NO: 3549791 - RNA, 17 nt, Pseudomonas putida KT2440
cccugugggagcggccu

SEQ ID NO: 3549792 - RNA, 22 nt, Pseudomonas putida KT2440
ccgacaguucgaaaccacccug

SEQ ID NO: 3549793 - RNA, 13 nt, Pseudomonas putida KT2440
ccgaccaccgccu

SEQ ID NO: 3549794 - RNA, 16 nt, Pseudomonas putida KT2440
ccgaccacgguaccgg

SEQ ID NO: 3549795 - RNA, 16 nt, Pseudomonas putida KT2440
ccgaccauuugccauc

SEQ ID NO: 3549796 - RNA, 15 nt, Pseudomonas putida KT2440
ccgacccacaggcac

SEQ ID NO: 3549797 - RNA, 23 nt, Pseudomonas putida KT2440
ccgacccgccuggugccagcggc

SEQ ID NO: 3549798 - RNA, 15 nt, Pseudomonas putida KT2440
ccgacccgggccagc

SEQ ID NO: 3549799 - RNA, 15 nt, Pseudomonas putida KT2440
ccgaccgaaccggcg

SEQ ID NO: 3549800 - RNA, 13 nt, Pseudomonas putida KT2440
ccgaccgccagcc

SEQ ID NO: 3549801 - RNA, 14 nt, Pseudomonas putida KT2440
ccgaccgcgcgcac

SEQ ID NO: 3549802 - RNA, 14 nt, Pseudomonas putida KT2440
ccgaccggucggcc

SEQ ID NO: 3549803 - RNA, 16 nt, Pseudomonas putida KT2440
ccgaccggucggccau

SEQ ID NO: 3549804 - RNA, 21 nt, Pseudomonas putida KT2440
ccgaccucacgcagguacucg

SEQ ID NO: 3549805 - RNA, 15 nt, Pseudomonas putida KT2440
ccgaccugcaacguc

SEQ ID NO: 3549806 - RNA, 20 nt, Pseudomonas putida KT2440
ccgaccuguguccacccccg

SEQ ID NO: 3549807 - RNA, 16 nt, Pseudomonas putida KT2440
ccgaccuugggccggc

SEQ ID NO: 3549808 - RNA, 13 nt, Pseudomonas putida KT2440
ccgacgaacaggg

SEQ ID NO: 3549809 - RNA, 21 nt, Pseudomonas putida KT2440
ccgacgaacagggccggcccc

SEQ ID NO: 3549810 - RNA, 15 nt, Pseudomonas putida KT2440
ccgacgauaccgccc

SEQ ID NO: 3549811 - RNA, 19 nt, Pseudomonas putida KT2440
ccgacgauuucuccccagu

SEQ ID NO: 3549812 - RNA, 16 nt, Pseudomonas putida KT2440
ccgacgauuucugccg

SEQ ID NO: 3549813 - RNA, 21 nt, Pseudomonas putida KT2440
ccgacgccaggaaggucacca

SEQ ID NO: 3549814 - RNA, 15 nt, Pseudomonas putida KT2440
ccgacgccgaucaau

SEQ ID NO: 3549815 - RNA, 18 nt, Pseudomonas putida KT2440
ccgacgccggccugccgc

SEQ ID NO: 3549816 - RNA, 17 nt, Pseudomonas putida KT2440
ccgacggcauggccgaa

SEQ ID NO: 3549817 - RNA, 16 nt, Pseudomonas putida KT2440
ccgacggugccggugg

SEQ ID NO: 3549818 - RNA, 19 nt, Pseudomonas putida KT2440
ccgacuccaacgcgccgau

SEQ ID NO: 3549819 - RNA, 21 nt, Pseudomonas putida KT2440
ccgacuccaacuggaccauca

SEQ ID NO: 3549820 - RNA, 18 nt, Pseudomonas putida KT2440
ccgacucuacugcccgca

SEQ ID NO: 3549821 - RNA, 21 nt, Pseudomonas putida KT2440
ccgacugacgcuacgccgccc

SEQ ID NO: 3549822 - RNA, 18 nt, Pseudomonas putida KT2440
ccgacuggcgcaccagcg

SEQ ID NO: 3549823 - RNA, 19 nt, Pseudomonas putida KT2440
ccgacuggcgcaccagcgg

SEQ ID NO: 3549824 - RNA, 13 nt, Pseudomonas putida KT2440
ccgacuggcuggc

SEQ ID NO: 3549825 - RNA, 14 nt, Pseudomonas putida KT2440
ccgacuuccccggc

SEQ ID NO: 3549826 - RNA, 15 nt, Pseudomonas putida KT2440
ccgacuuccccggcg

SEQ ID NO: 3549827 - RNA, 21 nt, Pseudomonas putida KT2440
ccgacuugucgaagucgaacu

SEQ ID NO: 3549828 - RNA, 12 nt, Pseudomonas putida KT2440
ccgagaacaggc

SEQ ID NO: 3549829 - RNA, 17 nt, Pseudomonas putida KT2440
ccgagaacaggcggccc

SEQ ID NO: 3549830 - RNA, 15 nt, Pseudomonas putida KT2440
ccgagaaugaaacuc

SEQ ID NO: 3549831 - RNA, 22 nt, Pseudomonas putida KT2440
ccgagaaugaaacuccaucguc

SEQ ID NO: 3549832 - RNA, 18 nt, Pseudomonas putida KT2440
ccgagacgaucaccaggu

SEQ ID NO: 3549833 - RNA, 16 nt, Pseudomonas putida KT2440
ccgagcaaagcccgcc

SEQ ID NO: 3549834 - RNA, 17 nt, Pseudomonas putida KT2440
ccgagcaaagcccgccc

SEQ ID NO: 3549835 - RNA, 20 nt, Pseudomonas putida KT2440
ccgagcaaagcccgccccaa

SEQ ID NO: 3549836 - RNA, 20 nt, Pseudomonas putida KT2440
ccgagcaucuuccagccugc

SEQ ID NO: 3549837 - RNA, 17 nt, Pseudomonas putida KT2440
ccgagcauuacaggcag

SEQ ID NO: 3549838 - RNA, 19 nt, Pseudomonas putida KT2440
ccgagccaagcgacgugca

SEQ ID NO: 3549839 - RNA, 12 nt, Pseudomonas putida KT2440
ccgagccuuccg

SEQ ID NO: 3549840 - RNA, 20 nt, Pseudomonas putida KT2440
ccgagcgagugaccuuggcu

SEQ ID NO: 3549841 - RNA, 20 nt, Pseudomonas putida KT2440
ccgagcgccgugcucggccu

SEQ ID NO: 3549842 - RNA, 16 nt, Pseudomonas putida KT2440
ccgagcgcggcgccca

SEQ ID NO: 3549843 - RNA, 13 nt, Pseudomonas putida KT2440
ccgagcggagcug

SEQ ID NO: 3549844 - RNA, 20 nt, Pseudomonas putida KT2440
ccgagcggucgcagguucga

SEQ ID NO: 3549845 - RNA, 16 nt, Pseudomonas putida KT2440
ccgagcugcccaagua

SEQ ID NO: 3549846 - RNA, 21 nt, Pseudomonas putida KT2440
ccgaggaauugcgccaggaug

SEQ ID NO: 3549847 - RNA, 14 nt, Pseudomonas putida KT2440
ccgaggacaacaag

SEQ ID NO: 3549848 - RNA, 21 nt, Pseudomonas putida KT2440
ccgaggacaacaaggacugcc

SEQ ID NO: 3549849 - RNA, 21 nt, Pseudomonas putida KT2440
ccgaggccgggcagagucguu

SEQ ID NO: 3549850 - RNA, 14 nt, Pseudomonas putida KT2440
ccgaggcgccgacg

SEQ ID NO: 3549851 - RNA, 21 nt, Pseudomonas putida KT2440
ccgaggggccgcuacgcgccc

SEQ ID NO: 3549852 - RNA, 15 nt, Pseudomonas putida KT2440
ccgagggugaggugc

SEQ ID NO: 3549853 - RNA, 20 nt, Pseudomonas putida KT2440
ccgagggugaggugcugcag

SEQ ID NO: 3549854 - RNA, 21 nt, Pseudomonas putida KT2440
ccgaggucagcaccagcucau

SEQ ID NO: 3549855 - RNA, 18 nt, Pseudomonas putida KT2440
ccgaggucugcgcgggaa

SEQ ID NO: 3549856 - RNA, 23 nt, Pseudomonas putida KT2440
ccgaguaccgucggcacgagcau

SEQ ID NO: 3549857 - RNA, 17 nt, Pseudomonas putida KT2440
ccgagucaacacggcug

SEQ ID NO: 3549858 - RNA, 14 nt, Pseudomonas putida KT2440
ccgagugcccgcgc

SEQ ID NO: 3549859 - RNA, 13 nt, Pseudomonas putida KT2440
ccgaguugccggu

SEQ ID NO: 3549860 - RNA, 19 nt, Pseudomonas putida KT2440
ccgauaaagguugcccggc

SEQ ID NO: 3549861 - RNA, 16 nt, Pseudomonas putida KT2440
ccgauacagcgcgccg

SEQ ID NO: 3549862 - RNA, 13 nt, Pseudomonas putida KT2440
ccgauagcagcac

SEQ ID NO: 3549863 - RNA, 15 nt, Pseudomonas putida KT2440
ccgauagccagcugg

SEQ ID NO: 3549864 - RNA, 16 nt, Pseudomonas putida KT2440
ccgaucacaccggcaa

SEQ ID NO: 3549865 - RNA, 18 nt, Pseudomonas putida KT2440
ccgaucaccugggcgauc

SEQ ID NO: 3549866 - RNA, 18 nt, Pseudomonas putida KT2440
ccgaucacggggcgacgc

SEQ ID NO: 3549867 - RNA, 19 nt, Pseudomonas putida KT2440
ccgaucacuuccuggccgc

SEQ ID NO: 3549868 - RNA, 20 nt, Pseudomonas putida KT2440
ccgaucagcacgccgccgau

SEQ ID NO: 3549869 - RNA, 14 nt, Pseudomonas putida KT2440
ccgaucagcugggu

SEQ ID NO: 3549870 - RNA, 17 nt, Pseudomonas putida KT2440
ccgaucaggaagccccg

SEQ ID NO: 3549871 - RNA, 19 nt, Pseudomonas putida KT2440
ccgaucagguugcccagca

SEQ ID NO: 3549872 - RNA, 14 nt, Pseudomonas putida KT2440
ccgauccuuggcga

SEQ ID NO: 3549873 - RNA, 16 nt, Pseudomonas putida KT2440
ccgaucgaagcagcag

SEQ ID NO: 3549874 - RNA, 17 nt, Pseudomonas putida KT2440
ccgaucgaagcagcagc

SEQ ID NO: 3549875 - RNA, 19 nt, Pseudomonas putida KT2440
ccgaucgaagcagcagcuu

SEQ ID NO: 3549876 - RNA, 15 nt, Pseudomonas putida KT2440
ccgaucucgccagcc

SEQ ID NO: 3549877 - RNA, 19 nt, Pseudomonas putida KT2440
ccgaucucgccagccugca

SEQ ID NO: 3549878 - RNA, 20 nt, Pseudomonas putida KT2440
ccgaucucgccagccugcag

SEQ ID NO: 3549879 - RNA, 15 nt, Pseudomonas putida KT2440
ccgaucuucgcccug

SEQ ID NO: 3549880 - RNA, 16 nt, Pseudomonas putida KT2440
ccgaugaagcaggccg

SEQ ID NO: 3549881 - RNA, 18 nt, Pseudomonas putida KT2440
ccgaugaguugucugccg

SEQ ID NO: 3549882 - RNA, 19 nt, Pseudomonas putida KT2440
ccgaugaguugucugccga

SEQ ID NO: 3549883 - RNA, 21 nt, Pseudomonas putida KT2440
ccgaugaguugucugccgaag

SEQ ID NO: 3549884 - RNA, 12 nt, Pseudomonas putida KT2440
ccgaugcccagg

SEQ ID NO: 3549885 - RNA, 19 nt, Pseudomonas putida KT2440
ccgaugccguaguaagcca

SEQ ID NO: 3549886 - RNA, 14 nt, Pseudomonas putida KT2440
ccgaugccgucgau

SEQ ID NO: 3549887 - RNA, 22 nt, Pseudomonas putida KT2440
ccgaugccuuuuuuugccgcau

SEQ ID NO: 3549888 - RNA, 19 nt, Pseudomonas putida KT2440
ccgaugcgcccgccgcccg

SEQ ID NO: 3549889 - RNA, 18 nt, Pseudomonas putida KT2440
ccgaugcggugcagcacc

SEQ ID NO: 3549890 - RNA, 19 nt, Pseudomonas putida KT2440
ccgaugcucgucagccccu

SEQ ID NO: 3549891 - RNA, 14 nt, Pseudomonas putida KT2440
ccgaugcugugccg

SEQ ID NO: 3549892 - RNA, 17 nt, Pseudomonas putida KT2440
ccgauggcgcaaacccu

SEQ ID NO: 3549893 - RNA, 15 nt, Pseudomonas putida KT2440
ccgaugggcaggcca

SEQ ID NO: 3549894 - RNA, 16 nt, Pseudomonas putida KT2440
ccgaugggcaggccau

SEQ ID NO: 3549895 - RNA, 16 nt, Pseudomonas putida KT2440
ccgaugggcgucgccu

SEQ ID NO: 3549896 - RNA, 19 nt, Pseudomonas putida KT2440
ccgaugggcgucgccugca

SEQ ID NO: 3549897 - RNA, 18 nt, Pseudomonas putida KT2440
ccgaugggcuguuccagc

SEQ ID NO: 3549898 - RNA, 17 nt, Pseudomonas putida KT2440
ccgccaaaccccagcaa

SEQ ID NO: 3549899 - RNA, 20 nt, Pseudomonas putida KT2440
ccgccaacaccaccuccacc

SEQ ID NO: 3549900 - RNA, 11 nt, Pseudomonas putida KT2440
ccgccaacagc

SEQ ID NO: 3549901 - RNA, 13 nt, Pseudomonas putida KT2440
ccgccaacagcgc

SEQ ID NO: 3549902 - RNA, 16 nt, Pseudomonas putida KT2440
ccgccaaccagcucac

SEQ ID NO: 3549903 - RNA, 18 nt, Pseudomonas putida KT2440
ccgccaaccccuccagca

SEQ ID NO: 3549904 - RNA, 16 nt, Pseudomonas putida KT2440
ccgccaacccgauccc

SEQ ID NO: 3549905 - RNA, 15 nt, Pseudomonas putida KT2440
ccgccaacgaaucag

SEQ ID NO: 3549906 - RNA, 21 nt, Pseudomonas putida KT2440
ccgccaacgaaucagccagcc

SEQ ID NO: 3549907 - RNA, 13 nt, Pseudomonas putida KT2440
ccgccaagcggcc

SEQ ID NO: 3549908 - RNA, 21 nt, Pseudomonas putida KT2440
ccgccaagggucgacaccagg

SEQ ID NO: 3549909 - RNA, 14 nt, Pseudomonas putida KT2440
ccgccaagguaauc

SEQ ID NO: 3549910 - RNA, 19 nt, Pseudomonas putida KT2440
ccgccaagguaaucuggcu

SEQ ID NO: 3549911 - RNA, 22 nt, Pseudomonas putida KT2440
ccgccaagguaaucuggcuguc

SEQ ID NO: 3549912 - RNA, 19 nt, Pseudomonas putida KT2440
ccgccaauacccacgucga

SEQ ID NO: 3549913 - RNA, 16 nt, Pseudomonas putida KT2440
ccgccaauugcgccag

SEQ ID NO: 3549914 - RNA, 14 nt, Pseudomonas putida KT2440
ccgccacaaacgcc

SEQ ID NO: 3549915 - RNA, 17 nt, Pseudomonas putida KT2440
ccgccacaccugccagg

SEQ ID NO: 3549916 - RNA, 17 nt, Pseudomonas putida KT2440
ccgccacauccagcgcc

SEQ ID NO: 3549917 - RNA, 11 nt, Pseudomonas putida KT2440
ccgccaccacg

SEQ ID NO: 3549918 - RNA, 16 nt, Pseudomonas putida KT2440
ccgccaccacgaugcc

SEQ ID NO: 3549919 - RNA, 11 nt, Pseudomonas putida KT2440
ccgccaccaga

SEQ ID NO: 3549920 - RNA, 12 nt, Pseudomonas putida KT2440
ccgccaccagcg

SEQ ID NO: 3549921 - RNA, 12 nt, Pseudomonas putida KT2440
ccgccaccaugc

SEQ ID NO: 3549922 - RNA, 12 nt, Pseudomonas putida KT2440
ccgccacccccg

SEQ ID NO: 3549923 - RNA, 13 nt, Pseudomonas putida KT2440
ccgccaccccggc

SEQ ID NO: 3549924 - RNA, 13 nt, Pseudomonas putida KT2440
ccgccaccgccuc

SEQ ID NO: 3549925 - RNA, 14 nt, Pseudomonas putida KT2440
ccgccaccucgcua

SEQ ID NO: 3549926 - RNA, 22 nt, Pseudomonas putida KT2440
ccgccaccuuguucgagcgcca

SEQ ID NO: 3549927 - RNA, 19 nt, Pseudomonas putida KT2440
ccgccagaaaauucucccg

SEQ ID NO: 3549928 - RNA, 14 nt, Pseudomonas putida KT2440
ccgccagaccaccu

SEQ ID NO: 3549929 - RNA, 17 nt, Pseudomonas putida KT2440
ccgccagaccaccucau

SEQ ID NO: 3549930 - RNA, 21 nt, Pseudomonas putida KT2440
ccgccagacuucauaggcugg

SEQ ID NO: 3549931 - RNA, 19 nt, Pseudomonas putida KT2440
ccgccagagcauggccagc

SEQ ID NO: 3549932 - RNA, 23 nt, Pseudomonas putida KT2440
ccgccagagcauggccagccggc

SEQ ID NO: 3549933 - RNA, 17 nt, Pseudomonas putida KT2440
ccgccagcaauugcgag

SEQ ID NO: 3549934 - RNA, 16 nt, Pseudomonas putida KT2440
ccgccagcagcugguc

SEQ ID NO: 3549935 - RNA, 12 nt, Pseudomonas putida KT2440
ccgccagcaggc

SEQ ID NO: 3549936 - RNA, 13 nt, Pseudomonas putida KT2440
ccgccagcaggcc

SEQ ID NO: 3549937 - RNA, 14 nt, Pseudomonas putida KT2440
ccgccagcaggcca

SEQ ID NO: 3549938 - RNA, 15 nt, Pseudomonas putida KT2440
ccgccagcaggccac

SEQ ID NO: 3549939 - RNA, 15 nt, Pseudomonas putida KT2440
ccgccagcaguucga

SEQ ID NO: 3549940 - RNA, 16 nt, Pseudomonas putida KT2440
ccgccagcaucacgcc

SEQ ID NO: 3549941 - RNA, 19 nt, Pseudomonas putida KT2440
ccgccagcauggccggaua

SEQ ID NO: 3549942 - RNA, 21 nt, Pseudomonas putida KT2440
ccgccagccaacgcugguaga

SEQ ID NO: 3549943 - RNA, 12 nt, Pseudomonas putida KT2440
ccgccagccccg

SEQ ID NO: 3549944 - RNA, 18 nt, Pseudomonas putida KT2440
ccgccagccccgccaaca

SEQ ID NO: 3549945 - RNA, 17 nt, Pseudomonas putida KT2440
ccgccagcccgccacac

SEQ ID NO: 3549946 - RNA, 17 nt, Pseudomonas putida KT2440
ccgccagcgcuccagca

SEQ ID NO: 3549947 - RNA, 17 nt, Pseudomonas putida KT2440
ccgccagcggcaguugc

SEQ ID NO: 3549948 - RNA, 15 nt, Pseudomonas putida KT2440
ccgccagcuccacca

SEQ ID NO: 3549949 - RNA, 23 nt, Pseudomonas putida KT2440
ccgccaggaagucgauguucagc

SEQ ID NO: 3549950 - RNA, 18 nt, Pseudomonas putida KT2440
ccgccaggcccaccaccg

SEQ ID NO: 3549951 - RNA, 15 nt, Pseudomonas putida KT2440
ccgccaggcggucgc

SEQ ID NO: 3549952 - RNA, 19 nt, Pseudomonas putida KT2440
ccgccaggcucuccagccg

SEQ ID NO: 3549953 - RNA, 20 nt, Pseudomonas putida KT2440
ccgccaggcucuccagccgc

SEQ ID NO: 3549954 - RNA, 21 nt, Pseudomonas putida KT2440
ccgccagguauucggcaaugc

SEQ ID NO: 3549955 - RNA, 20 nt, Pseudomonas putida KT2440
ccgccagguccgguaacugg

SEQ ID NO: 3549956 - RNA, 22 nt, Pseudomonas putida KT2440
ccgccagguccgguaacuggcc

SEQ ID NO: 3549957 - RNA, 16 nt, Pseudomonas putida KT2440
ccgccaggucgccggu

SEQ ID NO: 3549958 - RNA, 16 nt, Pseudomonas putida KT2440
ccgccaguagcaauca

SEQ ID NO: 3549959 - RNA, 21 nt, Pseudomonas putida KT2440
ccgccaguaggcugcagccuu

SEQ ID NO: 3549960 - RNA, 14 nt, Pseudomonas putida KT2440
ccgccagugaccgc

SEQ ID NO: 3549961 - RNA, 18 nt, Pseudomonas putida KT2440
ccgccagugcaaacuggc

SEQ ID NO: 3549962 - RNA, 16 nt, Pseudomonas putida KT2440
ccgccagugcggugac

SEQ ID NO: 3549963 - RNA, 19 nt, Pseudomonas putida KT2440
ccgccaguuucaccugacc

SEQ ID NO: 3549964 - RNA, 21 nt, Pseudomonas putida KT2440
ccgccauaucaggauugccgc

SEQ ID NO: 3549965 - RNA, 23 nt, Pseudomonas putida KT2440
ccgccauaucaggauugccgcag

SEQ ID NO: 3549966 - RNA, 16 nt, Pseudomonas putida KT2440
ccgccauguugcgcag

SEQ ID NO: 3549967 - RNA, 18 nt, Pseudomonas putida KT2440
ccgccauguugcgcagca

SEQ ID NO: 3549968 - RNA, 19 nt, Pseudomonas putida KT2440
ccgccauguugcgcagcaa

SEQ ID NO: 3549969 - RNA, 20 nt, Pseudomonas putida KT2440
ccgccauucuucuccaggug

SEQ ID NO: 3549970 - RNA, 22 nt, Pseudomonas putida KT2440
ccgccauucuucuccaggugcu

SEQ ID NO: 3549971 - RNA, 21 nt, Pseudomonas putida KT2440
ccgccauugacuaccagguag

SEQ ID NO: 3549972 - RNA, 13 nt, Pseudomonas putida KT2440
ccgccauugaugc

SEQ ID NO: 3549973 - RNA, 17 nt, Pseudomonas putida KT2440
ccgccauugcaccacgc

SEQ ID NO: 3549974 - RNA, 20 nt, Pseudomonas putida KT2440
ccgccauugcaccacgccau

SEQ ID NO: 3549975 - RNA, 18 nt, Pseudomonas putida KT2440
ccgccauugcccagccug

SEQ ID NO: 3549976 - RNA, 23 nt, Pseudomonas putida KT2440
ccgccauugcccagccugcccgc

SEQ ID NO: 3549977 - RNA, 22 nt, Pseudomonas putida KT2440
ccgccauugcuugacuauuucu

SEQ ID NO: 3549978 - RNA, 21 nt, Pseudomonas putida KT2440
ccgcccaaagaaaagcccgca

SEQ ID NO: 3549979 - RNA, 18 nt, Pseudomonas putida KT2440
ccgcccaauuuggccagc

SEQ ID NO: 3549980 - RNA, 13 nt, Pseudomonas putida KT2440
ccgcccaccacca

SEQ ID NO: 3549981 - RNA, 13 nt, Pseudomonas putida KT2440
ccgcccacccacc

SEQ ID NO: 3549982 - RNA, 12 nt, Pseudomonas putida KT2440
ccgcccagcagc

SEQ ID NO: 3549983 - RNA, 13 nt, Pseudomonas putida KT2440
ccgcccagcuggc

SEQ ID NO: 3549984 - RNA, 13 nt, Pseudomonas putida KT2440
ccgcccaguaccg

SEQ ID NO: 3549985 - RNA, 15 nt, Pseudomonas putida KT2440
ccgccccacucgcgc

SEQ ID NO: 3549986 - RNA, 18 nt, Pseudomonas putida KT2440
ccgccccacucgcgcagc

SEQ ID NO: 3549987 - RNA, 18 nt, Pseudomonas putida KT2440
ccgccccagcgcgccagc

SEQ ID NO: 3549988 - RNA, 19 nt, Pseudomonas putida KT2440
ccgccccagcgcgccagca

SEQ ID NO: 3549989 - RNA, 16 nt, Pseudomonas putida KT2440
ccgccccauagccugc

SEQ ID NO: 3549990 - RNA, 17 nt, Pseudomonas putida KT2440
ccgccccauagccugcu

SEQ ID NO: 3549991 - RNA, 18 nt, Pseudomonas putida KT2440
ccgccccccaccuggccc

SEQ ID NO: 3549992 - RNA, 14 nt, Pseudomonas putida KT2440
ccgccccgcaccag

SEQ ID NO: 3549993 - RNA, 22 nt, Pseudomonas putida KT2440
ccgcccgaacgggcucaccugg

SEQ ID NO: 3549994 - RNA, 15 nt, Pseudomonas putida KT2440
ccgcccgcgcggcgc

SEQ ID NO: 3549995 - RNA, 22 nt, Pseudomonas putida KT2440
ccgcccgcguccggcuugagac

SEQ ID NO: 3549996 - RNA, 23 nt, Pseudomonas putida KT2440
ccgcccgcuuuuggcugugcacc

SEQ ID NO: 3549997 - RNA, 21 nt, Pseudomonas putida KT2440
ccgcccggucauacagcccua

SEQ ID NO: 3549998 - RNA, 20 nt, Pseudomonas putida KT2440
ccgcccguaugcauccgcca

SEQ ID NO: 3549999 - RNA, 23 nt, Pseudomonas putida KT2440
ccgcccguaugcauccgccaugg

SEQ ID NO: 3550000 - RNA, 13 nt, Pseudomonas putida KT2440
ccgcccuccagcc

SEQ ID NO: 3550001 - RNA, 14 nt, Pseudomonas putida KT2440
ccgcccucuacgaa

SEQ ID NO: 3550002 - RNA, 21 nt, Pseudomonas putida KT2440
ccgcccugagccaaggccgcc

SEQ ID NO: 3550003 - RNA, 18 nt, Pseudomonas putida KT2440
ccgcccuugagcuucagc

SEQ ID NO: 3550004 - RNA, 20 nt, Pseudomonas putida KT2440
ccgcgauaucagcgccagca

SEQ ID NO: 3550005 - RNA, 16 nt, Pseudomonas putida KT2440
ccgcgaugccgacagc

SEQ ID NO: 3550006 - RNA, 20 nt, Pseudomonas putida KT2440
ccgcgaugccgacagccacc

SEQ ID NO: 3550007 - RNA, 18 nt, Pseudomonas putida KT2440
ccgcgauggauggcaccg

SEQ ID NO: 3550008 - RNA, 16 nt, Pseudomonas putida KT2440
ccgcgcaaaugcaccc

SEQ ID NO: 3550009 - RNA, 21 nt, Pseudomonas putida KT2440
ccgcgcaacgcgccauggccu

SEQ ID NO: 3550010 - RNA, 19 nt, Pseudomonas putida KT2440
ccgcgcaauugccggucgg

SEQ ID NO: 3550011 - RNA, 12 nt, Pseudomonas putida KT2440
ccgcgcaccucc

SEQ ID NO: 3550012 - RNA, 15 nt, Pseudomonas putida KT2440
ccgcgcaccuccugc

SEQ ID NO: 3550013 - RNA, 17 nt, Pseudomonas putida KT2440
ccgcgcaccuccugcgg

SEQ ID NO: 3550014 - RNA, 19 nt, Pseudomonas putida KT2440
ccgcgcaccuccugcggca

SEQ ID NO: 3550015 - RNA, 21 nt, Pseudomonas putida KT2440
ccgcgcaccuccugcggcaga

SEQ ID NO: 3550016 - RNA, 15 nt, Pseudomonas putida KT2440
ccgcgcagccuuuga

SEQ ID NO: 3550017 - RNA, 16 nt, Pseudomonas putida KT2440
ccgcgcagccuuugaa

SEQ ID NO: 3550018 - RNA, 15 nt, Pseudomonas putida KT2440
ccgcgcagcggcccc

SEQ ID NO: 3550019 - RNA, 13 nt, Pseudomonas putida KT2440
ccgcgcagcuucc

SEQ ID NO: 3550020 - RNA, 14 nt, Pseudomonas putida KT2440
ccgcgcagcuucca

SEQ ID NO: 3550021 - RNA, 21 nt, Pseudomonas putida KT2440
ccgcgcaugaucagcugccac

SEQ ID NO: 3550022 - RNA, 21 nt, Pseudomonas putida KT2440
ccgcgcaugaugaaguggcgc

SEQ ID NO: 3550023 - RNA, 14 nt, Pseudomonas putida KT2440
ccgcgccaccagcc

SEQ ID NO: 3550024 - RNA, 17 nt, Pseudomonas putida KT2440
ccgcgccaccagcccca

SEQ ID NO: 3550025 - RNA, 14 nt, Pseudomonas putida KT2440
ccgcgccagcggcc

SEQ ID NO: 3550026 - RNA, 16 nt, Pseudomonas putida KT2440
ccgcgccagcggccag

SEQ ID NO: 3550027 - RNA, 12 nt, Pseudomonas putida KT2440
ccgcgccagcuc

SEQ ID NO: 3550028 - RNA, 13 nt, Pseudomonas putida KT2440
ccgcgccagcucc

SEQ ID NO: 3550029 - RNA, 20 nt, Pseudomonas putida KT2440
ccgcgccaucaaggccgaca

SEQ ID NO: 3550030 - RNA, 21 nt, Pseudomonas putida KT2440
ccgcgccaucaaggccgacag

SEQ ID NO: 3550031 - RNA, 14 nt, Pseudomonas putida KT2440
ccgcgccaucagcu

SEQ ID NO: 3550032 - RNA, 15 nt, Pseudomonas putida KT2440
ccgcgccaucagcug

SEQ ID NO: 3550033 - RNA, 17 nt, Pseudomonas putida KT2440
ccgcgccaucagcugcg

SEQ ID NO: 3550034 - RNA, 20 nt, Pseudomonas putida KT2440
ccgcgccauugcccaguucg

SEQ ID NO: 3550035 - RNA, 22 nt, Pseudomonas putida KT2440
ccgcgcccagucaccguucuug

SEQ ID NO: 3550036 - RNA, 15 nt, Pseudomonas putida KT2440
ccgcgcccucuuccg

SEQ ID NO: 3550037 - RNA, 19 nt, Pseudomonas putida KT2440
ccgcgccgacagccucaag

SEQ ID NO: 3550038 - RNA, 15 nt, Pseudomonas putida KT2440
ccgcgccgcccagcu

SEQ ID NO: 3550039 - RNA, 15 nt, Pseudomonas putida KT2440
ccgcgccgccgacga

SEQ ID NO: 3550040 - RNA, 13 nt, Pseudomonas putida KT2440
ccgcgccuacagc

SEQ ID NO: 3550041 - RNA, 19 nt, Pseudomonas putida KT2440
ccgcgccuacagcggccug

SEQ ID NO: 3550042 - RNA, 16 nt, Pseudomonas putida KT2440
ccgcgccuacaggccc

SEQ ID NO: 3550043 - RNA, 22 nt, Pseudomonas putida KT2440
ccgcgccuacgacggccugcgc

SEQ ID NO: 3550044 - RNA, 17 nt, Pseudomonas putida KT2440
ccgcgccuccagcuggc

SEQ ID NO: 3550045 - RNA, 22 nt, Pseudomonas putida KT2440
ccgcgccucgaucccgccgcca

SEQ ID NO: 3550046 - RNA, 20 nt, Pseudomonas putida KT2440
ccgcgcggcuugcucgcggc

SEQ ID NO: 3550047 - RNA, 15 nt, Pseudomonas putida KT2440
ccgcgcgggcggcgc

SEQ ID NO: 3550048 - RNA, 18 nt, Pseudomonas putida KT2440
ccgcgcgguuaagcgcca

SEQ ID NO: 3550049 - RNA, 15 nt, Pseudomonas putida KT2440
ccgcgcucgguugau

SEQ ID NO: 3550050 - RNA, 13 nt, Pseudomonas putida KT2440
ccgcgcugacgca

SEQ ID NO: 3550051 - RNA, 22 nt, Pseudomonas putida KT2440
ccgcgcugccucgucggacagc

SEQ ID NO: 3550052 - RNA, 15 nt, Pseudomonas putida KT2440
ccgcgcuggcgcgcu

SEQ ID NO: 3550053 - RNA, 17 nt, Pseudomonas putida KT2440
ccgcgcuggcgcgcugu

SEQ ID NO: 3550054 - RNA, 15 nt, Pseudomonas putida KT2440
ccgcgcuuggcggcc

SEQ ID NO: 3550055 - RNA, 20 nt, Pseudomonas putida KT2440
ccgcgcuuugugcacaagcu

SEQ ID NO: 3550056 - RNA, 19 nt, Pseudomonas putida KT2440
ccgcgcuuugugugcccac

SEQ ID NO: 3550057 - RNA, 14 nt, Pseudomonas putida KT2440
ccgcggaucgcgcc

SEQ ID NO: 3550058 - RNA, 16 nt, Pseudomonas putida KT2440
ccgcggaugcgccugg

SEQ ID NO: 3550059 - RNA, 19 nt, Pseudomonas putida KT2440
ccgcggaugcgccuggccc

SEQ ID NO: 3550060 - RNA, 20 nt, Pseudomonas putida KT2440
ccgcggaugcgccuggcccg

SEQ ID NO: 3550061 - RNA, 16 nt, Pseudomonas putida KT2440
ccgcggcacccaauag

SEQ ID NO: 3550062 - RNA, 22 nt, Pseudomonas putida KT2440
ccgcggcacccaauagcccacc

SEQ ID NO: 3550063 - RNA, 18 nt, Pseudomonas putida KT2440
ccgcggccaacauucacg

SEQ ID NO: 3550064 - RNA, 20 nt, Pseudomonas putida KT2440
ccgcggcgaacacagcggcc

SEQ ID NO: 3550065 - RNA, 16 nt, Pseudomonas putida KT2440
ccgcggcucacccacc

SEQ ID NO: 3550066 - RNA, 19 nt, Pseudomonas putida KT2440
ccgcggcucacccaccagc

SEQ ID NO: 3550067 - RNA, 18 nt, Pseudomonas putida KT2440
ccgcggcugaacacgcuc

SEQ ID NO: 3550068 - RNA, 16 nt, Pseudomonas putida KT2440
ccgcgguaaugcgcac

SEQ ID NO: 3550069 - RNA, 21 nt, Pseudomonas putida KT2440
ccgcgguggauggcacgggcu

SEQ ID NO: 3550070 - RNA, 14 nt, Pseudomonas putida KT2440
ccgcguacagcugc

SEQ ID NO: 3550071 - RNA, 21 nt, Pseudomonas putida KT2440
ccgcguauguuuuguaggcgc

SEQ ID NO: 3550072 - RNA, 14 nt, Pseudomonas putida KT2440
ccgcgucagcucaa

SEQ ID NO: 3550073 - RNA, 15 nt, Pseudomonas putida KT2440
ccgcgucagcucaag

SEQ ID NO: 3550074 - RNA, 18 nt, Pseudomonas putida KT2440
ccgcguccuggacccgca

SEQ ID NO: 3550075 - RNA, 20 nt, Pseudomonas putida KT2440
ccgcguccuggacccgcagc

SEQ ID NO: 3550076 - RNA, 16 nt, Pseudomonas putida KT2440
ccgcguccuugacggg

SEQ ID NO: 3550077 - RNA, 15 nt, Pseudomonas putida KT2440
ccgcgucugccgcag

SEQ ID NO: 3550078 - RNA, 16 nt, Pseudomonas putida KT2440
ccgcgucugccgcagc

SEQ ID NO: 3550079 - RNA, 22 nt, Pseudomonas putida KT2440
ccgcgucugcuucuucgcgggc

SEQ ID NO: 3550080 - RNA, 13 nt, Pseudomonas putida KT2440
ccgcgugacgcgg

SEQ ID NO: 3550081 - RNA, 20 nt, Pseudomonas putida KT2440
ccgcgugcgauguugaucag

SEQ ID NO: 3550082 - RNA, 15 nt, Pseudomonas putida KT2440
ccgcguucacaucgc

SEQ ID NO: 3550083 - RNA, 18 nt, Pseudomonas putida KT2440
ccgcguucgcccaggcgc

SEQ ID NO: 3550084 - RNA, 22 nt, Pseudomonas putida KT2440
ccgcguucgcccaggcgccgca

SEQ ID NO: 3550085 - RNA, 22 nt, Pseudomonas putida KT2440
ccgcuacgacccugaagcccug

SEQ ID NO: 3550086 - RNA, 23 nt, Pseudomonas putida KT2440
ccgcuacgacccugaagcccugg

SEQ ID NO: 3550087 - RNA, 15 nt, Pseudomonas putida KT2440
ccgcuacgcgccccu

SEQ ID NO: 3550088 - RNA, 20 nt, Pseudomonas putida KT2440
ccgcuauccucgaucgccau

SEQ ID NO: 3550089 - RNA, 19 nt, Pseudomonas putida KT2440
ccgcucaaacccggcagcc

SEQ ID NO: 3550090 - RNA, 21 nt, Pseudomonas putida KT2440
ccgcucaaacccggcagccac

SEQ ID NO: 3550091 - RNA, 22 nt, Pseudomonas putida KT2440
ccgcucaaacccggcagccacc

SEQ ID NO: 3550092 - RNA, 15 nt, Pseudomonas putida KT2440
ccgcucaagucugca

SEQ ID NO: 3550093 - RNA, 14 nt, Pseudomonas putida KT2440
ccgcucaccggcca

SEQ ID NO: 3550094 - RNA, 21 nt, Pseudomonas putida KT2440
ccgcucaccggccagcgcgcu

SEQ ID NO: 3550095 - RNA, 16 nt, Pseudomonas putida KT2440
ccgcucagccaccugu

SEQ ID NO: 3550096 - RNA, 13 nt, Pseudomonas putida KT2440
ccgcucagugccg

SEQ ID NO: 3550097 - RNA, 21 nt, Pseudomonas putida KT2440
ccgcucaugguucuggcgcac

SEQ ID NO: 3550098 - RNA, 22 nt, Pseudomonas putida KT2440
ccgcucccacagaaggcugcgu

SEQ ID NO: 3550099 - RNA, 15 nt, Pseudomonas putida KT2440
ccgcucccacaggaa

SEQ ID NO: 3550100 - RNA, 22 nt, Pseudomonas putida KT2440
ccgcucccacaggaauggcacc

SEQ ID NO: 3550101 - RNA, 14 nt, Pseudomonas putida KT2440
ccgcucccacaggc

SEQ ID NO: 3550102 - RNA, 15 nt, Pseudomonas putida KT2440
ccgcucccacaggga

SEQ ID NO: 3550103 - RNA, 19 nt, Pseudomonas putida KT2440
ccgcucccacagggaccgc

SEQ ID NO: 3550104 - RNA, 21 nt, Pseudomonas putida KT2440
ccgcucccacagggaccgcau

SEQ ID NO: 3550105 - RNA, 20 nt, Pseudomonas putida KT2440
ccgcucccacagguacucgc

SEQ ID NO: 3550106 - RNA, 17 nt, Pseudomonas putida KT2440
ccgcucccacagguaug

SEQ ID NO: 3550107 - RNA, 21 nt, Pseudomonas putida KT2440
ccgcucccacaggugcagcac

SEQ ID NO: 3550108 - RNA, 22 nt, Pseudomonas putida KT2440
ccgcucccacagguuugcugag

SEQ ID NO: 3550109 - RNA, 22 nt, Pseudomonas putida KT2440
ccgcuuuuugcgucuccacgac

SEQ ID NO: 3550110 - RNA, 20 nt, Pseudomonas putida KT2440
ccggaacguuuccagcaacc

SEQ ID NO: 3550111 - RNA, 21 nt, Pseudomonas putida KT2440
ccggaacguuuccagcaaccg

SEQ ID NO: 3550112 - RNA, 18 nt, Pseudomonas putida KT2440
ccggaaugcccgggcgca

SEQ ID NO: 3550113 - RNA, 19 nt, Pseudomonas putida KT2440
ccggaaugcccgggcgcag

SEQ ID NO: 3550114 - RNA, 16 nt, Pseudomonas putida KT2440
ccggaauguuaccggc

SEQ ID NO: 3550115 - RNA, 16 nt, Pseudomonas putida KT2440
ccggaauuucugcacc

SEQ ID NO: 3550116 - RNA, 11 nt, Pseudomonas putida KT2440
ccggacagggg

SEQ ID NO: 3550117 - RNA, 20 nt, Pseudomonas putida KT2440
ccggacccugguucuccacg

SEQ ID NO: 3550118 - RNA, 15 nt, Pseudomonas putida KT2440
ccggaccugccgcag

SEQ ID NO: 3550119 - RNA, 16 nt, Pseudomonas putida KT2440
ccggaccugccgcagc

SEQ ID NO: 3550120 - RNA, 21 nt, Pseudomonas putida KT2440
ccggacucacccgcaccucac

SEQ ID NO: 3550121 - RNA, 15 nt, Pseudomonas putida KT2440
ccggacugcaccagg

SEQ ID NO: 3550122 - RNA, 15 nt, Pseudomonas putida KT2440
ccggacuuggacccc

SEQ ID NO: 3550123 - RNA, 16 nt, Pseudomonas putida KT2440
ccggagcgacuucgac

SEQ ID NO: 3550124 - RNA, 19 nt, Pseudomonas putida KT2440
ccggagcgacuucgaccac

SEQ ID NO: 3550125 - RNA, 23 nt, Pseudomonas putida KT2440
ccggagcgacuucgaccacggcc

SEQ ID NO: 3550126 - RNA, 20 nt, Pseudomonas putida KT2440
ccggagcuccccucagacag

SEQ ID NO: 3550127 - RNA, 14 nt, Pseudomonas putida KT2440
ccggagcuggagcc

SEQ ID NO: 3550128 - RNA, 22 nt, Pseudomonas putida KT2440
ccggaggugucaccgcgagcag

SEQ ID NO: 3550129 - RNA, 18 nt, Pseudomonas putida KT2440
ccggaguggaagaugguc

SEQ ID NO: 3550130 - RNA, 20 nt, Pseudomonas putida KT2440
ccggauagagcccggcgcag

SEQ ID NO: 3550131 - RNA, 20 nt, Pseudomonas putida KT2440
ccggaucguugcgggucagc

SEQ ID NO: 3550132 - RNA, 17 nt, Pseudomonas putida KT2440
ccggaucuggcagcuuc

SEQ ID NO: 3550133 - RNA, 15 nt, Pseudomonas putida KT2440
ccggaugacguccgg

SEQ ID NO: 3550134 - RNA, 18 nt, Pseudomonas putida KT2440
ccggauucaacuugggug

SEQ ID NO: 3550135 - RNA, 23 nt, Pseudomonas putida KT2440
ccggauucacggaucagccgcgg

SEQ ID NO: 3550136 - RNA, 16 nt, Pseudomonas putida KT2440
ccggauugucaugcgg

SEQ ID NO: 3550137 - RNA, 19 nt, Pseudomonas putida KT2440
ccggauuucuuccauggcc

SEQ ID NO: 3550138 - RNA, 14 nt, Pseudomonas putida KT2440
ccggcaaacacauc

SEQ ID NO: 3550139 - RNA, 17 nt, Pseudomonas putida KT2440
ccggcaaacacauccac

SEQ ID NO: 3550140 - RNA, 23 nt, Pseudomonas putida KT2440
ccggcaaacacauccaccaggcu

SEQ ID NO: 3550141 - RNA, 18 nt, Pseudomonas putida KT2440
ccggcaacccuucggcca

SEQ ID NO: 3550142 - RNA, 21 nt, Pseudomonas putida KT2440
ccggcaacgaacuugcggaac

SEQ ID NO: 3550143 - RNA, 21 nt, Pseudomonas putida KT2440
ccggcaacgauacccacgccc

SEQ ID NO: 3550144 - RNA, 13 nt, Pseudomonas putida KT2440
ccggcaacggcca

SEQ ID NO: 3550145 - RNA, 18 nt, Pseudomonas putida KT2440
ccggcaacuccuccagcc

SEQ ID NO: 3550146 - RNA, 19 nt, Pseudomonas putida KT2440
ccggcaacuugcgggucag

SEQ ID NO: 3550147 - RNA, 15 nt, Pseudomonas putida KT2440
ccggcaagcccaugg

SEQ ID NO: 3550148 - RNA, 17 nt, Pseudomonas putida KT2440
ccggcaagcccauggcu

SEQ ID NO: 3550149 - RNA, 14 nt, Pseudomonas putida KT2440
ccggcaagcugguc

SEQ ID NO: 3550150 - RNA, 17 nt, Pseudomonas putida KT2440
ccggcaagcuggucagg

SEQ ID NO: 3550151 - RNA, 17 nt, Pseudomonas putida KT2440
ccggcaaggcauccaga

SEQ ID NO: 3550152 - RNA, 19 nt, Pseudomonas putida KT2440
ccggcaaggcauccagaaa

SEQ ID NO: 3550153 - RNA, 23 nt, Pseudomonas putida KT2440
ccggcaaggcauccagaaacggc

SEQ ID NO: 3550154 - RNA, 17 nt, Pseudomonas putida KT2440
ccggcaauccuggguga

SEQ ID NO: 3550155 - RNA, 13 nt, Pseudomonas putida KT2440
ccggcaaucgcca

SEQ ID NO: 3550156 - RNA, 14 nt, Pseudomonas putida KT2440
ccggcaaucgccag

SEQ ID NO: 3550157 - RNA, 19 nt, Pseudomonas putida KT2440
ccggcaaucgccaggcgca

SEQ ID NO: 3550158 - RNA, 23 nt, Pseudomonas putida KT2440
ccggcaaucucacuuucugcgcu

SEQ ID NO: 3550159 - RNA, 17 nt, Pseudomonas putida KT2440
ccggcaaucugcccaca

SEQ ID NO: 3550160 - RNA, 16 nt, Pseudomonas putida KT2440
ccggcaauuucaucca

SEQ ID NO: 3550161 - RNA, 13 nt, Pseudomonas putida KT2440
ccggcacaaccga

SEQ ID NO: 3550162 - RNA, 16 nt, Pseudomonas putida KT2440
ccggcacaagcguccc

SEQ ID NO: 3550163 - RNA, 21 nt, Pseudomonas putida KT2440
ccggcacaagcgucccugccc

SEQ ID NO: 3550164 - RNA, 22 nt, Pseudomonas putida KT2440
ccggcacagaauccucuaugcc

SEQ ID NO: 3550165 - RNA, 16 nt, Pseudomonas putida KT2440
ccggcacagaccgcaa

SEQ ID NO: 3550166 - RNA, 17 nt, Pseudomonas putida KT2440
ccggcacagaccgcaac

SEQ ID NO: 3550167 - RNA, 14 nt, Pseudomonas putida KT2440
ccggcacagcccag

SEQ ID NO: 3550168 - RNA, 15 nt, Pseudomonas putida KT2440
ccggcacaggaaggc

SEQ ID NO: 3550169 - RNA, 18 nt, Pseudomonas putida KT2440
ccggcacagugccaagga

SEQ ID NO: 3550170 - RNA, 16 nt, Pseudomonas putida KT2440
ccggcacauagaccau

SEQ ID NO: 3550171 - RNA, 14 nt, Pseudomonas putida KT2440
ccggcaccaucuuc

SEQ ID NO: 3550172 - RNA, 23 nt, Pseudomonas putida KT2440
ccggcaccaucuucgacaguuca

SEQ ID NO: 3550173 - RNA, 20 nt, Pseudomonas putida KT2440
ccggcaccccuuucuccagc

SEQ ID NO: 3550174 - RNA, 16 nt, Pseudomonas putida KT2440
ccggcaccgacagcaa

SEQ ID NO: 3550175 - RNA, 20 nt, Pseudomonas putida KT2440
ccggcaccgccucuaccacg

SEQ ID NO: 3550176 - RNA, 21 nt, Pseudomonas putida KT2440
ccggcaccgccucuaccacgc

SEQ ID NO: 3550177 - RNA, 22 nt, Pseudomonas putida KT2440
ccggcaccgccucuaccacgcc

SEQ ID NO: 3550178 - RNA, 18 nt, Pseudomonas putida KT2440
ccggcaccugcuugccgc

SEQ ID NO: 3550179 - RNA, 16 nt, Pseudomonas putida KT2440
ccggcacgcuaccacc

SEQ ID NO: 3550180 - RNA, 12 nt, Pseudomonas putida KT2440
ccggcacugcac

SEQ ID NO: 3550181 - RNA, 13 nt, Pseudomonas putida KT2440
ccggcacugcaca

SEQ ID NO: 3550182 - RNA, 22 nt, Pseudomonas putida KT2440
ccggcagaagcgcugacugcca

SEQ ID NO: 3550183 - RNA, 18 nt, Pseudomonas putida KT2440
ccggcagaaucagguuca

SEQ ID NO: 3550184 - RNA, 19 nt, Pseudomonas putida KT2440
ccggcagaucgagcgccgc

SEQ ID NO: 3550185 - RNA, 22 nt, Pseudomonas putida KT2440
ccggcagaucgagcgccgcccg

SEQ ID NO: 3550186 - RNA, 15 nt, Pseudomonas putida KT2440
ccggcagcaaacccg

SEQ ID NO: 3550187 - RNA, 16 nt, Pseudomonas putida KT2440
ccggcagcaccggcaa

SEQ ID NO: 3550188 - RNA, 12 nt, Pseudomonas putida KT2440
ccggcagcaccu

SEQ ID NO: 3550189 - RNA, 12 nt, Pseudomonas putida KT2440
ccggcagccacc

SEQ ID NO: 3550190 - RNA, 20 nt, Pseudomonas putida KT2440
ccggcagccaccgccggcca

SEQ ID NO: 3550191 - RNA, 14 nt, Pseudomonas putida KT2440
ccggcagcgaugcc

SEQ ID NO: 3550192 - RNA, 18 nt, Pseudomonas putida KT2440
ccggcagcucaccggcaa

SEQ ID NO: 3550193 - RNA, 21 nt, Pseudomonas putida KT2440
ccggcagcucaccggcaaucg

SEQ ID NO: 3550194 - RNA, 12 nt, Pseudomonas putida KT2440
ccggcaggucgg

SEQ ID NO: 3550195 - RNA, 16 nt, Pseudomonas putida KT2440
ccggcaggucggcaac

SEQ ID NO: 3550196 - RNA, 17 nt, Pseudomonas putida KT2440
ccggcagguugcuggcc

SEQ ID NO: 3550197 - RNA, 18 nt, Pseudomonas putida KT2440
ccggcagguugcuggccu

SEQ ID NO: 3550198 - RNA, 18 nt, Pseudomonas putida KT2440
ccggcaguacauagaaca

SEQ ID NO: 3550199 - RNA, 19 nt, Pseudomonas putida KT2440
ccggcaguccacuugcguu

SEQ ID NO: 3550200 - RNA, 15 nt, Pseudomonas putida KT2440
ccggcauaccaucuu

SEQ ID NO: 3550201 - RNA, 16 nt, Pseudomonas putida KT2440
ccggcauaccaucuuc

SEQ ID NO: 3550202 - RNA, 21 nt, Pseudomonas putida KT2440
ccggcauaccaucuucugcag

SEQ ID NO: 3550203 - RNA, 15 nt, Pseudomonas putida KT2440
ccggcauagcgcaag

SEQ ID NO: 3550204 - RNA, 20 nt, Pseudomonas putida KT2440
ccggcaucauccugcuggcc

SEQ ID NO: 3550205 - RNA, 16 nt, Pseudomonas putida KT2440
ccggcauccgccucau

SEQ ID NO: 3550206 - RNA, 20 nt, Pseudomonas putida KT2440
ccggcauccuugggguacac

SEQ ID NO: 3550207 - RNA, 12 nt, Pseudomonas putida KT2440
ccggcaucgcca

SEQ ID NO: 3550208 - RNA, 16 nt, Pseudomonas putida KT2440
ccggcaucgccaacag

SEQ ID NO: 3550209 - RNA, 17 nt, Pseudomonas putida KT2440
ccggcaucgccuccagc

SEQ ID NO: 3550210 - RNA, 15 nt, Pseudomonas putida KT2440
ccggcaucgcucaac

SEQ ID NO: 3550211 - RNA, 16 nt, Pseudomonas putida KT2440
ccggcaugaacacaua

SEQ ID NO: 3550212 - RNA, 23 nt, Pseudomonas putida KT2440
ccggcaugaacacauacccggcc

SEQ ID NO: 3550213 - RNA, 15 nt, Pseudomonas putida KT2440
ccggccaacgacagg

SEQ ID NO: 3550214 - RNA, 18 nt, Pseudomonas putida KT2440
ccggcgcugaucagcugg

SEQ ID NO: 3550215 - RNA, 12 nt, Pseudomonas putida KT2440
ccggcgcuggac

SEQ ID NO: 3550216 - RNA, 13 nt, Pseudomonas putida KT2440
ccggcgcuggaca

SEQ ID NO: 3550217 - RNA, 14 nt, Pseudomonas putida KT2440
ccggcgcugggcuu

SEQ ID NO: 3550218 - RNA, 11 nt, Pseudomonas putida KT2440
ccggcgcuggu

SEQ ID NO: 3550219 - RNA, 18 nt, Pseudomonas putida KT2440
ccggcgcuucggcacgcg

SEQ ID NO: 3550220 - RNA, 18 nt, Pseudomonas putida KT2440
ccggcggauagccccgcc

SEQ ID NO: 3550221 - RNA, 23 nt, Pseudomonas putida KT2440
ccggcggauagccccgcccagca

SEQ ID NO: 3550222 - RNA, 13 nt, Pseudomonas putida KT2440
ccggcggccagca

SEQ ID NO: 3550223 - RNA, 14 nt, Pseudomonas putida KT2440
ccggcggccagcac

SEQ ID NO: 3550224 - RNA, 14 nt, Pseudomonas putida KT2440
ccggcggccaucgc

SEQ ID NO: 3550225 - RNA, 21 nt, Pseudomonas putida KT2440
ccggcggcgaacaucugcucg

SEQ ID NO: 3550226 - RNA, 18 nt, Pseudomonas putida KT2440
ccggcguacucucgucga

SEQ ID NO: 3550227 - RNA, 17 nt, Pseudomonas putida KT2440
ccggcgucccggccagc

SEQ ID NO: 3550228 - RNA, 20 nt, Pseudomonas putida KT2440
ccggcgucccggccagcgac

SEQ ID NO: 3550229 - RNA, 21 nt, Pseudomonas putida KT2440
ccggcgucccggccagcgacc

SEQ ID NO: 3550230 - RNA, 12 nt, Pseudomonas putida KT2440
ccggcgucgauc

SEQ ID NO: 3550231 - RNA, 21 nt, Pseudomonas putida KT2440
ccggcgucgaucugcaggugg

SEQ ID NO: 3550232 - RNA, 16 nt, Pseudomonas putida KT2440
ccggcgucggcgcgca

SEQ ID NO: 3550233 - RNA, 23 nt, Pseudomonas putida KT2440
ccggcgucggcgcgcaacagcaa

SEQ ID NO: 3550234 - RNA, 14 nt, Pseudomonas putida KT2440
ccggcgugccgucg

SEQ ID NO: 3550235 - RNA, 16 nt, Pseudomonas putida KT2440
ccggcguguccagcag

SEQ ID NO: 3550236 - RNA, 17 nt, Pseudomonas putida KT2440
ccggcguguugccgcug

SEQ ID NO: 3550237 - RNA, 16 nt, Pseudomonas putida KT2440
ccggcguucaggcgcg

SEQ ID NO: 3550238 - RNA, 17 nt, Pseudomonas putida KT2440
ccggcguucgaaagccc

SEQ ID NO: 3550239 - RNA, 17 nt, Pseudomonas putida KT2440
ccggcuaucggccagca

SEQ ID NO: 3550240 - RNA, 18 nt, Pseudomonas putida KT2440
ccggcuaucggccagcaa

SEQ ID NO: 3550241 - RNA, 19 nt, Pseudomonas putida KT2440
ccggcuaucucaggccagu

SEQ ID NO: 3550242 - RNA, 16 nt, Pseudomonas putida KT2440
ccggcucaucaggcga

SEQ ID NO: 3550243 - RNA, 17 nt, Pseudomonas putida KT2440
ccggcucaucaggcgau

SEQ ID NO: 3550244 - RNA, 20 nt, Pseudomonas putida KT2440
ccggcuccaccugcuccagc

SEQ ID NO: 3550245 - RNA, 21 nt, Pseudomonas putida KT2440
ccggcuccaccugcuccagca

SEQ ID NO: 3550246 - RNA, 16 nt, Pseudomonas putida KT2440
ccggcuccagguacuc

SEQ ID NO: 3550247 - RNA, 19 nt, Pseudomonas putida KT2440
ccggcuccgcgcaagcggu

SEQ ID NO: 3550248 - RNA, 16 nt, Pseudomonas putida KT2440
ccggcucgccauugau

SEQ ID NO: 3550249 - RNA, 16 nt, Pseudomonas putida KT2440
ccggcucgucacugcc

SEQ ID NO: 3550250 - RNA, 21 nt, Pseudomonas putida KT2440
ccggcucuaucuucaggcauc

SEQ ID NO: 3550251 - RNA, 13 nt, Pseudomonas putida KT2440
ccggcucugccgg

SEQ ID NO: 3550252 - RNA, 15 nt, Pseudomonas putida KT2440
ccggcucugccggug

SEQ ID NO: 3550253 - RNA, 17 nt, Pseudomonas putida KT2440
ccggcucugccgguguu

SEQ ID NO: 3550254 - RNA, 22 nt, Pseudomonas putida KT2440
ccggcugaaauggcggcccagc

SEQ ID NO: 3550255 - RNA, 13 nt, Pseudomonas putida KT2440
ccggcugcagcag

SEQ ID NO: 3550256 - RNA, 14 nt, Pseudomonas putida KT2440
ccggcugcauccac

SEQ ID NO: 3550257 - RNA, 18 nt, Pseudomonas putida KT2440
ccggcuggacaccucccg

SEQ ID NO: 3550258 - RNA, 16 nt, Pseudomonas putida KT2440
ccggcuggauggcgcg

SEQ ID NO: 3550259 - RNA, 17 nt, Pseudomonas putida KT2440
ccggcuggauggcgcgg

SEQ ID NO: 3550260 - RNA, 22 nt, Pseudomonas putida KT2440
ccggcuggauggcgcggugagg

SEQ ID NO: 3550261 - RNA, 13 nt, Pseudomonas putida KT2440
ccggcugguacuc

SEQ ID NO: 3550262 - RNA, 20 nt, Pseudomonas putida KT2440
ccggcugguacuccacuucc

SEQ ID NO: 3550263 - RNA, 21 nt, Pseudomonas putida KT2440
ccggcugguacuccacuucca

SEQ ID NO: 3550264 - RNA, 22 nt, Pseudomonas putida KT2440
ccggcuggucgaaccaguacug

SEQ ID NO: 3550265 - RNA, 13 nt, Pseudomonas putida KT2440
ccggcugucucca

SEQ ID NO: 3550266 - RNA, 23 nt, Pseudomonas putida KT2440
ccggcuugagacauucaccgccu

SEQ ID NO: 3550267 - RNA, 19 nt, Pseudomonas putida KT2440
ccggcuugcaccaacggcu

SEQ ID NO: 3550268 - RNA, 15 nt, Pseudomonas putida KT2440
ccggcuugcgcccgu

SEQ ID NO: 3550269 - RNA, 14 nt, Pseudomonas putida KT2440
ccggcuugcuccaa

SEQ ID NO: 3550270 - RNA, 15 nt, Pseudomonas putida KT2440
ccggcuuguagccgg

SEQ ID NO: 3550271 - RNA, 16 nt, Pseudomonas putida KT2440
ccggcuuguagccggc

SEQ ID NO: 3550272 - RNA, 18 nt, Pseudomonas putida KT2440
ccggcuuguagccggcag

SEQ ID NO: 3550273 - RNA, 16 nt, Pseudomonas putida KT2440
ccggcuugucuuccag

SEQ ID NO: 3550274 - RNA, 22 nt, Pseudomonas putida KT2440
ccggcuugucuuccaguuccau

SEQ ID NO: 3550275 - RNA, 19 nt, Pseudomonas putida KT2440
ccggcuuguucuguuucac

SEQ ID NO: 3550276 - RNA, 18 nt, Pseudomonas putida KT2440
ccgggaaaagccugccag

SEQ ID NO: 3550277 - RNA, 19 nt, Pseudomonas putida KT2440
ccgggaaaagccugccagg

SEQ ID NO: 3550278 - RNA, 16 nt, Pseudomonas putida KT2440
ccgggaaaucuuccgc

SEQ ID NO: 3550279 - RNA, 15 nt, Pseudomonas putida KT2440
ccgggaacagccgcg

SEQ ID NO: 3550280 - RNA, 19 nt, Pseudomonas putida KT2440
ccgggaagcaggucucgac

SEQ ID NO: 3550281 - RNA, 22 nt, Pseudomonas putida KT2440
ccgggaagcgcccgcccaccac

SEQ ID NO: 3550282 - RNA, 21 nt, Pseudomonas putida KT2440
ccgggacagcaccaugcgcgg

SEQ ID NO: 3550283 - RNA, 15 nt, Pseudomonas putida KT2440
ccgggagggcuuugc

SEQ ID NO: 3550284 - RNA, 22 nt, Pseudomonas putida KT2440
ccgggagggcuuugcccuccua

SEQ ID NO: 3550285 - RNA, 16 nt, Pseudomonas putida KT2440
ccgggauacugcgcac

SEQ ID NO: 3550286 - RNA, 14 nt, Pseudomonas putida KT2440
ccgggaucaccgca

SEQ ID NO: 3550287 - RNA, 12 nt, Pseudomonas putida KT2440
ccgggaugcucu

SEQ ID NO: 3550288 - RNA, 20 nt, Pseudomonas putida KT2440
ccgggaugcucugcagcagc

SEQ ID NO: 3550289 - RNA, 19 nt, Pseudomonas putida KT2440
ccgggauucgacuaucagg

SEQ ID NO: 3550290 - RNA, 21 nt, Pseudomonas putida KT2440
ccgggcaaugauccgguccag

SEQ ID NO: 3550291 - RNA, 14 nt, Pseudomonas putida KT2440
ccgggcaauggcgc

SEQ ID NO: 3550292 - RNA, 21 nt, Pseudomonas putida KT2440
ccgggcacaucaccagcagcu

SEQ ID NO: 3550293 - RNA, 17 nt, Pseudomonas putida KT2440
ccgggcacgggccagcg

SEQ ID NO: 3550294 - RNA, 10 nt, Pseudomonas putida KT2440
ccgggcacug

SEQ ID NO: 3550295 - RNA, 14 nt, Pseudomonas putida KT2440
ccgggcacugcccg

SEQ ID NO: 3550296 - RNA, 17 nt, Pseudomonas putida KT2440
ccgggcacuuggcauug

SEQ ID NO: 3550297 - RNA, 16 nt, Pseudomonas putida KT2440
ccgggcagcgggcucg

SEQ ID NO: 3550298 - RNA, 18 nt, Pseudomonas putida KT2440
ccgggcagcgggcucgcc

SEQ ID NO: 3550299 - RNA, 19 nt, Pseudomonas putida KT2440
ccgggcagcgggcucgccc

SEQ ID NO: 3550300 - RNA, 22 nt, Pseudomonas putida KT2440
ccgggcagcgggcucgcccaca

SEQ ID NO: 3550301 - RNA, 20 nt, Pseudomonas putida KT2440
ccgggcaggccaugcccgcc

SEQ ID NO: 3550302 - RNA, 17 nt, Pseudomonas putida KT2440
ccgggcaucgaucacua

SEQ ID NO: 3550303 - RNA, 21 nt, Pseudomonas putida KT2440
ccgggcauguucaacgcaaug

SEQ ID NO: 3550304 - RNA, 12 nt, Pseudomonas putida KT2440
ccgggccaccac

SEQ ID NO: 3550305 - RNA, 14 nt, Pseudomonas putida KT2440
ccgggccaccaccg

SEQ ID NO: 3550306 - RNA, 15 nt, Pseudomonas putida KT2440
ccgggccaccaccgc

SEQ ID NO: 3550307 - RNA, 13 nt, Pseudomonas putida KT2440
ccgggccaugcuu

SEQ ID NO: 3550308 - RNA, 19 nt, Pseudomonas putida KT2440
ccgggccaugcuuuccagg

SEQ ID NO: 3550309 - RNA, 14 nt, Pseudomonas putida KT2440
ccgggccuucaacc

SEQ ID NO: 3550310 - RNA, 23 nt, Pseudomonas putida KT2440
ccgggccuucaaccucacuggca

SEQ ID NO: 3550311 - RNA, 17 nt, Pseudomonas putida KT2440
ccgggccuugaccagca

SEQ ID NO: 3550312 - RNA, 17 nt, Pseudomonas putida KT2440
ccgggccuuucaccgcu

SEQ ID NO: 3550313 - RNA, 19 nt, Pseudomonas putida KT2440
ccgggccuuucaccgcuuc

SEQ ID NO: 3550314 - RNA, 21 nt, Pseudomonas putida KT2440
ccgggcgcaccacgaucacgc

SEQ ID NO: 3550315 - RNA, 20 nt, Pseudomonas putida KT2440
ccgggcgcgggcccuguggg

SEQ ID NO: 3550316 - RNA, 21 nt, Pseudomonas putida KT2440
ccgggcgcgguuuuuucaugc

SEQ ID NO: 3550317 - RNA, 23 nt, Pseudomonas putida KT2440
ccgggcggccaccggccacgcgc

SEQ ID NO: 3550318 - RNA, 15 nt, Pseudomonas putida KT2440
ccgggcgggugcaug

SEQ ID NO: 3550319 - RNA, 14 nt, Pseudomonas putida KT2440
ccgguucgccccca

SEQ ID NO: 3550320 - RNA, 18 nt, Pseudomonas putida KT2440
ccgguucgcccccacggg

SEQ ID NO: 3550321 - RNA, 14 nt, Pseudomonas putida KT2440
ccgguucgccgccg

SEQ ID NO: 3550322 - RNA, 18 nt, Pseudomonas putida KT2440
ccgguucucgcgaaccgg

SEQ ID NO: 3550323 - RNA, 19 nt, Pseudomonas putida KT2440
ccgguucugccggggcaug

SEQ ID NO: 3550324 - RNA, 23 nt, Pseudomonas putida KT2440
ccgguugcgcagccggccuugcu

SEQ ID NO: 3550325 - RNA, 18 nt, Pseudomonas putida KT2440
ccgguuggucgaagccga

SEQ ID NO: 3550326 - RNA, 17 nt, Pseudomonas putida KT2440
ccgguuucucgcagcag

SEQ ID NO: 3550327 - RNA, 20 nt, Pseudomonas putida KT2440
ccgguuucucgcagcagcac

SEQ ID NO: 3550328 - RNA, 20 nt, Pseudomonas putida KT2440
ccgguuugcgcucgcugccg

SEQ ID NO: 3550329 - RNA, 17 nt, Pseudomonas putida KT2440
ccgguuuguccuggccg

SEQ ID NO: 3550330 - RNA, 13 nt, Pseudomonas putida KT2440
ccgguuuuuucau

SEQ ID NO: 3550331 - RNA, 14 nt, Pseudomonas putida KT2440
ccguacagaccgcc

SEQ ID NO: 3550332 - RNA, 13 nt, Pseudomonas putida KT2440
ccguacccaggug

SEQ ID NO: 3550333 - RNA, 14 nt, Pseudomonas putida KT2440
ccguacccagguga

SEQ ID NO: 3550334 - RNA, 19 nt, Pseudomonas putida KT2440
ccguacccuuccuggagac

SEQ ID NO: 3550335 - RNA, 18 nt, Pseudomonas putida KT2440
ccguacggcccaugucga

SEQ ID NO: 3550336 - RNA, 23 nt, Pseudomonas putida KT2440
ccguacggcccaugucgaucagc

SEQ ID NO: 3550337 - RNA, 23 nt, Pseudomonas putida KT2440
ccguacucggucugguaacccuc

SEQ ID NO: 3550338 - RNA, 24 nt, Pseudomonas putida KT2440
ccguacugcugggucagcacuugc

SEQ ID NO: 3550339 - RNA, 14 nt, Pseudomonas putida KT2440
ccguacuugcugca

SEQ ID NO: 3550340 - RNA, 20 nt, Pseudomonas putida KT2440
ccguacuugcugcagggcac

SEQ ID NO: 3550341 - RNA, 18 nt, Pseudomonas putida KT2440
ccguagcggucaugcagc

SEQ ID NO: 3550342 - RNA, 22 nt, Pseudomonas putida KT2440
ccguaggagcgggcuugcccgc

SEQ ID NO: 3550343 - RNA, 18 nt, Pseudomonas putida KT2440
ccguaggagcggguuuac

SEQ ID NO: 3550344 - RNA, 19 nt, Pseudomonas putida KT2440
ccguagggggccgcuuugc

SEQ ID NO: 3550345 - RNA, 20 nt, Pseudomonas putida KT2440
ccguaggugaucagcuugcc

SEQ ID NO: 3550346 - RNA, 20 nt, Pseudomonas putida KT2440
ccguaguaggagcggguuua

SEQ ID NO: 3550347 - RNA, 13 nt, Pseudomonas putida KT2440
ccguauucgcggg

SEQ ID NO: 3550348 - RNA, 14 nt, Pseudomonas putida KT2440
ccgucaacgaggcc

SEQ ID NO: 3550349 - RNA, 13 nt, Pseudomonas putida KT2440
ccgucaccagcgu

SEQ ID NO: 3550350 - RNA, 19 nt, Pseudomonas putida KT2440
ccgucaccagcgucacccc

SEQ ID NO: 3550351 - RNA, 11 nt, Pseudomonas putida KT2440
ccgucaccgcu

SEQ ID NO: 3550352 - RNA, 21 nt, Pseudomonas putida KT2440
ccgucagaaagaauggaaagc

SEQ ID NO: 3550353 - RNA, 12 nt, Pseudomonas putida KT2440
ccgucagcagca

SEQ ID NO: 3550354 - RNA, 13 nt, Pseudomonas putida KT2440
ccgucagcagcag

SEQ ID NO: 3550355 - RNA, 18 nt, Pseudomonas putida KT2440
ccgucagcagcaggcgcg

SEQ ID NO: 3550356 - RNA, 14 nt, Pseudomonas putida KT2440
ccgucagcuugccu

SEQ ID NO: 3550357 - RNA, 14 nt, Pseudomonas putida KT2440
ccgucaggcucagc

SEQ ID NO: 3550358 - RNA, 17 nt, Pseudomonas putida KT2440
ccgucaggcucagcagg

SEQ ID NO: 3550359 - RNA, 17 nt, Pseudomonas putida KT2440
ccgucagguucaagccu

SEQ ID NO: 3550360 - RNA, 19 nt, Pseudomonas putida KT2440
ccgucaguuugggcgggcu

SEQ ID NO: 3550361 - RNA, 18 nt, Pseudomonas putida KT2440
ccgucaucgauccccagu

SEQ ID NO: 3550362 - RNA, 19 nt, Pseudomonas putida KT2440
ccgucaucgauccccaguu

SEQ ID NO: 3550363 - RNA, 13 nt, Pseudomonas putida KT2440
ccguccacagcga

SEQ ID NO: 3550364 - RNA, 18 nt, Pseudomonas putida KT2440
ccguccaccaucuccagc

SEQ ID NO: 3550365 - RNA, 14 nt, Pseudomonas putida KT2440
ccguccagcugagc

SEQ ID NO: 3550366 - RNA, 19 nt, Pseudomonas putida KT2440
ccguccagcugagcgccau

SEQ ID NO: 3550367 - RNA, 19 nt, Pseudomonas putida KT2440
ccguccagguagcgcucga

SEQ ID NO: 3550368 - RNA, 23 nt, Pseudomonas putida KT2440
ccguccagguagcgcucgacauc

SEQ ID NO: 3550369 - RNA, 17 nt, Pseudomonas putida KT2440
ccguccccaaccggguu

SEQ ID NO: 3550370 - RNA, 16 nt, Pseudomonas putida KT2440
ccguccggcaaucugc

SEQ ID NO: 3550371 - RNA, 19 nt, Pseudomonas putida KT2440
ccguccggcuugcugugag

SEQ ID NO: 3550372 - RNA, 18 nt, Pseudomonas putida KT2440
ccguccucgacccaguca

SEQ ID NO: 3550373 - RNA, 17 nt, Pseudomonas putida KT2440
ccgucgaaugcgacuga

SEQ ID NO: 3550374 - RNA, 21 nt, Pseudomonas putida KT2440
ccgucgaaugcgacugaggca

SEQ ID NO: 3550375 - RNA, 23 nt, Pseudomonas putida KT2440
ccgucgaaugcgacugaggcacc

SEQ ID NO: 3550376 - RNA, 12 nt, Pseudomonas putida KT2440
ccgucgaccagg

SEQ ID NO: 3550377 - RNA, 13 nt, Pseudomonas putida KT2440
ccgucgaccaggc

SEQ ID NO: 3550378 - RNA, 15 nt, Pseudomonas putida KT2440
ccgucgagccggguc

SEQ ID NO: 3550379 - RNA, 16 nt, Pseudomonas putida KT2440
ccgucgaucacaugcg

SEQ ID NO: 3550380 - RNA, 17 nt, Pseudomonas putida KT2440
ccgucgaucacaugcgg

SEQ ID NO: 3550381 - RNA, 22 nt, Pseudomonas putida KT2440
ccgucgaucacaugcggcaccg

SEQ ID NO: 3550382 - RNA, 15 nt, Pseudomonas putida KT2440
ccgucgaugccugug

SEQ ID NO: 3550383 - RNA, 17 nt, Pseudomonas putida KT2440
ccgucgaugucggcgug

SEQ ID NO: 3550384 - RNA, 20 nt, Pseudomonas putida KT2440
ccgucgauuuccccgacuga

SEQ ID NO: 3550385 - RNA, 14 nt, Pseudomonas putida KT2440
ccgucgccgcuucg

SEQ ID NO: 3550386 - RNA, 16 nt, Pseudomonas putida KT2440
ccgucgccgcuucggc

SEQ ID NO: 3550387 - RNA, 22 nt, Pseudomonas putida KT2440
ccgucgccggccggcucgccau

SEQ ID NO: 3550388 - RNA, 16 nt, Pseudomonas putida KT2440
ccgucgccucaccucc

SEQ ID NO: 3550389 - RNA, 13 nt, Pseudomonas putida KT2440
ccgucgccucccc

SEQ ID NO: 3550390 - RNA, 18 nt, Pseudomonas putida KT2440
ccgucgggcacgaucagc

SEQ ID NO: 3550391 - RNA, 19 nt, Pseudomonas putida KT2440
ccgucguaggagcggguuc

SEQ ID NO: 3550392 - RNA, 21 nt, Pseudomonas putida KT2440
ccgucguaggagcggguucac

SEQ ID NO: 3550393 - RNA, 17 nt, Pseudomonas putida KT2440
ccgucucugaccggcac

SEQ ID NO: 3550394 - RNA, 21 nt, Pseudomonas putida KT2440
ccgucucugaccggcacugca

SEQ ID NO: 3550395 - RNA, 14 nt, Pseudomonas putida KT2440
ccgucuggcugcaa

SEQ ID NO: 3550396 - RNA, 19 nt, Pseudomonas putida KT2440
ccgucuuccucgacccagc

SEQ ID NO: 3550397 - RNA, 22 nt, Pseudomonas putida KT2440
ccgucuuucagguuccaagcgu

SEQ ID NO: 3550398 - RNA, 15 nt, Pseudomonas putida KT2440
ccgucuuuuccgugc

SEQ ID NO: 3550399 - RNA, 22 nt, Pseudomonas putida KT2440
ccgugaaaccgaaaaagccuac

SEQ ID NO: 3550400 - RNA, 11 nt, Pseudomonas putida KT2440
ccgugaagacg

SEQ ID NO: 3550401 - RNA, 18 nt, Pseudomonas putida KT2440
ccgugaagacgcacacuc

SEQ ID NO: 3550402 - RNA, 15 nt, Pseudomonas putida KT2440
ccgugaagaggccag

SEQ ID NO: 3550403 - RNA, 20 nt, Pseudomonas putida KT2440
ccgugaauccggggccgcaa

SEQ ID NO: 3550404 - RNA, 13 nt, Pseudomonas putida KT2440
ccgugagccagga

SEQ ID NO: 3550405 - RNA, 14 nt, Pseudomonas putida KT2440
ccgugcaccagcac

SEQ ID NO: 3550406 - RNA, 15 nt, Pseudomonas putida KT2440
ccgugcaccagcacc

SEQ ID NO: 3550407 - RNA, 20 nt, Pseudomonas putida KT2440
ccgugcacgucgaugaaggc

SEQ ID NO: 3550408 - RNA, 14 nt, Pseudomonas putida KT2440
ccgugcagcaccgc

SEQ ID NO: 3550409 - RNA, 13 nt, Pseudomonas putida KT2440
ccgugcaggcggc

SEQ ID NO: 3550410 - RNA, 21 nt, Pseudomonas putida KT2440
ccgugcaggggucugugcagc

SEQ ID NO: 3550411 - RNA, 13 nt, Pseudomonas putida KT2440
ccgugcaggucag

SEQ ID NO: 3550412 - RNA, 17 nt, Pseudomonas putida KT2440
ccgugcauacacccggu

SEQ ID NO: 3550413 - RNA, 15 nt, Pseudomonas putida KT2440
ccgugcccaccagcg

SEQ ID NO: 3550414 - RNA, 16 nt, Pseudomonas putida KT2440
ccgugcccaccagcgc

SEQ ID NO: 3550415 - RNA, 12 nt, Pseudomonas putida KT2440
ccgugcccggca

SEQ ID NO: 3550416 - RNA, 13 nt, Pseudomonas putida KT2440
ccgugcccggcau

SEQ ID NO: 3550417 - RNA, 18 nt, Pseudomonas putida KT2440
ccgugccgcaucagccgg

SEQ ID NO: 3550418 - RNA, 14 nt, Pseudomonas putida KT2440
ccgugccugccugc

SEQ ID NO: 3550419 - RNA, 11 nt, Pseudomonas putida KT2440
ccgugcgccua

SEQ ID NO: 3550420 - RNA, 16 nt, Pseudomonas putida KT2440
ccgugcgccugaccgu

SEQ ID NO: 3550421 - RNA, 14 nt, Pseudomonas putida KT2440
ccgugcucaggcgg

SEQ ID NO: 3550422 - RNA, 14 nt, Pseudomonas putida KT2440
ccgugcucggccuu

SEQ ID NO: 3550423 - RNA, 17 nt, Pseudomonas putida KT2440
ccgugcuguguuucgcc

SEQ ID NO: 3550424 - RNA, 23 nt, Pseudomonas putida KT2440
ccgugcuugcgggcaaggucgau

SEQ ID NO: 3550425 - RNA, 16 nt, Pseudomonas putida KT2440
ccucagcuggccggcu

SEQ ID NO: 3550426 - RNA, 13 nt, Pseudomonas putida KT2440
ccucaggccccag

SEQ ID NO: 3550427 - RNA, 17 nt, Pseudomonas putida KT2440
ccucaggccccaggcca

SEQ ID NO: 3550428 - RNA, 16 nt, Pseudomonas putida KT2440
ccucagggguaaugcc

SEQ ID NO: 3550429 - RNA, 20 nt, Pseudomonas putida KT2440
ccucagggguaaugccccag

SEQ ID NO: 3550430 - RNA, 23 nt, Pseudomonas putida KT2440
ccucagggguaaugccccagccg

SEQ ID NO: 3550431 - RNA, 21 nt, Pseudomonas putida KT2440
ccucaguaccggucauggcgc

SEQ ID NO: 3550432 - RNA, 17 nt, Pseudomonas putida KT2440
ccucauaaggguaucgg

SEQ ID NO: 3550433 - RNA, 17 nt, Pseudomonas putida KT2440
ccucauaaugcuccgcc

SEQ ID NO: 3550434 - RNA, 17 nt, Pseudomonas putida KT2440
ccucauaguaaggcugg

SEQ ID NO: 3550435 - RNA, 14 nt, Pseudomonas putida KT2440
ccucaucaaaccag

SEQ ID NO: 3550436 - RNA, 20 nt, Pseudomonas putida KT2440
ccucaucccccggcccagcc

SEQ ID NO: 3550437 - RNA, 14 nt, Pseudomonas putida KT2440
ccucauccucgccc

SEQ ID NO: 3550438 - RNA, 20 nt, Pseudomonas putida KT2440
ccucauccucgcccaccagc

SEQ ID NO: 3550439 - RNA, 17 nt, Pseudomonas putida KT2440
ccucaucgaugcccguc

SEQ ID NO: 3550440 - RNA, 19 nt, Pseudomonas putida KT2440
ccucaucgaugcccguccc

SEQ ID NO: 3550441 - RNA, 18 nt, Pseudomonas putida KT2440
ccucaucuacgugcagcu

SEQ ID NO: 3550442 - RNA, 13 nt, Pseudomonas putida KT2440
ccucaugcagcac

SEQ ID NO: 3550443 - RNA, 17 nt, Pseudomonas putida KT2440
ccucaugcagcaccucc

SEQ ID NO: 3550444 - RNA, 18 nt, Pseudomonas putida KT2440
ccucauucagugccuggg

SEQ ID NO: 3550445 - RNA, 17 nt, Pseudomonas putida KT2440
ccucauucgcccgcacc

SEQ ID NO: 3550446 - RNA, 18 nt, Pseudomonas putida KT2440
ccucauuucaggcuucag

SEQ ID NO: 3550447 - RNA, 22 nt, Pseudomonas putida KT2440
ccuccaacaaucgcgucagcac

SEQ ID NO: 3550448 - RNA, 20 nt, Pseudomonas putida KT2440
ccuccaacucgcgcauccag

SEQ ID NO: 3550449 - RNA, 15 nt, Pseudomonas putida KT2440
ccuccacccgguccc

SEQ ID NO: 3550450 - RNA, 12 nt, Pseudomonas putida KT2440
ccuccaccuuca

SEQ ID NO: 3550451 - RNA, 15 nt, Pseudomonas putida KT2440
ccuccacggucagca

SEQ ID NO: 3550452 - RNA, 19 nt, Pseudomonas putida KT2440
ccuccagcacaccgcgcac

SEQ ID NO: 3550453 - RNA, 11 nt, Pseudomonas putida KT2440
ccuccagcagc

SEQ ID NO: 3550454 - RNA, 12 nt, Pseudomonas putida KT2440
ccuccagcagcg

SEQ ID NO: 3550455 - RNA, 20 nt, Pseudomonas putida KT2440
ccuccagcagcgacaccagc

SEQ ID NO: 3550456 - RNA, 14 nt, Pseudomonas putida KT2440
ccuccagcccugcu

SEQ ID NO: 3550457 - RNA, 21 nt, Pseudomonas putida KT2440
ccuccagcccugcucgccaaa

SEQ ID NO: 3550458 - RNA, 14 nt, Pseudomonas putida KT2440
ccuccagcucgcgc

SEQ ID NO: 3550459 - RNA, 18 nt, Pseudomonas putida KT2440
ccuccagcugaaagucgu

SEQ ID NO: 3550460 - RNA, 20 nt, Pseudomonas putida KT2440
ccuccagguucggguaauag

SEQ ID NO: 3550461 - RNA, 15 nt, Pseudomonas putida KT2440
ccuccaguugccagu

SEQ ID NO: 3550462 - RNA, 13 nt, Pseudomonas putida KT2440
ccucccccacccc

SEQ ID NO: 3550463 - RNA, 21 nt, Pseudomonas putida KT2440
ccucccgcuugcggcgacgca

SEQ ID NO: 3550464 - RNA, 13 nt, Pseudomonas putida KT2440
ccuccgacagcgc

SEQ ID NO: 3550465 - RNA, 16 nt, Pseudomonas putida KT2440
ccuccggcccaucccg

SEQ ID NO: 3550466 - RNA, 14 nt, Pseudomonas putida KT2440
ccuccguugcugcg

SEQ ID NO: 3550467 - RNA, 15 nt, Pseudomonas putida KT2440
ccuccuaaggggaag

SEQ ID NO: 3550468 - RNA, 17 nt, Pseudomonas putida KT2440
ccuccuaucgcgacaca

SEQ ID NO: 3550469 - RNA, 12 nt, Pseudomonas putida KT2440
ccuccuccagca

SEQ ID NO: 3550470 - RNA, 19 nt, Pseudomonas putida KT2440
ccuccuccagcauggcgau

SEQ ID NO: 3550471 - RNA, 18 nt, Pseudomonas putida KT2440
ccuccucgcgggcaaacc

SEQ ID NO: 3550472 - RNA, 19 nt, Pseudomonas putida KT2440
ccuccucgcgggcaaaccc

SEQ ID NO: 3550473 - RNA, 22 nt, Pseudomonas putida KT2440
ccuccugaacgaugcccgggcc

SEQ ID NO: 3550474 - RNA, 21 nt, Pseudomonas putida KT2440
ccuccugauguaggagcgggu

SEQ ID NO: 3550475 - RNA, 22 nt, Pseudomonas putida KT2440
ccuccugauguaggagcggguu

SEQ ID NO: 3550476 - RNA, 24 nt, Pseudomonas putida KT2440
ccuccugcggcagauccugcagcc

SEQ ID NO: 3550477 - RNA, 17 nt, Pseudomonas putida KT2440
ccuccuucagguaaucc

SEQ ID NO: 3550478 - RNA, 15 nt, Pseudomonas putida KT2440
ccucgaacagcgccg

SEQ ID NO: 3550479 - RNA, 19 nt, Pseudomonas putida KT2440
ccucgaacagcgccggcag

SEQ ID NO: 3550480 - RNA, 18 nt, Pseudomonas putida KT2440
ccucgaacgacagcugca

SEQ ID NO: 3550481 - RNA, 22 nt, Pseudomonas putida KT2440
ccucgacaaacugcucgcugcc

SEQ ID NO: 3550482 - RNA, 16 nt, Pseudomonas putida KT2440
ccucgacaaucgccag

SEQ ID NO: 3550483 - RNA, 19 nt, Pseudomonas putida KT2440
ccucgacaaucgccaggua

SEQ ID NO: 3550484 - RNA, 21 nt, Pseudomonas putida KT2440
ccucgaccacgaucuuggcca

SEQ ID NO: 3550485 - RNA, 18 nt, Pseudomonas putida KT2440
ccucgaccacgcacagcu

SEQ ID NO: 3550486 - RNA, 14 nt, Pseudomonas putida KT2440
ccucgaccaggcgc

SEQ ID NO: 3550487 - RNA, 16 nt, Pseudomonas putida KT2440
ccucgacccagccacc

SEQ ID NO: 3550488 - RNA, 20 nt, Pseudomonas putida KT2440
ccucgacccagccacccggc

SEQ ID NO: 3550489 - RNA, 17 nt, Pseudomonas putida KT2440
ccucgacccccuugcca

SEQ ID NO: 3550490 - RNA, 24 nt, Pseudomonas putida KT2440
ccucgacccccuugccagcauggu

SEQ ID NO: 3550491 - RNA, 18 nt, Pseudomonas putida KT2440
ccucgacccgcccgccau

SEQ ID NO: 3550492 - RNA, 13 nt, Pseudomonas putida KT2440
ccucgaccgcacc

SEQ ID NO: 3550493 - RNA, 14 nt, Pseudomonas putida KT2440
ccucgaccuggccc

SEQ ID NO: 3550494 - RNA, 15 nt, Pseudomonas putida KT2440
ccucgaccuggcccg

SEQ ID NO: 3550495 - RNA, 18 nt, Pseudomonas putida KT2440
ccucgaccuggcccgcuu

SEQ ID NO: 3550496 - RNA, 22 nt, Pseudomonas putida KT2440
ccucgacgaccaguucgacgcu

SEQ ID NO: 3550497 - RNA, 20 nt, Pseudomonas putida KT2440
ccucgacgccuuggcgcagc

SEQ ID NO: 3550498 - RNA, 15 nt, Pseudomonas putida KT2440
ccucgagugcgcuga

SEQ ID NO: 3550499 - RNA, 21 nt, Pseudomonas putida KT2440
ccucgaucgucgacaacgcac

SEQ ID NO: 3550500 - RNA, 19 nt, Pseudomonas putida KT2440
ccucgaucucgaagcugcc

SEQ ID NO: 3550501 - RNA, 19 nt, Pseudomonas putida KT2440
ccucgaugcggucuuccag

SEQ ID NO: 3550502 - RNA, 21 nt, Pseudomonas putida KT2440
ccucgaugucuuccagaccag

SEQ ID NO: 3550503 - RNA, 22 nt, Pseudomonas putida KT2440
ccucgaugucuuccagaccaga

SEQ ID NO: 3550504 - RNA, 21 nt, Pseudomonas putida KT2440
ccucgaugugcgugaacacug

SEQ ID NO: 3550505 - RNA, 19 nt, Pseudomonas putida KT2440
ccucgauuuccaccggcuu

SEQ ID NO: 3550506 - RNA, 18 nt, Pseudomonas putida KT2440
ccucgcagguaaucggcc

SEQ ID NO: 3550507 - RNA, 14 nt, Pseudomonas putida KT2440
ccucgcaugcggcc

SEQ ID NO: 3550508 - RNA, 22 nt, Pseudomonas putida KT2440
ccucgccauaagcugucagcac

SEQ ID NO: 3550509 - RNA, 14 nt, Pseudomonas putida KT2440
ccucgcccaccagc

SEQ ID NO: 3550510 - RNA, 19 nt, Pseudomonas putida KT2440
ccucgcccaccagcugcac

SEQ ID NO: 3550511 - RNA, 23 nt, Pseudomonas putida KT2440
ccucgcccaccagcugcaccacc

SEQ ID NO: 3550512 - RNA, 21 nt, Pseudomonas putida KT2440
ccucgcccagaaucucaacca

SEQ ID NO: 3550513 - RNA, 23 nt, Pseudomonas putida KT2440
ccucgcccagaaucucaaccacc

SEQ ID NO: 3550514 - RNA, 17 nt, Pseudomonas putida KT2440
ccucgcccaggccgccg

SEQ ID NO: 3550515 - RNA, 13 nt, Pseudomonas putida KT2440
ccucgcccagguc

SEQ ID NO: 3550516 - RNA, 14 nt, Pseudomonas putida KT2440
ccucgcccagguca

SEQ ID NO: 3550517 - RNA, 23 nt, Pseudomonas putida KT2440
ccucgcccuugucagccgccgcu

SEQ ID NO: 3550518 - RNA, 18 nt, Pseudomonas putida KT2440
ccucgcgcaacaccgcca

SEQ ID NO: 3550519 - RNA, 19 nt, Pseudomonas putida KT2440
ccucgcgcaacaccgccag

SEQ ID NO: 3550520 - RNA, 23 nt, Pseudomonas putida KT2440
ccucgcgcaacaccgccagcggg

SEQ ID NO: 3550521 - RNA, 21 nt, Pseudomonas putida KT2440
ccucgcgcguugcagccauag

SEQ ID NO: 3550522 - RNA, 22 nt, Pseudomonas putida KT2440
ccucgcggcggcuaagcgccag

SEQ ID NO: 3550523 - RNA, 21 nt, Pseudomonas putida KT2440
ccucgcuacccaaacucuuga

SEQ ID NO: 3550524 - RNA, 12 nt, Pseudomonas putida KT2440
ccucgcugccca

SEQ ID NO: 3550525 - RNA, 22 nt, Pseudomonas putida KT2440
ccucgcugccuuuggccgccag

SEQ ID NO: 3550526 - RNA, 16 nt, Pseudomonas putida KT2440
ccucggcaaucugcag

SEQ ID NO: 3550527 - RNA, 20 nt, Pseudomonas putida KT2440
ccucggcaaucugcagcagc

SEQ ID NO: 3550528 - RNA, 16 nt, Pseudomonas putida KT2440
ccucggcaccgcacca

SEQ ID NO: 3550529 - RNA, 20 nt, Pseudomonas putida KT2440
ccucggcaucgaacagcuug

SEQ ID NO: 3550530 - RNA, 15 nt, Pseudomonas putida KT2440
ccugcaaucagcuca

SEQ ID NO: 3550531 - RNA, 16 nt, Pseudomonas putida KT2440
ccugcaaucagcucac

SEQ ID NO: 3550532 - RNA, 20 nt, Pseudomonas putida KT2440
ccugcaaucagcucacaggc

SEQ ID NO: 3550533 - RNA, 16 nt, Pseudomonas putida KT2440
ccugcaauugcacccg

SEQ ID NO: 3550534 - RNA, 15 nt, Pseudomonas putida KT2440
ccugcaauuucuuga

SEQ ID NO: 3550535 - RNA, 20 nt, Pseudomonas putida KT2440
ccugcacaaacuucgggcug

SEQ ID NO: 3550536 - RNA, 15 nt, Pseudomonas putida KT2440
ccugcacaucacgcg

SEQ ID NO: 3550537 - RNA, 17 nt, Pseudomonas putida KT2440
ccugcacaucggccacc

SEQ ID NO: 3550538 - RNA, 15 nt, Pseudomonas putida KT2440
ccugcaccaguuccu

SEQ ID NO: 3550539 - RNA, 23 nt, Pseudomonas putida KT2440
ccugcaccaugauguucugcuug

SEQ ID NO: 3550540 - RNA, 16 nt, Pseudomonas putida KT2440
ccugcacccaggcucu

SEQ ID NO: 3550541 - RNA, 23 nt, Pseudomonas putida KT2440
ccugcaccuggcugagguucagc

SEQ ID NO: 3550542 - RNA, 15 nt, Pseudomonas putida KT2440
ccugcaccugguugc

SEQ ID NO: 3550543 - RNA, 20 nt, Pseudomonas putida KT2440
ccugcacuaagggcaggccu

SEQ ID NO: 3550544 - RNA, 20 nt, Pseudomonas putida KT2440
ccugcacuaccucgcucagg

SEQ ID NO: 3550545 - RNA, 12 nt, Pseudomonas putida KT2440
ccugcacuggcc

SEQ ID NO: 3550546 - RNA, 20 nt, Pseudomonas putida KT2440
ccugcacuggccucuucgcg

SEQ ID NO: 3550547 - RNA, 19 nt, Pseudomonas putida KT2440
ccugcagagacaucuccau

SEQ ID NO: 3550548 - RNA, 22 nt, Pseudomonas putida KT2440
ccugcagagacaucuccauagg

SEQ ID NO: 3550549 - RNA, 17 nt, Pseudomonas putida KT2440
ccugcagagcucagcgu

SEQ ID NO: 3550550 - RNA, 18 nt, Pseudomonas putida KT2440
ccugcagagcucagcgug

SEQ ID NO: 3550551 - RNA, 15 nt, Pseudomonas putida KT2440
ccugcagcccggcaa

SEQ ID NO: 3550552 - RNA, 12 nt, Pseudomonas putida KT2440
ccugcagccgca

SEQ ID NO: 3550553 - RNA, 18 nt, Pseudomonas putida KT2440
ccugcagccgcaccugcc

SEQ ID NO: 3550554 - RNA, 19 nt, Pseudomonas putida KT2440
ccugcagccgcaccugccc

SEQ ID NO: 3550555 - RNA, 18 nt, Pseudomonas putida KT2440
ccugcagccguugcuggg

SEQ ID NO: 3550556 - RNA, 20 nt, Pseudomonas putida KT2440
ccugcagccguugcugggcu

SEQ ID NO: 3550557 - RNA, 14 nt, Pseudomonas putida KT2440
ccugcagcgcguca

SEQ ID NO: 3550558 - RNA, 18 nt, Pseudomonas putida KT2440
ccugcagcgcgucauccg

SEQ ID NO: 3550559 - RNA, 22 nt, Pseudomonas putida KT2440
ccugcagcgcgucauccgccaa

SEQ ID NO: 3550560 - RNA, 13 nt, Pseudomonas putida KT2440
ccugcagcggcaa

SEQ ID NO: 3550561 - RNA, 19 nt, Pseudomonas putida KT2440
ccugcagcucagccagcaa

SEQ ID NO: 3550562 - RNA, 22 nt, Pseudomonas putida KT2440
ccugcagcucagccagcaagcg

SEQ ID NO: 3550563 - RNA, 16 nt, Pseudomonas putida KT2440
ccugcagcuucccggc

SEQ ID NO: 3550564 - RNA, 21 nt, Pseudomonas putida KT2440
ccugcagcuucccggccuggc

SEQ ID NO: 3550565 - RNA, 22 nt, Pseudomonas putida KT2440
ccugcagcuucccggccuggcg

SEQ ID NO: 3550566 - RNA, 22 nt, Pseudomonas putida KT2440
ccugcaggagcggguucacccg

SEQ ID NO: 3550567 - RNA, 15 nt, Pseudomonas putida KT2440
ccugcaggcccugua

SEQ ID NO: 3550568 - RNA, 18 nt, Pseudomonas putida KT2440
ccugcaggcgcggugccg

SEQ ID NO: 3550569 - RNA, 22 nt, Pseudomonas putida KT2440
ccugcaggcgcggugccggcag

SEQ ID NO: 3550570 - RNA, 17 nt, Pseudomonas putida KT2440
ccugcagggcgagcaca

SEQ ID NO: 3550571 - RNA, 21 nt, Pseudomonas putida KT2440
ccugcagggcgagcacacccg

SEQ ID NO: 3550572 - RNA, 23 nt, Pseudomonas putida KT2440
ccugcagggcgagcacacccggc

SEQ ID NO: 3550573 - RNA, 16 nt, Pseudomonas putida KT2440
ccugcagguacagcag

SEQ ID NO: 3550574 - RNA, 17 nt, Pseudomonas putida KT2440
ccugcagguacagcagc

SEQ ID NO: 3550575 - RNA, 18 nt, Pseudomonas putida KT2440
ccugcagguacagcagcu

SEQ ID NO: 3550576 - RNA, 20 nt, Pseudomonas putida KT2440
ccugcagguacagcagcugc

SEQ ID NO: 3550577 - RNA, 18 nt, Pseudomonas putida KT2440
ccugcagguaucacgcga

SEQ ID NO: 3550578 - RNA, 22 nt, Pseudomonas putida KT2440
ccugcagguaucacgcgagcug

SEQ ID NO: 3550579 - RNA, 24 nt, Pseudomonas putida KT2440
ccugcagguaucacgcgagcuguu

SEQ ID NO: 3550580 - RNA, 17 nt, Pseudomonas putida KT2440
ccugcagucgaucccga

SEQ ID NO: 3550581 - RNA, 14 nt, Pseudomonas putida KT2440
ccugcauccacacc

SEQ ID NO: 3550582 - RNA, 22 nt, Pseudomonas putida KT2440
ccugcauccacaccagcggcgc

SEQ ID NO: 3550583 - RNA, 20 nt, Pseudomonas putida KT2440
ccugcaucccuggguucucu

SEQ ID NO: 3550584 - RNA, 18 nt, Pseudomonas putida KT2440
ccugcauccguucggcgc

SEQ ID NO: 3550585 - RNA, 22 nt, Pseudomonas putida KT2440
ccugcaugcucaucgcggccga

SEQ ID NO: 3550586 - RNA, 23 nt, Pseudomonas putida KT2440
ccugcauggcauucgccacuugc

SEQ ID NO: 3550587 - RNA, 22 nt, Pseudomonas putida KT2440
ccugcaugucuucgcccgguuc

SEQ ID NO: 3550588 - RNA, 18 nt, Pseudomonas putida KT2440
ccugccacacacccgggc

SEQ ID NO: 3550589 - RNA, 20 nt, Pseudomonas putida KT2440
ccugccacacacccgggccc

SEQ ID NO: 3550590 - RNA, 12 nt, Pseudomonas putida KT2440
ccugccaccagu

SEQ ID NO: 3550591 - RNA, 13 nt, Pseudomonas putida KT2440
ccugccaccccgc

SEQ ID NO: 3550592 - RNA, 17 nt, Pseudomonas putida KT2440
ccugccagcaccagcgc

SEQ ID NO: 3550593 - RNA, 14 nt, Pseudomonas putida KT2440
ccugccagccccgc

SEQ ID NO: 3550594 - RNA, 15 nt, Pseudomonas putida KT2440
ccugccagccccgca

SEQ ID NO: 3550595 - RNA, 15 nt, Pseudomonas putida KT2440
ccugccagccuucga

SEQ ID NO: 3550596 - RNA, 12 nt, Pseudomonas putida KT2440
ccugccagguca

SEQ ID NO: 3550597 - RNA, 14 nt, Pseudomonas putida KT2440
ccugccagucgcac

SEQ ID NO: 3550598 - RNA, 22 nt, Pseudomonas putida KT2440
ccugccagucgcacagguccag

SEQ ID NO: 3550599 - RNA, 23 nt, Pseudomonas putida KT2440
ccugccagucgcacagguccagc

SEQ ID NO: 3550600 - RNA, 17 nt, Pseudomonas putida KT2440
ccugccaugcaggucga

SEQ ID NO: 3550601 - RNA, 18 nt, Pseudomonas putida KT2440
ccugccaugcaggucgac

SEQ ID NO: 3550602 - RNA, 13 nt, Pseudomonas putida KT2440
ccugccccagcau

SEQ ID NO: 3550603 - RNA, 21 nt, Pseudomonas putida KT2440
ccugccccagcaucaacgcug

SEQ ID NO: 3550604 - RNA, 13 nt, Pseudomonas putida KT2440
ccugccccagcgu

SEQ ID NO: 3550605 - RNA, 16 nt, Pseudomonas putida KT2440
ccugcccgaucgccuc

SEQ ID NO: 3550606 - RNA, 19 nt, Pseudomonas putida KT2440
ccugcccgaucgccucgcu

SEQ ID NO: 3550607 - RNA, 24 nt, Pseudomonas putida KT2440
ccugcccgaucgccucgcuggcgg

SEQ ID NO: 3550608 - RNA, 13 nt, Pseudomonas putida KT2440
ccugcccgccccc

SEQ ID NO: 3550609 - RNA, 22 nt, Pseudomonas putida KT2440
ccugcccgccccccaccuggcc

SEQ ID NO: 3550610 - RNA, 13 nt, Pseudomonas putida KT2440
ccugcccgccguc

SEQ ID NO: 3550611 - RNA, 16 nt, Pseudomonas putida KT2440
ccugcccgccguccag

SEQ ID NO: 3550612 - RNA, 17 nt, Pseudomonas putida KT2440
ccugcccggcguucagg

SEQ ID NO: 3550613 - RNA, 18 nt, Pseudomonas putida KT2440
ccugcccgggaacggcug

SEQ ID NO: 3550614 - RNA, 16 nt, Pseudomonas putida KT2440
ccugccgaggccaugu

SEQ ID NO: 3550615 - RNA, 15 nt, Pseudomonas putida KT2440
ccugccgcagcgcau

SEQ ID NO: 3550616 - RNA, 15 nt, Pseudomonas putida KT2440
ccugccgcagcuggc

SEQ ID NO: 3550617 - RNA, 18 nt, Pseudomonas putida KT2440
ccugccgcgauaagcgcg

SEQ ID NO: 3550618 - RNA, 23 nt, Pseudomonas putida KT2440
ccugccgcugauaaccugcauug

SEQ ID NO: 3550619 - RNA, 17 nt, Pseudomonas putida KT2440
ccugccggccucaauuc

SEQ ID NO: 3550620 - RNA, 20 nt, Pseudomonas putida KT2440
ccugccggccucaauuccag

SEQ ID NO: 3550621 - RNA, 18 nt, Pseudomonas putida KT2440
ccugccgggguaaaacgc

SEQ ID NO: 3550622 - RNA, 22 nt, Pseudomonas putida KT2440
ccugccgggucaaggccagcgc

SEQ ID NO: 3550623 - RNA, 15 nt, Pseudomonas putida KT2440
ccugccuaccaccgc

SEQ ID NO: 3550624 - RNA, 19 nt, Pseudomonas putida KT2440
ccugccuugcgauaccccg

SEQ ID NO: 3550625 - RNA, 15 nt, Pseudomonas putida KT2440
ccugcgaaaggcgcu

SEQ ID NO: 3550626 - RNA, 21 nt, Pseudomonas putida KT2440
ccugcgaauacgguagcggcg

SEQ ID NO: 3550627 - RNA, 17 nt, Pseudomonas putida KT2440
ccugcgaauggccgcaa

SEQ ID NO: 3550628 - RNA, 21 nt, Pseudomonas putida KT2440
ccugcgauagaucagcgaugc

SEQ ID NO: 3550629 - RNA, 22 nt, Pseudomonas putida KT2440
ccugcgauugcgauccgcccca

SEQ ID NO: 3550630 - RNA, 18 nt, Pseudomonas putida KT2440
ccugcgcacggcgcuggg

SEQ ID NO: 3550631 - RNA, 19 nt, Pseudomonas putida KT2440
ccugcgcaggcgccgccag

SEQ ID NO: 3550632 - RNA, 20 nt, Pseudomonas putida KT2440
ccugcgcaugcaacggcaca

SEQ ID NO: 3550633 - RNA, 22 nt, Pseudomonas putida KT2440
ccugcgcaugcaacggcacacg

SEQ ID NO: 3550634 - RNA, 21 nt, Pseudomonas putida KT2440
ccugggguuuuuuuggcuggu

SEQ ID NO: 3550635 - RNA, 13 nt, Pseudomonas putida KT2440
ccugggucagcuc

SEQ ID NO: 3550636 - RNA, 17 nt, Pseudomonas putida KT2440
ccugggucagcuccucu

SEQ ID NO: 3550637 - RNA, 18 nt, Pseudomonas putida KT2440
ccugggucugcgggucgu

SEQ ID NO: 3550638 - RNA, 22 nt, Pseudomonas putida KT2440
ccuggguuacggcggccugcug

SEQ ID NO: 3550639 - RNA, 16 nt, Pseudomonas putida KT2440
ccuggguuuauuucuc

SEQ ID NO: 3550640 - RNA, 11 nt, Pseudomonas putida KT2440
ccuggguuuua

SEQ ID NO: 3550641 - RNA, 13 nt, Pseudomonas putida KT2440
ccugguaaggcuc

SEQ ID NO: 3550642 - RNA, 15 nt, Pseudomonas putida KT2440
ccugguacagauggc

SEQ ID NO: 3550643 - RNA, 23 nt, Pseudomonas putida KT2440
ccugguaggucacuucagugcug

SEQ ID NO: 3550644 - RNA, 17 nt, Pseudomonas putida KT2440
ccuggucacgcaguucg

SEQ ID NO: 3550645 - RNA, 20 nt, Pseudomonas putida KT2440
ccuggucacgcaguucgucg

SEQ ID NO: 3550646 - RNA, 16 nt, Pseudomonas putida KT2440
ccuggucacggccacc

SEQ ID NO: 3550647 - RNA, 17 nt, Pseudomonas putida KT2440
ccuggucacggccaccc

SEQ ID NO: 3550648 - RNA, 16 nt, Pseudomonas putida KT2440
ccuggucaugcagcgg

SEQ ID NO: 3550649 - RNA, 15 nt, Pseudomonas putida KT2440
ccuggucgccgccac

SEQ ID NO: 3550650 - RNA, 18 nt, Pseudomonas putida KT2440
ccuggucgcgggccagcc

SEQ ID NO: 3550651 - RNA, 16 nt, Pseudomonas putida KT2440
ccuggugaucaacaaa

SEQ ID NO: 3550652 - RNA, 17 nt, Pseudomonas putida KT2440
ccuggugccagcggcca

SEQ ID NO: 3550653 - RNA, 13 nt, Pseudomonas putida KT2440
ccuggugcgccuu

SEQ ID NO: 3550654 - RNA, 15 nt, Pseudomonas putida KT2440
ccugguuauccaggu

SEQ ID NO: 3550655 - RNA, 16 nt, Pseudomonas putida KT2440
ccugguuauccaggua

SEQ ID NO: 3550656 - RNA, 14 nt, Pseudomonas putida KT2440
ccugguucaucgac

SEQ ID NO: 3550657 - RNA, 21 nt, Pseudomonas putida KT2440
ccugguugcguucgucgaugu

SEQ ID NO: 3550658 - RNA, 12 nt, Pseudomonas putida KT2440
ccugguuguagc

SEQ ID NO: 3550659 - RNA, 22 nt, Pseudomonas putida KT2440
ccugguuguagcccgggcagcc

SEQ ID NO: 3550660 - RNA, 18 nt, Pseudomonas putida KT2440
ccugguuuuccaccggca

SEQ ID NO: 3550661 - RNA, 15 nt, Pseudomonas putida KT2440
ccugguuuucgcggu

SEQ ID NO: 3550662 - RNA, 18 nt, Pseudomonas putida KT2440
ccugguuuucgcucgccg

SEQ ID NO: 3550663 - RNA, 20 nt, Pseudomonas putida KT2440
ccuguaacucagcuuacgcc

SEQ ID NO: 3550664 - RNA, 17 nt, Pseudomonas putida KT2440
ccuguacacagcccaag

SEQ ID NO: 3550665 - RNA, 22 nt, Pseudomonas putida KT2440
ccuguacauccagcuccagcac

SEQ ID NO: 3550666 - RNA, 12 nt, Pseudomonas putida KT2440
ccuguacccgcu

SEQ ID NO: 3550667 - RNA, 20 nt, Pseudomonas putida KT2440
ccuguaccgaccucuucgcg

SEQ ID NO: 3550668 - RNA, 20 nt, Pseudomonas putida KT2440
ccuguaccgcccucuucgcg

SEQ ID NO: 3550669 - RNA, 20 nt, Pseudomonas putida KT2440
ccuguaccggccuuuucgcg

SEQ ID NO: 3550670 - RNA, 17 nt, Pseudomonas putida KT2440
ccuguagccccgcuggu

SEQ ID NO: 3550671 - RNA, 12 nt, Pseudomonas putida KT2440
ccuguaggagcg

SEQ ID NO: 3550672 - RNA, 16 nt, Pseudomonas putida KT2440
ccuguaggagcgggcu

SEQ ID NO: 3550673 - RNA, 19 nt, Pseudomonas putida KT2440
ccuguaggaucggguuuac

SEQ ID NO: 3550674 - RNA, 17 nt, Pseudomonas putida KT2440
ccuguaggcgcggguuu

SEQ ID NO: 3550675 - RNA, 19 nt, Pseudomonas putida KT2440
ccuguaggcgcggguuuac

SEQ ID NO: 3550676 - RNA, 18 nt, Pseudomonas putida KT2440
ccuguaggcgcggguuug

SEQ ID NO: 3550677 - RNA, 19 nt, Pseudomonas putida KT2440
ccuguaggcgcggguuugc

SEQ ID NO: 3550678 - RNA, 18 nt, Pseudomonas putida KT2440
ccugucaagcguuuuuug

SEQ ID NO: 3550679 - RNA, 16 nt, Pseudomonas putida KT2440
ccugucacgccuucaa

SEQ ID NO: 3550680 - RNA, 17 nt, Pseudomonas putida KT2440
ccugucgcgacgggcug

SEQ ID NO: 3550681 - RNA, 21 nt, Pseudomonas putida KT2440
ccugucgcgacgggcugcucc

SEQ ID NO: 3550682 - RNA, 19 nt, Pseudomonas putida KT2440
ccugucuggccucuucgcg

SEQ ID NO: 3550683 - RNA, 20 nt, Pseudomonas putida KT2440
ccugugaagccagggcaagc

SEQ ID NO: 3550684 - RNA, 23 nt, Pseudomonas putida KT2440
ccugugagaucgagcgccgcccg

SEQ ID NO: 3550685 - RNA, 16 nt, Pseudomonas putida KT2440
ccugugcccaaccacc

SEQ ID NO: 3550686 - RNA, 20 nt, Pseudomonas putida KT2440
ccugugcccaaccaccgacc

SEQ ID NO: 3550687 - RNA, 15 nt, Pseudomonas putida KT2440
ccugugccgggccau

SEQ ID NO: 3550688 - RNA, 16 nt, Pseudomonas putida KT2440
ccugugccgggccauc

SEQ ID NO: 3550689 - RNA, 22 nt, Pseudomonas putida KT2440
ccugugccgggccaucggugcc

SEQ ID NO: 3550690 - RNA, 19 nt, Pseudomonas putida KT2440
ccugugcggcguauccgug

SEQ ID NO: 3550691 - RNA, 19 nt, Pseudomonas putida KT2440
ccugugcuuugagcaggcg

SEQ ID NO: 3550692 - RNA, 16 nt, Pseudomonas putida KT2440
ccuguggaagcgggcg

SEQ ID NO: 3550693 - RNA, 11 nt, Pseudomonas putida KT2440
ccuguggcugu

SEQ ID NO: 3550694 - RNA, 23 nt, Pseudomonas putida KT2440
ccuguggcugugguucaccgugu

SEQ ID NO: 3550695 - RNA, 15 nt, Pseudomonas putida KT2440
ccugugggagcggcc

SEQ ID NO: 3550696 - RNA, 16 nt, Pseudomonas putida KT2440
ccugugggagcggccu

SEQ ID NO: 3550697 - RNA, 18 nt, Pseudomonas putida KT2440
ccugugggagcgggcaug

SEQ ID NO: 3550698 - RNA, 18 nt, Pseudomonas putida KT2440
ccugugggagcgggcgug

SEQ ID NO: 3550699 - RNA, 20 nt, Pseudomonas putida KT2440
ccugugggagcgggcgugcc

SEQ ID NO: 3550700 - RNA, 20 nt, Pseudomonas putida KT2440
ccugugggagcgggcuugcc

SEQ ID NO: 3550701 - RNA, 17 nt, Pseudomonas putida KT2440
ccuguggggcaacugcg

SEQ ID NO: 3550702 - RNA, 14 nt, Pseudomonas putida KT2440
ccuguggguaaccc

SEQ ID NO: 3550703 - RNA, 19 nt, Pseudomonas putida KT2440
ccuguggguaacccugcuc

SEQ ID NO: 3550704 - RNA, 22 nt, Pseudomonas putida KT2440
ccuguggguaacccugcucgcc

SEQ ID NO: 3550705 - RNA, 17 nt, Pseudomonas putida KT2440
ccuguggguaugccacg

SEQ ID NO: 3550706 - RNA, 15 nt, Pseudomonas putida KT2440
ccugugguggcugcu

SEQ ID NO: 3550707 - RNA, 18 nt, Pseudomonas putida KT2440
ccuguguaggagcggguu

SEQ ID NO: 3550708 - RNA, 20 nt, Pseudomonas putida KT2440
ccuguguaggagcggguuca

SEQ ID NO: 3550709 - RNA, 21 nt, Pseudomonas putida KT2440
ccuguguaggagcggguuuac

SEQ ID NO: 3550710 - RNA, 15 nt, Pseudomonas putida KT2440
ccuguguccaacacc

SEQ ID NO: 3550711 - RNA, 19 nt, Pseudomonas putida KT2440
ccuguguccacccccgcuc

SEQ ID NO: 3550712 - RNA, 17 nt, Pseudomonas putida KT2440
ccuguucccccaccggc

SEQ ID NO: 3550713 - RNA, 20 nt, Pseudomonas putida KT2440
ccuguuccggccucuucgcg

SEQ ID NO: 3550714 - RNA, 24 nt, Pseudomonas putida KT2440
ccuguucgauuucaccggcuucua

SEQ ID NO: 3550715 - RNA, 15 nt, Pseudomonas putida KT2440
ccuguuuggccgcau

SEQ ID NO: 3550716 - RNA, 18 nt, Pseudomonas putida KT2440
ccuguuuggccgcauaua

SEQ ID NO: 3550717 - RNA, 15 nt, Pseudomonas putida KT2440
ccuuacagaugcugc

SEQ ID NO: 3550718 - RNA, 18 nt, Pseudomonas putida KT2440
ccuuacgcagccuucugu

SEQ ID NO: 3550719 - RNA, 14 nt, Pseudomonas putida KT2440
ccuucaaccucacu

SEQ ID NO: 3550720 - RNA, 16 nt, Pseudomonas putida KT2440
ccuucaagcuccccag

SEQ ID NO: 3550721 - RNA, 18 nt, Pseudomonas putida KT2440
ccuucaagcuccccagca

SEQ ID NO: 3550722 - RNA, 16 nt, Pseudomonas putida KT2440
ccuucaauagcggcca

SEQ ID NO: 3550723 - RNA, 19 nt, Pseudomonas putida KT2440
ccuucacggauggcagcga

SEQ ID NO: 3550724 - RNA, 22 nt, Pseudomonas putida KT2440
ccuucacuguggucauccaggc

SEQ ID NO: 3550725 - RNA, 17 nt, Pseudomonas putida KT2440
ccuucagcgccccauca

SEQ ID NO: 3550726 - RNA, 17 nt, Pseudomonas putida KT2440
ccuucagcggccgcgca

SEQ ID NO: 3550727 - RNA, 19 nt, Pseudomonas putida KT2440
ccuucaggccccagucauc

SEQ ID NO: 3550728 - RNA, 18 nt, Pseudomonas putida KT2440
ccuucaggcgcucacccc

SEQ ID NO: 3550729 - RNA, 15 nt, Pseudomonas putida KT2440
ccuucaggcgcuggu

SEQ ID NO: 3550730 - RNA, 20 nt, Pseudomonas putida KT2440
ccuucagguaauccaccagc

SEQ ID NO: 3550731 - RNA, 22 nt, Pseudomonas putida KT2440
ccuucagguaauccaccagccg

SEQ ID NO: 3550732 - RNA, 17 nt, Pseudomonas putida KT2440
ccuucagguugcucuga

SEQ ID NO: 3550733 - RNA, 18 nt, Pseudomonas putida KT2440
ccuucagguugcucugau

SEQ ID NO: 3550734 - RNA, 16 nt, Pseudomonas putida KT2440
ccuucauacagcgccu

SEQ ID NO: 3550735 - RNA, 18 nt, Pseudomonas putida KT2440
ccuucaucacgcaccagg

SEQ ID NO: 3550736 - RNA, 20 nt, Pseudomonas putida KT2440
ccuucauccucgacgaccag

SEQ ID NO: 3550737 - RNA, 12 nt, Pseudomonas putida KT2440
ccuucaucgccg

SEQ ID NO: 3550738 - RNA, 19 nt, Pseudomonas putida KT2440
ccuuccacucuuccaccgc

SEQ ID NO: 3550739 - RNA, 16 nt, Pseudomonas putida KT2440
ccuuggcgugcacgcu

SEQ ID NO: 3550740 - RNA, 20 nt, Pseudomonas putida KT2440
ccuuggcguuacuguuccag

SEQ ID NO: 3550741 - RNA, 16 nt, Pseudomonas putida KT2440
ccuuggcuacgcaagg

SEQ ID NO: 3550742 - RNA, 19 nt, Pseudomonas putida KT2440
ccuuggcuuccugcuggcu

SEQ ID NO: 3550743 - RNA, 17 nt, Pseudomonas putida KT2440
ccuugggccggcgcagg

SEQ ID NO: 3550744 - RNA, 17 nt, Pseudomonas putida KT2440
ccuugggcucagccgcc

SEQ ID NO: 3550745 - RNA, 19 nt, Pseudomonas putida KT2440
ccuugggcucagccgccac

SEQ ID NO: 3550746 - RNA, 20 nt, Pseudomonas putida KT2440
ccuugggggugaagcccugc

SEQ ID NO: 3550747 - RNA, 14 nt, Pseudomonas putida KT2440
ccuugggguacacc

SEQ ID NO: 3550748 - RNA, 16 nt, Pseudomonas putida KT2440
ccuuggucaggaucac

SEQ ID NO: 3550749 - RNA, 19 nt, Pseudomonas putida KT2440
ccuugguccgggucugauu

SEQ ID NO: 3550750 - RNA, 13 nt, Pseudomonas putida KT2440
ccuuggugcacca

SEQ ID NO: 3550751 - RNA, 18 nt, Pseudomonas putida KT2440
ccuuggugcaccagcuug

SEQ ID NO: 3550752 - RNA, 18 nt, Pseudomonas putida KT2440
ccuuggugcgcgcaucca

SEQ ID NO: 3550753 - RNA, 14 nt, Pseudomonas putida KT2440
ccuugucagcaacc

SEQ ID NO: 3550754 - RNA, 17 nt, Pseudomonas putida KT2440
ccuugucagccgccgcu

SEQ ID NO: 3550755 - RNA, 14 nt, Pseudomonas putida KT2440
ccuugucaguucug

SEQ ID NO: 3550756 - RNA, 21 nt, Pseudomonas putida KT2440
ccuugucaguucugcucagcu

SEQ ID NO: 3550757 - RNA, 15 nt, Pseudomonas putida KT2440
ccuuguccagcaggc

SEQ ID NO: 3550758 - RNA, 18 nt, Pseudomonas putida KT2440
ccuugucgaguuucaggg

SEQ ID NO: 3550759 - RNA, 19 nt, Pseudomonas putida KT2440
ccuugucggcacgcgccag

SEQ ID NO: 3550760 - RNA, 18 nt, Pseudomonas putida KT2440
ccuugucgguauacggcc

SEQ ID NO: 3550761 - RNA, 23 nt, Pseudomonas putida KT2440
ccuugucgguauacggccaguug

SEQ ID NO: 3550762 - RNA, 20 nt, Pseudomonas putida KT2440
ccuugugcgccaccgacucc

SEQ ID NO: 3550763 - RNA, 14 nt, Pseudomonas putida KT2440
ccuugugugcguug

SEQ ID NO: 3550764 - RNA, 22 nt, Pseudomonas putida KT2440
ccuugugugggccuugcucaau

SEQ ID NO: 3550765 - RNA, 16 nt, Pseudomonas putida KT2440
ccuuguucaacacugu

SEQ ID NO: 3550766 - RNA, 19 nt, Pseudomonas putida KT2440
ccuuguucaucgcauucuu

SEQ ID NO: 3550767 - RNA, 20 nt, Pseudomonas putida KT2440
ccuuguuccgcccagcucug

SEQ ID NO: 3550768 - RNA, 22 nt, Pseudomonas putida KT2440
ccuuguuccgcccagcucugga

SEQ ID NO: 3550769 - RNA, 16 nt, Pseudomonas putida KT2440
ccuuguucgagcgcca

SEQ ID NO: 3550770 - RNA, 18 nt, Pseudomonas putida KT2440
ccuuuaggggcucuucgc

SEQ ID NO: 3550771 - RNA, 20 nt, Pseudomonas putida KT2440
ccuuucacggcgguaacagg

SEQ ID NO: 3550772 - RNA, 19 nt, Pseudomonas putida KT2440
ccuuucagcgcccagaaca

SEQ ID NO: 3550773 - RNA, 20 nt, Pseudomonas putida KT2440
ccuuucauguaaagcagaau

SEQ ID NO: 3550774 - RNA, 23 nt, Pseudomonas putida KT2440
ccuuuccgcacucaggugagcca

SEQ ID NO: 3550775 - RNA, 18 nt, Pseudomonas putida KT2440
ccuuucgcgacacaaggc

SEQ ID NO: 3550776 - RNA, 13 nt, Pseudomonas putida KT2440
ccuuucgcgccag

SEQ ID NO: 3550777 - RNA, 22 nt, Pseudomonas putida KT2440
ccuuucgcgccaguucgacgcu

SEQ ID NO: 3550778 - RNA, 17 nt, Pseudomonas putida KT2440
ccuuucgcggguaaacc

SEQ ID NO: 3550779 - RNA, 18 nt, Pseudomonas putida KT2440
ccuuucgcggguaaaccc

SEQ ID NO: 3550780 - RNA, 22 nt, Pseudomonas putida KT2440
ccuuucgcgggugaacccgcuc

SEQ ID NO: 3550781 - RNA, 17 nt, Pseudomonas putida KT2440
ccuuucugcuuccacuc

SEQ ID NO: 3550782 - RNA, 20 nt, Pseudomonas putida KT2440
ccuuucugcuuccacucggu

SEQ ID NO: 3550783 - RNA, 21 nt, Pseudomonas putida KT2440
ccuuucuuggcaugcgacgcg

SEQ ID NO: 3550784 - RNA, 13 nt, Pseudomonas putida KT2440
ccuuugcaaagcg

SEQ ID NO: 3550785 - RNA, 22 nt, Pseudomonas putida KT2440
ccuuugccccugaucauccaca

SEQ ID NO: 3550786 - RNA, 21 nt, Pseudomonas putida KT2440
ccuuuguacgucucaucgugu

SEQ ID NO: 3550787 - RNA, 13 nt, Pseudomonas putida KT2440
ccuuuuccugcug

SEQ ID NO: 3550788 - RNA, 18 nt, Pseudomonas putida KT2440
ccuuuucgcggguaaacc

SEQ ID NO: 3550789 - RNA, 20 nt, Pseudomonas putida KT2440
ccuuuuuucgggcugcugcc

SEQ ID NO: 3550790 - RNA, 20 nt, Pseudomonas putida KT2440
cgaaaacggcggcccggcca

SEQ ID NO: 3550791 - RNA, 21 nt, Pseudomonas putida KT2440
cgaaaagccggguacuuggca

SEQ ID NO: 3550792 - RNA, 15 nt, Pseudomonas putida KT2440
cgaaaaucguaagga

SEQ ID NO: 3550793 - RNA, 13 nt, Pseudomonas putida KT2440
cgaaacaccagca

SEQ ID NO: 3550794 - RNA, 14 nt, Pseudomonas putida KT2440
cgaaaccagccccu

SEQ ID NO: 3550795 - RNA, 15 nt, Pseudomonas putida KT2440
cgaaaccagccccuu

SEQ ID NO: 3550796 - RNA, 20 nt, Pseudomonas putida KT2440
cgaaaccaugcaggucgacg

SEQ ID NO: 3550797 - RNA, 20 nt, Pseudomonas putida KT2440
cgaaacccaguacggcgcca

SEQ ID NO: 3550798 - RNA, 15 nt, Pseudomonas putida KT2440
cgaaacccggcgcag

SEQ ID NO: 3550799 - RNA, 17 nt, Pseudomonas putida KT2440
cgaaacccggcgcagcg

SEQ ID NO: 3550800 - RNA, 15 nt, Pseudomonas putida KT2440
cgaaacccugcuggg

SEQ ID NO: 3550801 - RNA, 15 nt, Pseudomonas putida KT2440
cgaaaccgccagcca

SEQ ID NO: 3550802 - RNA, 14 nt, Pseudomonas putida KT2440
cgaaaccgcccggg

SEQ ID NO: 3550803 - RNA, 17 nt, Pseudomonas putida KT2440
cgaaaccgucaugcaga

SEQ ID NO: 3550804 - RNA, 23 nt, Pseudomonas putida KT2440
cgaaacgccacgcccaacccagc

SEQ ID NO: 3550805 - RNA, 14 nt, Pseudomonas putida KT2440
cgaaaggcgcucga

SEQ ID NO: 3550806 - RNA, 19 nt, Pseudomonas putida KT2440
cgaaagggccaguacaggc

SEQ ID NO: 3550807 - RNA, 13 nt, Pseudomonas putida KT2440
cgaaagggccgca

SEQ ID NO: 3550808 - RNA, 14 nt, Pseudomonas putida KT2440
cgaaagggccgcaa

SEQ ID NO: 3550809 - RNA, 21 nt, Pseudomonas putida KT2440
cgaaagggccgcaaagcggcc

SEQ ID NO: 3550810 - RNA, 13 nt, Pseudomonas putida KT2440
cgaaaggggcgca

SEQ ID NO: 3550811 - RNA, 18 nt, Pseudomonas putida KT2440
cgaaauacccaacuccag

SEQ ID NO: 3550812 - RNA, 13 nt, Pseudomonas putida KT2440
cgaaaucagccuu

SEQ ID NO: 3550813 - RNA, 16 nt, Pseudomonas putida KT2440
cgaaaucguaggucac

SEQ ID NO: 3550814 - RNA, 21 nt, Pseudomonas putida KT2440
cgaaaucguaggucacggucu

SEQ ID NO: 3550815 - RNA, 19 nt, Pseudomonas putida KT2440
cgaacaaauccgcgccgau

SEQ ID NO: 3550816 - RNA, 21 nt, Pseudomonas putida KT2440
cgaacaacgccaccgaaggcg

SEQ ID NO: 3550817 - RNA, 21 nt, Pseudomonas putida KT2440
cgaacaacuguccugugcgca

SEQ ID NO: 3550818 - RNA, 16 nt, Pseudomonas putida KT2440
cgaacaaggcucagcu

SEQ ID NO: 3550819 - RNA, 17 nt, Pseudomonas putida KT2440
cgaacaaggcucagcug

SEQ ID NO: 3550820 - RNA, 19 nt, Pseudomonas putida KT2440
cgaacaaggcucagcugau

SEQ ID NO: 3550821 - RNA, 20 nt, Pseudomonas putida KT2440
cgaacacaaucgguucgccc

SEQ ID NO: 3550822 - RNA, 17 nt, Pseudomonas putida KT2440
cgaacaccagccccagc

SEQ ID NO: 3550823 - RNA, 18 nt, Pseudomonas putida KT2440
cgaacaccaguucgccau

SEQ ID NO: 3550824 - RNA, 22 nt, Pseudomonas putida KT2440
cgaacaccccgauucacagcag

SEQ ID NO: 3550825 - RNA, 20 nt, Pseudomonas putida KT2440
cgaacaccgccagcccgcca

SEQ ID NO: 3550826 - RNA, 20 nt, Pseudomonas putida KT2440
cgaacaccggcagagccggu

SEQ ID NO: 3550827 - RNA, 18 nt, Pseudomonas putida KT2440
cgaacaccgguuuguccu

SEQ ID NO: 3550828 - RNA, 13 nt, Pseudomonas putida KT2440
cgaacaccugcgc

SEQ ID NO: 3550829 - RNA, 20 nt, Pseudomonas putida KT2440
cgaacacgaaaaagccagcg

SEQ ID NO: 3550830 - RNA, 17 nt, Pseudomonas putida KT2440
cgaacacuucacgcaca

SEQ ID NO: 3550831 - RNA, 15 nt, Pseudomonas putida KT2440
cgaacacuuggcagc

SEQ ID NO: 3550832 - RNA, 13 nt, Pseudomonas putida KT2440
cgaacagcaaugu

SEQ ID NO: 3550833 - RNA, 13 nt, Pseudomonas putida KT2440
cgaacagcaccgc

SEQ ID NO: 3550834 - RNA, 17 nt, Pseudomonas putida KT2440
cgaacagcacgauggcg

SEQ ID NO: 3550835 - RNA, 22 nt, Pseudomonas putida KT2440
cgaacagcacgauggcggucga

SEQ ID NO: 3550836 - RNA, 17 nt, Pseudomonas putida KT2440
cgaacagcacugccagc

SEQ ID NO: 3550837 - RNA, 21 nt, Pseudomonas putida KT2440
cgaacagcauccagcgccaga

SEQ ID NO: 3550838 - RNA, 16 nt, Pseudomonas putida KT2440
cgaacagcgccggcag

SEQ ID NO: 3550839 - RNA, 18 nt, Pseudomonas putida KT2440
cgaacagcgccggcaguu

SEQ ID NO: 3550840 - RNA, 15 nt, Pseudomonas putida KT2440
cgaacaggcgcuugc

SEQ ID NO: 3550841 - RNA, 16 nt, Pseudomonas putida KT2440
cgaacaggcugccgcg

SEQ ID NO: 3550842 - RNA, 14 nt, Pseudomonas putida KT2440
cgaacaucugcucg

SEQ ID NO: 3550843 - RNA, 13 nt, Pseudomonas putida KT2440
cgaacauggccac

SEQ ID NO: 3550844 - RNA, 20 nt, Pseudomonas putida KT2440
cgaauacgagggugaaccca

SEQ ID NO: 3550845 - RNA, 22 nt, Pseudomonas putida KT2440
cgaauacgauauccgcagcccc

SEQ ID NO: 3550846 - RNA, 16 nt, Pseudomonas putida KT2440
cgaauacgcucgacca

SEQ ID NO: 3550847 - RNA, 21 nt, Pseudomonas putida KT2440
cgaauacgguaguggcggcaa

SEQ ID NO: 3550848 - RNA, 17 nt, Pseudomonas putida KT2440
cgaauagcgcgagcugg

SEQ ID NO: 3550849 - RNA, 13 nt, Pseudomonas putida KT2440
cgaauaucgccga

SEQ ID NO: 3550850 - RNA, 14 nt, Pseudomonas putida KT2440
cgaaucaagccugc

SEQ ID NO: 3550851 - RNA, 16 nt, Pseudomonas putida KT2440
cgaaucaagccugcgc

SEQ ID NO: 3550852 - RNA, 17 nt, Pseudomonas putida KT2440
cgaaucagcaugcccag

SEQ ID NO: 3550853 - RNA, 13 nt, Pseudomonas putida KT2440
cgaaucagccagc

SEQ ID NO: 3550854 - RNA, 14 nt, Pseudomonas putida KT2440
cgaaucagcgccuc

SEQ ID NO: 3550855 - RNA, 19 nt, Pseudomonas putida KT2440
cgaauccagccggcccggc

SEQ ID NO: 3550856 - RNA, 23 nt, Pseudomonas putida KT2440
cgaauccagccggcccggcuggc

SEQ ID NO: 3550857 - RNA, 15 nt, Pseudomonas putida KT2440
cgaauccccuuauaa

SEQ ID NO: 3550858 - RNA, 12 nt, Pseudomonas putida KT2440
cgaauccugcug

SEQ ID NO: 3550859 - RNA, 14 nt, Pseudomonas putida KT2440
cgaauccugcugag

SEQ ID NO: 3550860 - RNA, 19 nt, Pseudomonas putida KT2440
cgaaucgccuucagcgccc

SEQ ID NO: 3550861 - RNA, 17 nt, Pseudomonas putida KT2440
cgaaucgcucugccgca

SEQ ID NO: 3550862 - RNA, 12 nt, Pseudomonas putida KT2440
cgaaugagaggc

SEQ ID NO: 3550863 - RNA, 22 nt, Pseudomonas putida KT2440
cgaaugaugaauaaugcuccag

SEQ ID NO: 3550864 - RNA, 22 nt, Pseudomonas putida KT2440
cgaaugcaaugguaaauucaau

SEQ ID NO: 3550865 - RNA, 13 nt, Pseudomonas putida KT2440
cgaaugccucguc

SEQ ID NO: 3550866 - RNA, 19 nt, Pseudomonas putida KT2440
cgaaugggcugcaaagcag

SEQ ID NO: 3550867 - RNA, 16 nt, Pseudomonas putida KT2440
cgaauggguggcggca

SEQ ID NO: 3550868 - RNA, 15 nt, Pseudomonas putida KT2440
cgaauucagcccgcu

SEQ ID NO: 3550869 - RNA, 18 nt, Pseudomonas putida KT2440
cgaauuucaaggcgccga

SEQ ID NO: 3550870 - RNA, 15 nt, Pseudomonas putida KT2440
cgacaaacccgugcu

SEQ ID NO: 3550871 - RNA, 21 nt, Pseudomonas putida KT2440
cgacaaacguaccagccgcac

SEQ ID NO: 3550872 - RNA, 21 nt, Pseudomonas putida KT2440
cgacaaacuccuugaaauuca

SEQ ID NO: 3550873 - RNA, 18 nt, Pseudomonas putida KT2440
cgacaaagcucaaaugcu

SEQ ID NO: 3550874 - RNA, 18 nt, Pseudomonas putida KT2440
cgacaaaguugccgauga

SEQ ID NO: 3550875 - RNA, 21 nt, Pseudomonas putida KT2440
cgacaaaugccgguuugcggc

SEQ ID NO: 3550876 - RNA, 16 nt, Pseudomonas putida KT2440
cgacaacagcaugcuc

SEQ ID NO: 3550877 - RNA, 23 nt, Pseudomonas putida KT2440
cgacaaccgacggguuacccugg

SEQ ID NO: 3550878 - RNA, 17 nt, Pseudomonas putida KT2440
cgacaacgcacccgccu

SEQ ID NO: 3550879 - RNA, 13 nt, Pseudomonas putida KT2440
cgacaacggcugg

SEQ ID NO: 3550880 - RNA, 17 nt, Pseudomonas putida KT2440
cgacaacgguguggcca

SEQ ID NO: 3550881 - RNA, 22 nt, Pseudomonas putida KT2440
cgacaagauaacaccccccagc

SEQ ID NO: 3550882 - RNA, 13 nt, Pseudomonas putida KT2440
cgacaagccacgc

SEQ ID NO: 3550883 - RNA, 22 nt, Pseudomonas putida KT2440
cgacaagggcuacgaaaccguc

SEQ ID NO: 3550884 - RNA, 17 nt, Pseudomonas putida KT2440
cgacaagguacucagcg

SEQ ID NO: 3550885 - RNA, 20 nt, Pseudomonas putida KT2440
cgacaagguagcggccagcc

SEQ ID NO: 3550886 - RNA, 21 nt, Pseudomonas putida KT2440
cgacaagguagcggccagccc

SEQ ID NO: 3550887 - RNA, 19 nt, Pseudomonas putida KT2440
cgacaauacgcacauagcc

SEQ ID NO: 3550888 - RNA, 21 nt, Pseudomonas putida KT2440
cgacaauacgguaagccgccg

SEQ ID NO: 3550889 - RNA, 15 nt, Pseudomonas putida KT2440
cgacaaucgccaggu

SEQ ID NO: 3550890 - RNA, 23 nt, Pseudomonas putida KT2440
cgacacauaaccccccacccagc

SEQ ID NO: 3550891 - RNA, 24 nt, Pseudomonas putida KT2440
cgacacauaaccccccacccagcu

SEQ ID NO: 3550892 - RNA, 18 nt, Pseudomonas putida KT2440
cgacacaugcaaacccug

SEQ ID NO: 3550893 - RNA, 13 nt, Pseudomonas putida KT2440
cgacaccaaugcc

SEQ ID NO: 3550894 - RNA, 15 nt, Pseudomonas putida KT2440
cgacaccagcgcacc

SEQ ID NO: 3550895 - RNA, 18 nt, Pseudomonas putida KT2440
cgacaccagcgcaccacu

SEQ ID NO: 3550896 - RNA, 12 nt, Pseudomonas putida KT2440
cgacaccaggau

SEQ ID NO: 3550897 - RNA, 18 nt, Pseudomonas putida KT2440
cgacacccagcacccgca

SEQ ID NO: 3550898 - RNA, 19 nt, Pseudomonas putida KT2440
cgacacccuggucaugcag

SEQ ID NO: 3550899 - RNA, 15 nt, Pseudomonas putida KT2440
cgacaccgccaacuc

SEQ ID NO: 3550900 - RNA, 22 nt, Pseudomonas putida KT2440
cgacaccggucucaaacaaaaa

SEQ ID NO: 3550901 - RNA, 23 nt, Pseudomonas putida KT2440
cgacaccuaucaguuucgcgacg

SEQ ID NO: 3550902 - RNA, 23 nt, Pseudomonas putida KT2440
cgacacgcgaaucgccagggcuc

SEQ ID NO: 3550903 - RNA, 15 nt, Pseudomonas putida KT2440
cgacacggcaggguu

SEQ ID NO: 3550904 - RNA, 18 nt, Pseudomonas putida KT2440
cgacacgggguguugcuu

SEQ ID NO: 3550905 - RNA, 21 nt, Pseudomonas putida KT2440
cgacacuugguccagggccau

SEQ ID NO: 3550906 - RNA, 14 nt, Pseudomonas putida KT2440
cgacagacagggcc

SEQ ID NO: 3550907 - RNA, 21 nt, Pseudomonas putida KT2440
cgacagcacgggcacacuggc

SEQ ID NO: 3550908 - RNA, 23 nt, Pseudomonas putida KT2440
cgacagcacgggcacacuggcca

SEQ ID NO: 3550909 - RNA, 18 nt, Pseudomonas putida KT2440
cgacagcaucaucaggcc

SEQ ID NO: 3550910 - RNA, 20 nt, Pseudomonas putida KT2440
cgacagcaucaucaggccga

SEQ ID NO: 3550911 - RNA, 15 nt, Pseudomonas putida KT2440
cgacagcaucggcag

SEQ ID NO: 3550912 - RNA, 18 nt, Pseudomonas putida KT2440
cgacagcaucggcagguc

SEQ ID NO: 3550913 - RNA, 19 nt, Pseudomonas putida KT2440
cgacagcaucggcagguca

SEQ ID NO: 3550914 - RNA, 20 nt, Pseudomonas putida KT2440
cgacagcaucugcaccagga

SEQ ID NO: 3550915 - RNA, 15 nt, Pseudomonas putida KT2440
cgacagccaccugcc

SEQ ID NO: 3550916 - RNA, 15 nt, Pseudomonas putida KT2440
cgacagccucaaggc

SEQ ID NO: 3550917 - RNA, 22 nt, Pseudomonas putida KT2440
cgacagccucaaggccggcagc

SEQ ID NO: 3550918 - RNA, 15 nt, Pseudomonas putida KT2440
cgacagcggccagcu

SEQ ID NO: 3550919 - RNA, 16 nt, Pseudomonas putida KT2440
cgacagcguugcucca

SEQ ID NO: 3550920 - RNA, 24 nt, Pseudomonas putida KT2440
cgacagcguugcuccagcucacag

SEQ ID NO: 3550921 - RNA, 19 nt, Pseudomonas putida KT2440
cgacagcucaagcccugcc

SEQ ID NO: 3550922 - RNA, 23 nt, Pseudomonas putida KT2440
cgacagcuugcccagcugcggga

SEQ ID NO: 3550923 - RNA, 18 nt, Pseudomonas putida KT2440
cgacagcuuguugccagc

SEQ ID NO: 3550924 - RNA, 13 nt, Pseudomonas putida KT2440
cgacaggccguga

SEQ ID NO: 3550925 - RNA, 16 nt, Pseudomonas putida KT2440
cgacaggcgucggggc

SEQ ID NO: 3550926 - RNA, 15 nt, Pseudomonas putida KT2440
cgacaggggcgcaga

SEQ ID NO: 3550927 - RNA, 14 nt, Pseudomonas putida KT2440
cgacagguccaccg

SEQ ID NO: 3550928 - RNA, 17 nt, Pseudomonas putida KT2440
cgacagguccaccgcuu

SEQ ID NO: 3550929 - RNA, 20 nt, Pseudomonas putida KT2440
cgacaggucggcgaugguca

SEQ ID NO: 3550930 - RNA, 20 nt, Pseudomonas putida KT2440
cgacaggugccccuugagca

SEQ ID NO: 3550931 - RNA, 20 nt, Pseudomonas putida KT2440
cgacaggugccucugcugcg

SEQ ID NO: 3550932 - RNA, 20 nt, Pseudomonas putida KT2440
cgacagugaauuccuugcug

SEQ ID NO: 3550933 - RNA, 16 nt, Pseudomonas putida KT2440
cgacaguucgccaccc

SEQ ID NO: 3550934 - RNA, 23 nt, Pseudomonas putida KT2440
cgacaguucgccacccgacgcca

SEQ ID NO: 3550935 - RNA, 16 nt, Pseudomonas putida KT2440
cgacauccacguccug

SEQ ID NO: 3550936 - RNA, 13 nt, Pseudomonas putida KT2440
cgacauccagcgc

SEQ ID NO: 3550937 - RNA, 22 nt, Pseudomonas putida KT2440
cgacaucgaagcagugcugcca

SEQ ID NO: 3550938 - RNA, 22 nt, Pseudomonas putida KT2440
cgacaucguaaauaguggcuag

SEQ ID NO: 3550939 - RNA, 20 nt, Pseudomonas putida KT2440
cgacaugcaccacgccacca

SEQ ID NO: 3550940 - RNA, 12 nt, Pseudomonas putida KT2440
cgacaugcaguu

SEQ ID NO: 3550941 - RNA, 21 nt, Pseudomonas putida KT2440
cgacaugcaguugagcccucg

SEQ ID NO: 3550942 - RNA, 19 nt, Pseudomonas putida KT2440
cgacaugccggccaccaca

SEQ ID NO: 3550943 - RNA, 21 nt, Pseudomonas putida KT2440
cgaccaagcgccccacaagcc

SEQ ID NO: 3550944 - RNA, 21 nt, Pseudomonas putida KT2440
cgaccaaggccaacugcgccc

SEQ ID NO: 3550945 - RNA, 19 nt, Pseudomonas putida KT2440
cgaccaaggcuuccgccgg

SEQ ID NO: 3550946 - RNA, 21 nt, Pseudomonas putida KT2440
cgaccaaggcuuccgccggga

SEQ ID NO: 3550947 - RNA, 16 nt, Pseudomonas putida KT2440
cgaccaaguuuucgca

SEQ ID NO: 3550948 - RNA, 21 nt, Pseudomonas putida KT2440
cgacggaacggccgcaccuca

SEQ ID NO: 3550949 - RNA, 16 nt, Pseudomonas putida KT2440
cgacggaucggcacac

SEQ ID NO: 3550950 - RNA, 20 nt, Pseudomonas putida KT2440
cgacggauuggaaaauguua

SEQ ID NO: 3550951 - RNA, 16 nt, Pseudomonas putida KT2440
cgacggcauggccgaa

SEQ ID NO: 3550952 - RNA, 13 nt, Pseudomonas putida KT2440
cgacggccugugu

SEQ ID NO: 3550953 - RNA, 21 nt, Pseudomonas putida KT2440
cgacgggaagugcacugccug

SEQ ID NO: 3550954 - RNA, 22 nt, Pseudomonas putida KT2440
cgacggucauggucguguugag

SEQ ID NO: 3550955 - RNA, 12 nt, Pseudomonas putida KT2440
cgacgucggcgu

SEQ ID NO: 3550956 - RNA, 23 nt, Pseudomonas putida KT2440
cgacgugcuuggcagugaugccg

SEQ ID NO: 3550957 - RNA, 20 nt, Pseudomonas putida KT2440
cgacgugguacgcguggucg

SEQ ID NO: 3550958 - RNA, 17 nt, Pseudomonas putida KT2440
cgacgugguugagguuc

SEQ ID NO: 3550959 - RNA, 19 nt, Pseudomonas putida KT2440
cgacguucuugccgguggu

SEQ ID NO: 3550960 - RNA, 15 nt, Pseudomonas putida KT2440
cgacguuuaccugca

SEQ ID NO: 3550961 - RNA, 18 nt, Pseudomonas putida KT2440
cgacguuuaccugcagcu

SEQ ID NO: 3550962 - RNA, 22 nt, Pseudomonas putida KT2440
cgacucaaggaugucggucaug

SEQ ID NO: 3550963 - RNA, 23 nt, Pseudomonas putida KT2440
cgacucacgcucguuguccagca

SEQ ID NO: 3550964 - RNA, 16 nt, Pseudomonas putida KT2440
cgacuccaccgcgcgc

SEQ ID NO: 3550965 - RNA, 13 nt, Pseudomonas putida KT2440
cgacucccgcugc

SEQ ID NO: 3550966 - RNA, 14 nt, Pseudomonas putida KT2440
cgacucccgcugcc

SEQ ID NO: 3550967 - RNA, 19 nt, Pseudomonas putida KT2440
cgacucgguacgcacugua

SEQ ID NO: 3550968 - RNA, 16 nt, Pseudomonas putida KT2440
cgacucgucaauaccg

SEQ ID NO: 3550969 - RNA, 17 nt, Pseudomonas putida KT2440
cgacucuacugcccgca

SEQ ID NO: 3550970 - RNA, 14 nt, Pseudomonas putida KT2440
cgacucuucaccag

SEQ ID NO: 3550971 - RNA, 22 nt, Pseudomonas putida KT2440
cgacucuucccaccaccagcgc

SEQ ID NO: 3550972 - RNA, 19 nt, Pseudomonas putida KT2440
cgacugaacaccugccagc

SEQ ID NO: 3550973 - RNA, 22 nt, Pseudomonas putida KT2440
cgacugaacaccugccagcccc

SEQ ID NO: 3550974 - RNA, 11 nt, Pseudomonas putida KT2440
cgacugaccgc

SEQ ID NO: 3550975 - RNA, 13 nt, Pseudomonas putida KT2440
cgacugaccgcgc

SEQ ID NO: 3550976 - RNA, 18 nt, Pseudomonas putida KT2440
cgacugacgcuacgccgc

SEQ ID NO: 3550977 - RNA, 14 nt, Pseudomonas putida KT2440
cgacugaggcaccg

SEQ ID NO: 3550978 - RNA, 16 nt, Pseudomonas putida KT2440
cgacugaggcaccggu

SEQ ID NO: 3550979 - RNA, 23 nt, Pseudomonas putida KT2440
cgacugcaagcgaugcacgccag

SEQ ID NO: 3550980 - RNA, 23 nt, Pseudomonas putida KT2440
cgacugcagguaguuuuccagcc

SEQ ID NO: 3550981 - RNA, 19 nt, Pseudomonas putida KT2440
cgacugccgcucaucgagg

SEQ ID NO: 3550982 - RNA, 16 nt, Pseudomonas putida KT2440
cgacuggaaggcgcug

SEQ ID NO: 3550983 - RNA, 17 nt, Pseudomonas putida KT2440
cgacuggcgcaccagcg

SEQ ID NO: 3550984 - RNA, 17 nt, Pseudomonas putida KT2440
cgacuggugcucugcag

SEQ ID NO: 3550985 - RNA, 12 nt, Pseudomonas putida KT2440
cgacuucaaugc

SEQ ID NO: 3550986 - RNA, 15 nt, Pseudomonas putida KT2440
cgacuucaucaccuc

SEQ ID NO: 3550987 - RNA, 15 nt, Pseudomonas putida KT2440
cgacuucccgcaagc

SEQ ID NO: 3550988 - RNA, 16 nt, Pseudomonas putida KT2440
cgacuucgaccacggc

SEQ ID NO: 3550989 - RNA, 20 nt, Pseudomonas putida KT2440
cgacuuugaugccaacuucc

SEQ ID NO: 3550990 - RNA, 20 nt, Pseudomonas putida KT2440
cgagaaacucacgcauggcc

SEQ ID NO: 3550991 - RNA, 16 nt, Pseudomonas putida KT2440
cgagaacagcuggaug

SEQ ID NO: 3550992 - RNA, 15 nt, Pseudomonas putida KT2440
cgagaagcagaacau

SEQ ID NO: 3550993 - RNA, 18 nt, Pseudomonas putida KT2440
cgagaaggcguggugcag

SEQ ID NO: 3550994 - RNA, 12 nt, Pseudomonas putida KT2440
cgagaaugaaac

SEQ ID NO: 3550995 - RNA, 17 nt, Pseudomonas putida KT2440
cgagaaugcugcgcagc

SEQ ID NO: 3550996 - RNA, 17 nt, Pseudomonas putida KT2440
cgagaccuugccuuccg

SEQ ID NO: 3550997 - RNA, 13 nt, Pseudomonas putida KT2440
cgagacgccacca

SEQ ID NO: 3550998 - RNA, 17 nt, Pseudomonas putida KT2440
cgagacgguggcugcca

SEQ ID NO: 3550999 - RNA, 13 nt, Pseudomonas putida KT2440
cgagagccgggca

SEQ ID NO: 3551000 - RNA, 15 nt, Pseudomonas putida KT2440
cgagagccgggcaau

SEQ ID NO: 3551001 - RNA, 22 nt, Pseudomonas putida KT2440
cgagagcggcuucuaccgcacu

SEQ ID NO: 3551002 - RNA, 22 nt, Pseudomonas putida KT2440
cgagaucagguggaucaggguc

SEQ ID NO: 3551003 - RNA, 17 nt, Pseudomonas putida KT2440
cgagaugaucgcggcaa

SEQ ID NO: 3551004 - RNA, 18 nt, Pseudomonas putida KT2440
cgagaugaucgcggcaau

SEQ ID NO: 3551005 - RNA, 16 nt, Pseudomonas putida KT2440
cgagcaaggcgcagcc

SEQ ID NO: 3551006 - RNA, 16 nt, Pseudomonas putida KT2440
cgagcaggcccgcccc

SEQ ID NO: 3551007 - RNA, 22 nt, Pseudomonas putida KT2440
cgagcagguucaggcgcagcac

SEQ ID NO: 3551008 - RNA, 17 nt, Pseudomonas putida KT2440
cgagcauccgcgccacu

SEQ ID NO: 3551009 - RNA, 19 nt, Pseudomonas putida KT2440
cgagcaucggcucgcagau

SEQ ID NO: 3551010 - RNA, 20 nt, Pseudomonas putida KT2440
cgagcaucugcugcggcagg

SEQ ID NO: 3551011 - RNA, 18 nt, Pseudomonas putida KT2440
cgagcaucuuccagccug

SEQ ID NO: 3551012 - RNA, 23 nt, Pseudomonas putida KT2440
cgagcaucuuccagccugcagca

SEQ ID NO: 3551013 - RNA, 14 nt, Pseudomonas putida KT2440
cgagcaugaggaua

SEQ ID NO: 3551014 - RNA, 17 nt, Pseudomonas putida KT2440
cgagcaugccgaggaca

SEQ ID NO: 3551015 - RNA, 16 nt, Pseudomonas putida KT2440
cgagcauuacaggcag

SEQ ID NO: 3551016 - RNA, 12 nt, Pseudomonas putida KT2440
cgagccaaccgc

SEQ ID NO: 3551017 - RNA, 15 nt, Pseudomonas putida KT2440
cgagccaaccgcuuc

SEQ ID NO: 3551018 - RNA, 14 nt, Pseudomonas putida KT2440
cgagccacucggca

SEQ ID NO: 3551019 - RNA, 14 nt, Pseudomonas putida KT2440
cgagccagccaggu

SEQ ID NO: 3551020 - RNA, 21 nt, Pseudomonas putida KT2440
cgagccauaugaaaaggcccu

SEQ ID NO: 3551021 - RNA, 13 nt, Pseudomonas putida KT2440
cgagcccgccagc

SEQ ID NO: 3551022 - RNA, 16 nt, Pseudomonas putida KT2440
cgagcccgccagcagg

SEQ ID NO: 3551023 - RNA, 18 nt, Pseudomonas putida KT2440
cgagcccgccagcaggcc

SEQ ID NO: 3551024 - RNA, 20 nt, Pseudomonas putida KT2440
cgagcccgccagcaggccac

SEQ ID NO: 3551025 - RNA, 24 nt, Pseudomonas putida KT2440
cgagcccgccagcaggccaccggc

SEQ ID NO: 3551026 - RNA, 17 nt, Pseudomonas putida KT2440
cgagcccuuguccaggu

SEQ ID NO: 3551027 - RNA, 13 nt, Pseudomonas putida KT2440
cgagccgaacagc

SEQ ID NO: 3551028 - RNA, 16 nt, Pseudomonas putida KT2440
cgagccgaacagcagg

SEQ ID NO: 3551029 - RNA, 12 nt, Pseudomonas putida KT2440
cgagccgaucag

SEQ ID NO: 3551030 - RNA, 16 nt, Pseudomonas putida KT2440
cgagccgcauuggccg

SEQ ID NO: 3551031 - RNA, 17 nt, Pseudomonas putida KT2440
cgagccgcauuggccgg

SEQ ID NO: 3551032 - RNA, 13 nt, Pseudomonas putida KT2440
cgagccgcugcca

SEQ ID NO: 3551033 - RNA, 16 nt, Pseudomonas putida KT2440
cgagccggguccaccc

SEQ ID NO: 3551034 - RNA, 17 nt, Pseudomonas putida KT2440
cgagccggguccacccg

SEQ ID NO: 3551035 - RNA, 20 nt, Pseudomonas putida KT2440
cgagccucuguuugcugguc

SEQ ID NO: 3551036 - RNA, 17 nt, Pseudomonas putida KT2440
cgagccugggucacggc

SEQ ID NO: 3551037 - RNA, 13 nt, Pseudomonas putida KT2440
cgagccuuccggg

SEQ ID NO: 3551038 - RNA, 17 nt, Pseudomonas putida KT2440
cgagccuuccgggcacu

SEQ ID NO: 3551039 - RNA, 22 nt, Pseudomonas putida KT2440
cgagccuuccgggcacuggcug

SEQ ID NO: 3551040 - RNA, 20 nt, Pseudomonas putida KT2440
cgagccuugccaacggcacu

SEQ ID NO: 3551041 - RNA, 17 nt, Pseudomonas putida KT2440
cgagccuuggccagcgu

SEQ ID NO: 3551042 - RNA, 15 nt, Pseudomonas putida KT2440
cgagcgaacagcucg

SEQ ID NO: 3551043 - RNA, 16 nt, Pseudomonas putida KT2440
cgagcgagugaccuug

SEQ ID NO: 3551044 - RNA, 15 nt, Pseudomonas putida KT2440
cgagcgccgcccggg

SEQ ID NO: 3551045 - RNA, 12 nt, Pseudomonas putida KT2440
cgagcgccgcgc

SEQ ID NO: 3551046 - RNA, 20 nt, Pseudomonas putida KT2440
cgagcgccgcgcgggcggcg

SEQ ID NO: 3551047 - RNA, 18 nt, Pseudomonas putida KT2440
cgagcgccgugcucggcc

SEQ ID NO: 3551048 - RNA, 13 nt, Pseudomonas putida KT2440
cgagcgcgggcag

SEQ ID NO: 3551049 - RNA, 14 nt, Pseudomonas putida KT2440
cgagcgcuuaaauc

SEQ ID NO: 3551050 - RNA, 18 nt, Pseudomonas putida KT2440
cgagcgcuuucagccguu

SEQ ID NO: 3551051 - RNA, 20 nt, Pseudomonas putida KT2440
cgagcgcuuucagccguuca

SEQ ID NO: 3551052 - RNA, 19 nt, Pseudomonas putida KT2440
cgagcgggugccgcagcac

SEQ ID NO: 3551053 - RNA, 16 nt, Pseudomonas putida KT2440
cgagcgguucagcgca

SEQ ID NO: 3551054 - RNA, 21 nt, Pseudomonas putida KT2440
cgaucaggaagccccgcgcgu

SEQ ID NO: 3551055 - RNA, 20 nt, Pseudomonas putida KT2440
cgaucaggcaggccagcacg

SEQ ID NO: 3551056 - RNA, 15 nt, Pseudomonas putida KT2440
cgaucaggcucuguu

SEQ ID NO: 3551057 - RNA, 12 nt, Pseudomonas putida KT2440
cgaucaggucga

SEQ ID NO: 3551058 - RNA, 18 nt, Pseudomonas putida KT2440
cgaucagguugagcaccg

SEQ ID NO: 3551059 - RNA, 18 nt, Pseudomonas putida KT2440
cgaucagguuugccgcgc

SEQ ID NO: 3551060 - RNA, 15 nt, Pseudomonas putida KT2440
cgaucaguaaucugc

SEQ ID NO: 3551061 - RNA, 12 nt, Pseudomonas putida KT2440
cgaucaguacga

SEQ ID NO: 3551062 - RNA, 14 nt, Pseudomonas putida KT2440
cgaucaucgaagcc

SEQ ID NO: 3551063 - RNA, 17 nt, Pseudomonas putida KT2440
cgaucauuuccggcacg

SEQ ID NO: 3551064 - RNA, 16 nt, Pseudomonas putida KT2440
cgauccacucgucgau

SEQ ID NO: 3551065 - RNA, 13 nt, Pseudomonas putida KT2440
cgauccaggugcg

SEQ ID NO: 3551066 - RNA, 18 nt, Pseudomonas putida KT2440
cgauccaucuucaccuug

SEQ ID NO: 3551067 - RNA, 18 nt, Pseudomonas putida KT2440
cgauccauuuguaggagc

SEQ ID NO: 3551068 - RNA, 23 nt, Pseudomonas putida KT2440
cgauccccggccggucguuaccc

SEQ ID NO: 3551069 - RNA, 17 nt, Pseudomonas putida KT2440
cgaucccgaggucagca

SEQ ID NO: 3551070 - RNA, 19 nt, Pseudomonas putida KT2440
cgaucccgaggucagcagu

SEQ ID NO: 3551071 - RNA, 21 nt, Pseudomonas putida KT2440
cgaucccgaggucagcagugg

SEQ ID NO: 3551072 - RNA, 16 nt, Pseudomonas putida KT2440
cgaucccgaugcgcuu

SEQ ID NO: 3551073 - RNA, 20 nt, Pseudomonas putida KT2440
cgaucccggcucgcgaucca

SEQ ID NO: 3551074 - RNA, 15 nt, Pseudomonas putida KT2440
cgaucccuggggcca

SEQ ID NO: 3551075 - RNA, 19 nt, Pseudomonas putida KT2440
cgaucccuggggccaagug

SEQ ID NO: 3551076 - RNA, 18 nt, Pseudomonas putida KT2440
cgauccgcgccaucagcu

SEQ ID NO: 3551077 - RNA, 17 nt, Pseudomonas putida KT2440
cgauccgguggccuugc

SEQ ID NO: 3551078 - RNA, 21 nt, Pseudomonas putida KT2440
cgauccucaucguccaccgcg

SEQ ID NO: 3551079 - RNA, 22 nt, Pseudomonas putida KT2440
cgauccucaucguccaccgcgc

SEQ ID NO: 3551080 - RNA, 17 nt, Pseudomonas putida KT2440
cgauccuuggcgaaggc

SEQ ID NO: 3551081 - RNA, 22 nt, Pseudomonas putida KT2440
cgauccuuggcgaaggcugccu

SEQ ID NO: 3551082 - RNA, 21 nt, Pseudomonas putida KT2440
cgaucgaaaaaccgcucccgc

SEQ ID NO: 3551083 - RNA, 21 nt, Pseudomonas putida KT2440
cgaucgaaaggcgacuccuga

SEQ ID NO: 3551084 - RNA, 15 nt, Pseudomonas putida KT2440
cgaucgaagcagcag

SEQ ID NO: 3551085 - RNA, 22 nt, Pseudomonas putida KT2440
cgaucgaccggguaaucgccag

SEQ ID NO: 3551086 - RNA, 18 nt, Pseudomonas putida KT2440
cgaucgacuucaucaccu

SEQ ID NO: 3551087 - RNA, 15 nt, Pseudomonas putida KT2440
cgaucgagccgguca

SEQ ID NO: 3551088 - RNA, 14 nt, Pseudomonas putida KT2440
cgaucgccagcccc

SEQ ID NO: 3551089 - RNA, 17 nt, Pseudomonas putida KT2440
cgaucgccagccccagc

SEQ ID NO: 3551090 - RNA, 13 nt, Pseudomonas putida KT2440
cgaucgccgccac

SEQ ID NO: 3551091 - RNA, 15 nt, Pseudomonas putida KT2440
cgaucgccggcagcu

SEQ ID NO: 3551092 - RNA, 16 nt, Pseudomonas putida KT2440
cgaucgccucgcuggc

SEQ ID NO: 3551093 - RNA, 23 nt, Pseudomonas putida KT2440
cgaucgccucgcuggcgguguag

SEQ ID NO: 3551094 - RNA, 14 nt, Pseudomonas putida KT2440
cgaucggcgcgccu

SEQ ID NO: 3551095 - RNA, 20 nt, Pseudomonas putida KT2440
cgaucggcgcgccuggcucg

SEQ ID NO: 3551096 - RNA, 12 nt, Pseudomonas putida KT2440
cgaucgucgaca

SEQ ID NO: 3551097 - RNA, 22 nt, Pseudomonas putida KT2440
cgaucuaugcccggcucaccgc

SEQ ID NO: 3551098 - RNA, 23 nt, Pseudomonas putida KT2440
cgaucuccccaccaucaauacgc

SEQ ID NO: 3551099 - RNA, 20 nt, Pseudomonas putida KT2440
cgaucucccggcucaucagg

SEQ ID NO: 3551100 - RNA, 16 nt, Pseudomonas putida KT2440
cgaucuccugcaggga

SEQ ID NO: 3551101 - RNA, 17 nt, Pseudomonas putida KT2440
cgaucucgaagcugcca

SEQ ID NO: 3551102 - RNA, 18 nt, Pseudomonas putida KT2440
cgaucucgauccggccgu

SEQ ID NO: 3551103 - RNA, 17 nt, Pseudomonas putida KT2440
cgaucucgccagccugc

SEQ ID NO: 3551104 - RNA, 15 nt, Pseudomonas putida KT2440
cgaucucggccagca

SEQ ID NO: 3551105 - RNA, 17 nt, Pseudomonas putida KT2440
cgaucucggccagcagg

SEQ ID NO: 3551106 - RNA, 23 nt, Pseudomonas putida KT2440
cgaucucugcuuccuugcgcacg

SEQ ID NO: 3551107 - RNA, 22 nt, Pseudomonas putida KT2440
cgaucugaaucuucggugccca

SEQ ID NO: 3551108 - RNA, 17 nt, Pseudomonas putida KT2440
cgaucugccugccucaa

SEQ ID NO: 3551109 - RNA, 18 nt, Pseudomonas putida KT2440
cgaucuggaucacugcca

SEQ ID NO: 3551110 - RNA, 15 nt, Pseudomonas putida KT2440
cgaucuucagcgcau

SEQ ID NO: 3551111 - RNA, 21 nt, Pseudomonas putida KT2440
cgaucuucgccggcaucgccu

SEQ ID NO: 3551112 - RNA, 18 nt, Pseudomonas putida KT2440
cgaucuuggccagggccu

SEQ ID NO: 3551113 - RNA, 22 nt, Pseudomonas putida KT2440
cgaucuuguuggucaggccaug

SEQ ID NO: 3551114 - RNA, 17 nt, Pseudomonas putida KT2440
cgaugaaauucaccugc

SEQ ID NO: 3551115 - RNA, 18 nt, Pseudomonas putida KT2440
cgaugaaauucaccugcc

SEQ ID NO: 3551116 - RNA, 20 nt, Pseudomonas putida KT2440
cgaugaaauucaccugccgg

SEQ ID NO: 3551117 - RNA, 18 nt, Pseudomonas putida KT2440
cgaugaacacgccgucga

SEQ ID NO: 3551118 - RNA, 15 nt, Pseudomonas putida KT2440
cgaugaacccgcgau

SEQ ID NO: 3551119 - RNA, 15 nt, Pseudomonas putida KT2440
cgaugaaggcaucca

SEQ ID NO: 3551120 - RNA, 23 nt, Pseudomonas putida KT2440
cgaugaaggcugcuucguucacg

SEQ ID NO: 3551121 - RNA, 18 nt, Pseudomonas putida KT2440
cgaugacccuuccagccc

SEQ ID NO: 3551122 - RNA, 21 nt, Pseudomonas putida KT2440
cgaugaccugcgucaggaccu

SEQ ID NO: 3551123 - RNA, 14 nt, Pseudomonas putida KT2440
cgaugaccuugccu

SEQ ID NO: 3551124 - RNA, 23 nt, Pseudomonas putida KT2440
cgaugagguagaucacaccggcc

SEQ ID NO: 3551125 - RNA, 16 nt, Pseudomonas putida KT2440
cgaugaucaggccgcu

SEQ ID NO: 3551126 - RNA, 14 nt, Pseudomonas putida KT2440
cgaugaucaucccg

SEQ ID NO: 3551127 - RNA, 21 nt, Pseudomonas putida KT2440
cgaugaucaucccggcgacgu

SEQ ID NO: 3551128 - RNA, 15 nt, Pseudomonas putida KT2440
cgaugaucgccgccg

SEQ ID NO: 3551129 - RNA, 21 nt, Pseudomonas putida KT2440
cgaugaucugccgggccacca

SEQ ID NO: 3551130 - RNA, 23 nt, Pseudomonas putida KT2440
cgaugaugauaccgaacagcacc

SEQ ID NO: 3551131 - RNA, 14 nt, Pseudomonas putida KT2440
cgaugaugcgugcc

SEQ ID NO: 3551132 - RNA, 15 nt, Pseudomonas putida KT2440
cgaugaugcuggucg

SEQ ID NO: 3551133 - RNA, 18 nt, Pseudomonas putida KT2440
cgaugcacagcucgcgcu

SEQ ID NO: 3551134 - RNA, 16 nt, Pseudomonas putida KT2440
cgaugcacgccagcau

SEQ ID NO: 3551135 - RNA, 21 nt, Pseudomonas putida KT2440
cgaugcacgccagcaucaccc

SEQ ID NO: 3551136 - RNA, 17 nt, Pseudomonas putida KT2440
cgaugcacguaccuggc

SEQ ID NO: 3551137 - RNA, 21 nt, Pseudomonas putida KT2440
cgaugcaucaauggcuggggg

SEQ ID NO: 3551138 - RNA, 15 nt, Pseudomonas putida KT2440
cgaugccaagcaccg

SEQ ID NO: 3551139 - RNA, 12 nt, Pseudomonas putida KT2440
cgaugcccaccu

SEQ ID NO: 3551140 - RNA, 16 nt, Pseudomonas putida KT2440
cgaugcccaccuuggc

SEQ ID NO: 3551141 - RNA, 21 nt, Pseudomonas putida KT2440
cgaugcccaccuuggcgguga

SEQ ID NO: 3551142 - RNA, 17 nt, Pseudomonas putida KT2440
cgaugcccgggccuuca

SEQ ID NO: 3551143 - RNA, 16 nt, Pseudomonas putida KT2440
cgaugcccgucccuuc

SEQ ID NO: 3551144 - RNA, 16 nt, Pseudomonas putida KT2440
cgaugcccuccagccc

SEQ ID NO: 3551145 - RNA, 20 nt, Pseudomonas putida KT2440
cgaugcccuccagcccuggc

SEQ ID NO: 3551146 - RNA, 22 nt, Pseudomonas putida KT2440
cgaugccugggcgguccuucau

SEQ ID NO: 3551147 - RNA, 15 nt, Pseudomonas putida KT2440
cgaugcgcagagcca

SEQ ID NO: 3551148 - RNA, 17 nt, Pseudomonas putida KT2440
cgaugcgccccccaggc

SEQ ID NO: 3551149 - RNA, 15 nt, Pseudomonas putida KT2440
cgaugcgcuggcaca

SEQ ID NO: 3551150 - RNA, 13 nt, Pseudomonas putida KT2440
cgaugcggccaca

SEQ ID NO: 3551151 - RNA, 18 nt, Pseudomonas putida KT2440
cgaugcggugcagcaccu

SEQ ID NO: 3551152 - RNA, 18 nt, Pseudomonas putida KT2440
cgaugcggugcucaugca

SEQ ID NO: 3551153 - RNA, 12 nt, Pseudomonas putida KT2440
cgaugcugugcc

SEQ ID NO: 3551154 - RNA, 21 nt, Pseudomonas putida KT2440
cgaugcuuuugauggucuccg

SEQ ID NO: 3551155 - RNA, 19 nt, Pseudomonas putida KT2440
cgauggacagcccaaggcc

SEQ ID NO: 3551156 - RNA, 12 nt, Pseudomonas putida KT2440
cgauggccacca

SEQ ID NO: 3551157 - RNA, 15 nt, Pseudomonas putida KT2440
cgauggccaccagca

SEQ ID NO: 3551158 - RNA, 16 nt, Pseudomonas putida KT2440
cgauggccaccagcac

SEQ ID NO: 3551159 - RNA, 18 nt, Pseudomonas putida KT2440
cgcaaugcgccccggcga

SEQ ID NO: 3551160 - RNA, 20 nt, Pseudomonas putida KT2440
cgcacaaggccgcucccaca

SEQ ID NO: 3551161 - RNA, 17 nt, Pseudomonas putida KT2440
cgcacaccgcugguggc

SEQ ID NO: 3551162 - RNA, 16 nt, Pseudomonas putida KT2440
cgcacacgaccuugga

SEQ ID NO: 3551163 - RNA, 17 nt, Pseudomonas putida KT2440
cgcacagcacguucagc

SEQ ID NO: 3551164 - RNA, 19 nt, Pseudomonas putida KT2440
cgcacagcaucacccgcga

SEQ ID NO: 3551165 - RNA, 17 nt, Pseudomonas putida KT2440
cgcacagcugccggcca

SEQ ID NO: 3551166 - RNA, 20 nt, Pseudomonas putida KT2440
cgcacaggcgcagcagcuug

SEQ ID NO: 3551167 - RNA, 23 nt, Pseudomonas putida KT2440
cgcacaggcgcagcagcuugacc

SEQ ID NO: 3551168 - RNA, 16 nt, Pseudomonas putida KT2440
cgcacaggcuggccac

SEQ ID NO: 3551169 - RNA, 19 nt, Pseudomonas putida KT2440
cgcacaggcuggccaccau

SEQ ID NO: 3551170 - RNA, 13 nt, Pseudomonas putida KT2440
cgcacagggcgau

SEQ ID NO: 3551171 - RNA, 20 nt, Pseudomonas putida KT2440
cgcacagguccagccgccau

SEQ ID NO: 3551172 - RNA, 21 nt, Pseudomonas putida KT2440
cgcacagugguguacagcaac

SEQ ID NO: 3551173 - RNA, 17 nt, Pseudomonas putida KT2440
cgcacauaccucaucag

SEQ ID NO: 3551174 - RNA, 23 nt, Pseudomonas putida KT2440
cgcacauagcccugcucguccau

SEQ ID NO: 3551175 - RNA, 23 nt, Pseudomonas putida KT2440
cgcacaucacggcgcaggccgac

SEQ ID NO: 3551176 - RNA, 22 nt, Pseudomonas putida KT2440
cgcacaucguccgccgcgcuga

SEQ ID NO: 3551177 - RNA, 17 nt, Pseudomonas putida KT2440
cgcacaugaagccgcgc

SEQ ID NO: 3551178 - RNA, 18 nt, Pseudomonas putida KT2440
cgcacaugaagccgcgca

SEQ ID NO: 3551179 - RNA, 17 nt, Pseudomonas putida KT2440
cgcaccaacuggucggc

SEQ ID NO: 3551180 - RNA, 22 nt, Pseudomonas putida KT2440
cgcaccaacuggucggccuugc

SEQ ID NO: 3551181 - RNA, 12 nt, Pseudomonas putida KT2440
cgcaccaaggcg

SEQ ID NO: 3551182 - RNA, 14 nt, Pseudomonas putida KT2440
cgcaccaaggcggc

SEQ ID NO: 3551183 - RNA, 22 nt, Pseudomonas putida KT2440
cgcaccacguccggccagcaac

SEQ ID NO: 3551184 - RNA, 12 nt, Pseudomonas putida KT2440
cgcaccagcucc

SEQ ID NO: 3551185 - RNA, 13 nt, Pseudomonas putida KT2440
cgcaccagggcug

SEQ ID NO: 3551186 - RNA, 21 nt, Pseudomonas putida KT2440
cgcaccagggcuggcagcggg

SEQ ID NO: 3551187 - RNA, 22 nt, Pseudomonas putida KT2440
cgcaccagggcuggcagcgggu

SEQ ID NO: 3551188 - RNA, 23 nt, Pseudomonas putida KT2440
cgcaccagggcuggcagcgggua

SEQ ID NO: 3551189 - RNA, 21 nt, Pseudomonas putida KT2440
cgcaccagguccaccagcagg

SEQ ID NO: 3551190 - RNA, 16 nt, Pseudomonas putida KT2440
cgcaccaucggcucca

SEQ ID NO: 3551191 - RNA, 19 nt, Pseudomonas putida KT2440
cgcaccaucggcuccagcg

SEQ ID NO: 3551192 - RNA, 22 nt, Pseudomonas putida KT2440
cgcaccaucggcuccagcgcac

SEQ ID NO: 3551193 - RNA, 20 nt, Pseudomonas putida KT2440
cgcaccaugucccaguucau

SEQ ID NO: 3551194 - RNA, 19 nt, Pseudomonas putida KT2440
cgcacccaccgcaggucac

SEQ ID NO: 3551195 - RNA, 13 nt, Pseudomonas putida KT2440
cgcacccagcagg

SEQ ID NO: 3551196 - RNA, 15 nt, Pseudomonas putida KT2440
cgcacccagcaggcc

SEQ ID NO: 3551197 - RNA, 16 nt, Pseudomonas putida KT2440
cgcacccagcaggccg

SEQ ID NO: 3551198 - RNA, 13 nt, Pseudomonas putida KT2440
cgcacccaggugc

SEQ ID NO: 3551199 - RNA, 14 nt, Pseudomonas putida KT2440
cgcaccccuugcca

SEQ ID NO: 3551200 - RNA, 15 nt, Pseudomonas putida KT2440
cgcacccgcaagcgc

SEQ ID NO: 3551201 - RNA, 16 nt, Pseudomonas putida KT2440
cgcacccgccuccggc

SEQ ID NO: 3551202 - RNA, 17 nt, Pseudomonas putida KT2440
cgcacccgccuccggcg

SEQ ID NO: 3551203 - RNA, 18 nt, Pseudomonas putida KT2440
cgcacccgccuccggcgc

SEQ ID NO: 3551204 - RNA, 12 nt, Pseudomonas putida KT2440
cgcacccgcgau

SEQ ID NO: 3551205 - RNA, 12 nt, Pseudomonas putida KT2440
cgcaccgcggau

SEQ ID NO: 3551206 - RNA, 18 nt, Pseudomonas putida KT2440
cgcaccgcggaugcgccu

SEQ ID NO: 3551207 - RNA, 13 nt, Pseudomonas putida KT2440
cgcaccgcugacc

SEQ ID NO: 3551208 - RNA, 15 nt, Pseudomonas putida KT2440
cgcaccgcuugcgca

SEQ ID NO: 3551209 - RNA, 16 nt, Pseudomonas putida KT2440
cgcaccgggcaaaaaa

SEQ ID NO: 3551210 - RNA, 14 nt, Pseudomonas putida KT2440
cgcaccgugcacca

SEQ ID NO: 3551211 - RNA, 19 nt, Pseudomonas putida KT2440
cgcaccgugcaccagcacc

SEQ ID NO: 3551212 - RNA, 13 nt, Pseudomonas putida KT2440
cgcaccuccugcg

SEQ ID NO: 3551213 - RNA, 15 nt, Pseudomonas putida KT2440
cgcaccuccuuggcc

SEQ ID NO: 3551214 - RNA, 14 nt, Pseudomonas putida KT2440
cgcaccucgaccgc

SEQ ID NO: 3551215 - RNA, 21 nt, Pseudomonas putida KT2440
cgcaccucgaccgcacccgcg

SEQ ID NO: 3551216 - RNA, 21 nt, Pseudomonas putida KT2440
cgcaccucggccaugucguac

SEQ ID NO: 3551217 - RNA, 14 nt, Pseudomonas putida KT2440
cgcaccugcccgcc

SEQ ID NO: 3551218 - RNA, 18 nt, Pseudomonas putida KT2440
cgcaccugccugacgcgg

SEQ ID NO: 3551219 - RNA, 21 nt, Pseudomonas putida KT2440
cgcaccuuggcguccagguaa

SEQ ID NO: 3551220 - RNA, 15 nt, Pseudomonas putida KT2440
cgcaccuugugcacg

SEQ ID NO: 3551221 - RNA, 16 nt, Pseudomonas putida KT2440
cgcacgcauguccuug

SEQ ID NO: 3551222 - RNA, 16 nt, Pseudomonas putida KT2440
cgcacgcgccucuugc

SEQ ID NO: 3551223 - RNA, 15 nt, Pseudomonas putida KT2440
cgcacgcgcucugca

SEQ ID NO: 3551224 - RNA, 23 nt, Pseudomonas putida KT2440
cgcacgcgcuuuuccagcaaagu

SEQ ID NO: 3551225 - RNA, 16 nt, Pseudomonas putida KT2440
cgcacgcugcccaggu

SEQ ID NO: 3551226 - RNA, 20 nt, Pseudomonas putida KT2440
cgcacgcugcccaggugcca

SEQ ID NO: 3551227 - RNA, 21 nt, Pseudomonas putida KT2440
cgcacgcugcccaggugccag

SEQ ID NO: 3551228 - RNA, 23 nt, Pseudomonas putida KT2440
cgcacgcugcccaggugccaggc

SEQ ID NO: 3551229 - RNA, 16 nt, Pseudomonas putida KT2440
cgcacggcuucgcgca

SEQ ID NO: 3551230 - RNA, 17 nt, Pseudomonas putida KT2440
cgcacggcuucgcgcau

SEQ ID NO: 3551231 - RNA, 20 nt, Pseudomonas putida KT2440
cgcacgggucaccucaucga

SEQ ID NO: 3551232 - RNA, 23 nt, Pseudomonas putida KT2440
cgcacgguaggugaugcggcccu

SEQ ID NO: 3551233 - RNA, 14 nt, Pseudomonas putida KT2440
cgcacggucuccgg

SEQ ID NO: 3551234 - RNA, 22 nt, Pseudomonas putida KT2440
cgcacgugggucgggaacagcu

SEQ ID NO: 3551235 - RNA, 20 nt, Pseudomonas putida KT2440
cgcacucaguuaaucagcaa

SEQ ID NO: 3551236 - RNA, 21 nt, Pseudomonas putida KT2440
cgcacucaguuaaucagcaac

SEQ ID NO: 3551237 - RNA, 21 nt, Pseudomonas putida KT2440
cgcacuccccaucagcagcug

SEQ ID NO: 3551238 - RNA, 15 nt, Pseudomonas putida KT2440
cgcacucucccgcag

SEQ ID NO: 3551239 - RNA, 17 nt, Pseudomonas putida KT2440
cgcacugaacagcgccu

SEQ ID NO: 3551240 - RNA, 19 nt, Pseudomonas putida KT2440
cgcacugaauacaccagcu

SEQ ID NO: 3551241 - RNA, 14 nt, Pseudomonas putida KT2440
cgcacugcugccgc

SEQ ID NO: 3551242 - RNA, 13 nt, Pseudomonas putida KT2440
cgcacuggucaac

SEQ ID NO: 3551243 - RNA, 22 nt, Pseudomonas putida KT2440
cgcacuggucaaccccuugcgg

SEQ ID NO: 3551244 - RNA, 15 nt, Pseudomonas putida KT2440
cgcacuguagcgccc

SEQ ID NO: 3551245 - RNA, 19 nt, Pseudomonas putida KT2440
cgcacuuccacacccagcg

SEQ ID NO: 3551246 - RNA, 16 nt, Pseudomonas putida KT2440
cgcacuucguagcgcc

SEQ ID NO: 3551247 - RNA, 18 nt, Pseudomonas putida KT2440
cgcacuucguagcgcccg

SEQ ID NO: 3551248 - RNA, 23 nt, Pseudomonas putida KT2440
cgcacuucuguggaaaaccgcuc

SEQ ID NO: 3551249 - RNA, 18 nt, Pseudomonas putida KT2440
cgcacuugaucuugcgcc

SEQ ID NO: 3551250 - RNA, 18 nt, Pseudomonas putida KT2440
cgcacuugccagccgccc

SEQ ID NO: 3551251 - RNA, 22 nt, Pseudomonas putida KT2440
cgcacuuguuccagccgcgcca

SEQ ID NO: 3551252 - RNA, 18 nt, Pseudomonas putida KT2440
cgcagacaaaacgcugcg

SEQ ID NO: 3551253 - RNA, 13 nt, Pseudomonas putida KT2440
cgcagagcgccca

SEQ ID NO: 3551254 - RNA, 16 nt, Pseudomonas putida KT2440
cgcagagcgcccacca

SEQ ID NO: 3551255 - RNA, 18 nt, Pseudomonas putida KT2440
cgcagagcgccccggcaa

SEQ ID NO: 3551256 - RNA, 23 nt, Pseudomonas putida KT2440
cgcagagggccgcgcaggcggcu

SEQ ID NO: 3551257 - RNA, 16 nt, Pseudomonas putida KT2440
cgcagaucguuguagg

SEQ ID NO: 3551258 - RNA, 13 nt, Pseudomonas putida KT2440
cgcagauggcaga

SEQ ID NO: 3551259 - RNA, 15 nt, Pseudomonas putida KT2440
cgcagauggcagaca

SEQ ID NO: 3551260 - RNA, 21 nt, Pseudomonas putida KT2440
cgcagaugguggcauagcgcg

SEQ ID NO: 3551261 - RNA, 21 nt, Pseudomonas putida KT2440
cgcagcaauacgcacaggcgc

SEQ ID NO: 3551262 - RNA, 19 nt, Pseudomonas putida KT2440
cgcagcacgccguugcggu

SEQ ID NO: 3551263 - RNA, 10 nt, Pseudomonas putida KT2440
cgcagcagca

SEQ ID NO: 3551264 - RNA, 13 nt, Pseudomonas putida KT2440
cgcaucaagcggc

SEQ ID NO: 3551265 - RNA, 21 nt, Pseudomonas putida KT2440
cgcaucacccgccccucuucc

SEQ ID NO: 3551266 - RNA, 13 nt, Pseudomonas putida KT2440
cgcaucagccgcg

SEQ ID NO: 3551267 - RNA, 20 nt, Pseudomonas putida KT2440
cgcaucagccgcgcccucuu

SEQ ID NO: 3551268 - RNA, 15 nt, Pseudomonas putida KT2440
cgcaucagcgcagca

SEQ ID NO: 3551269 - RNA, 21 nt, Pseudomonas putida KT2440
cgcaucagcgcagcaucuucc

SEQ ID NO: 3551270 - RNA, 13 nt, Pseudomonas putida KT2440
cgcaucaggcugc

SEQ ID NO: 3551271 - RNA, 19 nt, Pseudomonas putida KT2440
cgcaucaggcugcgcccgc

SEQ ID NO: 3551272 - RNA, 12 nt, Pseudomonas putida KT2440
cgcaucaucacg

SEQ ID NO: 3551273 - RNA, 14 nt, Pseudomonas putida KT2440
cgcauccacaggcg

SEQ ID NO: 3551274 - RNA, 17 nt, Pseudomonas putida KT2440
cgcauccacaggcgccc

SEQ ID NO: 3551275 - RNA, 21 nt, Pseudomonas putida KT2440
cgcauccacaggcgccccggc

SEQ ID NO: 3551276 - RNA, 13 nt, Pseudomonas putida KT2440
cgcauccagcacu

SEQ ID NO: 3551277 - RNA, 23 nt, Pseudomonas putida KT2440
cgcauccccggccuccucgcggg

SEQ ID NO: 3551278 - RNA, 22 nt, Pseudomonas putida KT2440
cgcauccggaauuucugcaccu

SEQ ID NO: 3551279 - RNA, 18 nt, Pseudomonas putida KT2440
cgcauccucggugcgcgg

SEQ ID NO: 3551280 - RNA, 16 nt, Pseudomonas putida KT2440
cgcaucgacaggucca

SEQ ID NO: 3551281 - RNA, 20 nt, Pseudomonas putida KT2440
cgcaucgcuguccuuggcca

SEQ ID NO: 3551282 - RNA, 15 nt, Pseudomonas putida KT2440
cgcaucguccuugca

SEQ ID NO: 3551283 - RNA, 23 nt, Pseudomonas putida KT2440
cgcaucguuauccagcacccaca

SEQ ID NO: 3551284 - RNA, 19 nt, Pseudomonas putida KT2440
cgcaucugcaccggcagcg

SEQ ID NO: 3551285 - RNA, 17 nt, Pseudomonas putida KT2440
cgcaugacuuccaggua

SEQ ID NO: 3551286 - RNA, 20 nt, Pseudomonas putida KT2440
cgcaugacuuccagguagcg

SEQ ID NO: 3551287 - RNA, 15 nt, Pseudomonas putida KT2440
cgcaugcccgcgcaa

SEQ ID NO: 3551288 - RNA, 12 nt, Pseudomonas putida KT2440
cgcaugccgaug

SEQ ID NO: 3551289 - RNA, 13 nt, Pseudomonas putida KT2440
cgcaugcgcgcca

SEQ ID NO: 3551290 - RNA, 21 nt, Pseudomonas putida KT2440
cgcaugcgcgccauggccucg

SEQ ID NO: 3551291 - RNA, 18 nt, Pseudomonas putida KT2440
cgcaugcggccgugaaca

SEQ ID NO: 3551292 - RNA, 15 nt, Pseudomonas putida KT2440
cgcaugcucgcugcu

SEQ ID NO: 3551293 - RNA, 14 nt, Pseudomonas putida KT2440
cgcaugcuuggcga

SEQ ID NO: 3551294 - RNA, 16 nt, Pseudomonas putida KT2440
cgcaugcuuggcgaag

SEQ ID NO: 3551295 - RNA, 19 nt, Pseudomonas putida KT2440
cgcaugcuuggcgaagguc

SEQ ID NO: 3551296 - RNA, 19 nt, Pseudomonas putida KT2440
cgcauggcaaucgggccgg

SEQ ID NO: 3551297 - RNA, 23 nt, Pseudomonas putida KT2440
cgcauggccuggucgaaggucag

SEQ ID NO: 3551298 - RNA, 22 nt, Pseudomonas putida KT2440
cgcauggcguuguccagcaggu

SEQ ID NO: 3551299 - RNA, 23 nt, Pseudomonas putida KT2440
cgcauggcguuguccagcagguu

SEQ ID NO: 3551300 - RNA, 23 nt, Pseudomonas putida KT2440
cgcauggugguagggaaauccuc

SEQ ID NO: 3551301 - RNA, 14 nt, Pseudomonas putida KT2440
cgcauguccuuggc

SEQ ID NO: 3551302 - RNA, 16 nt, Pseudomonas putida KT2440
cgcauguccuuggccc

SEQ ID NO: 3551303 - RNA, 20 nt, Pseudomonas putida KT2440
cgcauucgcggguaaacccg

SEQ ID NO: 3551304 - RNA, 20 nt, Pseudomonas putida KT2440
cgcauucgcgggugaacccg

SEQ ID NO: 3551305 - RNA, 17 nt, Pseudomonas putida KT2440
cgcauucuuggccagga

SEQ ID NO: 3551306 - RNA, 17 nt, Pseudomonas putida KT2440
cgcauugaucaugccca

SEQ ID NO: 3551307 - RNA, 15 nt, Pseudomonas putida KT2440
cgcauuggccggguc

SEQ ID NO: 3551308 - RNA, 21 nt, Pseudomonas putida KT2440
cgcauuguaucggaaagccga

SEQ ID NO: 3551309 - RNA, 16 nt, Pseudomonas putida KT2440
cgcauuugcuccaggg

SEQ ID NO: 3551310 - RNA, 13 nt, Pseudomonas putida KT2440
cgcauuuucauca

SEQ ID NO: 3551311 - RNA, 15 nt, Pseudomonas putida KT2440
cgcauuuucaucaaa

SEQ ID NO: 3551312 - RNA, 17 nt, Pseudomonas putida KT2440
cgccaaaaccuguucca

SEQ ID NO: 3551313 - RNA, 23 nt, Pseudomonas putida KT2440
cgccaaaaccuguuccagccccu

SEQ ID NO: 3551314 - RNA, 21 nt, Pseudomonas putida KT2440
cgccaaaaggcccgaaacugc

SEQ ID NO: 3551315 - RNA, 22 nt, Pseudomonas putida KT2440
cgccaaaccccagcaaggcaau

SEQ ID NO: 3551316 - RNA, 17 nt, Pseudomonas putida KT2440
cgccaaacgccagggcc

SEQ ID NO: 3551317 - RNA, 18 nt, Pseudomonas putida KT2440
cgccaaacgccagggccg

SEQ ID NO: 3551318 - RNA, 13 nt, Pseudomonas putida KT2440
cgccaaagccugg

SEQ ID NO: 3551319 - RNA, 18 nt, Pseudomonas putida KT2440
cgccaaauucgaccagca

SEQ ID NO: 3551320 - RNA, 13 nt, Pseudomonas putida KT2440
cgccaacaacaag

SEQ ID NO: 3551321 - RNA, 15 nt, Pseudomonas putida KT2440
cgccaacaccaccuc

SEQ ID NO: 3551322 - RNA, 14 nt, Pseudomonas putida KT2440
cgccaacagcgcag

SEQ ID NO: 3551323 - RNA, 15 nt, Pseudomonas putida KT2440
cgccaaccccacgcc

SEQ ID NO: 3551324 - RNA, 15 nt, Pseudomonas putida KT2440
cgccaaccgccagca

SEQ ID NO: 3551325 - RNA, 16 nt, Pseudomonas putida KT2440
cgccaaccgcgccagc

SEQ ID NO: 3551326 - RNA, 17 nt, Pseudomonas putida KT2440
cgccaaccgcgccagca

SEQ ID NO: 3551327 - RNA, 24 nt, Pseudomonas putida KT2440
cgccaaccucaggccugcacugca

SEQ ID NO: 3551328 - RNA, 17 nt, Pseudomonas putida KT2440
cgccaacgcccccgcca

SEQ ID NO: 3551329 - RNA, 23 nt, Pseudomonas putida KT2440
cgccaacuguuucugcucuucug

SEQ ID NO: 3551330 - RNA, 12 nt, Pseudomonas putida KT2440
cgccaaggcacg

SEQ ID NO: 3551331 - RNA, 19 nt, Pseudomonas putida KT2440
cgccaaggccucgaacagc

SEQ ID NO: 3551332 - RNA, 21 nt, Pseudomonas putida KT2440
cgccaagggucgacaccagga

SEQ ID NO: 3551333 - RNA, 16 nt, Pseudomonas putida KT2440
cgccaagguccagcca

SEQ ID NO: 3551334 - RNA, 17 nt, Pseudomonas putida KT2440
cgccaauaccgcgcauc

SEQ ID NO: 3551335 - RNA, 18 nt, Pseudomonas putida KT2440
cgccaauaccgcgcauca

SEQ ID NO: 3551336 - RNA, 19 nt, Pseudomonas putida KT2440
cgccaaucagguuguucac

SEQ ID NO: 3551337 - RNA, 18 nt, Pseudomonas putida KT2440
cgccaaucaucgccagca

SEQ ID NO: 3551338 - RNA, 12 nt, Pseudomonas putida KT2440
cgccaaucucgu

SEQ ID NO: 3551339 - RNA, 20 nt, Pseudomonas putida KT2440
cgccaaucucguugcgccag

SEQ ID NO: 3551340 - RNA, 22 nt, Pseudomonas putida KT2440
cgccaaucucguugcgccaggc

SEQ ID NO: 3551341 - RNA, 15 nt, Pseudomonas putida KT2440
cgccaauugcgccag

SEQ ID NO: 3551342 - RNA, 17 nt, Pseudomonas putida KT2440
cgccaauugcgccagcc

SEQ ID NO: 3551343 - RNA, 19 nt, Pseudomonas putida KT2440
cgccaauugcgccagccgc

SEQ ID NO: 3551344 - RNA, 20 nt, Pseudomonas putida KT2440
cgccaauugcgccagccgcu

SEQ ID NO: 3551345 - RNA, 19 nt, Pseudomonas putida KT2440
cgccacaaaaucacaggcc

SEQ ID NO: 3551346 - RNA, 12 nt, Pseudomonas putida KT2440
cgccacaaacgc

SEQ ID NO: 3551347 - RNA, 21 nt, Pseudomonas putida KT2440
cgccacaacccaucacggccu

SEQ ID NO: 3551348 - RNA, 13 nt, Pseudomonas putida KT2440
cgccacaccacag

SEQ ID NO: 3551349 - RNA, 14 nt, Pseudomonas putida KT2440
cgccacaccacagc

SEQ ID NO: 3551350 - RNA, 15 nt, Pseudomonas putida KT2440
cgccacaccacagcu

SEQ ID NO: 3551351 - RNA, 21 nt, Pseudomonas putida KT2440
cgccacaccacagcugcacau

SEQ ID NO: 3551352 - RNA, 15 nt, Pseudomonas putida KT2440
cgccacacugucccg

SEQ ID NO: 3551353 - RNA, 20 nt, Pseudomonas putida KT2440
cgccacacugucccggcaca

SEQ ID NO: 3551354 - RNA, 21 nt, Pseudomonas putida KT2440
cgccacacugucccggcacaa

SEQ ID NO: 3551355 - RNA, 19 nt, Pseudomonas putida KT2440
cgccacauagcuggcacug

SEQ ID NO: 3551356 - RNA, 20 nt, Pseudomonas putida KT2440
cgccacauagcuggcacugc

SEQ ID NO: 3551357 - RNA, 14 nt, Pseudomonas putida KT2440
cgccacauccagcg

SEQ ID NO: 3551358 - RNA, 16 nt, Pseudomonas putida KT2440
cgccacaugcccgcgg

SEQ ID NO: 3551359 - RNA, 15 nt, Pseudomonas putida KT2440
cgccaccaaccggcc

SEQ ID NO: 3551360 - RNA, 21 nt, Pseudomonas putida KT2440
cgccaccaaccggccaguggc

SEQ ID NO: 3551361 - RNA, 13 nt, Pseudomonas putida KT2440
cgccaccaccgcu

SEQ ID NO: 3551362 - RNA, 14 nt, Pseudomonas putida KT2440
cgccaccaccgcug

SEQ ID NO: 3551363 - RNA, 21 nt, Pseudomonas putida KT2440
cgccaccacgaacaguggccc

SEQ ID NO: 3551364 - RNA, 14 nt, Pseudomonas putida KT2440
cgccaccacgaugc

SEQ ID NO: 3551365 - RNA, 19 nt, Pseudomonas putida KT2440
cgccaccacgaugccuggg

SEQ ID NO: 3551366 - RNA, 22 nt, Pseudomonas putida KT2440
cgccaccagccccaaucccaac

SEQ ID NO: 3551367 - RNA, 17 nt, Pseudomonas putida KT2440
cgccaccaguuccaccg

SEQ ID NO: 3551368 - RNA, 16 nt, Pseudomonas putida KT2440
cgccaccaucggccag

SEQ ID NO: 3551369 - RNA, 19 nt, Pseudomonas putida KT2440
cgccaggcacccagccagc

SEQ ID NO: 3551370 - RNA, 16 nt, Pseudomonas putida KT2440
cgccaggcauuccccg

SEQ ID NO: 3551371 - RNA, 18 nt, Pseudomonas putida KT2440
cgccaggcauuccccggu

SEQ ID NO: 3551372 - RNA, 15 nt, Pseudomonas putida KT2440
cgccaggcauugcuc

SEQ ID NO: 3551373 - RNA, 17 nt, Pseudomonas putida KT2440
cgccaggcccaccaccg

SEQ ID NO: 3551374 - RNA, 23 nt, Pseudomonas putida KT2440
cgccaggccuucaucggccuccu

SEQ ID NO: 3551375 - RNA, 20 nt, Pseudomonas putida KT2440
cgccaggccuuucagcgccc

SEQ ID NO: 3551376 - RNA, 21 nt, Pseudomonas putida KT2440
cgccaggccuuucagcgccca

SEQ ID NO: 3551377 - RNA, 18 nt, Pseudomonas putida KT2440
cgccaggcucuccagccg

SEQ ID NO: 3551378 - RNA, 19 nt, Pseudomonas putida KT2440
cgccaggcucuccagccgc

SEQ ID NO: 3551379 - RNA, 22 nt, Pseudomonas putida KT2440
cgccaggcugauacgcgacagu

SEQ ID NO: 3551380 - RNA, 12 nt, Pseudomonas putida KT2440
cgccaggcuuca

SEQ ID NO: 3551381 - RNA, 19 nt, Pseudomonas putida KT2440
cgccagggcaaaaugcagc

SEQ ID NO: 3551382 - RNA, 21 nt, Pseudomonas putida KT2440
cgccagggcaaucgccaaggu

SEQ ID NO: 3551383 - RNA, 13 nt, Pseudomonas putida KT2440
cgccagggcaucg

SEQ ID NO: 3551384 - RNA, 18 nt, Pseudomonas putida KT2440
cgccagggcaucgaccag

SEQ ID NO: 3551385 - RNA, 21 nt, Pseudomonas putida KT2440
cgccagggcugauugagcagc

SEQ ID NO: 3551386 - RNA, 22 nt, Pseudomonas putida KT2440
cgccaggguugcaucgcgcacu

SEQ ID NO: 3551387 - RNA, 17 nt, Pseudomonas putida KT2440
cgccaggguuugcaagc

SEQ ID NO: 3551388 - RNA, 23 nt, Pseudomonas putida KT2440
cgccaggguuugcaagcggcgau

SEQ ID NO: 3551389 - RNA, 14 nt, Pseudomonas putida KT2440
cgccagguccaggc

SEQ ID NO: 3551390 - RNA, 23 nt, Pseudomonas putida KT2440
cgccagguccgguaacuggccca

SEQ ID NO: 3551391 - RNA, 22 nt, Pseudomonas putida KT2440
cgccaggucuuccuccgacagc

SEQ ID NO: 3551392 - RNA, 10 nt, Pseudomonas putida KT2440
cgccagguga

SEQ ID NO: 3551393 - RNA, 17 nt, Pseudomonas putida KT2440
cgccaggugccgucggg

SEQ ID NO: 3551394 - RNA, 17 nt, Pseudomonas putida KT2440
cgccaggugcucagcca

SEQ ID NO: 3551395 - RNA, 19 nt, Pseudomonas putida KT2440
cgccaggugcucagccacg

SEQ ID NO: 3551396 - RNA, 21 nt, Pseudomonas putida KT2440
cgccaggugcucagccacgcu

SEQ ID NO: 3551397 - RNA, 20 nt, Pseudomonas putida KT2440
cgccagguggaagcgcgcau

SEQ ID NO: 3551398 - RNA, 19 nt, Pseudomonas putida KT2440
cgccaguacggccaucagc

SEQ ID NO: 3551399 - RNA, 16 nt, Pseudomonas putida KT2440
cgccagugcaaacugg

SEQ ID NO: 3551400 - RNA, 22 nt, Pseudomonas putida KT2440
cgccagugggugcuguggcgca

SEQ ID NO: 3551401 - RNA, 22 nt, Pseudomonas putida KT2440
cgccaguuacccuguacccgcu

SEQ ID NO: 3551402 - RNA, 16 nt, Pseudomonas putida KT2440
cgccaguuccacgacc

SEQ ID NO: 3551403 - RNA, 18 nt, Pseudomonas putida KT2440
cgccaguuccacgaccgu

SEQ ID NO: 3551404 - RNA, 14 nt, Pseudomonas putida KT2440
cgccaguucgacgc

SEQ ID NO: 3551405 - RNA, 17 nt, Pseudomonas putida KT2440
cgccaguucgacgcugc

SEQ ID NO: 3551406 - RNA, 18 nt, Pseudomonas putida KT2440
cgccaguucgacgcugcu

SEQ ID NO: 3551407 - RNA, 19 nt, Pseudomonas putida KT2440
cgccaguucgacgcugcug

SEQ ID NO: 3551408 - RNA, 22 nt, Pseudomonas putida KT2440
cgccaguucgacgcugcugucg

SEQ ID NO: 3551409 - RNA, 16 nt, Pseudomonas putida KT2440
cgccaguucgcggcgc

SEQ ID NO: 3551410 - RNA, 21 nt, Pseudomonas putida KT2440
cgccaguuguaguucccgcgc

SEQ ID NO: 3551411 - RNA, 16 nt, Pseudomonas putida KT2440
cgccaguugucgcugg

SEQ ID NO: 3551412 - RNA, 17 nt, Pseudomonas putida KT2440
cgccaguugucgcuggg

SEQ ID NO: 3551413 - RNA, 15 nt, Pseudomonas putida KT2440
cgccaguuucaccug

SEQ ID NO: 3551414 - RNA, 20 nt, Pseudomonas putida KT2440
cgccaguuucaccugaccau

SEQ ID NO: 3551415 - RNA, 22 nt, Pseudomonas putida KT2440
cgccaguuucaccugaccauca

SEQ ID NO: 3551416 - RNA, 21 nt, Pseudomonas putida KT2440
cgccauaagcugucagcaccu

SEQ ID NO: 3551417 - RNA, 22 nt, Pseudomonas putida KT2440
cgccauagcucauggucagccg

SEQ ID NO: 3551418 - RNA, 17 nt, Pseudomonas putida KT2440
cgccauaggcuugcgcu

SEQ ID NO: 3551419 - RNA, 22 nt, Pseudomonas putida KT2440
cgccauaucaggauugccgcag

SEQ ID NO: 3551420 - RNA, 14 nt, Pseudomonas putida KT2440
cgccaucagaggcg

SEQ ID NO: 3551421 - RNA, 22 nt, Pseudomonas putida KT2440
cgccaucagugcccccgccaca

SEQ ID NO: 3551422 - RNA, 15 nt, Pseudomonas putida KT2440
cgccauccccccagc

SEQ ID NO: 3551423 - RNA, 18 nt, Pseudomonas putida KT2440
cgccauccccccagcccu

SEQ ID NO: 3551424 - RNA, 22 nt, Pseudomonas putida KT2440
cgccauccccccagcccuugcg

SEQ ID NO: 3551425 - RNA, 12 nt, Pseudomonas putida KT2440
cgccaucgccca

SEQ ID NO: 3551426 - RNA, 16 nt, Pseudomonas putida KT2440
cgccaucgccccgcgc

SEQ ID NO: 3551427 - RNA, 17 nt, Pseudomonas putida KT2440
cgccaucgcccgucagc

SEQ ID NO: 3551428 - RNA, 14 nt, Pseudomonas putida KT2440
cgccaucgcgcagg

SEQ ID NO: 3551429 - RNA, 16 nt, Pseudomonas putida KT2440
cgccaucggcacgcca

SEQ ID NO: 3551430 - RNA, 21 nt, Pseudomonas putida KT2440
cgccaucggccucucucagca

SEQ ID NO: 3551431 - RNA, 15 nt, Pseudomonas putida KT2440
cgccaugagcaauac

SEQ ID NO: 3551432 - RNA, 19 nt, Pseudomonas putida KT2440
cgccaugagugcaggcaua

SEQ ID NO: 3551433 - RNA, 14 nt, Pseudomonas putida KT2440
cgccaugcaacugc

SEQ ID NO: 3551434 - RNA, 21 nt, Pseudomonas putida KT2440
cgccaugcagcccgcaccggc

SEQ ID NO: 3551435 - RNA, 20 nt, Pseudomonas putida KT2440
cgccauggccucgucgcggu

SEQ ID NO: 3551436 - RNA, 12 nt, Pseudomonas putida KT2440
cgccauggccug

SEQ ID NO: 3551437 - RNA, 18 nt, Pseudomonas putida KT2440
cgccauggccuggcgggu

SEQ ID NO: 3551438 - RNA, 18 nt, Pseudomonas putida KT2440
cgccauggcgacaauggc

SEQ ID NO: 3551439 - RNA, 20 nt, Pseudomonas putida KT2440
cgccauggcgacaauggcgc

SEQ ID NO: 3551440 - RNA, 15 nt, Pseudomonas putida KT2440
cgccaugugcgcccg

SEQ ID NO: 3551441 - RNA, 16 nt, Pseudomonas putida KT2440
cgccaugugcgcccga

SEQ ID NO: 3551442 - RNA, 22 nt, Pseudomonas putida KT2440
cgccauguguacgccgcuguca

SEQ ID NO: 3551443 - RNA, 21 nt, Pseudomonas putida KT2440
cgccauguugcgcagcaaucc

SEQ ID NO: 3551444 - RNA, 15 nt, Pseudomonas putida KT2440
cgccauucaccagcu

SEQ ID NO: 3551445 - RNA, 16 nt, Pseudomonas putida KT2440
cgccauucaccagcuu

SEQ ID NO: 3551446 - RNA, 17 nt, Pseudomonas putida KT2440
cgccauucuucuccagg

SEQ ID NO: 3551447 - RNA, 22 nt, Pseudomonas putida KT2440
cgccauugacuaccagguagcc

SEQ ID NO: 3551448 - RNA, 14 nt, Pseudomonas putida KT2440
cgccauugaugccg

SEQ ID NO: 3551449 - RNA, 15 nt, Pseudomonas putida KT2440
cgccauugaugccga

SEQ ID NO: 3551450 - RNA, 11 nt, Pseudomonas putida KT2440
cgccauugccc

SEQ ID NO: 3551451 - RNA, 17 nt, Pseudomonas putida KT2440
cgccauugcccagccug

SEQ ID NO: 3551452 - RNA, 14 nt, Pseudomonas putida KT2440
cgccauuguucgcc

SEQ ID NO: 3551453 - RNA, 21 nt, Pseudomonas putida KT2440
cgcccaaagaaaagcccgcac

SEQ ID NO: 3551454 - RNA, 24 nt, Pseudomonas putida KT2440
cgcccaacccagccagcgacagca

SEQ ID NO: 3551455 - RNA, 18 nt, Pseudomonas putida KT2440
cgcccaauacgcaccgcu

SEQ ID NO: 3551456 - RNA, 15 nt, Pseudomonas putida KT2440
cgcccaaucggguaa

SEQ ID NO: 3551457 - RNA, 22 nt, Pseudomonas putida KT2440
cgcccaaugcagccgcccgccc

SEQ ID NO: 3551458 - RNA, 14 nt, Pseudomonas putida KT2440
cgcccacacggcaa

SEQ ID NO: 3551459 - RNA, 15 nt, Pseudomonas putida KT2440
cgcccacacggcaag

SEQ ID NO: 3551460 - RNA, 19 nt, Pseudomonas putida KT2440
cgcccaccaauuacucggc

SEQ ID NO: 3551461 - RNA, 13 nt, Pseudomonas putida KT2440
cgcccaccaccag

SEQ ID NO: 3551462 - RNA, 14 nt, Pseudomonas putida KT2440
cgcccaccaccagc

SEQ ID NO: 3551463 - RNA, 15 nt, Pseudomonas putida KT2440
cgcccaccaccagcc

SEQ ID NO: 3551464 - RNA, 18 nt, Pseudomonas putida KT2440
cgcccaccaccagcccga

SEQ ID NO: 3551465 - RNA, 16 nt, Pseudomonas putida KT2440
cgcccaccagcugcac

SEQ ID NO: 3551466 - RNA, 17 nt, Pseudomonas putida KT2440
cgcccacgaucucacgc

SEQ ID NO: 3551467 - RNA, 15 nt, Pseudomonas putida KT2440
cgcccacgccgcugg

SEQ ID NO: 3551468 - RNA, 15 nt, Pseudomonas putida KT2440
cgcccacgccggcaa

SEQ ID NO: 3551469 - RNA, 17 nt, Pseudomonas putida KT2440
cgcccacgccggcaacc

SEQ ID NO: 3551470 - RNA, 12 nt, Pseudomonas putida KT2440
cgcccacgcggg

SEQ ID NO: 3551471 - RNA, 13 nt, Pseudomonas putida KT2440
cgcccacgcgggu

SEQ ID NO: 3551472 - RNA, 22 nt, Pseudomonas putida KT2440
cgcccacggcgauggucugcuc

SEQ ID NO: 3551473 - RNA, 14 nt, Pseudomonas putida KT2440
cgcccacucacgca

SEQ ID NO: 3551474 - RNA, 13 nt, Pseudomonas putida KT2440
cgcccggccacgu

SEQ ID NO: 3551475 - RNA, 12 nt, Pseudomonas putida KT2440
cgcccggccagg

SEQ ID NO: 3551476 - RNA, 21 nt, Pseudomonas putida KT2440
cgcccggccuguuuggccgca

SEQ ID NO: 3551477 - RNA, 14 nt, Pseudomonas putida KT2440
cgcccggcgcagca

SEQ ID NO: 3551478 - RNA, 20 nt, Pseudomonas putida KT2440
cgcccggcgcagcauaugcu

SEQ ID NO: 3551479 - RNA, 13 nt, Pseudomonas putida KT2440
cgcccggcgcuga

SEQ ID NO: 3551480 - RNA, 17 nt, Pseudomonas putida KT2440
cgcccggcuugcccggg

SEQ ID NO: 3551481 - RNA, 18 nt, Pseudomonas putida KT2440
cgcccggcuugcccgggc

SEQ ID NO: 3551482 - RNA, 21 nt, Pseudomonas putida KT2440
cgcccggcuugcccgggcgcg

SEQ ID NO: 3551483 - RNA, 17 nt, Pseudomonas putida KT2440
cgcccgggagggugaac

SEQ ID NO: 3551484 - RNA, 13 nt, Pseudomonas putida KT2440
cgcccgggccagg

SEQ ID NO: 3551485 - RNA, 14 nt, Pseudomonas putida KT2440
cgcccgggucaggu

SEQ ID NO: 3551486 - RNA, 18 nt, Pseudomonas putida KT2440
cgcccgggucaggucgcu

SEQ ID NO: 3551487 - RNA, 22 nt, Pseudomonas putida KT2440
cgcccgguauucggguguccac

SEQ ID NO: 3551488 - RNA, 23 nt, Pseudomonas putida KT2440
cgcccgguuccaauacauacacc

SEQ ID NO: 3551489 - RNA, 18 nt, Pseudomonas putida KT2440
cgcccgguuccagcgcac

SEQ ID NO: 3551490 - RNA, 14 nt, Pseudomonas putida KT2440
cgcccguaacgguc

SEQ ID NO: 3551491 - RNA, 19 nt, Pseudomonas putida KT2440
cgcccguaugcauccgcca

SEQ ID NO: 3551492 - RNA, 18 nt, Pseudomonas putida KT2440
cgcccgugcucacgcacg

SEQ ID NO: 3551493 - RNA, 19 nt, Pseudomonas putida KT2440
cgcccuagaacaggcggcu

SEQ ID NO: 3551494 - RNA, 12 nt, Pseudomonas putida KT2440
cgcccuccagcc

SEQ ID NO: 3551495 - RNA, 16 nt, Pseudomonas putida KT2440
cgcccuccaucaaucg

SEQ ID NO: 3551496 - RNA, 15 nt, Pseudomonas putida KT2440
cgcccuccgcguccu

SEQ ID NO: 3551497 - RNA, 16 nt, Pseudomonas putida KT2440
cgcccuccgcguccuc

SEQ ID NO: 3551498 - RNA, 21 nt, Pseudomonas putida KT2440
cgcccucgcgcguugcagcca

SEQ ID NO: 3551499 - RNA, 18 nt, Pseudomonas putida KT2440
cgcccucguucgcgggca

SEQ ID NO: 3551500 - RNA, 18 nt, Pseudomonas putida KT2440
cgcccucuugcugcaaca

SEQ ID NO: 3551501 - RNA, 19 nt, Pseudomonas putida KT2440
cgcccugagccaaggccgc

SEQ ID NO: 3551502 - RNA, 23 nt, Pseudomonas putida KT2440
cgcccugagccaaggccgcccag

SEQ ID NO: 3551503 - RNA, 14 nt, Pseudomonas putida KT2440
cgcccugcccucga

SEQ ID NO: 3551504 - RNA, 23 nt, Pseudomonas putida KT2440
cgcccugcccucgacaaucgcca

SEQ ID NO: 3551505 - RNA, 13 nt, Pseudomonas putida KT2440
cgcccugcgccug

SEQ ID NO: 3551506 - RNA, 14 nt, Pseudomonas putida KT2440
cgcccugcugccgc

SEQ ID NO: 3551507 - RNA, 12 nt, Pseudomonas putida KT2440
cgcccuggcaug

SEQ ID NO: 3551508 - RNA, 15 nt, Pseudomonas putida KT2440
cgcccuggcaugcug

SEQ ID NO: 3551509 - RNA, 19 nt, Pseudomonas putida KT2440
cgcccuggcaugcugaugc

SEQ ID NO: 3551510 - RNA, 12 nt, Pseudomonas putida KT2440
cgcccuggcggc

SEQ ID NO: 3551511 - RNA, 18 nt, Pseudomonas putida KT2440
cgcccugggcgagcaggu

SEQ ID NO: 3551512 - RNA, 22 nt, Pseudomonas putida KT2440
cgcccuguaccgccucgggggc

SEQ ID NO: 3551513 - RNA, 20 nt, Pseudomonas putida KT2440
cgcccuucacgcucaugcug

SEQ ID NO: 3551514 - RNA, 19 nt, Pseudomonas putida KT2440
cgcccuucauacagcgccu

SEQ ID NO: 3551515 - RNA, 20 nt, Pseudomonas putida KT2440
cgcccuucauacagcgccuc

SEQ ID NO: 3551516 - RNA, 16 nt, Pseudomonas putida KT2440
cgcccuucgcggaagc

SEQ ID NO: 3551517 - RNA, 14 nt, Pseudomonas putida KT2440
cgcccuuggugcac

SEQ ID NO: 3551518 - RNA, 17 nt, Pseudomonas putida KT2440
cgcccuugucagccgcc

SEQ ID NO: 3551519 - RNA, 22 nt, Pseudomonas putida KT2440
cgcccuugucagccgccgcugc

SEQ ID NO: 3551520 - RNA, 15 nt, Pseudomonas putida KT2440
cgcccuuucgcgggu

SEQ ID NO: 3551521 - RNA, 19 nt, Pseudomonas putida KT2440
cgcccuuucgcgggugaac

SEQ ID NO: 3551522 - RNA, 16 nt, Pseudomonas putida KT2440
cgcccuuugguacugc

SEQ ID NO: 3551523 - RNA, 21 nt, Pseudomonas putida KT2440
cgcccuuugguacugcgccgg

SEQ ID NO: 3551524 - RNA, 18 nt, Pseudomonas putida KT2440
cgcccuuuuucaccaggc

SEQ ID NO: 3551525 - RNA, 22 nt, Pseudomonas putida KT2440
cgccgaaacguagucgaccaga

SEQ ID NO: 3551526 - RNA, 22 nt, Pseudomonas putida KT2440
cgccgaaauuaccuuacugcag

SEQ ID NO: 3551527 - RNA, 21 nt, Pseudomonas putida KT2440
cgccgaacauggugcuuuugu

SEQ ID NO: 3551528 - RNA, 18 nt, Pseudomonas putida KT2440
cgccgaaccccaccagca

SEQ ID NO: 3551529 - RNA, 17 nt, Pseudomonas putida KT2440
cgccgaacgggccacca

SEQ ID NO: 3551530 - RNA, 16 nt, Pseudomonas putida KT2440
cgccgaacucuggcaa

SEQ ID NO: 3551531 - RNA, 20 nt, Pseudomonas putida KT2440
cgccgaacuugccgaugaac

SEQ ID NO: 3551532 - RNA, 21 nt, Pseudomonas putida KT2440
cgccgacagccucaaggccgg

SEQ ID NO: 3551533 - RNA, 23 nt, Pseudomonas putida KT2440
cgccgaccaagcgccccacaagc

SEQ ID NO: 3551534 - RNA, 18 nt, Pseudomonas putida KT2440
cgccgacccugugggagc

SEQ ID NO: 3551535 - RNA, 19 nt, Pseudomonas putida KT2440
cgccgacccugugggagcg

SEQ ID NO: 3551536 - RNA, 12 nt, Pseudomonas putida KT2440
cgccgaccgcgc

SEQ ID NO: 3551537 - RNA, 18 nt, Pseudomonas putida KT2440
cgccgacgauaccgccca

SEQ ID NO: 3551538 - RNA, 17 nt, Pseudomonas putida KT2440
cgccgacgaugcccgau

SEQ ID NO: 3551539 - RNA, 18 nt, Pseudomonas putida KT2440
cgccgacggcauggccga

SEQ ID NO: 3551540 - RNA, 21 nt, Pseudomonas putida KT2440
cgccgacggcauggccgaagc

SEQ ID NO: 3551541 - RNA, 15 nt, Pseudomonas putida KT2440
cgccgagaggcgcug

SEQ ID NO: 3551542 - RNA, 19 nt, Pseudomonas putida KT2440
cgccgagcauccgcgccac

SEQ ID NO: 3551543 - RNA, 20 nt, Pseudomonas putida KT2440
cgccgagcauccgcgccacu

SEQ ID NO: 3551544 - RNA, 22 nt, Pseudomonas putida KT2440
cgccgagcauccgcgccacuuc

SEQ ID NO: 3551545 - RNA, 20 nt, Pseudomonas putida KT2440
cgccgagcgagugaccuugg

SEQ ID NO: 3551546 - RNA, 21 nt, Pseudomonas putida KT2440
cgccgagcgcggcgcccagca

SEQ ID NO: 3551547 - RNA, 15 nt, Pseudomonas putida KT2440
cgccgagcugaugcc

SEQ ID NO: 3551548 - RNA, 16 nt, Pseudomonas putida KT2440
cgccgaggcaccggua

SEQ ID NO: 3551549 - RNA, 20 nt, Pseudomonas putida KT2440
cgccgaggcguuggccgaag

SEQ ID NO: 3551550 - RNA, 23 nt, Pseudomonas putida KT2440
cgccgaggcguuggccgaaggcc

SEQ ID NO: 3551551 - RNA, 19 nt, Pseudomonas putida KT2440
cgccgauaaagcgucgccc

SEQ ID NO: 3551552 - RNA, 15 nt, Pseudomonas putida KT2440
cgccgauagcagcac

SEQ ID NO: 3551553 - RNA, 23 nt, Pseudomonas putida KT2440
cgccgauagcagcaccgaucagc

SEQ ID NO: 3551554 - RNA, 17 nt, Pseudomonas putida KT2440
cgccgaucacaccggca

SEQ ID NO: 3551555 - RNA, 15 nt, Pseudomonas putida KT2440
cgccgaucagcuggg

SEQ ID NO: 3551556 - RNA, 14 nt, Pseudomonas putida KT2440
cgccgaucaggaag

SEQ ID NO: 3551557 - RNA, 14 nt, Pseudomonas putida KT2440
cgccgaucauugcu

SEQ ID NO: 3551558 - RNA, 17 nt, Pseudomonas putida KT2440
cgccgaucauugcugcg

SEQ ID NO: 3551559 - RNA, 20 nt, Pseudomonas putida KT2440
cgccgaucauugcugcggua

SEQ ID NO: 3551560 - RNA, 21 nt, Pseudomonas putida KT2440
cgccgauccucugugggagcg

SEQ ID NO: 3551561 - RNA, 19 nt, Pseudomonas putida KT2440
cgccgaucgaagcagcagc

SEQ ID NO: 3551562 - RNA, 20 nt, Pseudomonas putida KT2440
cgccgaucgaagcagcagcu

SEQ ID NO: 3551563 - RNA, 19 nt, Pseudomonas putida KT2440
cgccgaugaagcaggccga

SEQ ID NO: 3551564 - RNA, 20 nt, Pseudomonas putida KT2440
cgccgaugaguugucugccg

SEQ ID NO: 3551565 - RNA, 23 nt, Pseudomonas putida KT2440
cgccgaugaguugucugccgaag

SEQ ID NO: 3551566 - RNA, 22 nt, Pseudomonas putida KT2440
cgccgauguccuugcuggccac

SEQ ID NO: 3551567 - RNA, 15 nt, Pseudomonas putida KT2440
cgccgauugcugccg

SEQ ID NO: 3551568 - RNA, 16 nt, Pseudomonas putida KT2440
cgccgauugcugccga

SEQ ID NO: 3551569 - RNA, 20 nt, Pseudomonas putida KT2440
cgccgcaaagacugccaagu

SEQ ID NO: 3551570 - RNA, 18 nt, Pseudomonas putida KT2440
cgccgcaaccgccgcgcc

SEQ ID NO: 3551571 - RNA, 22 nt, Pseudomonas putida KT2440
cgccgcaaccgccgcgccucgc

SEQ ID NO: 3551572 - RNA, 13 nt, Pseudomonas putida KT2440
cgccgcaacggcc

SEQ ID NO: 3551573 - RNA, 18 nt, Pseudomonas putida KT2440
cgccgcaccgucgauguc

SEQ ID NO: 3551574 - RNA, 18 nt, Pseudomonas putida KT2440
cgccgcagcaguuggccg

SEQ ID NO: 3551575 - RNA, 20 nt, Pseudomonas putida KT2440
cgccgcagguccaccugguu

SEQ ID NO: 3551576 - RNA, 18 nt, Pseudomonas putida KT2440
cgccgcaucgccacgggc

SEQ ID NO: 3551577 - RNA, 20 nt, Pseudomonas putida KT2440
cgccgccaaaaaauccgccu

SEQ ID NO: 3551578 - RNA, 17 nt, Pseudomonas putida KT2440
cgccguccagcaggcug

SEQ ID NO: 3551579 - RNA, 15 nt, Pseudomonas putida KT2440
cgccgugccaggugu

SEQ ID NO: 3551580 - RNA, 13 nt, Pseudomonas putida KT2440
cgccgugccgguc

SEQ ID NO: 3551581 - RNA, 19 nt, Pseudomonas putida KT2440
cgccgugccggucacuggc

SEQ ID NO: 3551582 - RNA, 15 nt, Pseudomonas putida KT2440
cgccgugcucggccu

SEQ ID NO: 3551583 - RNA, 17 nt, Pseudomonas putida KT2440
cgccgugcucggccuug

SEQ ID NO: 3551584 - RNA, 19 nt, Pseudomonas putida KT2440
cgccguguucccagcaccc

SEQ ID NO: 3551585 - RNA, 18 nt, Pseudomonas putida KT2440
cgccguucacuguugccg

SEQ ID NO: 3551586 - RNA, 17 nt, Pseudomonas putida KT2440
cgccguucaggcgccug

SEQ ID NO: 3551587 - RNA, 18 nt, Pseudomonas putida KT2440
cgccguucaggcgccugc

SEQ ID NO: 3551588 - RNA, 21 nt, Pseudomonas putida KT2440
cgccguugaaagacugcuccg

SEQ ID NO: 3551589 - RNA, 14 nt, Pseudomonas putida KT2440
cgccguugccgccc

SEQ ID NO: 3551590 - RNA, 15 nt, Pseudomonas putida KT2440
cgccuacagcggccu

SEQ ID NO: 3551591 - RNA, 19 nt, Pseudomonas putida KT2440
cgccuacagcggccugugc

SEQ ID NO: 3551592 - RNA, 22 nt, Pseudomonas putida KT2440
cgccuacagcggccugugcaug

SEQ ID NO: 3551593 - RNA, 23 nt, Pseudomonas putida KT2440
cgccuacaggaaucugucagccu

SEQ ID NO: 3551594 - RNA, 16 nt, Pseudomonas putida KT2440
cgccuacaggcaaccg

SEQ ID NO: 3551595 - RNA, 15 nt, Pseudomonas putida KT2440
cgccuacgacggccu

SEQ ID NO: 3551596 - RNA, 18 nt, Pseudomonas putida KT2440
cgccuaucagaucgagcg

SEQ ID NO: 3551597 - RNA, 20 nt, Pseudomonas putida KT2440
cgccuaugaaaccgagcgcc

SEQ ID NO: 3551598 - RNA, 21 nt, Pseudomonas putida KT2440
cgccuaugaaaccgagcgccg

SEQ ID NO: 3551599 - RNA, 13 nt, Pseudomonas putida KT2440
cgccucacagcgc

SEQ ID NO: 3551600 - RNA, 15 nt, Pseudomonas putida KT2440
cgccucacagcgccg

SEQ ID NO: 3551601 - RNA, 17 nt, Pseudomonas putida KT2440
cgccucaccgacccaca

SEQ ID NO: 3551602 - RNA, 22 nt, Pseudomonas putida KT2440
cgccucagcgccaauaccgcgc

SEQ ID NO: 3551603 - RNA, 15 nt, Pseudomonas putida KT2440
cgccucauccucgcc

SEQ ID NO: 3551604 - RNA, 17 nt, Pseudomonas putida KT2440
cgccucauccucgccca

SEQ ID NO: 3551605 - RNA, 14 nt, Pseudomonas putida KT2440
cgccucaugcagca

SEQ ID NO: 3551606 - RNA, 22 nt, Pseudomonas putida KT2440
cgccucaugcagcaccuccugc

SEQ ID NO: 3551607 - RNA, 15 nt, Pseudomonas putida KT2440
cgccuccacggucag

SEQ ID NO: 3551608 - RNA, 11 nt, Pseudomonas putida KT2440
cgccuccagca

SEQ ID NO: 3551609 - RNA, 17 nt, Pseudomonas putida KT2440
cgccuccagcaacaucu

SEQ ID NO: 3551610 - RNA, 22 nt, Pseudomonas putida KT2440
cgccucccccacccccgcccca

SEQ ID NO: 3551611 - RNA, 13 nt, Pseudomonas putida KT2440
cgccucccccagc

SEQ ID NO: 3551612 - RNA, 12 nt, Pseudomonas putida KT2440
cgccuccugcug

SEQ ID NO: 3551613 - RNA, 17 nt, Pseudomonas putida KT2440
cgccucgaaguaggcaa

SEQ ID NO: 3551614 - RNA, 20 nt, Pseudomonas putida KT2440
cgccucgaucauuuccggca

SEQ ID NO: 3551615 - RNA, 15 nt, Pseudomonas putida KT2440
cgccucgaucccgcc

SEQ ID NO: 3551616 - RNA, 17 nt, Pseudomonas putida KT2440
cgccucgaucccgccgc

SEQ ID NO: 3551617 - RNA, 14 nt, Pseudomonas putida KT2440
cgccucgcagguaa

SEQ ID NO: 3551618 - RNA, 23 nt, Pseudomonas putida KT2440
cgccucggcacugcacgcuucga

SEQ ID NO: 3551619 - RNA, 20 nt, Pseudomonas putida KT2440
cgccucggcuacgccgccgc

SEQ ID NO: 3551620 - RNA, 19 nt, Pseudomonas putida KT2440
cgccucgggcgcucgcggu

SEQ ID NO: 3551621 - RNA, 18 nt, Pseudomonas putida KT2440
cgccucgggggcaucauu

SEQ ID NO: 3551622 - RNA, 14 nt, Pseudomonas putida KT2440
cgccucgucggcgc

SEQ ID NO: 3551623 - RNA, 14 nt, Pseudomonas putida KT2440
cgccucgugcagcu

SEQ ID NO: 3551624 - RNA, 23 nt, Pseudomonas putida KT2440
cgccucguuggcgaagucggccu

SEQ ID NO: 3551625 - RNA, 19 nt, Pseudomonas putida KT2440
cgccucuaccacgccgcug

SEQ ID NO: 3551626 - RNA, 20 nt, Pseudomonas putida KT2440
cgccucuugcaccuguccca

SEQ ID NO: 3551627 - RNA, 22 nt, Pseudomonas putida KT2440
cgccucuugcaccugucccagc

SEQ ID NO: 3551628 - RNA, 16 nt, Pseudomonas putida KT2440
cgccugaacgcugcgc

SEQ ID NO: 3551629 - RNA, 18 nt, Pseudomonas putida KT2440
cgccugaaucuugcgcgc

SEQ ID NO: 3551630 - RNA, 20 nt, Pseudomonas putida KT2440
cgccugaaucuugcgcgcca

SEQ ID NO: 3551631 - RNA, 21 nt, Pseudomonas putida KT2440
cgccugacgccgccagcgcuc

SEQ ID NO: 3551632 - RNA, 16 nt, Pseudomonas putida KT2440
cgccugauuacccugc

SEQ ID NO: 3551633 - RNA, 18 nt, Pseudomonas putida KT2440
cgccugcaagucaggcga

SEQ ID NO: 3551634 - RNA, 15 nt, Pseudomonas putida KT2440
cgccugcaauucgau

SEQ ID NO: 3551635 - RNA, 18 nt, Pseudomonas putida KT2440
cgccugcagcgcgucauc

SEQ ID NO: 3551636 - RNA, 23 nt, Pseudomonas putida KT2440
cgccugcagcgcgucauccgcca

SEQ ID NO: 3551637 - RNA, 14 nt, Pseudomonas putida KT2440
cgccugcaggccca

SEQ ID NO: 3551638 - RNA, 15 nt, Pseudomonas putida KT2440
cgccugcagggccug

SEQ ID NO: 3551639 - RNA, 19 nt, Pseudomonas putida KT2440
cgccugcagggccuggacg

SEQ ID NO: 3551640 - RNA, 18 nt, Pseudomonas putida KT2440
cgccugcaguucgcugcg

SEQ ID NO: 3551641 - RNA, 23 nt, Pseudomonas putida KT2440
cgccugcauggcaugcaggaggu

SEQ ID NO: 3551642 - RNA, 17 nt, Pseudomonas putida KT2440
cgccugccgaugggcac

SEQ ID NO: 3551643 - RNA, 21 nt, Pseudomonas putida KT2440
cgccugccgaugggcacuggc

SEQ ID NO: 3551644 - RNA, 14 nt, Pseudomonas putida KT2440
cgccugccgccugu

SEQ ID NO: 3551645 - RNA, 17 nt, Pseudomonas putida KT2440
cgccugccgggccaggg

SEQ ID NO: 3551646 - RNA, 18 nt, Pseudomonas putida KT2440
cgccugccgggucaaggc

SEQ ID NO: 3551647 - RNA, 22 nt, Pseudomonas putida KT2440
cgccugccgggucaaggccagc

SEQ ID NO: 3551648 - RNA, 12 nt, Pseudomonas putida KT2440
cgccugcgcacg

SEQ ID NO: 3551649 - RNA, 17 nt, Pseudomonas putida KT2440
cgccugcgcacggcgcu

SEQ ID NO: 3551650 - RNA, 13 nt, Pseudomonas putida KT2440
cgccugcgccgcu

SEQ ID NO: 3551651 - RNA, 14 nt, Pseudomonas putida KT2440
cgccugcggcauca

SEQ ID NO: 3551652 - RNA, 18 nt, Pseudomonas putida KT2440
cgccugcgggugccgugg

SEQ ID NO: 3551653 - RNA, 15 nt, Pseudomonas putida KT2440
cgccugcugccaggc

SEQ ID NO: 3551654 - RNA, 14 nt, Pseudomonas putida KT2440
cgccugcugcugga

SEQ ID NO: 3551655 - RNA, 13 nt, Pseudomonas putida KT2440
cgccugcuggccg

SEQ ID NO: 3551656 - RNA, 14 nt, Pseudomonas putida KT2440
cgccugcuggccgc

SEQ ID NO: 3551657 - RNA, 14 nt, Pseudomonas putida KT2440
cgccugcuuggcac

SEQ ID NO: 3551658 - RNA, 14 nt, Pseudomonas putida KT2440
cgccugcuuggccg

SEQ ID NO: 3551659 - RNA, 17 nt, Pseudomonas putida KT2440
cgccugcuuggccgacu

SEQ ID NO: 3551660 - RNA, 14 nt, Pseudomonas putida KT2440
cgccugcuuuggga

SEQ ID NO: 3551661 - RNA, 12 nt, Pseudomonas putida KT2440
cgccuggccaua

SEQ ID NO: 3551662 - RNA, 15 nt, Pseudomonas putida KT2440
cgccuggcccgcagc

SEQ ID NO: 3551663 - RNA, 14 nt, Pseudomonas putida KT2440
cgccuggccugcag

SEQ ID NO: 3551664 - RNA, 24 nt, Pseudomonas putida KT2440
cgccuggcgagaaggcguggugca

SEQ ID NO: 3551665 - RNA, 14 nt, Pseudomonas putida KT2440
cgccuggcgccugc

SEQ ID NO: 3551666 - RNA, 15 nt, Pseudomonas putida KT2440
cgccuggcgccugcg

SEQ ID NO: 3551667 - RNA, 22 nt, Pseudomonas putida KT2440
cgccugggaaaccgugucgggc

SEQ ID NO: 3551668 - RNA, 15 nt, Pseudomonas putida KT2440
cgccugggggucgcc

SEQ ID NO: 3551669 - RNA, 17 nt, Pseudomonas putida KT2440
cgccugggucaacccca

SEQ ID NO: 3551670 - RNA, 20 nt, Pseudomonas putida KT2440
cgccuggugccagcggccac

SEQ ID NO: 3551671 - RNA, 13 nt, Pseudomonas putida KT2440
cgccuguaccuca

SEQ ID NO: 3551672 - RNA, 23 nt, Pseudomonas putida KT2440
cgccuguccgggcucgucacggg

SEQ ID NO: 3551673 - RNA, 19 nt, Pseudomonas putida KT2440
cgccugucuagccgccugc

SEQ ID NO: 3551674 - RNA, 18 nt, Pseudomonas putida KT2440
cgccugugagaucgagcg

SEQ ID NO: 3551675 - RNA, 13 nt, Pseudomonas putida KT2440
cgccuguguucgc

SEQ ID NO: 3551676 - RNA, 14 nt, Pseudomonas putida KT2440
cgccuguuucgggu

SEQ ID NO: 3551677 - RNA, 22 nt, Pseudomonas putida KT2440
cgccuguuucggguaggucacc

SEQ ID NO: 3551678 - RNA, 13 nt, Pseudomonas putida KT2440
cgccuguuucuca

SEQ ID NO: 3551679 - RNA, 22 nt, Pseudomonas putida KT2440
cgccuguuucucacguucgcca

SEQ ID NO: 3551680 - RNA, 13 nt, Pseudomonas putida KT2440
cgccuucacugcg

SEQ ID NO: 3551681 - RNA, 18 nt, Pseudomonas putida KT2440
cgccuucagcgccccauc

SEQ ID NO: 3551682 - RNA, 13 nt, Pseudomonas putida KT2440
cgccuucgcccga

SEQ ID NO: 3551683 - RNA, 21 nt, Pseudomonas putida KT2440
cgccuucgcccgaccgccagc

SEQ ID NO: 3551684 - RNA, 23 nt, Pseudomonas putida KT2440
cgcgcacugaauacaccagcuug

SEQ ID NO: 3551685 - RNA, 21 nt, Pseudomonas putida KT2440
cgcgcacuugccagccgccca

SEQ ID NO: 3551686 - RNA, 20 nt, Pseudomonas putida KT2440
cgcgcagauuccgcgauagc

SEQ ID NO: 3551687 - RNA, 14 nt, Pseudomonas putida KT2440
cgcgcagccuuuga

SEQ ID NO: 3551688 - RNA, 14 nt, Pseudomonas putida KT2440
cgcgcagcgaacgc

SEQ ID NO: 3551689 - RNA, 15 nt, Pseudomonas putida KT2440
cgcgcagcggccccu

SEQ ID NO: 3551690 - RNA, 15 nt, Pseudomonas putida KT2440
cgcgcaggccacggu

SEQ ID NO: 3551691 - RNA, 12 nt, Pseudomonas putida KT2440
cgcgcaggcgcu

SEQ ID NO: 3551692 - RNA, 13 nt, Pseudomonas putida KT2440
cgcgcaggcgcug

SEQ ID NO: 3551693 - RNA, 17 nt, Pseudomonas putida KT2440
cgcgcaggcggcugacc

SEQ ID NO: 3551694 - RNA, 14 nt, Pseudomonas putida KT2440
cgcgcagggcaucg

SEQ ID NO: 3551695 - RNA, 15 nt, Pseudomonas putida KT2440
cgcgcagggcaucgc

SEQ ID NO: 3551696 - RNA, 14 nt, Pseudomonas putida KT2440
cgcgcagggccuug

SEQ ID NO: 3551697 - RNA, 13 nt, Pseudomonas putida KT2440
cgcgcagggcguu

SEQ ID NO: 3551698 - RNA, 22 nt, Pseudomonas putida KT2440
cgcgcagggugccggccagcgg

SEQ ID NO: 3551699 - RNA, 24 nt, Pseudomonas putida KT2440
cgcgcaggguuuucagcgccgcaa

SEQ ID NO: 3551700 - RNA, 19 nt, Pseudomonas putida KT2440
cgcgcaucagccgcgcccu

SEQ ID NO: 3551701 - RNA, 19 nt, Pseudomonas putida KT2440
cgcgcaucccuuguaggag

SEQ ID NO: 3551702 - RNA, 16 nt, Pseudomonas putida KT2440
cgcgcauccuccgccc

SEQ ID NO: 3551703 - RNA, 19 nt, Pseudomonas putida KT2440
cgcgcauccuccgcccugc

SEQ ID NO: 3551704 - RNA, 20 nt, Pseudomonas putida KT2440
cgcgcauccuccgcccugcc

SEQ ID NO: 3551705 - RNA, 23 nt, Pseudomonas putida KT2440
cgcgcaugaaaaagccggcaacg

SEQ ID NO: 3551706 - RNA, 22 nt, Pseudomonas putida KT2440
cgcgcaugaaggacaucaccag

SEQ ID NO: 3551707 - RNA, 22 nt, Pseudomonas putida KT2440
cgcgcauuucguccaggcucag

SEQ ID NO: 3551708 - RNA, 19 nt, Pseudomonas putida KT2440
cgcgccaaccgcgccagca

SEQ ID NO: 3551709 - RNA, 18 nt, Pseudomonas putida KT2440
cgcgccacauagcuggca

SEQ ID NO: 3551710 - RNA, 14 nt, Pseudomonas putida KT2440
cgcgccaccagccc

SEQ ID NO: 3551711 - RNA, 14 nt, Pseudomonas putida KT2440
cgcgccacccgcug

SEQ ID NO: 3551712 - RNA, 17 nt, Pseudomonas putida KT2440
cgcgccacccgcugggc

SEQ ID NO: 3551713 - RNA, 19 nt, Pseudomonas putida KT2440
cgcgccacgcaccagggcu

SEQ ID NO: 3551714 - RNA, 21 nt, Pseudomonas putida KT2440
cgcgccacuucuuccacgcgc

SEQ ID NO: 3551715 - RNA, 18 nt, Pseudomonas putida KT2440
cgcgccagcaaugcccgc

SEQ ID NO: 3551716 - RNA, 13 nt, Pseudomonas putida KT2440
cgcgccagcagcg

SEQ ID NO: 3551717 - RNA, 15 nt, Pseudomonas putida KT2440
cgcgccagcagcgcg

SEQ ID NO: 3551718 - RNA, 12 nt, Pseudomonas putida KT2440
cgcgccagcagg

SEQ ID NO: 3551719 - RNA, 11 nt, Pseudomonas putida KT2440
cgcgccagcau

SEQ ID NO: 3551720 - RNA, 22 nt, Pseudomonas putida KT2440
cgcgccagcauggaccaucagg

SEQ ID NO: 3551721 - RNA, 17 nt, Pseudomonas putida KT2440
cgcgccagccugggcug

SEQ ID NO: 3551722 - RNA, 15 nt, Pseudomonas putida KT2440
cgcgccagcgcaugc

SEQ ID NO: 3551723 - RNA, 23 nt, Pseudomonas putida KT2440
cgcgccagcgcaugcaucugcgc

SEQ ID NO: 3551724 - RNA, 16 nt, Pseudomonas putida KT2440
cgcgccagcuccgaca

SEQ ID NO: 3551725 - RNA, 18 nt, Pseudomonas putida KT2440
cgcgccaggguugcaucg

SEQ ID NO: 3551726 - RNA, 19 nt, Pseudomonas putida KT2440
cgcgccaggguugcaucgc

SEQ ID NO: 3551727 - RNA, 21 nt, Pseudomonas putida KT2440
cgcgccaggguugcaucgcgc

SEQ ID NO: 3551728 - RNA, 16 nt, Pseudomonas putida KT2440
cgcgccaggguuugca

SEQ ID NO: 3551729 - RNA, 21 nt, Pseudomonas putida KT2440
cgcgccaggucggcggggccc

SEQ ID NO: 3551730 - RNA, 21 nt, Pseudomonas putida KT2440
cgcgccaguucgacgcugcug

SEQ ID NO: 3551731 - RNA, 19 nt, Pseudomonas putida KT2440
cgcgccaguucgcggcgca

SEQ ID NO: 3551732 - RNA, 16 nt, Pseudomonas putida KT2440
cgcgccaucaaggccg

SEQ ID NO: 3551733 - RNA, 18 nt, Pseudomonas putida KT2440
cgcgccaucaaggccgac

SEQ ID NO: 3551734 - RNA, 14 nt, Pseudomonas putida KT2440
cgcgccauccgcca

SEQ ID NO: 3551735 - RNA, 17 nt, Pseudomonas putida KT2440
cgcgccaucuucacggc

SEQ ID NO: 3551736 - RNA, 22 nt, Pseudomonas putida KT2440
cgcgccauggccucgucgcggu

SEQ ID NO: 3551737 - RNA, 20 nt, Pseudomonas putida KT2440
cgcgcccaaggucagccaga

SEQ ID NO: 3551738 - RNA, 15 nt, Pseudomonas putida KT2440
cgcgcccacgcgggu

SEQ ID NO: 3551739 - RNA, 16 nt, Pseudomonas putida KT2440
cgcgcccacgcggguc

SEQ ID NO: 3551740 - RNA, 18 nt, Pseudomonas putida KT2440
cgcgcccacgcgggucca

SEQ ID NO: 3551741 - RNA, 14 nt, Pseudomonas putida KT2440
cgcgcccaggccca

SEQ ID NO: 3551742 - RNA, 19 nt, Pseudomonas putida KT2440
cgcgcccagugcgcgcaac

SEQ ID NO: 3551743 - RNA, 20 nt, Pseudomonas putida KT2440
cgcgcccagugcgcgcaaca

SEQ ID NO: 3551744 - RNA, 18 nt, Pseudomonas putida KT2440
cgcgccccaagcgggcca

SEQ ID NO: 3551745 - RNA, 13 nt, Pseudomonas putida KT2440
cgcgcccccgacc

SEQ ID NO: 3551746 - RNA, 18 nt, Pseudomonas putida KT2440
cgcgcccgcaaccucggc

SEQ ID NO: 3551747 - RNA, 14 nt, Pseudomonas putida KT2440
cgcgcccgcgaaga

SEQ ID NO: 3551748 - RNA, 22 nt, Pseudomonas putida KT2440
cgcgcccgcggcccacagugcu

SEQ ID NO: 3551749 - RNA, 21 nt, Pseudomonas putida KT2440
cgcgcccugcucauccagcaa

SEQ ID NO: 3551750 - RNA, 19 nt, Pseudomonas putida KT2440
cgcgccgauugcugccgac

SEQ ID NO: 3551751 - RNA, 18 nt, Pseudomonas putida KT2440
cgcgccgcaaagacugcc

SEQ ID NO: 3551752 - RNA, 17 nt, Pseudomonas putida KT2440
cgcgccgccacauccag

SEQ ID NO: 3551753 - RNA, 21 nt, Pseudomonas putida KT2440
cgcgccgccacauccagcgcc

SEQ ID NO: 3551754 - RNA, 12 nt, Pseudomonas putida KT2440
cgcgccgccagg

SEQ ID NO: 3551755 - RNA, 13 nt, Pseudomonas putida KT2440
cgcgccgccaggc

SEQ ID NO: 3551756 - RNA, 15 nt, Pseudomonas putida KT2440
cgcgccgccaggcgg

SEQ ID NO: 3551757 - RNA, 16 nt, Pseudomonas putida KT2440
cgcgccgccaggcggu

SEQ ID NO: 3551758 - RNA, 15 nt, Pseudomonas putida KT2440
cgcgccgccgacgau

SEQ ID NO: 3551759 - RNA, 12 nt, Pseudomonas putida KT2440
cgcgccgccgcu

SEQ ID NO: 3551760 - RNA, 13 nt, Pseudomonas putida KT2440
cgcgccgcgccca

SEQ ID NO: 3551761 - RNA, 14 nt, Pseudomonas putida KT2440
cgcgccgcugccug

SEQ ID NO: 3551762 - RNA, 15 nt, Pseudomonas putida KT2440
cgcgccgugccaggu

SEQ ID NO: 3551763 - RNA, 18 nt, Pseudomonas putida KT2440
cgcgccuacagcggccug

SEQ ID NO: 3551764 - RNA, 19 nt, Pseudomonas putida KT2440
cgcgccuacagcggccugu

SEQ ID NO: 3551765 - RNA, 21 nt, Pseudomonas putida KT2440
cgcgccuacgacggccugcgc

SEQ ID NO: 3551766 - RNA, 22 nt, Pseudomonas putida KT2440
cgcgccuacgacggccugcgcc

SEQ ID NO: 3551767 - RNA, 23 nt, Pseudomonas putida KT2440
cgcgccuacgacggccugcgccc

SEQ ID NO: 3551768 - RNA, 13 nt, Pseudomonas putida KT2440
cgcgccuccagcu

SEQ ID NO: 3551769 - RNA, 18 nt, Pseudomonas putida KT2440
cgcgccuccagcuggcca

SEQ ID NO: 3551770 - RNA, 23 nt, Pseudomonas putida KT2440
cgcgccucgaucccgccgccaga

SEQ ID NO: 3551771 - RNA, 18 nt, Pseudomonas putida KT2440
cgcgccugcaccuggcug

SEQ ID NO: 3551772 - RNA, 18 nt, Pseudomonas putida KT2440
cgcgccuggucgccgcca

SEQ ID NO: 3551773 - RNA, 18 nt, Pseudomonas putida KT2440
cgcgccuugauacgccca

SEQ ID NO: 3551774 - RNA, 20 nt, Pseudomonas putida KT2440
cgcgccuugcgccaggugcc

SEQ ID NO: 3551775 - RNA, 19 nt, Pseudomonas putida KT2440
cgcgccuugggcaacaccg

SEQ ID NO: 3551776 - RNA, 13 nt, Pseudomonas putida KT2440
cgcgcgaaggccc

SEQ ID NO: 3551777 - RNA, 14 nt, Pseudomonas putida KT2440
cgcgcgaugcgccg

SEQ ID NO: 3551778 - RNA, 21 nt, Pseudomonas putida KT2440
cgcgcgcauccacaggcgccc

SEQ ID NO: 3551779 - RNA, 22 nt, Pseudomonas putida KT2440
cgcgcgcauccacaggcgcccc

SEQ ID NO: 3551780 - RNA, 21 nt, Pseudomonas putida KT2440
cgcgcgccaguucgcggcgca

SEQ ID NO: 3551781 - RNA, 13 nt, Pseudomonas putida KT2440
cgcgcgcccaggc

SEQ ID NO: 3551782 - RNA, 14 nt, Pseudomonas putida KT2440
cgcgcgcccaggcc

SEQ ID NO: 3551783 - RNA, 15 nt, Pseudomonas putida KT2440
cgcgcgcccaggccc

SEQ ID NO: 3551784 - RNA, 12 nt, Pseudomonas putida KT2440
cgcgcgcgaugc

SEQ ID NO: 3551785 - RNA, 13 nt, Pseudomonas putida KT2440
cgcgcgcuggcuc

SEQ ID NO: 3551786 - RNA, 22 nt, Pseudomonas putida KT2440
cgcgcggccgccuccugcugcu

SEQ ID NO: 3551787 - RNA, 15 nt, Pseudomonas putida KT2440
cgcgcggcucggcca

SEQ ID NO: 3551788 - RNA, 20 nt, Pseudomonas putida KT2440
cgcgcggcuugcucgcggcg

SEQ ID NO: 3551789 - RNA, 16 nt, Pseudomonas putida KT2440
cgcggguaaacccgcc

SEQ ID NO: 3551790 - RNA, 20 nt, Pseudomonas putida KT2440
cgcggguaaacccgccccua

SEQ ID NO: 3551791 - RNA, 20 nt, Pseudomonas putida KT2440
cgcggguaaacccgcgccua

SEQ ID NO: 3551792 - RNA, 23 nt, Pseudomonas putida KT2440
cgcggguaaacccgcgccuacaa

SEQ ID NO: 3551793 - RNA, 17 nt, Pseudomonas putida KT2440
cgcggguaaacccgcuc

SEQ ID NO: 3551794 - RNA, 23 nt, Pseudomonas putida KT2440
cgcggguaaacccgcuccuacga

SEQ ID NO: 3551795 - RNA, 16 nt, Pseudomonas putida KT2440
cgcggguaagcccgcu

SEQ ID NO: 3551796 - RNA, 20 nt, Pseudomonas putida KT2440
cgcggguaagcccgcuccua

SEQ ID NO: 3551797 - RNA, 21 nt, Pseudomonas putida KT2440
cgcggguaagcccgcuccuac

SEQ ID NO: 3551798 - RNA, 17 nt, Pseudomonas putida KT2440
cgcggguagacccgcuc

SEQ ID NO: 3551799 - RNA, 20 nt, Pseudomonas putida KT2440
cgcggguccagcgcggccac

SEQ ID NO: 3551800 - RNA, 18 nt, Pseudomonas putida KT2440
cgcggguccgauccggug

SEQ ID NO: 3551801 - RNA, 17 nt, Pseudomonas putida KT2440
cgcgggucuuccaccac

SEQ ID NO: 3551802 - RNA, 17 nt, Pseudomonas putida KT2440
cgcgggugaacccgcuc

SEQ ID NO: 3551803 - RNA, 20 nt, Pseudomonas putida KT2440
cgcgggugaacccgcuccua

SEQ ID NO: 3551804 - RNA, 16 nt, Pseudomonas putida KT2440
cgcgggugaaccgcgc

SEQ ID NO: 3551805 - RNA, 19 nt, Pseudomonas putida KT2440
cgcgggugaaccgcgccua

SEQ ID NO: 3551806 - RNA, 20 nt, Pseudomonas putida KT2440
cgcgggugaaccgcgccuac

SEQ ID NO: 3551807 - RNA, 17 nt, Pseudomonas putida KT2440
cgcggguuuacccgcga

SEQ ID NO: 3551808 - RNA, 20 nt, Pseudomonas putida KT2440
cgcggguuuacccgcgaaga

SEQ ID NO: 3551809 - RNA, 16 nt, Pseudomonas putida KT2440
cgcggguuugcccgcg

SEQ ID NO: 3551810 - RNA, 23 nt, Pseudomonas putida KT2440
cgcggguuugcccgcgaagaggu

SEQ ID NO: 3551811 - RNA, 22 nt, Pseudomonas putida KT2440
cgcgguaaagaacaugaucaag

SEQ ID NO: 3551812 - RNA, 22 nt, Pseudomonas putida KT2440
cgcgguaaugcgcacggcuucg

SEQ ID NO: 3551813 - RNA, 18 nt, Pseudomonas putida KT2440
cgcgguacaccgggaaca

SEQ ID NO: 3551814 - RNA, 20 nt, Pseudomonas putida KT2440
cgcgguacaccgggaacagg

SEQ ID NO: 3551815 - RNA, 13 nt, Pseudomonas putida KT2440
cgcgguaccugga

SEQ ID NO: 3551816 - RNA, 19 nt, Pseudomonas putida KT2440
cgcgguaccuguggggcaa

SEQ ID NO: 3551817 - RNA, 20 nt, Pseudomonas putida KT2440
cgcgguaccuguggggcaac

SEQ ID NO: 3551818 - RNA, 18 nt, Pseudomonas putida KT2440
cgcgguauccaucaccau

SEQ ID NO: 3551819 - RNA, 17 nt, Pseudomonas putida KT2440
cgcggucaagcucgucc

SEQ ID NO: 3551820 - RNA, 23 nt, Pseudomonas putida KT2440
cgcggucaauuggagcggccuug

SEQ ID NO: 3551821 - RNA, 14 nt, Pseudomonas putida KT2440
cgcggucagcgaau

SEQ ID NO: 3551822 - RNA, 15 nt, Pseudomonas putida KT2440
cgcggucagcgaaua

SEQ ID NO: 3551823 - RNA, 21 nt, Pseudomonas putida KT2440
cgcggucgccgugcaacgccg

SEQ ID NO: 3551824 - RNA, 19 nt, Pseudomonas putida KT2440
cgcggucggucagcaccug

SEQ ID NO: 3551825 - RNA, 17 nt, Pseudomonas putida KT2440
cgcggucugcggcagca

SEQ ID NO: 3551826 - RNA, 23 nt, Pseudomonas putida KT2440
cgcggucuuguaucccaggcgcu

SEQ ID NO: 3551827 - RNA, 19 nt, Pseudomonas putida KT2440
cgcggugaccagcggcagc

SEQ ID NO: 3551828 - RNA, 20 nt, Pseudomonas putida KT2440
cgcggugaccagcggcagca

SEQ ID NO: 3551829 - RNA, 16 nt, Pseudomonas putida KT2440
cgcggugaggcaacgg

SEQ ID NO: 3551830 - RNA, 13 nt, Pseudomonas putida KT2440
cgcggugauggcg

SEQ ID NO: 3551831 - RNA, 15 nt, Pseudomonas putida KT2440
cgcggugauggcgca

SEQ ID NO: 3551832 - RNA, 22 nt, Pseudomonas putida KT2440
cgcggugauggcgcauggccug

SEQ ID NO: 3551833 - RNA, 22 nt, Pseudomonas putida KT2440
cgcggugcaacauguccacacc

SEQ ID NO: 3551834 - RNA, 19 nt, Pseudomonas putida KT2440
cgcggugccuucaggcgcu

SEQ ID NO: 3551835 - RNA, 18 nt, Pseudomonas putida KT2440
cgcggugggucgacgaac

SEQ ID NO: 3551836 - RNA, 18 nt, Pseudomonas putida KT2440
cgcgguuaagcgccacca

SEQ ID NO: 3551837 - RNA, 16 nt, Pseudomonas putida KT2440
cgcgguucaccagcag

SEQ ID NO: 3551838 - RNA, 15 nt, Pseudomonas putida KT2440
cgcgguucgaagcug

SEQ ID NO: 3551839 - RNA, 16 nt, Pseudomonas putida KT2440
cgcgguucuucgccug

SEQ ID NO: 3551840 - RNA, 19 nt, Pseudomonas putida KT2440
cgcgguucuucgccugcag

SEQ ID NO: 3551841 - RNA, 21 nt, Pseudomonas putida KT2440
cgcgguucuucgccugcagca

SEQ ID NO: 3551842 - RNA, 20 nt, Pseudomonas putida KT2440
cgcgguuucugcaaccacga

SEQ ID NO: 3551843 - RNA, 14 nt, Pseudomonas putida KT2440
cgcguacagcugcu

SEQ ID NO: 3551844 - RNA, 17 nt, Pseudomonas putida KT2440
cgcguacagcugcucac

SEQ ID NO: 3551845 - RNA, 17 nt, Pseudomonas putida KT2440
cgcguaccccuggcgcu

SEQ ID NO: 3551846 - RNA, 22 nt, Pseudomonas putida KT2440
cgcguacgaagcucuggucgau

SEQ ID NO: 3551847 - RNA, 14 nt, Pseudomonas putida KT2440
cgcguacucggcca

SEQ ID NO: 3551848 - RNA, 17 nt, Pseudomonas putida KT2440
cgcguaggugcgcggcc

SEQ ID NO: 3551849 - RNA, 21 nt, Pseudomonas putida KT2440
cgcguauccuugcccaccagg

SEQ ID NO: 3551850 - RNA, 14 nt, Pseudomonas putida KT2440
cgcguauugcuccc

SEQ ID NO: 3551851 - RNA, 23 nt, Pseudomonas putida KT2440
cgcgucagcaccggcaguagaaa

SEQ ID NO: 3551852 - RNA, 17 nt, Pseudomonas putida KT2440
cgcgucagcucaagcgc

SEQ ID NO: 3551853 - RNA, 18 nt, Pseudomonas putida KT2440
cgcgucagcucaagcgcu

SEQ ID NO: 3551854 - RNA, 20 nt, Pseudomonas putida KT2440
cgcgucauacucuucgcggg

SEQ ID NO: 3551855 - RNA, 16 nt, Pseudomonas putida KT2440
cgcgucauccgccaac

SEQ ID NO: 3551856 - RNA, 17 nt, Pseudomonas putida KT2440
cgcgucauccgccaaca

SEQ ID NO: 3551857 - RNA, 14 nt, Pseudomonas putida KT2440
cgcguccagcaaca

SEQ ID NO: 3551858 - RNA, 21 nt, Pseudomonas putida KT2440
cgcgucccccgguaccagcag

SEQ ID NO: 3551859 - RNA, 13 nt, Pseudomonas putida KT2440
cgcguccccuuca

SEQ ID NO: 3551860 - RNA, 20 nt, Pseudomonas putida KT2440
cgcguccuggacccgcagca

SEQ ID NO: 3551861 - RNA, 21 nt, Pseudomonas putida KT2440
cgcguccuggacccgcagcag

SEQ ID NO: 3551862 - RNA, 22 nt, Pseudomonas putida KT2440
cgcguccuggacccgcagcagg

SEQ ID NO: 3551863 - RNA, 15 nt, Pseudomonas putida KT2440
cgcguccuugaucag

SEQ ID NO: 3551864 - RNA, 23 nt, Pseudomonas putida KT2440
cgcgucgacaaaccgcacccggc

SEQ ID NO: 3551865 - RNA, 21 nt, Pseudomonas putida KT2440
cgcgucgauacgcugcugguc

SEQ ID NO: 3551866 - RNA, 14 nt, Pseudomonas putida KT2440
cgcgucgcccagac

SEQ ID NO: 3551867 - RNA, 20 nt, Pseudomonas putida KT2440
cgcgucucuuucaggcacag

SEQ ID NO: 3551868 - RNA, 21 nt, Pseudomonas putida KT2440
cgcgucucuuucaggcacagc

SEQ ID NO: 3551869 - RNA, 16 nt, Pseudomonas putida KT2440
cgcgucugccgcagcc

SEQ ID NO: 3551870 - RNA, 17 nt, Pseudomonas putida KT2440
cgcgugccgccaguucg

SEQ ID NO: 3551871 - RNA, 18 nt, Pseudomonas putida KT2440
cgcgugccgccaguucgc

SEQ ID NO: 3551872 - RNA, 17 nt, Pseudomonas putida KT2440
cgcgugccugagccuug

SEQ ID NO: 3551873 - RNA, 13 nt, Pseudomonas putida KT2440
cgcgugcgauguu

SEQ ID NO: 3551874 - RNA, 19 nt, Pseudomonas putida KT2440
cgcgugcugguccuccccu

SEQ ID NO: 3551875 - RNA, 16 nt, Pseudomonas putida KT2440
cgcgugguaaagcucg

SEQ ID NO: 3551876 - RNA, 14 nt, Pseudomonas putida KT2440
cgcgugugcaggug

SEQ ID NO: 3551877 - RNA, 16 nt, Pseudomonas putida KT2440
cgcguuacccaccaga

SEQ ID NO: 3551878 - RNA, 21 nt, Pseudomonas putida KT2440
cgcguuacccaccagauucgc

SEQ ID NO: 3551879 - RNA, 20 nt, Pseudomonas putida KT2440
cgcguucacaucgcccuucu

SEQ ID NO: 3551880 - RNA, 19 nt, Pseudomonas putida KT2440
cgcguucaugccggcccca

SEQ ID NO: 3551881 - RNA, 16 nt, Pseudomonas putida KT2440
cgcguucgcccaggcg

SEQ ID NO: 3551882 - RNA, 21 nt, Pseudomonas putida KT2440
cgcguugcggcccuucgcggg

SEQ ID NO: 3551883 - RNA, 13 nt, Pseudomonas putida KT2440
cgcguuggcagca

SEQ ID NO: 3551884 - RNA, 15 nt, Pseudomonas putida KT2440
cgcguuggcagcacc

SEQ ID NO: 3551885 - RNA, 13 nt, Pseudomonas putida KT2440
cgcguugucaggc

SEQ ID NO: 3551886 - RNA, 12 nt, Pseudomonas putida KT2440
cgcguuguucag

SEQ ID NO: 3551887 - RNA, 16 nt, Pseudomonas putida KT2440
cgcguuguucagcagc

SEQ ID NO: 3551888 - RNA, 14 nt, Pseudomonas putida KT2440
cgcguuucgaucuc

SEQ ID NO: 3551889 - RNA, 20 nt, Pseudomonas putida KT2440
cgcguuucggcggccugcag

SEQ ID NO: 3551890 - RNA, 20 nt, Pseudomonas putida KT2440
cgcuaaguuugcccagcgcu

SEQ ID NO: 3551891 - RNA, 22 nt, Pseudomonas putida KT2440
cgcuacaagccggcgcucagcg

SEQ ID NO: 3551892 - RNA, 17 nt, Pseudomonas putida KT2440
cgcuacaccggccugga

SEQ ID NO: 3551893 - RNA, 19 nt, Pseudomonas putida KT2440
cgcucuucaaccgccucca

SEQ ID NO: 3551894 - RNA, 22 nt, Pseudomonas putida KT2440
cgcucuuugccacucagcgggu

SEQ ID NO: 3551895 - RNA, 21 nt, Pseudomonas putida KT2440
cgcugaacaacuccgggugcu

SEQ ID NO: 3551896 - RNA, 19 nt, Pseudomonas putida KT2440
cgcugaacacgcaggucuu

SEQ ID NO: 3551897 - RNA, 13 nt, Pseudomonas putida KT2440
cgcugaacacgcc

SEQ ID NO: 3551898 - RNA, 20 nt, Pseudomonas putida KT2440
cgcugaacacgcccgcgugc

SEQ ID NO: 3551899 - RNA, 20 nt, Pseudomonas putida KT2440
cgcugaaccucaccgccggc

SEQ ID NO: 3551900 - RNA, 22 nt, Pseudomonas putida KT2440
cgcugaccgaugaucugccggg

SEQ ID NO: 3551901 - RNA, 15 nt, Pseudomonas putida KT2440
cgcugaccgggacgc

SEQ ID NO: 3551902 - RNA, 21 nt, Pseudomonas putida KT2440
cgcugaccgggucgacgcgca

SEQ ID NO: 3551903 - RNA, 15 nt, Pseudomonas putida KT2440
cgcugacgcagggcc

SEQ ID NO: 3551904 - RNA, 15 nt, Pseudomonas putida KT2440
cgcugacucagcggc

SEQ ID NO: 3551905 - RNA, 14 nt, Pseudomonas putida KT2440
cgcugacugccagg

SEQ ID NO: 3551906 - RNA, 15 nt, Pseudomonas putida KT2440
cgcugacuuccagca

SEQ ID NO: 3551907 - RNA, 17 nt, Pseudomonas putida KT2440
cgcugacuuccagcagc

SEQ ID NO: 3551908 - RNA, 20 nt, Pseudomonas putida KT2440
cgcugagaccgaggggccgc

SEQ ID NO: 3551909 - RNA, 21 nt, Pseudomonas putida KT2440
cgcugagaccgaggggccgcu

SEQ ID NO: 3551910 - RNA, 22 nt, Pseudomonas putida KT2440
cgcugaggauugggaaaacaca

SEQ ID NO: 3551911 - RNA, 18 nt, Pseudomonas putida KT2440
cgcugaguggcaugacca

SEQ ID NO: 3551912 - RNA, 14 nt, Pseudomonas putida KT2440
cgcugauaaccugc

SEQ ID NO: 3551913 - RNA, 16 nt, Pseudomonas putida KT2440
cgcugauaaccugcau

SEQ ID NO: 3551914 - RNA, 17 nt, Pseudomonas putida KT2440
cgcugaucaagcccgcu

SEQ ID NO: 3551915 - RNA, 20 nt, Pseudomonas putida KT2440
cgcugaucaagcccgcucgc

SEQ ID NO: 3551916 - RNA, 17 nt, Pseudomonas putida KT2440
cgcugaucgaaagcugc

SEQ ID NO: 3551917 - RNA, 15 nt, Pseudomonas putida KT2440
cgcugaugcgccgcu

SEQ ID NO: 3551918 - RNA, 22 nt, Pseudomonas putida KT2440
cgcugauggccaauaccgcugc

SEQ ID NO: 3551919 - RNA, 21 nt, Pseudomonas putida KT2440
cgcugcaagcgcaccugcagg

SEQ ID NO: 3551920 - RNA, 19 nt, Pseudomonas putida KT2440
cgcugcaaucgagccgaac

SEQ ID NO: 3551921 - RNA, 23 nt, Pseudomonas putida KT2440
cgcugcaaucgagccgaacagca

SEQ ID NO: 3551922 - RNA, 23 nt, Pseudomonas putida KT2440
cgcugcacaggccagccccagcg

SEQ ID NO: 3551923 - RNA, 22 nt, Pseudomonas putida KT2440
cgcugcaccgaaggccgccggc

SEQ ID NO: 3551924 - RNA, 20 nt, Pseudomonas putida KT2440
cgcugcacgucgcgcagggc

SEQ ID NO: 3551925 - RNA, 18 nt, Pseudomonas putida KT2440
cgcugcauggccuggcaa

SEQ ID NO: 3551926 - RNA, 19 nt, Pseudomonas putida KT2440
cgcugccaaaguccggcga

SEQ ID NO: 3551927 - RNA, 21 nt, Pseudomonas putida KT2440
cgcugccaaaguccggcgaag

SEQ ID NO: 3551928 - RNA, 20 nt, Pseudomonas putida KT2440
cgcugccacagguacugcgc

SEQ ID NO: 3551929 - RNA, 13 nt, Pseudomonas putida KT2440
cgcugccacccac

SEQ ID NO: 3551930 - RNA, 16 nt, Pseudomonas putida KT2440
cgcugccacccacagg

SEQ ID NO: 3551931 - RNA, 17 nt, Pseudomonas putida KT2440
cgcugccacccacaggc

SEQ ID NO: 3551932 - RNA, 19 nt, Pseudomonas putida KT2440
cgcugccacccacaggcac

SEQ ID NO: 3551933 - RNA, 21 nt, Pseudomonas putida KT2440
cgcugccaccuuccaggucga

SEQ ID NO: 3551934 - RNA, 16 nt, Pseudomonas putida KT2440
cgcugccagcagggca

SEQ ID NO: 3551935 - RNA, 19 nt, Pseudomonas putida KT2440
cgcugccagcguuuccggg

SEQ ID NO: 3551936 - RNA, 15 nt, Pseudomonas putida KT2440
cgcugccagcugcgc

SEQ ID NO: 3551937 - RNA, 19 nt, Pseudomonas putida KT2440
cgcugccagcugcgcugcc

SEQ ID NO: 3551938 - RNA, 16 nt, Pseudomonas putida KT2440
cgcugccaggccgggu

SEQ ID NO: 3551939 - RNA, 19 nt, Pseudomonas putida KT2440
cgcugccauagcgcugcac

SEQ ID NO: 3551940 - RNA, 24 nt, Pseudomonas putida KT2440
cgcugccauagcgcugcaccgaag

SEQ ID NO: 3551941 - RNA, 14 nt, Pseudomonas putida KT2440
cgcugccaugcgcu

SEQ ID NO: 3551942 - RNA, 17 nt, Pseudomonas putida KT2440
cgcugccaugcgcugca

SEQ ID NO: 3551943 - RNA, 18 nt, Pseudomonas putida KT2440
cgcugccaugcgcugcag

SEQ ID NO: 3551944 - RNA, 16 nt, Pseudomonas putida KT2440
cgcugcccaacgccug

SEQ ID NO: 3551945 - RNA, 23 nt, Pseudomonas putida KT2440
cgcugcccagcgaauagcaacac

SEQ ID NO: 3551946 - RNA, 19 nt, Pseudomonas putida KT2440
cgcugcccagcugaagugc

SEQ ID NO: 3551947 - RNA, 17 nt, Pseudomonas putida KT2440
cgcugcccaggugccag

SEQ ID NO: 3551948 - RNA, 19 nt, Pseudomonas putida KT2440
cgcugcccaggugccaggc

SEQ ID NO: 3551949 - RNA, 13 nt, Pseudomonas putida KT2440
cgcugcccgggca

SEQ ID NO: 3551950 - RNA, 18 nt, Pseudomonas putida KT2440
cgcugcccgggcaaagca

SEQ ID NO: 3551951 - RNA, 14 nt, Pseudomonas putida KT2440
cgcugcccguccgg

SEQ ID NO: 3551952 - RNA, 17 nt, Pseudomonas putida KT2440
cgcugcccguccggcau

SEQ ID NO: 3551953 - RNA, 15 nt, Pseudomonas putida KT2440
cgcugcccucggccg

SEQ ID NO: 3551954 - RNA, 20 nt, Pseudomonas putida KT2440
cgcugcccucggccggggcc

SEQ ID NO: 3551955 - RNA, 16 nt, Pseudomonas putida KT2440
cgcugccgcaccugcc

SEQ ID NO: 3551956 - RNA, 12 nt, Pseudomonas putida KT2440
cgcugccgccuu

SEQ ID NO: 3551957 - RNA, 23 nt, Pseudomonas putida KT2440
cgcugccuccacaccgacaucca

SEQ ID NO: 3551958 - RNA, 16 nt, Pseudomonas putida KT2440
cgcugccuuccgccau

SEQ ID NO: 3551959 - RNA, 23 nt, Pseudomonas putida KT2440
cgcugccuugcccagcuccagca

SEQ ID NO: 3551960 - RNA, 22 nt, Pseudomonas putida KT2440
cgcugccuuuggccgccagcgg

SEQ ID NO: 3551961 - RNA, 20 nt, Pseudomonas putida KT2440
cgcugcgacucgcggccggu

SEQ ID NO: 3551962 - RNA, 16 nt, Pseudomonas putida KT2440
cgcugcgaggccccag

SEQ ID NO: 3551963 - RNA, 23 nt, Pseudomonas putida KT2440
cgcugcgaggccccagaccauca

SEQ ID NO: 3551964 - RNA, 13 nt, Pseudomonas putida KT2440
cgcugcgcaaggc

SEQ ID NO: 3551965 - RNA, 16 nt, Pseudomonas putida KT2440
cgcugcgcaucacccg

SEQ ID NO: 3551966 - RNA, 20 nt, Pseudomonas putida KT2440
cgcugcgcaucacccgcccc

SEQ ID NO: 3551967 - RNA, 21 nt, Pseudomonas putida KT2440
cgcugcgcaugaaacucgcgc

SEQ ID NO: 3551968 - RNA, 16 nt, Pseudomonas putida KT2440
cgcugcgccugccggg

SEQ ID NO: 3551969 - RNA, 19 nt, Pseudomonas putida KT2440
cgcugcgcgguaaacggga

SEQ ID NO: 3551970 - RNA, 14 nt, Pseudomonas putida KT2440
cgcugcgcuggcca

SEQ ID NO: 3551971 - RNA, 16 nt, Pseudomonas putida KT2440
cgcugcgcuggccaau

SEQ ID NO: 3551972 - RNA, 20 nt, Pseudomonas putida KT2440
cgcugcggcacaccacgcca

SEQ ID NO: 3551973 - RNA, 11 nt, Pseudomonas putida KT2440
cgcugcggccg

SEQ ID NO: 3551974 - RNA, 20 nt, Pseudomonas putida KT2440
cgcugcggcgaaagccagca

SEQ ID NO: 3551975 - RNA, 15 nt, Pseudomonas putida KT2440
cgcugcggucaucac

SEQ ID NO: 3551976 - RNA, 21 nt, Pseudomonas putida KT2440
cgcugcggucaucaccacccc

SEQ ID NO: 3551977 - RNA, 15 nt, Pseudomonas putida KT2440
cgcugcgucaggcca

SEQ ID NO: 3551978 - RNA, 17 nt, Pseudomonas putida KT2440
cgcugcgucaggccaug

SEQ ID NO: 3551979 - RNA, 16 nt, Pseudomonas putida KT2440
cgcugcugcuggccgc

SEQ ID NO: 3551980 - RNA, 13 nt, Pseudomonas putida KT2440
cgcugcuggcgcu

SEQ ID NO: 3551981 - RNA, 16 nt, Pseudomonas putida KT2440
cgcugcuggcgcucca

SEQ ID NO: 3551982 - RNA, 21 nt, Pseudomonas putida KT2440
cgcugcuggcgcuccauguaa

SEQ ID NO: 3551983 - RNA, 21 nt, Pseudomonas putida KT2440
cgcugcugguacaugccgccg

SEQ ID NO: 3551984 - RNA, 20 nt, Pseudomonas putida KT2440
cgcugcugguccucgacggg

SEQ ID NO: 3551985 - RNA, 22 nt, Pseudomonas putida KT2440
cgcugcuguccagacgccgcag

SEQ ID NO: 3551986 - RNA, 18 nt, Pseudomonas putida KT2440
cgcugcugugcggcuggc

SEQ ID NO: 3551987 - RNA, 14 nt, Pseudomonas putida KT2440
cgcugcuuccggcu

SEQ ID NO: 3551988 - RNA, 22 nt, Pseudomonas putida KT2440
cgcugcuuccggcugguacucc

SEQ ID NO: 3551989 - RNA, 12 nt, Pseudomonas putida KT2440
cgcuggaagugc

SEQ ID NO: 3551990 - RNA, 19 nt, Pseudomonas putida KT2440
cgcuggaauuauuggccag

SEQ ID NO: 3551991 - RNA, 17 nt, Pseudomonas putida KT2440
cgcuggacagcggcagc

SEQ ID NO: 3551992 - RNA, 15 nt, Pseudomonas putida KT2440
cgcuggacagguaga

SEQ ID NO: 3551993 - RNA, 15 nt, Pseudomonas putida KT2440
cgcuggacgcuguca

SEQ ID NO: 3551994 - RNA, 16 nt, Pseudomonas putida KT2440
cgcuggagaacagcgu

SEQ ID NO: 3551995 - RNA, 18 nt, Pseudomonas putida KT2440
cgcuggagaacagcguca

SEQ ID NO: 3551996 - RNA, 14 nt, Pseudomonas putida KT2440
cgcuggaucaccac

SEQ ID NO: 3551997 - RNA, 22 nt, Pseudomonas putida KT2440
cgcuggaucugaugcuucugcu

SEQ ID NO: 3551998 - RNA, 17 nt, Pseudomonas putida KT2440
cgcuggcagcuuggcca

SEQ ID NO: 3551999 - RNA, 17 nt, Pseudomonas putida KT2440
cgcuggcauccaccagg

SEQ ID NO: 3552000 - RNA, 22 nt, Pseudomonas putida KT2440
cgcuggccaaggccucuaccgc

SEQ ID NO: 3552001 - RNA, 14 nt, Pseudomonas putida KT2440
cgcuggccaccagc

SEQ ID NO: 3552002 - RNA, 15 nt, Pseudomonas putida KT2440
cgcuggccaccagca

SEQ ID NO: 3552003 - RNA, 14 nt, Pseudomonas putida KT2440
cgcuggccaggcuu

SEQ ID NO: 3552004 - RNA, 13 nt, Pseudomonas putida KT2440
cgcuggcccuucg

SEQ ID NO: 3552005 - RNA, 16 nt, Pseudomonas putida KT2440
cgcuggccgcacccag

SEQ ID NO: 3552006 - RNA, 15 nt, Pseudomonas putida KT2440
cgcuggccggacgac

SEQ ID NO: 3552007 - RNA, 13 nt, Pseudomonas putida KT2440
cgcuggccugccc

SEQ ID NO: 3552008 - RNA, 20 nt, Pseudomonas putida KT2440
cgcuggccuguucguuccca

SEQ ID NO: 3552009 - RNA, 23 nt, Pseudomonas putida KT2440
cgcuggcgaccggcguguugccg

SEQ ID NO: 3552010 - RNA, 13 nt, Pseudomonas putida KT2440
cgcuggcgacgaa

SEQ ID NO: 3552011 - RNA, 21 nt, Pseudomonas putida KT2440
cgcuggcgaucaggcaggcca

SEQ ID NO: 3552012 - RNA, 21 nt, Pseudomonas putida KT2440
cgcuggcgcagagggucuugg

SEQ ID NO: 3552013 - RNA, 17 nt, Pseudomonas putida KT2440
cgcuggcgccagccgcc

SEQ ID NO: 3552014 - RNA, 23 nt, Pseudomonas putida KT2440
cgcuggcgccagccgccacgacc

SEQ ID NO: 3552015 - RNA, 12 nt, Pseudomonas putida KT2440
cgcuggcgccug

SEQ ID NO: 3552016 - RNA, 13 nt, Pseudomonas putida KT2440
cgcuggcgggcaa

SEQ ID NO: 3552017 - RNA, 15 nt, Pseudomonas putida KT2440
cgcuggcugccgcgg

SEQ ID NO: 3552018 - RNA, 23 nt, Pseudomonas putida KT2440
cgcuggcuuccucacggcagugc

SEQ ID NO: 3552019 - RNA, 17 nt, Pseudomonas putida KT2440
cgcuggcuuguucggca

SEQ ID NO: 3552020 - RNA, 15 nt, Pseudomonas putida KT2440
cgcugggcaucgaca

SEQ ID NO: 3552021 - RNA, 16 nt, Pseudomonas putida KT2440
cgcugggcguccaggu

SEQ ID NO: 3552022 - RNA, 13 nt, Pseudomonas putida KT2440
cgcugggcuucuu

SEQ ID NO: 3552023 - RNA, 20 nt, Pseudomonas putida KT2440
cgcuggggcugacgcgccgu

SEQ ID NO: 3552024 - RNA, 18 nt, Pseudomonas putida KT2440
cgcugguaagccucgagc

SEQ ID NO: 3552025 - RNA, 15 nt, Pseudomonas putida KT2440
cgcugguacaggguc

SEQ ID NO: 3552026 - RNA, 18 nt, Pseudomonas putida KT2440
cgcuggucaaucugugag

SEQ ID NO: 3552027 - RNA, 13 nt, Pseudomonas putida KT2440
cgcuggugcaggc

SEQ ID NO: 3552028 - RNA, 14 nt, Pseudomonas putida KT2440
cgcuggugcagugg

SEQ ID NO: 3552029 - RNA, 21 nt, Pseudomonas putida KT2440
cgcuggugcaguggcuguacc

SEQ ID NO: 3552030 - RNA, 21 nt, Pseudomonas putida KT2440
cgcugguucauugccaacagc

SEQ ID NO: 3552031 - RNA, 16 nt, Pseudomonas putida KT2440
cgcuguaaccugguug

SEQ ID NO: 3552032 - RNA, 20 nt, Pseudomonas putida KT2440
cgcuguacaccaggacuucc

SEQ ID NO: 3552033 - RNA, 21 nt, Pseudomonas putida KT2440
cgcuguacaccaggacuuccc

SEQ ID NO: 3552034 - RNA, 14 nt, Pseudomonas putida KT2440
cgcuguacguccaa

SEQ ID NO: 3552035 - RNA, 21 nt, Pseudomonas putida KT2440
cgcuguaggggcgggccugcu

SEQ ID NO: 3552036 - RNA, 14 nt, Pseudomonas putida KT2440
cgcugucaccggua

SEQ ID NO: 3552037 - RNA, 22 nt, Pseudomonas putida KT2440
cgcugucauccugcguggcggu

SEQ ID NO: 3552038 - RNA, 19 nt, Pseudomonas putida KT2440
cgcugucccccagcccuga

SEQ ID NO: 3552039 - RNA, 23 nt, Pseudomonas putida KT2440
cgcugucguccagcucgcgcagg

SEQ ID NO: 3552040 - RNA, 23 nt, Pseudomonas putida KT2440
cgcugucgucgucagcuuccgcu

SEQ ID NO: 3552041 - RNA, 18 nt, Pseudomonas putida KT2440
cgcugucuuccagggcaa

SEQ ID NO: 3552042 - RNA, 18 nt, Pseudomonas putida KT2440
cgcugucuucugccagag

SEQ ID NO: 3552043 - RNA, 15 nt, Pseudomonas putida KT2440
cgcugugcaacagcg

SEQ ID NO: 3552044 - RNA, 16 nt, Pseudomonas putida KT2440
cgcugugcaacagcgc

SEQ ID NO: 3552045 - RNA, 17 nt, Pseudomonas putida KT2440
cgcugugcaacagcgcc

SEQ ID NO: 3552046 - RNA, 13 nt, Pseudomonas putida KT2440
cgcugugccagcg

SEQ ID NO: 3552047 - RNA, 13 nt, Pseudomonas putida KT2440
cgcugugcgugau

SEQ ID NO: 3552048 - RNA, 13 nt, Pseudomonas putida KT2440
cgcugugcucagc

SEQ ID NO: 3552049 - RNA, 13 nt, Pseudomonas putida KT2440
cgcugugcucugg

SEQ ID NO: 3552050 - RNA, 19 nt, Pseudomonas putida KT2440
cgcuguggcgcccggcgcu

SEQ ID NO: 3552051 - RNA, 22 nt, Pseudomonas putida KT2440
cgcuguggcgcccggcgcuggu

SEQ ID NO: 3552052 - RNA, 17 nt, Pseudomonas putida KT2440
cgcugugggaguaacgg

SEQ ID NO: 3552053 - RNA, 16 nt, Pseudomonas putida KT2440
cgcuguuacugcuggu

SEQ ID NO: 3552054 - RNA, 12 nt, Pseudomonas putida KT2440
cgcuguucugcc

SEQ ID NO: 3552055 - RNA, 22 nt, Pseudomonas putida KT2440
cgcuguugagcagcagcccuuc

SEQ ID NO: 3552056 - RNA, 13 nt, Pseudomonas putida KT2440
cgcuguuggcagc

SEQ ID NO: 3552057 - RNA, 22 nt, Pseudomonas putida KT2440
cgcuuacagaugucuggcauca

SEQ ID NO: 3552058 - RNA, 20 nt, Pseudomonas putida KT2440
cgcuuagcagcuaaggcuga

SEQ ID NO: 3552059 - RNA, 12 nt, Pseudomonas putida KT2440
cgcuuauggcgc

SEQ ID NO: 3552060 - RNA, 20 nt, Pseudomonas putida KT2440
cgcuucacccucgcgcagca

SEQ ID NO: 3552061 - RNA, 19 nt, Pseudomonas putida KT2440
cgcuucaccgcgcaccucc

SEQ ID NO: 3552062 - RNA, 20 nt, Pseudomonas putida KT2440
cgcuucacgucuggcaccag

SEQ ID NO: 3552063 - RNA, 20 nt, Pseudomonas putida KT2440
cgcuucagccuuuuccagcu

SEQ ID NO: 3552064 - RNA, 21 nt, Pseudomonas putida KT2440
cgcuucagggucgggcacagg

SEQ ID NO: 3552065 - RNA, 22 nt, Pseudomonas putida KT2440
cgcuucagggucgggcacaggc

SEQ ID NO: 3552066 - RNA, 15 nt, Pseudomonas putida KT2440
cgcuucauaucacaa

SEQ ID NO: 3552067 - RNA, 20 nt, Pseudomonas putida KT2440
cgcuuccaagugcuguauga

SEQ ID NO: 3552068 - RNA, 22 nt, Pseudomonas putida KT2440
cgcuucccccaaucuccagccc

SEQ ID NO: 3552069 - RNA, 13 nt, Pseudomonas putida KT2440
cgcuuccuggccu

SEQ ID NO: 3552070 - RNA, 14 nt, Pseudomonas putida KT2440
cgcuucgaacaccc

SEQ ID NO: 3552071 - RNA, 22 nt, Pseudomonas putida KT2440
cgcuucgaacacccgcuugccu

SEQ ID NO: 3552072 - RNA, 20 nt, Pseudomonas putida KT2440
cgcuucgaucagcgccugcu

SEQ ID NO: 3552073 - RNA, 22 nt, Pseudomonas putida KT2440
cgcuucgaucagcgccugcuca

SEQ ID NO: 3552074 - RNA, 17 nt, Pseudomonas putida KT2440
cgcuucgaucgccggca

SEQ ID NO: 3552075 - RNA, 13 nt, Pseudomonas putida KT2440
cgcuucgccagcg

SEQ ID NO: 3552076 - RNA, 11 nt, Pseudomonas putida KT2440
cgcuucgccgc

SEQ ID NO: 3552077 - RNA, 13 nt, Pseudomonas putida KT2440
cgcuucgcggcca

SEQ ID NO: 3552078 - RNA, 13 nt, Pseudomonas putida KT2440
cgcuucggcacgc

SEQ ID NO: 3552079 - RNA, 20 nt, Pseudomonas putida KT2440
cgcuucggcacgcguacccc

SEQ ID NO: 3552080 - RNA, 17 nt, Pseudomonas putida KT2440
cgcuucggcaugcacgg

SEQ ID NO: 3552081 - RNA, 18 nt, Pseudomonas putida KT2440
cgcuucggcgggguuuuu

SEQ ID NO: 3552082 - RNA, 19 nt, Pseudomonas putida KT2440
cgcuucggugugcuccagc

SEQ ID NO: 3552083 - RNA, 22 nt, Pseudomonas putida KT2440
cgcuucggugugcuccagcucc

SEQ ID NO: 3552084 - RNA, 13 nt, Pseudomonas putida KT2440
cgcuucguccagg

SEQ ID NO: 3552085 - RNA, 13 nt, Pseudomonas putida KT2440
cgcuucgugcagg

SEQ ID NO: 3552086 - RNA, 14 nt, Pseudomonas putida KT2440
cgcuucuuugcgau

SEQ ID NO: 3552087 - RNA, 18 nt, Pseudomonas putida KT2440
cgcuucuuugcgauccag

SEQ ID NO: 3552088 - RNA, 16 nt, Pseudomonas putida KT2440
cgcuugaagaagccuu

SEQ ID NO: 3552089 - RNA, 17 nt, Pseudomonas putida KT2440
cgcuugacccggugcac

SEQ ID NO: 3552090 - RNA, 14 nt, Pseudomonas putida KT2440
cgcuugaucagccu

SEQ ID NO: 3552091 - RNA, 18 nt, Pseudomonas putida KT2440
cgcuugcaguuguccagg

SEQ ID NO: 3552092 - RNA, 13 nt, Pseudomonas putida KT2440
cgcuugccacggc

SEQ ID NO: 3552093 - RNA, 19 nt, Pseudomonas putida KT2440
cgcuugccuuccucggcca

SEQ ID NO: 3552094 - RNA, 18 nt, Pseudomonas putida KT2440
cgcuugcgaccgaugccc

SEQ ID NO: 3552095 - RNA, 21 nt, Pseudomonas putida KT2440
cgcuugcgcauggccgccaca

SEQ ID NO: 3552096 - RNA, 22 nt, Pseudomonas putida KT2440
cgcuuggaaauguucaacagcc

SEQ ID NO: 3552097 - RNA, 23 nt, Pseudomonas putida KT2440
cgcuuggaaauguucaacagccg

SEQ ID NO: 3552098 - RNA, 23 nt, Pseudomonas putida KT2440
cgcuuggaucuuuucgggcaagg

SEQ ID NO: 3552099 - RNA, 20 nt, Pseudomonas putida KT2440
cgcuuggcaccggcagcagc

SEQ ID NO: 3552100 - RNA, 12 nt, Pseudomonas putida KT2440
cgcuuggccacc

SEQ ID NO: 3552101 - RNA, 13 nt, Pseudomonas putida KT2440
cgcuuggccacca

SEQ ID NO: 3552102 - RNA, 17 nt, Pseudomonas putida KT2440
cgcuuggcggcccuauc

SEQ ID NO: 3552103 - RNA, 17 nt, Pseudomonas putida KT2440
cggcaaacacauccagc

SEQ ID NO: 3552104 - RNA, 15 nt, Pseudomonas putida KT2440
cggcaaacgcgguca

SEQ ID NO: 3552105 - RNA, 19 nt, Pseudomonas putida KT2440
cggcaaacgcggucagcag

SEQ ID NO: 3552106 - RNA, 19 nt, Pseudomonas putida KT2440
cggcaaacuucucgccuca

SEQ ID NO: 3552107 - RNA, 17 nt, Pseudomonas putida KT2440
cggcaaaguccagcauc

SEQ ID NO: 3552108 - RNA, 15 nt, Pseudomonas putida KT2440
cggcaaaugcggcgc

SEQ ID NO: 3552109 - RNA, 17 nt, Pseudomonas putida KT2440
cggcaaccauggcuucg

SEQ ID NO: 3552110 - RNA, 17 nt, Pseudomonas putida KT2440
cggcaacccuucggcca

SEQ ID NO: 3552111 - RNA, 19 nt, Pseudomonas putida KT2440
cggcaacccuucggccagc

SEQ ID NO: 3552112 - RNA, 16 nt, Pseudomonas putida KT2440
cggcaaccugcucgcu

SEQ ID NO: 3552113 - RNA, 19 nt, Pseudomonas putida KT2440
cggcaaccugcucgcucag

SEQ ID NO: 3552114 - RNA, 13 nt, Pseudomonas putida KT2440
cggcaacgccagc

SEQ ID NO: 3552115 - RNA, 15 nt, Pseudomonas putida KT2440
cggcaacgccagcaa

SEQ ID NO: 3552116 - RNA, 13 nt, Pseudomonas putida KT2440
cggcaacggccac

SEQ ID NO: 3552117 - RNA, 21 nt, Pseudomonas putida KT2440
cggcaacggccgugcgccuga

SEQ ID NO: 3552118 - RNA, 18 nt, Pseudomonas putida KT2440
cggcaacuggcacaaccc

SEQ ID NO: 3552119 - RNA, 19 nt, Pseudomonas putida KT2440
cggcaacuggcaucgguca

SEQ ID NO: 3552120 - RNA, 17 nt, Pseudomonas putida KT2440
cggcaagccacgccaga

SEQ ID NO: 3552121 - RNA, 17 nt, Pseudomonas putida KT2440
cggcaagcccauggcug

SEQ ID NO: 3552122 - RNA, 20 nt, Pseudomonas putida KT2440
cggcaagcccauggcuggca

SEQ ID NO: 3552123 - RNA, 21 nt, Pseudomonas putida KT2440
cggcaagcccauggcuggcag

SEQ ID NO: 3552124 - RNA, 19 nt, Pseudomonas putida KT2440
cggcaagcccgcuccuaca

SEQ ID NO: 3552125 - RNA, 14 nt, Pseudomonas putida KT2440
cggcaaggcgaccu

SEQ ID NO: 3552126 - RNA, 20 nt, Pseudomonas putida KT2440
cggcaaggcgaccugccagc

SEQ ID NO: 3552127 - RNA, 20 nt, Pseudomonas putida KT2440
cggcaaggcguaccggcaac

SEQ ID NO: 3552128 - RNA, 21 nt, Pseudomonas putida KT2440
cggcaaggcguaccggcaacc

SEQ ID NO: 3552129 - RNA, 17 nt, Pseudomonas putida KT2440
cggcaagguacugaucc

SEQ ID NO: 3552130 - RNA, 18 nt, Pseudomonas putida KT2440
cggcaagguagccugcug

SEQ ID NO: 3552131 - RNA, 21 nt, Pseudomonas putida KT2440
cggcaagguagccugcugacg

SEQ ID NO: 3552132 - RNA, 22 nt, Pseudomonas putida KT2440
cggcaauacaacgaucagcgcc

SEQ ID NO: 3552133 - RNA, 14 nt, Pseudomonas putida KT2440
cggcaauaccggcc

SEQ ID NO: 3552134 - RNA, 15 nt, Pseudomonas putida KT2440
cggcaauaccggcca

SEQ ID NO: 3552135 - RNA, 22 nt, Pseudomonas putida KT2440
cggcaaucaccgccagguccag

SEQ ID NO: 3552136 - RNA, 21 nt, Pseudomonas putida KT2440
cggcaaucacgaacaccagcc

SEQ ID NO: 3552137 - RNA, 18 nt, Pseudomonas putida KT2440
cggcaaucaggcugauca

SEQ ID NO: 3552138 - RNA, 24 nt, Pseudomonas putida KT2440
cggcaaucaggcugaucaccgccg

SEQ ID NO: 3552139 - RNA, 21 nt, Pseudomonas putida KT2440
cggcaauccugggugaaacgg

SEQ ID NO: 3552140 - RNA, 18 nt, Pseudomonas putida KT2440
cggcaaucgccaggcgca

SEQ ID NO: 3552141 - RNA, 18 nt, Pseudomonas putida KT2440
cggcaaucgccgggcgca

SEQ ID NO: 3552142 - RNA, 19 nt, Pseudomonas putida KT2440
cggcaaucgggauggcacc

SEQ ID NO: 3552143 - RNA, 15 nt, Pseudomonas putida KT2440
cggcaaucugcagca

SEQ ID NO: 3552144 - RNA, 17 nt, Pseudomonas putida KT2440
cggcaaucugcagcagc

SEQ ID NO: 3552145 - RNA, 13 nt, Pseudomonas putida KT2440
cggcaaugaccaa

SEQ ID NO: 3552146 - RNA, 22 nt, Pseudomonas putida KT2440
cggcaaugaccaagcaacgcaa

SEQ ID NO: 3552147 - RNA, 14 nt, Pseudomonas putida KT2440
cggcaaugcgcgcg

SEQ ID NO: 3552148 - RNA, 18 nt, Pseudomonas putida KT2440
cggcaaugcgcgcgaagg

SEQ ID NO: 3552149 - RNA, 21 nt, Pseudomonas putida KT2440
cggcaaugcgcgcgaaggccc

SEQ ID NO: 3552150 - RNA, 12 nt, Pseudomonas putida KT2440
cggcaauggcgg

SEQ ID NO: 3552151 - RNA, 12 nt, Pseudomonas putida KT2440
cggcaaugguca

SEQ ID NO: 3552152 - RNA, 17 nt, Pseudomonas putida KT2440
cggcaauucgccggcag

SEQ ID NO: 3552153 - RNA, 19 nt, Pseudomonas putida KT2440
cggcaauucgccggcagca

SEQ ID NO: 3552154 - RNA, 22 nt, Pseudomonas putida KT2440
cggcaauucgccggcagcaaac

SEQ ID NO: 3552155 - RNA, 20 nt, Pseudomonas putida KT2440
cggcacaccacgccaaccug

SEQ ID NO: 3552156 - RNA, 23 nt, Pseudomonas putida KT2440
cggcacacgcaccaccccggggc

SEQ ID NO: 3552157 - RNA, 19 nt, Pseudomonas putida KT2440
cggcacacgguuuccaggc

SEQ ID NO: 3552158 - RNA, 12 nt, Pseudomonas putida KT2440
cggcacagaauc

SEQ ID NO: 3552159 - RNA, 14 nt, Pseudomonas putida KT2440
cggcacagcccagc

SEQ ID NO: 3552160 - RNA, 15 nt, Pseudomonas putida KT2440
cggcacaggaaggca

SEQ ID NO: 3552161 - RNA, 18 nt, Pseudomonas putida KT2440
cggcacaggcuuacaacu

SEQ ID NO: 3552162 - RNA, 23 nt, Pseudomonas putida KT2440
cggcacagugccaaggaccagac

SEQ ID NO: 3552163 - RNA, 22 nt, Pseudomonas putida KT2440
cggcaccaccgauucgcgcagg

SEQ ID NO: 3552164 - RNA, 12 nt, Pseudomonas putida KT2440
cggcaccagcac

SEQ ID NO: 3552165 - RNA, 15 nt, Pseudomonas putida KT2440
cggcaccagcaccag

SEQ ID NO: 3552166 - RNA, 11 nt, Pseudomonas putida KT2440
cggcaccaucu

SEQ ID NO: 3552167 - RNA, 17 nt, Pseudomonas putida KT2440
cggcaccaucuucgaca

SEQ ID NO: 3552168 - RNA, 17 nt, Pseudomonas putida KT2440
cggcacccaauagccca

SEQ ID NO: 3552169 - RNA, 19 nt, Pseudomonas putida KT2440
cggcaccccuuucuccagc

SEQ ID NO: 3552170 - RNA, 20 nt, Pseudomonas putida KT2440
cggcaccccuuucuccagca

SEQ ID NO: 3552171 - RNA, 22 nt, Pseudomonas putida KT2440
cggcaccccuuucuccagcaac

SEQ ID NO: 3552172 - RNA, 23 nt, Pseudomonas putida KT2440
cggcaccccuuucuccagcaaca

SEQ ID NO: 3552173 - RNA, 17 nt, Pseudomonas putida KT2440
cggcacccgcacaugcc

SEQ ID NO: 3552174 - RNA, 13 nt, Pseudomonas putida KT2440
cggcaccgacagc

SEQ ID NO: 3552175 - RNA, 13 nt, Pseudomonas putida KT2440
cggcaccgccagc

SEQ ID NO: 3552176 - RNA, 21 nt, Pseudomonas putida KT2440
cggcaccggcgaacagcaaug

SEQ ID NO: 3552177 - RNA, 16 nt, Pseudomonas putida KT2440
cggcaccgucgccugc

SEQ ID NO: 3552178 - RNA, 17 nt, Pseudomonas putida KT2440
cggcaccgucgccugca

SEQ ID NO: 3552179 - RNA, 20 nt, Pseudomonas putida KT2440
cggcaccucguccagguuga

SEQ ID NO: 3552180 - RNA, 14 nt, Pseudomonas putida KT2440
cggcaccugccggg

SEQ ID NO: 3552181 - RNA, 16 nt, Pseudomonas putida KT2440
cggcaccugccgggca

SEQ ID NO: 3552182 - RNA, 18 nt, Pseudomonas putida KT2440
cggcaccugccgggcauc

SEQ ID NO: 3552183 - RNA, 22 nt, Pseudomonas putida KT2440
cggcaccugcuugccgcuggca

SEQ ID NO: 3552184 - RNA, 18 nt, Pseudomonas putida KT2440
cggcaccugugcaggcgu

SEQ ID NO: 3552185 - RNA, 21 nt, Pseudomonas putida KT2440
cggcaccuuucuccaggugga

SEQ ID NO: 3552186 - RNA, 20 nt, Pseudomonas putida KT2440
cggcaccuuugcaggugccg

SEQ ID NO: 3552187 - RNA, 16 nt, Pseudomonas putida KT2440
cggcacgagcaugccg

SEQ ID NO: 3552188 - RNA, 16 nt, Pseudomonas putida KT2440
cggcacgcccagcaac

SEQ ID NO: 3552189 - RNA, 19 nt, Pseudomonas putida KT2440
cggcacgcgccagcagcgc

SEQ ID NO: 3552190 - RNA, 15 nt, Pseudomonas putida KT2440
cggcacgcguacccc

SEQ ID NO: 3552191 - RNA, 22 nt, Pseudomonas putida KT2440
cggcacgcguaccccuggcgcu

SEQ ID NO: 3552192 - RNA, 17 nt, Pseudomonas putida KT2440
cggcacggcgugcucca

SEQ ID NO: 3552193 - RNA, 19 nt, Pseudomonas putida KT2440
cggcacggcgugcuccaca

SEQ ID NO: 3552194 - RNA, 22 nt, Pseudomonas putida KT2440
cggcacguucacgcaagcgccu

SEQ ID NO: 3552195 - RNA, 16 nt, Pseudomonas putida KT2440
cggcacguuggugccg

SEQ ID NO: 3552196 - RNA, 23 nt, Pseudomonas putida KT2440
cggcacuaccaggcccaacagcg

SEQ ID NO: 3552197 - RNA, 15 nt, Pseudomonas putida KT2440
cggcacucgaagcac

SEQ ID NO: 3552198 - RNA, 14 nt, Pseudomonas putida KT2440
cggcacugcacagc

SEQ ID NO: 3552199 - RNA, 14 nt, Pseudomonas putida KT2440
cggcacugcacgcu

SEQ ID NO: 3552200 - RNA, 23 nt, Pseudomonas putida KT2440
cggcacuggcuacagaucagcca

SEQ ID NO: 3552201 - RNA, 23 nt, Pseudomonas putida KT2440
cggcagaaauguuuggguugacg

SEQ ID NO: 3552202 - RNA, 17 nt, Pseudomonas putida KT2440
cggcagaacacaucggu

SEQ ID NO: 3552203 - RNA, 17 nt, Pseudomonas putida KT2440
cggcagaacggcuucga

SEQ ID NO: 3552204 - RNA, 18 nt, Pseudomonas putida KT2440
cggcagaaucagguucag

SEQ ID NO: 3552205 - RNA, 17 nt, Pseudomonas putida KT2440
cggcagacacaggcgcu

SEQ ID NO: 3552206 - RNA, 14 nt, Pseudomonas putida KT2440
cggcagagccggug

SEQ ID NO: 3552207 - RNA, 14 nt, Pseudomonas putida KT2440
cggcagagcgccag

SEQ ID NO: 3552208 - RNA, 18 nt, Pseudomonas putida KT2440
cggcccugaaggccgcuc

SEQ ID NO: 3552209 - RNA, 15 nt, Pseudomonas putida KT2440
cggcccugaucgguu

SEQ ID NO: 3552210 - RNA, 13 nt, Pseudomonas putida KT2440
cggcccugccggc

SEQ ID NO: 3552211 - RNA, 23 nt, Pseudomonas putida KT2440
cggcccugccggccucaauucca

SEQ ID NO: 3552212 - RNA, 20 nt, Pseudomonas putida KT2440
cggcccugcuggccaaucuc

SEQ ID NO: 3552213 - RNA, 22 nt, Pseudomonas putida KT2440
cggcccuucuccgccuaccgcg

SEQ ID NO: 3552214 - RNA, 14 nt, Pseudomonas putida KT2440
cggcccuuucgcgg

SEQ ID NO: 3552215 - RNA, 15 nt, Pseudomonas putida KT2440
cggcccuuucgcggg

SEQ ID NO: 3552216 - RNA, 16 nt, Pseudomonas putida KT2440
cggcccuuucgcgggu

SEQ ID NO: 3552217 - RNA, 18 nt, Pseudomonas putida KT2440
cggcccuuucgcggguaa

SEQ ID NO: 3552218 - RNA, 20 nt, Pseudomonas putida KT2440
cggccgaagugauggccugg

SEQ ID NO: 3552219 - RNA, 22 nt, Pseudomonas putida KT2440
cggccgacccgccuggugccag

SEQ ID NO: 3552220 - RNA, 20 nt, Pseudomonas putida KT2440
cggccgacucuucaccagcu

SEQ ID NO: 3552221 - RNA, 15 nt, Pseudomonas putida KT2440
cggccgaggccgggu

SEQ ID NO: 3552222 - RNA, 19 nt, Pseudomonas putida KT2440
cggccgaggccggguuuuu

SEQ ID NO: 3552223 - RNA, 18 nt, Pseudomonas putida KT2440
cggccgaugccagguaca

SEQ ID NO: 3552224 - RNA, 17 nt, Pseudomonas putida KT2440
cggccgcauccaugccg

SEQ ID NO: 3552225 - RNA, 20 nt, Pseudomonas putida KT2440
cggccgccgccagaccaccu

SEQ ID NO: 3552226 - RNA, 20 nt, Pseudomonas putida KT2440
cggccgcucaccggccagcg

SEQ ID NO: 3552227 - RNA, 15 nt, Pseudomonas putida KT2440
cggccgcuucgcgga

SEQ ID NO: 3552228 - RNA, 16 nt, Pseudomonas putida KT2440
cggccgcuucgcggau

SEQ ID NO: 3552229 - RNA, 11 nt, Pseudomonas putida KT2440
cggccgcuucu

SEQ ID NO: 3552230 - RNA, 11 nt, Pseudomonas putida KT2440
cggccgcuugc

SEQ ID NO: 3552231 - RNA, 12 nt, Pseudomonas putida KT2440
cggccggcagcg

SEQ ID NO: 3552232 - RNA, 15 nt, Pseudomonas putida KT2440
cggccggcagcgcgg

SEQ ID NO: 3552233 - RNA, 20 nt, Pseudomonas putida KT2440
cggccggcggauagccccgc

SEQ ID NO: 3552234 - RNA, 14 nt, Pseudomonas putida KT2440
cggccggcucgcca

SEQ ID NO: 3552235 - RNA, 16 nt, Pseudomonas putida KT2440
cggccgggcguagcag

SEQ ID NO: 3552236 - RNA, 20 nt, Pseudomonas putida KT2440
cggccggggcaaccugggug

SEQ ID NO: 3552237 - RNA, 21 nt, Pseudomonas putida KT2440
cggccggggccaggcgcggcu

SEQ ID NO: 3552238 - RNA, 13 nt, Pseudomonas putida KT2440
cggccggggccug

SEQ ID NO: 3552239 - RNA, 16 nt, Pseudomonas putida KT2440
cggccgggucgaaggc

SEQ ID NO: 3552240 - RNA, 22 nt, Pseudomonas putida KT2440
cggccgggucgauagccagccc

SEQ ID NO: 3552241 - RNA, 21 nt, Pseudomonas putida KT2440
cggccggucguuacccaccag

SEQ ID NO: 3552242 - RNA, 21 nt, Pseudomonas putida KT2440
cggccggugguaauuggccgg

SEQ ID NO: 3552243 - RNA, 15 nt, Pseudomonas putida KT2440
cggccgucaacgagg

SEQ ID NO: 3552244 - RNA, 21 nt, Pseudomonas putida KT2440
cggccgucaacgaggccgcca

SEQ ID NO: 3552245 - RNA, 23 nt, Pseudomonas putida KT2440
cggccgucaugcgaucaguaauc

SEQ ID NO: 3552246 - RNA, 15 nt, Pseudomonas putida KT2440
cggccgucgguaaac

SEQ ID NO: 3552247 - RNA, 14 nt, Pseudomonas putida KT2440
cggccgugcagggc

SEQ ID NO: 3552248 - RNA, 15 nt, Pseudomonas putida KT2440
cggccguggguccug

SEQ ID NO: 3552249 - RNA, 13 nt, Pseudomonas putida KT2440
cggccuacccggg

SEQ ID NO: 3552250 - RNA, 22 nt, Pseudomonas putida KT2440
cggccuaguucggcaccuuucu

SEQ ID NO: 3552251 - RNA, 14 nt, Pseudomonas putida KT2440
cggccucagcagcg

SEQ ID NO: 3552252 - RNA, 15 nt, Pseudomonas putida KT2440
cggccuccucgauga

SEQ ID NO: 3552253 - RNA, 20 nt, Pseudomonas putida KT2440
cggccuccucgcgggcaaac

SEQ ID NO: 3552254 - RNA, 18 nt, Pseudomonas putida KT2440
cggccucgauagcagcgc

SEQ ID NO: 3552255 - RNA, 15 nt, Pseudomonas putida KT2440
cggccucggccgggu

SEQ ID NO: 3552256 - RNA, 12 nt, Pseudomonas putida KT2440
cggccucguguc

SEQ ID NO: 3552257 - RNA, 16 nt, Pseudomonas putida KT2440
cggccucuucgcgggc

SEQ ID NO: 3552258 - RNA, 17 nt, Pseudomonas putida KT2440
cggccucuucgcgggca

SEQ ID NO: 3552259 - RNA, 20 nt, Pseudomonas putida KT2440
cggccucuucgcggguaaac

SEQ ID NO: 3552260 - RNA, 21 nt, Pseudomonas putida KT2440
cggccucuucgcggguaagcc

SEQ ID NO: 3552261 - RNA, 20 nt, Pseudomonas putida KT2440
cggccucuucgcgggugaac

SEQ ID NO: 3552262 - RNA, 20 nt, Pseudomonas putida KT2440
cggccugaugccucaucagg

SEQ ID NO: 3552263 - RNA, 21 nt, Pseudomonas putida KT2440
cggccugaugccucaucaggc

SEQ ID NO: 3552264 - RNA, 12 nt, Pseudomonas putida KT2440
cggccugcacaa

SEQ ID NO: 3552265 - RNA, 13 nt, Pseudomonas putida KT2440
cggccugcagcuu

SEQ ID NO: 3552266 - RNA, 19 nt, Pseudomonas putida KT2440
cggccugcauccacaccag

SEQ ID NO: 3552267 - RNA, 21 nt, Pseudomonas putida KT2440
cggccugcauccacaccagcg

SEQ ID NO: 3552268 - RNA, 15 nt, Pseudomonas putida KT2440
cggccugccgcugac

SEQ ID NO: 3552269 - RNA, 13 nt, Pseudomonas putida KT2440
cggccugcgaugc

SEQ ID NO: 3552270 - RNA, 17 nt, Pseudomonas putida KT2440
cggccugcgcccgauca

SEQ ID NO: 3552271 - RNA, 20 nt, Pseudomonas putida KT2440
cggccugcgcuccagcagcu

SEQ ID NO: 3552272 - RNA, 14 nt, Pseudomonas putida KT2440
cggccuggcauuug

SEQ ID NO: 3552273 - RNA, 16 nt, Pseudomonas putida KT2440
cggccuggccugcaug

SEQ ID NO: 3552274 - RNA, 15 nt, Pseudomonas putida KT2440
cggccuggcgcaggu

SEQ ID NO: 3552275 - RNA, 14 nt, Pseudomonas putida KT2440
cggccugggcaggu

SEQ ID NO: 3552276 - RNA, 23 nt, Pseudomonas putida KT2440
cggccuggggcaggcccggcagg

SEQ ID NO: 3552277 - RNA, 16 nt, Pseudomonas putida KT2440
cggccuguguccaaca

SEQ ID NO: 3552278 - RNA, 15 nt, Pseudomonas putida KT2440
cggccuguugcgcac

SEQ ID NO: 3552279 - RNA, 21 nt, Pseudomonas putida KT2440
cggccuguugcgcacugccgc

SEQ ID NO: 3552280 - RNA, 17 nt, Pseudomonas putida KT2440
cggccuguuuggccgca

SEQ ID NO: 3552281 - RNA, 17 nt, Pseudomonas putida KT2440
cggccuucagggccggu

SEQ ID NO: 3552282 - RNA, 15 nt, Pseudomonas putida KT2440
cggccuucccgccug

SEQ ID NO: 3552283 - RNA, 21 nt, Pseudomonas putida KT2440
cggccuucguaguaauggccg

SEQ ID NO: 3552284 - RNA, 22 nt, Pseudomonas putida KT2440
cggccuucguaguaauggccga

SEQ ID NO: 3552285 - RNA, 17 nt, Pseudomonas putida KT2440
cggccuucuucgguggc

SEQ ID NO: 3552286 - RNA, 18 nt, Pseudomonas putida KT2440
cggccuugaccacuucga

SEQ ID NO: 3552287 - RNA, 18 nt, Pseudomonas putida KT2440
cggccuugccgcuggcga

SEQ ID NO: 3552288 - RNA, 10 nt, Pseudomonas putida KT2440
cggccuugcg

SEQ ID NO: 3552289 - RNA, 13 nt, Pseudomonas putida KT2440
cggccuugcgagc

SEQ ID NO: 3552290 - RNA, 12 nt, Pseudomonas putida KT2440
cggccuugcgcu

SEQ ID NO: 3552291 - RNA, 17 nt, Pseudomonas putida KT2440
cggccuugcgcugggca

SEQ ID NO: 3552292 - RNA, 19 nt, Pseudomonas putida KT2440
cggccuugcgcugggcauc

SEQ ID NO: 3552293 - RNA, 13 nt, Pseudomonas putida KT2440
cggccuuggcgcg

SEQ ID NO: 3552294 - RNA, 14 nt, Pseudomonas putida KT2440
cggccuuguucaac

SEQ ID NO: 3552295 - RNA, 18 nt, Pseudomonas putida KT2440
cggccuuguucaacacug

SEQ ID NO: 3552296 - RNA, 22 nt, Pseudomonas putida KT2440
cggccuuucugcuucgcugcca

SEQ ID NO: 3552297 - RNA, 15 nt, Pseudomonas putida KT2440
cggccuuuucgcgcu

SEQ ID NO: 3552298 - RNA, 14 nt, Pseudomonas putida KT2440
cggcgaaaagccgg

SEQ ID NO: 3552299 - RNA, 17 nt, Pseudomonas putida KT2440
cggcgaaaagccgggua

SEQ ID NO: 3552300 - RNA, 15 nt, Pseudomonas putida KT2440
cggcgaaagccagca

SEQ ID NO: 3552301 - RNA, 16 nt, Pseudomonas putida KT2440
cggcgaaagccagcag

SEQ ID NO: 3552302 - RNA, 23 nt, Pseudomonas putida KT2440
cggcgaaauacccaacuccagcg

SEQ ID NO: 3552303 - RNA, 14 nt, Pseudomonas putida KT2440
cggcgaagacggca

SEQ ID NO: 3552304 - RNA, 13 nt, Pseudomonas putida KT2440
cggcgaaggcugg

SEQ ID NO: 3552305 - RNA, 20 nt, Pseudomonas putida KT2440
cggcgaauccagcaggcuug

SEQ ID NO: 3552306 - RNA, 19 nt, Pseudomonas putida KT2440
cggcgaauccagccggccc

SEQ ID NO: 3552307 - RNA, 14 nt, Pseudomonas putida KT2440
cggcgaaugcugca

SEQ ID NO: 3552308 - RNA, 21 nt, Pseudomonas putida KT2440
cggcgaaugcugcagauugca

SEQ ID NO: 3552309 - RNA, 16 nt, Pseudomonas putida KT2440
cggcgacagcucaagc

SEQ ID NO: 3552310 - RNA, 17 nt, Pseudomonas putida KT2440
cggcgacagggcgaaga

SEQ ID NO: 3552311 - RNA, 14 nt, Pseudomonas putida KT2440
cggcgacgcggugc

SEQ ID NO: 3552312 - RNA, 15 nt, Pseudomonas putida KT2440
cggcgacgcggugcu

SEQ ID NO: 3552313 - RNA, 17 nt, Pseudomonas putida KT2440
cggcgacgcggugcucg

SEQ ID NO: 3552314 - RNA, 20 nt, Pseudomonas putida KT2440
cggcgucgaacaacggcagc

SEQ ID NO: 3552315 - RNA, 17 nt, Pseudomonas putida KT2440
cggcgucggcgcgcaac

SEQ ID NO: 3552316 - RNA, 19 nt, Pseudomonas putida KT2440
cggcgucgucaaggaagcu

SEQ ID NO: 3552317 - RNA, 16 nt, Pseudomonas putida KT2440
cggcgugacgugcgcu

SEQ ID NO: 3552318 - RNA, 19 nt, Pseudomonas putida KT2440
cggcgugauuuucguugag

SEQ ID NO: 3552319 - RNA, 14 nt, Pseudomonas putida KT2440
cggcgugcaccacg

SEQ ID NO: 3552320 - RNA, 13 nt, Pseudomonas putida KT2440
cggcgugcugcgu

SEQ ID NO: 3552321 - RNA, 18 nt, Pseudomonas putida KT2440
cggcguggaugaucggcu

SEQ ID NO: 3552322 - RNA, 23 nt, Pseudomonas putida KT2440
cggcguggaugaucggcuggcca

SEQ ID NO: 3552323 - RNA, 12 nt, Pseudomonas putida KT2440
cggcguggcgag

SEQ ID NO: 3552324 - RNA, 16 nt, Pseudomonas putida KT2440
cggcguggugcugcau

SEQ ID NO: 3552325 - RNA, 22 nt, Pseudomonas putida KT2440
cggcguguaguagcuccagccc

SEQ ID NO: 3552326 - RNA, 24 nt, Pseudomonas putida KT2440
cggcguguaguagcuccagcccag

SEQ ID NO: 3552327 - RNA, 15 nt, Pseudomonas putida KT2440
cggcguguccagcag

SEQ ID NO: 3552328 - RNA, 16 nt, Pseudomonas putida KT2440
cggcguguccagcagg

SEQ ID NO: 3552329 - RNA, 17 nt, Pseudomonas putida KT2440
cggcguguccagcaggu

SEQ ID NO: 3552330 - RNA, 22 nt, Pseudomonas putida KT2440
cggcguuaccccguugcgcagc

SEQ ID NO: 3552331 - RNA, 17 nt, Pseudomonas putida KT2440
cggcguucgaaagccca

SEQ ID NO: 3552332 - RNA, 15 nt, Pseudomonas putida KT2440
cggcguugaccgagg

SEQ ID NO: 3552333 - RNA, 22 nt, Pseudomonas putida KT2440
cggcguuuucguuuacacggua

SEQ ID NO: 3552334 - RNA, 17 nt, Pseudomonas putida KT2440
cggcuaaagccgcaccu

SEQ ID NO: 3552335 - RNA, 20 nt, Pseudomonas putida KT2440
cggcuaaagccgcaccuaca

SEQ ID NO: 3552336 - RNA, 16 nt, Pseudomonas putida KT2440
cggcuaagcgccagca

SEQ ID NO: 3552337 - RNA, 21 nt, Pseudomonas putida KT2440
cggcuaccccgaugcgcugau

SEQ ID NO: 3552338 - RNA, 19 nt, Pseudomonas putida KT2440
cggcuaccgcauucuuggc

SEQ ID NO: 3552339 - RNA, 19 nt, Pseudomonas putida KT2440
cggcuaccgcugcgcacca

SEQ ID NO: 3552340 - RNA, 22 nt, Pseudomonas putida KT2440
cggcuacgaaaccgacuugauu

SEQ ID NO: 3552341 - RNA, 20 nt, Pseudomonas putida KT2440
cggcuacgccgccgcuggcg

SEQ ID NO: 3552342 - RNA, 23 nt, Pseudomonas putida KT2440
cggcuacgcucguccaggcccug

SEQ ID NO: 3552343 - RNA, 16 nt, Pseudomonas putida KT2440
cggcuaucggccagca

SEQ ID NO: 3552344 - RNA, 14 nt, Pseudomonas putida KT2440
cggcuaucucaggc

SEQ ID NO: 3552345 - RNA, 18 nt, Pseudomonas putida KT2440
cggcucaacagcaggugc

SEQ ID NO: 3552346 - RNA, 19 nt, Pseudomonas putida KT2440
cggcucaacagcaggugca

SEQ ID NO: 3552347 - RNA, 17 nt, Pseudomonas putida KT2440
cggcucaacagccacgc

SEQ ID NO: 3552348 - RNA, 15 nt, Pseudomonas putida KT2440
cggcucacccaccag

SEQ ID NO: 3552349 - RNA, 16 nt, Pseudomonas putida KT2440
cggcucacccaccagc

SEQ ID NO: 3552350 - RNA, 17 nt, Pseudomonas putida KT2440
cggcucacccaccagcc

SEQ ID NO: 3552351 - RNA, 14 nt, Pseudomonas putida KT2440
cggcucacugacca

SEQ ID NO: 3552352 - RNA, 19 nt, Pseudomonas putida KT2440
cggcucacugcucaucggc

SEQ ID NO: 3552353 - RNA, 14 nt, Pseudomonas putida KT2440
cggcucaucaggcg

SEQ ID NO: 3552354 - RNA, 22 nt, Pseudomonas putida KT2440
cggcuccaccgaaaucagcaac

SEQ ID NO: 3552355 - RNA, 16 nt, Pseudomonas putida KT2440
cggcuccaccugcucc

SEQ ID NO: 3552356 - RNA, 18 nt, Pseudomonas putida KT2440
cggcuccaccugcuccag

SEQ ID NO: 3552357 - RNA, 21 nt, Pseudomonas putida KT2440
cggcuccaccugcuccagcac

SEQ ID NO: 3552358 - RNA, 14 nt, Pseudomonas putida KT2440
cggcuccaggcaca

SEQ ID NO: 3552359 - RNA, 19 nt, Pseudomonas putida KT2440
cggcuccaggcacaggcgc

SEQ ID NO: 3552360 - RNA, 15 nt, Pseudomonas putida KT2440
cggcucccggcuacg

SEQ ID NO: 3552361 - RNA, 12 nt, Pseudomonas putida KT2440
cggcuccgcgca

SEQ ID NO: 3552362 - RNA, 14 nt, Pseudomonas putida KT2440
cggcuccgcgcaag

SEQ ID NO: 3552363 - RNA, 20 nt, Pseudomonas putida KT2440
cggcuccggcguguccagca

SEQ ID NO: 3552364 - RNA, 16 nt, Pseudomonas putida KT2440
cggcucgaccaagccu

SEQ ID NO: 3552365 - RNA, 18 nt, Pseudomonas putida KT2440
cggcucgaccaagccuga

SEQ ID NO: 3552366 - RNA, 17 nt, Pseudomonas putida KT2440
cggcucgcaugagccgg

SEQ ID NO: 3552367 - RNA, 20 nt, Pseudomonas putida KT2440
cggcucgccauugaugcuca

SEQ ID NO: 3552368 - RNA, 14 nt, Pseudomonas putida KT2440
cggcucgcucaggc

SEQ ID NO: 3552369 - RNA, 15 nt, Pseudomonas putida KT2440
cggcucgcugaacac

SEQ ID NO: 3552370 - RNA, 17 nt, Pseudomonas putida KT2440
cggcucgucaaccacag

SEQ ID NO: 3552371 - RNA, 20 nt, Pseudomonas putida KT2440
cggcucguugaccguccaca

SEQ ID NO: 3552372 - RNA, 21 nt, Pseudomonas putida KT2440
cggcucuaucuucaggcauca

SEQ ID NO: 3552373 - RNA, 21 nt, Pseudomonas putida KT2440
cggcucucgaaguagcgcucu

SEQ ID NO: 3552374 - RNA, 22 nt, Pseudomonas putida KT2440
cggcucuguuucugccccuggc

SEQ ID NO: 3552375 - RNA, 15 nt, Pseudomonas putida KT2440
cggcucuucgccuuc

SEQ ID NO: 3552376 - RNA, 18 nt, Pseudomonas putida KT2440
cggcugaaauggcggccc

SEQ ID NO: 3552377 - RNA, 21 nt, Pseudomonas putida KT2440
cggcugaucucuucagccacc

SEQ ID NO: 3552378 - RNA, 21 nt, Pseudomonas putida KT2440
cggcugaugguggucggcagc

SEQ ID NO: 3552379 - RNA, 19 nt, Pseudomonas putida KT2440
cggcugcaguagucgccag

SEQ ID NO: 3552380 - RNA, 21 nt, Pseudomonas putida KT2440
cggcugcaguagucgccaggc

SEQ ID NO: 3552381 - RNA, 17 nt, Pseudomonas putida KT2440
cggcugcauccacccac

SEQ ID NO: 3552382 - RNA, 14 nt, Pseudomonas putida KT2440
cggcugccgucccc

SEQ ID NO: 3552383 - RNA, 19 nt, Pseudomonas putida KT2440
cggcugcgacggcgaauga

SEQ ID NO: 3552384 - RNA, 21 nt, Pseudomonas putida KT2440
cggcugcgccgguguucgcgg

SEQ ID NO: 3552385 - RNA, 14 nt, Pseudomonas putida KT2440
cggcugcucgauca

SEQ ID NO: 3552386 - RNA, 15 nt, Pseudomonas putida KT2440
cggcuggauggcgcg

SEQ ID NO: 3552387 - RNA, 17 nt, Pseudomonas putida KT2440
cggcuggauggcgcggu

SEQ ID NO: 3552388 - RNA, 20 nt, Pseudomonas putida KT2440
cggcuggcagcgggcugccc

SEQ ID NO: 3552389 - RNA, 15 nt, Pseudomonas putida KT2440
cggcuggcagcuugc

SEQ ID NO: 3552390 - RNA, 13 nt, Pseudomonas putida KT2440
cggcuggcugccg

SEQ ID NO: 3552391 - RNA, 19 nt, Pseudomonas putida KT2440
cggcugggccccaggcggu

SEQ ID NO: 3552392 - RNA, 15 nt, Pseudomonas putida KT2440
cggcuggugucggcc

SEQ ID NO: 3552393 - RNA, 17 nt, Pseudomonas putida KT2440
cggcuggugucggccag

SEQ ID NO: 3552394 - RNA, 15 nt, Pseudomonas putida KT2440
cggcuguucgcagca

SEQ ID NO: 3552395 - RNA, 16 nt, Pseudomonas putida KT2440
cggcuguucgcagcac

SEQ ID NO: 3552396 - RNA, 22 nt, Pseudomonas putida KT2440
cggcuucacauccaccgcucgc

SEQ ID NO: 3552397 - RNA, 17 nt, Pseudomonas putida KT2440
cggcuucagguucacuu

SEQ ID NO: 3552398 - RNA, 19 nt, Pseudomonas putida KT2440
cggcuugcccgggcgcggu

SEQ ID NO: 3552399 - RNA, 12 nt, Pseudomonas putida KT2440
cggcuugccggc

SEQ ID NO: 3552400 - RNA, 22 nt, Pseudomonas putida KT2440
cggcuugcuccaagugccgugc

SEQ ID NO: 3552401 - RNA, 17 nt, Pseudomonas putida KT2440
cggcuugcucgcggcgc

SEQ ID NO: 3552402 - RNA, 21 nt, Pseudomonas putida KT2440
cggcuuguucagcuggugggc

SEQ ID NO: 3552403 - RNA, 23 nt, Pseudomonas putida KT2440
cggcuuguucuguuucaccagca

SEQ ID NO: 3552404 - RNA, 15 nt, Pseudomonas putida KT2440
cggcuuucagcgccg

SEQ ID NO: 3552405 - RNA, 16 nt, Pseudomonas putida KT2440
cggcuuugcgucauca

SEQ ID NO: 3552406 - RNA, 14 nt, Pseudomonas putida KT2440
cgggaacagcagca

SEQ ID NO: 3552407 - RNA, 20 nt, Pseudomonas putida KT2440
cgggaacagcucuggcagca

SEQ ID NO: 3552408 - RNA, 21 nt, Pseudomonas putida KT2440
cgggaacagcucuggcagcag

SEQ ID NO: 3552409 - RNA, 22 nt, Pseudomonas putida KT2440
cgggaacagcucuggcagcagu

SEQ ID NO: 3552410 - RNA, 18 nt, Pseudomonas putida KT2440
cgggaacaggugcgcgcg

SEQ ID NO: 3552411 - RNA, 11 nt, Pseudomonas putida KT2440
cgggaagcagg

SEQ ID NO: 3552412 - RNA, 15 nt, Pseudomonas putida KT2440
cgggaagccaugcac

SEQ ID NO: 3552413 - RNA, 17 nt, Pseudomonas putida KT2440
cgggaagguuuccagcc

SEQ ID NO: 3552414 - RNA, 12 nt, Pseudomonas putida KT2440
cgggaaguccgc

SEQ ID NO: 3552415 - RNA, 19 nt, Pseudomonas putida KT2440
cgggaaguccgccaggaag

SEQ ID NO: 3552416 - RNA, 21 nt, Pseudomonas putida KT2440
cgggaagucgcuuugcgggca

SEQ ID NO: 3552417 - RNA, 22 nt, Pseudomonas putida KT2440
cgggaaguggugguagaagguc

SEQ ID NO: 3552418 - RNA, 20 nt, Pseudomonas putida KT2440
cgggaaguuaccgcccgccc

SEQ ID NO: 3552419 - RNA, 15 nt, Pseudomonas putida KT2440
cgggcggaaugcucg

SEQ ID NO: 3552420 - RNA, 21 nt, Pseudomonas putida KT2440
cgggcggaaugcucgucacca

SEQ ID NO: 3552421 - RNA, 18 nt, Pseudomonas putida KT2440
cgggcggagauuggccag

SEQ ID NO: 3552422 - RNA, 20 nt, Pseudomonas putida KT2440
cgggcggagauuggccagca

SEQ ID NO: 3552423 - RNA, 21 nt, Pseudomonas putida KT2440
cgggcggagauuggccagcag

SEQ ID NO: 3552424 - RNA, 15 nt, Pseudomonas putida KT2440
cgggcggccaccggc

SEQ ID NO: 3552425 - RNA, 20 nt, Pseudomonas putida KT2440
cgggcggccaccggccacgc

SEQ ID NO: 3552426 - RNA, 24 nt, Pseudomonas putida KT2440
cgggcggcgcucgaucucacaggc

SEQ ID NO: 3552427 - RNA, 23 nt, Pseudomonas putida KT2440
cgggcggcgguugucgucgaccg

SEQ ID NO: 3552428 - RNA, 19 nt, Pseudomonas putida KT2440
cgggcgggugcauggcucg

SEQ ID NO: 3552429 - RNA, 20 nt, Pseudomonas putida KT2440
cgggcgguugucgaccuggc

SEQ ID NO: 3552430 - RNA, 18 nt, Pseudomonas putida KT2440
cgggcgucuuccaggugg

SEQ ID NO: 3552431 - RNA, 14 nt, Pseudomonas putida KT2440
cgggcgugcccgcg

SEQ ID NO: 3552432 - RNA, 23 nt, Pseudomonas putida KT2440
cgggcgugcccgcgaacaaggcu

SEQ ID NO: 3552433 - RNA, 18 nt, Pseudomonas putida KT2440
cgggcgugcccgcgaagg

SEQ ID NO: 3552434 - RNA, 22 nt, Pseudomonas putida KT2440
cgggcuaacguagggaagcgga

SEQ ID NO: 3552435 - RNA, 21 nt, Pseudomonas putida KT2440
cgggcucaccugguaccccuc

SEQ ID NO: 3552436 - RNA, 18 nt, Pseudomonas putida KT2440
cgggcucgcccgcgaaga

SEQ ID NO: 3552437 - RNA, 16 nt, Pseudomonas putida KT2440
cgggcucggccggggc

SEQ ID NO: 3552438 - RNA, 22 nt, Pseudomonas putida KT2440
cgggcucggccggggcaaccug

SEQ ID NO: 3552439 - RNA, 12 nt, Pseudomonas putida KT2440
cgggcugagccc

SEQ ID NO: 3552440 - RNA, 16 nt, Pseudomonas putida KT2440
cgggcugcucccgcag

SEQ ID NO: 3552441 - RNA, 15 nt, Pseudomonas putida KT2440
cgggcugcugccgcc

SEQ ID NO: 3552442 - RNA, 15 nt, Pseudomonas putida KT2440
cgggcugcugcgcag

SEQ ID NO: 3552443 - RNA, 16 nt, Pseudomonas putida KT2440
cgggcugcugcgcagc

SEQ ID NO: 3552444 - RNA, 17 nt, Pseudomonas putida KT2440
cgggcugcugcgcagcc

SEQ ID NO: 3552445 - RNA, 20 nt, Pseudomonas putida KT2440
cgggcugcugcgcagcccug

SEQ ID NO: 3552446 - RNA, 22 nt, Pseudomonas putida KT2440
cgggcugucgagcagguucagg

SEQ ID NO: 3552447 - RNA, 14 nt, Pseudomonas putida KT2440
cgggcuuacccgcg

SEQ ID NO: 3552448 - RNA, 15 nt, Pseudomonas putida KT2440
cgggcuuacccgcga

SEQ ID NO: 3552449 - RNA, 18 nt, Pseudomonas putida KT2440
cgggcuugcccgcgaagc

SEQ ID NO: 3552450 - RNA, 19 nt, Pseudomonas putida KT2440
cgggcuugcccgcgaaugg

SEQ ID NO: 3552451 - RNA, 13 nt, Pseudomonas putida KT2440
cgggcuuggcacg

SEQ ID NO: 3552452 - RNA, 19 nt, Pseudomonas putida KT2440
cgggcuuggcuucggcggc

SEQ ID NO: 3552453 - RNA, 18 nt, Pseudomonas putida KT2440
cgggcuugugcaucagcg

SEQ ID NO: 3552454 - RNA, 18 nt, Pseudomonas putida KT2440
cgggcuuuggucgcggcg

SEQ ID NO: 3552455 - RNA, 20 nt, Pseudomonas putida KT2440
cgggcuuuuuuuguuggccu

SEQ ID NO: 3552456 - RNA, 21 nt, Pseudomonas putida KT2440
cgggcuuuuuuuguuggccug

SEQ ID NO: 3552457 - RNA, 23 nt, Pseudomonas putida KT2440
cgggcuuuuuuuguuggccugga

SEQ ID NO: 3552458 - RNA, 16 nt, Pseudomonas putida KT2440
cggggaauggcccagc

SEQ ID NO: 3552459 - RNA, 20 nt, Pseudomonas putida KT2440
cggggaauggcccagccagc

SEQ ID NO: 3552460 - RNA, 19 nt, Pseudomonas putida KT2440
cggggaggccgucaggccu

SEQ ID NO: 3552461 - RNA, 23 nt, Pseudomonas putida KT2440
cggggaggccgucaggccucccc

SEQ ID NO: 3552462 - RNA, 17 nt, Pseudomonas putida KT2440
cggggauguugugggca

SEQ ID NO: 3552463 - RNA, 20 nt, Pseudomonas putida KT2440
cggggcaaacuucucgauga

SEQ ID NO: 3552464 - RNA, 13 nt, Pseudomonas putida KT2440
cggggcaaccugg

SEQ ID NO: 3552465 - RNA, 17 nt, Pseudomonas putida KT2440
cggggcacaacccgggg

SEQ ID NO: 3552466 - RNA, 21 nt, Pseudomonas putida KT2440
cggggcaccuugaagugcgca

SEQ ID NO: 3552467 - RNA, 24 nt, Pseudomonas putida KT2440
cggggcaccuugaagugcgcaauc

SEQ ID NO: 3552468 - RNA, 22 nt, Pseudomonas putida KT2440
cggggcagcaucaccacgcccu

SEQ ID NO: 3552469 - RNA, 16 nt, Pseudomonas putida KT2440
cggggcccggacaggg

SEQ ID NO: 3552470 - RNA, 20 nt, Pseudomonas putida KT2440
cggggccgcaaggcggccca

SEQ ID NO: 3552471 - RNA, 18 nt, Pseudomonas putida KT2440
cggggccucuucgcagca

SEQ ID NO: 3552472 - RNA, 22 nt, Pseudomonas putida KT2440
cggggcgaaauggcgaaucagc

SEQ ID NO: 3552473 - RNA, 15 nt, Pseudomonas putida KT2440
cggggcgcuccagca

SEQ ID NO: 3552474 - RNA, 13 nt, Pseudomonas putida KT2440
cggggcucacagc

SEQ ID NO: 3552475 - RNA, 16 nt, Pseudomonas putida KT2440
cgggggccccaccagg

SEQ ID NO: 3552476 - RNA, 17 nt, Pseudomonas putida KT2440
cgggggcgcgucagccg

SEQ ID NO: 3552477 - RNA, 15 nt, Pseudomonas putida KT2440
cgggggugcacagcg

SEQ ID NO: 3552478 - RNA, 19 nt, Pseudomonas putida KT2440
cggggguggcgagcagguc

SEQ ID NO: 3552479 - RNA, 19 nt, Pseudomonas putida KT2440
cgggguaaaacgcauggcg

SEQ ID NO: 3552480 - RNA, 22 nt, Pseudomonas putida KT2440
cgggguagaacaagucgcgcac

SEQ ID NO: 3552481 - RNA, 15 nt, Pseudomonas putida KT2440
cgggguagaccuucu

SEQ ID NO: 3552482 - RNA, 21 nt, Pseudomonas putida KT2440
cgggguggccggcacugacca

SEQ ID NO: 3552483 - RNA, 18 nt, Pseudomonas putida KT2440
cgggguguccucgaucac

SEQ ID NO: 3552484 - RNA, 15 nt, Pseudomonas putida KT2440
cggggugucugggca

SEQ ID NO: 3552485 - RNA, 15 nt, Pseudomonas putida KT2440
cgggguguggccaau

SEQ ID NO: 3552486 - RNA, 23 nt, Pseudomonas putida KT2440
cgggguuuuuuauugccugccag

SEQ ID NO: 3552487 - RNA, 23 nt, Pseudomonas putida KT2440
cgggguuuuuucuauugcucagu

SEQ ID NO: 3552488 - RNA, 20 nt, Pseudomonas putida KT2440
cggguaaacccccuccugau

SEQ ID NO: 3552489 - RNA, 20 nt, Pseudomonas putida KT2440
cggguaaacccgcgccuaca

SEQ ID NO: 3552490 - RNA, 15 nt, Pseudomonas putida KT2440
cggguaaacccgcuc

SEQ ID NO: 3552491 - RNA, 20 nt, Pseudomonas putida KT2440
cggguaaacccgcucccaca

SEQ ID NO: 3552492 - RNA, 22 nt, Pseudomonas putida KT2440
cggguaaacccgcuccuacaca

SEQ ID NO: 3552493 - RNA, 20 nt, Pseudomonas putida KT2440
cggguaaacccgcuccuacg

SEQ ID NO: 3552494 - RNA, 18 nt, Pseudomonas putida KT2440
cggguaagccaugcgcag

SEQ ID NO: 3552495 - RNA, 14 nt, Pseudomonas putida KT2440
cggguaagcccgcu

SEQ ID NO: 3552496 - RNA, 20 nt, Pseudomonas putida KT2440
cggguaagcccgcuccuaca

SEQ ID NO: 3552497 - RNA, 17 nt, Pseudomonas putida KT2440
cggguaagccggcggcc

SEQ ID NO: 3552498 - RNA, 17 nt, Pseudomonas putida KT2440
cggguaccaccugggcg

SEQ ID NO: 3552499 - RNA, 19 nt, Pseudomonas putida KT2440
cggguaccaccugggcgcu

SEQ ID NO: 3552500 - RNA, 17 nt, Pseudomonas putida KT2440
cggguacccgcguuggc

SEQ ID NO: 3552501 - RNA, 14 nt, Pseudomonas putida KT2440
cggguacuccacca

SEQ ID NO: 3552502 - RNA, 16 nt, Pseudomonas putida KT2440
cggguacuccaccacc

SEQ ID NO: 3552503 - RNA, 17 nt, Pseudomonas putida KT2440
cggguacuucucgacca

SEQ ID NO: 3552504 - RNA, 22 nt, Pseudomonas putida KT2440
cggguaggucaccaucagccgc

SEQ ID NO: 3552505 - RNA, 14 nt, Pseudomonas putida KT2440
cggguaguccggca

SEQ ID NO: 3552506 - RNA, 17 nt, Pseudomonas putida KT2440
cggguaguccuccaaca

SEQ ID NO: 3552507 - RNA, 22 nt, Pseudomonas putida KT2440
cggguaguugcccggguacagc

SEQ ID NO: 3552508 - RNA, 19 nt, Pseudomonas putida KT2440
cggguauagccaugcaccg

SEQ ID NO: 3552509 - RNA, 16 nt, Pseudomonas putida KT2440
cgggucaaggccagcg

SEQ ID NO: 3552510 - RNA, 19 nt, Pseudomonas putida KT2440
cgggucaaggccagcgccu

SEQ ID NO: 3552511 - RNA, 12 nt, Pseudomonas putida KT2440
cgggucaccacg

SEQ ID NO: 3552512 - RNA, 15 nt, Pseudomonas putida KT2440
cgggucacgcuccuu

SEQ ID NO: 3552513 - RNA, 17 nt, Pseudomonas putida KT2440
cgggucacgcuccuucg

SEQ ID NO: 3552514 - RNA, 19 nt, Pseudomonas putida KT2440
cgggucacgcuccuucgcc

SEQ ID NO: 3552515 - RNA, 22 nt, Pseudomonas putida KT2440
cgggucacgcuccuucgccacg

SEQ ID NO: 3552516 - RNA, 16 nt, Pseudomonas putida KT2440
cgggucacggcugaag

SEQ ID NO: 3552517 - RNA, 16 nt, Pseudomonas putida KT2440
cgggucacugcgcgcc

SEQ ID NO: 3552518 - RNA, 16 nt, Pseudomonas putida KT2440
cgggucagccugccau

SEQ ID NO: 3552519 - RNA, 13 nt, Pseudomonas putida KT2440
cgggucagcucgc

SEQ ID NO: 3552520 - RNA, 17 nt, Pseudomonas putida KT2440
cgggucaggccgaugcg

SEQ ID NO: 3552521 - RNA, 13 nt, Pseudomonas putida KT2440
cgggucaggcgca

SEQ ID NO: 3552522 - RNA, 16 nt, Pseudomonas putida KT2440
cgggucauccggccga

SEQ ID NO: 3552523 - RNA, 13 nt, Pseudomonas putida KT2440
cggucaugcccgg

SEQ ID NO: 3552524 - RNA, 14 nt, Pseudomonas putida KT2440
cggucaugcccgga

SEQ ID NO: 3552525 - RNA, 17 nt, Pseudomonas putida KT2440
cggucaugcucagcugg

SEQ ID NO: 3552526 - RNA, 22 nt, Pseudomonas putida KT2440
cggucauggucaacagcccggu

SEQ ID NO: 3552527 - RNA, 15 nt, Pseudomonas putida KT2440
cgguccaccgccagu

SEQ ID NO: 3552528 - RNA, 12 nt, Pseudomonas putida KT2440
cgguccaucagg

SEQ ID NO: 3552529 - RNA, 16 nt, Pseudomonas putida KT2440
cgguccauguaggagc

SEQ ID NO: 3552530 - RNA, 19 nt, Pseudomonas putida KT2440
cggucccaauaauaaaaaa

SEQ ID NO: 3552531 - RNA, 17 nt, Pseudomonas putida KT2440
cggucccgcccggccug

SEQ ID NO: 3552532 - RNA, 15 nt, Pseudomonas putida KT2440
cggucccgcccucca

SEQ ID NO: 3552533 - RNA, 18 nt, Pseudomonas putida KT2440
cggucccgcccuccagcc

SEQ ID NO: 3552534 - RNA, 13 nt, Pseudomonas putida KT2440
cgguccuggucgc

SEQ ID NO: 3552535 - RNA, 19 nt, Pseudomonas putida KT2440
cgguccuggucgcgggcca

SEQ ID NO: 3552536 - RNA, 17 nt, Pseudomonas putida KT2440
cggucgaaaagccgcgg

SEQ ID NO: 3552537 - RNA, 13 nt, Pseudomonas putida KT2440
cggucgaucagcu

SEQ ID NO: 3552538 - RNA, 17 nt, Pseudomonas putida KT2440
cggucgaucuucgccgg

SEQ ID NO: 3552539 - RNA, 20 nt, Pseudomonas putida KT2440
cggucgaucuucgccggcau

SEQ ID NO: 3552540 - RNA, 23 nt, Pseudomonas putida KT2440
cggucgaugauggucgcgacgau

SEQ ID NO: 3552541 - RNA, 22 nt, Pseudomonas putida KT2440
cggucgccaaauucgaccagca

SEQ ID NO: 3552542 - RNA, 18 nt, Pseudomonas putida KT2440
cggucgccaaccccacgc

SEQ ID NO: 3552543 - RNA, 14 nt, Pseudomonas putida KT2440
cggucgccgagccg

SEQ ID NO: 3552544 - RNA, 17 nt, Pseudomonas putida KT2440
cggucgcggcggcaacg

SEQ ID NO: 3552545 - RNA, 23 nt, Pseudomonas putida KT2440
cggucggaaggggccgcaaagcg

SEQ ID NO: 3552546 - RNA, 14 nt, Pseudomonas putida KT2440
cggucggagagacc

SEQ ID NO: 3552547 - RNA, 22 nt, Pseudomonas putida KT2440
cggucggcaguuugccgaugau

SEQ ID NO: 3552548 - RNA, 17 nt, Pseudomonas putida KT2440
cggucggccagcggcac

SEQ ID NO: 3552549 - RNA, 18 nt, Pseudomonas putida KT2440
cggucggccccucgacca

SEQ ID NO: 3552550 - RNA, 14 nt, Pseudomonas putida KT2440
cggucggccugcac

SEQ ID NO: 3552551 - RNA, 22 nt, Pseudomonas putida KT2440
cggucggccugcgcuccagcag

SEQ ID NO: 3552552 - RNA, 21 nt, Pseudomonas putida KT2440
cggucggcguccacugcaccc

SEQ ID NO: 3552553 - RNA, 23 nt, Pseudomonas putida KT2440
cggucggcguccacugcacccgu

SEQ ID NO: 3552554 - RNA, 19 nt, Pseudomonas putida KT2440
cggucggugaaaccacccc

SEQ ID NO: 3552555 - RNA, 16 nt, Pseudomonas putida KT2440
cggucguuacccacca

SEQ ID NO: 3552556 - RNA, 18 nt, Pseudomonas putida KT2440
cggucguuacccaccagc

SEQ ID NO: 3552557 - RNA, 21 nt, Pseudomonas putida KT2440
cggucguuacccaccagcucc

SEQ ID NO: 3552558 - RNA, 19 nt, Pseudomonas putida KT2440
cggucguugaucggcuuga

SEQ ID NO: 3552559 - RNA, 21 nt, Pseudomonas putida KT2440
cggucucgaucuaugcccggc

SEQ ID NO: 3552560 - RNA, 17 nt, Pseudomonas putida KT2440
cggucucggugcuccuu

SEQ ID NO: 3552561 - RNA, 13 nt, Pseudomonas putida KT2440
cggucugccggca

SEQ ID NO: 3552562 - RNA, 14 nt, Pseudomonas putida KT2440
cggucugccggcac

SEQ ID NO: 3552563 - RNA, 20 nt, Pseudomonas putida KT2440
cggucuuggccgcaauggcg

SEQ ID NO: 3552564 - RNA, 18 nt, Pseudomonas putida KT2440
cggucuuuuccccuuaua

SEQ ID NO: 3552565 - RNA, 16 nt, Pseudomonas putida KT2440
cggugaaaccaccccg

SEQ ID NO: 3552566 - RNA, 20 nt, Pseudomonas putida KT2440
cggugaacagguugcgcgcc

SEQ ID NO: 3552567 - RNA, 14 nt, Pseudomonas putida KT2440
cggugacacugcca

SEQ ID NO: 3552568 - RNA, 18 nt, Pseudomonas putida KT2440
cggugaccagcggcagca

SEQ ID NO: 3552569 - RNA, 12 nt, Pseudomonas putida KT2440
cggugacgaccu

SEQ ID NO: 3552570 - RNA, 20 nt, Pseudomonas putida KT2440
cggugacgaccucggccagg

SEQ ID NO: 3552571 - RNA, 17 nt, Pseudomonas putida KT2440
cggugacgaucaccagg

SEQ ID NO: 3552572 - RNA, 16 nt, Pseudomonas putida KT2440
cggugaguaaagccgc

SEQ ID NO: 3552573 - RNA, 21 nt, Pseudomonas putida KT2440
cggugauaugcguacccggcu

SEQ ID NO: 3552574 - RNA, 16 nt, Pseudomonas putida KT2440
cggugcacccacuggc

SEQ ID NO: 3552575 - RNA, 21 nt, Pseudomonas putida KT2440
cggugcacccacuggccgaca

SEQ ID NO: 3552576 - RNA, 17 nt, Pseudomonas putida KT2440
cggugcacggccugcau

SEQ ID NO: 3552577 - RNA, 20 nt, Pseudomonas putida KT2440
cggugcacggccugcaucca

SEQ ID NO: 3552578 - RNA, 21 nt, Pseudomonas putida KT2440
cggugcagaacguacuggccg

SEQ ID NO: 3552579 - RNA, 12 nt, Pseudomonas putida KT2440
cggugcagaccu

SEQ ID NO: 3552580 - RNA, 18 nt, Pseudomonas putida KT2440
cggugcagauugcccugu

SEQ ID NO: 3552581 - RNA, 15 nt, Pseudomonas putida KT2440
cggugcagcaccucc

SEQ ID NO: 3552582 - RNA, 19 nt, Pseudomonas putida KT2440
cggugcagcaccuccaccu

SEQ ID NO: 3552583 - RNA, 15 nt, Pseudomonas putida KT2440
cggugcagcggcaga

SEQ ID NO: 3552584 - RNA, 11 nt, Pseudomonas putida KT2440
cggugcaugcg

SEQ ID NO: 3552585 - RNA, 14 nt, Pseudomonas putida KT2440
cggugcaugcgcac

SEQ ID NO: 3552586 - RNA, 17 nt, Pseudomonas putida KT2440
cggugccaauaaccggc

SEQ ID NO: 3552587 - RNA, 19 nt, Pseudomonas putida KT2440
cggugccaauaaccggcac

SEQ ID NO: 3552588 - RNA, 21 nt, Pseudomonas putida KT2440
cggugccacccaaggcaucca

SEQ ID NO: 3552589 - RNA, 17 nt, Pseudomonas putida KT2440
cggugccauccaccgcg

SEQ ID NO: 3552590 - RNA, 13 nt, Pseudomonas putida KT2440
cggugcccacugc

SEQ ID NO: 3552591 - RNA, 18 nt, Pseudomonas putida KT2440
cggugcccacugcagcca

SEQ ID NO: 3552592 - RNA, 22 nt, Pseudomonas putida KT2440
cggugcccacugcagccauuca

SEQ ID NO: 3552593 - RNA, 20 nt, Pseudomonas putida KT2440
cggugccccgguccagcaca

SEQ ID NO: 3552594 - RNA, 22 nt, Pseudomonas putida KT2440
cggugcccuugccgccccgugc

SEQ ID NO: 3552595 - RNA, 22 nt, Pseudomonas putida KT2440
cggugccgaagucauccauggc

SEQ ID NO: 3552596 - RNA, 18 nt, Pseudomonas putida KT2440
cggugccgccugggucag

SEQ ID NO: 3552597 - RNA, 23 nt, Pseudomonas putida KT2440
cggugccgccugggucaggcgua

SEQ ID NO: 3552598 - RNA, 22 nt, Pseudomonas putida KT2440
cggugccggccaaucgaucugc

SEQ ID NO: 3552599 - RNA, 14 nt, Pseudomonas putida KT2440
cggugccggcgagu

SEQ ID NO: 3552600 - RNA, 12 nt, Pseudomonas putida KT2440
cggugcgcugcu

SEQ ID NO: 3552601 - RNA, 19 nt, Pseudomonas putida KT2440
cggugcggcgacagggcga

SEQ ID NO: 3552602 - RNA, 17 nt, Pseudomonas putida KT2440
cggugcguacucgacca

SEQ ID NO: 3552603 - RNA, 20 nt, Pseudomonas putida KT2440
cggugcguaggagcgggucu

SEQ ID NO: 3552604 - RNA, 21 nt, Pseudomonas putida KT2440
cggugcguaggagcgggucua

SEQ ID NO: 3552605 - RNA, 15 nt, Pseudomonas putida KT2440
cggugcucaggcuca

SEQ ID NO: 3552606 - RNA, 15 nt, Pseudomonas putida KT2440
cggugcuccuuuauu

SEQ ID NO: 3552607 - RNA, 15 nt, Pseudomonas putida KT2440
cggugcugcugccau

SEQ ID NO: 3552608 - RNA, 15 nt, Pseudomonas putida KT2440
cgguggaagcuggcu

SEQ ID NO: 3552609 - RNA, 17 nt, Pseudomonas putida KT2440
cgguggaguaccugugg

SEQ ID NO: 3552610 - RNA, 19 nt, Pseudomonas putida KT2440
cgguggcaauggccugcau

SEQ ID NO: 3552611 - RNA, 20 nt, Pseudomonas putida KT2440
cgguggccgcguaccagcag

SEQ ID NO: 3552612 - RNA, 15 nt, Pseudomonas putida KT2440
cgguggcggcagcaa

SEQ ID NO: 3552613 - RNA, 15 nt, Pseudomonas putida KT2440
cgguggcggccagcg

SEQ ID NO: 3552614 - RNA, 15 nt, Pseudomonas putida KT2440
cgguggcguggccac

SEQ ID NO: 3552615 - RNA, 13 nt, Pseudomonas putida KT2440
cgguggcucacau

SEQ ID NO: 3552616 - RNA, 12 nt, Pseudomonas putida KT2440
cgguggcucucc

SEQ ID NO: 3552617 - RNA, 18 nt, Pseudomonas putida KT2440
cgguggcucuccucuccc

SEQ ID NO: 3552618 - RNA, 14 nt, Pseudomonas putida KT2440
cgguggcugccagc

SEQ ID NO: 3552619 - RNA, 22 nt, Pseudomonas putida KT2440
cgguggcugccagcgcgcugcg

SEQ ID NO: 3552620 - RNA, 18 nt, Pseudomonas putida KT2440
cggugggcaacagcugcg

SEQ ID NO: 3552621 - RNA, 15 nt, Pseudomonas putida KT2440
cgguggucaccagca

SEQ ID NO: 3552622 - RNA, 13 nt, Pseudomonas putida KT2440
cgguggucagcuc

SEQ ID NO: 3552623 - RNA, 15 nt, Pseudomonas putida KT2440
cgguggugaaauggu

SEQ ID NO: 3552624 - RNA, 15 nt, Pseudomonas putida KT2440
cgguguaccauccag

SEQ ID NO: 3552625 - RNA, 16 nt, Pseudomonas putida KT2440
cgguguagaacggcag

SEQ ID NO: 3552626 - RNA, 13 nt, Pseudomonas putida KT2440
cgguguccuugca

SEQ ID NO: 3552627 - RNA, 20 nt, Pseudomonas putida KT2440
cggugucggccagcugcgca

SEQ ID NO: 3552628 - RNA, 15 nt, Pseudomonas putida KT2440
cguauucgcggguaa

SEQ ID NO: 3552629 - RNA, 17 nt, Pseudomonas putida KT2440
cguauucgcggguaaac

SEQ ID NO: 3552630 - RNA, 17 nt, Pseudomonas putida KT2440
cgucaaacagccgccca

SEQ ID NO: 3552631 - RNA, 19 nt, Pseudomonas putida KT2440
cgucaaccaggcgcagcag

SEQ ID NO: 3552632 - RNA, 20 nt, Pseudomonas putida KT2440
cgucaaccaggcgcagcagc

SEQ ID NO: 3552633 - RNA, 18 nt, Pseudomonas putida KT2440
cgucaaccgaacccgcug

SEQ ID NO: 3552634 - RNA, 18 nt, Pseudomonas putida KT2440
cgucaaccgugcccgccc

SEQ ID NO: 3552635 - RNA, 15 nt, Pseudomonas putida KT2440
cgucaacgaggccgc

SEQ ID NO: 3552636 - RNA, 24 nt, Pseudomonas putida KT2440
cgucaacggguauuucaaagaucu

SEQ ID NO: 3552637 - RNA, 13 nt, Pseudomonas putida KT2440
cgucaagcucuuc

SEQ ID NO: 3552638 - RNA, 17 nt, Pseudomonas putida KT2440
cgucaagguugcucagg

SEQ ID NO: 3552639 - RNA, 19 nt, Pseudomonas putida KT2440
cgucaaguacuugcaggug

SEQ ID NO: 3552640 - RNA, 21 nt, Pseudomonas putida KT2440
cgucaauaccggugccccggu

SEQ ID NO: 3552641 - RNA, 22 nt, Pseudomonas putida KT2440
cgucaauaccggugccccgguc

SEQ ID NO: 3552642 - RNA, 23 nt, Pseudomonas putida KT2440
cgucacaucgguuucgccggugu

SEQ ID NO: 3552643 - RNA, 14 nt, Pseudomonas putida KT2440
cgucacaugcgcca

SEQ ID NO: 3552644 - RNA, 18 nt, Pseudomonas putida KT2440
cgucacaugcgccacacc

SEQ ID NO: 3552645 - RNA, 19 nt, Pseudomonas putida KT2440
cgucacaugcgccacaccc

SEQ ID NO: 3552646 - RNA, 14 nt, Pseudomonas putida KT2440
cgucacccacuuca

SEQ ID NO: 3552647 - RNA, 16 nt, Pseudomonas putida KT2440
cgucacccacuucaau

SEQ ID NO: 3552648 - RNA, 23 nt, Pseudomonas putida KT2440
cgucaccccucggcucacgcccc

SEQ ID NO: 3552649 - RNA, 20 nt, Pseudomonas putida KT2440
cgucacccgcgccaccagcc

SEQ ID NO: 3552650 - RNA, 15 nt, Pseudomonas putida KT2440
cgucaccgccccagc

SEQ ID NO: 3552651 - RNA, 18 nt, Pseudomonas putida KT2440
cgucaccgccccagcgcg

SEQ ID NO: 3552652 - RNA, 19 nt, Pseudomonas putida KT2440
cgucaccgccccagcgcgc

SEQ ID NO: 3552653 - RNA, 21 nt, Pseudomonas putida KT2440
cgucaccgccccagcgcgcca

SEQ ID NO: 3552654 - RNA, 17 nt, Pseudomonas putida KT2440
cgucaccgccgccuggg

SEQ ID NO: 3552655 - RNA, 23 nt, Pseudomonas putida KT2440
cgucaccgccgccugggucaacc

SEQ ID NO: 3552656 - RNA, 14 nt, Pseudomonas putida KT2440
cgucaccugacaca

SEQ ID NO: 3552657 - RNA, 20 nt, Pseudomonas putida KT2440
cgucaccugacacauaggca

SEQ ID NO: 3552658 - RNA, 14 nt, Pseudomonas putida KT2440
cgucaccuugcuga

SEQ ID NO: 3552659 - RNA, 20 nt, Pseudomonas putida KT2440
cgucacguuuuuugggagcg

SEQ ID NO: 3552660 - RNA, 13 nt, Pseudomonas putida KT2440
cgucacugacccu

SEQ ID NO: 3552661 - RNA, 16 nt, Pseudomonas putida KT2440
cgucacugcagaucac

SEQ ID NO: 3552662 - RNA, 18 nt, Pseudomonas putida KT2440
cgucacugcagaucacca

SEQ ID NO: 3552663 - RNA, 12 nt, Pseudomonas putida KT2440
cgucacugccca

SEQ ID NO: 3552664 - RNA, 15 nt, Pseudomonas putida KT2440
cgucacuggcugcug

SEQ ID NO: 3552665 - RNA, 16 nt, Pseudomonas putida KT2440
cgucagcagcaggcgc

SEQ ID NO: 3552666 - RNA, 17 nt, Pseudomonas putida KT2440
cgucagcauccaacccu

SEQ ID NO: 3552667 - RNA, 22 nt, Pseudomonas putida KT2440
cgucagccccuagcgcauccug

SEQ ID NO: 3552668 - RNA, 18 nt, Pseudomonas putida KT2440
cgucagccguugaccagg

SEQ ID NO: 3552669 - RNA, 16 nt, Pseudomonas putida KT2440
cgucagcuacgcgagu

SEQ ID NO: 3552670 - RNA, 18 nt, Pseudomonas putida KT2440
cgucagcucaggccuugc

SEQ ID NO: 3552671 - RNA, 13 nt, Pseudomonas putida KT2440
cgucagcuugcaa

SEQ ID NO: 3552672 - RNA, 14 nt, Pseudomonas putida KT2440
cgucagcuugcaac

SEQ ID NO: 3552673 - RNA, 16 nt, Pseudomonas putida KT2440
cgucaggccaugcccu

SEQ ID NO: 3552674 - RNA, 13 nt, Pseudomonas putida KT2440
cgucaggcucagc

SEQ ID NO: 3552675 - RNA, 14 nt, Pseudomonas putida KT2440
cgucaggcuucauc

SEQ ID NO: 3552676 - RNA, 22 nt, Pseudomonas putida KT2440
cgucagguucaagccuacgccc

SEQ ID NO: 3552677 - RNA, 17 nt, Pseudomonas putida KT2440
cgucaguucggcggccc

SEQ ID NO: 3552678 - RNA, 16 nt, Pseudomonas putida KT2440
cgucauccaccgcccc

SEQ ID NO: 3552679 - RNA, 17 nt, Pseudomonas putida KT2440
cgucauccaccgcccca

SEQ ID NO: 3552680 - RNA, 15 nt, Pseudomonas putida KT2440
cgucauccgccaaca

SEQ ID NO: 3552681 - RNA, 19 nt, Pseudomonas putida KT2440
cgucaucgaaccguucacg

SEQ ID NO: 3552682 - RNA, 18 nt, Pseudomonas putida KT2440
cgucaugcgguacagcac

SEQ ID NO: 3552683 - RNA, 19 nt, Pseudomonas putida KT2440
cgucaugcucaugcgcggc

SEQ ID NO: 3552684 - RNA, 16 nt, Pseudomonas putida KT2440
cgucaugguggugccg

SEQ ID NO: 3552685 - RNA, 20 nt, Pseudomonas putida KT2440
cgucaugguggugccguugg

SEQ ID NO: 3552686 - RNA, 14 nt, Pseudomonas putida KT2440
cguccaacgggcgg

SEQ ID NO: 3552687 - RNA, 12 nt, Pseudomonas putida KT2440
cguccaauagcc

SEQ ID NO: 3552688 - RNA, 19 nt, Pseudomonas putida KT2440
cguccaaugccgccuugca

SEQ ID NO: 3552689 - RNA, 14 nt, Pseudomonas putida KT2440
cguccacaaacccc

SEQ ID NO: 3552690 - RNA, 20 nt, Pseudomonas putida KT2440
cguccacuaccuccagcccg

SEQ ID NO: 3552691 - RNA, 15 nt, Pseudomonas putida KT2440
cguccagcagugcca

SEQ ID NO: 3552692 - RNA, 16 nt, Pseudomonas putida KT2440
cguccagcccggucca

SEQ ID NO: 3552693 - RNA, 16 nt, Pseudomonas putida KT2440
cguccagcugagcgcc

SEQ ID NO: 3552694 - RNA, 21 nt, Pseudomonas putida KT2440
cguccagcugagcgccaucca

SEQ ID NO: 3552695 - RNA, 18 nt, Pseudomonas putida KT2440
cguccaggaacgcugccu

SEQ ID NO: 3552696 - RNA, 13 nt, Pseudomonas putida KT2440
cguccaggcucag

SEQ ID NO: 3552697 - RNA, 16 nt, Pseudomonas putida KT2440
cguccagggcagguca

SEQ ID NO: 3552698 - RNA, 15 nt, Pseudomonas putida KT2440
cguccagguccaggc

SEQ ID NO: 3552699 - RNA, 17 nt, Pseudomonas putida KT2440
cguccagguccaggcca

SEQ ID NO: 3552700 - RNA, 20 nt, Pseudomonas putida KT2440
cguccaguuggcggcgcagc

SEQ ID NO: 3552701 - RNA, 15 nt, Pseudomonas putida KT2440
cguccaucaccgcca

SEQ ID NO: 3552702 - RNA, 17 nt, Pseudomonas putida KT2440
cguccaucuugcugcuc

SEQ ID NO: 3552703 - RNA, 20 nt, Pseudomonas putida KT2440
cguccaucuugcugcucugc

SEQ ID NO: 3552704 - RNA, 16 nt, Pseudomonas putida KT2440
cgucccagcaggcaca

SEQ ID NO: 3552705 - RNA, 17 nt, Pseudomonas putida KT2440
cgucccgaaagggccgc

SEQ ID NO: 3552706 - RNA, 18 nt, Pseudomonas putida KT2440
cgucccgaaagggccgca

SEQ ID NO: 3552707 - RNA, 17 nt, Pseudomonas putida KT2440
cgucccugcccgaucgc

SEQ ID NO: 3552708 - RNA, 22 nt, Pseudomonas putida KT2440
cgucccugcccgaucgccucgc

SEQ ID NO: 3552709 - RNA, 16 nt, Pseudomonas putida KT2440
cguccgcaaaucccug

SEQ ID NO: 3552710 - RNA, 13 nt, Pseudomonas putida KT2440
cguccgccgcgcu

SEQ ID NO: 3552711 - RNA, 16 nt, Pseudomonas putida KT2440
cguccgccgcgcugac

SEQ ID NO: 3552712 - RNA, 17 nt, Pseudomonas putida KT2440
cguccggcaaucugccc

SEQ ID NO: 3552713 - RNA, 13 nt, Pseudomonas putida KT2440
cguccggccagca

SEQ ID NO: 3552714 - RNA, 15 nt, Pseudomonas putida KT2440
cguccgggcgccagg

SEQ ID NO: 3552715 - RNA, 24 nt, Pseudomonas putida KT2440
cguccucaugggugucggcauaca

SEQ ID NO: 3552716 - RNA, 19 nt, Pseudomonas putida KT2440
cguccucgacccacggcug

SEQ ID NO: 3552717 - RNA, 17 nt, Pseudomonas putida KT2440
cguccuggucacggcca

SEQ ID NO: 3552718 - RNA, 17 nt, Pseudomonas putida KT2440
cguccuugacgaugacc

SEQ ID NO: 3552719 - RNA, 18 nt, Pseudomonas putida KT2440
cguccuugccguccaggu

SEQ ID NO: 3552720 - RNA, 21 nt, Pseudomonas putida KT2440
cguccuugccguccaggucca

SEQ ID NO: 3552721 - RNA, 18 nt, Pseudomonas putida KT2440
cgucgaacgaguccgggc

SEQ ID NO: 3552722 - RNA, 16 nt, Pseudomonas putida KT2440
cgucgaacucgcgccc

SEQ ID NO: 3552723 - RNA, 20 nt, Pseudomonas putida KT2440
cgucgaaugcgacugaggca

SEQ ID NO: 3552724 - RNA, 22 nt, Pseudomonas putida KT2440
cgucgacaaaccgcacccggcu

SEQ ID NO: 3552725 - RNA, 22 nt, Pseudomonas putida KT2440
cgucgacaacgcacccgccucc

SEQ ID NO: 3552726 - RNA, 20 nt, Pseudomonas putida KT2440
cgucgacaccguugcagucg

SEQ ID NO: 3552727 - RNA, 12 nt, Pseudomonas putida KT2440
cgucgaccaccg

SEQ ID NO: 3552728 - RNA, 17 nt, Pseudomonas putida KT2440
cgucgaccaggcauugu

SEQ ID NO: 3552729 - RNA, 18 nt, Pseudomonas putida KT2440
cgucgaccgccgccuggc

SEQ ID NO: 3552730 - RNA, 20 nt, Pseudomonas putida KT2440
cgucgacucgaugccaucga

SEQ ID NO: 3552731 - RNA, 20 nt, Pseudomonas putida KT2440
cgucgacucuucccaccacc

SEQ ID NO: 3552732 - RNA, 19 nt, Pseudomonas putida KT2440
cgucgagcaacuugcgcag

SEQ ID NO: 3552733 - RNA, 15 nt, Pseudomonas putida KT2440
cgugcauguagccaa

SEQ ID NO: 3552734 - RNA, 19 nt, Pseudomonas putida KT2440
cgugcauguccugaagcag

SEQ ID NO: 3552735 - RNA, 23 nt, Pseudomonas putida KT2440
cgugccagagaauuucuccccag

SEQ ID NO: 3552736 - RNA, 16 nt, Pseudomonas putida KT2440
cgugccauccaccgcg

SEQ ID NO: 3552737 - RNA, 14 nt, Pseudomonas putida KT2440
cgugcccaccagcg

SEQ ID NO: 3552738 - RNA, 19 nt, Pseudomonas putida KT2440
cgugcccgcccacgccgcu

SEQ ID NO: 3552739 - RNA, 21 nt, Pseudomonas putida KT2440
cgugcccgcgaagagggcgac

SEQ ID NO: 3552740 - RNA, 21 nt, Pseudomonas putida KT2440
cgugcccgcgaagggccgcga

SEQ ID NO: 3552741 - RNA, 22 nt, Pseudomonas putida KT2440
cgugcccgcgaagggcugccgc

SEQ ID NO: 3552742 - RNA, 21 nt, Pseudomonas putida KT2440
cgugcccggcaaucgccaggc

SEQ ID NO: 3552743 - RNA, 23 nt, Pseudomonas putida KT2440
cgugcccggcauccgccucaucc

SEQ ID NO: 3552744 - RNA, 16 nt, Pseudomonas putida KT2440
cgugcccugaacaggg

SEQ ID NO: 3552745 - RNA, 16 nt, Pseudomonas putida KT2440
cgugccgcaucagccg

SEQ ID NO: 3552746 - RNA, 14 nt, Pseudomonas putida KT2440
cgugccgcaugugc

SEQ ID NO: 3552747 - RNA, 16 nt, Pseudomonas putida KT2440
cgugccggaacaaccc

SEQ ID NO: 3552748 - RNA, 21 nt, Pseudomonas putida KT2440
cgugccggaacaaccccuugc

SEQ ID NO: 3552749 - RNA, 16 nt, Pseudomonas putida KT2440
cgugccucgcccaggu

SEQ ID NO: 3552750 - RNA, 19 nt, Pseudomonas putida KT2440
cgugccucgcccaggucaa

SEQ ID NO: 3552751 - RNA, 14 nt, Pseudomonas putida KT2440
cgugccugcugcuc

SEQ ID NO: 3552752 - RNA, 17 nt, Pseudomonas putida KT2440
cgugccugcugcucgcu

SEQ ID NO: 3552753 - RNA, 19 nt, Pseudomonas putida KT2440
cgugccugguugcccaugc

SEQ ID NO: 3552754 - RNA, 15 nt, Pseudomonas putida KT2440
cgugccuucaccagc

SEQ ID NO: 3552755 - RNA, 16 nt, Pseudomonas putida KT2440
cgugccuucaccagcu

SEQ ID NO: 3552756 - RNA, 14 nt, Pseudomonas putida KT2440
cgugccuuccagcu

SEQ ID NO: 3552757 - RNA, 20 nt, Pseudomonas putida KT2440
cgugccuugccugggccggu

SEQ ID NO: 3552758 - RNA, 18 nt, Pseudomonas putida KT2440
cgugcgccuaucaggccu

SEQ ID NO: 3552759 - RNA, 16 nt, Pseudomonas putida KT2440
cgugcgccucaugcag

SEQ ID NO: 3552760 - RNA, 19 nt, Pseudomonas putida KT2440
cgugcgccucaugcagcac

SEQ ID NO: 3552761 - RNA, 21 nt, Pseudomonas putida KT2440
cgugcgccucaugcagcaccu

SEQ ID NO: 3552762 - RNA, 15 nt, Pseudomonas putida KT2440
cgugcgcgaucagcg

SEQ ID NO: 3552763 - RNA, 17 nt, Pseudomonas putida KT2440
cgugcgcgaucagcgca

SEQ ID NO: 3552764 - RNA, 12 nt, Pseudomonas putida KT2440
cgugcgcggcau

SEQ ID NO: 3552765 - RNA, 19 nt, Pseudomonas putida KT2440
cgugcggccaaagcuguug

SEQ ID NO: 3552766 - RNA, 15 nt, Pseudomonas putida KT2440
cgugcgggcccccuc

SEQ ID NO: 3552767 - RNA, 17 nt, Pseudomonas putida KT2440
cgugcuacgcgcggggu

SEQ ID NO: 3552768 - RNA, 14 nt, Pseudomonas putida KT2440
cgugcucaggcggc

SEQ ID NO: 3552769 - RNA, 18 nt, Pseudomonas putida KT2440
cgugcucaggcggccaaa

SEQ ID NO: 3552770 - RNA, 13 nt, Pseudomonas putida KT2440
cgugcucgcgcau

SEQ ID NO: 3552771 - RNA, 14 nt, Pseudomonas putida KT2440
cgugcugcaggcug

SEQ ID NO: 3552772 - RNA, 19 nt, Pseudomonas putida KT2440
cgugcugcaggcuggcaau

SEQ ID NO: 3552773 - RNA, 19 nt, Pseudomonas putida KT2440
cgugcugccggucggccug

SEQ ID NO: 3552774 - RNA, 17 nt, Pseudomonas putida KT2440
cgugcugguccuccccu

SEQ ID NO: 3552775 - RNA, 22 nt, Pseudomonas putida KT2440
cgugcuguugagccagggcgcu

SEQ ID NO: 3552776 - RNA, 14 nt, Pseudomonas putida KT2440
cgugcuuccaccuc

SEQ ID NO: 3552777 - RNA, 12 nt, Pseudomonas putida KT2440
cguggacagcag

SEQ ID NO: 3552778 - RNA, 20 nt, Pseudomonas putida KT2440
cguggcaaacccggccagca

SEQ ID NO: 3552779 - RNA, 21 nt, Pseudomonas putida KT2440
cguggcaaacccggccagcag

SEQ ID NO: 3552780 - RNA, 15 nt, Pseudomonas putida KT2440
cguggcaacgccaca

SEQ ID NO: 3552781 - RNA, 18 nt, Pseudomonas putida KT2440
cguggcaaucuucuugcc

SEQ ID NO: 3552782 - RNA, 21 nt, Pseudomonas putida KT2440
cguggcaaucuucuugccggu

SEQ ID NO: 3552783 - RNA, 17 nt, Pseudomonas putida KT2440
cguggcaccggcgaaga

SEQ ID NO: 3552784 - RNA, 20 nt, Pseudomonas putida KT2440
cguggcagcaaucggcagcg

SEQ ID NO: 3552785 - RNA, 15 nt, Pseudomonas putida KT2440
cguggcagccccccc

SEQ ID NO: 3552786 - RNA, 18 nt, Pseudomonas putida KT2440
cguggcagcccccccagc

SEQ ID NO: 3552787 - RNA, 16 nt, Pseudomonas putida KT2440
cguggccacgcccggu

SEQ ID NO: 3552788 - RNA, 16 nt, Pseudomonas putida KT2440
cguggccagcccaagg

SEQ ID NO: 3552789 - RNA, 15 nt, Pseudomonas putida KT2440
cguggccgccaacag

SEQ ID NO: 3552790 - RNA, 16 nt, Pseudomonas putida KT2440
cguggccgccaacagc

SEQ ID NO: 3552791 - RNA, 13 nt, Pseudomonas putida KT2440
cguggccgccaug

SEQ ID NO: 3552792 - RNA, 19 nt, Pseudomonas putida KT2440
cguggccggcaucgcagcg

SEQ ID NO: 3552793 - RNA, 15 nt, Pseudomonas putida KT2440
cguggccuguaccga

SEQ ID NO: 3552794 - RNA, 16 nt, Pseudomonas putida KT2440
cguggcggugaugcgc

SEQ ID NO: 3552795 - RNA, 16 nt, Pseudomonas putida KT2440
cguggcugaugccauc

SEQ ID NO: 3552796 - RNA, 17 nt, Pseudomonas putida KT2440
cguggcugaugccaucg

SEQ ID NO: 3552797 - RNA, 21 nt, Pseudomonas putida KT2440
cguggcuguucgucggccuug

SEQ ID NO: 3552798 - RNA, 21 nt, Pseudomonas putida KT2440
cguggggccugccgguacagc

SEQ ID NO: 3552799 - RNA, 23 nt, Pseudomonas putida KT2440
cguggggucugcccggccagcag

SEQ ID NO: 3552800 - RNA, 20 nt, Pseudomonas putida KT2440
cguggguauugucggucagg

SEQ ID NO: 3552801 - RNA, 17 nt, Pseudomonas putida KT2440
cgugggucaucuugccg

SEQ ID NO: 3552802 - RNA, 15 nt, Pseudomonas putida KT2440
cgugguacgcguggu

SEQ ID NO: 3552803 - RNA, 21 nt, Pseudomonas putida KT2440
cguggucgccgucgcacaggc

SEQ ID NO: 3552804 - RNA, 15 nt, Pseudomonas putida KT2440
cguggucgccuucac

SEQ ID NO: 3552805 - RNA, 17 nt, Pseudomonas putida KT2440
cguggugaauggcgagc

SEQ ID NO: 3552806 - RNA, 19 nt, Pseudomonas putida KT2440
cguggugcgauucgcgcau

SEQ ID NO: 3552807 - RNA, 18 nt, Pseudomonas putida KT2440
cguggugcgggccaccag

SEQ ID NO: 3552808 - RNA, 17 nt, Pseudomonas putida KT2440
cgugguucuugccgagc

SEQ ID NO: 3552809 - RNA, 18 nt, Pseudomonas putida KT2440
cgugguugaugcgcucgu

SEQ ID NO: 3552810 - RNA, 23 nt, Pseudomonas putida KT2440
cgugguugcugauguuggccauc

SEQ ID NO: 3552811 - RNA, 20 nt, Pseudomonas putida KT2440
cgugugacccaguucgcgga

SEQ ID NO: 3552812 - RNA, 21 nt, Pseudomonas putida KT2440
cgugugacccaguucgcggau

SEQ ID NO: 3552813 - RNA, 14 nt, Pseudomonas putida KT2440
cgugugcaggugga

SEQ ID NO: 3552814 - RNA, 23 nt, Pseudomonas putida KT2440
cgugugcugcguuguugggaagc

SEQ ID NO: 3552815 - RNA, 23 nt, Pseudomonas putida KT2440
cguguucaaugccccgaccaccg

SEQ ID NO: 3552816 - RNA, 14 nt, Pseudomonas putida KT2440
cguguucaggcacg

SEQ ID NO: 3552817 - RNA, 17 nt, Pseudomonas putida KT2440
cguguucccagcacccc

SEQ ID NO: 3552818 - RNA, 23 nt, Pseudomonas putida KT2440
cguguucgacgaucgacuucauc

SEQ ID NO: 3552819 - RNA, 13 nt, Pseudomonas putida KT2440
cguguucgccugu

SEQ ID NO: 3552820 - RNA, 18 nt, Pseudomonas putida KT2440
cguguucgcgaggaaacc

SEQ ID NO: 3552821 - RNA, 23 nt, Pseudomonas putida KT2440
cguguucgcgaggaaacccgcgc

SEQ ID NO: 3552822 - RNA, 13 nt, Pseudomonas putida KT2440
cguguugagcaac

SEQ ID NO: 3552823 - RNA, 15 nt, Pseudomonas putida KT2440
cguguuguucgccaa

SEQ ID NO: 3552824 - RNA, 23 nt, Pseudomonas putida KT2440
cguguuguucgccaacuucgccg

SEQ ID NO: 3552825 - RNA, 14 nt, Pseudomonas putida KT2440
cguuacccaccagc

SEQ ID NO: 3552826 - RNA, 15 nt, Pseudomonas putida KT2440
cguuacuguuccagc

SEQ ID NO: 3552827 - RNA, 17 nt, Pseudomonas putida KT2440
cguuaguucgugcaccc

SEQ ID NO: 3552828 - RNA, 14 nt, Pseudomonas putida KT2440
cguuauccugcagc

SEQ ID NO: 3552829 - RNA, 16 nt, Pseudomonas putida KT2440
cguucaacgccguacg

SEQ ID NO: 3552830 - RNA, 13 nt, Pseudomonas putida KT2440
cguucaccggcac

SEQ ID NO: 3552831 - RNA, 14 nt, Pseudomonas putida KT2440
cguucacuguugcc

SEQ ID NO: 3552832 - RNA, 17 nt, Pseudomonas putida KT2440
cguucagcaagaccaga

SEQ ID NO: 3552833 - RNA, 20 nt, Pseudomonas putida KT2440
cguucagcuugucgaccagg

SEQ ID NO: 3552834 - RNA, 16 nt, Pseudomonas putida KT2440
cguucaggcgccugcc

SEQ ID NO: 3552835 - RNA, 14 nt, Pseudomonas putida KT2440
cguucauccccucg

SEQ ID NO: 3552836 - RNA, 15 nt, Pseudomonas putida KT2440
cguucaucgaaggcc

SEQ ID NO: 3552837 - RNA, 22 nt, Pseudomonas putida KT2440
cguucccgccauguugcgcagc

SEQ ID NO: 3552838 - RNA, 22 nt, Pseudomonas putida KT2440
cuacaggccccacaacggccgc

SEQ ID NO: 3552839 - RNA, 14 nt, Pseudomonas putida KT2440
cuacaggccgcccu

SEQ ID NO: 3552840 - RNA, 13 nt, Pseudomonas putida KT2440
cuacaucuucgcg

SEQ ID NO: 3552841 - RNA, 22 nt, Pseudomonas putida KT2440
cuacauggaucgcauugccccu

SEQ ID NO: 3552842 - RNA, 20 nt, Pseudomonas putida KT2440
cuacauggugggucguguag

SEQ ID NO: 3552843 - RNA, 18 nt, Pseudomonas putida KT2440
cuaccaaccugccaugca

SEQ ID NO: 3552844 - RNA, 20 nt, Pseudomonas putida KT2440
cuaccaaccugccaugcagg

SEQ ID NO: 3552845 - RNA, 22 nt, Pseudomonas putida KT2440
cuaccaaccugccaugcagguc

SEQ ID NO: 3552846 - RNA, 18 nt, Pseudomonas putida KT2440
cuaccaacgcagcaugcg

SEQ ID NO: 3552847 - RNA, 19 nt, Pseudomonas putida KT2440
cuaccaacgcagcaugcgg

SEQ ID NO: 3552848 - RNA, 20 nt, Pseudomonas putida KT2440
cuaccaaucuguaccuugcu

SEQ ID NO: 3552849 - RNA, 15 nt, Pseudomonas putida KT2440
cuaccacgccgcugc

SEQ ID NO: 3552850 - RNA, 16 nt, Pseudomonas putida KT2440
cuaccacgccgcugcc

SEQ ID NO: 3552851 - RNA, 19 nt, Pseudomonas putida KT2440
cuaccagcaguuggcugcc

SEQ ID NO: 3552852 - RNA, 14 nt, Pseudomonas putida KT2440
cuaccagcuugccg

SEQ ID NO: 3552853 - RNA, 15 nt, Pseudomonas putida KT2440
cuaccagcuugccgc

SEQ ID NO: 3552854 - RNA, 20 nt, Pseudomonas putida KT2440
cuaccaggcccaacagcgcg

SEQ ID NO: 3552855 - RNA, 22 nt, Pseudomonas putida KT2440
cuaccaugaaaaacaacaacca

SEQ ID NO: 3552856 - RNA, 17 nt, Pseudomonas putida KT2440
cuacccacuccccacuc

SEQ ID NO: 3552857 - RNA, 21 nt, Pseudomonas putida KT2440
cuacccagccgggcaugcagg

SEQ ID NO: 3552858 - RNA, 13 nt, Pseudomonas putida KT2440
cuacccaggcaac

SEQ ID NO: 3552859 - RNA, 13 nt, Pseudomonas putida KT2440
cuacccaggccaa

SEQ ID NO: 3552860 - RNA, 22 nt, Pseudomonas putida KT2440
cuacccccuccuccagcauggc

SEQ ID NO: 3552861 - RNA, 23 nt, Pseudomonas putida KT2440
cuaccccgaugcgcugaucgugc

SEQ ID NO: 3552862 - RNA, 17 nt, Pseudomonas putida KT2440
cuaccccuucauccgcg

SEQ ID NO: 3552863 - RNA, 18 nt, Pseudomonas putida KT2440
cuaccccuucauccgcgg

SEQ ID NO: 3552864 - RNA, 19 nt, Pseudomonas putida KT2440
cuacccgguaaaaccgcuc

SEQ ID NO: 3552865 - RNA, 21 nt, Pseudomonas putida KT2440
cuaccgcguuggacaccaggu

SEQ ID NO: 3552866 - RNA, 14 nt, Pseudomonas putida KT2440
cuaccggcgccacu

SEQ ID NO: 3552867 - RNA, 23 nt, Pseudomonas putida KT2440
cuaccguuggcaucugcugggug

SEQ ID NO: 3552868 - RNA, 14 nt, Pseudomonas putida KT2440
cuaccuccagcccg

SEQ ID NO: 3552869 - RNA, 16 nt, Pseudomonas putida KT2440
cuaccuccagcccggc

SEQ ID NO: 3552870 - RNA, 18 nt, Pseudomonas putida KT2440
cuaccuccagcccggcuu

SEQ ID NO: 3552871 - RNA, 23 nt, Pseudomonas putida KT2440
cuaccuccagcccggcuucacag

SEQ ID NO: 3552872 - RNA, 20 nt, Pseudomonas putida KT2440
cuacgacccugaagcccugg

SEQ ID NO: 3552873 - RNA, 14 nt, Pseudomonas putida KT2440
cuacgagacggugg

SEQ ID NO: 3552874 - RNA, 18 nt, Pseudomonas putida KT2440
cuacgagacgguggcugc

SEQ ID NO: 3552875 - RNA, 14 nt, Pseudomonas putida KT2440
cuacgaucgaauga

SEQ ID NO: 3552876 - RNA, 14 nt, Pseudomonas putida KT2440
cuacgcacccgcac

SEQ ID NO: 3552877 - RNA, 19 nt, Pseudomonas putida KT2440
cuacgcagucagccacauc

SEQ ID NO: 3552878 - RNA, 15 nt, Pseudomonas putida KT2440
cuacgcccccagccu

SEQ ID NO: 3552879 - RNA, 15 nt, Pseudomonas putida KT2440
cuacgccgccccacu

SEQ ID NO: 3552880 - RNA, 15 nt, Pseudomonas putida KT2440
cuacgccguacugcu

SEQ ID NO: 3552881 - RNA, 16 nt, Pseudomonas putida KT2440
cuacgcucguccaggc

SEQ ID NO: 3552882 - RNA, 19 nt, Pseudomonas putida KT2440
cuacgcucguccaggcccu

SEQ ID NO: 3552883 - RNA, 12 nt, Pseudomonas putida KT2440
cuacgcuggacu

SEQ ID NO: 3552884 - RNA, 20 nt, Pseudomonas putida KT2440
cuacgcuggacuugccuugg

SEQ ID NO: 3552885 - RNA, 13 nt, Pseudomonas putida KT2440
cuacggccgacaa

SEQ ID NO: 3552886 - RNA, 19 nt, Pseudomonas putida KT2440
cuacggcgucgacaccguu

SEQ ID NO: 3552887 - RNA, 20 nt, Pseudomonas putida KT2440
cuacgggggggcgcagggug

SEQ ID NO: 3552888 - RNA, 16 nt, Pseudomonas putida KT2440
cuacgugauugacccg

SEQ ID NO: 3552889 - RNA, 19 nt, Pseudomonas putida KT2440
cuacuacggccugugucca

SEQ ID NO: 3552890 - RNA, 13 nt, Pseudomonas putida KT2440
cuacugcgaaugg

SEQ ID NO: 3552891 - RNA, 17 nt, Pseudomonas putida KT2440
cuagaggaucugaaugu

SEQ ID NO: 3552892 - RNA, 13 nt, Pseudomonas putida KT2440
cuagaugcugguu

SEQ ID NO: 3552893 - RNA, 15 nt, Pseudomonas putida KT2440
cuagaugcugguucg

SEQ ID NO: 3552894 - RNA, 13 nt, Pseudomonas putida KT2440
cuagcaaggccuc

SEQ ID NO: 3552895 - RNA, 14 nt, Pseudomonas putida KT2440
cuagccaucgcacc

SEQ ID NO: 3552896 - RNA, 16 nt, Pseudomonas putida KT2440
cuagccaucgcaccac

SEQ ID NO: 3552897 - RNA, 17 nt, Pseudomonas putida KT2440
cuagccggucaccgacc

SEQ ID NO: 3552898 - RNA, 20 nt, Pseudomonas putida KT2440
cuagccucaucagagcguga

SEQ ID NO: 3552899 - RNA, 14 nt, Pseudomonas putida KT2440
cuagcuuggucucg

SEQ ID NO: 3552900 - RNA, 15 nt, Pseudomonas putida KT2440
cuaguacuuuuucag

SEQ ID NO: 3552901 - RNA, 18 nt, Pseudomonas putida KT2440
cuaguacuuuuucagguu

SEQ ID NO: 3552902 - RNA, 18 nt, Pseudomonas putida KT2440
cuaguaugguguuuugca

SEQ ID NO: 3552903 - RNA, 14 nt, Pseudomonas putida KT2440
cuagucaagcugcg

SEQ ID NO: 3552904 - RNA, 22 nt, Pseudomonas putida KT2440
cuauaucucugguacaacaaca

SEQ ID NO: 3552905 - RNA, 17 nt, Pseudomonas putida KT2440
cuaucaggagcaacuac

SEQ ID NO: 3552906 - RNA, 12 nt, Pseudomonas putida KT2440
cuaucagggcug

SEQ ID NO: 3552907 - RNA, 13 nt, Pseudomonas putida KT2440
cuaucccccuuug

SEQ ID NO: 3552908 - RNA, 18 nt, Pseudomonas putida KT2440
cuauccggagcuccccuc

SEQ ID NO: 3552909 - RNA, 16 nt, Pseudomonas putida KT2440
cuauccucgaucgcca

SEQ ID NO: 3552910 - RNA, 23 nt, Pseudomonas putida KT2440
cuauccuucugccguuugcuggc

SEQ ID NO: 3552911 - RNA, 17 nt, Pseudomonas putida KT2440
cuaucgaggggcaggcg

SEQ ID NO: 3552912 - RNA, 22 nt, Pseudomonas putida KT2440
cuaucgcagagggccgcgcagg

SEQ ID NO: 3552913 - RNA, 17 nt, Pseudomonas putida KT2440
cuaucgccagcaggccg

SEQ ID NO: 3552914 - RNA, 18 nt, Pseudomonas putida KT2440
cuaucgcucuggcacuca

SEQ ID NO: 3552915 - RNA, 15 nt, Pseudomonas putida KT2440
cuaucggccagcaaa

SEQ ID NO: 3552916 - RNA, 13 nt, Pseudomonas putida KT2440
cuaucucccagcc

SEQ ID NO: 3552917 - RNA, 14 nt, Pseudomonas putida KT2440
cuaucucccagccu

SEQ ID NO: 3552918 - RNA, 19 nt, Pseudomonas putida KT2440
cuaucucuccgccauacaa

SEQ ID NO: 3552919 - RNA, 19 nt, Pseudomonas putida KT2440
cuaugagacuagcaguccc

SEQ ID NO: 3552920 - RNA, 22 nt, Pseudomonas putida KT2440
cuaugcccggcucaccgcagcc

SEQ ID NO: 3552921 - RNA, 17 nt, Pseudomonas putida KT2440
cuaugccggucagcagc

SEQ ID NO: 3552922 - RNA, 18 nt, Pseudomonas putida KT2440
cuaugccggucagcagca

SEQ ID NO: 3552923 - RNA, 23 nt, Pseudomonas putida KT2440
cuaugcgugaaacgcagcuuugg

SEQ ID NO: 3552924 - RNA, 16 nt, Pseudomonas putida KT2440
cuauggggugagcggc

SEQ ID NO: 3552925 - RNA, 20 nt, Pseudomonas putida KT2440
cuauguacucggcgcucaag

SEQ ID NO: 3552926 - RNA, 15 nt, Pseudomonas putida KT2440
cuauuaaccgcuugg

SEQ ID NO: 3552927 - RNA, 16 nt, Pseudomonas putida KT2440
cuauuaaugcacgccu

SEQ ID NO: 3552928 - RNA, 14 nt, Pseudomonas putida KT2440
cuauugagagcaga

SEQ ID NO: 3552929 - RNA, 20 nt, Pseudomonas putida KT2440
cuauugagagcagaugacuc

SEQ ID NO: 3552930 - RNA, 11 nt, Pseudomonas putida KT2440
cucaaaaaaau

SEQ ID NO: 3552931 - RNA, 21 nt, Pseudomonas putida KT2440
cucaaacaaaaacgccgcccu

SEQ ID NO: 3552932 - RNA, 24 nt, Pseudomonas putida KT2440
cucaaaccauuggugaaagcgcaa

SEQ ID NO: 3552933 - RNA, 20 nt, Pseudomonas putida KT2440
cucaaagcgcaaaaccacca

SEQ ID NO: 3552934 - RNA, 15 nt, Pseudomonas putida KT2440
cucaaaugcuggcaa

SEQ ID NO: 3552935 - RNA, 14 nt, Pseudomonas putida KT2440
cucaacagccacgc

SEQ ID NO: 3552936 - RNA, 20 nt, Pseudomonas putida KT2440
cucaacccgccugacgccgc

SEQ ID NO: 3552937 - RNA, 15 nt, Pseudomonas putida KT2440
cucaacccucgccca

SEQ ID NO: 3552938 - RNA, 18 nt, Pseudomonas putida KT2440
cucaaccggugcaacugc

SEQ ID NO: 3552939 - RNA, 13 nt, Pseudomonas putida KT2440
cucaaccuggauu

SEQ ID NO: 3552940 - RNA, 21 nt, Pseudomonas putida KT2440
cucaaccuuugcggcacaucu

SEQ ID NO: 3552941 - RNA, 23 nt, Pseudomonas putida KT2440
cucaaccuuugcggcacaucuca

SEQ ID NO: 3552942 - RNA, 22 nt, Pseudomonas putida KT2440
cucaacgcaacugcggccccug

SEQ ID NO: 3552943 - RNA, 19 nt, Pseudomonas putida KT2440
cucagcucgucgagcauga

SEQ ID NO: 3552944 - RNA, 14 nt, Pseudomonas putida KT2440
cucagcuggccggc

SEQ ID NO: 3552945 - RNA, 14 nt, Pseudomonas putida KT2440
cucagcugggcguu

SEQ ID NO: 3552946 - RNA, 23 nt, Pseudomonas putida KT2440
cucaggccaguuccucggccuga

SEQ ID NO: 3552947 - RNA, 20 nt, Pseudomonas putida KT2440
cucaggccaugcugcgccag

SEQ ID NO: 3552948 - RNA, 18 nt, Pseudomonas putida KT2440
cucaggcccaccagucug

SEQ ID NO: 3552949 - RNA, 16 nt, Pseudomonas putida KT2440
cucaggccccaggcca

SEQ ID NO: 3552950 - RNA, 16 nt, Pseudomonas putida KT2440
cucaggccugcacugc

SEQ ID NO: 3552951 - RNA, 18 nt, Pseudomonas putida KT2440
cucaggccuucgccacug

SEQ ID NO: 3552952 - RNA, 19 nt, Pseudomonas putida KT2440
cucaggccuucgccacugc

SEQ ID NO: 3552953 - RNA, 14 nt, Pseudomonas putida KT2440
cucaggccuugccg

SEQ ID NO: 3552954 - RNA, 11 nt, Pseudomonas putida KT2440
cucaggcgcuc

SEQ ID NO: 3552955 - RNA, 22 nt, Pseudomonas putida KT2440
cucaggcgcuccagcagggucg

SEQ ID NO: 3552956 - RNA, 21 nt, Pseudomonas putida KT2440
cucaggcggccaaacuggaug

SEQ ID NO: 3552957 - RNA, 16 nt, Pseudomonas putida KT2440
cucaggcucagcucca

SEQ ID NO: 3552958 - RNA, 18 nt, Pseudomonas putida KT2440
cucaggcucagcuccaug

SEQ ID NO: 3552959 - RNA, 22 nt, Pseudomonas putida KT2440
cucaggcucaguugcaagucuc

SEQ ID NO: 3552960 - RNA, 17 nt, Pseudomonas putida KT2440
cucaggcucuugaacug

SEQ ID NO: 3552961 - RNA, 14 nt, Pseudomonas putida KT2440
cucaggcugagcag

SEQ ID NO: 3552962 - RNA, 22 nt, Pseudomonas putida KT2440
cucagggcagcaacgccgagca

SEQ ID NO: 3552963 - RNA, 19 nt, Pseudomonas putida KT2440
cucaggggcauugcgcugg

SEQ ID NO: 3552964 - RNA, 18 nt, Pseudomonas putida KT2440
cucagggguaaugcccca

SEQ ID NO: 3552965 - RNA, 16 nt, Pseudomonas putida KT2440
cucaggugcacagggc

SEQ ID NO: 3552966 - RNA, 16 nt, Pseudomonas putida KT2440
cucagguggcugucug

SEQ ID NO: 3552967 - RNA, 19 nt, Pseudomonas putida KT2440
cucagguuacgcaccagcu

SEQ ID NO: 3552968 - RNA, 22 nt, Pseudomonas putida KT2440
cucagguuacgcaccagcucca

SEQ ID NO: 3552969 - RNA, 22 nt, Pseudomonas putida KT2440
cucagucgcaucgacaggucca

SEQ ID NO: 3552970 - RNA, 22 nt, Pseudomonas putida KT2440
cucaguggaccucuggcgugca

SEQ ID NO: 3552971 - RNA, 18 nt, Pseudomonas putida KT2440
cucaguggcugcacuucg

SEQ ID NO: 3552972 - RNA, 17 nt, Pseudomonas putida KT2440
cucauaaugcuccgcca

SEQ ID NO: 3552973 - RNA, 14 nt, Pseudomonas putida KT2440
cucauagcucagcu

SEQ ID NO: 3552974 - RNA, 15 nt, Pseudomonas putida KT2440
cucauagcucagcug

SEQ ID NO: 3552975 - RNA, 16 nt, Pseudomonas putida KT2440
cucauagcucagcugg

SEQ ID NO: 3552976 - RNA, 19 nt, Pseudomonas putida KT2440
cucauagcuuucaggcgca

SEQ ID NO: 3552977 - RNA, 17 nt, Pseudomonas putida KT2440
cucauaggcgcugaaac

SEQ ID NO: 3552978 - RNA, 20 nt, Pseudomonas putida KT2440
cucauaggcgcugaaacugu

SEQ ID NO: 3552979 - RNA, 15 nt, Pseudomonas putida KT2440
cucaucaccaggccc

SEQ ID NO: 3552980 - RNA, 16 nt, Pseudomonas putida KT2440
cucaucaccggcguug

SEQ ID NO: 3552981 - RNA, 13 nt, Pseudomonas putida KT2440
cucaucacucuug

SEQ ID NO: 3552982 - RNA, 17 nt, Pseudomonas putida KT2440
cucaucacucuugcgcc

SEQ ID NO: 3552983 - RNA, 18 nt, Pseudomonas putida KT2440
cucaucacucuugcgcca

SEQ ID NO: 3552984 - RNA, 17 nt, Pseudomonas putida KT2440
cucaucaggccgaaggc

SEQ ID NO: 3552985 - RNA, 19 nt, Pseudomonas putida KT2440
cucaucaggcgauucaggc

SEQ ID NO: 3552986 - RNA, 19 nt, Pseudomonas putida KT2440
cucauccacaccuucggca

SEQ ID NO: 3552987 - RNA, 12 nt, Pseudomonas putida KT2440
cucauccaccac

SEQ ID NO: 3552988 - RNA, 13 nt, Pseudomonas putida KT2440
cucauccagccgc

SEQ ID NO: 3552989 - RNA, 18 nt, Pseudomonas putida KT2440
cucaucccccggcccagc

SEQ ID NO: 3552990 - RNA, 14 nt, Pseudomonas putida KT2440
cucauccucgccca

SEQ ID NO: 3552991 - RNA, 19 nt, Pseudomonas putida KT2440
cucauccucgcccaccagc

SEQ ID NO: 3552992 - RNA, 14 nt, Pseudomonas putida KT2440
cucauccuuuuuug

SEQ ID NO: 3552993 - RNA, 23 nt, Pseudomonas putida KT2440
cucaucgaugcccgucccuucau

SEQ ID NO: 3552994 - RNA, 18 nt, Pseudomonas putida KT2440
cucaucgcggccgaaggc

SEQ ID NO: 3552995 - RNA, 15 nt, Pseudomonas putida KT2440
cucaucggcggcuuc

SEQ ID NO: 3552996 - RNA, 23 nt, Pseudomonas putida KT2440
cucaucggcggcuuccagggcug

SEQ ID NO: 3552997 - RNA, 19 nt, Pseudomonas putida KT2440
cucaucuaccugagccugc

SEQ ID NO: 3552998 - RNA, 20 nt, Pseudomonas putida KT2440
cucaucuaccugagccugca

SEQ ID NO: 3552999 - RNA, 23 nt, Pseudomonas putida KT2440
cucaugaucugcaagcgcagccc

SEQ ID NO: 3553000 - RNA, 23 nt, Pseudomonas putida KT2440
cucaugccccgcaccuccuuggc

SEQ ID NO: 3553001 - RNA, 14 nt, Pseudomonas putida KT2440
cucaugccuucggu

SEQ ID NO: 3553002 - RNA, 19 nt, Pseudomonas putida KT2440
cucaugcuccugcgccacc

SEQ ID NO: 3553003 - RNA, 23 nt, Pseudomonas putida KT2440
cucaugcugguuuggcagcaccg

SEQ ID NO: 3553004 - RNA, 21 nt, Pseudomonas putida KT2440
cucaugggcuucgagcagcuu

SEQ ID NO: 3553005 - RNA, 21 nt, Pseudomonas putida KT2440
cucaugggugucggcauacag

SEQ ID NO: 3553006 - RNA, 20 nt, Pseudomonas putida KT2440
cucaugugugccgagugcca

SEQ ID NO: 3553007 - RNA, 23 nt, Pseudomonas putida KT2440
cucauucaaagccugcuccagca

SEQ ID NO: 3553008 - RNA, 19 nt, Pseudomonas putida KT2440
cucauuuuguaaaaccgcg

SEQ ID NO: 3553009 - RNA, 17 nt, Pseudomonas putida KT2440
cuccaaagccagcgcua

SEQ ID NO: 3553010 - RNA, 14 nt, Pseudomonas putida KT2440
cuccaaccccagcg

SEQ ID NO: 3553011 - RNA, 21 nt, Pseudomonas putida KT2440
cuccaaccguacccuuccugg

SEQ ID NO: 3553012 - RNA, 18 nt, Pseudomonas putida KT2440
cuccaacgucaaccgugc

SEQ ID NO: 3553013 - RNA, 20 nt, Pseudomonas putida KT2440
cuccaacuggcgcaucuucc

SEQ ID NO: 3553014 - RNA, 24 nt, Pseudomonas putida KT2440
cuccaagccgcuucacuguccugg

SEQ ID NO: 3553015 - RNA, 17 nt, Pseudomonas putida KT2440
cuccacaaucucgcccu

SEQ ID NO: 3553016 - RNA, 20 nt, Pseudomonas putida KT2440
cuccacaaucucgcccuugu

SEQ ID NO: 3553017 - RNA, 23 nt, Pseudomonas putida KT2440
cuccacaccgacauccacguccu

SEQ ID NO: 3553018 - RNA, 18 nt, Pseudomonas putida KT2440
cuccacacucgacgcugc

SEQ ID NO: 3553019 - RNA, 19 nt, Pseudomonas putida KT2440
cuccacacucgacgcugcc

SEQ ID NO: 3553020 - RNA, 23 nt, Pseudomonas putida KT2440
cuccaccaaggcuucaaggucgg

SEQ ID NO: 3553021 - RNA, 20 nt, Pseudomonas putida KT2440
cuccaccacagcugcgccag

SEQ ID NO: 3553022 - RNA, 13 nt, Pseudomonas putida KT2440
cuccaccagccca

SEQ ID NO: 3553023 - RNA, 20 nt, Pseudomonas putida KT2440
cuccaccagcggcucgcuca

SEQ ID NO: 3553024 - RNA, 17 nt, Pseudomonas putida KT2440
cuccacccaccuuggcc

SEQ ID NO: 3553025 - RNA, 17 nt, Pseudomonas putida KT2440
cuccaccccgcaggccg

SEQ ID NO: 3553026 - RNA, 12 nt, Pseudomonas putida KT2440
cuccaccccuuc

SEQ ID NO: 3553027 - RNA, 13 nt, Pseudomonas putida KT2440
cuccaccccuucc

SEQ ID NO: 3553028 - RNA, 16 nt, Pseudomonas putida KT2440
cuccacccgccguuca

SEQ ID NO: 3553029 - RNA, 18 nt, Pseudomonas putida KT2440
cuccacccggucccgccc

SEQ ID NO: 3553030 - RNA, 23 nt, Pseudomonas putida KT2440
cuccacccggucccgcccggccu

SEQ ID NO: 3553031 - RNA, 18 nt, Pseudomonas putida KT2440
cuccaccgauccuuggcg

SEQ ID NO: 3553032 - RNA, 13 nt, Pseudomonas putida KT2440
cuccaccgccagg

SEQ ID NO: 3553033 - RNA, 14 nt, Pseudomonas putida KT2440
cuccaccugcucca

SEQ ID NO: 3553034 - RNA, 17 nt, Pseudomonas putida KT2440
cuccaccugcuccagca

SEQ ID NO: 3553035 - RNA, 13 nt, Pseudomonas putida KT2440
cuccaccuucaau

SEQ ID NO: 3553036 - RNA, 16 nt, Pseudomonas putida KT2440
cuccacggcaaucggc

SEQ ID NO: 3553037 - RNA, 18 nt, Pseudomonas putida KT2440
cuccacggcaaucggcag

SEQ ID NO: 3553038 - RNA, 22 nt, Pseudomonas putida KT2440
cuccacggcaaucggcaggccg

SEQ ID NO: 3553039 - RNA, 17 nt, Pseudomonas putida KT2440
cuccacggucagcaucc

SEQ ID NO: 3553040 - RNA, 14 nt, Pseudomonas putida KT2440
cuccacugugcccg

SEQ ID NO: 3553041 - RNA, 16 nt, Pseudomonas putida KT2440
cuccacuguggucgaa

SEQ ID NO: 3553042 - RNA, 19 nt, Pseudomonas putida KT2440
cuccagacgcuguacgucc

SEQ ID NO: 3553043 - RNA, 21 nt, Pseudomonas putida KT2440
cuccagacgcuguacguccaa

SEQ ID NO: 3553044 - RNA, 19 nt, Pseudomonas putida KT2440
cuccagagaaccgcacacu

SEQ ID NO: 3553045 - RNA, 13 nt, Pseudomonas putida KT2440
cuccagcaacaac

SEQ ID NO: 3553046 - RNA, 20 nt, Pseudomonas putida KT2440
cuccagcaacaacgccuugg

SEQ ID NO: 3553047 - RNA, 18 nt, Pseudomonas putida KT2440
cuccagcaacaucugccg

SEQ ID NO: 3553048 - RNA, 16 nt, Pseudomonas putida KT2440
cuccggcaaggcaucc

SEQ ID NO: 3553049 - RNA, 23 nt, Pseudomonas putida KT2440
cuccggcgaaauacccaacucca

SEQ ID NO: 3553050 - RNA, 15 nt, Pseudomonas putida KT2440
cuccggcgacagcuc

SEQ ID NO: 3553051 - RNA, 15 nt, Pseudomonas putida KT2440
cuccggcguguccag

SEQ ID NO: 3553052 - RNA, 21 nt, Pseudomonas putida KT2440
cuccggcguguccagcagguu

SEQ ID NO: 3553053 - RNA, 20 nt, Pseudomonas putida KT2440
cuccgggcgcccuggcaugc

SEQ ID NO: 3553054 - RNA, 21 nt, Pseudomonas putida KT2440
cuccggguacuucucgaccag

SEQ ID NO: 3553055 - RNA, 16 nt, Pseudomonas putida KT2440
cuccgggucaggccga

SEQ ID NO: 3553056 - RNA, 23 nt, Pseudomonas putida KT2440
cuccgggugaucauucaggcacg

SEQ ID NO: 3553057 - RNA, 19 nt, Pseudomonas putida KT2440
cuccgguucugccggggca

SEQ ID NO: 3553058 - RNA, 17 nt, Pseudomonas putida KT2440
cuccgucugcucugcca

SEQ ID NO: 3553059 - RNA, 12 nt, Pseudomonas putida KT2440
cuccguguccgu

SEQ ID NO: 3553060 - RNA, 23 nt, Pseudomonas putida KT2440
cuccuacaagguaccccaccggc

SEQ ID NO: 3553061 - RNA, 22 nt, Pseudomonas putida KT2440
cuccuacacaggaaacgcaauc

SEQ ID NO: 3553062 - RNA, 20 nt, Pseudomonas putida KT2440
cuccuacacgcggccugugc

SEQ ID NO: 3553063 - RNA, 20 nt, Pseudomonas putida KT2440
cuccuacaggauggccgcag

SEQ ID NO: 3553064 - RNA, 20 nt, Pseudomonas putida KT2440
cuccuacagggguagcguca

SEQ ID NO: 3553065 - RNA, 14 nt, Pseudomonas putida KT2440
cuccuacgaaagcc

SEQ ID NO: 3553066 - RNA, 17 nt, Pseudomonas putida KT2440
cuccuacgacggccugc

SEQ ID NO: 3553067 - RNA, 22 nt, Pseudomonas putida KT2440
cuccuacgacggccugcgcccg

SEQ ID NO: 3553068 - RNA, 22 nt, Pseudomonas putida KT2440
cuccuacgacggccuguguuca

SEQ ID NO: 3553069 - RNA, 17 nt, Pseudomonas putida KT2440
cuccuacgacggucugc

SEQ ID NO: 3553070 - RNA, 22 nt, Pseudomonas putida KT2440
cuccuacgcggggcagcgcacg

SEQ ID NO: 3553071 - RNA, 20 nt, Pseudomonas putida KT2440
cuccuacggaaucugcaccg

SEQ ID NO: 3553072 - RNA, 12 nt, Pseudomonas putida KT2440
cuccuacgggca

SEQ ID NO: 3553073 - RNA, 16 nt, Pseudomonas putida KT2440
cuccuacgggcaaccg

SEQ ID NO: 3553074 - RNA, 20 nt, Pseudomonas putida KT2440
cuccuacgggcaaccgcauc

SEQ ID NO: 3553075 - RNA, 21 nt, Pseudomonas putida KT2440
cuccuacgggcgagcgcgcag

SEQ ID NO: 3553076 - RNA, 15 nt, Pseudomonas putida KT2440
cuccucaucgaugcc

SEQ ID NO: 3553077 - RNA, 21 nt, Pseudomonas putida KT2440
cuccucaucgaugcccguccc

SEQ ID NO: 3553078 - RNA, 23 nt, Pseudomonas putida KT2440
cuccuccagccaacggucgauca

SEQ ID NO: 3553079 - RNA, 12 nt, Pseudomonas putida KT2440
cuccucgcgggc

SEQ ID NO: 3553080 - RNA, 13 nt, Pseudomonas putida KT2440
cuccucgcgggca

SEQ ID NO: 3553081 - RNA, 23 nt, Pseudomonas putida KT2440
cuccugauguaggagcggguuua

SEQ ID NO: 3553082 - RNA, 18 nt, Pseudomonas putida KT2440
cuccugcacauacaaaau

SEQ ID NO: 3553083 - RNA, 23 nt, Pseudomonas putida KT2440
cuccugcagcaggccgcugagga

SEQ ID NO: 3553084 - RNA, 22 nt, Pseudomonas putida KT2440
cuccugcagggaacugcgcgag

SEQ ID NO: 3553085 - RNA, 22 nt, Pseudomonas putida KT2440
cuccugcaugccuuccugcacc

SEQ ID NO: 3553086 - RNA, 15 nt, Pseudomonas putida KT2440
cuccugcgcaugcaa

SEQ ID NO: 3553087 - RNA, 15 nt, Pseudomonas putida KT2440
cuccugcgccaccuc

SEQ ID NO: 3553088 - RNA, 18 nt, Pseudomonas putida KT2440
cuccugcggucagccugc

SEQ ID NO: 3553089 - RNA, 12 nt, Pseudomonas putida KT2440
cuccugcugcug

SEQ ID NO: 3553090 - RNA, 17 nt, Pseudomonas putida KT2440
cuccugcuggucgcagu

SEQ ID NO: 3553091 - RNA, 15 nt, Pseudomonas putida KT2440
cuccuggccgcccgc

SEQ ID NO: 3553092 - RNA, 20 nt, Pseudomonas putida KT2440
cuccuggcucaguggcugca

SEQ ID NO: 3553093 - RNA, 16 nt, Pseudomonas putida KT2440
cuccugggcuggccuu

SEQ ID NO: 3553094 - RNA, 17 nt, Pseudomonas putida KT2440
cuccuggguaacccgcu

SEQ ID NO: 3553095 - RNA, 23 nt, Pseudomonas putida KT2440
cuccuggucaucgaagccaagcg

SEQ ID NO: 3553096 - RNA, 16 nt, Pseudomonas putida KT2440
cuccugguccugcgcg

SEQ ID NO: 3553097 - RNA, 14 nt, Pseudomonas putida KT2440
cuccugugccggcc

SEQ ID NO: 3553098 - RNA, 15 nt, Pseudomonas putida KT2440
cuccugugccggccu

SEQ ID NO: 3553099 - RNA, 19 nt, Pseudomonas putida KT2440
cuccugugccggccucuuc

SEQ ID NO: 3553100 - RNA, 22 nt, Pseudomonas putida KT2440
cuccuucgccacgaacaggcgc

SEQ ID NO: 3553101 - RNA, 13 nt, Pseudomonas putida KT2440
cuccuuggccggu

SEQ ID NO: 3553102 - RNA, 15 nt, Pseudomonas putida KT2440
cucgaacaacgccuc

SEQ ID NO: 3553103 - RNA, 15 nt, Pseudomonas putida KT2440
cucgaacaccugcgc

SEQ ID NO: 3553104 - RNA, 20 nt, Pseudomonas putida KT2440
cucgaacagcaguucgcggu

SEQ ID NO: 3553105 - RNA, 13 nt, Pseudomonas putida KT2440
cucgaacagcgcc

SEQ ID NO: 3553106 - RNA, 19 nt, Pseudomonas putida KT2440
cucgaaccaaggugcuacc

SEQ ID NO: 3553107 - RNA, 20 nt, Pseudomonas putida KT2440
cucgaaccaaggugcuaccg

SEQ ID NO: 3553108 - RNA, 21 nt, Pseudomonas putida KT2440
cucgaaccaguucgggaagug

SEQ ID NO: 3553109 - RNA, 22 nt, Pseudomonas putida KT2440
cucgaacgacagcugcaacaga

SEQ ID NO: 3553110 - RNA, 16 nt, Pseudomonas putida KT2440
cucgaacgcugugccg

SEQ ID NO: 3553111 - RNA, 22 nt, Pseudomonas putida KT2440
cucgaacugaugaccggccugg

SEQ ID NO: 3553112 - RNA, 23 nt, Pseudomonas putida KT2440
cucgaacugaugaccggccuggu

SEQ ID NO: 3553113 - RNA, 23 nt, Pseudomonas putida KT2440
cucgaacuugcccggggugcaga

SEQ ID NO: 3553114 - RNA, 22 nt, Pseudomonas putida KT2440
cucgaagcugccacugcgcgca

SEQ ID NO: 3553115 - RNA, 14 nt, Pseudomonas putida KT2440
cucgaauccccuua

SEQ ID NO: 3553116 - RNA, 16 nt, Pseudomonas putida KT2440
cucgaaugccgcugcu

SEQ ID NO: 3553117 - RNA, 18 nt, Pseudomonas putida KT2440
cucgaaugccgcugcugg

SEQ ID NO: 3553118 - RNA, 13 nt, Pseudomonas putida KT2440
cucgacaaacugc

SEQ ID NO: 3553119 - RNA, 13 nt, Pseudomonas putida KT2440
cucgacaaauccc

SEQ ID NO: 3553120 - RNA, 19 nt, Pseudomonas putida KT2440
cucgacaaaucccgcacaa

SEQ ID NO: 3553121 - RNA, 15 nt, Pseudomonas putida KT2440
cucgacacccagucg

SEQ ID NO: 3553122 - RNA, 17 nt, Pseudomonas putida KT2440
cucgacagccaccugcc

SEQ ID NO: 3553123 - RNA, 13 nt, Pseudomonas putida KT2440
cucgaccacuguc

SEQ ID NO: 3553124 - RNA, 18 nt, Pseudomonas putida KT2440
cucgaccagaucagccgu

SEQ ID NO: 3553125 - RNA, 14 nt, Pseudomonas putida KT2440
cucgaccagcgcca

SEQ ID NO: 3553126 - RNA, 15 nt, Pseudomonas putida KT2440
cucgaccagcgccag

SEQ ID NO: 3553127 - RNA, 18 nt, Pseudomonas putida KT2440
cucgacccacggcugaac

SEQ ID NO: 3553128 - RNA, 15 nt, Pseudomonas putida KT2440
cucgacccagccacc

SEQ ID NO: 3553129 - RNA, 19 nt, Pseudomonas putida KT2440
cucgacccccuugccagca

SEQ ID NO: 3553130 - RNA, 20 nt, Pseudomonas putida KT2440
cucgacccccuugccagcau

SEQ ID NO: 3553131 - RNA, 21 nt, Pseudomonas putida KT2440
cucgacccccuugccagcaug

SEQ ID NO: 3553132 - RNA, 21 nt, Pseudomonas putida KT2440
cucgacccgccgguugcgcag

SEQ ID NO: 3553133 - RNA, 20 nt, Pseudomonas putida KT2440
cucgacccgcgucagcucaa

SEQ ID NO: 3553134 - RNA, 22 nt, Pseudomonas putida KT2440
cucgacccgcgucagcucaagc

SEQ ID NO: 3553135 - RNA, 19 nt, Pseudomonas putida KT2440
cucgacccgcuggcgaccg

SEQ ID NO: 3553136 - RNA, 20 nt, Pseudomonas putida KT2440
cucgacccgucgcugccaaa

SEQ ID NO: 3553137 - RNA, 13 nt, Pseudomonas putida KT2440
cucgaccgccgca

SEQ ID NO: 3553138 - RNA, 14 nt, Pseudomonas putida KT2440
cucgacgaaggucu

SEQ ID NO: 3553139 - RNA, 17 nt, Pseudomonas putida KT2440
cucgacgaccaguucga

SEQ ID NO: 3553140 - RNA, 21 nt, Pseudomonas putida KT2440
cucgacgccccggccugcaca

SEQ ID NO: 3553141 - RNA, 15 nt, Pseudomonas putida KT2440
cucgacgccuuggcg

SEQ ID NO: 3553142 - RNA, 22 nt, Pseudomonas putida KT2440
cucgacgccuuggcgcagcaag

SEQ ID NO: 3553143 - RNA, 20 nt, Pseudomonas putida KT2440
cucgacgcgcgcagccuggc

SEQ ID NO: 3553144 - RNA, 20 nt, Pseudomonas putida KT2440
cucgacgucguaggcuuugc

SEQ ID NO: 3553145 - RNA, 17 nt, Pseudomonas putida KT2440
cucgagaaacgccagcu

SEQ ID NO: 3553146 - RNA, 17 nt, Pseudomonas putida KT2440
cucgagcccgccagcag

SEQ ID NO: 3553147 - RNA, 22 nt, Pseudomonas putida KT2440
cucgagcccgccagcaggccac

SEQ ID NO: 3553148 - RNA, 19 nt, Pseudomonas putida KT2440
cucgagcgcuuucagccgu

SEQ ID NO: 3553149 - RNA, 22 nt, Pseudomonas putida KT2440
cucgagugcgcugaucgaaagc

SEQ ID NO: 3553150 - RNA, 21 nt, Pseudomonas putida KT2440
cucgaucaacgugguaaugcg

SEQ ID NO: 3553151 - RNA, 21 nt, Pseudomonas putida KT2440
cucgaucaugcggcaagccaa

SEQ ID NO: 3553152 - RNA, 17 nt, Pseudomonas putida KT2440
cucggcgaugccgcgcg

SEQ ID NO: 3553153 - RNA, 20 nt, Pseudomonas putida KT2440
cucggcgaugccgcgcgccc

SEQ ID NO: 3553154 - RNA, 23 nt, Pseudomonas putida KT2440
cucggcgcggucaagcucguccu

SEQ ID NO: 3553155 - RNA, 16 nt, Pseudomonas putida KT2440
cucggcggugccugca

SEQ ID NO: 3553156 - RNA, 19 nt, Pseudomonas putida KT2440
cucggcggugccugcagcc

SEQ ID NO: 3553157 - RNA, 15 nt, Pseudomonas putida KT2440
cucggcguacuccag

SEQ ID NO: 3553158 - RNA, 17 nt, Pseudomonas putida KT2440
cucggcguucagcucgu

SEQ ID NO: 3553159 - RNA, 14 nt, Pseudomonas putida KT2440
cucggcuacgaacc

SEQ ID NO: 3553160 - RNA, 23 nt, Pseudomonas putida KT2440
cucggcuacgaaccgagcggucg

SEQ ID NO: 3553161 - RNA, 15 nt, Pseudomonas putida KT2440
cucggcuagcgccug

SEQ ID NO: 3553162 - RNA, 15 nt, Pseudomonas putida KT2440
cucggcucacgcccc

SEQ ID NO: 3553163 - RNA, 19 nt, Pseudomonas putida KT2440
cucgggaauuguacgaccc

SEQ ID NO: 3553164 - RNA, 22 nt, Pseudomonas putida KT2440
cucgggcgguugggcaagugcg

SEQ ID NO: 3553165 - RNA, 13 nt, Pseudomonas putida KT2440
cucgggcuuccag

SEQ ID NO: 3553166 - RNA, 22 nt, Pseudomonas putida KT2440
cucgggcuuggcuucggcggcu

SEQ ID NO: 3553167 - RNA, 15 nt, Pseudomonas putida KT2440
cucgggugcgcucaa

SEQ ID NO: 3553168 - RNA, 11 nt, Pseudomonas putida KT2440
cucggucaggc

SEQ ID NO: 3553169 - RNA, 19 nt, Pseudomonas putida KT2440
cucggucagggcggcagcg

SEQ ID NO: 3553170 - RNA, 19 nt, Pseudomonas putida KT2440
cucgguccaccccaugugg

SEQ ID NO: 3553171 - RNA, 16 nt, Pseudomonas putida KT2440
cucggucgacaggggc

SEQ ID NO: 3553172 - RNA, 14 nt, Pseudomonas putida KT2440
cucggucggcuggc

SEQ ID NO: 3553173 - RNA, 22 nt, Pseudomonas putida KT2440
cucggucggcuggcacuccacu

SEQ ID NO: 3553174 - RNA, 21 nt, Pseudomonas putida KT2440
cucggucucacaggcgcugaa

SEQ ID NO: 3553175 - RNA, 21 nt, Pseudomonas putida KT2440
cucggucucauaggcgcugaa

SEQ ID NO: 3553176 - RNA, 14 nt, Pseudomonas putida KT2440
cucggugaacaggu

SEQ ID NO: 3553177 - RNA, 13 nt, Pseudomonas putida KT2440
cucggugcuccuu

SEQ ID NO: 3553178 - RNA, 15 nt, Pseudomonas putida KT2440
cucggugcugcugcc

SEQ ID NO: 3553179 - RNA, 17 nt, Pseudomonas putida KT2440
cucggugugcaccuggu

SEQ ID NO: 3553180 - RNA, 20 nt, Pseudomonas putida KT2440
cucguaauccucguccagcu

SEQ ID NO: 3553181 - RNA, 12 nt, Pseudomonas putida KT2440
cucgucaaaccg

SEQ ID NO: 3553182 - RNA, 18 nt, Pseudomonas putida KT2440
cucgucaaaccggcaccg

SEQ ID NO: 3553183 - RNA, 17 nt, Pseudomonas putida KT2440
cucgucaaccacagccc

SEQ ID NO: 3553184 - RNA, 23 nt, Pseudomonas putida KT2440
cucgucaaguacuugcaggugca

SEQ ID NO: 3553185 - RNA, 18 nt, Pseudomonas putida KT2440
cucgucaccgccccagcg

SEQ ID NO: 3553186 - RNA, 19 nt, Pseudomonas putida KT2440
cucgucacuggcugcugcg

SEQ ID NO: 3553187 - RNA, 13 nt, Pseudomonas putida KT2440
cucgucagccccu

SEQ ID NO: 3553188 - RNA, 17 nt, Pseudomonas putida KT2440
cucguccaggcccugca

SEQ ID NO: 3553189 - RNA, 17 nt, Pseudomonas putida KT2440
cucguccaucaccgcca

SEQ ID NO: 3553190 - RNA, 19 nt, Pseudomonas putida KT2440
cucguccaucuugcugcuc

SEQ ID NO: 3553191 - RNA, 20 nt, Pseudomonas putida KT2440
cucguccaucuugcugcucu

SEQ ID NO: 3553192 - RNA, 21 nt, Pseudomonas putida KT2440
cucguccaucuugcugcucug

SEQ ID NO: 3553193 - RNA, 15 nt, Pseudomonas putida KT2440
cucguccgggcgcca

SEQ ID NO: 3553194 - RNA, 20 nt, Pseudomonas putida KT2440
cucguccggugccgccuggg

SEQ ID NO: 3553195 - RNA, 14 nt, Pseudomonas putida KT2440
cucgucgaacagca

SEQ ID NO: 3553196 - RNA, 15 nt, Pseudomonas putida KT2440
cucgucgaacagcau

SEQ ID NO: 3553197 - RNA, 17 nt, Pseudomonas putida KT2440
cucgucgaacucgcgcc

SEQ ID NO: 3553198 - RNA, 19 nt, Pseudomonas putida KT2440
cucgucgcgguccuugccg

SEQ ID NO: 3553199 - RNA, 23 nt, Pseudomonas putida KT2440
cucgucggcgcgguucuucgccu

SEQ ID NO: 3553200 - RNA, 24 nt, Pseudomonas putida KT2440
cucgugauagauaucaagcaugcg

SEQ ID NO: 3553201 - RNA, 16 nt, Pseudomonas putida KT2440
cucgugggucaucuug

SEQ ID NO: 3553202 - RNA, 16 nt, Pseudomonas putida KT2440
cucguuacugguggac

SEQ ID NO: 3553203 - RNA, 15 nt, Pseudomonas putida KT2440
cucguucgcgggcac

SEQ ID NO: 3553204 - RNA, 16 nt, Pseudomonas putida KT2440
cucguucgcgggcacg

SEQ ID NO: 3553205 - RNA, 13 nt, Pseudomonas putida KT2440
cucguugcgccag

SEQ ID NO: 3553206 - RNA, 16 nt, Pseudomonas putida KT2440
cucguuguccagcagc

SEQ ID NO: 3553207 - RNA, 19 nt, Pseudomonas putida KT2440
cucguuguccagcagcagc

SEQ ID NO: 3553208 - RNA, 24 nt, Pseudomonas putida KT2440
cucguuguccagcagcagcgcacc

SEQ ID NO: 3553209 - RNA, 17 nt, Pseudomonas putida KT2440
cucguuucccgcuccaa

SEQ ID NO: 3553210 - RNA, 23 nt, Pseudomonas putida KT2440
cucuaaaucgaccugcaggcccu

SEQ ID NO: 3553211 - RNA, 16 nt, Pseudomonas putida KT2440
cucuaccaacugagcu

SEQ ID NO: 3553212 - RNA, 13 nt, Pseudomonas putida KT2440
cucuaccacgccg

SEQ ID NO: 3553213 - RNA, 20 nt, Pseudomonas putida KT2440
cucuaugccaccuguugccg

SEQ ID NO: 3553214 - RNA, 22 nt, Pseudomonas putida KT2440
cucuaugccaccuguugccgcu

SEQ ID NO: 3553215 - RNA, 23 nt, Pseudomonas putida KT2440
cucucaaguucuuuguccugcga

SEQ ID NO: 3553216 - RNA, 23 nt, Pseudomonas putida KT2440
cucucccgcagccgauacggugc

SEQ ID NO: 3553217 - RNA, 18 nt, Pseudomonas putida KT2440
cucuccgaggccgggcag

SEQ ID NO: 3553218 - RNA, 15 nt, Pseudomonas putida KT2440
cucucgaaguagcgc

SEQ ID NO: 3553219 - RNA, 17 nt, Pseudomonas putida KT2440
cucugaacacaugccau

SEQ ID NO: 3553220 - RNA, 13 nt, Pseudomonas putida KT2440
cucugcagcagcg

SEQ ID NO: 3553221 - RNA, 18 nt, Pseudomonas putida KT2440
cucugccgacaaacguac

SEQ ID NO: 3553222 - RNA, 13 nt, Pseudomonas putida KT2440
cucugccgagagg

SEQ ID NO: 3553223 - RNA, 14 nt, Pseudomonas putida KT2440
cucugccgcaccag

SEQ ID NO: 3553224 - RNA, 24 nt, Pseudomonas putida KT2440
cucugccgcaccagguccaccagc

SEQ ID NO: 3553225 - RNA, 18 nt, Pseudomonas putida KT2440
cucugccgccccuccacc

SEQ ID NO: 3553226 - RNA, 16 nt, Pseudomonas putida KT2440
cucugccgccgcagca

SEQ ID NO: 3553227 - RNA, 16 nt, Pseudomonas putida KT2440
cucugccggaucuggc

SEQ ID NO: 3553228 - RNA, 14 nt, Pseudomonas putida KT2440
cucugccugcccau

SEQ ID NO: 3553229 - RNA, 18 nt, Pseudomonas putida KT2440
cucugcggccuucaagcu

SEQ ID NO: 3553230 - RNA, 14 nt, Pseudomonas putida KT2440
cucugcuccagcug

SEQ ID NO: 3553231 - RNA, 19 nt, Pseudomonas putida KT2440
cucugcugcucugccgccg

SEQ ID NO: 3553232 - RNA, 17 nt, Pseudomonas putida KT2440
cucugcuuccuugcgca

SEQ ID NO: 3553233 - RNA, 17 nt, Pseudomonas putida KT2440
cucuggcccgaacagca

SEQ ID NO: 3553234 - RNA, 13 nt, Pseudomonas putida KT2440
cucuggcgugcac

SEQ ID NO: 3553235 - RNA, 15 nt, Pseudomonas putida KT2440
cucuggggagcggau

SEQ ID NO: 3553236 - RNA, 16 nt, Pseudomonas putida KT2440
cucugguacaacaaca

SEQ ID NO: 3553237 - RNA, 15 nt, Pseudomonas putida KT2440
cucuggucaccuucg

SEQ ID NO: 3553238 - RNA, 16 nt, Pseudomonas putida KT2440
cucuggucaccuucgu

SEQ ID NO: 3553239 - RNA, 19 nt, Pseudomonas putida KT2440
cucuggucgaucuucagcg

SEQ ID NO: 3553240 - RNA, 13 nt, Pseudomonas putida KT2440
cucuuagcgggca

SEQ ID NO: 3553241 - RNA, 15 nt, Pseudomonas putida KT2440
cucuucaacaccagc

SEQ ID NO: 3553242 - RNA, 21 nt, Pseudomonas putida KT2440
cucuucaaccuguuccggccu

SEQ ID NO: 3553243 - RNA, 13 nt, Pseudomonas putida KT2440
cucuucaccagcu

SEQ ID NO: 3553244 - RNA, 19 nt, Pseudomonas putida KT2440
cucuucaccaugggccugg

SEQ ID NO: 3553245 - RNA, 22 nt, Pseudomonas putida KT2440
cucuucaccaugggccuggaug

SEQ ID NO: 3553246 - RNA, 22 nt, Pseudomonas putida KT2440
cucuucaccguacuugcugcag

SEQ ID NO: 3553247 - RNA, 22 nt, Pseudomonas putida KT2440
cucuucaccugaccauuggcca

SEQ ID NO: 3553248 - RNA, 18 nt, Pseudomonas putida KT2440
cucuucacggcuaaagcc

SEQ ID NO: 3553249 - RNA, 17 nt, Pseudomonas putida KT2440
cucuuccaccguacccc

SEQ ID NO: 3553250 - RNA, 12 nt, Pseudomonas putida KT2440
cucuuccagcuc

SEQ ID NO: 3553251 - RNA, 17 nt, Pseudomonas putida KT2440
cucuucccaccaccagc

SEQ ID NO: 3553252 - RNA, 20 nt, Pseudomonas putida KT2440
cucuucccaccaccagcgcc

SEQ ID NO: 3553253 - RNA, 22 nt, Pseudomonas putida KT2440
cucuuccgcacgggucaccuca

SEQ ID NO: 3553254 - RNA, 23 nt, Pseudomonas putida KT2440
cucuuccuccaucucgugguuga

SEQ ID NO: 3553255 - RNA, 17 nt, Pseudomonas putida KT2440
cucuuccugcaccuggu

SEQ ID NO: 3553256 - RNA, 22 nt, Pseudomonas putida KT2440
cucuuccugcaccugguugcca

SEQ ID NO: 3553257 - RNA, 14 nt, Pseudomonas putida KT2440
cugacgaacaacgc

SEQ ID NO: 3553258 - RNA, 16 nt, Pseudomonas putida KT2440
cugacgaagcgccugg

SEQ ID NO: 3553259 - RNA, 19 nt, Pseudomonas putida KT2440
cugacgcagugcagccgcg

SEQ ID NO: 3553260 - RNA, 18 nt, Pseudomonas putida KT2440
cugacgccgccagcgcuc

SEQ ID NO: 3553261 - RNA, 15 nt, Pseudomonas putida KT2440
cugacgcgccgugcc

SEQ ID NO: 3553262 - RNA, 23 nt, Pseudomonas putida KT2440
cugacgcggauagcgcgccaaag

SEQ ID NO: 3553263 - RNA, 17 nt, Pseudomonas putida KT2440
cugacgcugcacuucca

SEQ ID NO: 3553264 - RNA, 20 nt, Pseudomonas putida KT2440
cugacgcugcacuuccacac

SEQ ID NO: 3553265 - RNA, 23 nt, Pseudomonas putida KT2440
cugacgcugcacuuccacacccg

SEQ ID NO: 3553266 - RNA, 15 nt, Pseudomonas putida KT2440
cugacgggccucuuc

SEQ ID NO: 3553267 - RNA, 20 nt, Pseudomonas putida KT2440
cugacgggccucuucgcggg

SEQ ID NO: 3553268 - RNA, 19 nt, Pseudomonas putida KT2440
cugacgguugaggcggucg

SEQ ID NO: 3553269 - RNA, 16 nt, Pseudomonas putida KT2440
cugacguaguccuugu

SEQ ID NO: 3553270 - RNA, 21 nt, Pseudomonas putida KT2440
cugacucagcccugagggcuc

SEQ ID NO: 3553271 - RNA, 17 nt, Pseudomonas putida KT2440
cugacucagcggccuuu

SEQ ID NO: 3553272 - RNA, 16 nt, Pseudomonas putida KT2440
cugacucgaccgccgc

SEQ ID NO: 3553273 - RNA, 16 nt, Pseudomonas putida KT2440
cugacuggcagcaagg

SEQ ID NO: 3553274 - RNA, 17 nt, Pseudomonas putida KT2440
cugacuggcagcaaggc

SEQ ID NO: 3553275 - RNA, 18 nt, Pseudomonas putida KT2440
cugacuggcagcaaggcc

SEQ ID NO: 3553276 - RNA, 15 nt, Pseudomonas putida KT2440
cugacugugagcucu

SEQ ID NO: 3553277 - RNA, 19 nt, Pseudomonas putida KT2440
cugacuuccagcagcacac

SEQ ID NO: 3553278 - RNA, 23 nt, Pseudomonas putida KT2440
cugagaaaaaggggugcaaagcg

SEQ ID NO: 3553279 - RNA, 14 nt, Pseudomonas putida KT2440
cugagaccaguucu

SEQ ID NO: 3553280 - RNA, 22 nt, Pseudomonas putida KT2440
cugagcaccacauacggcgcac

SEQ ID NO: 3553281 - RNA, 13 nt, Pseudomonas putida KT2440
cugagcagaccag

SEQ ID NO: 3553282 - RNA, 17 nt, Pseudomonas putida KT2440
cugagcagaccagccgg

SEQ ID NO: 3553283 - RNA, 13 nt, Pseudomonas putida KT2440
cugagcagcggug

SEQ ID NO: 3553284 - RNA, 18 nt, Pseudomonas putida KT2440
cugagccaggccgacaac

SEQ ID NO: 3553285 - RNA, 14 nt, Pseudomonas putida KT2440
cugagccaguucac

SEQ ID NO: 3553286 - RNA, 16 nt, Pseudomonas putida KT2440
cugagcccaaccucug

SEQ ID NO: 3553287 - RNA, 22 nt, Pseudomonas putida KT2440
cugagccuugucaguucugcuc

SEQ ID NO: 3553288 - RNA, 19 nt, Pseudomonas putida KT2440
cugagccuuguucgcgcag

SEQ ID NO: 3553289 - RNA, 20 nt, Pseudomonas putida KT2440
cugagccuuguucgcgcagg

SEQ ID NO: 3553290 - RNA, 19 nt, Pseudomonas putida KT2440
cugagcgacagcaucugca

SEQ ID NO: 3553291 - RNA, 17 nt, Pseudomonas putida KT2440
cugagcgccauccaccu

SEQ ID NO: 3553292 - RNA, 21 nt, Pseudomonas putida KT2440
cugagggucgugagccugcac

SEQ ID NO: 3553293 - RNA, 19 nt, Pseudomonas putida KT2440
cugaggguuguugaagaag

SEQ ID NO: 3553294 - RNA, 21 nt, Pseudomonas putida KT2440
cugaggugcuuggggcugaac

SEQ ID NO: 3553295 - RNA, 13 nt, Pseudomonas putida KT2440
cugagguucagcg

SEQ ID NO: 3553296 - RNA, 21 nt, Pseudomonas putida KT2440
cugaguuacagguuguaaaca

SEQ ID NO: 3553297 - RNA, 22 nt, Pseudomonas putida KT2440
cugauacgcgacaguucgccac

SEQ ID NO: 3553298 - RNA, 17 nt, Pseudomonas putida KT2440
cugauagcgagccgcau

SEQ ID NO: 3553299 - RNA, 12 nt, Pseudomonas putida KT2440
cugauagcgcuu

SEQ ID NO: 3553300 - RNA, 19 nt, Pseudomonas putida KT2440
cugauagcgcuuuuccagu

SEQ ID NO: 3553301 - RNA, 19 nt, Pseudomonas putida KT2440
cugaucaaagucgccuaca

SEQ ID NO: 3553302 - RNA, 21 nt, Pseudomonas putida KT2440
cugaucaagcccgcucgccac

SEQ ID NO: 3553303 - RNA, 16 nt, Pseudomonas putida KT2440
cugaucaauccucugc

SEQ ID NO: 3553304 - RNA, 21 nt, Pseudomonas putida KT2440
cugaucaauccucugcccgca

SEQ ID NO: 3553305 - RNA, 23 nt, Pseudomonas putida KT2440
cugaucaauccucugcccgcagc

SEQ ID NO: 3553306 - RNA, 17 nt, Pseudomonas putida KT2440
cugaucaauucagcaca

SEQ ID NO: 3553307 - RNA, 20 nt, Pseudomonas putida KT2440
cugaucacccgucugcagga

SEQ ID NO: 3553308 - RNA, 17 nt, Pseudomonas putida KT2440
cugaucacuugcucauc

SEQ ID NO: 3553309 - RNA, 13 nt, Pseudomonas putida KT2440
cugaucagacuuu

SEQ ID NO: 3553310 - RNA, 12 nt, Pseudomonas putida KT2440
cugaucagcuuc

SEQ ID NO: 3553311 - RNA, 21 nt, Pseudomonas putida KT2440
cugaucccggccguugaaggc

SEQ ID NO: 3553312 - RNA, 21 nt, Pseudomonas putida KT2440
cugauccgcuuucggcagugu

SEQ ID NO: 3553313 - RNA, 16 nt, Pseudomonas putida KT2440
cugaucgaaagcugcg

SEQ ID NO: 3553314 - RNA, 21 nt, Pseudomonas putida KT2440
cugaucgauacaccacuggug

SEQ ID NO: 3553315 - RNA, 14 nt, Pseudomonas putida KT2440
cugaucgccuccag

SEQ ID NO: 3553316 - RNA, 15 nt, Pseudomonas putida KT2440
cugaucgccuccagg

SEQ ID NO: 3553317 - RNA, 20 nt, Pseudomonas putida KT2440
cugaucgggauuacaugaug

SEQ ID NO: 3553318 - RNA, 13 nt, Pseudomonas putida KT2440
cugaucgugcacc

SEQ ID NO: 3553319 - RNA, 14 nt, Pseudomonas putida KT2440
cugaucucuucagc

SEQ ID NO: 3553320 - RNA, 17 nt, Pseudomonas putida KT2440
cugaucucuucagccac

SEQ ID NO: 3553321 - RNA, 18 nt, Pseudomonas putida KT2440
cugaucucuucagccacc

SEQ ID NO: 3553322 - RNA, 15 nt, Pseudomonas putida KT2440
cugaucugccccucg

SEQ ID NO: 3553323 - RNA, 19 nt, Pseudomonas putida KT2440
cugaucuguaauagccuca

SEQ ID NO: 3553324 - RNA, 17 nt, Pseudomonas putida KT2440
cugaugaccggccuggu

SEQ ID NO: 3553325 - RNA, 15 nt, Pseudomonas putida KT2440
cugaugcaccaggcc

SEQ ID NO: 3553326 - RNA, 18 nt, Pseudomonas putida KT2440
cugaugcaccaggcccag

SEQ ID NO: 3553327 - RNA, 12 nt, Pseudomonas putida KT2440
cugaugcagcag

SEQ ID NO: 3553328 - RNA, 16 nt, Pseudomonas putida KT2440
cugaugcgagcuaccu

SEQ ID NO: 3553329 - RNA, 12 nt, Pseudomonas putida KT2440
cugaugcgccag

SEQ ID NO: 3553330 - RNA, 22 nt, Pseudomonas putida KT2440
cugaugcgcuggcccuugccau

SEQ ID NO: 3553331 - RNA, 19 nt, Pseudomonas putida KT2440
cugaugcuucugcuucagc

SEQ ID NO: 3553332 - RNA, 20 nt, Pseudomonas putida KT2440
cugaugcuucugcuucagcu

SEQ ID NO: 3553333 - RNA, 15 nt, Pseudomonas putida KT2440
cugauggauuccucg

SEQ ID NO: 3553334 - RNA, 16 nt, Pseudomonas putida KT2440
cugaugggucuugccg

SEQ ID NO: 3553335 - RNA, 22 nt, Pseudomonas putida KT2440
cugaugguggucggcagcucaa

SEQ ID NO: 3553336 - RNA, 14 nt, Pseudomonas putida KT2440
cugauguacaagga

SEQ ID NO: 3553337 - RNA, 23 nt, Pseudomonas putida KT2440
cugauguucggugcucaggcuca

SEQ ID NO: 3553338 - RNA, 17 nt, Pseudomonas putida KT2440
cugauguuggccaucac

SEQ ID NO: 3553339 - RNA, 18 nt, Pseudomonas putida KT2440
cugauguuggccaucacu

SEQ ID NO: 3553340 - RNA, 21 nt, Pseudomonas putida KT2440
cugauguuggccaucacuucc

SEQ ID NO: 3553341 - RNA, 14 nt, Pseudomonas putida KT2440
cugauuacccugcg

SEQ ID NO: 3553342 - RNA, 14 nt, Pseudomonas putida KT2440
cugauucagcacac

SEQ ID NO: 3553343 - RNA, 13 nt, Pseudomonas putida KT2440
cugauugagcagc

SEQ ID NO: 3553344 - RNA, 13 nt, Pseudomonas putida KT2440
cugcaaacgcagg

SEQ ID NO: 3553345 - RNA, 21 nt, Pseudomonas putida KT2440
cugcaaacgcaggugcgcacg

SEQ ID NO: 3553346 - RNA, 13 nt, Pseudomonas putida KT2440
cugcaaagcagcc

SEQ ID NO: 3553347 - RNA, 15 nt, Pseudomonas putida KT2440
cugcaaagcagcccc

SEQ ID NO: 3553348 - RNA, 16 nt, Pseudomonas putida KT2440
cugcaaagcagcccca

SEQ ID NO: 3553349 - RNA, 21 nt, Pseudomonas putida KT2440
cugcaaagcagccccagggcc

SEQ ID NO: 3553350 - RNA, 16 nt, Pseudomonas putida KT2440
cugcaaagcagccccc

SEQ ID NO: 3553351 - RNA, 23 nt, Pseudomonas putida KT2440
cugcaaagcagcccccaacccuc

SEQ ID NO: 3553352 - RNA, 14 nt, Pseudomonas putida KT2440
cugcaaauacccca

SEQ ID NO: 3553353 - RNA, 21 nt, Pseudomonas putida KT2440
cugcaaauaccccaggcaaaa

SEQ ID NO: 3553354 - RNA, 23 nt, Pseudomonas putida KT2440
cugcaacaccggucagguccgcc

SEQ ID NO: 3553355 - RNA, 14 nt, Pseudomonas putida KT2440
cugcaacaccucca

SEQ ID NO: 3553356 - RNA, 12 nt, Pseudomonas putida KT2440
cugcaacagcuc

SEQ ID NO: 3553357 - RNA, 17 nt, Pseudomonas putida KT2440
cugcaacagcucaucca

SEQ ID NO: 3553358 - RNA, 21 nt, Pseudomonas putida KT2440
cugcaacagcucauccaggcu

SEQ ID NO: 3553359 - RNA, 15 nt, Pseudomonas putida KT2440
cugcaacagcuccag

SEQ ID NO: 3553360 - RNA, 13 nt, Pseudomonas putida KT2440
cugcaacagggcg

SEQ ID NO: 3553361 - RNA, 16 nt, Pseudomonas putida KT2440
cugcaacuccucgauc

SEQ ID NO: 3553362 - RNA, 16 nt, Pseudomonas putida KT2440
cugcagcuucccggcc

SEQ ID NO: 3553363 - RNA, 17 nt, Pseudomonas putida KT2440
cugcaggagcgggcacg

SEQ ID NO: 3553364 - RNA, 13 nt, Pseudomonas putida KT2440
cugcaggcccagg

SEQ ID NO: 3553365 - RNA, 21 nt, Pseudomonas putida KT2440
cugcaggcgcggugccggcag

SEQ ID NO: 3553366 - RNA, 14 nt, Pseudomonas putida KT2440
cugcaggcucugaa

SEQ ID NO: 3553367 - RNA, 13 nt, Pseudomonas putida KT2440
cugcaggcuggca

SEQ ID NO: 3553368 - RNA, 22 nt, Pseudomonas putida KT2440
cugcaggcuggcaaucagcucu

SEQ ID NO: 3553369 - RNA, 18 nt, Pseudomonas putida KT2440
cugcagggaacugcgcga

SEQ ID NO: 3553370 - RNA, 15 nt, Pseudomonas putida KT2440
cugcagggcacgcca

SEQ ID NO: 3553371 - RNA, 16 nt, Pseudomonas putida KT2440
cugcagggcacgccaa

SEQ ID NO: 3553372 - RNA, 17 nt, Pseudomonas putida KT2440
cugcagggcacgccaau

SEQ ID NO: 3553373 - RNA, 17 nt, Pseudomonas putida KT2440
cugcagggcccagccac

SEQ ID NO: 3553374 - RNA, 18 nt, Pseudomonas putida KT2440
cugcagggcccagccacc

SEQ ID NO: 3553375 - RNA, 12 nt, Pseudomonas putida KT2440
cugcagggccug

SEQ ID NO: 3553376 - RNA, 18 nt, Pseudomonas putida KT2440
cugcagguacagcagcug

SEQ ID NO: 3553377 - RNA, 21 nt, Pseudomonas putida KT2440
cugcagguaguuuuccagccc

SEQ ID NO: 3553378 - RNA, 18 nt, Pseudomonas putida KT2440
cugcaggucggccagcuc

SEQ ID NO: 3553379 - RNA, 18 nt, Pseudomonas putida KT2440
cugcagguucugaaucug

SEQ ID NO: 3553380 - RNA, 13 nt, Pseudomonas putida KT2440
cugcagucagguu

SEQ ID NO: 3553381 - RNA, 14 nt, Pseudomonas putida KT2440
cugcagucagguug

SEQ ID NO: 3553382 - RNA, 19 nt, Pseudomonas putida KT2440
cugcagugccucacgcaug

SEQ ID NO: 3553383 - RNA, 13 nt, Pseudomonas putida KT2440
cugcagugcuggg

SEQ ID NO: 3553384 - RNA, 15 nt, Pseudomonas putida KT2440
cugcagugcugggca

SEQ ID NO: 3553385 - RNA, 18 nt, Pseudomonas putida KT2440
cugcauacgcaucggugg

SEQ ID NO: 3553386 - RNA, 19 nt, Pseudomonas putida KT2440
cugcauacgcaucgguggu

SEQ ID NO: 3553387 - RNA, 22 nt, Pseudomonas putida KT2440
cugcauaggugucgaacaccac

SEQ ID NO: 3553388 - RNA, 14 nt, Pseudomonas putida KT2440
cugcauauaccgcg

SEQ ID NO: 3553389 - RNA, 19 nt, Pseudomonas putida KT2440
cugcauaugcagggccuuu

SEQ ID NO: 3553390 - RNA, 19 nt, Pseudomonas putida KT2440
cugcaucacuugcagcucg

SEQ ID NO: 3553391 - RNA, 19 nt, Pseudomonas putida KT2440
cugcaucagguagcugggc

SEQ ID NO: 3553392 - RNA, 20 nt, Pseudomonas putida KT2440
cugcaucagguagcugggcc

SEQ ID NO: 3553393 - RNA, 21 nt, Pseudomonas putida KT2440
cugcaucauucgcgccauggc

SEQ ID NO: 3553394 - RNA, 13 nt, Pseudomonas putida KT2440
cugcauccgcccc

SEQ ID NO: 3553395 - RNA, 17 nt, Pseudomonas putida KT2440
cugcauccgccccaggu

SEQ ID NO: 3553396 - RNA, 19 nt, Pseudomonas putida KT2440
cugcauccgccccaggugg

SEQ ID NO: 3553397 - RNA, 20 nt, Pseudomonas putida KT2440
cugcauccguucggcgcgcu

SEQ ID NO: 3553398 - RNA, 15 nt, Pseudomonas putida KT2440
cugcaucgguggaga

SEQ ID NO: 3553399 - RNA, 22 nt, Pseudomonas putida KT2440
cugcaugccuuccugcaccuug

SEQ ID NO: 3553400 - RNA, 13 nt, Pseudomonas putida KT2440
cugcaugcgugcc

SEQ ID NO: 3553401 - RNA, 15 nt, Pseudomonas putida KT2440
cugcauggcauucgc

SEQ ID NO: 3553402 - RNA, 16 nt, Pseudomonas putida KT2440
cugcauggcggcaccg

SEQ ID NO: 3553403 - RNA, 14 nt, Pseudomonas putida KT2440
cugcaugucggcag

SEQ ID NO: 3553404 - RNA, 15 nt, Pseudomonas putida KT2440
cugcaugugccgcuc

SEQ ID NO: 3553405 - RNA, 18 nt, Pseudomonas putida KT2440
cugcauugcagccccaau

SEQ ID NO: 3553406 - RNA, 21 nt, Pseudomonas putida KT2440
cugcauugcagccccaauggu

SEQ ID NO: 3553407 - RNA, 13 nt, Pseudomonas putida KT2440
cugcauugcgcgu

SEQ ID NO: 3553408 - RNA, 21 nt, Pseudomonas putida KT2440
cugcauugcgcgucacugcac

SEQ ID NO: 3553409 - RNA, 14 nt, Pseudomonas putida KT2440
cugcauuggccacg

SEQ ID NO: 3553410 - RNA, 21 nt, Pseudomonas putida KT2440
cugccaaaguccggcgaagca

SEQ ID NO: 3553411 - RNA, 13 nt, Pseudomonas putida KT2440
cugccaaccggcu

SEQ ID NO: 3553412 - RNA, 19 nt, Pseudomonas putida KT2440
cugccaaccggcuuguagc

SEQ ID NO: 3553413 - RNA, 21 nt, Pseudomonas putida KT2440
cugccaaccggcuuguagccg

SEQ ID NO: 3553414 - RNA, 15 nt, Pseudomonas putida KT2440
cugccaacgcaccga

SEQ ID NO: 3553415 - RNA, 14 nt, Pseudomonas putida KT2440
cugccaaucaaccc

SEQ ID NO: 3553416 - RNA, 16 nt, Pseudomonas putida KT2440
cugccaaucaacccgu

SEQ ID NO: 3553417 - RNA, 18 nt, Pseudomonas putida KT2440
cugccacacacccgggcc

SEQ ID NO: 3553418 - RNA, 21 nt, Pseudomonas putida KT2440
cugccacacacccgggcccgc

SEQ ID NO: 3553419 - RNA, 20 nt, Pseudomonas putida KT2440
cugccaccaguucauggcuc

SEQ ID NO: 3553420 - RNA, 18 nt, Pseudomonas putida KT2440
cugccacccacaggcacg

SEQ ID NO: 3553421 - RNA, 22 nt, Pseudomonas putida KT2440
cugccaccgugagcauggcaaa

SEQ ID NO: 3553422 - RNA, 14 nt, Pseudomonas putida KT2440
cugccacgcaugcc

SEQ ID NO: 3553423 - RNA, 12 nt, Pseudomonas putida KT2440
cugccacgcccg

SEQ ID NO: 3553424 - RNA, 15 nt, Pseudomonas putida KT2440
cugccacgcccgcug

SEQ ID NO: 3553425 - RNA, 21 nt, Pseudomonas putida KT2440
cugccacucguccgggcgcca

SEQ ID NO: 3553426 - RNA, 20 nt, Pseudomonas putida KT2440
cugccagaaucuggggccgc

SEQ ID NO: 3553427 - RNA, 15 nt, Pseudomonas putida KT2440
cugccagcaccagcg

SEQ ID NO: 3553428 - RNA, 21 nt, Pseudomonas putida KT2440
cugccagcaccagcgcgauca

SEQ ID NO: 3553429 - RNA, 22 nt, Pseudomonas putida KT2440
cugccagcaccagcgcgaucac

SEQ ID NO: 3553430 - RNA, 16 nt, Pseudomonas putida KT2440
cugccagcaccuggcg

SEQ ID NO: 3553431 - RNA, 12 nt, Pseudomonas putida KT2440
cugccagcacga

SEQ ID NO: 3553432 - RNA, 13 nt, Pseudomonas putida KT2440
cugccagcacgau

SEQ ID NO: 3553433 - RNA, 13 nt, Pseudomonas putida KT2440
cugccagcagggc

SEQ ID NO: 3553434 - RNA, 13 nt, Pseudomonas putida KT2440
cugccagccccgc

SEQ ID NO: 3553435 - RNA, 14 nt, Pseudomonas putida KT2440
cugccagcccggcg

SEQ ID NO: 3553436 - RNA, 21 nt, Pseudomonas putida KT2440
cugccagcccggcggccagca

SEQ ID NO: 3553437 - RNA, 14 nt, Pseudomonas putida KT2440
cugccagcgccuca

SEQ ID NO: 3553438 - RNA, 13 nt, Pseudomonas putida KT2440
cugccagcgcgcu

SEQ ID NO: 3553439 - RNA, 13 nt, Pseudomonas putida KT2440
cugccagcuccug

SEQ ID NO: 3553440 - RNA, 16 nt, Pseudomonas putida KT2440
cugccagcuccuggcu

SEQ ID NO: 3553441 - RNA, 15 nt, Pseudomonas putida KT2440
cugccaggaagcucg

SEQ ID NO: 3553442 - RNA, 21 nt, Pseudomonas putida KT2440
cugccaggcaaaguugagcgc

SEQ ID NO: 3553443 - RNA, 15 nt, Pseudomonas putida KT2440
cugccaggcaccaca

SEQ ID NO: 3553444 - RNA, 14 nt, Pseudomonas putida KT2440
cugccaggccaaac

SEQ ID NO: 3553445 - RNA, 18 nt, Pseudomonas putida KT2440
cugccaggccgcacgcgc

SEQ ID NO: 3553446 - RNA, 16 nt, Pseudomonas putida KT2440
cugccaggcuggcgcu

SEQ ID NO: 3553447 - RNA, 18 nt, Pseudomonas putida KT2440
cugccaggucaccgccca

SEQ ID NO: 3553448 - RNA, 22 nt, Pseudomonas putida KT2440
cugccaggucaccgcccagcuu

SEQ ID NO: 3553449 - RNA, 19 nt, Pseudomonas putida KT2440
cugccaguaaggcuugcuc

SEQ ID NO: 3553450 - RNA, 17 nt, Pseudomonas putida KT2440
cugccaguccuuggcca

SEQ ID NO: 3553451 - RNA, 21 nt, Pseudomonas putida KT2440
cugccaguccuuggccaaugc

SEQ ID NO: 3553452 - RNA, 15 nt, Pseudomonas putida KT2440
cugccagucgcacag

SEQ ID NO: 3553453 - RNA, 23 nt, Pseudomonas putida KT2440
cugccagugucaguugcucgccc

SEQ ID NO: 3553454 - RNA, 16 nt, Pseudomonas putida KT2440
cugccaguucaugcag

SEQ ID NO: 3553455 - RNA, 19 nt, Pseudomonas putida KT2440
cugccaguugcuucugcag

SEQ ID NO: 3553456 - RNA, 17 nt, Pseudomonas putida KT2440
cugccauacagccagaa

SEQ ID NO: 3553457 - RNA, 21 nt, Pseudomonas putida KT2440
cugccauagcgcugcaccgaa

SEQ ID NO: 3553458 - RNA, 13 nt, Pseudomonas putida KT2440
cugccauccaggu

SEQ ID NO: 3553459 - RNA, 17 nt, Pseudomonas putida KT2440
cugccaucucgccaagc

SEQ ID NO: 3553460 - RNA, 14 nt, Pseudomonas putida KT2440
cugccaugcagguc

SEQ ID NO: 3553461 - RNA, 20 nt, Pseudomonas putida KT2440
cugccauuucuucagcagga

SEQ ID NO: 3553462 - RNA, 16 nt, Pseudomonas putida KT2440
cugcccaagccaucca

SEQ ID NO: 3553463 - RNA, 19 nt, Pseudomonas putida KT2440
cugcccaagccauccacca

SEQ ID NO: 3553464 - RNA, 16 nt, Pseudomonas putida KT2440
cugcccacccaaccgc

SEQ ID NO: 3553465 - RNA, 14 nt, Pseudomonas putida KT2440
cugcccaccgauca

SEQ ID NO: 3553466 - RNA, 22 nt, Pseudomonas putida KT2440
cugcccagcagccccacgccca

SEQ ID NO: 3553467 - RNA, 19 nt, Pseudomonas putida KT2440
cugcccaggugccaggcuc

SEQ ID NO: 3553468 - RNA, 14 nt, Pseudomonas putida KT2440
cugccuggcucagg

SEQ ID NO: 3553469 - RNA, 12 nt, Pseudomonas putida KT2440
cugccugggcac

SEQ ID NO: 3553470 - RNA, 12 nt, Pseudomonas putida KT2440
cugccugugccg

SEQ ID NO: 3553471 - RNA, 15 nt, Pseudomonas putida KT2440
cugccugugccggug

SEQ ID NO: 3553472 - RNA, 19 nt, Pseudomonas putida KT2440
cugccuuccaaccagccag

SEQ ID NO: 3553473 - RNA, 21 nt, Pseudomonas putida KT2440
cugccuuccacccgccugcaa

SEQ ID NO: 3553474 - RNA, 13 nt, Pseudomonas putida KT2440
cugccuuccgcca

SEQ ID NO: 3553475 - RNA, 15 nt, Pseudomonas putida KT2440
cugccuucgcucagg

SEQ ID NO: 3553476 - RNA, 13 nt, Pseudomonas putida KT2440
cugccuucucugu

SEQ ID NO: 3553477 - RNA, 23 nt, Pseudomonas putida KT2440
cugccuugcagccccugcaauuu

SEQ ID NO: 3553478 - RNA, 15 nt, Pseudomonas putida KT2440
cugccuugcccagcu

SEQ ID NO: 3553479 - RNA, 19 nt, Pseudomonas putida KT2440
cugccuugcccagcuccag

SEQ ID NO: 3553480 - RNA, 23 nt, Pseudomonas putida KT2440
cugccuugcccagcuccagcacc

SEQ ID NO: 3553481 - RNA, 13 nt, Pseudomonas putida KT2440
cugccuugcccug

SEQ ID NO: 3553482 - RNA, 21 nt, Pseudomonas putida KT2440
cugccuugcccugcagcuucc

SEQ ID NO: 3553483 - RNA, 20 nt, Pseudomonas putida KT2440
cugccuuggcauuggugcca

SEQ ID NO: 3553484 - RNA, 21 nt, Pseudomonas putida KT2440
cugccuuuggccgccagcggc

SEQ ID NO: 3553485 - RNA, 16 nt, Pseudomonas putida KT2440
cugccuuuuccugcug

SEQ ID NO: 3553486 - RNA, 14 nt, Pseudomonas putida KT2440
cugcgaaaggcgcu

SEQ ID NO: 3553487 - RNA, 14 nt, Pseudomonas putida KT2440
cugcgaacggacaa

SEQ ID NO: 3553488 - RNA, 23 nt, Pseudomonas putida KT2440
cugcgaagaggccccgacagcaa

SEQ ID NO: 3553489 - RNA, 20 nt, Pseudomonas putida KT2440
cugcgaaugggcugcaaagc

SEQ ID NO: 3553490 - RNA, 13 nt, Pseudomonas putida KT2440
cugcgacacgcga

SEQ ID NO: 3553491 - RNA, 16 nt, Pseudomonas putida KT2440
cugcgacacgcgaauc

SEQ ID NO: 3553492 - RNA, 11 nt, Pseudomonas putida KT2440
cugcgacgaac

SEQ ID NO: 3553493 - RNA, 18 nt, Pseudomonas putida KT2440
cugcgacugaauacagcc

SEQ ID NO: 3553494 - RNA, 20 nt, Pseudomonas putida KT2440
cugcgacugcagguaguuuu

SEQ ID NO: 3553495 - RNA, 17 nt, Pseudomonas putida KT2440
cugcgauagaucagcga

SEQ ID NO: 3553496 - RNA, 20 nt, Pseudomonas putida KT2440
cugcgauugcgauccgcccc

SEQ ID NO: 3553497 - RNA, 21 nt, Pseudomonas putida KT2440
cugcgcaccggcuucgucggc

SEQ ID NO: 3553498 - RNA, 23 nt, Pseudomonas putida KT2440
cugcgcacgaauacgcucgacca

SEQ ID NO: 3553499 - RNA, 20 nt, Pseudomonas putida KT2440
cugcgcacgaccauuggcgu

SEQ ID NO: 3553500 - RNA, 16 nt, Pseudomonas putida KT2440
cugcgcacggaaggca

SEQ ID NO: 3553501 - RNA, 18 nt, Pseudomonas putida KT2440
cugcgcacggaaggcauc

SEQ ID NO: 3553502 - RNA, 14 nt, Pseudomonas putida KT2440
cugcgcacggcgcu

SEQ ID NO: 3553503 - RNA, 21 nt, Pseudomonas putida KT2440
cugcgcagcccauucgcgggu

SEQ ID NO: 3553504 - RNA, 14 nt, Pseudomonas putida KT2440
cugcgcagcccugu

SEQ ID NO: 3553505 - RNA, 24 nt, Pseudomonas putida KT2440
cugcgcaggcgccgccagcugcug

SEQ ID NO: 3553506 - RNA, 18 nt, Pseudomonas putida KT2440
cugcgcaguacaggcugc

SEQ ID NO: 3553507 - RNA, 21 nt, Pseudomonas putida KT2440
cugcgcagucauuuucaugca

SEQ ID NO: 3553508 - RNA, 20 nt, Pseudomonas putida KT2440
cugcgcaucacccgccccuc

SEQ ID NO: 3553509 - RNA, 21 nt, Pseudomonas putida KT2440
cugcgcaucacccgccccucu

SEQ ID NO: 3553510 - RNA, 16 nt, Pseudomonas putida KT2440
cugcgcaucaggcugc

SEQ ID NO: 3553511 - RNA, 23 nt, Pseudomonas putida KT2440
cugcgccaaaaccuguuccagcc

SEQ ID NO: 3553512 - RNA, 12 nt, Pseudomonas putida KT2440
cugcgccaaagc

SEQ ID NO: 3553513 - RNA, 15 nt, Pseudomonas putida KT2440
cugcgccacggcgcu

SEQ ID NO: 3553514 - RNA, 12 nt, Pseudomonas putida KT2440
cugcgccaggca

SEQ ID NO: 3553515 - RNA, 14 nt, Pseudomonas putida KT2440
cugcgccaggcauu

SEQ ID NO: 3553516 - RNA, 17 nt, Pseudomonas putida KT2440
cugcgccaggcauugcu

SEQ ID NO: 3553517 - RNA, 22 nt, Pseudomonas putida KT2440
cugcgccagugccuucaggcac

SEQ ID NO: 3553518 - RNA, 15 nt, Pseudomonas putida KT2440
cugcgcccaaucggg

SEQ ID NO: 3553519 - RNA, 19 nt, Pseudomonas putida KT2440
cugcgcccaguagcgccac

SEQ ID NO: 3553520 - RNA, 17 nt, Pseudomonas putida KT2440
cugcgccccgcucgccu

SEQ ID NO: 3553521 - RNA, 22 nt, Pseudomonas putida KT2440
cugcgccccgcucgccuggcca

SEQ ID NO: 3553522 - RNA, 17 nt, Pseudomonas putida KT2440
cugcgcccuuugcgggu

SEQ ID NO: 3553523 - RNA, 18 nt, Pseudomonas putida KT2440
cugcgcccuuugcgggug

SEQ ID NO: 3553524 - RNA, 16 nt, Pseudomonas putida KT2440
cugcgccgagaggcgc

SEQ ID NO: 3553525 - RNA, 22 nt, Pseudomonas putida KT2440
cugcgccgaucaggaaggccuu

SEQ ID NO: 3553526 - RNA, 22 nt, Pseudomonas putida KT2440
cugcgccgccaccugcggcagg

SEQ ID NO: 3553527 - RNA, 15 nt, Pseudomonas putida KT2440
cugcgccgccuccac

SEQ ID NO: 3553528 - RNA, 20 nt, Pseudomonas putida KT2440
cugcgccgccuccaccggga

SEQ ID NO: 3553529 - RNA, 14 nt, Pseudomonas putida KT2440
cugcgccgcucugc

SEQ ID NO: 3553530 - RNA, 21 nt, Pseudomonas putida KT2440
cugcgccgguguucgcgggca

SEQ ID NO: 3553531 - RNA, 14 nt, Pseudomonas putida KT2440
cugcgccguggccg

SEQ ID NO: 3553532 - RNA, 16 nt, Pseudomonas putida KT2440
cugcgccugccgggcc

SEQ ID NO: 3553533 - RNA, 17 nt, Pseudomonas putida KT2440
cugcgccugccgggcca

SEQ ID NO: 3553534 - RNA, 14 nt, Pseudomonas putida KT2440
cugcgccugcgggu

SEQ ID NO: 3553535 - RNA, 19 nt, Pseudomonas putida KT2440
cugcgccuugcuuggcagc

SEQ ID NO: 3553536 - RNA, 23 nt, Pseudomonas putida KT2440
cugcgcgaaguggauauccagcg

SEQ ID NO: 3553537 - RNA, 22 nt, Pseudomonas putida KT2440
cugcgcgauagccuguggggca

SEQ ID NO: 3553538 - RNA, 12 nt, Pseudomonas putida KT2440
cugcgcgaucgc

SEQ ID NO: 3553539 - RNA, 18 nt, Pseudomonas putida KT2440
cugcgcggcagcccuucg

SEQ ID NO: 3553540 - RNA, 17 nt, Pseudomonas putida KT2440
cugcgcggccggucgaa

SEQ ID NO: 3553541 - RNA, 14 nt, Pseudomonas putida KT2440
cugcgcggccuugc

SEQ ID NO: 3553542 - RNA, 21 nt, Pseudomonas putida KT2440
cugcgcgggaagcccguacag

SEQ ID NO: 3553543 - RNA, 18 nt, Pseudomonas putida KT2440
cugcgcggguucugguug

SEQ ID NO: 3553544 - RNA, 23 nt, Pseudomonas putida KT2440
cugcgcgguaaacgggaagucgc

SEQ ID NO: 3553545 - RNA, 20 nt, Pseudomonas putida KT2440
cugcgcgguaaugaccugga

SEQ ID NO: 3553546 - RNA, 21 nt, Pseudomonas putida KT2440
cugcgcgucgacaaaccgcac

SEQ ID NO: 3553547 - RNA, 13 nt, Pseudomonas putida KT2440
cugcgcuacaccc

SEQ ID NO: 3553548 - RNA, 13 nt, Pseudomonas putida KT2440
cugcgcuccagca

SEQ ID NO: 3553549 - RNA, 16 nt, Pseudomonas putida KT2440
cugcgcuccagcagcu

SEQ ID NO: 3553550 - RNA, 12 nt, Pseudomonas putida KT2440
cugcgcugguac

SEQ ID NO: 3553551 - RNA, 20 nt, Pseudomonas putida KT2440
cugcgcugugccgauagaca

SEQ ID NO: 3553552 - RNA, 17 nt, Pseudomonas putida KT2440
cugcggauacagcgccc

SEQ ID NO: 3553553 - RNA, 18 nt, Pseudomonas putida KT2440
cugcggauacagcgccca

SEQ ID NO: 3553554 - RNA, 17 nt, Pseudomonas putida KT2440
cugcggcacaccacgcc

SEQ ID NO: 3553555 - RNA, 23 nt, Pseudomonas putida KT2440
cugcggcaccgucgccugcaacc

SEQ ID NO: 3553556 - RNA, 20 nt, Pseudomonas putida KT2440
cugcggcagauccugcagcc

SEQ ID NO: 3553557 - RNA, 22 nt, Pseudomonas putida KT2440
cugcggcagcacgaugacgaac

SEQ ID NO: 3553558 - RNA, 18 nt, Pseudomonas putida KT2440
cugcggcagguaggccca

SEQ ID NO: 3553559 - RNA, 22 nt, Pseudomonas putida KT2440
cugcggccaccgccucggcuac

SEQ ID NO: 3553560 - RNA, 19 nt, Pseudomonas putida KT2440
cugcggcccauucgcgggc

SEQ ID NO: 3553561 - RNA, 13 nt, Pseudomonas putida KT2440
cugcggccccugg

SEQ ID NO: 3553562 - RNA, 13 nt, Pseudomonas putida KT2440
cugcggccgcgcc

SEQ ID NO: 3553563 - RNA, 23 nt, Pseudomonas putida KT2440
cugcggccuucaagcuccccagc

SEQ ID NO: 3553564 - RNA, 13 nt, Pseudomonas putida KT2440
cugcggcgaaagc

SEQ ID NO: 3553565 - RNA, 19 nt, Pseudomonas putida KT2440
cugcggcgugcgcccggca

SEQ ID NO: 3553566 - RNA, 17 nt, Pseudomonas putida KT2440
cugcggcugcucgauca

SEQ ID NO: 3553567 - RNA, 19 nt, Pseudomonas putida KT2440
cugcggcuguucgcagcac

SEQ ID NO: 3553568 - RNA, 14 nt, Pseudomonas putida KT2440
cugcggggcagccc

SEQ ID NO: 3553569 - RNA, 17 nt, Pseudomonas putida KT2440
cugcggggugcucugcc

SEQ ID NO: 3553570 - RNA, 18 nt, Pseudomonas putida KT2440
cugcggggugcucugccg

SEQ ID NO: 3553571 - RNA, 20 nt, Pseudomonas putida KT2440
cugcggggugcucugccgca

SEQ ID NO: 3553572 - RNA, 17 nt, Pseudomonas putida KT2440
cugcggguaaugccacc

SEQ ID NO: 3553573 - RNA, 14 nt, Pseudomonas putida KT2440
cugcuggccuugca

SEQ ID NO: 3553574 - RNA, 18 nt, Pseudomonas putida KT2440
cugcuggcgcgaccauca

SEQ ID NO: 3553575 - RNA, 23 nt, Pseudomonas putida KT2440
cugcuggcgcgaccaucaccgcc

SEQ ID NO: 3553576 - RNA, 22 nt, Pseudomonas putida KT2440
cugcuggcggcugagccggcug

SEQ ID NO: 3553577 - RNA, 21 nt, Pseudomonas putida KT2440
cugcugggcaagggccugcag

SEQ ID NO: 3553578 - RNA, 21 nt, Pseudomonas putida KT2440
cugcugggcgaugaucgccug

SEQ ID NO: 3553579 - RNA, 18 nt, Pseudomonas putida KT2440
cugcugggucagcacuug

SEQ ID NO: 3553580 - RNA, 16 nt, Pseudomonas putida KT2440
cugcugguacagccgg

SEQ ID NO: 3553581 - RNA, 16 nt, Pseudomonas putida KT2440
cugcugguacaugccg

SEQ ID NO: 3553582 - RNA, 23 nt, Pseudomonas putida KT2440
cugcugguccucgacgggcaggc

SEQ ID NO: 3553583 - RNA, 15 nt, Pseudomonas putida KT2440
cugcugguccuugca

SEQ ID NO: 3553584 - RNA, 11 nt, Pseudomonas putida KT2440
cugcuggucgc

SEQ ID NO: 3553585 - RNA, 16 nt, Pseudomonas putida KT2440
cugcugguucaucgac

SEQ ID NO: 3553586 - RNA, 15 nt, Pseudomonas putida KT2440
cugcugucggucagg

SEQ ID NO: 3553587 - RNA, 18 nt, Pseudomonas putida KT2440
cugcugucggucagggca

SEQ ID NO: 3553588 - RNA, 16 nt, Pseudomonas putida KT2440
cugcugugcggcuggc

SEQ ID NO: 3553589 - RNA, 18 nt, Pseudomonas putida KT2440
cugcugugcggcuggcgu

SEQ ID NO: 3553590 - RNA, 20 nt, Pseudomonas putida KT2440
cugcuguggaacagccuugu

SEQ ID NO: 3553591 - RNA, 16 nt, Pseudomonas putida KT2440
cugcuuaccagcuugg

SEQ ID NO: 3553592 - RNA, 21 nt, Pseudomonas putida KT2440
cugcuucagcucgaacccacu

SEQ ID NO: 3553593 - RNA, 14 nt, Pseudomonas putida KT2440
cugcuucaggccuu

SEQ ID NO: 3553594 - RNA, 12 nt, Pseudomonas putida KT2440
cugcuucgcggg

SEQ ID NO: 3553595 - RNA, 20 nt, Pseudomonas putida KT2440
cugcuucgcgggcacgcccg

SEQ ID NO: 3553596 - RNA, 21 nt, Pseudomonas putida KT2440
cugcuucgcgggcacgcccgc

SEQ ID NO: 3553597 - RNA, 18 nt, Pseudomonas putida KT2440
cugcuucgggaauaccag

SEQ ID NO: 3553598 - RNA, 23 nt, Pseudomonas putida KT2440
cugcuugaacacauagaacaggu

SEQ ID NO: 3553599 - RNA, 22 nt, Pseudomonas putida KT2440
cugcuugaacgagccagccagg

SEQ ID NO: 3553600 - RNA, 17 nt, Pseudomonas putida KT2440
cugcuugaucaggcccg

SEQ ID NO: 3553601 - RNA, 22 nt, Pseudomonas putida KT2440
cugcuugcccagauccauguac

SEQ ID NO: 3553602 - RNA, 17 nt, Pseudomonas putida KT2440
cugcuugccgcuggcau

SEQ ID NO: 3553603 - RNA, 19 nt, Pseudomonas putida KT2440
cugcuugcucugugcaugc

SEQ ID NO: 3553604 - RNA, 12 nt, Pseudomonas putida KT2440
cugcuuggcacc

SEQ ID NO: 3553605 - RNA, 15 nt, Pseudomonas putida KT2440
cugcuuuaucuccaa

SEQ ID NO: 3553606 - RNA, 20 nt, Pseudomonas putida KT2440
cuggaaaagcaaggcucagg

SEQ ID NO: 3553607 - RNA, 14 nt, Pseudomonas putida KT2440
cuggaaaaugcccc

SEQ ID NO: 3553608 - RNA, 19 nt, Pseudomonas putida KT2440
cuggaaauucucggcugcc

SEQ ID NO: 3553609 - RNA, 22 nt, Pseudomonas putida KT2440
cuggaacgugcgggcuuguccg

SEQ ID NO: 3553610 - RNA, 18 nt, Pseudomonas putida KT2440
cuggaacucgaucggcac

SEQ ID NO: 3553611 - RNA, 14 nt, Pseudomonas putida KT2440
cuggaacugcugca

SEQ ID NO: 3553612 - RNA, 14 nt, Pseudomonas putida KT2440
cuggaacugguuga

SEQ ID NO: 3553613 - RNA, 14 nt, Pseudomonas putida KT2440
cuggaagagcagga

SEQ ID NO: 3553614 - RNA, 16 nt, Pseudomonas putida KT2440
cuggaagagcaggaag

SEQ ID NO: 3553615 - RNA, 13 nt, Pseudomonas putida KT2440
cuggaauaccacc

SEQ ID NO: 3553616 - RNA, 15 nt, Pseudomonas putida KT2440
cuggaauaccaccuc

SEQ ID NO: 3553617 - RNA, 18 nt, Pseudomonas putida KT2440
cuggaauuauuggccagc

SEQ ID NO: 3553618 - RNA, 22 nt, Pseudomonas putida KT2440
cuggaauucgcugcgcaucacc

SEQ ID NO: 3553619 - RNA, 12 nt, Pseudomonas putida KT2440
cuggacaaucuc

SEQ ID NO: 3553620 - RNA, 16 nt, Pseudomonas putida KT2440
cuggacaccucccgcg

SEQ ID NO: 3553621 - RNA, 23 nt, Pseudomonas putida KT2440
cuggacaccucccgcgcauccuc

SEQ ID NO: 3553622 - RNA, 17 nt, Pseudomonas putida KT2440
cuggacauaucgcugau

SEQ ID NO: 3553623 - RNA, 16 nt, Pseudomonas putida KT2440
cuggaccaucacggaa

SEQ ID NO: 3553624 - RNA, 20 nt, Pseudomonas putida KT2440
cuggacccaaucgcugugca

SEQ ID NO: 3553625 - RNA, 13 nt, Pseudomonas putida KT2440
cuggaccccgccc

SEQ ID NO: 3553626 - RNA, 17 nt, Pseudomonas putida KT2440
cuggaccccgcccuagc

SEQ ID NO: 3553627 - RNA, 18 nt, Pseudomonas putida KT2440
cuggaccccgcccuagcg

SEQ ID NO: 3553628 - RNA, 15 nt, Pseudomonas putida KT2440
cuggaccuggcuggc

SEQ ID NO: 3553629 - RNA, 18 nt, Pseudomonas putida KT2440
cuggacgcgugcaaggga

SEQ ID NO: 3553630 - RNA, 20 nt, Pseudomonas putida KT2440
cuggacgugguugcugaugu

SEQ ID NO: 3553631 - RNA, 16 nt, Pseudomonas putida KT2440
cuggagccggaucgac

SEQ ID NO: 3553632 - RNA, 16 nt, Pseudomonas putida KT2440
cuggaggaguccagcu

SEQ ID NO: 3553633 - RNA, 18 nt, Pseudomonas putida KT2440
cuggaggaguccagcugc

SEQ ID NO: 3553634 - RNA, 18 nt, Pseudomonas putida KT2440
cuggaggugauggucacc

SEQ ID NO: 3553635 - RNA, 17 nt, Pseudomonas putida KT2440
cuggauaugcuccaugu

SEQ ID NO: 3553636 - RNA, 20 nt, Pseudomonas putida KT2440
cuggaucacugccagcaccu

SEQ ID NO: 3553637 - RNA, 20 nt, Pseudomonas putida KT2440
cuggaucagugucugcgccu

SEQ ID NO: 3553638 - RNA, 23 nt, Pseudomonas putida KT2440
cuggaucagugucugcgccugcu

SEQ ID NO: 3553639 - RNA, 22 nt, Pseudomonas putida KT2440
cuggaucgcucucgcuuuugcu

SEQ ID NO: 3553640 - RNA, 12 nt, Pseudomonas putida KT2440
cuggaugacgcc

SEQ ID NO: 3553641 - RNA, 15 nt, Pseudomonas putida KT2440
cuggaugauccagcc

SEQ ID NO: 3553642 - RNA, 14 nt, Pseudomonas putida KT2440
cuggauggcgcggu

SEQ ID NO: 3553643 - RNA, 21 nt, Pseudomonas putida KT2440
cuggauguugugcgaaacccc

SEQ ID NO: 3553644 - RNA, 18 nt, Pseudomonas putida KT2440
cuggcaacccgccuccug

SEQ ID NO: 3553645 - RNA, 20 nt, Pseudomonas putida KT2440
cuggcaaucagcucuucgau

SEQ ID NO: 3553646 - RNA, 17 nt, Pseudomonas putida KT2440
cuggcaauccagcguga

SEQ ID NO: 3553647 - RNA, 16 nt, Pseudomonas putida KT2440
cuggcacagaacaaua

SEQ ID NO: 3553648 - RNA, 17 nt, Pseudomonas putida KT2440
cuggcacagaacaauaa

SEQ ID NO: 3553649 - RNA, 18 nt, Pseudomonas putida KT2440
cuggcacagaacaauaaa

SEQ ID NO: 3553650 - RNA, 16 nt, Pseudomonas putida KT2440
cuggcacaggcuacgc

SEQ ID NO: 3553651 - RNA, 20 nt, Pseudomonas putida KT2440
cuggcacaggcuacgcagca

SEQ ID NO: 3553652 - RNA, 21 nt, Pseudomonas putida KT2440
cuggcacaggcuacgcagcac

SEQ ID NO: 3553653 - RNA, 20 nt, Pseudomonas putida KT2440
cuggcaccaguuccagggcg

SEQ ID NO: 3553654 - RNA, 16 nt, Pseudomonas putida KT2440
cuggcacccgcaggac

SEQ ID NO: 3553655 - RNA, 18 nt, Pseudomonas putida KT2440
cuggcaccggcugcgccg

SEQ ID NO: 3553656 - RNA, 20 nt, Pseudomonas putida KT2440
cuggcacgcccggcaccugc

SEQ ID NO: 3553657 - RNA, 14 nt, Pseudomonas putida KT2440
cuggcacgccuuca

SEQ ID NO: 3553658 - RNA, 17 nt, Pseudomonas putida KT2440
cuggcacgccuucagca

SEQ ID NO: 3553659 - RNA, 20 nt, Pseudomonas putida KT2440
cuggcacgccuucagcagcc

SEQ ID NO: 3553660 - RNA, 13 nt, Pseudomonas putida KT2440
cuggcacgugcag

SEQ ID NO: 3553661 - RNA, 21 nt, Pseudomonas putida KT2440
cuggcacucucgcggugccuu

SEQ ID NO: 3553662 - RNA, 12 nt, Pseudomonas putida KT2440
cuggcacugaca

SEQ ID NO: 3553663 - RNA, 15 nt, Pseudomonas putida KT2440
cuggcacugcccaag

SEQ ID NO: 3553664 - RNA, 14 nt, Pseudomonas putida KT2440
cuggcacugcgggu

SEQ ID NO: 3553665 - RNA, 17 nt, Pseudomonas putida KT2440
cuggcagcacgaucagc

SEQ ID NO: 3553666 - RNA, 23 nt, Pseudomonas putida KT2440
cuggcagcacgaucagcgcggca

SEQ ID NO: 3553667 - RNA, 13 nt, Pseudomonas putida KT2440
cuggcagcagugc

SEQ ID NO: 3553668 - RNA, 14 nt, Pseudomonas putida KT2440
cuggcagcgggcug

SEQ ID NO: 3553669 - RNA, 15 nt, Pseudomonas putida KT2440
cuggcagcuccagcc

SEQ ID NO: 3553670 - RNA, 18 nt, Pseudomonas putida KT2440
cuggcagcugcagugcug

SEQ ID NO: 3553671 - RNA, 23 nt, Pseudomonas putida KT2440
cuggcagcugcagugcugggcau

SEQ ID NO: 3553672 - RNA, 19 nt, Pseudomonas putida KT2440
cuggcagcuucucgcggcg

SEQ ID NO: 3553673 - RNA, 17 nt, Pseudomonas putida KT2440
cuggcagcuugcccugc

SEQ ID NO: 3553674 - RNA, 15 nt, Pseudomonas putida KT2440
cuggcagcuuggcca

SEQ ID NO: 3553675 - RNA, 14 nt, Pseudomonas putida KT2440
cuggcaggccuugu

SEQ ID NO: 3553676 - RNA, 16 nt, Pseudomonas putida KT2440
cuggcaggcucagggc

SEQ ID NO: 3553677 - RNA, 20 nt, Pseudomonas putida KT2440
cuggcaggcucagggcagca

SEQ ID NO: 3553678 - RNA, 20 nt, Pseudomonas putida KT2440
cuggcgcgcugugcucagca

SEQ ID NO: 3553679 - RNA, 14 nt, Pseudomonas putida KT2440
cuggcgcuccaugu

SEQ ID NO: 3553680 - RNA, 22 nt, Pseudomonas putida KT2440
cuggcgcuccauguaacgcucc

SEQ ID NO: 3553681 - RNA, 16 nt, Pseudomonas putida KT2440
cuggcgcuuuccagcu

SEQ ID NO: 3553682 - RNA, 19 nt, Pseudomonas putida KT2440
cuggcggaucugacggcgc

SEQ ID NO: 3553683 - RNA, 15 nt, Pseudomonas putida KT2440
cuggcggcccgccgg

SEQ ID NO: 3553684 - RNA, 18 nt, Pseudomonas putida KT2440
cuggcggcccgccggcaa

SEQ ID NO: 3553685 - RNA, 20 nt, Pseudomonas putida KT2440
cuggcggcccgccggcaacu

SEQ ID NO: 3553686 - RNA, 17 nt, Pseudomonas putida KT2440
cuggcggcgaugugguu

SEQ ID NO: 3553687 - RNA, 13 nt, Pseudomonas putida KT2440
cuggcggcugagc

SEQ ID NO: 3553688 - RNA, 14 nt, Pseudomonas putida KT2440
cuggcggcugagcc

SEQ ID NO: 3553689 - RNA, 18 nt, Pseudomonas putida KT2440
cuggcgggguggccggca

SEQ ID NO: 3553690 - RNA, 16 nt, Pseudomonas putida KT2440
cuggcgguugaccagg

SEQ ID NO: 3553691 - RNA, 19 nt, Pseudomonas putida KT2440
cuggcgguugaccagggcg

SEQ ID NO: 3553692 - RNA, 18 nt, Pseudomonas putida KT2440
cuggcguauuuccugagc

SEQ ID NO: 3553693 - RNA, 17 nt, Pseudomonas putida KT2440
cuggcgucauccugcgc

SEQ ID NO: 3553694 - RNA, 12 nt, Pseudomonas putida KT2440
cuggcgucgaug

SEQ ID NO: 3553695 - RNA, 14 nt, Pseudomonas putida KT2440
cuggcgucgaugau

SEQ ID NO: 3553696 - RNA, 17 nt, Pseudomonas putida KT2440
cuggcgucgaugaucac

SEQ ID NO: 3553697 - RNA, 20 nt, Pseudomonas putida KT2440
cuggcuacagaucagccacg

SEQ ID NO: 3553698 - RNA, 22 nt, Pseudomonas putida KT2440
cuggcuacccgcucggccuugu

SEQ ID NO: 3553699 - RNA, 14 nt, Pseudomonas putida KT2440
cuggcucaggcgcu

SEQ ID NO: 3553700 - RNA, 24 nt, Pseudomonas putida KT2440
cuggcucaguggcugcacuucgau

SEQ ID NO: 3553701 - RNA, 16 nt, Pseudomonas putida KT2440
cuggcucaucugccgg

SEQ ID NO: 3553702 - RNA, 16 nt, Pseudomonas putida KT2440
cuggcucgaucacgaa

SEQ ID NO: 3553703 - RNA, 14 nt, Pseudomonas putida KT2440
cuggcucggcuggg

SEQ ID NO: 3553704 - RNA, 17 nt, Pseudomonas putida KT2440
cuggcucggcugggcuu

SEQ ID NO: 3553705 - RNA, 18 nt, Pseudomonas putida KT2440
cuggcucggugugcaccu

SEQ ID NO: 3553706 - RNA, 13 nt, Pseudomonas putida KT2440
cuggcucuucaac

SEQ ID NO: 3553707 - RNA, 20 nt, Pseudomonas putida KT2440
cuggcucuucaacaccagca

SEQ ID NO: 3553708 - RNA, 20 nt, Pseudomonas putida KT2440
cuggcugaccagugucugca

SEQ ID NO: 3553709 - RNA, 18 nt, Pseudomonas putida KT2440
cuggcugagguucagcgc

SEQ ID NO: 3553710 - RNA, 19 nt, Pseudomonas putida KT2440
cuggcugagguucagcgca

SEQ ID NO: 3553711 - RNA, 21 nt, Pseudomonas putida KT2440
cuggcugagguucagcgcacc

SEQ ID NO: 3553712 - RNA, 17 nt, Pseudomonas putida KT2440
cuggcugaucagcaugu

SEQ ID NO: 3553713 - RNA, 19 nt, Pseudomonas putida KT2440
cuggcugaucucacggcca

SEQ ID NO: 3553714 - RNA, 21 nt, Pseudomonas putida KT2440
cuggcugaucucacggccauc

SEQ ID NO: 3553715 - RNA, 16 nt, Pseudomonas putida KT2440
cuggcugcaaggucca

SEQ ID NO: 3553716 - RNA, 16 nt, Pseudomonas putida KT2440
cuggcugcacugggcg

SEQ ID NO: 3553717 - RNA, 23 nt, Pseudomonas putida KT2440
cuggcugccuucgcucaggugca

SEQ ID NO: 3553718 - RNA, 12 nt, Pseudomonas putida KT2440
cuggcugcugcg

SEQ ID NO: 3553719 - RNA, 14 nt, Pseudomonas putida KT2440
cuggcugcuguggu

SEQ ID NO: 3553720 - RNA, 16 nt, Pseudomonas putida KT2440
cuggcuggucuccagc

SEQ ID NO: 3553721 - RNA, 22 nt, Pseudomonas putida KT2440
cuggcuggugacaacgcccgcc

SEQ ID NO: 3553722 - RNA, 16 nt, Pseudomonas putida KT2440
cuggcuguaccggccu

SEQ ID NO: 3553723 - RNA, 17 nt, Pseudomonas putida KT2440
cuggcuguaccggccuc

SEQ ID NO: 3553724 - RNA, 17 nt, Pseudomonas putida KT2440
cuggcugugauacagca

SEQ ID NO: 3553725 - RNA, 18 nt, Pseudomonas putida KT2440
cuggcuuacaucaugccg

SEQ ID NO: 3553726 - RNA, 23 nt, Pseudomonas putida KT2440
cuggcuuacaucaugccgcccau

SEQ ID NO: 3553727 - RNA, 16 nt, Pseudomonas putida KT2440
cuggcuuccucuucaa

SEQ ID NO: 3553728 - RNA, 14 nt, Pseudomonas putida KT2440
cuggcuuggcugcg

SEQ ID NO: 3553729 - RNA, 15 nt, Pseudomonas putida KT2440
cuggcuuucccccag

SEQ ID NO: 3553730 - RNA, 18 nt, Pseudomonas putida KT2440
cuggcuuucccccagcca

SEQ ID NO: 3553731 - RNA, 19 nt, Pseudomonas putida KT2440
cugggaagcugcagcagcu

SEQ ID NO: 3553732 - RNA, 17 nt, Pseudomonas putida KT2440
cugggaauccagugcag

SEQ ID NO: 3553733 - RNA, 17 nt, Pseudomonas putida KT2440
cugggcaaaaucgacca

SEQ ID NO: 3553734 - RNA, 22 nt, Pseudomonas putida KT2440
cugggcaaaaucgaccagggcc

SEQ ID NO: 3553735 - RNA, 23 nt, Pseudomonas putida KT2440
cugggcaaaaucgaccagggccu

SEQ ID NO: 3553736 - RNA, 20 nt, Pseudomonas putida KT2440
cugggcaagggccugcaggc

SEQ ID NO: 3553737 - RNA, 17 nt, Pseudomonas putida KT2440
cugggcaccaaacacgc

SEQ ID NO: 3553738 - RNA, 20 nt, Pseudomonas putida KT2440
cugggcaccaaacacgcccu

SEQ ID NO: 3553739 - RNA, 17 nt, Pseudomonas putida KT2440
cugggcacccugaucga

SEQ ID NO: 3553740 - RNA, 20 nt, Pseudomonas putida KT2440
cugggcacccugaucgauga

SEQ ID NO: 3553741 - RNA, 13 nt, Pseudomonas putida KT2440
cugggcauccagc

SEQ ID NO: 3553742 - RNA, 19 nt, Pseudomonas putida KT2440
cugggcauccagcuugcca

SEQ ID NO: 3553743 - RNA, 20 nt, Pseudomonas putida KT2440
cugggcauccagcuugccac

SEQ ID NO: 3553744 - RNA, 19 nt, Pseudomonas putida KT2440
cugggcaugagccuggccg

SEQ ID NO: 3553745 - RNA, 23 nt, Pseudomonas putida KT2440
cugggcauuggagcguugcaggc

SEQ ID NO: 3553746 - RNA, 21 nt, Pseudomonas putida KT2440
cugggccaguaccuucuggcu

SEQ ID NO: 3553747 - RNA, 15 nt, Pseudomonas putida KT2440
cugggccccaggcgg

SEQ ID NO: 3553748 - RNA, 16 nt, Pseudomonas putida KT2440
cugggcccgcccagcu

SEQ ID NO: 3553749 - RNA, 22 nt, Pseudomonas putida KT2440
cugggccgguccuuucgcgggu

SEQ ID NO: 3553750 - RNA, 16 nt, Pseudomonas putida KT2440
cugggccucaucaucg

SEQ ID NO: 3553751 - RNA, 17 nt, Pseudomonas putida KT2440
cugggccucaucaucga

SEQ ID NO: 3553752 - RNA, 23 nt, Pseudomonas putida KT2440
cugggcgaacgccugcagggccu

SEQ ID NO: 3553753 - RNA, 21 nt, Pseudomonas putida KT2440
cugggcgaaggugucgaacuu

SEQ ID NO: 3553754 - RNA, 14 nt, Pseudomonas putida KT2440
cugggcgagccacu

SEQ ID NO: 3553755 - RNA, 20 nt, Pseudomonas putida KT2440
cugggcgagccacucggcaa

SEQ ID NO: 3553756 - RNA, 13 nt, Pseudomonas putida KT2440
cugggcgaucaca

SEQ ID NO: 3553757 - RNA, 22 nt, Pseudomonas putida KT2440
cugggcgaucacauaaggcagc

SEQ ID NO: 3553758 - RNA, 18 nt, Pseudomonas putida KT2440
cugggcgaugaucgccug

SEQ ID NO: 3553759 - RNA, 20 nt, Pseudomonas putida KT2440
cugggcgaugaucgccuggc

SEQ ID NO: 3553760 - RNA, 16 nt, Pseudomonas putida KT2440
cugggcgcggcgggca

SEQ ID NO: 3553761 - RNA, 17 nt, Pseudomonas putida KT2440
cugggcgcggcgggcau

SEQ ID NO: 3553762 - RNA, 17 nt, Pseudomonas putida KT2440
cugggcgcuuugcaccc

SEQ ID NO: 3553763 - RNA, 23 nt, Pseudomonas putida KT2440
cugggcgucaucacccgggaaca

SEQ ID NO: 3553764 - RNA, 16 nt, Pseudomonas putida KT2440
cugggcguccuucucc

SEQ ID NO: 3553765 - RNA, 20 nt, Pseudomonas putida KT2440
cugggcgugaaagcaggaug

SEQ ID NO: 3553766 - RNA, 16 nt, Pseudomonas putida KT2440
cugggcgugacggcga

SEQ ID NO: 3553767 - RNA, 20 nt, Pseudomonas putida KT2440
cugggcgugccaggcuuggc

SEQ ID NO: 3553768 - RNA, 21 nt, Pseudomonas putida KT2440
cugggcgugccaggcuuggcg

SEQ ID NO: 3553769 - RNA, 23 nt, Pseudomonas putida KT2440
cugggcguuuccagguuccauag

SEQ ID NO: 3553770 - RNA, 15 nt, Pseudomonas putida KT2440
cugggcuucaugcug

SEQ ID NO: 3553771 - RNA, 18 nt, Pseudomonas putida KT2440
cugggcuucaugcugcug

SEQ ID NO: 3553772 - RNA, 20 nt, Pseudomonas putida KT2440
cugggcuucaugcugcugca

SEQ ID NO: 3553773 - RNA, 21 nt, Pseudomonas putida KT2440
cugggcuucaugcugcugcag

SEQ ID NO: 3553774 - RNA, 15 nt, Pseudomonas putida KT2440
cugggcuucgacaac

SEQ ID NO: 3553775 - RNA, 20 nt, Pseudomonas putida KT2440
cuggggaucgggauguucag

SEQ ID NO: 3553776 - RNA, 20 nt, Pseudomonas putida KT2440
cuggggccaaguggcuggac

SEQ ID NO: 3553777 - RNA, 21 nt, Pseudomonas putida KT2440
cuggggccagccggcgcugga

SEQ ID NO: 3553778 - RNA, 21 nt, Pseudomonas putida KT2440
cuggggcugcaccgcagcccc

SEQ ID NO: 3553779 - RNA, 23 nt, Pseudomonas putida KT2440
cugggggucgcccgcaacaccag

SEQ ID NO: 3553780 - RNA, 14 nt, Pseudomonas putida KT2440
cuggggugggguac

SEQ ID NO: 3553781 - RNA, 21 nt, Pseudomonas putida KT2440
cuggguauagguccagcucug

SEQ ID NO: 3553782 - RNA, 13 nt, Pseudomonas putida KT2440
cuguccagcaagg

SEQ ID NO: 3553783 - RNA, 12 nt, Pseudomonas putida KT2440
cuguccagcgca

SEQ ID NO: 3553784 - RNA, 12 nt, Pseudomonas putida KT2440
cuguccaggcaa

SEQ ID NO: 3553785 - RNA, 15 nt, Pseudomonas putida KT2440
cugucccagcuggca

SEQ ID NO: 3553786 - RNA, 20 nt, Pseudomonas putida KT2440
cugucccggcacaaccgaac

SEQ ID NO: 3553787 - RNA, 20 nt, Pseudomonas putida KT2440
cuguccggcgugaaauccuc

SEQ ID NO: 3553788 - RNA, 21 nt, Pseudomonas putida KT2440
cuguccggcgugaaauccuca

SEQ ID NO: 3553789 - RNA, 21 nt, Pseudomonas putida KT2440
cuguccgggcucgucacgggu

SEQ ID NO: 3553790 - RNA, 13 nt, Pseudomonas putida KT2440
cuguccuccugcc

SEQ ID NO: 3553791 - RNA, 21 nt, Pseudomonas putida KT2440
cuguccuuggccaacugcagc

SEQ ID NO: 3553792 - RNA, 21 nt, Pseudomonas putida KT2440
cugucgaacaggcugccgcgg

SEQ ID NO: 3553793 - RNA, 14 nt, Pseudomonas putida KT2440
cugucgaacgcugc

SEQ ID NO: 3553794 - RNA, 14 nt, Pseudomonas putida KT2440
cugucgaagcgcuc

SEQ ID NO: 3553795 - RNA, 20 nt, Pseudomonas putida KT2440
cugucgaagcgcucccaggc

SEQ ID NO: 3553796 - RNA, 15 nt, Pseudomonas putida KT2440
cugucgagcagguuc

SEQ ID NO: 3553797 - RNA, 21 nt, Pseudomonas putida KT2440
cugucgagcuuggcguccaca

SEQ ID NO: 3553798 - RNA, 18 nt, Pseudomonas putida KT2440
cugucgaucacgggcaau

SEQ ID NO: 3553799 - RNA, 18 nt, Pseudomonas putida KT2440
cugucgaugucuuucgcg

SEQ ID NO: 3553800 - RNA, 12 nt, Pseudomonas putida KT2440
cugucgcgccag

SEQ ID NO: 3553801 - RNA, 16 nt, Pseudomonas putida KT2440
cugucgcucuuaauuc

SEQ ID NO: 3553802 - RNA, 14 nt, Pseudomonas putida KT2440
cugucggcgcggau

SEQ ID NO: 3553803 - RNA, 16 nt, Pseudomonas putida KT2440
cugucggcgucggcca

SEQ ID NO: 3553804 - RNA, 22 nt, Pseudomonas putida KT2440
cugucgguaccuggccgugccg

SEQ ID NO: 3553805 - RNA, 16 nt, Pseudomonas putida KT2440
cugucggucacagcag

SEQ ID NO: 3553806 - RNA, 14 nt, Pseudomonas putida KT2440
cugucguccagcuc

SEQ ID NO: 3553807 - RNA, 16 nt, Pseudomonas putida KT2440
cugucuagccgccugc

SEQ ID NO: 3553808 - RNA, 13 nt, Pseudomonas putida KT2440
cugucuuccaggg

SEQ ID NO: 3553809 - RNA, 17 nt, Pseudomonas putida KT2440
cugucuuccagggcaau

SEQ ID NO: 3553810 - RNA, 19 nt, Pseudomonas putida KT2440
cugugaagccagggcaagc

SEQ ID NO: 3553811 - RNA, 20 nt, Pseudomonas putida KT2440
cugugaagccagggcaagca

SEQ ID NO: 3553812 - RNA, 21 nt, Pseudomonas putida KT2440
cugugagaucgagcgccgccc

SEQ ID NO: 3553813 - RNA, 11 nt, Pseudomonas putida KT2440
cugugagaugu

SEQ ID NO: 3553814 - RNA, 17 nt, Pseudomonas putida KT2440
cugugaggccagcggga

SEQ ID NO: 3553815 - RNA, 23 nt, Pseudomonas putida KT2440
cugugaggccuucagcgcggcaa

SEQ ID NO: 3553816 - RNA, 20 nt, Pseudomonas putida KT2440
cugugcacagccgugccuuc

SEQ ID NO: 3553817 - RNA, 20 nt, Pseudomonas putida KT2440
cugugcacugcgaagcccag

SEQ ID NO: 3553818 - RNA, 23 nt, Pseudomonas putida KT2440
cugugcacugcgaagcccaguuc

SEQ ID NO: 3553819 - RNA, 15 nt, Pseudomonas putida KT2440
cugugcagcgaccau

SEQ ID NO: 3553820 - RNA, 18 nt, Pseudomonas putida KT2440
cugugcaggggagggcgu

SEQ ID NO: 3553821 - RNA, 16 nt, Pseudomonas putida KT2440
cugugcaugcgccccc

SEQ ID NO: 3553822 - RNA, 14 nt, Pseudomonas putida KT2440
cugugccagcgagg

SEQ ID NO: 3553823 - RNA, 15 nt, Pseudomonas putida KT2440
cugugccagcgaggc

SEQ ID NO: 3553824 - RNA, 20 nt, Pseudomonas putida KT2440
cugugcccgccaggcgcaag

SEQ ID NO: 3553825 - RNA, 17 nt, Pseudomonas putida KT2440
cugugcccggcgcgcgc

SEQ ID NO: 3553826 - RNA, 19 nt, Pseudomonas putida KT2440
cugugcccugaucgccucc

SEQ ID NO: 3553827 - RNA, 21 nt, Pseudomonas putida KT2440
cugugcccugaucgccuccag

SEQ ID NO: 3553828 - RNA, 23 nt, Pseudomonas putida KT2440
cugugcccugaucgccuccaggc

SEQ ID NO: 3553829 - RNA, 18 nt, Pseudomonas putida KT2440
cugugccgcuuuggcagc

SEQ ID NO: 3553830 - RNA, 19 nt, Pseudomonas putida KT2440
cugugccgcuuuggcagca

SEQ ID NO: 3553831 - RNA, 21 nt, Pseudomonas putida KT2440
cugugccgcuuuggcagcagc

SEQ ID NO: 3553832 - RNA, 22 nt, Pseudomonas putida KT2440
cugugccgcuuuggcagcagcc

SEQ ID NO: 3553833 - RNA, 16 nt, Pseudomonas putida KT2440
cugugccggcagcgag

SEQ ID NO: 3553834 - RNA, 21 nt, Pseudomonas putida KT2440
cugugccggcagcgagcgcug

SEQ ID NO: 3553835 - RNA, 18 nt, Pseudomonas putida KT2440
cugugccggccgcuucau

SEQ ID NO: 3553836 - RNA, 15 nt, Pseudomonas putida KT2440
cugugccggccucuu

SEQ ID NO: 3553837 - RNA, 16 nt, Pseudomonas putida KT2440
cugugccggccucuuc

SEQ ID NO: 3553838 - RNA, 22 nt, Pseudomonas putida KT2440
cugugccggccucuucgcgggc

SEQ ID NO: 3553839 - RNA, 13 nt, Pseudomonas putida KT2440
cugugccgggcca

SEQ ID NO: 3553840 - RNA, 14 nt, Pseudomonas putida KT2440
cugugccgggccau

SEQ ID NO: 3553841 - RNA, 23 nt, Pseudomonas putida KT2440
cugugcggccaaugcacgccugu

SEQ ID NO: 3553842 - RNA, 19 nt, Pseudomonas putida KT2440
cugugcggcguauacccgg

SEQ ID NO: 3553843 - RNA, 13 nt, Pseudomonas putida KT2440
cugugcggcuggc

SEQ ID NO: 3553844 - RNA, 11 nt, Pseudomonas putida KT2440
cugugcugcca

SEQ ID NO: 3553845 - RNA, 15 nt, Pseudomonas putida KT2440
cugugcuggccucuu

SEQ ID NO: 3553846 - RNA, 21 nt, Pseudomonas putida KT2440
cugugcuuugagcaggcgcuc

SEQ ID NO: 3553847 - RNA, 16 nt, Pseudomonas putida KT2440
cuguggaagcgggcgu

SEQ ID NO: 3553848 - RNA, 16 nt, Pseudomonas putida KT2440
cuguggauuucaauua

SEQ ID NO: 3553849 - RNA, 20 nt, Pseudomonas putida KT2440
cuguggcaauuggcggaagc

SEQ ID NO: 3553850 - RNA, 20 nt, Pseudomonas putida KT2440
cuguggcagcggcuuggccg

SEQ ID NO: 3553851 - RNA, 16 nt, Pseudomonas putida KT2440
cugugggagcaggcau

SEQ ID NO: 3553852 - RNA, 15 nt, Pseudomonas putida KT2440
cugugggagcggccu

SEQ ID NO: 3553853 - RNA, 16 nt, Pseudomonas putida KT2440
cugugggagcggccuu

SEQ ID NO: 3553854 - RNA, 14 nt, Pseudomonas putida KT2440
cugugggagcgggc

SEQ ID NO: 3553855 - RNA, 15 nt, Pseudomonas putida KT2440
cugugggagcgggca

SEQ ID NO: 3553856 - RNA, 16 nt, Pseudomonas putida KT2440
cugugggagcgggcau

SEQ ID NO: 3553857 - RNA, 19 nt, Pseudomonas putida KT2440
cugugggagcgggcgugcc

SEQ ID NO: 3553858 - RNA, 16 nt, Pseudomonas putida KT2440
cugugggagcgggcuu

SEQ ID NO: 3553859 - RNA, 20 nt, Pseudomonas putida KT2440
cugugggagcgggcuugccc

SEQ ID NO: 3553860 - RNA, 22 nt, Pseudomonas putida KT2440
cugugggagcgggggcgcguca

SEQ ID NO: 3553861 - RNA, 14 nt, Pseudomonas putida KT2440
cuguggguaacccu

SEQ ID NO: 3553862 - RNA, 15 nt, Pseudomonas putida KT2440
cugugguggcugcuu

SEQ ID NO: 3553863 - RNA, 19 nt, Pseudomonas putida KT2440
cuguguaggagcggguuca

SEQ ID NO: 3553864 - RNA, 19 nt, Pseudomonas putida KT2440
cuguguccacccccgcucc

SEQ ID NO: 3553865 - RNA, 21 nt, Pseudomonas putida KT2440
cuguguccacccccgcuccua

SEQ ID NO: 3553866 - RNA, 23 nt, Pseudomonas putida KT2440
cuguguccacccccgcuccuacg

SEQ ID NO: 3553867 - RNA, 23 nt, Pseudomonas putida KT2440
cuguucagguaggccgcagccau

SEQ ID NO: 3553868 - RNA, 13 nt, Pseudomonas putida KT2440
cuguuccacagca

SEQ ID NO: 3553869 - RNA, 14 nt, Pseudomonas putida KT2440
cuguuccagcagcg

SEQ ID NO: 3553870 - RNA, 18 nt, Pseudomonas putida KT2440
cuguuccagcguagccgu

SEQ ID NO: 3553871 - RNA, 18 nt, Pseudomonas putida KT2440
cuguuccucgccauggcc

SEQ ID NO: 3553872 - RNA, 20 nt, Pseudomonas putida KT2440
cuguucgcugaugcgccgcu

SEQ ID NO: 3553873 - RNA, 19 nt, Pseudomonas putida KT2440
cuguucgcuggagaacagc

SEQ ID NO: 3553874 - RNA, 22 nt, Pseudomonas putida KT2440
cuguucguguuccccgaccaaa

SEQ ID NO: 3553875 - RNA, 22 nt, Pseudomonas putida KT2440
cuguucuugaacucgccgcgca

SEQ ID NO: 3553876 - RNA, 23 nt, Pseudomonas putida KT2440
cuguugaaggcguuuuccagguu

SEQ ID NO: 3553877 - RNA, 23 nt, Pseudomonas putida KT2440
cuguugaucagguuacuggccaa

SEQ ID NO: 3553878 - RNA, 15 nt, Pseudomonas putida KT2440
cuguugcagcgccag

SEQ ID NO: 3553879 - RNA, 15 nt, Pseudomonas putida KT2440
cuguugccgccacca

SEQ ID NO: 3553880 - RNA, 16 nt, Pseudomonas putida KT2440
cuguugcgcaccuugu

SEQ ID NO: 3553881 - RNA, 17 nt, Pseudomonas putida KT2440
cuguugcgucaacucau

SEQ ID NO: 3553882 - RNA, 22 nt, Pseudomonas putida KT2440
cuguugcugcagguucugaauc

SEQ ID NO: 3553883 - RNA, 17 nt, Pseudomonas putida KT2440
cuguugcugcaguucag

SEQ ID NO: 3553884 - RNA, 14 nt, Pseudomonas putida KT2440
cuguuggcacgugc

SEQ ID NO: 3553885 - RNA, 15 nt, Pseudomonas putida KT2440
cuguuggccuucccu

SEQ ID NO: 3553886 - RNA, 22 nt, Pseudomonas putida KT2440
cuguuggccuucccuucuuugu

SEQ ID NO: 3553887 - RNA, 23 nt, Pseudomonas putida KT2440
cuucaugcaauaaccaaucaacg

SEQ ID NO: 3553888 - RNA, 23 nt, Pseudomonas putida KT2440
cuucaugcacaacgcgcgggcaa

SEQ ID NO: 3553889 - RNA, 16 nt, Pseudomonas putida KT2440
cuuccaaccagccagc

SEQ ID NO: 3553890 - RNA, 17 nt, Pseudomonas putida KT2440
cuuccacacccagcgcg

SEQ ID NO: 3553891 - RNA, 15 nt, Pseudomonas putida KT2440
cuuccaccaccucca

SEQ ID NO: 3553892 - RNA, 16 nt, Pseudomonas putida KT2440
cuuccaccaccuccau

SEQ ID NO: 3553893 - RNA, 15 nt, Pseudomonas putida KT2440
cuuccaccgccucga

SEQ ID NO: 3553894 - RNA, 23 nt, Pseudomonas putida KT2440
cuuccaccgccucgaccuggccc

SEQ ID NO: 3553895 - RNA, 13 nt, Pseudomonas putida KT2440
cuuccaccugcgc

SEQ ID NO: 3553896 - RNA, 12 nt, Pseudomonas putida KT2440
cuuccacgccca

SEQ ID NO: 3553897 - RNA, 19 nt, Pseudomonas putida KT2440
cuuccacgcccaggcgcuu

SEQ ID NO: 3553898 - RNA, 16 nt, Pseudomonas putida KT2440
cuuccacucuuccacc

SEQ ID NO: 3553899 - RNA, 14 nt, Pseudomonas putida KT2440
cuuccagaacggcg

SEQ ID NO: 3553900 - RNA, 16 nt, Pseudomonas putida KT2440
cuuccagaccagacag

SEQ ID NO: 3553901 - RNA, 21 nt, Pseudomonas putida KT2440
cuuccagaccagacagcgcua

SEQ ID NO: 3553902 - RNA, 20 nt, Pseudomonas putida KT2440
cuuccagcagcacacgcuug

SEQ ID NO: 3553903 - RNA, 18 nt, Pseudomonas putida KT2440
cuuccagcaggacccggc

SEQ ID NO: 3553904 - RNA, 22 nt, Pseudomonas putida KT2440
cuuccagcaggacccggcugga

SEQ ID NO: 3553905 - RNA, 17 nt, Pseudomonas putida KT2440
cuuccagcccgccugcu

SEQ ID NO: 3553906 - RNA, 18 nt, Pseudomonas putida KT2440
cuuccagcccgccugcuc

SEQ ID NO: 3553907 - RNA, 23 nt, Pseudomonas putida KT2440
cuuccagcccgccugcucaauca

SEQ ID NO: 3553908 - RNA, 14 nt, Pseudomonas putida KT2440
cuuccagccugcag

SEQ ID NO: 3553909 - RNA, 15 nt, Pseudomonas putida KT2440
cuuccagccugcagc

SEQ ID NO: 3553910 - RNA, 16 nt, Pseudomonas putida KT2440
cuuccagccugcagca

SEQ ID NO: 3553911 - RNA, 18 nt, Pseudomonas putida KT2440
cuuccagccugcagcacc

SEQ ID NO: 3553912 - RNA, 14 nt, Pseudomonas putida KT2440
cuuccagcggcaag

SEQ ID NO: 3553913 - RNA, 14 nt, Pseudomonas putida KT2440
cuuccagcuccuuc

SEQ ID NO: 3553914 - RNA, 20 nt, Pseudomonas putida KT2440
cuuccagcugcgccugcaau

SEQ ID NO: 3553915 - RNA, 15 nt, Pseudomonas putida KT2440
cuuccagcugcggcu

SEQ ID NO: 3553916 - RNA, 14 nt, Pseudomonas putida KT2440
cuuccagcugucau

SEQ ID NO: 3553917 - RNA, 19 nt, Pseudomonas putida KT2440
cuuccagcuucugcugguc

SEQ ID NO: 3553918 - RNA, 18 nt, Pseudomonas putida KT2440
cuuccaggaaggccucgc

SEQ ID NO: 3553919 - RNA, 22 nt, Pseudomonas putida KT2440
cuuccagggcugguuccuggga

SEQ ID NO: 3553920 - RNA, 21 nt, Pseudomonas putida KT2440
cuuccagguaaugcgcaggcg

SEQ ID NO: 3553921 - RNA, 21 nt, Pseudomonas putida KT2440
cuuccaggucgaucgcaacgu

SEQ ID NO: 3553922 - RNA, 15 nt, Pseudomonas putida KT2440
cuuccaguuucacca

SEQ ID NO: 3553923 - RNA, 20 nt, Pseudomonas putida KT2440
cuuccaugccuucuucgaug

SEQ ID NO: 3553924 - RNA, 18 nt, Pseudomonas putida KT2440
cuuccaugcgcgcgcggu

SEQ ID NO: 3553925 - RNA, 23 nt, Pseudomonas putida KT2440
cuuccauggcaucggacgcgugg

SEQ ID NO: 3553926 - RNA, 20 nt, Pseudomonas putida KT2440
cuucccccaaucuccagccc

SEQ ID NO: 3553927 - RNA, 15 nt, Pseudomonas putida KT2440
cuucccccgggcuug

SEQ ID NO: 3553928 - RNA, 16 nt, Pseudomonas putida KT2440
cuuccccgcccaagcg

SEQ ID NO: 3553929 - RNA, 14 nt, Pseudomonas putida KT2440
cuuccccgucuucc

SEQ ID NO: 3553930 - RNA, 15 nt, Pseudomonas putida KT2440
cuuccccuuggcgac

SEQ ID NO: 3553931 - RNA, 13 nt, Pseudomonas putida KT2440
cuucccgccuggc

SEQ ID NO: 3553932 - RNA, 14 nt, Pseudomonas putida KT2440
cuucccggcaccgc

SEQ ID NO: 3553933 - RNA, 14 nt, Pseudomonas putida KT2440
cuucccggccuggc

SEQ ID NO: 3553934 - RNA, 18 nt, Pseudomonas putida KT2440
cuucccggccuggcgcag

SEQ ID NO: 3553935 - RNA, 13 nt, Pseudomonas putida KT2440
cuucccucugccu

SEQ ID NO: 3553936 - RNA, 14 nt, Pseudomonas putida KT2440
cuucccucugccug

SEQ ID NO: 3553937 - RNA, 13 nt, Pseudomonas putida KT2440
cuuccgcaugcuu

SEQ ID NO: 3553938 - RNA, 17 nt, Pseudomonas putida KT2440
cuuccgccaccacgaac

SEQ ID NO: 3553939 - RNA, 17 nt, Pseudomonas putida KT2440
cuuccgcgugccccccc

SEQ ID NO: 3553940 - RNA, 14 nt, Pseudomonas putida KT2440
cuuccggcaccccu

SEQ ID NO: 3553941 - RNA, 23 nt, Pseudomonas putida KT2440
cuuccggcaccccuuucuccagc

SEQ ID NO: 3553942 - RNA, 14 nt, Pseudomonas putida KT2440
cuuccggcaggucg

SEQ ID NO: 3553943 - RNA, 14 nt, Pseudomonas putida KT2440
cuuccggcugcagc

SEQ ID NO: 3553944 - RNA, 16 nt, Pseudomonas putida KT2440
cuuccgggaagaugca

SEQ ID NO: 3553945 - RNA, 16 nt, Pseudomonas putida KT2440
cuuccgggcacuggcu

SEQ ID NO: 3553946 - RNA, 21 nt, Pseudomonas putida KT2440
cuuccucgaacgacagcugca

SEQ ID NO: 3553947 - RNA, 20 nt, Pseudomonas putida KT2440
cuuccucggccaugcgcggg

SEQ ID NO: 3553948 - RNA, 18 nt, Pseudomonas putida KT2440
cuuccucgugaccgacca

SEQ ID NO: 3553949 - RNA, 15 nt, Pseudomonas putida KT2440
cuuccugaagacgcu

SEQ ID NO: 3553950 - RNA, 16 nt, Pseudomonas putida KT2440
cuuccugaagacgcuu

SEQ ID NO: 3553951 - RNA, 15 nt, Pseudomonas putida KT2440
cuuccugcaccuugu

SEQ ID NO: 3553952 - RNA, 13 nt, Pseudomonas putida KT2440
cuuccuggcuggc

SEQ ID NO: 3553953 - RNA, 18 nt, Pseudomonas putida KT2440
cuuccugguuuucgcggu

SEQ ID NO: 3553954 - RNA, 20 nt, Pseudomonas putida KT2440
cuuccuugaacucagugccu

SEQ ID NO: 3553955 - RNA, 23 nt, Pseudomonas putida KT2440
cuuccuugaacucagugccuggc

SEQ ID NO: 3553956 - RNA, 20 nt, Pseudomonas putida KT2440
cuuccuugaccauuuccggg

SEQ ID NO: 3553957 - RNA, 23 nt, Pseudomonas putida KT2440
cuuccuugaccauuuccgggucc

SEQ ID NO: 3553958 - RNA, 14 nt, Pseudomonas putida KT2440
cuuccuuguaggcc

SEQ ID NO: 3553959 - RNA, 14 nt, Pseudomonas putida KT2440
cuuccuugucaguc

SEQ ID NO: 3553960 - RNA, 21 nt, Pseudomonas putida KT2440
cuucgaacaauucuuccagcu

SEQ ID NO: 3553961 - RNA, 16 nt, Pseudomonas putida KT2440
cuucgaacacccgcuu

SEQ ID NO: 3553962 - RNA, 19 nt, Pseudomonas putida KT2440
cuucgaacagcgaaguguu

SEQ ID NO: 3553963 - RNA, 17 nt, Pseudomonas putida KT2440
cuucgaagaacacggcu

SEQ ID NO: 3553964 - RNA, 14 nt, Pseudomonas putida KT2440
cuucgacaguucaa

SEQ ID NO: 3553965 - RNA, 20 nt, Pseudomonas putida KT2440
cuucgaccagaacagcucga

SEQ ID NO: 3553966 - RNA, 17 nt, Pseudomonas putida KT2440
cuucgacgaagaagccu

SEQ ID NO: 3553967 - RNA, 23 nt, Pseudomonas putida KT2440
cuucgacggucggcaguuugccg

SEQ ID NO: 3553968 - RNA, 16 nt, Pseudomonas putida KT2440
cuucgaggaugcggcu

SEQ ID NO: 3553969 - RNA, 21 nt, Pseudomonas putida KT2440
cuucgaggauuuucaccuucg

SEQ ID NO: 3553970 - RNA, 15 nt, Pseudomonas putida KT2440
cuucgaucagcgccu

SEQ ID NO: 3553971 - RNA, 19 nt, Pseudomonas putida KT2440
cuucgaucaggcagucuuc

SEQ ID NO: 3553972 - RNA, 21 nt, Pseudomonas putida KT2440
cuucgauccgcgccaucagcu

SEQ ID NO: 3553973 - RNA, 16 nt, Pseudomonas putida KT2440
cuucgaucgccggcag

SEQ ID NO: 3553974 - RNA, 14 nt, Pseudomonas putida KT2440
cuucgauuagaccc

SEQ ID NO: 3553975 - RNA, 14 nt, Pseudomonas putida KT2440
cuucgauucaggcc

SEQ ID NO: 3553976 - RNA, 15 nt, Pseudomonas putida KT2440
cuucgcaggcacgcc

SEQ ID NO: 3553977 - RNA, 14 nt, Pseudomonas putida KT2440
cuucgccacugcca

SEQ ID NO: 3553978 - RNA, 14 nt, Pseudomonas putida KT2440
cuucgccagcgcca

SEQ ID NO: 3553979 - RNA, 15 nt, Pseudomonas putida KT2440
cuucgcccagugccu

SEQ ID NO: 3553980 - RNA, 17 nt, Pseudomonas putida KT2440
cuucgcccagugccuga

SEQ ID NO: 3553981 - RNA, 17 nt, Pseudomonas putida KT2440
cuucgcccgaccgccag

SEQ ID NO: 3553982 - RNA, 21 nt, Pseudomonas putida KT2440
cuucgcccgaccgccagcccg

SEQ ID NO: 3553983 - RNA, 20 nt, Pseudomonas putida KT2440
cuucgcccguguucgcgggc

SEQ ID NO: 3553984 - RNA, 21 nt, Pseudomonas putida KT2440
cuucgcccucguucgcgggca

SEQ ID NO: 3553985 - RNA, 14 nt, Pseudomonas putida KT2440
cuucgcccuucagc

SEQ ID NO: 3553986 - RNA, 15 nt, Pseudomonas putida KT2440
cuucgcccuucagcg

SEQ ID NO: 3553987 - RNA, 12 nt, Pseudomonas putida KT2440
cuucgccgccau

SEQ ID NO: 3553988 - RNA, 15 nt, Pseudomonas putida KT2440
cuucgccggcacgcc

SEQ ID NO: 3553989 - RNA, 20 nt, Pseudomonas putida KT2440
cuucgccggcacgcccgcuc

SEQ ID NO: 3553990 - RNA, 20 nt, Pseudomonas putida KT2440
cuucgccggcaucgccucca

SEQ ID NO: 3553991 - RNA, 21 nt, Pseudomonas putida KT2440
cuucgccggcaucgccuccag

SEQ ID NO: 3553992 - RNA, 17 nt, Pseudomonas putida KT2440
cuucgccguacuggcug

SEQ ID NO: 3553993 - RNA, 22 nt, Pseudomonas putida KT2440
cuugagaucagcaaccugcugg

SEQ ID NO: 3553994 - RNA, 23 nt, Pseudomonas putida KT2440
cuugagaucagcaaccugcuggg

SEQ ID NO: 3553995 - RNA, 22 nt, Pseudomonas putida KT2440
cuugagcaggucgaacagcccc

SEQ ID NO: 3553996 - RNA, 18 nt, Pseudomonas putida KT2440
cuugagcgccgcgcccau

SEQ ID NO: 3553997 - RNA, 15 nt, Pseudomonas putida KT2440
cuugagcgcgccgcc

SEQ ID NO: 3553998 - RNA, 20 nt, Pseudomonas putida KT2440
cuugagcguggcaaacccgg

SEQ ID NO: 3553999 - RNA, 13 nt, Pseudomonas putida KT2440
cuugagcuggccg

SEQ ID NO: 3554000 - RNA, 21 nt, Pseudomonas putida KT2440
cuugagcuggccguccagcug

SEQ ID NO: 3554001 - RNA, 21 nt, Pseudomonas putida KT2440
cuugagggccucuucgcgggu

SEQ ID NO: 3554002 - RNA, 23 nt, Pseudomonas putida KT2440
cuugagggccucuucgcggguaa

SEQ ID NO: 3554003 - RNA, 21 nt, Pseudomonas putida KT2440
cuugagguagucgauccaggu

SEQ ID NO: 3554004 - RNA, 18 nt, Pseudomonas putida KT2440
cuugagguccgccucgau

SEQ ID NO: 3554005 - RNA, 21 nt, Pseudomonas putida KT2440
cuugagguccgccucgaucau

SEQ ID NO: 3554006 - RNA, 21 nt, Pseudomonas putida KT2440
cuugaggugccauagcaccag

SEQ ID NO: 3554007 - RNA, 13 nt, Pseudomonas putida KT2440
cuugagguugccg

SEQ ID NO: 3554008 - RNA, 16 nt, Pseudomonas putida KT2440
cuugaguucccaggca

SEQ ID NO: 3554009 - RNA, 24 nt, Pseudomonas putida KT2440
cuugaguucccaggcagccuccag

SEQ ID NO: 3554010 - RNA, 18 nt, Pseudomonas putida KT2440
cuugaguugaguggggug

SEQ ID NO: 3554011 - RNA, 13 nt, Pseudomonas putida KT2440
cuugaucagccug

SEQ ID NO: 3554012 - RNA, 21 nt, Pseudomonas putida KT2440
cuugaucaggcccugcugcuu

SEQ ID NO: 3554013 - RNA, 18 nt, Pseudomonas putida KT2440
cuugaucaggggccgcgc

SEQ ID NO: 3554014 - RNA, 22 nt, Pseudomonas putida KT2440
cuugaucaggggccgcgcagcg

SEQ ID NO: 3554015 - RNA, 21 nt, Pseudomonas putida KT2440
cuugaucaggguuugcagcuc

SEQ ID NO: 3554016 - RNA, 20 nt, Pseudomonas putida KT2440
cuugaucgcguuacccacca

SEQ ID NO: 3554017 - RNA, 14 nt, Pseudomonas putida KT2440
cuugaucugccagg

SEQ ID NO: 3554018 - RNA, 17 nt, Pseudomonas putida KT2440
cuugaucugccaggcac

SEQ ID NO: 3554019 - RNA, 15 nt, Pseudomonas putida KT2440
cuugaucugcugcga

SEQ ID NO: 3554020 - RNA, 20 nt, Pseudomonas putida KT2440
cuugaucuguccuccugccg

SEQ ID NO: 3554021 - RNA, 20 nt, Pseudomonas putida KT2440
cuugaucuugguggucagcc

SEQ ID NO: 3554022 - RNA, 22 nt, Pseudomonas putida KT2440
cuugaugacuuuggcgucgguc

SEQ ID NO: 3554023 - RNA, 20 nt, Pseudomonas putida KT2440
cuugaugaucaggucggcgg

SEQ ID NO: 3554024 - RNA, 22 nt, Pseudomonas putida KT2440
cuugaugcugucgucaagcucu

SEQ ID NO: 3554025 - RNA, 21 nt, Pseudomonas putida KT2440
cuugcacagguaucgccgccc

SEQ ID NO: 3554026 - RNA, 16 nt, Pseudomonas putida KT2440
cuugcaccaacggcuu

SEQ ID NO: 3554027 - RNA, 17 nt, Pseudomonas putida KT2440
cuugcaccugucccagc

SEQ ID NO: 3554028 - RNA, 18 nt, Pseudomonas putida KT2440
cuugcaccugucccagcu

SEQ ID NO: 3554029 - RNA, 21 nt, Pseudomonas putida KT2440
cuugcaccugucccagcuggc

SEQ ID NO: 3554030 - RNA, 17 nt, Pseudomonas putida KT2440
cuugcacuuugccgccc

SEQ ID NO: 3554031 - RNA, 15 nt, Pseudomonas putida KT2440
cuugcagaaacgcca

SEQ ID NO: 3554032 - RNA, 16 nt, Pseudomonas putida KT2440
cuugcagaaacgccau

SEQ ID NO: 3554033 - RNA, 22 nt, Pseudomonas putida KT2440
cuugcagcgccgcauccagcac

SEQ ID NO: 3554034 - RNA, 11 nt, Pseudomonas putida KT2440
cuugcagcgcu

SEQ ID NO: 3554035 - RNA, 19 nt, Pseudomonas putida KT2440
cuugcagcucguugugcac

SEQ ID NO: 3554036 - RNA, 22 nt, Pseudomonas putida KT2440
cuugcagcucuugucgacagug

SEQ ID NO: 3554037 - RNA, 21 nt, Pseudomonas putida KT2440
cuugcaggaagcggcgcuuuu

SEQ ID NO: 3554038 - RNA, 22 nt, Pseudomonas putida KT2440
cuugcagguagcgcccgggcau

SEQ ID NO: 3554039 - RNA, 15 nt, Pseudomonas putida KT2440
cuugcaguaucgccc

SEQ ID NO: 3554040 - RNA, 16 nt, Pseudomonas putida KT2440
cuugcaguaucgcccc

SEQ ID NO: 3554041 - RNA, 18 nt, Pseudomonas putida KT2440
cuugcagucaccuggccc

SEQ ID NO: 3554042 - RNA, 16 nt, Pseudomonas putida KT2440
cuugcaguucuugauc

SEQ ID NO: 3554043 - RNA, 17 nt, Pseudomonas putida KT2440
cuugccaacggcacucg

SEQ ID NO: 3554044 - RNA, 22 nt, Pseudomonas putida KT2440
cuugccaacggcacucgaagca

SEQ ID NO: 3554045 - RNA, 20 nt, Pseudomonas putida KT2440
cuugccaccaucgaccuggc

SEQ ID NO: 3554046 - RNA, 21 nt, Pseudomonas putida KT2440
cuugccaccaucgaccuggcc

SEQ ID NO: 3554047 - RNA, 12 nt, Pseudomonas putida KT2440
cuugccagcaug

SEQ ID NO: 3554048 - RNA, 13 nt, Pseudomonas putida KT2440
cuugccagcaugg

SEQ ID NO: 3554049 - RNA, 22 nt, Pseudomonas putida KT2440
cuugccagcgucuuuggccugc

SEQ ID NO: 3554050 - RNA, 21 nt, Pseudomonas putida KT2440
cuugccagcuuggucagggca

SEQ ID NO: 3554051 - RNA, 24 nt, Pseudomonas putida KT2440
cuugccauaacuccagcgccagca

SEQ ID NO: 3554052 - RNA, 14 nt, Pseudomonas putida KT2440
cuugccaucgacca

SEQ ID NO: 3554053 - RNA, 14 nt, Pseudomonas putida KT2440
cuugccaucggcca

SEQ ID NO: 3554054 - RNA, 14 nt, Pseudomonas putida KT2440
cuugcccaccagga

SEQ ID NO: 3554055 - RNA, 24 nt, Pseudomonas putida KT2440
cuugcccagccaacccucgaccuc

SEQ ID NO: 3554056 - RNA, 14 nt, Pseudomonas putida KT2440
cuugcccagcucca

SEQ ID NO: 3554057 - RNA, 15 nt, Pseudomonas putida KT2440
cuugcccagcuccag

SEQ ID NO: 3554058 - RNA, 16 nt, Pseudomonas putida KT2440
cuugcccagcuccagc

SEQ ID NO: 3554059 - RNA, 17 nt, Pseudomonas putida KT2440
cuugcccagcuccagca

SEQ ID NO: 3554060 - RNA, 13 nt, Pseudomonas putida KT2440
cuugccccgcagg

SEQ ID NO: 3554061 - RNA, 14 nt, Pseudomonas putida KT2440
cuugcccgaggaac

SEQ ID NO: 3554062 - RNA, 23 nt, Pseudomonas putida KT2440
cuugcccgcgaagaggccggcac

SEQ ID NO: 3554063 - RNA, 14 nt, Pseudomonas putida KT2440
cuugcccucauucg

SEQ ID NO: 3554064 - RNA, 20 nt, Pseudomonas putida KT2440
cuugcccucauucgcccgca

SEQ ID NO: 3554065 - RNA, 21 nt, Pseudomonas putida KT2440
cuugcccucauucgcccgcac

SEQ ID NO: 3554066 - RNA, 20 nt, Pseudomonas putida KT2440
cuugcccugcagcuucccgg

SEQ ID NO: 3554067 - RNA, 16 nt, Pseudomonas putida KT2440
cuugcccugcuugcgg

SEQ ID NO: 3554068 - RNA, 16 nt, Pseudomonas putida KT2440
cuugccgagcagcgcg

SEQ ID NO: 3554069 - RNA, 17 nt, Pseudomonas putida KT2440
cuugccgaucagcgagu

SEQ ID NO: 3554070 - RNA, 17 nt, Pseudomonas putida KT2440
cuugccgccccgugccc

SEQ ID NO: 3554071 - RNA, 20 nt, Pseudomonas putida KT2440
cuugccgcuggcauccacca

SEQ ID NO: 3554072 - RNA, 24 nt, Pseudomonas putida KT2440
cuugccggccuugaccucgaccag

SEQ ID NO: 3554073 - RNA, 14 nt, Pseudomonas putida KT2440
cuugccgguaccgc

SEQ ID NO: 3554074 - RNA, 23 nt, Pseudomonas putida KT2440
cuugccguccagguccaggccag

SEQ ID NO: 3554075 - RNA, 12 nt, Pseudomonas putida KT2440
cuugccuuccac

SEQ ID NO: 3554076 - RNA, 22 nt, Pseudomonas putida KT2440
cuugccuuccucggccaugcgc

SEQ ID NO: 3554077 - RNA, 15 nt, Pseudomonas putida KT2440
cuugccuucggcauu

SEQ ID NO: 3554078 - RNA, 17 nt, Pseudomonas putida KT2440
cuugccuuucaucaucg

SEQ ID NO: 3554079 - RNA, 17 nt, Pseudomonas putida KT2440
cuugcgaccgaugccca

SEQ ID NO: 3554080 - RNA, 18 nt, Pseudomonas putida KT2440
cuugcgaccgaugcccaa

SEQ ID NO: 3554081 - RNA, 20 nt, Pseudomonas putida KT2440
cuugcgacuugugcauccug

SEQ ID NO: 3554082 - RNA, 16 nt, Pseudomonas putida KT2440
cuugcgauaccccgcu

SEQ ID NO: 3554083 - RNA, 20 nt, Pseudomonas putida KT2440
cuugcgcacgcgcucugcaa

SEQ ID NO: 3554084 - RNA, 23 nt, Pseudomonas putida KT2440
cuugcgcacgcgcuuuuccagca

SEQ ID NO: 3554085 - RNA, 18 nt, Pseudomonas putida KT2440
cuugcgcacguaggcggg

SEQ ID NO: 3554086 - RNA, 12 nt, Pseudomonas putida KT2440
cuugcgccccag

SEQ ID NO: 3554087 - RNA, 15 nt, Pseudomonas putida KT2440
cuugcgcggcgcgcc

SEQ ID NO: 3554088 - RNA, 20 nt, Pseudomonas putida KT2440
cuugcggaacaggaucagcg

SEQ ID NO: 3554089 - RNA, 21 nt, Pseudomonas putida KT2440
cuugcggaacguuuccaggcu

SEQ ID NO: 3554090 - RNA, 17 nt, Pseudomonas putida KT2440
cuugcggaccaccuggg

SEQ ID NO: 3554091 - RNA, 18 nt, Pseudomonas putida KT2440
cuugcggaccaccugggc

SEQ ID NO: 3554092 - RNA, 17 nt, Pseudomonas putida KT2440
cuugcggaucacuucca

SEQ ID NO: 3554093 - RNA, 15 nt, Pseudomonas putida KT2440
cuugcggcgacgcac

SEQ ID NO: 3554094 - RNA, 14 nt, Pseudomonas putida KT2440
cuugcgggucagca

SEQ ID NO: 3554095 - RNA, 15 nt, Pseudomonas putida KT2440
cuugcgggucagcag

SEQ ID NO: 3554096 - RNA, 18 nt, Pseudomonas putida KT2440
cuugcggugcaugcgcac

SEQ ID NO: 3554097 - RNA, 22 nt, Pseudomonas putida KT2440
cuugucuggcaccaccagggcg

SEQ ID NO: 3554098 - RNA, 19 nt, Pseudomonas putida KT2440
cuugucuuccagcugcgcc

SEQ ID NO: 3554099 - RNA, 15 nt, Pseudomonas putida KT2440
cuugugaucccgcga

SEQ ID NO: 3554100 - RNA, 20 nt, Pseudomonas putida KT2440
cuugugcacgaacagauggu

SEQ ID NO: 3554101 - RNA, 20 nt, Pseudomonas putida KT2440
cuugugcaguucgcacagcu

SEQ ID NO: 3554102 - RNA, 15 nt, Pseudomonas putida KT2440
cuugugcaucaaguc

SEQ ID NO: 3554103 - RNA, 14 nt, Pseudomonas putida KT2440
cuugugccgcggcu

SEQ ID NO: 3554104 - RNA, 20 nt, Pseudomonas putida KT2440
cuugugcgccaccgacuccg

SEQ ID NO: 3554105 - RNA, 14 nt, Pseudomonas putida KT2440
cuugugcggcccuc

SEQ ID NO: 3554106 - RNA, 23 nt, Pseudomonas putida KT2440
cuugugcugcgaguucaggcgcc

SEQ ID NO: 3554107 - RNA, 15 nt, Pseudomonas putida KT2440
cuuguggcggaucau

SEQ ID NO: 3554108 - RNA, 15 nt, Pseudomonas putida KT2440
cuugugugccugcuc

SEQ ID NO: 3554109 - RNA, 16 nt, Pseudomonas putida KT2440
cuugugugccugcucc

SEQ ID NO: 3554110 - RNA, 17 nt, Pseudomonas putida KT2440
cuugugugccugcuccg

SEQ ID NO: 3554111 - RNA, 22 nt, Pseudomonas putida KT2440
cuugugugccugcuccggaauc

SEQ ID NO: 3554112 - RNA, 19 nt, Pseudomonas putida KT2440
cuuguguugccacccggcu

SEQ ID NO: 3554113 - RNA, 21 nt, Pseudomonas putida KT2440
cuuguguuuugccuccagcuu

SEQ ID NO: 3554114 - RNA, 13 nt, Pseudomonas putida KT2440
cuuguuacccgca

SEQ ID NO: 3554115 - RNA, 23 nt, Pseudomonas putida KT2440
cuuguuacccgcauaaccaccac

SEQ ID NO: 3554116 - RNA, 22 nt, Pseudomonas putida KT2440
cuuguuccagccgcgccacucc

SEQ ID NO: 3554117 - RNA, 18 nt, Pseudomonas putida KT2440
cuuguucgagcgccauga

SEQ ID NO: 3554118 - RNA, 14 nt, Pseudomonas putida KT2440
cuuguucggguuca

SEQ ID NO: 3554119 - RNA, 19 nt, Pseudomonas putida KT2440
cuuguucuguuucaccagc

SEQ ID NO: 3554120 - RNA, 22 nt, Pseudomonas putida KT2440
cuuguuggccaccaucgccggc

SEQ ID NO: 3554121 - RNA, 13 nt, Pseudomonas putida KT2440
cuuguuggucagg

SEQ ID NO: 3554122 - RNA, 15 nt, Pseudomonas putida KT2440
cuuguugguguggca

SEQ ID NO: 3554123 - RNA, 17 nt, Pseudomonas putida KT2440
cuuuaaaacuaauauuu

SEQ ID NO: 3554124 - RNA, 23 nt, Pseudomonas putida KT2440
cuuuacaacccagacucaaucag

SEQ ID NO: 3554125 - RNA, 15 nt, Pseudomonas putida KT2440
cuuuacaccgaugcc

SEQ ID NO: 3554126 - RNA, 22 nt, Pseudomonas putida KT2440
cuuuaccguuggcuagccgcca

SEQ ID NO: 3554127 - RNA, 17 nt, Pseudomonas putida KT2440
cuuuacgcauugccgac

SEQ ID NO: 3554128 - RNA, 17 nt, Pseudomonas putida KT2440
cuuuagcaggcaagccc

SEQ ID NO: 3554129 - RNA, 18 nt, Pseudomonas putida KT2440
cuuuagcgcaucuuccgg

SEQ ID NO: 3554130 - RNA, 19 nt, Pseudomonas putida KT2440
cuuuagcuuauucgaugca

SEQ ID NO: 3554131 - RNA, 20 nt, Pseudomonas putida KT2440
cuuuaucuccaagccgcuuc

SEQ ID NO: 3554132 - RNA, 17 nt, Pseudomonas putida KT2440
cuuucaccgcuucuuug

SEQ ID NO: 3554133 - RNA, 18 nt, Pseudomonas putida KT2440
cuuucagcgcccagaaca

SEQ ID NO: 3554134 - RNA, 21 nt, Pseudomonas putida KT2440
cuuucagcgccugccuggccc

SEQ ID NO: 3554135 - RNA, 15 nt, Pseudomonas putida KT2440
cuuucaggcacagca

SEQ ID NO: 3554136 - RNA, 18 nt, Pseudomonas putida KT2440
cuuucaggcacagcacgg

SEQ ID NO: 3554137 - RNA, 19 nt, Pseudomonas putida KT2440
cuuucaggcgcagcacaag

SEQ ID NO: 3554138 - RNA, 21 nt, Pseudomonas putida KT2440
cuuucaggcgcagcacaaggc

SEQ ID NO: 3554139 - RNA, 19 nt, Pseudomonas putida KT2440
cuuucagguaacgggcaag

SEQ ID NO: 3554140 - RNA, 20 nt, Pseudomonas putida KT2440
cuuucaggugcuucggcucu

SEQ ID NO: 3554141 - RNA, 21 nt, Pseudomonas putida KT2440
cuuuccaaaccugcgaccaca

SEQ ID NO: 3554142 - RNA, 21 nt, Pseudomonas putida KT2440
cuuuccaccuggccacccggc

SEQ ID NO: 3554143 - RNA, 12 nt, Pseudomonas putida KT2440
cuuuccacgccu

SEQ ID NO: 3554144 - RNA, 20 nt, Pseudomonas putida KT2440
cuuuccagcuguacgcuggc

SEQ ID NO: 3554145 - RNA, 16 nt, Pseudomonas putida KT2440
cuuuccagguccugcu

SEQ ID NO: 3554146 - RNA, 21 nt, Pseudomonas putida KT2440
cuuuccagguccugcuccacc

SEQ ID NO: 3554147 - RNA, 16 nt, Pseudomonas putida KT2440
cuuuccauuacuccag

SEQ ID NO: 3554148 - RNA, 20 nt, Pseudomonas putida KT2440
cuuucccacauguaaugaaa

SEQ ID NO: 3554149 - RNA, 21 nt, Pseudomonas putida KT2440
cuuuccugaaaccccgcccca

SEQ ID NO: 3554150 - RNA, 16 nt, Pseudomonas putida KT2440
cuuucgacaugcaguu

SEQ ID NO: 3554151 - RNA, 18 nt, Pseudomonas putida KT2440
cuuucgacaugcaguuga

SEQ ID NO: 3554152 - RNA, 18 nt, Pseudomonas putida KT2440
cuuucgagagccgggcaa

SEQ ID NO: 3554153 - RNA, 20 nt, Pseudomonas putida KT2440
cuuucgagagccgggcaaug

SEQ ID NO: 3554154 - RNA, 16 nt, Pseudomonas putida KT2440
cuuucgccgaucagcu

SEQ ID NO: 3554155 - RNA, 13 nt, Pseudomonas putida KT2440
cuuucgcggguaa

SEQ ID NO: 3554156 - RNA, 20 nt, Pseudomonas putida KT2440
cuuucgcggguaaacccgcc

SEQ ID NO: 3554157 - RNA, 20 nt, Pseudomonas putida KT2440
cuuucgcggguaaacccgcu

SEQ ID NO: 3554158 - RNA, 21 nt, Pseudomonas putida KT2440
cuuucgcggguaaacccgcuc

SEQ ID NO: 3554159 - RNA, 21 nt, Pseudomonas putida KT2440
cuuucggcagcacccgcuugg

SEQ ID NO: 3554160 - RNA, 23 nt, Pseudomonas putida KT2440
cuuucggcagcacccgcuuggcc

SEQ ID NO: 3554161 - RNA, 13 nt, Pseudomonas putida KT2440
cuuucucccaggc

SEQ ID NO: 3554162 - RNA, 15 nt, Pseudomonas putida KT2440
cuuucucccaggccg

SEQ ID NO: 3554163 - RNA, 16 nt, Pseudomonas putida KT2440
cuuucucccaggccga

SEQ ID NO: 3554164 - RNA, 15 nt, Pseudomonas putida KT2440
cuuucuuaugccugg

SEQ ID NO: 3554165 - RNA, 17 nt, Pseudomonas putida KT2440
cuuugaaaguggccaag

SEQ ID NO: 3554166 - RNA, 15 nt, Pseudomonas putida KT2440
cuuugagcaggcgcu

SEQ ID NO: 3554167 - RNA, 18 nt, Pseudomonas putida KT2440
cuuugaggcucaugacac

SEQ ID NO: 3554168 - RNA, 16 nt, Pseudomonas putida KT2440
cuuugaggggcuagcu

SEQ ID NO: 3554169 - RNA, 17 nt, Pseudomonas putida KT2440
cuuugauuacuugacga

SEQ ID NO: 3554170 - RNA, 15 nt, Pseudomonas putida KT2440
cuuugcaagccuugu

SEQ ID NO: 3554171 - RNA, 14 nt, Pseudomonas putida KT2440
cuuugcacccgcgc

SEQ ID NO: 3554172 - RNA, 22 nt, Pseudomonas putida KT2440
cuuugcagcccuucgcaggcac

SEQ ID NO: 3554173 - RNA, 22 nt, Pseudomonas putida KT2440
cuuugcagcccuucgccggcac

SEQ ID NO: 3554174 - RNA, 18 nt, Pseudomonas putida KT2440
cuuugccacucagcgggu

SEQ ID NO: 3554175 - RNA, 14 nt, Pseudomonas putida KT2440
cuuugccccugauc

SEQ ID NO: 3554176 - RNA, 12 nt, Pseudomonas putida KT2440
cuuugcgggcac

SEQ ID NO: 3554177 - RNA, 13 nt, Pseudomonas putida KT2440
cuuugcgggcacg

SEQ ID NO: 3554178 - RNA, 21 nt, Pseudomonas putida KT2440
cuuugcucuucaccugaccau

SEQ ID NO: 3554179 - RNA, 20 nt, Pseudomonas putida KT2440
cuuugcugccugugccggcc

SEQ ID NO: 3554180 - RNA, 17 nt, Pseudomonas putida KT2440
cuuugcuuuugaauaaa

SEQ ID NO: 3554181 - RNA, 20 nt, Pseudomonas putida KT2440
cuuugcuuuugaauaaagaa

SEQ ID NO: 3554182 - RNA, 14 nt, Pseudomonas putida KT2440
cuuuggcagcagcc

SEQ ID NO: 3554183 - RNA, 17 nt, Pseudomonas putida KT2440
cuuuggcuaucagccgu

SEQ ID NO: 3554184 - RNA, 20 nt, Pseudomonas putida KT2440
cuuuggcugcaggucggcca

SEQ ID NO: 3554185 - RNA, 22 nt, Pseudomonas putida KT2440
cuuuggcuggacucgccgagaa

SEQ ID NO: 3554186 - RNA, 15 nt, Pseudomonas putida KT2440
cuuugggggugcuga

SEQ ID NO: 3554187 - RNA, 16 nt, Pseudomonas putida KT2440
cuuuggucgcggcgcu

SEQ ID NO: 3554188 - RNA, 20 nt, Pseudomonas putida KT2440
cuuugguuggcuuguccagc

SEQ ID NO: 3554189 - RNA, 21 nt, Pseudomonas putida KT2440
cuuuguuguuguacuggcuga

SEQ ID NO: 3554190 - RNA, 22 nt, Pseudomonas putida KT2440
cuuuguuguuugggccugugcc

SEQ ID NO: 3554191 - RNA, 19 nt, Pseudomonas putida KT2440
cuuuucaccuccaguugcc

SEQ ID NO: 3554192 - RNA, 12 nt, Pseudomonas putida KT2440
cuuuuccagcuc

SEQ ID NO: 3554193 - RNA, 12 nt, Pseudomonas putida KT2440
cuuuuccccuua

SEQ ID NO: 3554194 - RNA, 22 nt, Pseudomonas putida KT2440
cuuuuccugcgggucauccuca

SEQ ID NO: 3554195 - RNA, 18 nt, Pseudomonas putida KT2440
cuuuuccugcugcaacaa

SEQ ID NO: 3554196 - RNA, 16 nt, Pseudomonas putida KT2440
cuuuucggucaugccc

SEQ ID NO: 3554197 - RNA, 14 nt, Pseudomonas putida KT2440
cuuuugaagucggc

SEQ ID NO: 3554198 - RNA, 14 nt, Pseudomonas putida KT2440
cuuuuggcugugca

SEQ ID NO: 3554199 - RNA, 15 nt, Pseudomonas putida KT2440
cuuuuucaccaggcg

SEQ ID NO: 3554200 - RNA, 17 nt, Pseudomonas putida KT2440
cuuuuucauggcuugag

SEQ ID NO: 3554201 - RNA, 13 nt, Pseudomonas putida KT2440
cuuuuuccagcgc

SEQ ID NO: 3554202 - RNA, 13 nt, Pseudomonas putida KT2440
gaacaccugcagc

SEQ ID NO: 3554203 - RNA, 16 nt, Pseudomonas putida KT2440
gaacaccugcagcgcg

SEQ ID NO: 3554204 - RNA, 18 nt, Pseudomonas putida KT2440
gaacaccugccagccccg

SEQ ID NO: 3554205 - RNA, 20 nt, Pseudomonas putida KT2440
gaacaccugcgccccgguac

SEQ ID NO: 3554206 - RNA, 21 nt, Pseudomonas putida KT2440
gaacacgaaaaagccagcgua

SEQ ID NO: 3554207 - RNA, 12 nt, Pseudomonas putida KT2440
gaacacgaacac

SEQ ID NO: 3554208 - RNA, 23 nt, Pseudomonas putida KT2440
gaacacgcaggucuugcccacuu

SEQ ID NO: 3554209 - RNA, 14 nt, Pseudomonas putida KT2440
gaacacgcccgcgu

SEQ ID NO: 3554210 - RNA, 22 nt, Pseudomonas putida KT2440
gaacacgcucaugaacagcgcc

SEQ ID NO: 3554211 - RNA, 23 nt, Pseudomonas putida KT2440
gaacacggcuucgcagacgucuu

SEQ ID NO: 3554212 - RNA, 17 nt, Pseudomonas putida KT2440
gaacacuuccgggcuga

SEQ ID NO: 3554213 - RNA, 21 nt, Pseudomonas putida KT2440
gaacagaaggaagauugaagg

SEQ ID NO: 3554214 - RNA, 15 nt, Pseudomonas putida KT2440
gaacagacaacauca

SEQ ID NO: 3554215 - RNA, 13 nt, Pseudomonas putida KT2440
gaacagcaacaca

SEQ ID NO: 3554216 - RNA, 13 nt, Pseudomonas putida KT2440
gaacagcaccgcc

SEQ ID NO: 3554217 - RNA, 19 nt, Pseudomonas putida KT2440
gaacagcaccgccauggcc

SEQ ID NO: 3554218 - RNA, 16 nt, Pseudomonas putida KT2440
gaacagcacgauaccg

SEQ ID NO: 3554219 - RNA, 13 nt, Pseudomonas putida KT2440
gaacagcacugcc

SEQ ID NO: 3554220 - RNA, 14 nt, Pseudomonas putida KT2440
gaacagcacugcca

SEQ ID NO: 3554221 - RNA, 16 nt, Pseudomonas putida KT2440
gaacagcacugccagc

SEQ ID NO: 3554222 - RNA, 17 nt, Pseudomonas putida KT2440
gaacagcacugccagcc

SEQ ID NO: 3554223 - RNA, 11 nt, Pseudomonas putida KT2440
gaacagcagcg

SEQ ID NO: 3554224 - RNA, 21 nt, Pseudomonas putida KT2440
gaacagcagcgccgccaggcc

SEQ ID NO: 3554225 - RNA, 14 nt, Pseudomonas putida KT2440
gaacagccacagcu

SEQ ID NO: 3554226 - RNA, 22 nt, Pseudomonas putida KT2440
gaacagccggcuaucggccagc

SEQ ID NO: 3554227 - RNA, 12 nt, Pseudomonas putida KT2440
gaacagccuugu

SEQ ID NO: 3554228 - RNA, 17 nt, Pseudomonas putida KT2440
gaacagcgaagccagca

SEQ ID NO: 3554229 - RNA, 16 nt, Pseudomonas putida KT2440
gaacagcgcagccacc

SEQ ID NO: 3554230 - RNA, 17 nt, Pseudomonas putida KT2440
gaacagcgcagccacca

SEQ ID NO: 3554231 - RNA, 12 nt, Pseudomonas putida KT2440
gaacagcgccac

SEQ ID NO: 3554232 - RNA, 23 nt, Pseudomonas putida KT2440
gaacagcgcccagaucagcagca

SEQ ID NO: 3554233 - RNA, 13 nt, Pseudomonas putida KT2440
gaacagcgccggc

SEQ ID NO: 3554234 - RNA, 15 nt, Pseudomonas putida KT2440
gaacagcgccggcag

SEQ ID NO: 3554235 - RNA, 14 nt, Pseudomonas putida KT2440
gaacagcgccuuga

SEQ ID NO: 3554236 - RNA, 13 nt, Pseudomonas putida KT2440
gaacagcggcagc

SEQ ID NO: 3554237 - RNA, 15 nt, Pseudomonas putida KT2440
gaacagcggcagcaa

SEQ ID NO: 3554238 - RNA, 17 nt, Pseudomonas putida KT2440
gaacagcggcagcaaca

SEQ ID NO: 3554239 - RNA, 20 nt, Pseudomonas putida KT2440
gaacagcgucuuguuguccg

SEQ ID NO: 3554240 - RNA, 17 nt, Pseudomonas putida KT2440
gaacagcgugccaugca

SEQ ID NO: 3554241 - RNA, 18 nt, Pseudomonas putida KT2440
gaacagcgugccaugcag

SEQ ID NO: 3554242 - RNA, 17 nt, Pseudomonas putida KT2440
gaacagcguggccagcc

SEQ ID NO: 3554243 - RNA, 16 nt, Pseudomonas putida KT2440
gaacagcucgaucagu

SEQ ID NO: 3554244 - RNA, 20 nt, Pseudomonas putida KT2440
gaacagcucgauggccagga

SEQ ID NO: 3554245 - RNA, 20 nt, Pseudomonas putida KT2440
gaacagcucuggcagcagug

SEQ ID NO: 3554246 - RNA, 19 nt, Pseudomonas putida KT2440
gaacagcucuuccaguuuc

SEQ ID NO: 3554247 - RNA, 17 nt, Pseudomonas putida KT2440
gaacaggaucagcggcu

SEQ ID NO: 3554248 - RNA, 16 nt, Pseudomonas putida KT2440
gaacaggccugcggcc

SEQ ID NO: 3554249 - RNA, 14 nt, Pseudomonas putida KT2440
gaacaggcgcuugc

SEQ ID NO: 3554250 - RNA, 13 nt, Pseudomonas putida KT2440
gaacagggcagac

SEQ ID NO: 3554251 - RNA, 14 nt, Pseudomonas putida KT2440
gaacagggccaggu

SEQ ID NO: 3554252 - RNA, 16 nt, Pseudomonas putida KT2440
gaacagggccagguag

SEQ ID NO: 3554253 - RNA, 14 nt, Pseudomonas putida KT2440
gaacagggccggcc

SEQ ID NO: 3554254 - RNA, 20 nt, Pseudomonas putida KT2440
gaacaggugcgcgcgcgaca

SEQ ID NO: 3554255 - RNA, 18 nt, Pseudomonas putida KT2440
gaacaguguggugcggcu

SEQ ID NO: 3554256 - RNA, 21 nt, Pseudomonas putida KT2440
gaacaguguggugcggcuggg

SEQ ID NO: 3554257 - RNA, 13 nt, Pseudomonas putida KT2440
gaacaucagcagg

SEQ ID NO: 3554258 - RNA, 20 nt, Pseudomonas putida KT2440
gaacaucaggucugccagug

SEQ ID NO: 3554259 - RNA, 23 nt, Pseudomonas putida KT2440
gaacaugccacggccuucuucac

SEQ ID NO: 3554260 - RNA, 17 nt, Pseudomonas putida KT2440
gaacauugcagggcggc

SEQ ID NO: 3554261 - RNA, 15 nt, Pseudomonas putida KT2440
gaaccacagcacgcc

SEQ ID NO: 3554262 - RNA, 13 nt, Pseudomonas putida KT2440
gaaccacaucacg

SEQ ID NO: 3554263 - RNA, 13 nt, Pseudomonas putida KT2440
gaaccaccagugg

SEQ ID NO: 3554264 - RNA, 18 nt, Pseudomonas putida KT2440
gaaccagcagcaccugcc

SEQ ID NO: 3554265 - RNA, 20 nt, Pseudomonas putida KT2440
gaaccaggauauugccgacu

SEQ ID NO: 3554266 - RNA, 15 nt, Pseudomonas putida KT2440
gaaccaucccacuca

SEQ ID NO: 3554267 - RNA, 19 nt, Pseudomonas putida KT2440
gaacccaaucauauacauc

SEQ ID NO: 3554268 - RNA, 15 nt, Pseudomonas putida KT2440
gaacccacuguaggg

SEQ ID NO: 3554269 - RNA, 13 nt, Pseudomonas putida KT2440
gaacccacuguca

SEQ ID NO: 3554270 - RNA, 21 nt, Pseudomonas putida KT2440
gaacccgauuacaagggccug

SEQ ID NO: 3554271 - RNA, 19 nt, Pseudomonas putida KT2440
gaacccgcuccuaccgggg

SEQ ID NO: 3554272 - RNA, 15 nt, Pseudomonas putida KT2440
gaacccgcugccacc

SEQ ID NO: 3554273 - RNA, 18 nt, Pseudomonas putida KT2440
gaacccgcugccacccac

SEQ ID NO: 3554274 - RNA, 15 nt, Pseudomonas putida KT2440
gaaccgccagcacca

SEQ ID NO: 3554275 - RNA, 18 nt, Pseudomonas putida KT2440
gaaccgccagcaccaaug

SEQ ID NO: 3554276 - RNA, 14 nt, Pseudomonas putida KT2440
gaaccgcuccgggu

SEQ ID NO: 3554277 - RNA, 14 nt, Pseudomonas putida KT2440
gaaccggcgaucag

SEQ ID NO: 3554278 - RNA, 20 nt, Pseudomonas putida KT2440
gaaccggcgaucagggugua

SEQ ID NO: 3554279 - RNA, 23 nt, Pseudomonas putida KT2440
gaaccggcuguuggccuucccuu

SEQ ID NO: 3554280 - RNA, 12 nt, Pseudomonas putida KT2440
gaaccucaccgc

SEQ ID NO: 3554281 - RNA, 16 nt, Pseudomonas putida KT2440
gaaccugggacugcgu

SEQ ID NO: 3554282 - RNA, 15 nt, Pseudomonas putida KT2440
gaaccugugcacagc

SEQ ID NO: 3554283 - RNA, 16 nt, Pseudomonas putida KT2440
gaaccuguugaagcga

SEQ ID NO: 3554284 - RNA, 21 nt, Pseudomonas putida KT2440
gaacgaaaaacuccuugagau

SEQ ID NO: 3554285 - RNA, 23 nt, Pseudomonas putida KT2440
gaacgacaaacuccuugaaauuc

SEQ ID NO: 3554286 - RNA, 19 nt, Pseudomonas putida KT2440
gaacgacacgugguugcac

SEQ ID NO: 3554287 - RNA, 19 nt, Pseudomonas putida KT2440
gaacgacagcugcaacaga

SEQ ID NO: 3554288 - RNA, 19 nt, Pseudomonas putida KT2440
gaacgacagcuuguugcca

SEQ ID NO: 3554289 - RNA, 23 nt, Pseudomonas putida KT2440
gaacgacuucggcaacagccggg

SEQ ID NO: 3554290 - RNA, 20 nt, Pseudomonas putida KT2440
gaacgagguuuugcagcgcu

SEQ ID NO: 3554291 - RNA, 16 nt, Pseudomonas putida KT2440
gaacgauucugccagc

SEQ ID NO: 3554292 - RNA, 20 nt, Pseudomonas putida KT2440
gaacgauucugccagcuccu

SEQ ID NO: 3554293 - RNA, 15 nt, Pseudomonas putida KT2440
gaacgcaagaaggcu

SEQ ID NO: 3554294 - RNA, 12 nt, Pseudomonas putida KT2440
gaacgcagcgcc

SEQ ID NO: 3554295 - RNA, 18 nt, Pseudomonas putida KT2440
gaacgcagcgccgccaac

SEQ ID NO: 3554296 - RNA, 12 nt, Pseudomonas putida KT2440
gaacgccccgaa

SEQ ID NO: 3554297 - RNA, 14 nt, Pseudomonas putida KT2440
gaacgccgccugcc

SEQ ID NO: 3554298 - RNA, 16 nt, Pseudomonas putida KT2440
gaacgccuuggccucg

SEQ ID NO: 3554299 - RNA, 22 nt, Pseudomonas putida KT2440
gaacgccuuguuccgcccagcu

SEQ ID NO: 3554300 - RNA, 14 nt, Pseudomonas putida KT2440
gaacgcugccugca

SEQ ID NO: 3554301 - RNA, 21 nt, Pseudomonas putida KT2440
gaacgcugccugcaggcugcc

SEQ ID NO: 3554302 - RNA, 15 nt, Pseudomonas putida KT2440
gaacgcugcgcgggu

SEQ ID NO: 3554303 - RNA, 22 nt, Pseudomonas putida KT2440
gaacgcuuggccagaaacggcg

SEQ ID NO: 3554304 - RNA, 15 nt, Pseudomonas putida KT2440
gaacggcccgcggau

SEQ ID NO: 3554305 - RNA, 16 nt, Pseudomonas putida KT2440
gaacggcgccagcagu

SEQ ID NO: 3554306 - RNA, 17 nt, Pseudomonas putida KT2440
gaacggcgccagcagug

SEQ ID NO: 3554307 - RNA, 20 nt, Pseudomonas putida KT2440
gaacgggccaccaaaggccu

SEQ ID NO: 3554308 - RNA, 21 nt, Pseudomonas putida KT2440
gaagcuuccaguuggccggca

SEQ ID NO: 3554309 - RNA, 20 nt, Pseudomonas putida KT2440
gaagcuugcagucaccuggc

SEQ ID NO: 3554310 - RNA, 20 nt, Pseudomonas putida KT2440
gaagcuuggggccgcucugc

SEQ ID NO: 3554311 - RNA, 18 nt, Pseudomonas putida KT2440
gaaggaacgacuugaugu

SEQ ID NO: 3554312 - RNA, 14 nt, Pseudomonas putida KT2440
gaaggacaucacca

SEQ ID NO: 3554313 - RNA, 15 nt, Pseudomonas putida KT2440
gaaggacaucaccag

SEQ ID NO: 3554314 - RNA, 15 nt, Pseudomonas putida KT2440
gaaggagagccucgg

SEQ ID NO: 3554315 - RNA, 22 nt, Pseudomonas putida KT2440
gaaggcaaucggguacacgcca

SEQ ID NO: 3554316 - RNA, 15 nt, Pseudomonas putida KT2440
gaaggcaggucagcg

SEQ ID NO: 3554317 - RNA, 17 nt, Pseudomonas putida KT2440
gaaggcauccacaccgu

SEQ ID NO: 3554318 - RNA, 23 nt, Pseudomonas putida KT2440
gaaggcaucguuguaagccauga

SEQ ID NO: 3554319 - RNA, 12 nt, Pseudomonas putida KT2440
gaaggccagcaa

SEQ ID NO: 3554320 - RNA, 16 nt, Pseudomonas putida KT2440
gaaggccagccgagcc

SEQ ID NO: 3554321 - RNA, 14 nt, Pseudomonas putida KT2440
gaaggccgccggca

SEQ ID NO: 3554322 - RNA, 18 nt, Pseudomonas putida KT2440
gaaggccgccggcaacug

SEQ ID NO: 3554323 - RNA, 18 nt, Pseudomonas putida KT2440
gaaggccguaggccaggu

SEQ ID NO: 3554324 - RNA, 18 nt, Pseudomonas putida KT2440
gaaggccguggcaaggcc

SEQ ID NO: 3554325 - RNA, 21 nt, Pseudomonas putida KT2440
gaaggccucgccguacucggu

SEQ ID NO: 3554326 - RNA, 16 nt, Pseudomonas putida KT2440
gaaggcgaauagcauc

SEQ ID NO: 3554327 - RNA, 16 nt, Pseudomonas putida KT2440
gaaggcgucacgcagg

SEQ ID NO: 3554328 - RNA, 14 nt, Pseudomonas putida KT2440
gaaggcucaguaau

SEQ ID NO: 3554329 - RNA, 17 nt, Pseudomonas putida KT2440
gaaggcuccagcaccga

SEQ ID NO: 3554330 - RNA, 14 nt, Pseudomonas putida KT2440
gaaggcuggccuca

SEQ ID NO: 3554331 - RNA, 22 nt, Pseudomonas putida KT2440
gaagggcugcgguagcgcagcc

SEQ ID NO: 3554332 - RNA, 19 nt, Pseudomonas putida KT2440
gaaggggaucagcacgcga

SEQ ID NO: 3554333 - RNA, 17 nt, Pseudomonas putida KT2440
gaaggggcggguggagg

SEQ ID NO: 3554334 - RNA, 19 nt, Pseudomonas putida KT2440
gaagggugaugguugaaga

SEQ ID NO: 3554335 - RNA, 20 nt, Pseudomonas putida KT2440
gaagguaucggccauggccg

SEQ ID NO: 3554336 - RNA, 18 nt, Pseudomonas putida KT2440
gaaggugcuguaagggcu

SEQ ID NO: 3554337 - RNA, 19 nt, Pseudomonas putida KT2440
gaagguggccggcaacggc

SEQ ID NO: 3554338 - RNA, 17 nt, Pseudomonas putida KT2440
gaagguguucaccacgc

SEQ ID NO: 3554339 - RNA, 23 nt, Pseudomonas putida KT2440
gaagguguucaccacgcccugca

SEQ ID NO: 3554340 - RNA, 16 nt, Pseudomonas putida KT2440
gaagguucguccccuu

SEQ ID NO: 3554341 - RNA, 18 nt, Pseudomonas putida KT2440
gaagguugcagguucuua

SEQ ID NO: 3554342 - RNA, 17 nt, Pseudomonas putida KT2440
gaaguagcgcucuuugc

SEQ ID NO: 3554343 - RNA, 15 nt, Pseudomonas putida KT2440
gaaguaggcaaacgg

SEQ ID NO: 3554344 - RNA, 16 nt, Pseudomonas putida KT2440
gaaguaggcaaacggc

SEQ ID NO: 3554345 - RNA, 12 nt, Pseudomonas putida KT2440
gaagucaaccuc

SEQ ID NO: 3554346 - RNA, 23 nt, Pseudomonas putida KT2440
gaagucaccgaacucguugacca

SEQ ID NO: 3554347 - RNA, 19 nt, Pseudomonas putida KT2440
gaagucacuuugucgaugc

SEQ ID NO: 3554348 - RNA, 15 nt, Pseudomonas putida KT2440
gaagucagccagguu

SEQ ID NO: 3554349 - RNA, 18 nt, Pseudomonas putida KT2440
gaagucaggggaaucccg

SEQ ID NO: 3554350 - RNA, 15 nt, Pseudomonas putida KT2440
gaagucauccauggc

SEQ ID NO: 3554351 - RNA, 21 nt, Pseudomonas putida KT2440
gaagucaugggucacucccgg

SEQ ID NO: 3554352 - RNA, 17 nt, Pseudomonas putida KT2440
gaagucgaacuugacgu

SEQ ID NO: 3554353 - RNA, 18 nt, Pseudomonas putida KT2440
gaagucgauguucagcac

SEQ ID NO: 3554354 - RNA, 16 nt, Pseudomonas putida KT2440
gaagucgcuuugcggg

SEQ ID NO: 3554355 - RNA, 21 nt, Pseudomonas putida KT2440
gaagucggccugggucagcug

SEQ ID NO: 3554356 - RNA, 21 nt, Pseudomonas putida KT2440
gaagucggcguagcgcuugaa

SEQ ID NO: 3554357 - RNA, 19 nt, Pseudomonas putida KT2440
gaagucgguggucaccagc

SEQ ID NO: 3554358 - RNA, 21 nt, Pseudomonas putida KT2440
gaagucuuccugguuuucgcg

SEQ ID NO: 3554359 - RNA, 20 nt, Pseudomonas putida KT2440
gaagugauuugauggggcgc

SEQ ID NO: 3554360 - RNA, 21 nt, Pseudomonas putida KT2440
gaagugauuugauggggcgcu

SEQ ID NO: 3554361 - RNA, 20 nt, Pseudomonas putida KT2440
gaagugcacugccuggcuca

SEQ ID NO: 3554362 - RNA, 14 nt, Pseudomonas putida KT2440
gaagugccaaggcu

SEQ ID NO: 3554363 - RNA, 15 nt, Pseudomonas putida KT2440
gaaguggauauccag

SEQ ID NO: 3554364 - RNA, 15 nt, Pseudomonas putida KT2440
gaaguggugguagaa

SEQ ID NO: 3554365 - RNA, 16 nt, Pseudomonas putida KT2440
gaaguugagcaccggc

SEQ ID NO: 3554366 - RNA, 20 nt, Pseudomonas putida KT2440
gaaguuguccgggucgccgu

SEQ ID NO: 3554367 - RNA, 16 nt, Pseudomonas putida KT2440
gaauaaaaaaagggcg

SEQ ID NO: 3554368 - RNA, 14 nt, Pseudomonas putida KT2440
gaauaaagaaagug

SEQ ID NO: 3554369 - RNA, 17 nt, Pseudomonas putida KT2440
gaauaaagaaagugaug

SEQ ID NO: 3554370 - RNA, 17 nt, Pseudomonas putida KT2440
gaauaaugcuccagcga

SEQ ID NO: 3554371 - RNA, 17 nt, Pseudomonas putida KT2440
gaauacauagcgaucga

SEQ ID NO: 3554372 - RNA, 18 nt, Pseudomonas putida KT2440
gaauaccaggcccgcuau

SEQ ID NO: 3554373 - RNA, 20 nt, Pseudomonas putida KT2440
gaauaccaggcccgcuaucc

SEQ ID NO: 3554374 - RNA, 19 nt, Pseudomonas putida KT2440
gaauacgagggugaaccca

SEQ ID NO: 3554375 - RNA, 18 nt, Pseudomonas putida KT2440
gaauacgauagcggcggc

SEQ ID NO: 3554376 - RNA, 20 nt, Pseudomonas putida KT2440
gaauacgauagcggcggcag

SEQ ID NO: 3554377 - RNA, 21 nt, Pseudomonas putida KT2440
gaauacgauauccgcagcccc

SEQ ID NO: 3554378 - RNA, 15 nt, Pseudomonas putida KT2440
gaauacgcucagccg

SEQ ID NO: 3554379 - RNA, 13 nt, Pseudomonas putida KT2440
gaauacgguagcg

SEQ ID NO: 3554380 - RNA, 20 nt, Pseudomonas putida KT2440
gaauacgguggcggcagcaa

SEQ ID NO: 3554381 - RNA, 15 nt, Pseudomonas putida KT2440
gaauagcaagcgcca

SEQ ID NO: 3554382 - RNA, 12 nt, Pseudomonas putida KT2440
gaauagccgguc

SEQ ID NO: 3554383 - RNA, 18 nt, Pseudomonas putida KT2440
gaauaucgagcguuuuuc

SEQ ID NO: 3554384 - RNA, 23 nt, Pseudomonas putida KT2440
gaaucagcgccuccagggcggcc

SEQ ID NO: 3554385 - RNA, 15 nt, Pseudomonas putida KT2440
gaaucagcggcaggc

SEQ ID NO: 3554386 - RNA, 21 nt, Pseudomonas putida KT2440
gaaucagcggcaggcuggcgu

SEQ ID NO: 3554387 - RNA, 14 nt, Pseudomonas putida KT2440
gaaucagcuugcca

SEQ ID NO: 3554388 - RNA, 15 nt, Pseudomonas putida KT2440
gaaucagcuugccau

SEQ ID NO: 3554389 - RNA, 18 nt, Pseudomonas putida KT2440
gaaucagcuugccauucu

SEQ ID NO: 3554390 - RNA, 17 nt, Pseudomonas putida KT2440
gaaucauccucgacacc

SEQ ID NO: 3554391 - RNA, 22 nt, Pseudomonas putida KT2440
gaauccagcaggcuugccagcu

SEQ ID NO: 3554392 - RNA, 21 nt, Pseudomonas putida KT2440
gaauccuagcuucuuggucuc

SEQ ID NO: 3554393 - RNA, 17 nt, Pseudomonas putida KT2440
gaauccugcugaguccg

SEQ ID NO: 3554394 - RNA, 20 nt, Pseudomonas putida KT2440
gaaucggcuccaggcacagg

SEQ ID NO: 3554395 - RNA, 17 nt, Pseudomonas putida KT2440
gaaucggcuucagguuc

SEQ ID NO: 3554396 - RNA, 17 nt, Pseudomonas putida KT2440
gaaucucaaccaccucu

SEQ ID NO: 3554397 - RNA, 18 nt, Pseudomonas putida KT2440
gaaucuggcucugcagcg

SEQ ID NO: 3554398 - RNA, 22 nt, Pseudomonas putida KT2440
gaaugaccagggaaauuggcca

SEQ ID NO: 3554399 - RNA, 15 nt, Pseudomonas putida KT2440
gaaugacuucgcugc

SEQ ID NO: 3554400 - RNA, 19 nt, Pseudomonas putida KT2440
gaaugagaggcgggucagg

SEQ ID NO: 3554401 - RNA, 19 nt, Pseudomonas putida KT2440
gaaugcauggugaagcccg

SEQ ID NO: 3554402 - RNA, 18 nt, Pseudomonas putida KT2440
gaaugcgcccggccaggu

SEQ ID NO: 3554403 - RNA, 14 nt, Pseudomonas putida KT2440
gaaugcgcucgaaa

SEQ ID NO: 3554404 - RNA, 18 nt, Pseudomonas putida KT2440
gaaugcuguugugcgaua

SEQ ID NO: 3554405 - RNA, 21 nt, Pseudomonas putida KT2440
gaauggccuuuacaccgaugc

SEQ ID NO: 3554406 - RNA, 14 nt, Pseudomonas putida KT2440
gaauggcgcaccga

SEQ ID NO: 3554407 - RNA, 13 nt, Pseudomonas putida KT2440
gaauggguggcag

SEQ ID NO: 3554408 - RNA, 16 nt, Pseudomonas putida KT2440
gaauggguggcagcug

SEQ ID NO: 3554409 - RNA, 20 nt, Pseudomonas putida KT2440
gaaugguguggggguucagc

SEQ ID NO: 3554410 - RNA, 14 nt, Pseudomonas putida KT2440
gaaugucaccgcgg

SEQ ID NO: 3554411 - RNA, 15 nt, Pseudomonas putida KT2440
gaaugugcucggccu

SEQ ID NO: 3554412 - RNA, 18 nt, Pseudomonas putida KT2440
gaauguugacgccgccuu

SEQ ID NO: 3554413 - RNA, 15 nt, Pseudomonas putida KT2440
gacauugaucggcgu

SEQ ID NO: 3554414 - RNA, 19 nt, Pseudomonas putida KT2440
gacauuguaggcggcaagg

SEQ ID NO: 3554415 - RNA, 17 nt, Pseudomonas putida KT2440
gaccaaaaaucuuaacu

SEQ ID NO: 3554416 - RNA, 16 nt, Pseudomonas putida KT2440
gaccaaaugagugagc

SEQ ID NO: 3554417 - RNA, 21 nt, Pseudomonas putida KT2440
gaccaacaggcuggcaucgcc

SEQ ID NO: 3554418 - RNA, 15 nt, Pseudomonas putida KT2440
gaccaacgccaguug

SEQ ID NO: 3554419 - RNA, 11 nt, Pseudomonas putida KT2440
gaccaacuuuu

SEQ ID NO: 3554420 - RNA, 14 nt, Pseudomonas putida KT2440
gaccaagcaacgca

SEQ ID NO: 3554421 - RNA, 15 nt, Pseudomonas putida KT2440
gaccaaggccaacug

SEQ ID NO: 3554422 - RNA, 14 nt, Pseudomonas putida KT2440
gaccaauccagccc

SEQ ID NO: 3554423 - RNA, 15 nt, Pseudomonas putida KT2440
gaccaauccagcccu

SEQ ID NO: 3554424 - RNA, 16 nt, Pseudomonas putida KT2440
gaccaauccagcccuc

SEQ ID NO: 3554425 - RNA, 20 nt, Pseudomonas putida KT2440
gaccaauugguuaaaagcca

SEQ ID NO: 3554426 - RNA, 23 nt, Pseudomonas putida KT2440
gaccacaggcgcuugaagaagcc

SEQ ID NO: 3554427 - RNA, 17 nt, Pseudomonas putida KT2440
gaccaccagacgggcau

SEQ ID NO: 3554428 - RNA, 20 nt, Pseudomonas putida KT2440
gaccaccagacgggcauggu

SEQ ID NO: 3554429 - RNA, 11 nt, Pseudomonas putida KT2440
gaccaccagca

SEQ ID NO: 3554430 - RNA, 19 nt, Pseudomonas putida KT2440
gaccaccagcaacaucgcc

SEQ ID NO: 3554431 - RNA, 18 nt, Pseudomonas putida KT2440
gaccaccaucgccaggcc

SEQ ID NO: 3554432 - RNA, 21 nt, Pseudomonas putida KT2440
gaccacccggugacggcaucg

SEQ ID NO: 3554433 - RNA, 22 nt, Pseudomonas putida KT2440
gaccaccgcaggugcaggcucg

SEQ ID NO: 3554434 - RNA, 16 nt, Pseudomonas putida KT2440
gaccaccgccaaggca

SEQ ID NO: 3554435 - RNA, 18 nt, Pseudomonas putida KT2440
gaccaccgccaaggcacg

SEQ ID NO: 3554436 - RNA, 11 nt, Pseudomonas putida KT2440
gaccaccugcc

SEQ ID NO: 3554437 - RNA, 12 nt, Pseudomonas putida KT2440
gaccacgaugcc

SEQ ID NO: 3554438 - RNA, 14 nt, Pseudomonas putida KT2440
gaccacgcacagcu

SEQ ID NO: 3554439 - RNA, 14 nt, Pseudomonas putida KT2440
gaccacgccgaagc

SEQ ID NO: 3554440 - RNA, 21 nt, Pseudomonas putida KT2440
gaccacgcgcucguugcgagc

SEQ ID NO: 3554441 - RNA, 17 nt, Pseudomonas putida KT2440
gaccacuaucgccagaa

SEQ ID NO: 3554442 - RNA, 17 nt, Pseudomonas putida KT2440
gaccacuuuuggcguga

SEQ ID NO: 3554443 - RNA, 15 nt, Pseudomonas putida KT2440
gaccagaaacccagg

SEQ ID NO: 3554444 - RNA, 22 nt, Pseudomonas putida KT2440
gaccagaagggcgcaaaagucc

SEQ ID NO: 3554445 - RNA, 13 nt, Pseudomonas putida KT2440
gaccagaucagcc

SEQ ID NO: 3554446 - RNA, 20 nt, Pseudomonas putida KT2440
gaccagaucaggccgcugaa

SEQ ID NO: 3554447 - RNA, 21 nt, Pseudomonas putida KT2440
gaccagcaccagcgacugcaa

SEQ ID NO: 3554448 - RNA, 21 nt, Pseudomonas putida KT2440
gaccagcaugcgaagccgcca

SEQ ID NO: 3554449 - RNA, 15 nt, Pseudomonas putida KT2440
gaccagcccgcugca

SEQ ID NO: 3554450 - RNA, 19 nt, Pseudomonas putida KT2440
gaccagcgacgguggcgug

SEQ ID NO: 3554451 - RNA, 16 nt, Pseudomonas putida KT2440
gaccagcggaucaccg

SEQ ID NO: 3554452 - RNA, 19 nt, Pseudomonas putida KT2440
gaccagcggaucaccgacg

SEQ ID NO: 3554453 - RNA, 14 nt, Pseudomonas putida KT2440
gaccagcggcagca

SEQ ID NO: 3554454 - RNA, 15 nt, Pseudomonas putida KT2440
gaccagcggcagcaa

SEQ ID NO: 3554455 - RNA, 19 nt, Pseudomonas putida KT2440
gaccagcugccauacagcc

SEQ ID NO: 3554456 - RNA, 19 nt, Pseudomonas putida KT2440
gaccaggcauuguugcaac

SEQ ID NO: 3554457 - RNA, 15 nt, Pseudomonas putida KT2440
gaccaggcccagcag

SEQ ID NO: 3554458 - RNA, 21 nt, Pseudomonas putida KT2440
gaccaggcccagcagguagac

SEQ ID NO: 3554459 - RNA, 22 nt, Pseudomonas putida KT2440
gaccaggccgauguuguggcug

SEQ ID NO: 3554460 - RNA, 14 nt, Pseudomonas putida KT2440
gaccagggcgucga

SEQ ID NO: 3554461 - RNA, 14 nt, Pseudomonas putida KT2440
gaccaggugcaggu

SEQ ID NO: 3554462 - RNA, 20 nt, Pseudomonas putida KT2440
gaccaggugguaacuggcca

SEQ ID NO: 3554463 - RNA, 20 nt, Pseudomonas putida KT2440
gaccagugcaacguucaccg

SEQ ID NO: 3554464 - RNA, 23 nt, Pseudomonas putida KT2440
gaccagugcaacguucaccgucg

SEQ ID NO: 3554465 - RNA, 15 nt, Pseudomonas putida KT2440
gaccaguugcucgca

SEQ ID NO: 3554466 - RNA, 22 nt, Pseudomonas putida KT2440
gaccaucaccgccagcauggcc

SEQ ID NO: 3554467 - RNA, 16 nt, Pseudomonas putida KT2440
gaccaucggcaggcgg

SEQ ID NO: 3554468 - RNA, 18 nt, Pseudomonas putida KT2440
gaccaucggcaggcgguc

SEQ ID NO: 3554469 - RNA, 23 nt, Pseudomonas putida KT2440
gaccaucggcaggcgguccagca

SEQ ID NO: 3554470 - RNA, 14 nt, Pseudomonas putida KT2440
gaccauuuccgggu

SEQ ID NO: 3554471 - RNA, 15 nt, Pseudomonas putida KT2440
gaccauuucgcgcag

SEQ ID NO: 3554472 - RNA, 16 nt, Pseudomonas putida KT2440
gaccauuucgcgcagg

SEQ ID NO: 3554473 - RNA, 20 nt, Pseudomonas putida KT2440
gaccauuucgcgcagggugc

SEQ ID NO: 3554474 - RNA, 23 nt, Pseudomonas putida KT2440
gacccacaggcacaggcccagca

SEQ ID NO: 3554475 - RNA, 17 nt, Pseudomonas putida KT2440
gacccaccuacccgcaa

SEQ ID NO: 3554476 - RNA, 15 nt, Pseudomonas putida KT2440
gacccagaaucccaa

SEQ ID NO: 3554477 - RNA, 17 nt, Pseudomonas putida KT2440
gacccaguucgcggauc

SEQ ID NO: 3554478 - RNA, 18 nt, Pseudomonas putida KT2440
gacccaugauugaauucu

SEQ ID NO: 3554479 - RNA, 16 nt, Pseudomonas putida KT2440
gacccccuugccagca

SEQ ID NO: 3554480 - RNA, 22 nt, Pseudomonas putida KT2440
gaccccgaacuucccccucccc

SEQ ID NO: 3554481 - RNA, 22 nt, Pseudomonas putida KT2440
gaccccgcccuagcgguccgga

SEQ ID NO: 3554482 - RNA, 16 nt, Pseudomonas putida KT2440
gaccccgccgcuggcu

SEQ ID NO: 3554483 - RNA, 12 nt, Pseudomonas putida KT2440
gacccgccuggu

SEQ ID NO: 3554484 - RNA, 14 nt, Pseudomonas putida KT2440
gacccgcgccaggg

SEQ ID NO: 3554485 - RNA, 16 nt, Pseudomonas putida KT2440
gacccgcgucagcuca

SEQ ID NO: 3554486 - RNA, 19 nt, Pseudomonas putida KT2440
gacccgcgucucgccgcug

SEQ ID NO: 3554487 - RNA, 18 nt, Pseudomonas putida KT2440
gacccgcucccacagaag

SEQ ID NO: 3554488 - RNA, 17 nt, Pseudomonas putida KT2440
gacccgucgcugccaaa

SEQ ID NO: 3554489 - RNA, 13 nt, Pseudomonas putida KT2440
gacccugcugcug

SEQ ID NO: 3554490 - RNA, 21 nt, Pseudomonas putida KT2440
gacccuggaaaaugcccccgc

SEQ ID NO: 3554491 - RNA, 14 nt, Pseudomonas putida KT2440
gacccuuccagccc

SEQ ID NO: 3554492 - RNA, 22 nt, Pseudomonas putida KT2440
gacccuuccagcccgccugcuc

SEQ ID NO: 3554493 - RNA, 17 nt, Pseudomonas putida KT2440
gacccuugugugggccu

SEQ ID NO: 3554494 - RNA, 19 nt, Pseudomonas putida KT2440
gaccgaaccggcgcuggcc

SEQ ID NO: 3554495 - RNA, 14 nt, Pseudomonas putida KT2440
gaccgaccaccugc

SEQ ID NO: 3554496 - RNA, 15 nt, Pseudomonas putida KT2440
gaccgagaacaggcg

SEQ ID NO: 3554497 - RNA, 16 nt, Pseudomonas putida KT2440
gaccgagaacaggcgg

SEQ ID NO: 3554498 - RNA, 18 nt, Pseudomonas putida KT2440
gaccgagaacaggcggcc

SEQ ID NO: 3554499 - RNA, 21 nt, Pseudomonas putida KT2440
gaccgagguaccaccggagga

SEQ ID NO: 3554500 - RNA, 23 nt, Pseudomonas putida KT2440
gaccgaugccgccguuguugacc

SEQ ID NO: 3554501 - RNA, 15 nt, Pseudomonas putida KT2440
gaccgcacccgcgau

SEQ ID NO: 3554502 - RNA, 11 nt, Pseudomonas putida KT2440
gaccgccgcca

SEQ ID NO: 3554503 - RNA, 11 nt, Pseudomonas putida KT2440
gaccgccgccc

SEQ ID NO: 3554504 - RNA, 14 nt, Pseudomonas putida KT2440
gaccgccgccuggc

SEQ ID NO: 3554505 - RNA, 21 nt, Pseudomonas putida KT2440
gaccgccgccuggcucaccuu

SEQ ID NO: 3554506 - RNA, 15 nt, Pseudomonas putida KT2440
gaccgccugcgcacg

SEQ ID NO: 3554507 - RNA, 17 nt, Pseudomonas putida KT2440
gaccgcggaaugaaccg

SEQ ID NO: 3554508 - RNA, 13 nt, Pseudomonas putida KT2440
gaccggcacugca

SEQ ID NO: 3554509 - RNA, 14 nt, Pseudomonas putida KT2440
gaccggcacugcac

SEQ ID NO: 3554510 - RNA, 13 nt, Pseudomonas putida KT2440
gaccggccgggcu

SEQ ID NO: 3554511 - RNA, 18 nt, Pseudomonas putida KT2440
gaccggcuugucuuccag

SEQ ID NO: 3554512 - RNA, 22 nt, Pseudomonas putida KT2440
gaccggggcugcuuugcagccc

SEQ ID NO: 3554513 - RNA, 12 nt, Pseudomonas putida KT2440
gaccggucagcc

SEQ ID NO: 3554514 - RNA, 18 nt, Pseudomonas putida KT2440
gaccggucagcccggcuu

SEQ ID NO: 3554515 - RNA, 18 nt, Pseudomonas putida KT2440
gaccgguggccugagccg

SEQ ID NO: 3554516 - RNA, 15 nt, Pseudomonas putida KT2440
gaccgguggcgccuu

SEQ ID NO: 3554517 - RNA, 20 nt, Pseudomonas putida KT2440
gaccgugaucaucagcgccg

SEQ ID NO: 3554518 - RNA, 20 nt, Pseudomonas putida KT2440
gaccgugcauacacccgguc

SEQ ID NO: 3554519 - RNA, 20 nt, Pseudomonas putida KT2440
gacgguuacgugcaggcgca

SEQ ID NO: 3554520 - RNA, 21 nt, Pseudomonas putida KT2440
gacgguuacgugcaggcgcac

SEQ ID NO: 3554521 - RNA, 15 nt, Pseudomonas putida KT2440
gacgguugacagcac

SEQ ID NO: 3554522 - RNA, 18 nt, Pseudomonas putida KT2440
gacguagugacgcggauc

SEQ ID NO: 3554523 - RNA, 15 nt, Pseudomonas putida KT2440
gacgucccagcaggc

SEQ ID NO: 3554524 - RNA, 14 nt, Pseudomonas putida KT2440
gacguccggcugcg

SEQ ID NO: 3554525 - RNA, 21 nt, Pseudomonas putida KT2440
gacgugcccagaucacuucca

SEQ ID NO: 3554526 - RNA, 23 nt, Pseudomonas putida KT2440
gacguugguagcgguggcguugc

SEQ ID NO: 3554527 - RNA, 17 nt, Pseudomonas putida KT2440
gacguuuaccugcagcu

SEQ ID NO: 3554528 - RNA, 18 nt, Pseudomonas putida KT2440
gacuaacaggugcucacc

SEQ ID NO: 3554529 - RNA, 17 nt, Pseudomonas putida KT2440
gacuacaucuucgcgcu

SEQ ID NO: 3554530 - RNA, 14 nt, Pseudomonas putida KT2440
gacuaccagguagc

SEQ ID NO: 3554531 - RNA, 22 nt, Pseudomonas putida KT2440
gacuagcagucccaucugguug

SEQ ID NO: 3554532 - RNA, 14 nt, Pseudomonas putida KT2440
gacucagcgcuugc

SEQ ID NO: 3554533 - RNA, 16 nt, Pseudomonas putida KT2440
gacucagcgcuugccg

SEQ ID NO: 3554534 - RNA, 17 nt, Pseudomonas putida KT2440
gacucagcgcuugccgc

SEQ ID NO: 3554535 - RNA, 19 nt, Pseudomonas putida KT2440
gacucagcgcuugccgcug

SEQ ID NO: 3554536 - RNA, 15 nt, Pseudomonas putida KT2440
gacucaugccuucgg

SEQ ID NO: 3554537 - RNA, 13 nt, Pseudomonas putida KT2440
gacucccgcugcc

SEQ ID NO: 3554538 - RNA, 17 nt, Pseudomonas putida KT2440
gacuccggccggggcuc

SEQ ID NO: 3554539 - RNA, 20 nt, Pseudomonas putida KT2440
gacuccugugggagcgggcg

SEQ ID NO: 3554540 - RNA, 22 nt, Pseudomonas putida KT2440
gacucgaaaccaucaaucaacu

SEQ ID NO: 3554541 - RNA, 13 nt, Pseudomonas putida KT2440
gacucgaugccau

SEQ ID NO: 3554542 - RNA, 18 nt, Pseudomonas putida KT2440
gacucgcggccggucacc

SEQ ID NO: 3554543 - RNA, 15 nt, Pseudomonas putida KT2440
gacucuucaccagcu

SEQ ID NO: 3554544 - RNA, 19 nt, Pseudomonas putida KT2440
gacucuuguguugccaccc

SEQ ID NO: 3554545 - RNA, 21 nt, Pseudomonas putida KT2440
gacucuuguguugccacccgg

SEQ ID NO: 3554546 - RNA, 20 nt, Pseudomonas putida KT2440
gacugaacaccugccagccc

SEQ ID NO: 3554547 - RNA, 21 nt, Pseudomonas putida KT2440
gacugaacaccugccagcccc

SEQ ID NO: 3554548 - RNA, 22 nt, Pseudomonas putida KT2440
gacugaacaccugccagccccg

SEQ ID NO: 3554549 - RNA, 17 nt, Pseudomonas putida KT2440
gacugaagcgcgggucu

SEQ ID NO: 3554550 - RNA, 19 nt, Pseudomonas putida KT2440
gacugaagcgcgggucuuc

SEQ ID NO: 3554551 - RNA, 18 nt, Pseudomonas putida KT2440
gacugcaccagguccagc

SEQ ID NO: 3554552 - RNA, 15 nt, Pseudomonas putida KT2440
gacugcaccaugaau

SEQ ID NO: 3554553 - RNA, 17 nt, Pseudomonas putida KT2440
gacugccgcucaucgag

SEQ ID NO: 3554554 - RNA, 21 nt, Pseudomonas putida KT2440
gacugcuguggaacagccuug

SEQ ID NO: 3554555 - RNA, 18 nt, Pseudomonas putida KT2440
gacugcuucaggccuucg

SEQ ID NO: 3554556 - RNA, 19 nt, Pseudomonas putida KT2440
gacugcuucaggccuucga

SEQ ID NO: 3554557 - RNA, 20 nt, Pseudomonas putida KT2440
gacuggcgcaccagcggcuu

SEQ ID NO: 3554558 - RNA, 17 nt, Pseudomonas putida KT2440
gacuggucauacuccag

SEQ ID NO: 3554559 - RNA, 18 nt, Pseudomonas putida KT2440
gacuggucauacuccagc

SEQ ID NO: 3554560 - RNA, 19 nt, Pseudomonas putida KT2440
gacugguuuuccgaguugc

SEQ ID NO: 3554561 - RNA, 14 nt, Pseudomonas putida KT2440
gacugucucgccca

SEQ ID NO: 3554562 - RNA, 14 nt, Pseudomonas putida KT2440
gacuuaaucaaugc

SEQ ID NO: 3554563 - RNA, 22 nt, Pseudomonas putida KT2440
gacuuaaucaaugcaaguaauc

SEQ ID NO: 3554564 - RNA, 20 nt, Pseudomonas putida KT2440
gacuuccagcuugccgucgc

SEQ ID NO: 3554565 - RNA, 18 nt, Pseudomonas putida KT2440
gacuucccgcaagccagc

SEQ ID NO: 3554566 - RNA, 20 nt, Pseudomonas putida KT2440
gacuucccggcaccgcuugc

SEQ ID NO: 3554567 - RNA, 23 nt, Pseudomonas putida KT2440
gacuucgaccacggccggggccu

SEQ ID NO: 3554568 - RNA, 21 nt, Pseudomonas putida KT2440
gacuucgucgaacaccagggu

SEQ ID NO: 3554569 - RNA, 20 nt, Pseudomonas putida KT2440
gacuugccugucauggcagu

SEQ ID NO: 3554570 - RNA, 18 nt, Pseudomonas putida KT2440
gacuuucaugcccgcguc

SEQ ID NO: 3554571 - RNA, 13 nt, Pseudomonas putida KT2440
gacuuucccacau

SEQ ID NO: 3554572 - RNA, 20 nt, Pseudomonas putida KT2440
gacuuucccacauguaauga

SEQ ID NO: 3554573 - RNA, 21 nt, Pseudomonas putida KT2440
gacuuuggcgucggucagcga

SEQ ID NO: 3554574 - RNA, 22 nt, Pseudomonas putida KT2440
gagaaacugucguuuggcgcga

SEQ ID NO: 3554575 - RNA, 21 nt, Pseudomonas putida KT2440
gagaaauggcaguguggcaag

SEQ ID NO: 3554576 - RNA, 23 nt, Pseudomonas putida KT2440
gagaaccugaugcgagcuaccug

SEQ ID NO: 3554577 - RNA, 15 nt, Pseudomonas putida KT2440
gagaagcacaagcca

SEQ ID NO: 3554578 - RNA, 13 nt, Pseudomonas putida KT2440
gagaagcugcagc

SEQ ID NO: 3554579 - RNA, 17 nt, Pseudomonas putida KT2440
gagaagcugcagcuuca

SEQ ID NO: 3554580 - RNA, 11 nt, Pseudomonas putida KT2440
gagaaugaaac

SEQ ID NO: 3554581 - RNA, 20 nt, Pseudomonas putida KT2440
gagacauccgcaacaugaag

SEQ ID NO: 3554582 - RNA, 18 nt, Pseudomonas putida KT2440
gagaccgauuucaacccu

SEQ ID NO: 3554583 - RNA, 19 nt, Pseudomonas putida KT2440
gagaccguagggggccgcu

SEQ ID NO: 3554584 - RNA, 21 nt, Pseudomonas putida KT2440
gagaccugugguuucacacuc

SEQ ID NO: 3554585 - RNA, 18 nt, Pseudomonas putida KT2440
gagacgcauguugaaaca

SEQ ID NO: 3554586 - RNA, 18 nt, Pseudomonas putida KT2440
gagacgguggcugccagc

SEQ ID NO: 3554587 - RNA, 22 nt, Pseudomonas putida KT2440
gagacuuuagcuuauucgaugc

SEQ ID NO: 3554588 - RNA, 20 nt, Pseudomonas putida KT2440
gagagauugagaggacuuua

SEQ ID NO: 3554589 - RNA, 18 nt, Pseudomonas putida KT2440
gagagcaguuccuucagc

SEQ ID NO: 3554590 - RNA, 19 nt, Pseudomonas putida KT2440
gagagcaguuccuucagca

SEQ ID NO: 3554591 - RNA, 19 nt, Pseudomonas putida KT2440
gagagccucggcucuccuu

SEQ ID NO: 3554592 - RNA, 17 nt, Pseudomonas putida KT2440
gagagguacacccccag

SEQ ID NO: 3554593 - RNA, 19 nt, Pseudomonas putida KT2440
gagauaucgcauuucuagc

SEQ ID NO: 3554594 - RNA, 21 nt, Pseudomonas putida KT2440
gagauauguccauccaugcaa

SEQ ID NO: 3554595 - RNA, 17 nt, Pseudomonas putida KT2440
gagaucagcaaccugcu

SEQ ID NO: 3554596 - RNA, 17 nt, Pseudomonas putida KT2440
gagaucgagugcucgaa

SEQ ID NO: 3554597 - RNA, 17 nt, Pseudomonas putida KT2440
gagauuccgggcugcug

SEQ ID NO: 3554598 - RNA, 13 nt, Pseudomonas putida KT2440
gagauugagagga

SEQ ID NO: 3554599 - RNA, 18 nt, Pseudomonas putida KT2440
gagauuggccagcagggc

SEQ ID NO: 3554600 - RNA, 23 nt, Pseudomonas putida KT2440
gagauuugccuuggaaugcacau

SEQ ID NO: 3554601 - RNA, 12 nt, Pseudomonas putida KT2440
gagcaaaaccgu

SEQ ID NO: 3554602 - RNA, 20 nt, Pseudomonas putida KT2440
gagcaaaaccguacaaggca

SEQ ID NO: 3554603 - RNA, 13 nt, Pseudomonas putida KT2440
gagcaaagcccgc

SEQ ID NO: 3554604 - RNA, 19 nt, Pseudomonas putida KT2440
gagcaacagaacgccuugu

SEQ ID NO: 3554605 - RNA, 14 nt, Pseudomonas putida KT2440
gagcaaccagcaga

SEQ ID NO: 3554606 - RNA, 20 nt, Pseudomonas putida KT2440
gagcaagacacgagcggccu

SEQ ID NO: 3554607 - RNA, 21 nt, Pseudomonas putida KT2440
gagcaagacacgagcggccuu

SEQ ID NO: 3554608 - RNA, 13 nt, Pseudomonas putida KT2440
gagcaagcucgcu

SEQ ID NO: 3554609 - RNA, 21 nt, Pseudomonas putida KT2440
gagcaaggcauccaccugcag

SEQ ID NO: 3554610 - RNA, 15 nt, Pseudomonas putida KT2440
gagcaaggcguuguc

SEQ ID NO: 3554611 - RNA, 19 nt, Pseudomonas putida KT2440
gagcaaggcguugucggcc

SEQ ID NO: 3554612 - RNA, 23 nt, Pseudomonas putida KT2440
gagcaagggccguuacucccaca

SEQ ID NO: 3554613 - RNA, 13 nt, Pseudomonas putida KT2440
gagcaauacaucc

SEQ ID NO: 3554614 - RNA, 20 nt, Pseudomonas putida KT2440
gagcaauacauccaggcccg

SEQ ID NO: 3554615 - RNA, 13 nt, Pseudomonas putida KT2440
gagcaccacggcg

SEQ ID NO: 3554616 - RNA, 17 nt, Pseudomonas putida KT2440
gagcacggcuucgacgc

SEQ ID NO: 3554617 - RNA, 23 nt, Pseudomonas putida KT2440
gagcacggcuucgacgcuuuccu

SEQ ID NO: 3554618 - RNA, 18 nt, Pseudomonas putida KT2440
gagcacucggcggcgaag

SEQ ID NO: 3554619 - RNA, 19 nt, Pseudomonas putida KT2440
gagcagcuuauugcgcagg

SEQ ID NO: 3554620 - RNA, 20 nt, Pseudomonas putida KT2440
gagcagcuuauugcgcaggg

SEQ ID NO: 3554621 - RNA, 23 nt, Pseudomonas putida KT2440
gagcagcuuauugcgcagggugg

SEQ ID NO: 3554622 - RNA, 17 nt, Pseudomonas putida KT2440
gagcagggcugcgcgcc

SEQ ID NO: 3554623 - RNA, 14 nt, Pseudomonas putida KT2440
gagcuguuucaugc

SEQ ID NO: 3554624 - RNA, 17 nt, Pseudomonas putida KT2440
gagcuguuucaugcugc

SEQ ID NO: 3554625 - RNA, 11 nt, Pseudomonas putida KT2440
gagcuucaacg

SEQ ID NO: 3554626 - RNA, 13 nt, Pseudomonas putida KT2440
gagcuucaacgcg

SEQ ID NO: 3554627 - RNA, 18 nt, Pseudomonas putida KT2440
gagcuucgucggugcccu

SEQ ID NO: 3554628 - RNA, 21 nt, Pseudomonas putida KT2440
gagcuucgucggugcccuuca

SEQ ID NO: 3554629 - RNA, 13 nt, Pseudomonas putida KT2440
gagcuugcucgcg

SEQ ID NO: 3554630 - RNA, 18 nt, Pseudomonas putida KT2440
gagcuuggcguccacagc

SEQ ID NO: 3554631 - RNA, 14 nt, Pseudomonas putida KT2440
gagcuuguacacgc

SEQ ID NO: 3554632 - RNA, 22 nt, Pseudomonas putida KT2440
gaggaaaagcagcuccagcguu

SEQ ID NO: 3554633 - RNA, 14 nt, Pseudomonas putida KT2440
gaggaacaacuugg

SEQ ID NO: 3554634 - RNA, 21 nt, Pseudomonas putida KT2440
gaggacaacaaggacugccug

SEQ ID NO: 3554635 - RNA, 18 nt, Pseudomonas putida KT2440
gaggacacaucgaucagg

SEQ ID NO: 3554636 - RNA, 15 nt, Pseudomonas putida KT2440
gaggacauaccacac

SEQ ID NO: 3554637 - RNA, 16 nt, Pseudomonas putida KT2440
gaggaccugcguuggg

SEQ ID NO: 3554638 - RNA, 22 nt, Pseudomonas putida KT2440
gaggagggcugcaucacuugca

SEQ ID NO: 3554639 - RNA, 16 nt, Pseudomonas putida KT2440
gaggauauaagccgcc

SEQ ID NO: 3554640 - RNA, 14 nt, Pseudomonas putida KT2440
gaggaucagcgcag

SEQ ID NO: 3554641 - RNA, 17 nt, Pseudomonas putida KT2440
gaggaugcugaagcucu

SEQ ID NO: 3554642 - RNA, 20 nt, Pseudomonas putida KT2440
gaggauugggaaaacacagg

SEQ ID NO: 3554643 - RNA, 21 nt, Pseudomonas putida KT2440
gaggcacaaaaaagcccggca

SEQ ID NO: 3554644 - RNA, 15 nt, Pseudomonas putida KT2440
gaggcagcgaaagca

SEQ ID NO: 3554645 - RNA, 11 nt, Pseudomonas putida KT2440
gaggccagcac

SEQ ID NO: 3554646 - RNA, 17 nt, Pseudomonas putida KT2440
gaggccagcgggaaguu

SEQ ID NO: 3554647 - RNA, 18 nt, Pseudomonas putida KT2440
gaggccaguaccagcagc

SEQ ID NO: 3554648 - RNA, 19 nt, Pseudomonas putida KT2440
gaggccaguaccagcagca

SEQ ID NO: 3554649 - RNA, 15 nt, Pseudomonas putida KT2440
gaggccccgacagca

SEQ ID NO: 3554650 - RNA, 15 nt, Pseudomonas putida KT2440
gaggccggggaugcg

SEQ ID NO: 3554651 - RNA, 21 nt, Pseudomonas putida KT2440
gaggccgguacagccagcaaa

SEQ ID NO: 3554652 - RNA, 17 nt, Pseudomonas putida KT2440
gaggccgguacugccca

SEQ ID NO: 3554653 - RNA, 21 nt, Pseudomonas putida KT2440
gaggccgguaggccuccccgc

SEQ ID NO: 3554654 - RNA, 15 nt, Pseudomonas putida KT2440
gaggcgaauggcagg

SEQ ID NO: 3554655 - RNA, 19 nt, Pseudomonas putida KT2440
gaggcgaauggcaggugau

SEQ ID NO: 3554656 - RNA, 16 nt, Pseudomonas putida KT2440
gaggcgaugcagggcu

SEQ ID NO: 3554657 - RNA, 13 nt, Pseudomonas putida KT2440
gaggcgauggcau

SEQ ID NO: 3554658 - RNA, 20 nt, Pseudomonas putida KT2440
gaggcgccgacgauaccgcc

SEQ ID NO: 3554659 - RNA, 13 nt, Pseudomonas putida KT2440
gaggcgcgcgccu

SEQ ID NO: 3554660 - RNA, 21 nt, Pseudomonas putida KT2440
gaggcgcgcgccuggguggcg

SEQ ID NO: 3554661 - RNA, 16 nt, Pseudomonas putida KT2440
gaggcgggccgcaggc

SEQ ID NO: 3554662 - RNA, 15 nt, Pseudomonas putida KT2440
gaggcguuggccgaa

SEQ ID NO: 3554663 - RNA, 21 nt, Pseudomonas putida KT2440
gaggcguuggccgaaggccgu

SEQ ID NO: 3554664 - RNA, 19 nt, Pseudomonas putida KT2440
gaggcugaucaggaacacu

SEQ ID NO: 3554665 - RNA, 19 nt, Pseudomonas putida KT2440
gaggcuguggcccaaggcg

SEQ ID NO: 3554666 - RNA, 19 nt, Pseudomonas putida KT2440
gagggaaaacucggucagg

SEQ ID NO: 3554667 - RNA, 22 nt, Pseudomonas putida KT2440
gagggaagggcgucugcuccgc

SEQ ID NO: 3554668 - RNA, 16 nt, Pseudomonas putida KT2440
gagggcguuccagcca

SEQ ID NO: 3554669 - RNA, 17 nt, Pseudomonas putida KT2440
gaggggacgaucugcag

SEQ ID NO: 3554670 - RNA, 21 nt, Pseudomonas putida KT2440
gaggggacgaucugcagcacc

SEQ ID NO: 3554671 - RNA, 21 nt, Pseudomonas putida KT2440
gagggucagcuggccuucgaa

SEQ ID NO: 3554672 - RNA, 14 nt, Pseudomonas putida KT2440
gagggucggcgggc

SEQ ID NO: 3554673 - RNA, 15 nt, Pseudomonas putida KT2440
gagggucgugagccu

SEQ ID NO: 3554674 - RNA, 19 nt, Pseudomonas putida KT2440
gagggucgugagccugcac

SEQ ID NO: 3554675 - RNA, 20 nt, Pseudomonas putida KT2440
gagggugacccagcgcuggu

SEQ ID NO: 3554676 - RNA, 19 nt, Pseudomonas putida KT2440
gagggugaggugcugcaga

SEQ ID NO: 3554677 - RNA, 14 nt, Pseudomonas putida KT2440
gaggguuccaggcc

SEQ ID NO: 3554678 - RNA, 15 nt, Pseudomonas putida KT2440
gagguaaaggucaca

SEQ ID NO: 3554679 - RNA, 14 nt, Pseudomonas putida KT2440
gagguaagacaggc

SEQ ID NO: 3554680 - RNA, 23 nt, Pseudomonas putida KT2440
gagguacacccccagguuaucca

SEQ ID NO: 3554681 - RNA, 22 nt, Pseudomonas putida KT2440
gagguagaucacaccggccgcc

SEQ ID NO: 3554682 - RNA, 19 nt, Pseudomonas putida KT2440
gagguaggccgucagcagc

SEQ ID NO: 3554683 - RNA, 21 nt, Pseudomonas putida KT2440
gagguaggccgucagcagcag

SEQ ID NO: 3554684 - RNA, 23 nt, Pseudomonas putida KT2440
gaggucggagaucgagugcucga

SEQ ID NO: 3554685 - RNA, 16 nt, Pseudomonas putida KT2440
gaggucgucggucucg

SEQ ID NO: 3554686 - RNA, 22 nt, Pseudomonas putida KT2440
gaggucuucgaucucggccagc

SEQ ID NO: 3554687 - RNA, 19 nt, Pseudomonas putida KT2440
gaggugccauagcaccagc

SEQ ID NO: 3554688 - RNA, 23 nt, Pseudomonas putida KT2440
gaggugcgcuucaaauagaagaa

SEQ ID NO: 3554689 - RNA, 18 nt, Pseudomonas putida KT2440
gagguggucgaggcaaag

SEQ ID NO: 3554690 - RNA, 14 nt, Pseudomonas putida KT2440
gagguugcgcucca

SEQ ID NO: 3554691 - RNA, 15 nt, Pseudomonas putida KT2440
gaguaaaaagagccc

SEQ ID NO: 3554692 - RNA, 16 nt, Pseudomonas putida KT2440
gaguaaagccagcagc

SEQ ID NO: 3554693 - RNA, 15 nt, Pseudomonas putida KT2440
gaguaaagccgaucg

SEQ ID NO: 3554694 - RNA, 13 nt, Pseudomonas putida KT2440
gaguacgaucagc

SEQ ID NO: 3554695 - RNA, 19 nt, Pseudomonas putida KT2440
gaguagaucaucagcgcca

SEQ ID NO: 3554696 - RNA, 15 nt, Pseudomonas putida KT2440
gaguauucuccuucu

SEQ ID NO: 3554697 - RNA, 21 nt, Pseudomonas putida KT2440
gagucagcuugugccgcggcu

SEQ ID NO: 3554698 - RNA, 16 nt, Pseudomonas putida KT2440
gagucaggcugcacaa

SEQ ID NO: 3554699 - RNA, 13 nt, Pseudomonas putida KT2440
gaguccagcugca

SEQ ID NO: 3554700 - RNA, 15 nt, Pseudomonas putida KT2440
gagucggcucuggca

SEQ ID NO: 3554701 - RNA, 15 nt, Pseudomonas putida KT2440
gagucgguggcgaag

SEQ ID NO: 3554702 - RNA, 20 nt, Pseudomonas putida KT2440
gagugcgcggaacagguuga

SEQ ID NO: 3554703 - RNA, 13 nt, Pseudomonas putida KT2440
gagugcggcaggc

SEQ ID NO: 3554704 - RNA, 16 nt, Pseudomonas putida KT2440
gagugcggcaggccga

SEQ ID NO: 3554705 - RNA, 21 nt, Pseudomonas putida KT2440
gagugcucgccucacagcgcc

SEQ ID NO: 3554706 - RNA, 19 nt, Pseudomonas putida KT2440
gagugcuggggccgcaaag

SEQ ID NO: 3554707 - RNA, 21 nt, Pseudomonas putida KT2440
gaguggaucaaccgaccagcg

SEQ ID NO: 3554708 - RNA, 19 nt, Pseudomonas putida KT2440
gagugguaaugaaagucca

SEQ ID NO: 3554709 - RNA, 20 nt, Pseudomonas putida KT2440
gagugucaguuuuuuugugu

SEQ ID NO: 3554710 - RNA, 22 nt, Pseudomonas putida KT2440
gaguuagacaauucugaaggug

SEQ ID NO: 3554711 - RNA, 16 nt, Pseudomonas putida KT2440
gaguucccaggcagcc

SEQ ID NO: 3554712 - RNA, 22 nt, Pseudomonas putida KT2440
gaguucccaggcagccuccagg

SEQ ID NO: 3554713 - RNA, 16 nt, Pseudomonas putida KT2440
gaguugaguggggugg

SEQ ID NO: 3554714 - RNA, 15 nt, Pseudomonas putida KT2440
gaguugccuucgauc

SEQ ID NO: 3554715 - RNA, 22 nt, Pseudomonas putida KT2440
gaguugccuucgaucggcgcgc

SEQ ID NO: 3554716 - RNA, 18 nt, Pseudomonas putida KT2440
gaguugcguggggccugc

SEQ ID NO: 3554717 - RNA, 17 nt, Pseudomonas putida KT2440
gaguuucaucggucuua

SEQ ID NO: 3554718 - RNA, 14 nt, Pseudomonas putida KT2440
gauaaaaguaauac

SEQ ID NO: 3554719 - RNA, 20 nt, Pseudomonas putida KT2440
gauaaacacgaacaucagca

SEQ ID NO: 3554720 - RNA, 13 nt, Pseudomonas putida KT2440
gauaaaccagcag

SEQ ID NO: 3554721 - RNA, 15 nt, Pseudomonas putida KT2440
gauaaaccagcagcg

SEQ ID NO: 3554722 - RNA, 20 nt, Pseudomonas putida KT2440
gauaaaccagcagcgccugc

SEQ ID NO: 3554723 - RNA, 18 nt, Pseudomonas putida KT2440
gauaaaccgugcaaacaa

SEQ ID NO: 3554724 - RNA, 19 nt, Pseudomonas putida KT2440
gauaaacgcgauaucccaa

SEQ ID NO: 3554725 - RNA, 17 nt, Pseudomonas putida KT2440
gauaaagagaagcugca

SEQ ID NO: 3554726 - RNA, 22 nt, Pseudomonas putida KT2440
gauaaagagaagcugcagcuuc

SEQ ID NO: 3554727 - RNA, 17 nt, Pseudomonas putida KT2440
gauaaccuggcucggcu

SEQ ID NO: 3554728 - RNA, 14 nt, Pseudomonas putida KT2440
gaucauccccagca

SEQ ID NO: 3554729 - RNA, 18 nt, Pseudomonas putida KT2440
gaucaucgaagccaguac

SEQ ID NO: 3554730 - RNA, 23 nt, Pseudomonas putida KT2440
gaucaucuccaugaaggccggca

SEQ ID NO: 3554731 - RNA, 20 nt, Pseudomonas putida KT2440
gaucaugaacgaggacugca

SEQ ID NO: 3554732 - RNA, 23 nt, Pseudomonas putida KT2440
gaucaugaacgaggacugcacca

SEQ ID NO: 3554733 - RNA, 15 nt, Pseudomonas putida KT2440
gaucaugccgacggu

SEQ ID NO: 3554734 - RNA, 18 nt, Pseudomonas putida KT2440
gaucaugcggcaagccaa

SEQ ID NO: 3554735 - RNA, 15 nt, Pseudomonas putida KT2440
gaucaugcuggccag

SEQ ID NO: 3554736 - RNA, 17 nt, Pseudomonas putida KT2440
gaucauguccuugcugc

SEQ ID NO: 3554737 - RNA, 18 nt, Pseudomonas putida KT2440
gaucauguccuugcugcg

SEQ ID NO: 3554738 - RNA, 12 nt, Pseudomonas putida KT2440
gaucaugucgcc

SEQ ID NO: 3554739 - RNA, 14 nt, Pseudomonas putida KT2440
gaucauucaggcac

SEQ ID NO: 3554740 - RNA, 22 nt, Pseudomonas putida KT2440
gaucauucaggcacggcaccag

SEQ ID NO: 3554741 - RNA, 14 nt, Pseudomonas putida KT2440
gaucauuucaucgc

SEQ ID NO: 3554742 - RNA, 15 nt, Pseudomonas putida KT2440
gauccagcccaccac

SEQ ID NO: 3554743 - RNA, 17 nt, Pseudomonas putida KT2440
gauccaggugcgcaccu

SEQ ID NO: 3554744 - RNA, 14 nt, Pseudomonas putida KT2440
gauccaucuucacc

SEQ ID NO: 3554745 - RNA, 15 nt, Pseudomonas putida KT2440
gauccaucuucaccu

SEQ ID NO: 3554746 - RNA, 17 nt, Pseudomonas putida KT2440
gaucccacggccgcgca

SEQ ID NO: 3554747 - RNA, 20 nt, Pseudomonas putida KT2440
gaucccacggccgcgcaggg

SEQ ID NO: 3554748 - RNA, 15 nt, Pseudomonas putida KT2440
gauccccaccagcau

SEQ ID NO: 3554749 - RNA, 13 nt, Pseudomonas putida KT2440
gauccccggcgac

SEQ ID NO: 3554750 - RNA, 16 nt, Pseudomonas putida KT2440
gaucccgaggucagca

SEQ ID NO: 3554751 - RNA, 19 nt, Pseudomonas putida KT2440
gaucccgaggucagcagug

SEQ ID NO: 3554752 - RNA, 14 nt, Pseudomonas putida KT2440
gaucccgccgagca

SEQ ID NO: 3554753 - RNA, 13 nt, Pseudomonas putida KT2440
gaucccgccgcca

SEQ ID NO: 3554754 - RNA, 19 nt, Pseudomonas putida KT2440
gaucccgcgaggucaggua

SEQ ID NO: 3554755 - RNA, 16 nt, Pseudomonas putida KT2440
gaucccgcuccucggc

SEQ ID NO: 3554756 - RNA, 20 nt, Pseudomonas putida KT2440
gaucccuacccccuccucca

SEQ ID NO: 3554757 - RNA, 19 nt, Pseudomonas putida KT2440
gaucccuguaggagcgggu

SEQ ID NO: 3554758 - RNA, 16 nt, Pseudomonas putida KT2440
gauccgauaaucuugc

SEQ ID NO: 3554759 - RNA, 16 nt, Pseudomonas putida KT2440
gauccgccccauagcc

SEQ ID NO: 3554760 - RNA, 13 nt, Pseudomonas putida KT2440
gauccggccgugu

SEQ ID NO: 3554761 - RNA, 21 nt, Pseudomonas putida KT2440
gauccggccguguucaggcac

SEQ ID NO: 3554762 - RNA, 14 nt, Pseudomonas putida KT2440
gauccgggugcugg

SEQ ID NO: 3554763 - RNA, 21 nt, Pseudomonas putida KT2440
gauccgguguaggagcggguu

SEQ ID NO: 3554764 - RNA, 22 nt, Pseudomonas putida KT2440
gauccucugugggagcggccuu

SEQ ID NO: 3554765 - RNA, 21 nt, Pseudomonas putida KT2440
gauccugcagccgcaccugcc

SEQ ID NO: 3554766 - RNA, 21 nt, Pseudomonas putida KT2440
gauccugggggcguaaagcgc

SEQ ID NO: 3554767 - RNA, 22 nt, Pseudomonas putida KT2440
gaucgaaagcugcgcacauuga

SEQ ID NO: 3554768 - RNA, 16 nt, Pseudomonas putida KT2440
gaucgaagcagcagcu

SEQ ID NO: 3554769 - RNA, 16 nt, Pseudomonas putida KT2440
gaucgagccgaucagg

SEQ ID NO: 3554770 - RNA, 16 nt, Pseudomonas putida KT2440
gaucgagugcucgaac

SEQ ID NO: 3554771 - RNA, 20 nt, Pseudomonas putida KT2440
gaucgaugaacucacccgcc

SEQ ID NO: 3554772 - RNA, 21 nt, Pseudomonas putida KT2440
gaucgaugcacguaccuggcu

SEQ ID NO: 3554773 - RNA, 15 nt, Pseudomonas putida KT2440
gaucgcaagcuggcg

SEQ ID NO: 3554774 - RNA, 14 nt, Pseudomonas putida KT2440
gaucgccagcccca

SEQ ID NO: 3554775 - RNA, 15 nt, Pseudomonas putida KT2440
gaucgccagccccag

SEQ ID NO: 3554776 - RNA, 23 nt, Pseudomonas putida KT2440
gaucgccagccccagcccggugc

SEQ ID NO: 3554777 - RNA, 12 nt, Pseudomonas putida KT2440
gaucgccuccag

SEQ ID NO: 3554778 - RNA, 14 nt, Pseudomonas putida KT2440
gaucgccuccaggc

SEQ ID NO: 3554779 - RNA, 15 nt, Pseudomonas putida KT2440
gaucgcgcaagccuu

SEQ ID NO: 3554780 - RNA, 13 nt, Pseudomonas putida KT2440
gaucgcgcuggca

SEQ ID NO: 3554781 - RNA, 22 nt, Pseudomonas putida KT2440
gaucgcggcguugucagccuuc

SEQ ID NO: 3554782 - RNA, 17 nt, Pseudomonas putida KT2440
gaucgcucucgcuuuug

SEQ ID NO: 3554783 - RNA, 22 nt, Pseudomonas putida KT2440
gaucgcuugucuccaugucgaa

SEQ ID NO: 3554784 - RNA, 17 nt, Pseudomonas putida KT2440
gaucggcaagcccaaug

SEQ ID NO: 3554785 - RNA, 17 nt, Pseudomonas putida KT2440
gaucggcagugccgcag

SEQ ID NO: 3554786 - RNA, 14 nt, Pseudomonas putida KT2440
gaucggccgccaga

SEQ ID NO: 3554787 - RNA, 22 nt, Pseudomonas putida KT2440
gaucggccggcggauagccccg

SEQ ID NO: 3554788 - RNA, 17 nt, Pseudomonas putida KT2440
gaucggcgucgguguac

SEQ ID NO: 3554789 - RNA, 19 nt, Pseudomonas putida KT2440
gaucggcgugcggcuggcu

SEQ ID NO: 3554790 - RNA, 15 nt, Pseudomonas putida KT2440
gaucggcguggucca

SEQ ID NO: 3554791 - RNA, 13 nt, Pseudomonas putida KT2440
gaucggcuggcca

SEQ ID NO: 3554792 - RNA, 19 nt, Pseudomonas putida KT2440
gaucggguuuacccgcgaa

SEQ ID NO: 3554793 - RNA, 20 nt, Pseudomonas putida KT2440
gaucggguuuacccgcgaag

SEQ ID NO: 3554794 - RNA, 12 nt, Pseudomonas putida KT2440
gaucgguacaug

SEQ ID NO: 3554795 - RNA, 15 nt, Pseudomonas putida KT2440
gaucgguacaugcga

SEQ ID NO: 3554796 - RNA, 20 nt, Pseudomonas putida KT2440
gaucgguacaugcgaacgca

SEQ ID NO: 3554797 - RNA, 22 nt, Pseudomonas putida KT2440
gaucggugccacccaaggcauc

SEQ ID NO: 3554798 - RNA, 21 nt, Pseudomonas putida KT2440
gaucggugcguaggagcgggu

SEQ ID NO: 3554799 - RNA, 21 nt, Pseudomonas putida KT2440
gaucgucggccccggccccag

SEQ ID NO: 3554800 - RNA, 19 nt, Pseudomonas putida KT2440
gaucgucguaggagcgggu

SEQ ID NO: 3554801 - RNA, 14 nt, Pseudomonas putida KT2440
gaucguugcgcgcc

SEQ ID NO: 3554802 - RNA, 13 nt, Pseudomonas putida KT2440
gaucguuguagga

SEQ ID NO: 3554803 - RNA, 17 nt, Pseudomonas putida KT2440
gaucuaugaccaacuuu

SEQ ID NO: 3554804 - RNA, 18 nt, Pseudomonas putida KT2440
gaucucacgcgccacaua

SEQ ID NO: 3554805 - RNA, 19 nt, Pseudomonas putida KT2440
gaucuccucggccagcggc

SEQ ID NO: 3554806 - RNA, 15 nt, Pseudomonas putida KT2440
gaucucgauccggcc

SEQ ID NO: 3554807 - RNA, 20 nt, Pseudomonas putida KT2440
gaucucgccagccugcagcg

SEQ ID NO: 3554808 - RNA, 21 nt, Pseudomonas putida KT2440
gaucucgcccaugauguggcu

SEQ ID NO: 3554809 - RNA, 22 nt, Pseudomonas putida KT2440
gaucucgcccaugauguggcug

SEQ ID NO: 3554810 - RNA, 16 nt, Pseudomonas putida KT2440
gaucucgcgcauccgg

SEQ ID NO: 3554811 - RNA, 17 nt, Pseudomonas putida KT2440
gaucucgcuucauggcc

SEQ ID NO: 3554812 - RNA, 17 nt, Pseudomonas putida KT2440
gaucucggccagcaggc

SEQ ID NO: 3554813 - RNA, 19 nt, Pseudomonas putida KT2440
gaucugaaaguucagcgcc

SEQ ID NO: 3554814 - RNA, 16 nt, Pseudomonas putida KT2440
gaucugccccucgauc

SEQ ID NO: 3554815 - RNA, 15 nt, Pseudomonas putida KT2440
gaucugcggugggca

SEQ ID NO: 3554816 - RNA, 22 nt, Pseudomonas putida KT2440
gaucugcguacaccgacgccga

SEQ ID NO: 3554817 - RNA, 14 nt, Pseudomonas putida KT2440
gaucugcugcagca

SEQ ID NO: 3554818 - RNA, 16 nt, Pseudomonas putida KT2440
gaucugcugcagcaug

SEQ ID NO: 3554819 - RNA, 18 nt, Pseudomonas putida KT2440
gaucuggcgcagcgggga

SEQ ID NO: 3554820 - RNA, 22 nt, Pseudomonas putida KT2440
gaucuggcggaaugucggcguu

SEQ ID NO: 3554821 - RNA, 15 nt, Pseudomonas putida KT2440
gaucuggucacccug

SEQ ID NO: 3554822 - RNA, 18 nt, Pseudomonas putida KT2440
gaucugugggagcggccu

SEQ ID NO: 3554823 - RNA, 17 nt, Pseudomonas putida KT2440
gaucuguugcugcaggu

SEQ ID NO: 3554824 - RNA, 15 nt, Pseudomonas putida KT2440
gaucuucucggcgcg

SEQ ID NO: 3554825 - RNA, 13 nt, Pseudomonas putida KT2440
gaucuucucuucc

SEQ ID NO: 3554826 - RNA, 20 nt, Pseudomonas putida KT2440
gaucuugccuucggccacac

SEQ ID NO: 3554827 - RNA, 13 nt, Pseudomonas putida KT2440
gaucuugcuggcc

SEQ ID NO: 3554828 - RNA, 14 nt, Pseudomonas putida KT2440
gaucuugcuggccg

SEQ ID NO: 3554829 - RNA, 14 nt, Pseudomonas putida KT2440
gaucuuggccaggg

SEQ ID NO: 3554830 - RNA, 20 nt, Pseudomonas putida KT2440
gaucuuguuggucaggccau

SEQ ID NO: 3554831 - RNA, 16 nt, Pseudomonas putida KT2440
gaucuuuacuuucuac

SEQ ID NO: 3554832 - RNA, 14 nt, Pseudomonas putida KT2440
gaugaaauccacca

SEQ ID NO: 3554833 - RNA, 17 nt, Pseudomonas putida KT2440
gaugaaauucaccugcc

SEQ ID NO: 3554834 - RNA, 18 nt, Pseudomonas putida KT2440
gauguccuugcuggccac

SEQ ID NO: 3554835 - RNA, 19 nt, Pseudomonas putida KT2440
gaugucggcgugcaccacg

SEQ ID NO: 3554836 - RNA, 19 nt, Pseudomonas putida KT2440
gaugucuacccacaagcgc

SEQ ID NO: 3554837 - RNA, 16 nt, Pseudomonas putida KT2440
gauguggcccgggaag

SEQ ID NO: 3554838 - RNA, 12 nt, Pseudomonas putida KT2440
gauguggcuggu

SEQ ID NO: 3554839 - RNA, 15 nt, Pseudomonas putida KT2440
gauguguuggccgga

SEQ ID NO: 3554840 - RNA, 14 nt, Pseudomonas putida KT2440
gauguucaggucgc

SEQ ID NO: 3554841 - RNA, 22 nt, Pseudomonas putida KT2440
gauguucccauugagcuguuuc

SEQ ID NO: 3554842 - RNA, 23 nt, Pseudomonas putida KT2440
gauguugcccggcaugaucagcu

SEQ ID NO: 3554843 - RNA, 17 nt, Pseudomonas putida KT2440
gauguugcggcgguggc

SEQ ID NO: 3554844 - RNA, 16 nt, Pseudomonas putida KT2440
gauguuggccaucacu

SEQ ID NO: 3554845 - RNA, 14 nt, Pseudomonas putida KT2440
gauuacaagggccu

SEQ ID NO: 3554846 - RNA, 15 nt, Pseudomonas putida KT2440
gauuacaagggccug

SEQ ID NO: 3554847 - RNA, 20 nt, Pseudomonas putida KT2440
gauuacaagggccugugccg

SEQ ID NO: 3554848 - RNA, 20 nt, Pseudomonas putida KT2440
gauuacccugcgccaggcau

SEQ ID NO: 3554849 - RNA, 15 nt, Pseudomonas putida KT2440
gauuaucgagcuaca

SEQ ID NO: 3554850 - RNA, 18 nt, Pseudomonas putida KT2440
gauuaucgagcuacagcc

SEQ ID NO: 3554851 - RNA, 12 nt, Pseudomonas putida KT2440
gauucaagcccg

SEQ ID NO: 3554852 - RNA, 14 nt, Pseudomonas putida KT2440
gauucaagcccggc

SEQ ID NO: 3554853 - RNA, 15 nt, Pseudomonas putida KT2440
gauuccagcagggga

SEQ ID NO: 3554854 - RNA, 19 nt, Pseudomonas putida KT2440
gauuccagcaggggacgca

SEQ ID NO: 3554855 - RNA, 20 nt, Pseudomonas putida KT2440
gauuccgggcugcugcgcag

SEQ ID NO: 3554856 - RNA, 17 nt, Pseudomonas putida KT2440
gauuccguaccaguucc

SEQ ID NO: 3554857 - RNA, 15 nt, Pseudomonas putida KT2440
gauuccuugcagcgc

SEQ ID NO: 3554858 - RNA, 15 nt, Pseudomonas putida KT2440
gauucgccaaggccu

SEQ ID NO: 3554859 - RNA, 17 nt, Pseudomonas putida KT2440
gauucgccaaggccucg

SEQ ID NO: 3554860 - RNA, 13 nt, Pseudomonas putida KT2440
gauugacccgacg

SEQ ID NO: 3554861 - RNA, 15 nt, Pseudomonas putida KT2440
gauugaucagcgccu

SEQ ID NO: 3554862 - RNA, 18 nt, Pseudomonas putida KT2440
gauugccagggugccaga

SEQ ID NO: 3554863 - RNA, 15 nt, Pseudomonas putida KT2440
gauugcccuguggcu

SEQ ID NO: 3554864 - RNA, 17 nt, Pseudomonas putida KT2440
gauugcccuguggcugu

SEQ ID NO: 3554865 - RNA, 22 nt, Pseudomonas putida KT2440
gauugccugaucaaagucgccu

SEQ ID NO: 3554866 - RNA, 17 nt, Pseudomonas putida KT2440
gauugccuggcuuucca

SEQ ID NO: 3554867 - RNA, 15 nt, Pseudomonas putida KT2440
gauugcgauccgccc

SEQ ID NO: 3554868 - RNA, 16 nt, Pseudomonas putida KT2440
gauugcgggcuuucug

SEQ ID NO: 3554869 - RNA, 15 nt, Pseudomonas putida KT2440
gauugcugccgaccu

SEQ ID NO: 3554870 - RNA, 15 nt, Pseudomonas putida KT2440
gauuggaaaauguua

SEQ ID NO: 3554871 - RNA, 13 nt, Pseudomonas putida KT2440
gauuggccagcag

SEQ ID NO: 3554872 - RNA, 17 nt, Pseudomonas putida KT2440
gauuggccagcaggccc

SEQ ID NO: 3554873 - RNA, 14 nt, Pseudomonas putida KT2440
gauugggaaaacac

SEQ ID NO: 3554874 - RNA, 20 nt, Pseudomonas putida KT2440
gauugggaaaacacaggcac

SEQ ID NO: 3554875 - RNA, 14 nt, Pseudomonas putida KT2440
gauugggccgcaca

SEQ ID NO: 3554876 - RNA, 17 nt, Pseudomonas putida KT2440
gauugggcggcaguuca

SEQ ID NO: 3554877 - RNA, 16 nt, Pseudomonas putida KT2440
gauugggcuuggcagc

SEQ ID NO: 3554878 - RNA, 12 nt, Pseudomonas putida KT2440
gauuggucggca

SEQ ID NO: 3554879 - RNA, 15 nt, Pseudomonas putida KT2440
gauuguggagcugaa

SEQ ID NO: 3554880 - RNA, 23 nt, Pseudomonas putida KT2440
gauuucgaagggauguuggaaua

SEQ ID NO: 3554881 - RNA, 20 nt, Pseudomonas putida KT2440
gauuucgugcacuuucgcgg

SEQ ID NO: 3554882 - RNA, 13 nt, Pseudomonas putida KT2440
gauuugauggggc

SEQ ID NO: 3554883 - RNA, 20 nt, Pseudomonas putida KT2440
gauuuggcccgcugcgccga

SEQ ID NO: 3554884 - RNA, 12 nt, Pseudomonas putida KT2440
gauuuucacgcc

SEQ ID NO: 3554885 - RNA, 16 nt, Pseudomonas putida KT2440
gauuuuugaaaaauga

SEQ ID NO: 3554886 - RNA, 19 nt, Pseudomonas putida KT2440
gcaaaaaacccggcgcaag

SEQ ID NO: 3554887 - RNA, 15 nt, Pseudomonas putida KT2440
gcaaaaaacuucaaa

SEQ ID NO: 3554888 - RNA, 20 nt, Pseudomonas putida KT2440
gcaaaacaaaaagcgcagcg

SEQ ID NO: 3554889 - RNA, 12 nt, Pseudomonas putida KT2440
gcaaaaccacca

SEQ ID NO: 3554890 - RNA, 15 nt, Pseudomonas putida KT2440
gcaaaaccaccagcc

SEQ ID NO: 3554891 - RNA, 19 nt, Pseudomonas putida KT2440
gcaaaaccaccagccgugg

SEQ ID NO: 3554892 - RNA, 17 nt, Pseudomonas putida KT2440
gcaaaaccugccggugc

SEQ ID NO: 3554893 - RNA, 15 nt, Pseudomonas putida KT2440
gcaaaagaaaaaggg

SEQ ID NO: 3554894 - RNA, 15 nt, Pseudomonas putida KT2440
gcaaaaucgaccagg

SEQ ID NO: 3554895 - RNA, 16 nt, Pseudomonas putida KT2440
gcaaaaucgaccaggg

SEQ ID NO: 3554896 - RNA, 22 nt, Pseudomonas putida KT2440
gcaaaaucgaccagggccuugg

SEQ ID NO: 3554897 - RNA, 16 nt, Pseudomonas putida KT2440
gcaaacaaaaagcacc

SEQ ID NO: 3554898 - RNA, 12 nt, Pseudomonas putida KT2440
gcaaacacccag

SEQ ID NO: 3554899 - RNA, 17 nt, Pseudomonas putida KT2440
gcaaacaccuugccccg

SEQ ID NO: 3554900 - RNA, 21 nt, Pseudomonas putida KT2440
gcaaacagccuaagguugcuc

SEQ ID NO: 3554901 - RNA, 20 nt, Pseudomonas putida KT2440
gcaaacccgacaacagcugc

SEQ ID NO: 3554902 - RNA, 21 nt, Pseudomonas putida KT2440
gcaaacccgacaacagcugca

SEQ ID NO: 3554903 - RNA, 16 nt, Pseudomonas putida KT2440
gcaaacccggccagca

SEQ ID NO: 3554904 - RNA, 21 nt, Pseudomonas putida KT2440
gcaaacccggccagcagguca

SEQ ID NO: 3554905 - RNA, 18 nt, Pseudomonas putida KT2440
gcaaaccgaccaggcagu

SEQ ID NO: 3554906 - RNA, 24 nt, Pseudomonas putida KT2440
gcaaacgcaggugcgcacgcugcc

SEQ ID NO: 3554907 - RNA, 17 nt, Pseudomonas putida KT2440
gcaaacgccuguuucuc

SEQ ID NO: 3554908 - RNA, 22 nt, Pseudomonas putida KT2440
gcaaacuccacugugcccgcca

SEQ ID NO: 3554909 - RNA, 18 nt, Pseudomonas putida KT2440
gcaaacuggcgcccggca

SEQ ID NO: 3554910 - RNA, 21 nt, Pseudomonas putida KT2440
gcaaacuggcgcccggcaucg

SEQ ID NO: 3554911 - RNA, 23 nt, Pseudomonas putida KT2440
gcaaacuggcgcccggcaucgcu

SEQ ID NO: 3554912 - RNA, 23 nt, Pseudomonas putida KT2440
gcaaacuucucgccucagcgcca

SEQ ID NO: 3554913 - RNA, 18 nt, Pseudomonas putida KT2440
gcaaagaacagcgugcca

SEQ ID NO: 3554914 - RNA, 15 nt, Pseudomonas putida KT2440
gcaaagaacaucacg

SEQ ID NO: 3554915 - RNA, 23 nt, Pseudomonas putida KT2440
gcaaagaaugccgcccaucaccg

SEQ ID NO: 3554916 - RNA, 15 nt, Pseudomonas putida KT2440
gcaaagagugcccca

SEQ ID NO: 3554917 - RNA, 17 nt, Pseudomonas putida KT2440
gcaaagaucgcccagcu

SEQ ID NO: 3554918 - RNA, 14 nt, Pseudomonas putida KT2440
gcaaagcagcccca

SEQ ID NO: 3554919 - RNA, 16 nt, Pseudomonas putida KT2440
gcaaagcagcccccaa

SEQ ID NO: 3554920 - RNA, 14 nt, Pseudomonas putida KT2440
gcaaagcagccccg

SEQ ID NO: 3554921 - RNA, 23 nt, Pseudomonas putida KT2440
gcaaagcccaguucuuggcggcu

SEQ ID NO: 3554922 - RNA, 17 nt, Pseudomonas putida KT2440
gcaaagcccgccccaau

SEQ ID NO: 3554923 - RNA, 13 nt, Pseudomonas putida KT2440
gcaaagcccugcc

SEQ ID NO: 3554924 - RNA, 16 nt, Pseudomonas putida KT2440
gcaaagcccugccuca

SEQ ID NO: 3554925 - RNA, 13 nt, Pseudomonas putida KT2440
gcaaagcgcaccg

SEQ ID NO: 3554926 - RNA, 16 nt, Pseudomonas putida KT2440
gcaaagcggccccagg

SEQ ID NO: 3554927 - RNA, 16 nt, Pseudomonas putida KT2440
gcaaagcggcccccag

SEQ ID NO: 3554928 - RNA, 18 nt, Pseudomonas putida KT2440
gcaaagcggcccccagca

SEQ ID NO: 3554929 - RNA, 14 nt, Pseudomonas putida KT2440
gcaaagcgggucgc

SEQ ID NO: 3554930 - RNA, 23 nt, Pseudomonas putida KT2440
gcaaagcguucgguguccuugca

SEQ ID NO: 3554931 - RNA, 16 nt, Pseudomonas putida KT2440
gcaaagcugaucgaua

SEQ ID NO: 3554932 - RNA, 23 nt, Pseudomonas putida KT2440
gcaaaggcuagcagcaucaccgc

SEQ ID NO: 3554933 - RNA, 22 nt, Pseudomonas putida KT2440
gcaaaggcuugucaugccuugg

SEQ ID NO: 3554934 - RNA, 23 nt, Pseudomonas putida KT2440
gcaaaggcuugucaugccuuggc

SEQ ID NO: 3554935 - RNA, 19 nt, Pseudomonas putida KT2440
gcaaaguuauaagccccau

SEQ ID NO: 3554936 - RNA, 23 nt, Pseudomonas putida KT2440
gcaaauaaucagaauuugccccu

SEQ ID NO: 3554937 - RNA, 14 nt, Pseudomonas putida KT2440
gcaaauaccccagg

SEQ ID NO: 3554938 - RNA, 14 nt, Pseudomonas putida KT2440
gcaaauaguuuuau

SEQ ID NO: 3554939 - RNA, 13 nt, Pseudomonas putida KT2440
gcaaaucacugac

SEQ ID NO: 3554940 - RNA, 12 nt, Pseudomonas putida KT2440
gcaagccugcuu

SEQ ID NO: 3554941 - RNA, 20 nt, Pseudomonas putida KT2440
gcaagccuucgucgcuggcc

SEQ ID NO: 3554942 - RNA, 21 nt, Pseudomonas putida KT2440
gcaagccuucgucgcuggcca

SEQ ID NO: 3554943 - RNA, 15 nt, Pseudomonas putida KT2440
gcaagccuuugcgcc

SEQ ID NO: 3554944 - RNA, 20 nt, Pseudomonas putida KT2440
gcaagcgaugcacgccagca

SEQ ID NO: 3554945 - RNA, 15 nt, Pseudomonas putida KT2440
gcaagcgcaccugca

SEQ ID NO: 3554946 - RNA, 20 nt, Pseudomonas putida KT2440
gcaagcgcauaggcaaugau

SEQ ID NO: 3554947 - RNA, 14 nt, Pseudomonas putida KT2440
gcaagcgcgcgccc

SEQ ID NO: 3554948 - RNA, 18 nt, Pseudomonas putida KT2440
gcaagcgggcagugcaau

SEQ ID NO: 3554949 - RNA, 19 nt, Pseudomonas putida KT2440
gcaagcgguugcccgcugc

SEQ ID NO: 3554950 - RNA, 17 nt, Pseudomonas putida KT2440
gcaagcucgcuccugca

SEQ ID NO: 3554951 - RNA, 15 nt, Pseudomonas putida KT2440
gcaagcugagaaugc

SEQ ID NO: 3554952 - RNA, 20 nt, Pseudomonas putida KT2440
gcaagcugagaaugcccucc

SEQ ID NO: 3554953 - RNA, 13 nt, Pseudomonas putida KT2440
gcaagcugcaccg

SEQ ID NO: 3554954 - RNA, 23 nt, Pseudomonas putida KT2440
gcaagcuggcgcaagccgugccu

SEQ ID NO: 3554955 - RNA, 19 nt, Pseudomonas putida KT2440
gcaagcuggucaggugcau

SEQ ID NO: 3554956 - RNA, 15 nt, Pseudomonas putida KT2440
gcaagcuugccagcg

SEQ ID NO: 3554957 - RNA, 18 nt, Pseudomonas putida KT2440
gcaagcuugccagcgucu

SEQ ID NO: 3554958 - RNA, 15 nt, Pseudomonas putida KT2440
gcaaggaucaccaag

SEQ ID NO: 3554959 - RNA, 22 nt, Pseudomonas putida KT2440
gcaaggcaaugcccauggccag

SEQ ID NO: 3554960 - RNA, 17 nt, Pseudomonas putida KT2440
gcaaggcaucggcgccu

SEQ ID NO: 3554961 - RNA, 21 nt, Pseudomonas putida KT2440
gcaaggcauucagcucggcca

SEQ ID NO: 3554962 - RNA, 15 nt, Pseudomonas putida KT2440
gcaaggccagugccg

SEQ ID NO: 3554963 - RNA, 14 nt, Pseudomonas putida KT2440
gcaaggccgcggcu

SEQ ID NO: 3554964 - RNA, 15 nt, Pseudomonas putida KT2440
gcaaggccgcuccca

SEQ ID NO: 3554965 - RNA, 16 nt, Pseudomonas putida KT2440
gcaaggccuccaggua

SEQ ID NO: 3554966 - RNA, 15 nt, Pseudomonas putida KT2440
gcaaggcgaccugcc

SEQ ID NO: 3554967 - RNA, 17 nt, Pseudomonas putida KT2440
gcaaggcgaccugccag

SEQ ID NO: 3554968 - RNA, 19 nt, Pseudomonas putida KT2440
gcaaggcgaccugccagcc

SEQ ID NO: 3554969 - RNA, 13 nt, Pseudomonas putida KT2440
gcaaggcgagguu

SEQ ID NO: 3554970 - RNA, 18 nt, Pseudomonas putida KT2440
gcaaggcgaucuggcgga

SEQ ID NO: 3554971 - RNA, 13 nt, Pseudomonas putida KT2440
gcaaggcgcagcc

SEQ ID NO: 3554972 - RNA, 17 nt, Pseudomonas putida KT2440
gcaaggcguaccggcaa

SEQ ID NO: 3554973 - RNA, 14 nt, Pseudomonas putida KT2440
gcaaggcugcuuca

SEQ ID NO: 3554974 - RNA, 15 nt, Pseudomonas putida KT2440
gcaaggcuggcaacc

SEQ ID NO: 3554975 - RNA, 21 nt, Pseudomonas putida KT2440
gcaagggccguuacucccaca

SEQ ID NO: 3554976 - RNA, 15 nt, Pseudomonas putida KT2440
gcaagggccugcagg

SEQ ID NO: 3554977 - RNA, 18 nt, Pseudomonas putida KT2440
gcaagggccugcaggcag

SEQ ID NO: 3554978 - RNA, 20 nt, Pseudomonas putida KT2440
gcaagggccugcaggcagca

SEQ ID NO: 3554979 - RNA, 19 nt, Pseudomonas putida KT2440
gcaagggcgaaccaggugc

SEQ ID NO: 3554980 - RNA, 21 nt, Pseudomonas putida KT2440
gcaagguagccugcugacgca

SEQ ID NO: 3554981 - RNA, 18 nt, Pseudomonas putida KT2440
gcaagguagcggcggcaa

SEQ ID NO: 3554982 - RNA, 14 nt, Pseudomonas putida KT2440
gcaaggucgccgcc

SEQ ID NO: 3554983 - RNA, 22 nt, Pseudomonas putida KT2440
gcaaggucucuuccugcaccug

SEQ ID NO: 3554984 - RNA, 16 nt, Pseudomonas putida KT2440
gcaaggugccaacagg

SEQ ID NO: 3554985 - RNA, 17 nt, Pseudomonas putida KT2440
gcaaggugccaacaggc

SEQ ID NO: 3554986 - RNA, 19 nt, Pseudomonas putida KT2440
gcaaggugccaacaggcag

SEQ ID NO: 3554987 - RNA, 20 nt, Pseudomonas putida KT2440
gcaaggugccaacaggcagc

SEQ ID NO: 3554988 - RNA, 21 nt, Pseudomonas putida KT2440
gcaaggugccaacaggcagca

SEQ ID NO: 3554989 - RNA, 21 nt, Pseudomonas putida KT2440
gcaagguguuggucagggcac

SEQ ID NO: 3554990 - RNA, 19 nt, Pseudomonas putida KT2440
gcaaguagaaccacacaga

SEQ ID NO: 3554991 - RNA, 17 nt, Pseudomonas putida KT2440
gcaagucaugcucgccg

SEQ ID NO: 3554992 - RNA, 14 nt, Pseudomonas putida KT2440
gcaagucccccauc

SEQ ID NO: 3554993 - RNA, 20 nt, Pseudomonas putida KT2440
gcaaguucccgugcgccuau

SEQ ID NO: 3554994 - RNA, 16 nt, Pseudomonas putida KT2440
gcaauacaacgaucag

SEQ ID NO: 3554995 - RNA, 21 nt, Pseudomonas putida KT2440
gcaauacaacgaucagcgccg

SEQ ID NO: 3554996 - RNA, 16 nt, Pseudomonas putida KT2440
gcaauaccgugcuugc

SEQ ID NO: 3554997 - RNA, 20 nt, Pseudomonas putida KT2440
gcaauaccgugcuugcgggc

SEQ ID NO: 3554998 - RNA, 20 nt, Pseudomonas putida KT2440
gcaaucaagguuucacgccg

SEQ ID NO: 3554999 - RNA, 16 nt, Pseudomonas putida KT2440
gcaaucagcaggucgg

SEQ ID NO: 3555000 - RNA, 18 nt, Pseudomonas putida KT2440
gcaaucagcgacaacggc

SEQ ID NO: 3555001 - RNA, 18 nt, Pseudomonas putida KT2440
gcaauccgugagccagga

SEQ ID NO: 3555002 - RNA, 19 nt, Pseudomonas putida KT2440
gcaaucgacucaaggaugu

SEQ ID NO: 3555003 - RNA, 14 nt, Pseudomonas putida KT2440
gcaaucgccaggcg

SEQ ID NO: 3555004 - RNA, 15 nt, Pseudomonas putida KT2440
gcaaucgccaggcgc

SEQ ID NO: 3555005 - RNA, 21 nt, Pseudomonas putida KT2440
gcaaucgccaggcgcaccgcc

SEQ ID NO: 3555006 - RNA, 19 nt, Pseudomonas putida KT2440
gcaaucgccgggcgcacca

SEQ ID NO: 3555007 - RNA, 21 nt, Pseudomonas putida KT2440
gcaaucgccgggcgcaccaca

SEQ ID NO: 3555008 - RNA, 15 nt, Pseudomonas putida KT2440
gcaaucgcgcccggu

SEQ ID NO: 3555009 - RNA, 16 nt, Pseudomonas putida KT2440
gcaaucgcugugcgug

SEQ ID NO: 3555010 - RNA, 18 nt, Pseudomonas putida KT2440
gcaaucgcugugcgugau

SEQ ID NO: 3555011 - RNA, 13 nt, Pseudomonas putida KT2440
gcaaucgggaugg

SEQ ID NO: 3555012 - RNA, 15 nt, Pseudomonas putida KT2440
gcaaucgggauggca

SEQ ID NO: 3555013 - RNA, 15 nt, Pseudomonas putida KT2440
gcaaucgggccggcg

SEQ ID NO: 3555014 - RNA, 22 nt, Pseudomonas putida KT2440
gcaaucggguacacgccacgga

SEQ ID NO: 3555015 - RNA, 21 nt, Pseudomonas putida KT2440
gcaaucgugaucauccccagc

SEQ ID NO: 3555016 - RNA, 22 nt, Pseudomonas putida KT2440
gcaaucgugaucauccccagca

SEQ ID NO: 3555017 - RNA, 24 nt, Pseudomonas putida KT2440
gcaaucgugaucauccccagcaug

SEQ ID NO: 3555018 - RNA, 13 nt, Pseudomonas putida KT2440
gcaaucugcagca

SEQ ID NO: 3555019 - RNA, 16 nt, Pseudomonas putida KT2440
gcaaucugcagcagca

SEQ ID NO: 3555020 - RNA, 18 nt, Pseudomonas putida KT2440
gcaaucugcagcagcauu

SEQ ID NO: 3555021 - RNA, 23 nt, Pseudomonas putida KT2440
gcaaucuucuugccgguaccgcc

SEQ ID NO: 3555022 - RNA, 14 nt, Pseudomonas putida KT2440
gcaaugaucagccc

SEQ ID NO: 3555023 - RNA, 14 nt, Pseudomonas putida KT2440
gcaaugaucgggca

SEQ ID NO: 3555024 - RNA, 20 nt, Pseudomonas putida KT2440
gcaaugaugauguugccgau

SEQ ID NO: 3555025 - RNA, 18 nt, Pseudomonas putida KT2440
gcaaugauggcaaucacg

SEQ ID NO: 3555026 - RNA, 23 nt, Pseudomonas putida KT2440
gcaaugauugcugccggaccugc

SEQ ID NO: 3555027 - RNA, 13 nt, Pseudomonas putida KT2440
gcaaugcaacucg

SEQ ID NO: 3555028 - RNA, 20 nt, Pseudomonas putida KT2440
gcaaugcccauggccaggcu

SEQ ID NO: 3555029 - RNA, 15 nt, Pseudomonas putida KT2440
gcaaugccgaacagu

SEQ ID NO: 3555030 - RNA, 22 nt, Pseudomonas putida KT2440
gcaaugccgaacagucauccag

SEQ ID NO: 3555031 - RNA, 19 nt, Pseudomonas putida KT2440
gcaauggccacacgcugcu

SEQ ID NO: 3555032 - RNA, 16 nt, Pseudomonas putida KT2440
gcaauggcccuggaca

SEQ ID NO: 3555033 - RNA, 21 nt, Pseudomonas putida KT2440
gcaaugucguauugagcgacg

SEQ ID NO: 3555034 - RNA, 13 nt, Pseudomonas putida KT2440
gcaauugccaccg

SEQ ID NO: 3555035 - RNA, 15 nt, Pseudomonas putida KT2440
gcaauugccaccggc

SEQ ID NO: 3555036 - RNA, 14 nt, Pseudomonas putida KT2440
gcaauuggcuucca

SEQ ID NO: 3555037 - RNA, 11 nt, Pseudomonas putida KT2440
gcacaaagccc

SEQ ID NO: 3555038 - RNA, 23 nt, Pseudomonas putida KT2440
gcacaacccgauuccuugcagcg

SEQ ID NO: 3555039 - RNA, 16 nt, Pseudomonas putida KT2440
gcacaacgcgcgggca

SEQ ID NO: 3555040 - RNA, 23 nt, Pseudomonas putida KT2440
gcacaacgcgcgggcaauggcca

SEQ ID NO: 3555041 - RNA, 19 nt, Pseudomonas putida KT2440
gcacaagaccguuccgcaa

SEQ ID NO: 3555042 - RNA, 21 nt, Pseudomonas putida KT2440
gcacaagcgucccugcccgau

SEQ ID NO: 3555043 - RNA, 15 nt, Pseudomonas putida KT2440
gcacaaggccacugg

SEQ ID NO: 3555044 - RNA, 21 nt, Pseudomonas putida KT2440
gcacaaggccgcucccacagg

SEQ ID NO: 3555045 - RNA, 17 nt, Pseudomonas putida KT2440
gcaccagcgcgaucacc

SEQ ID NO: 3555046 - RNA, 19 nt, Pseudomonas putida KT2440
gcaccagcgcgaucaccag

SEQ ID NO: 3555047 - RNA, 18 nt, Pseudomonas putida KT2440
gcaccagcggcuuggcac

SEQ ID NO: 3555048 - RNA, 20 nt, Pseudomonas putida KT2440
gcaccagcgggcccagcagg

SEQ ID NO: 3555049 - RNA, 17 nt, Pseudomonas putida KT2440
gcaccagcuccuggccg

SEQ ID NO: 3555050 - RNA, 19 nt, Pseudomonas putida KT2440
gcaccagcuccuggccgcc

SEQ ID NO: 3555051 - RNA, 19 nt, Pseudomonas putida KT2440
gcaccagcuugugccgcug

SEQ ID NO: 3555052 - RNA, 18 nt, Pseudomonas putida KT2440
gcaccagcuuguugccgg

SEQ ID NO: 3555053 - RNA, 21 nt, Pseudomonas putida KT2440
gcaccagggcuggcagcgggu

SEQ ID NO: 3555054 - RNA, 23 nt, Pseudomonas putida KT2440
gcaccagggcuggcagcggguag

SEQ ID NO: 3555055 - RNA, 17 nt, Pseudomonas putida KT2440
gcaccaggucaggacau

SEQ ID NO: 3555056 - RNA, 22 nt, Pseudomonas putida KT2440
gcaccagguccaccagcaggcu

SEQ ID NO: 3555057 - RNA, 18 nt, Pseudomonas putida KT2440
gcaccaggucgcggugca

SEQ ID NO: 3555058 - RNA, 16 nt, Pseudomonas putida KT2440
gcaccaguuccagggc

SEQ ID NO: 3555059 - RNA, 17 nt, Pseudomonas putida KT2440
gcaccaucagagcgcca

SEQ ID NO: 3555060 - RNA, 18 nt, Pseudomonas putida KT2440
gcaccaucagagcgccag

SEQ ID NO: 3555061 - RNA, 23 nt, Pseudomonas putida KT2440
gcaccaucagagcgccagcaagc

SEQ ID NO: 3555062 - RNA, 16 nt, Pseudomonas putida KT2440
gcaccaucaggcacag

SEQ ID NO: 3555063 - RNA, 20 nt, Pseudomonas putida KT2440
gcaccaucaggcacaggcca

SEQ ID NO: 3555064 - RNA, 18 nt, Pseudomonas putida KT2440
gcaccaucggcuccagcg

SEQ ID NO: 3555065 - RNA, 16 nt, Pseudomonas putida KT2440
gcaccaugaacucuuc

SEQ ID NO: 3555066 - RNA, 18 nt, Pseudomonas putida KT2440
gcaccaugaacucuuccc

SEQ ID NO: 3555067 - RNA, 15 nt, Pseudomonas putida KT2440
gcaccaugcgcgggu

SEQ ID NO: 3555068 - RNA, 16 nt, Pseudomonas putida KT2440
gcacccaauagcccac

SEQ ID NO: 3555069 - RNA, 17 nt, Pseudomonas putida KT2440
gcacccaauagcccacc

SEQ ID NO: 3555070 - RNA, 21 nt, Pseudomonas putida KT2440
gcacccacagagacaccgcag

SEQ ID NO: 3555071 - RNA, 20 nt, Pseudomonas putida KT2440
gcacccacagcgccugcugc

SEQ ID NO: 3555072 - RNA, 12 nt, Pseudomonas putida KT2440
gcacccagcagg

SEQ ID NO: 3555073 - RNA, 14 nt, Pseudomonas putida KT2440
gcacccagcaggcc

SEQ ID NO: 3555074 - RNA, 15 nt, Pseudomonas putida KT2440
gcacccagccagcga

SEQ ID NO: 3555075 - RNA, 21 nt, Pseudomonas putida KT2440
gcacccagcguauagccaccg

SEQ ID NO: 3555076 - RNA, 13 nt, Pseudomonas putida KT2440
gcacccaggccac

SEQ ID NO: 3555077 - RNA, 11 nt, Pseudomonas putida KT2440
gcacccaggug

SEQ ID NO: 3555078 - RNA, 16 nt, Pseudomonas putida KT2440
gcaccccaaggcugcc

SEQ ID NO: 3555079 - RNA, 13 nt, Pseudomonas putida KT2440
gcaccccagcacc

SEQ ID NO: 3555080 - RNA, 18 nt, Pseudomonas putida KT2440
gcaccccauaacgcccac

SEQ ID NO: 3555081 - RNA, 19 nt, Pseudomonas putida KT2440
gcaccccggccgcuugcaa

SEQ ID NO: 3555082 - RNA, 18 nt, Pseudomonas putida KT2440
gcaccccuuucuccagca

SEQ ID NO: 3555083 - RNA, 16 nt, Pseudomonas putida KT2440
gcacccgaccacccuc

SEQ ID NO: 3555084 - RNA, 17 nt, Pseudomonas putida KT2440
gcacccgaccacccucg

SEQ ID NO: 3555085 - RNA, 14 nt, Pseudomonas putida KT2440
gcacccgccagccg

SEQ ID NO: 3555086 - RNA, 14 nt, Pseudomonas putida KT2440
gcacccgcccaucg

SEQ ID NO: 3555087 - RNA, 19 nt, Pseudomonas putida KT2440
gcacccgcccaucgcacac

SEQ ID NO: 3555088 - RNA, 23 nt, Pseudomonas putida KT2440
gcacccgcccaucgcacacccug

SEQ ID NO: 3555089 - RNA, 15 nt, Pseudomonas putida KT2440
gcacccgccuccggc

SEQ ID NO: 3555090 - RNA, 14 nt, Pseudomonas putida KT2440
gcacccgcuuggcc

SEQ ID NO: 3555091 - RNA, 23 nt, Pseudomonas putida KT2440
gcacccggcuaccaaucuguacc

SEQ ID NO: 3555092 - RNA, 14 nt, Pseudomonas putida KT2440
gcacccggucgccg

SEQ ID NO: 3555093 - RNA, 19 nt, Pseudomonas putida KT2440
gcacccggucgccgacggc

SEQ ID NO: 3555094 - RNA, 15 nt, Pseudomonas putida KT2440
gcacccgugcagggc

SEQ ID NO: 3555095 - RNA, 12 nt, Pseudomonas putida KT2440
gcacccucacca

SEQ ID NO: 3555096 - RNA, 20 nt, Pseudomonas putida KT2440
gcacccugagggagcgggcu

SEQ ID NO: 3555097 - RNA, 21 nt, Pseudomonas putida KT2440
gcacccugaucgaugagcgag

SEQ ID NO: 3555098 - RNA, 24 nt, Pseudomonas putida KT2440
gcacccugaucgaugagcgagccc

SEQ ID NO: 3555099 - RNA, 20 nt, Pseudomonas putida KT2440
gcacccugcuauaucucugg

SEQ ID NO: 3555100 - RNA, 19 nt, Pseudomonas putida KT2440
gcacccuggcgguugacca

SEQ ID NO: 3555101 - RNA, 22 nt, Pseudomonas putida KT2440
gcacccuuccccccuggccugg

SEQ ID NO: 3555102 - RNA, 21 nt, Pseudomonas putida KT2440
gcaccgaccacgguaccggca

SEQ ID NO: 3555103 - RNA, 20 nt, Pseudomonas putida KT2440
gcaccgaccgugcauacacc

SEQ ID NO: 3555104 - RNA, 22 nt, Pseudomonas putida KT2440
gcaccgaccgugcauacacccg

SEQ ID NO: 3555105 - RNA, 15 nt, Pseudomonas putida KT2440
gcaccgacuggcgua

SEQ ID NO: 3555106 - RNA, 17 nt, Pseudomonas putida KT2440
gcaccgacuuccccggc

SEQ ID NO: 3555107 - RNA, 21 nt, Pseudomonas putida KT2440
gcaccgacuuccccggcgccg

SEQ ID NO: 3555108 - RNA, 22 nt, Pseudomonas putida KT2440
gcaccgacuuccccggcgccgc

SEQ ID NO: 3555109 - RNA, 21 nt, Pseudomonas putida KT2440
gcaccgagaugaucgcggcaa

SEQ ID NO: 3555110 - RNA, 16 nt, Pseudomonas putida KT2440
gcaccgccaccccggc

SEQ ID NO: 3555111 - RNA, 21 nt, Pseudomonas putida KT2440
gcaccgccaccccggcuugcu

SEQ ID NO: 3555112 - RNA, 14 nt, Pseudomonas putida KT2440
gcaccgccauggcc

SEQ ID NO: 3555113 - RNA, 13 nt, Pseudomonas putida KT2440
gcaccgccccggc

SEQ ID NO: 3555114 - RNA, 16 nt, Pseudomonas putida KT2440
gcaccgccccggccag

SEQ ID NO: 3555115 - RNA, 16 nt, Pseudomonas putida KT2440
gcaccgccgcccacgc

SEQ ID NO: 3555116 - RNA, 21 nt, Pseudomonas putida KT2440
gcaccgccgcccacgccggca

SEQ ID NO: 3555117 - RNA, 23 nt, Pseudomonas putida KT2440
gcaccgccgcccacgccggcaac

SEQ ID NO: 3555118 - RNA, 18 nt, Pseudomonas putida KT2440
gcaccgcggaugcgccug

SEQ ID NO: 3555119 - RNA, 18 nt, Pseudomonas putida KT2440
gcaccgcguaucaggcau

SEQ ID NO: 3555120 - RNA, 16 nt, Pseudomonas putida KT2440
gcaccgcuccgacaaa

SEQ ID NO: 3555121 - RNA, 15 nt, Pseudomonas putida KT2440
gcaccgcugaccaca

SEQ ID NO: 3555122 - RNA, 18 nt, Pseudomonas putida KT2440
gcaccgcugccagcugcg

SEQ ID NO: 3555123 - RNA, 12 nt, Pseudomonas putida KT2440
gcaccggcaacc

SEQ ID NO: 3555124 - RNA, 16 nt, Pseudomonas putida KT2440
gcaccggcaccgggcg

SEQ ID NO: 3555125 - RNA, 15 nt, Pseudomonas putida KT2440
gcaccggcagcagca

SEQ ID NO: 3555126 - RNA, 22 nt, Pseudomonas putida KT2440
gcaccggcaguagaaaguccau

SEQ ID NO: 3555127 - RNA, 18 nt, Pseudomonas putida KT2440
gcaccggccaccaggcgc

SEQ ID NO: 3555128 - RNA, 14 nt, Pseudomonas putida KT2440
gcaccggccgaagu

SEQ ID NO: 3555129 - RNA, 22 nt, Pseudomonas putida KT2440
gcaccggccucuucgcgggcaa

SEQ ID NO: 3555130 - RNA, 18 nt, Pseudomonas putida KT2440
gcaccggcgugccgucga

SEQ ID NO: 3555131 - RNA, 14 nt, Pseudomonas putida KT2440
gcaccggcucugcc

SEQ ID NO: 3555132 - RNA, 18 nt, Pseudomonas putida KT2440
gcaccgggaugcucugca

SEQ ID NO: 3555133 - RNA, 21 nt, Pseudomonas putida KT2440
gcaccgggaugcucugcagca

SEQ ID NO: 3555134 - RNA, 17 nt, Pseudomonas putida KT2440
gcaccgggcacuuggca

SEQ ID NO: 3555135 - RNA, 15 nt, Pseudomonas putida KT2440
gcaccgggcggcggu

SEQ ID NO: 3555136 - RNA, 15 nt, Pseudomonas putida KT2440
gcaccgggcgggugc

SEQ ID NO: 3555137 - RNA, 16 nt, Pseudomonas putida KT2440
gcaccgggcgggugca

SEQ ID NO: 3555138 - RNA, 17 nt, Pseudomonas putida KT2440
gcaccgguucgccccca

SEQ ID NO: 3555139 - RNA, 18 nt, Pseudomonas putida KT2440
gcaccgguucgcccccac

SEQ ID NO: 3555140 - RNA, 17 nt, Pseudomonas putida KT2440
gcaccgguucgccgccg

SEQ ID NO: 3555141 - RNA, 22 nt, Pseudomonas putida KT2440
gcaccgucgaggaaaagcagcu

SEQ ID NO: 3555142 - RNA, 15 nt, Pseudomonas putida KT2440
gcaccgucgccugca

SEQ ID NO: 3555143 - RNA, 22 nt, Pseudomonas putida KT2440
gcaccgucuggaagucgcgagu

SEQ ID NO: 3555144 - RNA, 18 nt, Pseudomonas putida KT2440
gcaccgucuggacuggga

SEQ ID NO: 3555145 - RNA, 16 nt, Pseudomonas putida KT2440
gcaccgugcaccagca

SEQ ID NO: 3555146 - RNA, 18 nt, Pseudomonas putida KT2440
gcaccgugcaccagcacc

SEQ ID NO: 3555147 - RNA, 19 nt, Pseudomonas putida KT2440
gcaccgugcaccagcacca

SEQ ID NO: 3555148 - RNA, 20 nt, Pseudomonas putida KT2440
gcaccguggcguauugcugg

SEQ ID NO: 3555149 - RNA, 20 nt, Pseudomonas putida KT2440
gcaccuaaccagugggagcg

SEQ ID NO: 3555150 - RNA, 20 nt, Pseudomonas putida KT2440
gcacguccguuccugcaguu

SEQ ID NO: 3555151 - RNA, 17 nt, Pseudomonas putida KT2440
gcacgucgcgcagggcc

SEQ ID NO: 3555152 - RNA, 19 nt, Pseudomonas putida KT2440
gcacgucgcgcagggccuu

SEQ ID NO: 3555153 - RNA, 20 nt, Pseudomonas putida KT2440
gcacgugcccguagcggaua

SEQ ID NO: 3555154 - RNA, 18 nt, Pseudomonas putida KT2440
gcacgugggucgggaaca

SEQ ID NO: 3555155 - RNA, 23 nt, Pseudomonas putida KT2440
gcacgugggucgggaacagcucu

SEQ ID NO: 3555156 - RNA, 14 nt, Pseudomonas putida KT2440
gcacguugcugccu

SEQ ID NO: 3555157 - RNA, 22 nt, Pseudomonas putida KT2440
gcacguuggugccggucggcgu

SEQ ID NO: 3555158 - RNA, 14 nt, Pseudomonas putida KT2440
gcacguuuggagcg

SEQ ID NO: 3555159 - RNA, 12 nt, Pseudomonas putida KT2440
gcacuaagcgaa

SEQ ID NO: 3555160 - RNA, 13 nt, Pseudomonas putida KT2440
gcacuaagcgaaa

SEQ ID NO: 3555161 - RNA, 17 nt, Pseudomonas putida KT2440
gcacuaagggcaggccu

SEQ ID NO: 3555162 - RNA, 14 nt, Pseudomonas putida KT2440
gcacuacgccggcc

SEQ ID NO: 3555163 - RNA, 19 nt, Pseudomonas putida KT2440
gcacuacgccggccaaggu

SEQ ID NO: 3555164 - RNA, 23 nt, Pseudomonas putida KT2440
gcacucaguuaaucagcaacgcc

SEQ ID NO: 3555165 - RNA, 18 nt, Pseudomonas putida KT2440
gcacuccccaucagcagc

SEQ ID NO: 3555166 - RNA, 13 nt, Pseudomonas putida KT2440
gcacucccccuug

SEQ ID NO: 3555167 - RNA, 17 nt, Pseudomonas putida KT2440
gcacucgccgauaaagc

SEQ ID NO: 3555168 - RNA, 21 nt, Pseudomonas putida KT2440
gcacucgccgauaaagcgucg

SEQ ID NO: 3555169 - RNA, 20 nt, Pseudomonas putida KT2440
gcacucggguucgcagacgu

SEQ ID NO: 3555170 - RNA, 17 nt, Pseudomonas putida KT2440
gcacucggucggcuggc

SEQ ID NO: 3555171 - RNA, 17 nt, Pseudomonas putida KT2440
gcacucucccgcagccg

SEQ ID NO: 3555172 - RNA, 17 nt, Pseudomonas putida KT2440
gcacucucgcggugccu

SEQ ID NO: 3555173 - RNA, 20 nt, Pseudomonas putida KT2440
gcacucugcugcucugccgc

SEQ ID NO: 3555174 - RNA, 17 nt, Pseudomonas putida KT2440
gcacugaacagcgccuu

SEQ ID NO: 3555175 - RNA, 14 nt, Pseudomonas putida KT2440
gcacugcaacaccg

SEQ ID NO: 3555176 - RNA, 13 nt, Pseudomonas putida KT2440
gcacugcacccuc

SEQ ID NO: 3555177 - RNA, 16 nt, Pseudomonas putida KT2440
gcacugcacgcuucga

SEQ ID NO: 3555178 - RNA, 22 nt, Pseudomonas putida KT2440
gcacugccagcccggcggccag

SEQ ID NO: 3555179 - RNA, 17 nt, Pseudomonas putida KT2440
gcacugccagcgccuca

SEQ ID NO: 3555180 - RNA, 18 nt, Pseudomonas putida KT2440
gcacugccagcgccucac

SEQ ID NO: 3555181 - RNA, 17 nt, Pseudomonas putida KT2440
gcacugcccaagccauc

SEQ ID NO: 3555182 - RNA, 20 nt, Pseudomonas putida KT2440
gcacugcccaagccauccac

SEQ ID NO: 3555183 - RNA, 19 nt, Pseudomonas putida KT2440
gcacugccugcacggcaaa

SEQ ID NO: 3555184 - RNA, 16 nt, Pseudomonas putida KT2440
gcacugccugcaugcg

SEQ ID NO: 3555185 - RNA, 13 nt, Pseudomonas putida KT2440
gcacugccuggcc

SEQ ID NO: 3555186 - RNA, 17 nt, Pseudomonas putida KT2440
gcacugccuggcucagg

SEQ ID NO: 3555187 - RNA, 13 nt, Pseudomonas putida KT2440
gcacugccuugcc

SEQ ID NO: 3555188 - RNA, 21 nt, Pseudomonas putida KT2440
gcacugccuugcccugcagcu

SEQ ID NO: 3555189 - RNA, 14 nt, Pseudomonas putida KT2440
gcacugcugccgcc

SEQ ID NO: 3555190 - RNA, 15 nt, Pseudomonas putida KT2440
gcacugcugccgccc

SEQ ID NO: 3555191 - RNA, 13 nt, Pseudomonas putida KT2440
gcacugcugcgca

SEQ ID NO: 3555192 - RNA, 16 nt, Pseudomonas putida KT2440
gcacuggcaggccuug

SEQ ID NO: 3555193 - RNA, 13 nt, Pseudomonas putida KT2440
gcacuggccagcg

SEQ ID NO: 3555194 - RNA, 20 nt, Pseudomonas putida KT2440
gcacuggcuacagaucagcc

SEQ ID NO: 3555195 - RNA, 14 nt, Pseudomonas putida KT2440
gcacugggcgaugg

SEQ ID NO: 3555196 - RNA, 15 nt, Pseudomonas putida KT2440
gcacugggugcacag

SEQ ID NO: 3555197 - RNA, 14 nt, Pseudomonas putida KT2440
gcacuguugcuggc

SEQ ID NO: 3555198 - RNA, 15 nt, Pseudomonas putida KT2440
gcacuguugcuggcg

SEQ ID NO: 3555199 - RNA, 16 nt, Pseudomonas putida KT2440
gcacuguugcuggcga

SEQ ID NO: 3555200 - RNA, 15 nt, Pseudomonas putida KT2440
gcacuguuguccaag

SEQ ID NO: 3555201 - RNA, 17 nt, Pseudomonas putida KT2440
gcacuguuguccaaggg

SEQ ID NO: 3555202 - RNA, 12 nt, Pseudomonas putida KT2440
gcacuuccacac

SEQ ID NO: 3555203 - RNA, 22 nt, Pseudomonas putida KT2440
gcacuuccacuccagccgucga

SEQ ID NO: 3555204 - RNA, 21 nt, Pseudomonas putida KT2440
gcacuuccaggaaggccucgc

SEQ ID NO: 3555205 - RNA, 15 nt, Pseudomonas putida KT2440
gcacuucgauaccca

SEQ ID NO: 3555206 - RNA, 22 nt, Pseudomonas putida KT2440
gcacuucgauacccagccagcc

SEQ ID NO: 3555207 - RNA, 13 nt, Pseudomonas putida KT2440
gcacuucguccag

SEQ ID NO: 3555208 - RNA, 15 nt, Pseudomonas putida KT2440
gcacuucuguggaaa

SEQ ID NO: 3555209 - RNA, 19 nt, Pseudomonas putida KT2440
gcacuugcgguguccauuc

SEQ ID NO: 3555210 - RNA, 16 nt, Pseudomonas putida KT2440
gcacuugcuugacagc

SEQ ID NO: 3555211 - RNA, 18 nt, Pseudomonas putida KT2440
gcacuuggccugcugauu

SEQ ID NO: 3555212 - RNA, 15 nt, Pseudomonas putida KT2440
gcacuuguggcgccu

SEQ ID NO: 3555213 - RNA, 16 nt, Pseudomonas putida KT2440
gcacuuguggcgccua

SEQ ID NO: 3555214 - RNA, 23 nt, Pseudomonas putida KT2440
gcacuuguuccagccgcgccacu

SEQ ID NO: 3555215 - RNA, 14 nt, Pseudomonas putida KT2440
gcacuuucuugacc

SEQ ID NO: 3555216 - RNA, 13 nt, Pseudomonas putida KT2440
gcacuuugccgcc

SEQ ID NO: 3555217 - RNA, 16 nt, Pseudomonas putida KT2440
gcacuuuugccaccac

SEQ ID NO: 3555218 - RNA, 11 nt, Pseudomonas putida KT2440
gcagaaacucg

SEQ ID NO: 3555219 - RNA, 21 nt, Pseudomonas putida KT2440
gcagaaagugcguuggcugcu

SEQ ID NO: 3555220 - RNA, 18 nt, Pseudomonas putida KT2440
gcagaacauggccgagcu

SEQ ID NO: 3555221 - RNA, 22 nt, Pseudomonas putida KT2440
gcagaaccgccagcaccaauga

SEQ ID NO: 3555222 - RNA, 21 nt, Pseudomonas putida KT2440
gcagaacggcuucgauguccu

SEQ ID NO: 3555223 - RNA, 21 nt, Pseudomonas putida KT2440
gcagaagccuucaucacgcac

SEQ ID NO: 3555224 - RNA, 19 nt, Pseudomonas putida KT2440
gcagaagcgugcgaaguug

SEQ ID NO: 3555225 - RNA, 21 nt, Pseudomonas putida KT2440
gcagaagguaggcaccccggc

SEQ ID NO: 3555226 - RNA, 13 nt, Pseudomonas putida KT2440
gcagaauuucagg

SEQ ID NO: 3555227 - RNA, 17 nt, Pseudomonas putida KT2440
gcagacaacgcggcgga

SEQ ID NO: 3555228 - RNA, 15 nt, Pseudomonas putida KT2440
gcagacacaggcgcu

SEQ ID NO: 3555229 - RNA, 22 nt, Pseudomonas putida KT2440
gcagacccagaaucccaaccuc

SEQ ID NO: 3555230 - RNA, 21 nt, Pseudomonas putida KT2440
gcagaccugugggagcgggca

SEQ ID NO: 3555231 - RNA, 22 nt, Pseudomonas putida KT2440
gcagaccugugggagcgggcau

SEQ ID NO: 3555232 - RNA, 12 nt, Pseudomonas putida KT2440
gcagacgaucag

SEQ ID NO: 3555233 - RNA, 13 nt, Pseudomonas putida KT2440
gcagacgaucagg

SEQ ID NO: 3555234 - RNA, 19 nt, Pseudomonas putida KT2440
gcagacgucuuccaugccu

SEQ ID NO: 3555235 - RNA, 15 nt, Pseudomonas putida KT2440
gcagagacaucucca

SEQ ID NO: 3555236 - RNA, 20 nt, Pseudomonas putida KT2440
gcagagacaucuccauaggu

SEQ ID NO: 3555237 - RNA, 15 nt, Pseudomonas putida KT2440
gcagagagauugaga

SEQ ID NO: 3555238 - RNA, 15 nt, Pseudomonas putida KT2440
gcagagcgccccggc

SEQ ID NO: 3555239 - RNA, 23 nt, Pseudomonas putida KT2440
gcagagcggccccaagcuucacc

SEQ ID NO: 3555240 - RNA, 21 nt, Pseudomonas putida KT2440
gcagagcggcccugagccuug

SEQ ID NO: 3555241 - RNA, 18 nt, Pseudomonas putida KT2440
gcagaggcguagcaagca

SEQ ID NO: 3555242 - RNA, 21 nt, Pseudomonas putida KT2440
gcagaggcuucuuugcaagcc

SEQ ID NO: 3555243 - RNA, 18 nt, Pseudomonas putida KT2440
gcagagggccgcgcaggc

SEQ ID NO: 3555244 - RNA, 19 nt, Pseudomonas putida KT2440
gcagagucguucugccggu

SEQ ID NO: 3555245 - RNA, 20 nt, Pseudomonas putida KT2440
gcagauaaccuggcucggcu

SEQ ID NO: 3555246 - RNA, 16 nt, Pseudomonas putida KT2440
gcagauacaaccccag

SEQ ID NO: 3555247 - RNA, 21 nt, Pseudomonas putida KT2440
gcagauaucuggaccccgccc

SEQ ID NO: 3555248 - RNA, 16 nt, Pseudomonas putida KT2440
gcagaucacgcaaccu

SEQ ID NO: 3555249 - RNA, 18 nt, Pseudomonas putida KT2440
gcagaucacgcaaccucg

SEQ ID NO: 3555250 - RNA, 16 nt, Pseudomonas putida KT2440
gcagaucaggcaauca

SEQ ID NO: 3555251 - RNA, 22 nt, Pseudomonas putida KT2440
gcagaucaucaugcccaaugcc

SEQ ID NO: 3555252 - RNA, 16 nt, Pseudomonas putida KT2440
gcagauggggcagacu

SEQ ID NO: 3555253 - RNA, 23 nt, Pseudomonas putida KT2440
gcagaugguggcauagcgcggcg

SEQ ID NO: 3555254 - RNA, 15 nt, Pseudomonas putida KT2440
gcagauugcaucacu

SEQ ID NO: 3555255 - RNA, 20 nt, Pseudomonas putida KT2440
gcagccguugcugggcugcg

SEQ ID NO: 3555256 - RNA, 21 nt, Pseudomonas putida KT2440
gcagccucguccaucuugcug

SEQ ID NO: 3555257 - RNA, 18 nt, Pseudomonas putida KT2440
gcagccucuucggccagc

SEQ ID NO: 3555258 - RNA, 21 nt, Pseudomonas putida KT2440
gcagccucuucggccagcaac

SEQ ID NO: 3555259 - RNA, 12 nt, Pseudomonas putida KT2440
gcagccugacgc

SEQ ID NO: 3555260 - RNA, 16 nt, Pseudomonas putida KT2440
gcagccugacgcgccg

SEQ ID NO: 3555261 - RNA, 21 nt, Pseudomonas putida KT2440
gcagccugccaggucaccgcc

SEQ ID NO: 3555262 - RNA, 17 nt, Pseudomonas putida KT2440
gcagccugcuccucacu

SEQ ID NO: 3555263 - RNA, 22 nt, Pseudomonas putida KT2440
gcagccuuuuuuuauuuuucug

SEQ ID NO: 3555264 - RNA, 16 nt, Pseudomonas putida KT2440
gcagcgaacgccgggg

SEQ ID NO: 3555265 - RNA, 15 nt, Pseudomonas putida KT2440
gcagcgaaugcagcu

SEQ ID NO: 3555266 - RNA, 12 nt, Pseudomonas putida KT2440
gcagcgaccauc

SEQ ID NO: 3555267 - RNA, 14 nt, Pseudomonas putida KT2440
gcagcgacgaccug

SEQ ID NO: 3555268 - RNA, 16 nt, Pseudomonas putida KT2440
gcagcgaucagcgcag

SEQ ID NO: 3555269 - RNA, 18 nt, Pseudomonas putida KT2440
gcagcgaucagcgcagaa

SEQ ID NO: 3555270 - RNA, 17 nt, Pseudomonas putida KT2440
gcagcgaucaguuccgc

SEQ ID NO: 3555271 - RNA, 15 nt, Pseudomonas putida KT2440
gcagcgaugccgggg

SEQ ID NO: 3555272 - RNA, 20 nt, Pseudomonas putida KT2440
gcagcgcaccgugcaccagc

SEQ ID NO: 3555273 - RNA, 23 nt, Pseudomonas putida KT2440
gcagcgcacuuccacacccagcg

SEQ ID NO: 3555274 - RNA, 16 nt, Pseudomonas putida KT2440
gcagcgcauccaccuc

SEQ ID NO: 3555275 - RNA, 22 nt, Pseudomonas putida KT2440
gcagcgcaugcucgcgggccug

SEQ ID NO: 3555276 - RNA, 23 nt, Pseudomonas putida KT2440
gcagcgcaugcucgcgggccugg

SEQ ID NO: 3555277 - RNA, 13 nt, Pseudomonas putida KT2440
gcagcgccgccag

SEQ ID NO: 3555278 - RNA, 14 nt, Pseudomonas putida KT2440
gcagcgccgccagg

SEQ ID NO: 3555279 - RNA, 15 nt, Pseudomonas putida KT2440
gcagcgccgccaggc

SEQ ID NO: 3555280 - RNA, 16 nt, Pseudomonas putida KT2440
gcagcgccgccaggcc

SEQ ID NO: 3555281 - RNA, 17 nt, Pseudomonas putida KT2440
gcagcgccgccaggccc

SEQ ID NO: 3555282 - RNA, 14 nt, Pseudomonas putida KT2440
gcagcgccugcagc

SEQ ID NO: 3555283 - RNA, 15 nt, Pseudomonas putida KT2440
gcagcgccugcagcg

SEQ ID NO: 3555284 - RNA, 21 nt, Pseudomonas putida KT2440
gcagcgccugcagcgcgucau

SEQ ID NO: 3555285 - RNA, 12 nt, Pseudomonas putida KT2440
gcagcgccuggu

SEQ ID NO: 3555286 - RNA, 13 nt, Pseudomonas putida KT2440
gcagcgcggcgau

SEQ ID NO: 3555287 - RNA, 18 nt, Pseudomonas putida KT2440
gcagcgcggcgaucaacg

SEQ ID NO: 3555288 - RNA, 11 nt, Pseudomonas putida KT2440
gcagcgcgugc

SEQ ID NO: 3555289 - RNA, 17 nt, Pseudomonas putida KT2440
gcagcgcgugcuggucc

SEQ ID NO: 3555290 - RNA, 23 nt, Pseudomonas putida KT2440
gcagcgcgugcugguccuccccu

SEQ ID NO: 3555291 - RNA, 14 nt, Pseudomonas putida KT2440
gcagcgcuccgcca

SEQ ID NO: 3555292 - RNA, 16 nt, Pseudomonas putida KT2440
gcagcgcuccgccaaa

SEQ ID NO: 3555293 - RNA, 14 nt, Pseudomonas putida KT2440
gcagcgcucgcugc

SEQ ID NO: 3555294 - RNA, 19 nt, Pseudomonas putida KT2440
gcagcgcucgcugccgguc

SEQ ID NO: 3555295 - RNA, 13 nt, Pseudomonas putida KT2440
gcagcgcugcaag

SEQ ID NO: 3555296 - RNA, 17 nt, Pseudomonas putida KT2440
gcagcgcuucgaucagc

SEQ ID NO: 3555297 - RNA, 20 nt, Pseudomonas putida KT2440
gcagcgcuucgaucagcgcc

SEQ ID NO: 3555298 - RNA, 24 nt, Pseudomonas putida KT2440
gcagcgcuucgaucagcgccugcu

SEQ ID NO: 3555299 - RNA, 17 nt, Pseudomonas putida KT2440
gcagcgcuucgaucgcc

SEQ ID NO: 3555300 - RNA, 12 nt, Pseudomonas putida KT2440
gcagcggcaagg

SEQ ID NO: 3555301 - RNA, 18 nt, Pseudomonas putida KT2440
gcagcggcagaucacgca

SEQ ID NO: 3555302 - RNA, 15 nt, Pseudomonas putida KT2440
gcagcggccccuuuc

SEQ ID NO: 3555303 - RNA, 20 nt, Pseudomonas putida KT2440
gcagcggcgucaccuuccug

SEQ ID NO: 3555304 - RNA, 15 nt, Pseudomonas putida KT2440
gcagcggcuggcgcu

SEQ ID NO: 3555305 - RNA, 19 nt, Pseudomonas putida KT2440
gcagcggcuuggccgcgaa

SEQ ID NO: 3555306 - RNA, 20 nt, Pseudomonas putida KT2440
gcagcgggauguuggucuug

SEQ ID NO: 3555307 - RNA, 11 nt, Pseudomonas putida KT2440
gcagcgggcac

SEQ ID NO: 3555308 - RNA, 15 nt, Pseudomonas putida KT2440
gcagcgggcacaggc

SEQ ID NO: 3555309 - RNA, 16 nt, Pseudomonas putida KT2440
gcagcgggcacaggcc

SEQ ID NO: 3555310 - RNA, 18 nt, Pseudomonas putida KT2440
gcagcgggcacaggccgc

SEQ ID NO: 3555311 - RNA, 22 nt, Pseudomonas putida KT2440
gcagcgggcacaggccgcgcau

SEQ ID NO: 3555312 - RNA, 21 nt, Pseudomonas putida KT2440
gcagcgggcucgcccacacgg

SEQ ID NO: 3555313 - RNA, 14 nt, Pseudomonas putida KT2440
gcagcgggcugccc

SEQ ID NO: 3555314 - RNA, 20 nt, Pseudomonas putida KT2440
gcagcggggauucaacagcg

SEQ ID NO: 3555315 - RNA, 22 nt, Pseudomonas putida KT2440
gcagcggggauucaacagcgcg

SEQ ID NO: 3555316 - RNA, 23 nt, Pseudomonas putida KT2440
gcagcggggauucaacagcgcga

SEQ ID NO: 3555317 - RNA, 14 nt, Pseudomonas putida KT2440
gcagcgggucgcac

SEQ ID NO: 3555318 - RNA, 21 nt, Pseudomonas putida KT2440
gcagcgggucgcacucggcaa

SEQ ID NO: 3555319 - RNA, 22 nt, Pseudomonas putida KT2440
gcagcgggucgcacucggcaau

SEQ ID NO: 3555320 - RNA, 20 nt, Pseudomonas putida KT2440
gcagcguaauagcuggugaa

SEQ ID NO: 3555321 - RNA, 22 nt, Pseudomonas putida KT2440
gcagcguaauagcuggugaacu

SEQ ID NO: 3555322 - RNA, 16 nt, Pseudomonas putida KT2440
gcagcguacccagcuc

SEQ ID NO: 3555323 - RNA, 17 nt, Pseudomonas putida KT2440
gcagcgucggcagagcg

SEQ ID NO: 3555324 - RNA, 14 nt, Pseudomonas putida KT2440
gcagcguggccuuc

SEQ ID NO: 3555325 - RNA, 16 nt, Pseudomonas putida KT2440
gcagcguuguucacca

SEQ ID NO: 3555326 - RNA, 23 nt, Pseudomonas putida KT2440
gcagcuaaggcugauaagcaaga

SEQ ID NO: 3555327 - RNA, 14 nt, Pseudomonas putida KT2440
gcagcuaccacccc

SEQ ID NO: 3555328 - RNA, 20 nt, Pseudomonas putida KT2440
gcagcuacgagacgguggcu

SEQ ID NO: 3555329 - RNA, 12 nt, Pseudomonas putida KT2440
gcagcucaccgg

SEQ ID NO: 3555330 - RNA, 14 nt, Pseudomonas putida KT2440
gcagcucagccagc

SEQ ID NO: 3555331 - RNA, 17 nt, Pseudomonas putida KT2440
gcagcucagccagcaag

SEQ ID NO: 3555332 - RNA, 16 nt, Pseudomonas putida KT2440
gcagcuccagccagau

SEQ ID NO: 3555333 - RNA, 13 nt, Pseudomonas putida KT2440
gcagcuccagcgu

SEQ ID NO: 3555334 - RNA, 17 nt, Pseudomonas putida KT2440
gcagcucccgagccagg

SEQ ID NO: 3555335 - RNA, 14 nt, Pseudomonas putida KT2440
gcagcucgagcaug

SEQ ID NO: 3555336 - RNA, 16 nt, Pseudomonas putida KT2440
gcagcucuugucgaca

SEQ ID NO: 3555337 - RNA, 23 nt, Pseudomonas putida KT2440
gcagcucuuuugccgggaagcgc

SEQ ID NO: 3555338 - RNA, 16 nt, Pseudomonas putida KT2440
gcagcugcagugcugg

SEQ ID NO: 3555339 - RNA, 18 nt, Pseudomonas putida KT2440
gcagcugcagugcugggc

SEQ ID NO: 3555340 - RNA, 16 nt, Pseudomonas putida KT2440
gcagcugccggaacgu

SEQ ID NO: 3555341 - RNA, 17 nt, Pseudomonas putida KT2440
gcagcuggcgcaaauug

SEQ ID NO: 3555342 - RNA, 12 nt, Pseudomonas putida KT2440
gcagcuggcuug

SEQ ID NO: 3555343 - RNA, 13 nt, Pseudomonas putida KT2440
gcagcuggucgag

SEQ ID NO: 3555344 - RNA, 20 nt, Pseudomonas putida KT2440
gcagcuggucgagcaaggca

SEQ ID NO: 3555345 - RNA, 18 nt, Pseudomonas putida KT2440
gcagcuucaacuccacca

SEQ ID NO: 3555346 - RNA, 13 nt, Pseudomonas putida KT2440
gcagcuuccacca

SEQ ID NO: 3555347 - RNA, 13 nt, Pseudomonas putida KT2440
gcagcuucccggc

SEQ ID NO: 3555348 - RNA, 16 nt, Pseudomonas putida KT2440
gcagcuucccggccug

SEQ ID NO: 3555349 - RNA, 18 nt, Pseudomonas putida KT2440
gcagcuucccggccuggc

SEQ ID NO: 3555350 - RNA, 19 nt, Pseudomonas putida KT2440
gcagcuucccggccuggcg

SEQ ID NO: 3555351 - RNA, 21 nt, Pseudomonas putida KT2440
gcagcuucccggccuggcgca

SEQ ID NO: 3555352 - RNA, 15 nt, Pseudomonas putida KT2440
gcagcuuccgccacc

SEQ ID NO: 3555353 - RNA, 20 nt, Pseudomonas putida KT2440
gcagcuuccgccaccacgaa

SEQ ID NO: 3555354 - RNA, 21 nt, Pseudomonas putida KT2440
gcagcuucucgcggcgaaugc

SEQ ID NO: 3555355 - RNA, 19 nt, Pseudomonas putida KT2440
gcagcuucuggcgcguguc

SEQ ID NO: 3555356 - RNA, 13 nt, Pseudomonas putida KT2440
gcagcuucuucac

SEQ ID NO: 3555357 - RNA, 15 nt, Pseudomonas putida KT2440
gcagcuucuucacac

SEQ ID NO: 3555358 - RNA, 13 nt, Pseudomonas putida KT2440
gcagcuugaacaa

SEQ ID NO: 3555359 - RNA, 14 nt, Pseudomonas putida KT2440
gcagcuugaacaac

SEQ ID NO: 3555360 - RNA, 17 nt, Pseudomonas putida KT2440
gcagcuugaacaacggc

SEQ ID NO: 3555361 - RNA, 19 nt, Pseudomonas putida KT2440
gcagggaagguggccggca

SEQ ID NO: 3555362 - RNA, 13 nt, Pseudomonas putida KT2440
gcagggacugucg

SEQ ID NO: 3555363 - RNA, 21 nt, Pseudomonas putida KT2440
gcagggcacacuucgccgugc

SEQ ID NO: 3555364 - RNA, 13 nt, Pseudomonas putida KT2440
gcagggcaccagu

SEQ ID NO: 3555365 - RNA, 15 nt, Pseudomonas putida KT2440
gcagggcaccaguug

SEQ ID NO: 3555366 - RNA, 23 nt, Pseudomonas putida KT2440
gcagggcacgccaaucaccugca

SEQ ID NO: 3555367 - RNA, 21 nt, Pseudomonas putida KT2440
gcagggccaacgacacuccgg

SEQ ID NO: 3555368 - RNA, 20 nt, Pseudomonas putida KT2440
gcagggccaucaucugcuga

SEQ ID NO: 3555369 - RNA, 16 nt, Pseudomonas putida KT2440
gcagggcccagccacc

SEQ ID NO: 3555370 - RNA, 18 nt, Pseudomonas putida KT2440
gcagggcccagccaccga

SEQ ID NO: 3555371 - RNA, 22 nt, Pseudomonas putida KT2440
gcagggcccagccaccgacgaa

SEQ ID NO: 3555372 - RNA, 12 nt, Pseudomonas putida KT2440
gcagggccgcgc

SEQ ID NO: 3555373 - RNA, 14 nt, Pseudomonas putida KT2440
gcagggccgcgcuu

SEQ ID NO: 3555374 - RNA, 18 nt, Pseudomonas putida KT2440
gcagggcgagcacacccg

SEQ ID NO: 3555375 - RNA, 22 nt, Pseudomonas putida KT2440
gcagggcgagcacacccggcgu

SEQ ID NO: 3555376 - RNA, 22 nt, Pseudomonas putida KT2440
gcagggcgaucuccugcaggga

SEQ ID NO: 3555377 - RNA, 21 nt, Pseudomonas putida KT2440
gcagggcgcgaaaagccugca

SEQ ID NO: 3555378 - RNA, 13 nt, Pseudomonas putida KT2440
gcagggcggccuc

SEQ ID NO: 3555379 - RNA, 15 nt, Pseudomonas putida KT2440
gcaggguagccccga

SEQ ID NO: 3555380 - RNA, 23 nt, Pseudomonas putida KT2440
gcagggucgcgccccaagcgggc

SEQ ID NO: 3555381 - RNA, 15 nt, Pseudomonas putida KT2440
gcagggucuucucag

SEQ ID NO: 3555382 - RNA, 16 nt, Pseudomonas putida KT2440
gcagggugccgccaug

SEQ ID NO: 3555383 - RNA, 15 nt, Pseudomonas putida KT2440
gcagggugucgacga

SEQ ID NO: 3555384 - RNA, 20 nt, Pseudomonas putida KT2440
gcaggguucgccgucagccu

SEQ ID NO: 3555385 - RNA, 21 nt, Pseudomonas putida KT2440
gcaggguuuucagcgccgcaa

SEQ ID NO: 3555386 - RNA, 22 nt, Pseudomonas putida KT2440
gcaggguuuucagcgccgcaac

SEQ ID NO: 3555387 - RNA, 21 nt, Pseudomonas putida KT2440
gcagguaaaaaucaugcaguu

SEQ ID NO: 3555388 - RNA, 15 nt, Pseudomonas putida KT2440
gcagguaaacccgcg

SEQ ID NO: 3555389 - RNA, 16 nt, Pseudomonas putida KT2440
gcagguaaacccgcgc

SEQ ID NO: 3555390 - RNA, 20 nt, Pseudomonas putida KT2440
gcagguaaacccgcgccugc

SEQ ID NO: 3555391 - RNA, 21 nt, Pseudomonas putida KT2440
gcagguaaugcgccgcaccaa

SEQ ID NO: 3555392 - RNA, 23 nt, Pseudomonas putida KT2440
gcagguacagcaccccguccagc

SEQ ID NO: 3555393 - RNA, 16 nt, Pseudomonas putida KT2440
gcagguacagcagcug

SEQ ID NO: 3555394 - RNA, 18 nt, Pseudomonas putida KT2440
gcagguacagcagcugca

SEQ ID NO: 3555395 - RNA, 18 nt, Pseudomonas putida KT2440
gcagguacucgccgggcg

SEQ ID NO: 3555396 - RNA, 20 nt, Pseudomonas putida KT2440
gcagguacucugucacccgc

SEQ ID NO: 3555397 - RNA, 21 nt, Pseudomonas putida KT2440
gcagguacucugucacccgcu

SEQ ID NO: 3555398 - RNA, 13 nt, Pseudomonas putida KT2440
gcagguagcgccc

SEQ ID NO: 3555399 - RNA, 19 nt, Pseudomonas putida KT2440
gcaggucagcgagcgggug

SEQ ID NO: 3555400 - RNA, 15 nt, Pseudomonas putida KT2440
gcaggucaggcccuu

SEQ ID NO: 3555401 - RNA, 15 nt, Pseudomonas putida KT2440
gcaggucaucgaaca

SEQ ID NO: 3555402 - RNA, 20 nt, Pseudomonas putida KT2440
gcaggucauuggcgccaucg

SEQ ID NO: 3555403 - RNA, 13 nt, Pseudomonas putida KT2440
gcagguccagcuc

SEQ ID NO: 3555404 - RNA, 15 nt, Pseudomonas putida KT2440
gcagguccagcuccg

SEQ ID NO: 3555405 - RNA, 14 nt, Pseudomonas putida KT2440
gcagguccaggcgc

SEQ ID NO: 3555406 - RNA, 19 nt, Pseudomonas putida KT2440
gcagguccaguucgcgcaa

SEQ ID NO: 3555407 - RNA, 14 nt, Pseudomonas putida KT2440
gcaggucgaacagc

SEQ ID NO: 3555408 - RNA, 13 nt, Pseudomonas putida KT2440
gcaggucgacccg

SEQ ID NO: 3555409 - RNA, 16 nt, Pseudomonas putida KT2440
gcaggucgacccgcgc

SEQ ID NO: 3555410 - RNA, 15 nt, Pseudomonas putida KT2440
gcaggucgaccugcc

SEQ ID NO: 3555411 - RNA, 17 nt, Pseudomonas putida KT2440
gcaggucgaccugccag

SEQ ID NO: 3555412 - RNA, 20 nt, Pseudomonas putida KT2440
gcaggucgacgauacccagc

SEQ ID NO: 3555413 - RNA, 23 nt, Pseudomonas putida KT2440
gcaggucgacgaucgccgccacg

SEQ ID NO: 3555414 - RNA, 14 nt, Pseudomonas putida KT2440
gcaggucgccaucc

SEQ ID NO: 3555415 - RNA, 16 nt, Pseudomonas putida KT2440
gcaggucggccagcuc

SEQ ID NO: 3555416 - RNA, 13 nt, Pseudomonas putida KT2440
gcaggugcaggcu

SEQ ID NO: 3555417 - RNA, 14 nt, Pseudomonas putida KT2440
gcaggugcagggug

SEQ ID NO: 3555418 - RNA, 15 nt, Pseudomonas putida KT2440
gcaggugcagggugc

SEQ ID NO: 3555419 - RNA, 21 nt, Pseudomonas putida KT2440
gcaggugcccaagcggcacua

SEQ ID NO: 3555420 - RNA, 14 nt, Pseudomonas putida KT2440
gcaggugcgcaggc

SEQ ID NO: 3555421 - RNA, 14 nt, Pseudomonas putida KT2440
gcagguucaacggc

SEQ ID NO: 3555422 - RNA, 15 nt, Pseudomonas putida KT2440
gcagguucaacggcg

SEQ ID NO: 3555423 - RNA, 15 nt, Pseudomonas putida KT2440
gcagguucaggcgca

SEQ ID NO: 3555424 - RNA, 18 nt, Pseudomonas putida KT2440
gcagguucaggcgcagca

SEQ ID NO: 3555425 - RNA, 22 nt, Pseudomonas putida KT2440
gcagguucgaccaccgcaggug

SEQ ID NO: 3555426 - RNA, 16 nt, Pseudomonas putida KT2440
gcagguucugaaucug

SEQ ID NO: 3555427 - RNA, 18 nt, Pseudomonas putida KT2440
gcagguucugaaucuggc

SEQ ID NO: 3555428 - RNA, 23 nt, Pseudomonas putida KT2440
gcagguucuuaucuggggugggg

SEQ ID NO: 3555429 - RNA, 23 nt, Pseudomonas putida KT2440
gcagguugaacagguugcugccg

SEQ ID NO: 3555430 - RNA, 16 nt, Pseudomonas putida KT2440
gcagguugcuggccuu

SEQ ID NO: 3555431 - RNA, 14 nt, Pseudomonas putida KT2440
gcagguugcuggug

SEQ ID NO: 3555432 - RNA, 17 nt, Pseudomonas putida KT2440
gcagguuggacagcgcc

SEQ ID NO: 3555433 - RNA, 18 nt, Pseudomonas putida KT2440
gcagguuggacagcgccc

SEQ ID NO: 3555434 - RNA, 14 nt, Pseudomonas putida KT2440
gcagguuggcgcga

SEQ ID NO: 3555435 - RNA, 22 nt, Pseudomonas putida KT2440
gcagguuggugcaauugcaguu

SEQ ID NO: 3555436 - RNA, 15 nt, Pseudomonas putida KT2440
gcagguuguccaccg

SEQ ID NO: 3555437 - RNA, 18 nt, Pseudomonas putida KT2440
gcagguuguccaccgcgc

SEQ ID NO: 3555438 - RNA, 17 nt, Pseudomonas putida KT2440
gcagguuuuccagcccg

SEQ ID NO: 3555439 - RNA, 15 nt, Pseudomonas putida KT2440
gcaguacaggcugcc

SEQ ID NO: 3555440 - RNA, 22 nt, Pseudomonas putida KT2440
gcaguaccuguggcagcggcuu

SEQ ID NO: 3555441 - RNA, 20 nt, Pseudomonas putida KT2440
gcaguacuuauaagcagcaa

SEQ ID NO: 3555442 - RNA, 22 nt, Pseudomonas putida KT2440
gcaguacuuauaagcagcaagc

SEQ ID NO: 3555443 - RNA, 22 nt, Pseudomonas putida KT2440
gcaguacuugcuggauuccgac

SEQ ID NO: 3555444 - RNA, 15 nt, Pseudomonas putida KT2440
gcaguagagccccca

SEQ ID NO: 3555445 - RNA, 17 nt, Pseudomonas putida KT2440
gcaguaggugcaggcgu

SEQ ID NO: 3555446 - RNA, 21 nt, Pseudomonas putida KT2440
gcagucaccacacggcagccc

SEQ ID NO: 3555447 - RNA, 16 nt, Pseudomonas putida KT2440
gcagucacccaccggc

SEQ ID NO: 3555448 - RNA, 20 nt, Pseudomonas putida KT2440
gcagucagccacauccucug

SEQ ID NO: 3555449 - RNA, 22 nt, Pseudomonas putida KT2440
gcagucagggucucggccaauc

SEQ ID NO: 3555450 - RNA, 16 nt, Pseudomonas putida KT2440
gcaguccacuugcguu

SEQ ID NO: 3555451 - RNA, 17 nt, Pseudomonas putida KT2440
gcagucccagcaccgcg

SEQ ID NO: 3555452 - RNA, 18 nt, Pseudomonas putida KT2440
gcagucccagcaccgcga

SEQ ID NO: 3555453 - RNA, 13 nt, Pseudomonas putida KT2440
gcagucccaucug

SEQ ID NO: 3555454 - RNA, 14 nt, Pseudomonas putida KT2440
gcagucccgccaua

SEQ ID NO: 3555455 - RNA, 15 nt, Pseudomonas putida KT2440
gcagucccguuggcc

SEQ ID NO: 3555456 - RNA, 19 nt, Pseudomonas putida KT2440
gcagucccguuggcccgcc

SEQ ID NO: 3555457 - RNA, 22 nt, Pseudomonas putida KT2440
gcagucccguuggcccgccagu

SEQ ID NO: 3555458 - RNA, 22 nt, Pseudomonas putida KT2440
gcaguccugcaacucggccuug

SEQ ID NO: 3555459 - RNA, 21 nt, Pseudomonas putida KT2440
gcagucgaaggggaucagcac

SEQ ID NO: 3555460 - RNA, 23 nt, Pseudomonas putida KT2440
gcagucgaucccgaggucagcag

SEQ ID NO: 3555461 - RNA, 14 nt, Pseudomonas putida KT2440
gcagucguugucca

SEQ ID NO: 3555462 - RNA, 17 nt, Pseudomonas putida KT2440
gcagucuugcugaucac

SEQ ID NO: 3555463 - RNA, 17 nt, Pseudomonas putida KT2440
gcagucuugugcugcga

SEQ ID NO: 3555464 - RNA, 18 nt, Pseudomonas putida KT2440
gcagucuugugcugcgag

SEQ ID NO: 3555465 - RNA, 21 nt, Pseudomonas putida KT2440
gcagugaacuccaacgccggc

SEQ ID NO: 3555466 - RNA, 15 nt, Pseudomonas putida KT2440
gcaucgaagcaggcc

SEQ ID NO: 3555467 - RNA, 16 nt, Pseudomonas putida KT2440
gcaucgaagcaggccg

SEQ ID NO: 3555468 - RNA, 15 nt, Pseudomonas putida KT2440
gcaucgaagcgcacc

SEQ ID NO: 3555469 - RNA, 18 nt, Pseudomonas putida KT2440
gcaucgaagcgcaccagu

SEQ ID NO: 3555470 - RNA, 21 nt, Pseudomonas putida KT2440
gcaucgacagguccaccgcuu

SEQ ID NO: 3555471 - RNA, 22 nt, Pseudomonas putida KT2440
gcaucgacgcuuccuuguccgc

SEQ ID NO: 3555472 - RNA, 18 nt, Pseudomonas putida KT2440
gcaucgaggaaggcaucg

SEQ ID NO: 3555473 - RNA, 21 nt, Pseudomonas putida KT2440
gcaucgaucccuggggccaag

SEQ ID NO: 3555474 - RNA, 20 nt, Pseudomonas putida KT2440
gcaucgccacgggcgugacc

SEQ ID NO: 3555475 - RNA, 16 nt, Pseudomonas putida KT2440
gcaucgccuccagcgc

SEQ ID NO: 3555476 - RNA, 16 nt, Pseudomonas putida KT2440
gcaucgcgcacuugcc

SEQ ID NO: 3555477 - RNA, 22 nt, Pseudomonas putida KT2440
gcaucgcgcacuugccagccgc

SEQ ID NO: 3555478 - RNA, 18 nt, Pseudomonas putida KT2440
gcaucgcugcccgggcaa

SEQ ID NO: 3555479 - RNA, 21 nt, Pseudomonas putida KT2440
gcaucgcuguccuuggccaac

SEQ ID NO: 3555480 - RNA, 20 nt, Pseudomonas putida KT2440
gcaucggccacuucgcggaa

SEQ ID NO: 3555481 - RNA, 19 nt, Pseudomonas putida KT2440
gcaucggccgagccggucg

SEQ ID NO: 3555482 - RNA, 21 nt, Pseudomonas putida KT2440
gcaucggccuggggcaggccc

SEQ ID NO: 3555483 - RNA, 17 nt, Pseudomonas putida KT2440
gcaucggcucgcagaua

SEQ ID NO: 3555484 - RNA, 19 nt, Pseudomonas putida KT2440
gcaucgggccgauggcgca

SEQ ID NO: 3555485 - RNA, 21 nt, Pseudomonas putida KT2440
gcaucgggcgcgucgucaugg

SEQ ID NO: 3555486 - RNA, 19 nt, Pseudomonas putida KT2440
gcaucgguugccuugucgg

SEQ ID NO: 3555487 - RNA, 13 nt, Pseudomonas putida KT2440
gcaucguccuugc

SEQ ID NO: 3555488 - RNA, 16 nt, Pseudomonas putida KT2440
gcaucguuauccagca

SEQ ID NO: 3555489 - RNA, 18 nt, Pseudomonas putida KT2440
gcaucguuauccagcacc

SEQ ID NO: 3555490 - RNA, 19 nt, Pseudomonas putida KT2440
gcaucguuauccagcaccc

SEQ ID NO: 3555491 - RNA, 22 nt, Pseudomonas putida KT2440
gcaucucgcacuugaucuugcg

SEQ ID NO: 3555492 - RNA, 22 nt, Pseudomonas putida KT2440
gcaucucggccagugcgugcag

SEQ ID NO: 3555493 - RNA, 16 nt, Pseudomonas putida KT2440
gcaucugcaccaggaa

SEQ ID NO: 3555494 - RNA, 22 nt, Pseudomonas putida KT2440
gcaucugcaccaggaagcuggg

SEQ ID NO: 3555495 - RNA, 16 nt, Pseudomonas putida KT2440
gcaucugcaccggcag

SEQ ID NO: 3555496 - RNA, 20 nt, Pseudomonas putida KT2440
gcaucugcugcggcaggcug

SEQ ID NO: 3555497 - RNA, 23 nt, Pseudomonas putida KT2440
gcaucugcugcggcaggcuggca

SEQ ID NO: 3555498 - RNA, 22 nt, Pseudomonas putida KT2440
gcaugaacgcagcuuccgccac

SEQ ID NO: 3555499 - RNA, 19 nt, Pseudomonas putida KT2440
gcaugaaggacaucaccag

SEQ ID NO: 3555500 - RNA, 14 nt, Pseudomonas putida KT2440
gcaugaaggcccag

SEQ ID NO: 3555501 - RNA, 21 nt, Pseudomonas putida KT2440
gcaugaauagcgcacugagca

SEQ ID NO: 3555502 - RNA, 15 nt, Pseudomonas putida KT2440
gcaugacuuccaggu

SEQ ID NO: 3555503 - RNA, 15 nt, Pseudomonas putida KT2440
gcaugagccuggccg

SEQ ID NO: 3555504 - RNA, 17 nt, Pseudomonas putida KT2440
gcaugagccuggccggu

SEQ ID NO: 3555505 - RNA, 19 nt, Pseudomonas putida KT2440
gcaugagccuggccggugu

SEQ ID NO: 3555506 - RNA, 17 nt, Pseudomonas putida KT2440
gcaugaucaccgccagc

SEQ ID NO: 3555507 - RNA, 15 nt, Pseudomonas putida KT2440
gcaugaucgcgcuug

SEQ ID NO: 3555508 - RNA, 22 nt, Pseudomonas putida KT2440
gcaugaugaaguggcgcaggcu

SEQ ID NO: 3555509 - RNA, 17 nt, Pseudomonas putida KT2440
gcaugauugcgggcuuu

SEQ ID NO: 3555510 - RNA, 14 nt, Pseudomonas putida KT2440
gcaugcaacccgca

SEQ ID NO: 3555511 - RNA, 13 nt, Pseudomonas putida KT2440
gcaugcaacggca

SEQ ID NO: 3555512 - RNA, 23 nt, Pseudomonas putida KT2440
gcaugcacggcagcaaucgccgc

SEQ ID NO: 3555513 - RNA, 21 nt, Pseudomonas putida KT2440
gcaugcaggucgaccugccag

SEQ ID NO: 3555514 - RNA, 16 nt, Pseudomonas putida KT2440
gcaugcaucagggucu

SEQ ID NO: 3555515 - RNA, 14 nt, Pseudomonas putida KT2440
gcaugccagcagcu

SEQ ID NO: 3555516 - RNA, 18 nt, Pseudomonas putida KT2440
gcaugccagcagcuggcu

SEQ ID NO: 3555517 - RNA, 21 nt, Pseudomonas putida KT2440
gcaugccaguagaagcccaga

SEQ ID NO: 3555518 - RNA, 15 nt, Pseudomonas putida KT2440
gcaugcccagcgcca

SEQ ID NO: 3555519 - RNA, 18 nt, Pseudomonas putida KT2440
gcaugcccaguucgcgug

SEQ ID NO: 3555520 - RNA, 21 nt, Pseudomonas putida KT2440
gcaugccccucgaacagcgcc

SEQ ID NO: 3555521 - RNA, 22 nt, Pseudomonas putida KT2440
gcaugccccucgaacagcgccg

SEQ ID NO: 3555522 - RNA, 20 nt, Pseudomonas putida KT2440
gcaugcccgccccugccagc

SEQ ID NO: 3555523 - RNA, 15 nt, Pseudomonas putida KT2440
gcaugcccgcgcaaa

SEQ ID NO: 3555524 - RNA, 22 nt, Pseudomonas putida KT2440
gcaugcccgcgcaaaucgccgc

SEQ ID NO: 3555525 - RNA, 15 nt, Pseudomonas putida KT2440
gcaugcccgcuccca

SEQ ID NO: 3555526 - RNA, 20 nt, Pseudomonas putida KT2440
gcaugcccgcucccacaggg

SEQ ID NO: 3555527 - RNA, 20 nt, Pseudomonas putida KT2440
gcaugcccgcucccacaggu

SEQ ID NO: 3555528 - RNA, 11 nt, Pseudomonas putida KT2440
gcaugccuucc

SEQ ID NO: 3555529 - RNA, 15 nt, Pseudomonas putida KT2440
gcaugcgaagccgcc

SEQ ID NO: 3555530 - RNA, 23 nt, Pseudomonas putida KT2440
gcaugcgcacggucuccggcgaa

SEQ ID NO: 3555531 - RNA, 13 nt, Pseudomonas putida KT2440
gcaugcgcccccc

SEQ ID NO: 3555532 - RNA, 14 nt, Pseudomonas putida KT2440
gcaugcgcgacagc

SEQ ID NO: 3555533 - RNA, 12 nt, Pseudomonas putida KT2440
gcaugcggccgu

SEQ ID NO: 3555534 - RNA, 22 nt, Pseudomonas putida KT2440
gcaugcguuguucgaucagccg

SEQ ID NO: 3555535 - RNA, 17 nt, Pseudomonas putida KT2440
gcaugcucgcgggccug

SEQ ID NO: 3555536 - RNA, 22 nt, Pseudomonas putida KT2440
gcaugcucgcgggccuggagca

SEQ ID NO: 3555537 - RNA, 17 nt, Pseudomonas putida KT2440
gcaugcugccaggcaaa

SEQ ID NO: 3555538 - RNA, 18 nt, Pseudomonas putida KT2440
gcaugcugccaggcaaag

SEQ ID NO: 3555539 - RNA, 18 nt, Pseudomonas putida KT2440
gcauggaagggcggguug

SEQ ID NO: 3555540 - RNA, 12 nt, Pseudomonas putida KT2440
gcauggcaaaca

SEQ ID NO: 3555541 - RNA, 22 nt, Pseudomonas putida KT2440
gcauggcaaacagcaccagccc

SEQ ID NO: 3555542 - RNA, 18 nt, Pseudomonas putida KT2440
gcauggcaaccaugucga

SEQ ID NO: 3555543 - RNA, 23 nt, Pseudomonas putida KT2440
gcauggcaaucaaugacaauugu

SEQ ID NO: 3555544 - RNA, 15 nt, Pseudomonas putida KT2440
gcauggccagccggc

SEQ ID NO: 3555545 - RNA, 17 nt, Pseudomonas putida KT2440
gcauggccaguuccugg

SEQ ID NO: 3555546 - RNA, 19 nt, Pseudomonas putida KT2440
gcauggccaguuccuggca

SEQ ID NO: 3555547 - RNA, 20 nt, Pseudomonas putida KT2440
gcauggccaguuccuggcac

SEQ ID NO: 3555548 - RNA, 16 nt, Pseudomonas putida KT2440
gcauggcccaugaucg

SEQ ID NO: 3555549 - RNA, 19 nt, Pseudomonas putida KT2440
gcauggccgaaaccagccc

SEQ ID NO: 3555550 - RNA, 21 nt, Pseudomonas putida KT2440
gcauggccgaaaccagccccu

SEQ ID NO: 3555551 - RNA, 23 nt, Pseudomonas putida KT2440
gcauggccgaaaccagccccuug

SEQ ID NO: 3555552 - RNA, 13 nt, Pseudomonas putida KT2440
gcauggccgaggu

SEQ ID NO: 3555553 - RNA, 18 nt, Pseudomonas putida KT2440
gcauggccgccacaugcu

SEQ ID NO: 3555554 - RNA, 23 nt, Pseudomonas putida KT2440
gcauggccggauagagcccggcg

SEQ ID NO: 3555555 - RNA, 18 nt, Pseudomonas putida KT2440
gcauggcgaucucuuccc

SEQ ID NO: 3555556 - RNA, 15 nt, Pseudomonas putida KT2440
gcauggcgucggcga

SEQ ID NO: 3555557 - RNA, 23 nt, Pseudomonas putida KT2440
gcauggcgucggcgauggcgucc

SEQ ID NO: 3555558 - RNA, 18 nt, Pseudomonas putida KT2440
gcauggcgugcccggcaa

SEQ ID NO: 3555559 - RNA, 19 nt, Pseudomonas putida KT2440
gcauggcgugcccggcaau

SEQ ID NO: 3555560 - RNA, 18 nt, Pseudomonas putida KT2440
gcauggcguuguccagca

SEQ ID NO: 3555561 - RNA, 17 nt, Pseudomonas putida KT2440
gcauggcucaacuggca

SEQ ID NO: 3555562 - RNA, 18 nt, Pseudomonas putida KT2440
gcauggcucaacuggcag

SEQ ID NO: 3555563 - RNA, 15 nt, Pseudomonas putida KT2440
gcaugggccagggau

SEQ ID NO: 3555564 - RNA, 11 nt, Pseudomonas putida KT2440
gcaugggugag

SEQ ID NO: 3555565 - RNA, 18 nt, Pseudomonas putida KT2440
gcauguacucuucgacgg

SEQ ID NO: 3555566 - RNA, 15 nt, Pseudomonas putida KT2440
gcauguagccacgcu

SEQ ID NO: 3555567 - RNA, 18 nt, Pseudomonas putida KT2440
gcauguagccacgcugcc

SEQ ID NO: 3555568 - RNA, 21 nt, Pseudomonas putida KT2440
gcaugucaggggugccuucga

SEQ ID NO: 3555569 - RNA, 14 nt, Pseudomonas putida KT2440
gcauguccagcccg

SEQ ID NO: 3555570 - RNA, 20 nt, Pseudomonas putida KT2440
gccaagguugccaccagcau

SEQ ID NO: 3555571 - RNA, 19 nt, Pseudomonas putida KT2440
gccaauaacucgcagcgca

SEQ ID NO: 3555572 - RNA, 17 nt, Pseudomonas putida KT2440
gccaauaccgcgcauca

SEQ ID NO: 3555573 - RNA, 15 nt, Pseudomonas putida KT2440
gccaauagcccgcug

SEQ ID NO: 3555574 - RNA, 15 nt, Pseudomonas putida KT2440
gccaaucaucgccag

SEQ ID NO: 3555575 - RNA, 16 nt, Pseudomonas putida KT2440
gccaaucgaucugcuc

SEQ ID NO: 3555576 - RNA, 18 nt, Pseudomonas putida KT2440
gccaaucucguugcgcca

SEQ ID NO: 3555577 - RNA, 13 nt, Pseudomonas putida KT2440
gccaaugaucgag

SEQ ID NO: 3555578 - RNA, 17 nt, Pseudomonas putida KT2440
gccaaugcucaguggac

SEQ ID NO: 3555579 - RNA, 13 nt, Pseudomonas putida KT2440
gccaaugcugaug

SEQ ID NO: 3555580 - RNA, 22 nt, Pseudomonas putida KT2440
gccaauggcaaucccccgcuca

SEQ ID NO: 3555581 - RNA, 14 nt, Pseudomonas putida KT2440
gccaauuucaacgc

SEQ ID NO: 3555582 - RNA, 23 nt, Pseudomonas putida KT2440
gccaauuucaacgcucgcgcaug

SEQ ID NO: 3555583 - RNA, 20 nt, Pseudomonas putida KT2440
gccaauuuccauaccaaugg

SEQ ID NO: 3555584 - RNA, 22 nt, Pseudomonas putida KT2440
gccaauuuccauaccaauggca

SEQ ID NO: 3555585 - RNA, 21 nt, Pseudomonas putida KT2440
gccaauuugccagcgugaacc

SEQ ID NO: 3555586 - RNA, 20 nt, Pseudomonas putida KT2440
gccacaaaaucacaggccau

SEQ ID NO: 3555587 - RNA, 20 nt, Pseudomonas putida KT2440
gccacaacccuugcagcgcc

SEQ ID NO: 3555588 - RNA, 15 nt, Pseudomonas putida KT2440
gccacaauccgcugu

SEQ ID NO: 3555589 - RNA, 20 nt, Pseudomonas putida KT2440
gccacaauggcgcacagggc

SEQ ID NO: 3555590 - RNA, 18 nt, Pseudomonas putida KT2440
gccacacaaauccaggac

SEQ ID NO: 3555591 - RNA, 23 nt, Pseudomonas putida KT2440
gccacacaagccccccuguagga

SEQ ID NO: 3555592 - RNA, 22 nt, Pseudomonas putida KT2440
gccacacacauucccuguagga

SEQ ID NO: 3555593 - RNA, 18 nt, Pseudomonas putida KT2440
gccacacacccgggcccg

SEQ ID NO: 3555594 - RNA, 13 nt, Pseudomonas putida KT2440
gccacaccacagc

SEQ ID NO: 3555595 - RNA, 16 nt, Pseudomonas putida KT2440
gccacaccacagcugc

SEQ ID NO: 3555596 - RNA, 17 nt, Pseudomonas putida KT2440
gccacaccacagcugca

SEQ ID NO: 3555597 - RNA, 19 nt, Pseudomonas putida KT2440
gccacacgcugcugcuggc

SEQ ID NO: 3555598 - RNA, 15 nt, Pseudomonas putida KT2440
gccacacugcucagu

SEQ ID NO: 3555599 - RNA, 17 nt, Pseudomonas putida KT2440
gccacacugucccggca

SEQ ID NO: 3555600 - RNA, 20 nt, Pseudomonas putida KT2440
gccacacugucccggcacaa

SEQ ID NO: 3555601 - RNA, 19 nt, Pseudomonas putida KT2440
gccacagccgagggcaugg

SEQ ID NO: 3555602 - RNA, 17 nt, Pseudomonas putida KT2440
gccacagcgccaacgcc

SEQ ID NO: 3555603 - RNA, 16 nt, Pseudomonas putida KT2440
gccacauagcuggcac

SEQ ID NO: 3555604 - RNA, 21 nt, Pseudomonas putida KT2440
gccacauagcuggcacugccc

SEQ ID NO: 3555605 - RNA, 18 nt, Pseudomonas putida KT2440
gccacauaguaggcaaug

SEQ ID NO: 3555606 - RNA, 20 nt, Pseudomonas putida KT2440
gccacauaguaggcaaugcc

SEQ ID NO: 3555607 - RNA, 16 nt, Pseudomonas putida KT2440
gccacauccagcgccu

SEQ ID NO: 3555608 - RNA, 16 nt, Pseudomonas putida KT2440
gccacauccucugccc

SEQ ID NO: 3555609 - RNA, 19 nt, Pseudomonas putida KT2440
gccacauccucugcccgca

SEQ ID NO: 3555610 - RNA, 21 nt, Pseudomonas putida KT2440
gccacauccucugcccgcaag

SEQ ID NO: 3555611 - RNA, 15 nt, Pseudomonas putida KT2440
gccacaucggcaagu

SEQ ID NO: 3555612 - RNA, 14 nt, Pseudomonas putida KT2440
gccacaugccagcu

SEQ ID NO: 3555613 - RNA, 17 nt, Pseudomonas putida KT2440
gccacaugcccgcggcu

SEQ ID NO: 3555614 - RNA, 15 nt, Pseudomonas putida KT2440
gccacauggaucagc

SEQ ID NO: 3555615 - RNA, 17 nt, Pseudomonas putida KT2440
gccaccaaaggccuuga

SEQ ID NO: 3555616 - RNA, 19 nt, Pseudomonas putida KT2440
gccaccaaccggccagugg

SEQ ID NO: 3555617 - RNA, 14 nt, Pseudomonas putida KT2440
gccaccaccagcaa

SEQ ID NO: 3555618 - RNA, 21 nt, Pseudomonas putida KT2440
gccaccacccgcugggugcgc

SEQ ID NO: 3555619 - RNA, 15 nt, Pseudomonas putida KT2440
gccaccacccggggc

SEQ ID NO: 3555620 - RNA, 19 nt, Pseudomonas putida KT2440
gccaccacccggggcagca

SEQ ID NO: 3555621 - RNA, 20 nt, Pseudomonas putida KT2440
gccaccacccggggcagcau

SEQ ID NO: 3555622 - RNA, 22 nt, Pseudomonas putida KT2440
gccaccacccggggcagcauca

SEQ ID NO: 3555623 - RNA, 14 nt, Pseudomonas putida KT2440
gccaccaccgcuga

SEQ ID NO: 3555624 - RNA, 19 nt, Pseudomonas putida KT2440
gccaccacgucacgcacca

SEQ ID NO: 3555625 - RNA, 20 nt, Pseudomonas putida KT2440
gccaccacgucacgcaccau

SEQ ID NO: 3555626 - RNA, 21 nt, Pseudomonas putida KT2440
gccaccagaugaccaaagauc

SEQ ID NO: 3555627 - RNA, 19 nt, Pseudomonas putida KT2440
gccaccagcaccugcaggu

SEQ ID NO: 3555628 - RNA, 22 nt, Pseudomonas putida KT2440
gccaccagcaccugcagguaca

SEQ ID NO: 3555629 - RNA, 17 nt, Pseudomonas putida KT2440
gccaccagcauggcguc

SEQ ID NO: 3555630 - RNA, 20 nt, Pseudomonas putida KT2440
gccaccagcauggcgucggc

SEQ ID NO: 3555631 - RNA, 13 nt, Pseudomonas putida KT2440
gccaccagcgccg

SEQ ID NO: 3555632 - RNA, 12 nt, Pseudomonas putida KT2440
gccaccaggccu

SEQ ID NO: 3555633 - RNA, 16 nt, Pseudomonas putida KT2440
gccaccaggccuuuga

SEQ ID NO: 3555634 - RNA, 15 nt, Pseudomonas putida KT2440
gccaccaggcgcggc

SEQ ID NO: 3555635 - RNA, 15 nt, Pseudomonas putida KT2440
gccaccagugccggg

SEQ ID NO: 3555636 - RNA, 16 nt, Pseudomonas putida KT2440
gccaccagugccgggu

SEQ ID NO: 3555637 - RNA, 23 nt, Pseudomonas putida KT2440
gccaccaguucauggcucacacc

SEQ ID NO: 3555638 - RNA, 21 nt, Pseudomonas putida KT2440
gccaccaguuccaccggcaag

SEQ ID NO: 3555639 - RNA, 18 nt, Pseudomonas putida KT2440
gccaccaucgaccuggcc

SEQ ID NO: 3555640 - RNA, 18 nt, Pseudomonas putida KT2440
gccaccaucgacucacgc

SEQ ID NO: 3555641 - RNA, 14 nt, Pseudomonas putida KT2440
gccaccaucgccgg

SEQ ID NO: 3555642 - RNA, 19 nt, Pseudomonas putida KT2440
gccaccaucuugcccaggg

SEQ ID NO: 3555643 - RNA, 22 nt, Pseudomonas putida KT2440
gccaccaucuugcccagggcug

SEQ ID NO: 3555644 - RNA, 16 nt, Pseudomonas putida KT2440
gccaccaugaacagca

SEQ ID NO: 3555645 - RNA, 18 nt, Pseudomonas putida KT2440
gccaccaugcucaccgcc

SEQ ID NO: 3555646 - RNA, 17 nt, Pseudomonas putida KT2440
gccaccaugcucggcca

SEQ ID NO: 3555647 - RNA, 19 nt, Pseudomonas putida KT2440
gccaccaugcucggccagc

SEQ ID NO: 3555648 - RNA, 19 nt, Pseudomonas putida KT2440
gccacccaaggcauccagc

SEQ ID NO: 3555649 - RNA, 24 nt, Pseudomonas putida KT2440
gccacccaaggcauccagcucggc

SEQ ID NO: 3555650 - RNA, 13 nt, Pseudomonas putida KT2440
gccacccacaggc

SEQ ID NO: 3555651 - RNA, 17 nt, Pseudomonas putida KT2440
gccacccaccacggccu

SEQ ID NO: 3555652 - RNA, 21 nt, Pseudomonas putida KT2440
gccacccagaacagccacagc

SEQ ID NO: 3555653 - RNA, 18 nt, Pseudomonas putida KT2440
gccacccagaugcgggcc

SEQ ID NO: 3555654 - RNA, 19 nt, Pseudomonas putida KT2440
gccacccagaugcgggccc

SEQ ID NO: 3555655 - RNA, 22 nt, Pseudomonas putida KT2440
gccacccagaugcgggcccugg

SEQ ID NO: 3555656 - RNA, 22 nt, Pseudomonas putida KT2440
gccacccaggcauacagcuggc

SEQ ID NO: 3555657 - RNA, 14 nt, Pseudomonas putida KT2440
gccacccaggcccu

SEQ ID NO: 3555658 - RNA, 22 nt, Pseudomonas putida KT2440
gccacccaggcccugacgccag

SEQ ID NO: 3555659 - RNA, 13 nt, Pseudomonas putida KT2440
gccaccccaggcc

SEQ ID NO: 3555660 - RNA, 14 nt, Pseudomonas putida KT2440
gccaccccaggcca

SEQ ID NO: 3555661 - RNA, 15 nt, Pseudomonas putida KT2440
gccaccccaggccac

SEQ ID NO: 3555662 - RNA, 19 nt, Pseudomonas putida KT2440
gccaccccaggccacuggu

SEQ ID NO: 3555663 - RNA, 16 nt, Pseudomonas putida KT2440
gccacccccgccgcca

SEQ ID NO: 3555664 - RNA, 20 nt, Pseudomonas putida KT2440
gccacccccgccgccagggc

SEQ ID NO: 3555665 - RNA, 20 nt, Pseudomonas putida KT2440
gccaccccgcaaagcccugc

SEQ ID NO: 3555666 - RNA, 21 nt, Pseudomonas putida KT2440
gccaccccgcaaagcccugcc

SEQ ID NO: 3555667 - RNA, 13 nt, Pseudomonas putida KT2440
gccacccgcucug

SEQ ID NO: 3555668 - RNA, 14 nt, Pseudomonas putida KT2440
gccacccgcugggc

SEQ ID NO: 3555669 - RNA, 15 nt, Pseudomonas putida KT2440
gccacccgcugggcu

SEQ ID NO: 3555670 - RNA, 18 nt, Pseudomonas putida KT2440
gccacccggaccagcgcc

SEQ ID NO: 3555671 - RNA, 15 nt, Pseudomonas putida KT2440
gccacccggcugcau

SEQ ID NO: 3555672 - RNA, 20 nt, Pseudomonas putida KT2440
gccacccggcugcauccacc

SEQ ID NO: 3555673 - RNA, 21 nt, Pseudomonas putida KT2440
gccaccgacuccggcaaggca

SEQ ID NO: 3555674 - RNA, 16 nt, Pseudomonas putida KT2440
gccaccgaucucgcca

SEQ ID NO: 3555675 - RNA, 22 nt, Pseudomonas putida KT2440
gccagaaccaggauauugccga

SEQ ID NO: 3555676 - RNA, 14 nt, Pseudomonas putida KT2440
gccagaaggcucag

SEQ ID NO: 3555677 - RNA, 17 nt, Pseudomonas putida KT2440
gccagacaacuggccag

SEQ ID NO: 3555678 - RNA, 19 nt, Pseudomonas putida KT2440
gccagacauugaagaagcc

SEQ ID NO: 3555679 - RNA, 22 nt, Pseudomonas putida KT2440
gccagaccaccucaucccccgg

SEQ ID NO: 3555680 - RNA, 21 nt, Pseudomonas putida KT2440
gccagaccacggugucgucgc

SEQ ID NO: 3555681 - RNA, 15 nt, Pseudomonas putida KT2440
gccagaccuugcgca

SEQ ID NO: 3555682 - RNA, 22 nt, Pseudomonas putida KT2440
gccagaccuugcgcacggccuc

SEQ ID NO: 3555683 - RNA, 17 nt, Pseudomonas putida KT2440
gccagacgaccagcaug

SEQ ID NO: 3555684 - RNA, 17 nt, Pseudomonas putida KT2440
gccagacgcgcgcuggc

SEQ ID NO: 3555685 - RNA, 16 nt, Pseudomonas putida KT2440
gccagagcgcgccacg

SEQ ID NO: 3555686 - RNA, 17 nt, Pseudomonas putida KT2440
gccagaucggccagcuu

SEQ ID NO: 3555687 - RNA, 19 nt, Pseudomonas putida KT2440
gccagcaaaugcccacugc

SEQ ID NO: 3555688 - RNA, 19 nt, Pseudomonas putida KT2440
gccagcaacaagcuggaca

SEQ ID NO: 3555689 - RNA, 12 nt, Pseudomonas putida KT2440
gccagcaacgca

SEQ ID NO: 3555690 - RNA, 14 nt, Pseudomonas putida KT2440
gccagcaacgcagc

SEQ ID NO: 3555691 - RNA, 20 nt, Pseudomonas putida KT2440
gccagcaauugcgagguacc

SEQ ID NO: 3555692 - RNA, 21 nt, Pseudomonas putida KT2440
gccagcaauugcgagguaccg

SEQ ID NO: 3555693 - RNA, 14 nt, Pseudomonas putida KT2440
gccagcacaagccg

SEQ ID NO: 3555694 - RNA, 13 nt, Pseudomonas putida KT2440
gccagcaccagcg

SEQ ID NO: 3555695 - RNA, 17 nt, Pseudomonas putida KT2440
gccagcaccagcgcgau

SEQ ID NO: 3555696 - RNA, 19 nt, Pseudomonas putida KT2440
gccagcaccaucaggcaca

SEQ ID NO: 3555697 - RNA, 23 nt, Pseudomonas putida KT2440
gccagcaccaucaggcacaggcc

SEQ ID NO: 3555698 - RNA, 14 nt, Pseudomonas putida KT2440
gccagcaccuggcg

SEQ ID NO: 3555699 - RNA, 18 nt, Pseudomonas putida KT2440
gccagcacgaucaugggg

SEQ ID NO: 3555700 - RNA, 21 nt, Pseudomonas putida KT2440
gccagcacgaucauggggaug

SEQ ID NO: 3555701 - RNA, 16 nt, Pseudomonas putida KT2440
gccagcacgcaggcca

SEQ ID NO: 3555702 - RNA, 19 nt, Pseudomonas putida KT2440
gccagcacgcaggccagcg

SEQ ID NO: 3555703 - RNA, 21 nt, Pseudomonas putida KT2440
gccagcacgcaggccagcgca

SEQ ID NO: 3555704 - RNA, 13 nt, Pseudomonas putida KT2440
gccagcacgccgg

SEQ ID NO: 3555705 - RNA, 20 nt, Pseudomonas putida KT2440
gccagcacguucucgcucag

SEQ ID NO: 3555706 - RNA, 20 nt, Pseudomonas putida KT2440
gccagcacuacgccggccaa

SEQ ID NO: 3555707 - RNA, 22 nt, Pseudomonas putida KT2440
gccagcacuacgccggccaagg

SEQ ID NO: 3555708 - RNA, 14 nt, Pseudomonas putida KT2440
gccagcagauggcu

SEQ ID NO: 3555709 - RNA, 23 nt, Pseudomonas putida KT2440
gccagcagauggcucaucgccgu

SEQ ID NO: 3555710 - RNA, 16 nt, Pseudomonas putida KT2440
gccagcagccccccuu

SEQ ID NO: 3555711 - RNA, 17 nt, Pseudomonas putida KT2440
gccagcagccccccuuc

SEQ ID NO: 3555712 - RNA, 13 nt, Pseudomonas putida KT2440
gccagcagccugu

SEQ ID NO: 3555713 - RNA, 21 nt, Pseudomonas putida KT2440
gccagcagccugugcggcucc

SEQ ID NO: 3555714 - RNA, 13 nt, Pseudomonas putida KT2440
gccagcagcgcau

SEQ ID NO: 3555715 - RNA, 22 nt, Pseudomonas putida KT2440
gccagcagcgcauggcucaacu

SEQ ID NO: 3555716 - RNA, 12 nt, Pseudomonas putida KT2440
gccagcagcgcg

SEQ ID NO: 3555717 - RNA, 22 nt, Pseudomonas putida KT2440
gccagcagcggguuccccagca

SEQ ID NO: 3555718 - RNA, 23 nt, Pseudomonas putida KT2440
gccagcagcggguuccccagcaa

SEQ ID NO: 3555719 - RNA, 14 nt, Pseudomonas putida KT2440
gccagcagcuccau

SEQ ID NO: 3555720 - RNA, 16 nt, Pseudomonas putida KT2440
gccagcagcuccauac

SEQ ID NO: 3555721 - RNA, 18 nt, Pseudomonas putida KT2440
gccagcagcuccauacca

SEQ ID NO: 3555722 - RNA, 14 nt, Pseudomonas putida KT2440
gccagcagcuggcu

SEQ ID NO: 3555723 - RNA, 18 nt, Pseudomonas putida KT2440
gccagcagcuggcuuguc

SEQ ID NO: 3555724 - RNA, 22 nt, Pseudomonas putida KT2440
gccagcaggacgauaccguugu

SEQ ID NO: 3555725 - RNA, 11 nt, Pseudomonas putida KT2440
gccagcaggcc

SEQ ID NO: 3555726 - RNA, 14 nt, Pseudomonas putida KT2440
gccagcaggccacc

SEQ ID NO: 3555727 - RNA, 17 nt, Pseudomonas putida KT2440
gccagcaggccaccggc

SEQ ID NO: 3555728 - RNA, 19 nt, Pseudomonas putida KT2440
gccagcaggccaccggcag

SEQ ID NO: 3555729 - RNA, 13 nt, Pseudomonas putida KT2440
gccagcaggcccg

SEQ ID NO: 3555730 - RNA, 23 nt, Pseudomonas putida KT2440
gccagcaggcccggcccauucgc

SEQ ID NO: 3555731 - RNA, 13 nt, Pseudomonas putida KT2440
gccagcaggccgc

SEQ ID NO: 3555732 - RNA, 15 nt, Pseudomonas putida KT2440
gccagcaggccgccg

SEQ ID NO: 3555733 - RNA, 16 nt, Pseudomonas putida KT2440
gccagcaggccgccga

SEQ ID NO: 3555734 - RNA, 20 nt, Pseudomonas putida KT2440
gccagcagggcaggggacag

SEQ ID NO: 3555735 - RNA, 18 nt, Pseudomonas putida KT2440
gccagcagggccgcccuu

SEQ ID NO: 3555736 - RNA, 14 nt, Pseudomonas putida KT2440
gccagcagggccgg

SEQ ID NO: 3555737 - RNA, 23 nt, Pseudomonas putida KT2440
gccagcagggccggcccuuucgc

SEQ ID NO: 3555738 - RNA, 15 nt, Pseudomonas putida KT2440
gccagcaggucagca

SEQ ID NO: 3555739 - RNA, 21 nt, Pseudomonas putida KT2440
gccagcaggucagcacgcgcu

SEQ ID NO: 3555740 - RNA, 23 nt, Pseudomonas putida KT2440
gccagcaggucaggcccuuucgc

SEQ ID NO: 3555741 - RNA, 19 nt, Pseudomonas putida KT2440
gccagcagugcaucgaagc

SEQ ID NO: 3555742 - RNA, 20 nt, Pseudomonas putida KT2440
gccagcagugcaucgaagca

SEQ ID NO: 3555743 - RNA, 16 nt, Pseudomonas putida KT2440
gccagcagugcggcaa

SEQ ID NO: 3555744 - RNA, 18 nt, Pseudomonas putida KT2440
gccagcaguucgcagcca

SEQ ID NO: 3555745 - RNA, 19 nt, Pseudomonas putida KT2440
gccagcaguuucagcggcc

SEQ ID NO: 3555746 - RNA, 20 nt, Pseudomonas putida KT2440
gccagcaguuucagcggccg

SEQ ID NO: 3555747 - RNA, 14 nt, Pseudomonas putida KT2440
gccagcaucacgcc

SEQ ID NO: 3555748 - RNA, 16 nt, Pseudomonas putida KT2440
gccagcaucacgccgc

SEQ ID NO: 3555749 - RNA, 18 nt, Pseudomonas putida KT2440
gccagcaucacgccgcgc

SEQ ID NO: 3555750 - RNA, 14 nt, Pseudomonas putida KT2440
gccagcaugcuggu

SEQ ID NO: 3555751 - RNA, 16 nt, Pseudomonas putida KT2440
gccagcaugcugguua

SEQ ID NO: 3555752 - RNA, 13 nt, Pseudomonas putida KT2440
gccagccaaccgc

SEQ ID NO: 3555753 - RNA, 12 nt, Pseudomonas putida KT2440
gccagccaacgc

SEQ ID NO: 3555754 - RNA, 19 nt, Pseudomonas putida KT2440
gccagccacagacgggucg

SEQ ID NO: 3555755 - RNA, 14 nt, Pseudomonas putida KT2440
gccagccaccacca

SEQ ID NO: 3555756 - RNA, 23 nt, Pseudomonas putida KT2440
gccagccacuccgccucguuggc

SEQ ID NO: 3555757 - RNA, 20 nt, Pseudomonas putida KT2440
gccagccagcagcguaccca

SEQ ID NO: 3555758 - RNA, 23 nt, Pseudomonas putida KT2440
gccagccagguauggccagagcg

SEQ ID NO: 3555759 - RNA, 18 nt, Pseudomonas putida KT2440
gccagccaguacggcagc

SEQ ID NO: 3555760 - RNA, 22 nt, Pseudomonas putida KT2440
gccagccauuccuugcgcggcg

SEQ ID NO: 3555761 - RNA, 15 nt, Pseudomonas putida KT2440
gccagcccauccagg

SEQ ID NO: 3555762 - RNA, 18 nt, Pseudomonas putida KT2440
gccagcccauccagggcu

SEQ ID NO: 3555763 - RNA, 14 nt, Pseudomonas putida KT2440
gccagcccauggcg

SEQ ID NO: 3555764 - RNA, 15 nt, Pseudomonas putida KT2440
gccagcccauggcgc

SEQ ID NO: 3555765 - RNA, 21 nt, Pseudomonas putida KT2440
gccagccccaacccaccagca

SEQ ID NO: 3555766 - RNA, 15 nt, Pseudomonas putida KT2440
gccagccccagcggc

SEQ ID NO: 3555767 - RNA, 17 nt, Pseudomonas putida KT2440
gccagccccagcggcag

SEQ ID NO: 3555768 - RNA, 20 nt, Pseudomonas putida KT2440
gccagccccagcggcagcag

SEQ ID NO: 3555769 - RNA, 22 nt, Pseudomonas putida KT2440
gccagccccagcggcagcagca

SEQ ID NO: 3555770 - RNA, 23 nt, Pseudomonas putida KT2440
gccagccccagcggcagcagcag

SEQ ID NO: 3555771 - RNA, 16 nt, Pseudomonas putida KT2440
gccagcccggcggcca

SEQ ID NO: 3555772 - RNA, 15 nt, Pseudomonas putida KT2440
gccagcccugccgag

SEQ ID NO: 3555773 - RNA, 17 nt, Pseudomonas putida KT2440
gccagccgcaggcgccc

SEQ ID NO: 3555774 - RNA, 15 nt, Pseudomonas putida KT2440
gccagccgcgccagg

SEQ ID NO: 3555775 - RNA, 16 nt, Pseudomonas putida KT2440
gccagccgcucagcca

SEQ ID NO: 3555776 - RNA, 14 nt, Pseudomonas putida KT2440
gccagccggcagca

SEQ ID NO: 3555777 - RNA, 20 nt, Pseudomonas putida KT2440
gccagccggcagcaaggcau

SEQ ID NO: 3555778 - RNA, 16 nt, Pseudomonas putida KT2440
gccagccggcgcauca

SEQ ID NO: 3555779 - RNA, 22 nt, Pseudomonas putida KT2440
gccagccggcgcaucagugccg

SEQ ID NO: 3555780 - RNA, 23 nt, Pseudomonas putida KT2440
gccagccguugcgccgcucgccc

SEQ ID NO: 3555781 - RNA, 22 nt, Pseudomonas putida KT2440
gccagccguuguacaagcuggc

SEQ ID NO: 3555782 - RNA, 21 nt, Pseudomonas putida KT2440
gccagccucuucuucaaggcu

SEQ ID NO: 3555783 - RNA, 21 nt, Pseudomonas putida KT2440
gccagccugcagcgcggcgau

SEQ ID NO: 3555784 - RNA, 19 nt, Pseudomonas putida KT2440
gccagccuucgccaacugc

SEQ ID NO: 3555785 - RNA, 20 nt, Pseudomonas putida KT2440
gccagccuucgccaacugca

SEQ ID NO: 3555786 - RNA, 24 nt, Pseudomonas putida KT2440
gccagcgauaaaccagcagcgccu

SEQ ID NO: 3555787 - RNA, 15 nt, Pseudomonas putida KT2440
gccagcgcaucggcc

SEQ ID NO: 3555788 - RNA, 23 nt, Pseudomonas putida KT2440
gccagcgcaucggccacuucgcg

SEQ ID NO: 3555789 - RNA, 15 nt, Pseudomonas putida KT2440
gccagcgcaugcauc

SEQ ID NO: 3555790 - RNA, 14 nt, Pseudomonas putida KT2440
gccagcgccucacc

SEQ ID NO: 3555791 - RNA, 17 nt, Pseudomonas putida KT2440
gccagcgccugcaggcc

SEQ ID NO: 3555792 - RNA, 23 nt, Pseudomonas putida KT2440
gccagcgccugcaggcccaggug

SEQ ID NO: 3555793 - RNA, 17 nt, Pseudomonas putida KT2440
gccagcgccugcugcca

SEQ ID NO: 3555794 - RNA, 18 nt, Pseudomonas putida KT2440
gccagcgccugcugccag

SEQ ID NO: 3555795 - RNA, 21 nt, Pseudomonas putida KT2440
gccagcgccugcugccaggcc

SEQ ID NO: 3555796 - RNA, 15 nt, Pseudomonas putida KT2440
gccagcgccuggcga

SEQ ID NO: 3555797 - RNA, 18 nt, Pseudomonas putida KT2440
gccagcgccuggcgcagu

SEQ ID NO: 3555798 - RNA, 21 nt, Pseudomonas putida KT2440
gccagcgcgcugcgcaaggac

SEQ ID NO: 3555799 - RNA, 17 nt, Pseudomonas putida KT2440
gccagcgcgguagcugc

SEQ ID NO: 3555800 - RNA, 14 nt, Pseudomonas putida KT2440
gccagcgcuccagc

SEQ ID NO: 3555801 - RNA, 20 nt, Pseudomonas putida KT2440
gccagcgcuccagcaacgga

SEQ ID NO: 3555802 - RNA, 15 nt, Pseudomonas putida KT2440
gccagcggaaucacc

SEQ ID NO: 3555803 - RNA, 22 nt, Pseudomonas putida KT2440
gccagcggcaguugcaggcgca

SEQ ID NO: 3555804 - RNA, 14 nt, Pseudomonas putida KT2440
gccagcggccagcg

SEQ ID NO: 3555805 - RNA, 13 nt, Pseudomonas putida KT2440
gccagcggcgaug

SEQ ID NO: 3555806 - RNA, 18 nt, Pseudomonas putida KT2440
gccagcggcgaugcucag

SEQ ID NO: 3555807 - RNA, 15 nt, Pseudomonas putida KT2440
gccagcggcgcggcc

SEQ ID NO: 3555808 - RNA, 19 nt, Pseudomonas putida KT2440
gccagcggcucgaccaagc

SEQ ID NO: 3555809 - RNA, 22 nt, Pseudomonas putida KT2440
gccagcggcucgaccaagccug

SEQ ID NO: 3555810 - RNA, 13 nt, Pseudomonas putida KT2440
gccagcggugcca

SEQ ID NO: 3555811 - RNA, 16 nt, Pseudomonas putida KT2440
gccagcguaagcuggc

SEQ ID NO: 3555812 - RNA, 22 nt, Pseudomonas putida KT2440
gccagcgucagggucucgcggc

SEQ ID NO: 3555813 - RNA, 18 nt, Pseudomonas putida KT2440
gccagcgucuuuggccug

SEQ ID NO: 3555814 - RNA, 20 nt, Pseudomonas putida KT2440
gccagcgucuuuggccugcu

SEQ ID NO: 3555815 - RNA, 21 nt, Pseudomonas putida KT2440
gccagcgucuuuggccugcuu

SEQ ID NO: 3555816 - RNA, 18 nt, Pseudomonas putida KT2440
gccagcgugaaccggcug

SEQ ID NO: 3555817 - RNA, 19 nt, Pseudomonas putida KT2440
gccagcgugaaccggcugu

SEQ ID NO: 3555818 - RNA, 16 nt, Pseudomonas putida KT2440
gccagcguggccgcca

SEQ ID NO: 3555819 - RNA, 19 nt, Pseudomonas putida KT2440
gccagcguggccgccaaca

SEQ ID NO: 3555820 - RNA, 21 nt, Pseudomonas putida KT2440
gccagcguggccgccaacagc

SEQ ID NO: 3555821 - RNA, 19 nt, Pseudomonas putida KT2440
gccagcguucucgcucagg

SEQ ID NO: 3555822 - RNA, 15 nt, Pseudomonas putida KT2440
gccagcguuuccggg

SEQ ID NO: 3555823 - RNA, 18 nt, Pseudomonas putida KT2440
gccagcguuuccggguug

SEQ ID NO: 3555824 - RNA, 16 nt, Pseudomonas putida KT2440
gccagcuaucucccag

SEQ ID NO: 3555825 - RNA, 24 nt, Pseudomonas putida KT2440
gccagcuaucucccagccugggcg

SEQ ID NO: 3555826 - RNA, 14 nt, Pseudomonas putida KT2440
gccagcucauccag

SEQ ID NO: 3555827 - RNA, 16 nt, Pseudomonas putida KT2440
gccagcucauccagcc

SEQ ID NO: 3555828 - RNA, 13 nt, Pseudomonas putida KT2440
gccagcuccacca

SEQ ID NO: 3555829 - RNA, 17 nt, Pseudomonas putida KT2440
gccagcuccgacaggcu

SEQ ID NO: 3555830 - RNA, 17 nt, Pseudomonas putida KT2440
gccagcuccuggcucag

SEQ ID NO: 3555831 - RNA, 23 nt, Pseudomonas putida KT2440
gccagcuccuggcucaguggcug

SEQ ID NO: 3555832 - RNA, 18 nt, Pseudomonas putida KT2440
gccagcucggcaguggcg

SEQ ID NO: 3555833 - RNA, 21 nt, Pseudomonas putida KT2440
gccagcucggccgaugccagg

SEQ ID NO: 3555834 - RNA, 13 nt, Pseudomonas putida KT2440
gccagcugcgcac

SEQ ID NO: 3555835 - RNA, 18 nt, Pseudomonas putida KT2440
gccagcugcugccccaug

SEQ ID NO: 3555836 - RNA, 22 nt, Pseudomonas putida KT2440
gccagcugcugcggcaccucgu

SEQ ID NO: 3555837 - RNA, 14 nt, Pseudomonas putida KT2440
gccagcuucgacga

SEQ ID NO: 3555838 - RNA, 17 nt, Pseudomonas putida KT2440
gccagcuucgacgaaga

SEQ ID NO: 3555839 - RNA, 13 nt, Pseudomonas putida KT2440
gccagcuuggcuu

SEQ ID NO: 3555840 - RNA, 13 nt, Pseudomonas putida KT2440
gccaggaacagcg

SEQ ID NO: 3555841 - RNA, 17 nt, Pseudomonas putida KT2440
gccaggaacagcgcagc

SEQ ID NO: 3555842 - RNA, 19 nt, Pseudomonas putida KT2440
gccaggaacagcgcagcca

SEQ ID NO: 3555843 - RNA, 21 nt, Pseudomonas putida KT2440
gccaggaacagcgcagccacc

SEQ ID NO: 3555844 - RNA, 15 nt, Pseudomonas putida KT2440
gccaggaacagcgcc

SEQ ID NO: 3555845 - RNA, 16 nt, Pseudomonas putida KT2440
gccaggaacagcgcca

SEQ ID NO: 3555846 - RNA, 15 nt, Pseudomonas putida KT2440
gccaggaccgcggaa

SEQ ID NO: 3555847 - RNA, 17 nt, Pseudomonas putida KT2440
gccaggacgauggugaa

SEQ ID NO: 3555848 - RNA, 18 nt, Pseudomonas putida KT2440
gccaggagaacacccagc

SEQ ID NO: 3555849 - RNA, 22 nt, Pseudomonas putida KT2440
gccaggagaacacccagcgcau

SEQ ID NO: 3555850 - RNA, 14 nt, Pseudomonas putida KT2440
gccaggaucggcac

SEQ ID NO: 3555851 - RNA, 16 nt, Pseudomonas putida KT2440
gccaggauggcaccga

SEQ ID NO: 3555852 - RNA, 15 nt, Pseudomonas putida KT2440
gccaggauggcuuug

SEQ ID NO: 3555853 - RNA, 22 nt, Pseudomonas putida KT2440
gccaggcaaaguugagcgccgc

SEQ ID NO: 3555854 - RNA, 20 nt, Pseudomonas putida KT2440
gccaggcacagaucaacgcc

SEQ ID NO: 3555855 - RNA, 23 nt, Pseudomonas putida KT2440
gccaggcaccacaagaacugcga

SEQ ID NO: 3555856 - RNA, 14 nt, Pseudomonas putida KT2440
gccaggcacuggcc

SEQ ID NO: 3555857 - RNA, 15 nt, Pseudomonas putida KT2440
gccaggcacuggcca

SEQ ID NO: 3555858 - RNA, 17 nt, Pseudomonas putida KT2440
gccaggcacuggccagc

SEQ ID NO: 3555859 - RNA, 21 nt, Pseudomonas putida KT2440
gccaggcacuggccagcggcg

SEQ ID NO: 3555860 - RNA, 14 nt, Pseudomonas putida KT2440
gccaggcagcagac

SEQ ID NO: 3555861 - RNA, 20 nt, Pseudomonas putida KT2440
gccaggcaguuucaggcgcu

SEQ ID NO: 3555862 - RNA, 22 nt, Pseudomonas putida KT2440
gccaggcauugcccgcgauagc

SEQ ID NO: 3555863 - RNA, 17 nt, Pseudomonas putida KT2440
gccaggcauugcucgau

SEQ ID NO: 3555864 - RNA, 16 nt, Pseudomonas putida KT2440
gccaggccaaacaggc

SEQ ID NO: 3555865 - RNA, 17 nt, Pseudomonas putida KT2440
gccaggccaaacaggcc

SEQ ID NO: 3555866 - RNA, 13 nt, Pseudomonas putida KT2440
gccaggcccacca

SEQ ID NO: 3555867 - RNA, 12 nt, Pseudomonas putida KT2440
gccaggccccga

SEQ ID NO: 3555868 - RNA, 17 nt, Pseudomonas putida KT2440
gccaggccccuuggcca

SEQ ID NO: 3555869 - RNA, 23 nt, Pseudomonas putida KT2440
gccaggccccuuggccaacggca

SEQ ID NO: 3555870 - RNA, 18 nt, Pseudomonas putida KT2440
gccaggccgauggcgaug

SEQ ID NO: 3555871 - RNA, 15 nt, Pseudomonas putida KT2440
gccaggccggcgcag

SEQ ID NO: 3555872 - RNA, 16 nt, Pseudomonas putida KT2440
gccaggccggcgcaga

SEQ ID NO: 3555873 - RNA, 17 nt, Pseudomonas putida KT2440
gccaggccggcgcagau

SEQ ID NO: 3555874 - RNA, 21 nt, Pseudomonas putida KT2440
gccaggccggcgcagauggug

SEQ ID NO: 3555875 - RNA, 16 nt, Pseudomonas putida KT2440
gccaggccgugcuuga

SEQ ID NO: 3555876 - RNA, 15 nt, Pseudomonas putida KT2440
gccaggccucaagcc

SEQ ID NO: 3555877 - RNA, 14 nt, Pseudomonas putida KT2440
gccaggcgcaggcc

SEQ ID NO: 3555878 - RNA, 13 nt, Pseudomonas putida KT2440
gccaggcgcagug

SEQ ID NO: 3555879 - RNA, 18 nt, Pseudomonas putida KT2440
gccaggcguauucggcca

SEQ ID NO: 3555880 - RNA, 23 nt, Pseudomonas putida KT2440
gccaggcguauucggccaccagc

SEQ ID NO: 3555881 - RNA, 18 nt, Pseudomonas putida KT2440
gccaggcucgacggcgca

SEQ ID NO: 3555882 - RNA, 13 nt, Pseudomonas putida KT2440
gccaggcucucca

SEQ ID NO: 3555883 - RNA, 16 nt, Pseudomonas putida KT2440
gccaggcucuccagcc

SEQ ID NO: 3555884 - RNA, 23 nt, Pseudomonas putida KT2440
gccaggcucuccagccgcugcug

SEQ ID NO: 3555885 - RNA, 18 nt, Pseudomonas putida KT2440
gccauccgguaugcccau

SEQ ID NO: 3555886 - RNA, 23 nt, Pseudomonas putida KT2440
gccauccguuacaauaccgacaa

SEQ ID NO: 3555887 - RNA, 20 nt, Pseudomonas putida KT2440
gccauccucggccaggccca

SEQ ID NO: 3555888 - RNA, 14 nt, Pseudomonas putida KT2440
gccaucgagcaccg

SEQ ID NO: 3555889 - RNA, 15 nt, Pseudomonas putida KT2440
gccaucgcccacggc

SEQ ID NO: 3555890 - RNA, 17 nt, Pseudomonas putida KT2440
gccaucgcccacggcga

SEQ ID NO: 3555891 - RNA, 21 nt, Pseudomonas putida KT2440
gccaucgccucggcacugcac

SEQ ID NO: 3555892 - RNA, 14 nt, Pseudomonas putida KT2440
gccaucggcacgcc

SEQ ID NO: 3555893 - RNA, 15 nt, Pseudomonas putida KT2440
gccaucggcacgcca

SEQ ID NO: 3555894 - RNA, 11 nt, Pseudomonas putida KT2440
gccaucggccu

SEQ ID NO: 3555895 - RNA, 17 nt, Pseudomonas putida KT2440
gccaucggugccgugca

SEQ ID NO: 3555896 - RNA, 17 nt, Pseudomonas putida KT2440
gccaucucaaucgcaug

SEQ ID NO: 3555897 - RNA, 19 nt, Pseudomonas putida KT2440
gccaucucaaucgcaugca

SEQ ID NO: 3555898 - RNA, 15 nt, Pseudomonas putida KT2440
gccaucucgccaagc

SEQ ID NO: 3555899 - RNA, 12 nt, Pseudomonas putida KT2440
gccaucuucacg

SEQ ID NO: 3555900 - RNA, 20 nt, Pseudomonas putida KT2440
gccaugaacaccaccgcgaa

SEQ ID NO: 3555901 - RNA, 21 nt, Pseudomonas putida KT2440
gccaugaacaccaccgcgaaa

SEQ ID NO: 3555902 - RNA, 15 nt, Pseudomonas putida KT2440
gccaugaucagcgcc

SEQ ID NO: 3555903 - RNA, 14 nt, Pseudomonas putida KT2440
gccaugaucgccgc

SEQ ID NO: 3555904 - RNA, 16 nt, Pseudomonas putida KT2440
gccaugaucgccgccg

SEQ ID NO: 3555905 - RNA, 17 nt, Pseudomonas putida KT2440
gccaugcaggucgacga

SEQ ID NO: 3555906 - RNA, 12 nt, Pseudomonas putida KT2440
gccaugccccua

SEQ ID NO: 3555907 - RNA, 13 nt, Pseudomonas putida KT2440
gccaugccccuac

SEQ ID NO: 3555908 - RNA, 20 nt, Pseudomonas putida KT2440
gccaugcccgcccgggcuuu

SEQ ID NO: 3555909 - RNA, 13 nt, Pseudomonas putida KT2440
gccaugccgccga

SEQ ID NO: 3555910 - RNA, 17 nt, Pseudomonas putida KT2440
gccaugcugcgccagga

SEQ ID NO: 3555911 - RNA, 18 nt, Pseudomonas putida KT2440
gccauggccgaucuucag

SEQ ID NO: 3555912 - RNA, 17 nt, Pseudomonas putida KT2440
gccauggcgggcgacga

SEQ ID NO: 3555913 - RNA, 13 nt, Pseudomonas putida KT2440
gccaugggcagag

SEQ ID NO: 3555914 - RNA, 22 nt, Pseudomonas putida KT2440
gccauggucgcguuguucagca

SEQ ID NO: 3555915 - RNA, 16 nt, Pseudomonas putida KT2440
gccaugguuuugggca

SEQ ID NO: 3555916 - RNA, 18 nt, Pseudomonas putida KT2440
gccauguacguugccaga

SEQ ID NO: 3555917 - RNA, 14 nt, Pseudomonas putida KT2440
gccaugugcuggcg

SEQ ID NO: 3555918 - RNA, 15 nt, Pseudomonas putida KT2440
gccauguugcgcagc

SEQ ID NO: 3555919 - RNA, 16 nt, Pseudomonas putida KT2440
gccauguugcgcagca

SEQ ID NO: 3555920 - RNA, 17 nt, Pseudomonas putida KT2440
gccauguugcgcagcaa

SEQ ID NO: 3555921 - RNA, 15 nt, Pseudomonas putida KT2440
gccauucaccagcuu

SEQ ID NO: 3555922 - RNA, 14 nt, Pseudomonas putida KT2440
gccauucaucaucg

SEQ ID NO: 3555923 - RNA, 15 nt, Pseudomonas putida KT2440
gccauuccaggcuag

SEQ ID NO: 3555924 - RNA, 16 nt, Pseudomonas putida KT2440
gccauuccggcugcag

SEQ ID NO: 3555925 - RNA, 14 nt, Pseudomonas putida KT2440
gccauuccuugcgc

SEQ ID NO: 3555926 - RNA, 16 nt, Pseudomonas putida KT2440
gccauucgcgggcaug

SEQ ID NO: 3555927 - RNA, 22 nt, Pseudomonas putida KT2440
gccauucguccgaccaacggua

SEQ ID NO: 3555928 - RNA, 12 nt, Pseudomonas putida KT2440
gccauucucgau

SEQ ID NO: 3555929 - RNA, 15 nt, Pseudomonas putida KT2440
gccauugacccgcuu

SEQ ID NO: 3555930 - RNA, 17 nt, Pseudomonas putida KT2440
gccauugaccuugguga

SEQ ID NO: 3555931 - RNA, 20 nt, Pseudomonas putida KT2440
gccauugaggaaguagaaca

SEQ ID NO: 3555932 - RNA, 17 nt, Pseudomonas putida KT2440
gccauugaggcuguggc

SEQ ID NO: 3555933 - RNA, 20 nt, Pseudomonas putida KT2440
gccauugaggcuguggccca

SEQ ID NO: 3555934 - RNA, 18 nt, Pseudomonas putida KT2440
gccauugaucaccuccac

SEQ ID NO: 3555935 - RNA, 15 nt, Pseudomonas putida KT2440
gccauugcaccaccc

SEQ ID NO: 3555936 - RNA, 21 nt, Pseudomonas putida KT2440
gccauugcaccacccccagcg

SEQ ID NO: 3555937 - RNA, 17 nt, Pseudomonas putida KT2440
gccauugcccaguucgu

SEQ ID NO: 3555938 - RNA, 23 nt, Pseudomonas putida KT2440
gccauuggccgcgcgcccaucug

SEQ ID NO: 3555939 - RNA, 20 nt, Pseudomonas putida KT2440
gccauuggggcugcauugca

SEQ ID NO: 3555940 - RNA, 16 nt, Pseudomonas putida KT2440
gccauuggugccaccg

SEQ ID NO: 3555941 - RNA, 18 nt, Pseudomonas putida KT2440
gccauuucuucagcagga

SEQ ID NO: 3555942 - RNA, 19 nt, Pseudomonas putida KT2440
gccauuucuucagcaggaa

SEQ ID NO: 3555943 - RNA, 14 nt, Pseudomonas putida KT2440
gccauuugcucgac

SEQ ID NO: 3555944 - RNA, 13 nt, Pseudomonas putida KT2440
gcccaaacagcau

SEQ ID NO: 3555945 - RNA, 17 nt, Pseudomonas putida KT2440
gcccaaagaaaagcccg

SEQ ID NO: 3555946 - RNA, 12 nt, Pseudomonas putida KT2440
gcccaaagcccg

SEQ ID NO: 3555947 - RNA, 13 nt, Pseudomonas putida KT2440
gcccaacccagcc

SEQ ID NO: 3555948 - RNA, 16 nt, Pseudomonas putida KT2440
gcccaacccagccagc

SEQ ID NO: 3555949 - RNA, 23 nt, Pseudomonas putida KT2440
gcccaacccagccagcgacagca

SEQ ID NO: 3555950 - RNA, 15 nt, Pseudomonas putida KT2440
gcccaaccccagcgc

SEQ ID NO: 3555951 - RNA, 17 nt, Pseudomonas putida KT2440
gcccaaccccagcgcgu

SEQ ID NO: 3555952 - RNA, 23 nt, Pseudomonas putida KT2440
gcccaaccccagcgcguacagcg

SEQ ID NO: 3555953 - RNA, 17 nt, Pseudomonas putida KT2440
gcccaaccccaggcgca

SEQ ID NO: 3555954 - RNA, 20 nt, Pseudomonas putida KT2440
gcccaaccguuccugcagga

SEQ ID NO: 3555955 - RNA, 19 nt, Pseudomonas putida KT2440
gcccaacgaaaaaggcccu

SEQ ID NO: 3555956 - RNA, 17 nt, Pseudomonas putida KT2440
gcccaagccauccacca

SEQ ID NO: 3555957 - RNA, 22 nt, Pseudomonas putida KT2440
gcccaagcggcacuaccaggcc

SEQ ID NO: 3555958 - RNA, 13 nt, Pseudomonas putida KT2440
gcccaagcggcag

SEQ ID NO: 3555959 - RNA, 16 nt, Pseudomonas putida KT2440
gcccaaggcaccaacu

SEQ ID NO: 3555960 - RNA, 16 nt, Pseudomonas putida KT2440
gcccaaggcuggccag

SEQ ID NO: 3555961 - RNA, 17 nt, Pseudomonas putida KT2440
gcccaaggcuggccaga

SEQ ID NO: 3555962 - RNA, 14 nt, Pseudomonas putida KT2440
gcccaaggucagcc

SEQ ID NO: 3555963 - RNA, 12 nt, Pseudomonas putida KT2440
gcccaaggugca

SEQ ID NO: 3555964 - RNA, 19 nt, Pseudomonas putida KT2440
gcccaaguacaccggcagc

SEQ ID NO: 3555965 - RNA, 21 nt, Pseudomonas putida KT2440
gcccaaguacaccggcagcac

SEQ ID NO: 3555966 - RNA, 13 nt, Pseudomonas putida KT2440
gcccaauagacuu

SEQ ID NO: 3555967 - RNA, 16 nt, Pseudomonas putida KT2440
gcccaaucggguaaaa

SEQ ID NO: 3555968 - RNA, 17 nt, Pseudomonas putida KT2440
gcccaaucggguaaaac

SEQ ID NO: 3555969 - RNA, 16 nt, Pseudomonas putida KT2440
gcccaauuuggccagc

SEQ ID NO: 3555970 - RNA, 20 nt, Pseudomonas putida KT2440
gcccaauuuggccagcuucu

SEQ ID NO: 3555971 - RNA, 18 nt, Pseudomonas putida KT2440
gcccacaaguccgaacuc

SEQ ID NO: 3555972 - RNA, 19 nt, Pseudomonas putida KT2440
gcccacacggcaagccacg

SEQ ID NO: 3555973 - RNA, 20 nt, Pseudomonas putida KT2440
gcccacacggcaagccacgc

SEQ ID NO: 3555974 - RNA, 21 nt, Pseudomonas putida KT2440
gcccacagugcuuccagcagg

SEQ ID NO: 3555975 - RNA, 21 nt, Pseudomonas putida KT2440
gcccacagugucccggccagg

SEQ ID NO: 3555976 - RNA, 20 nt, Pseudomonas putida KT2440
gcccacaugcgagccgcugc

SEQ ID NO: 3555977 - RNA, 13 nt, Pseudomonas putida KT2440
gcccaccaccggu

SEQ ID NO: 3555978 - RNA, 15 nt, Pseudomonas putida KT2440
gcccaccaccuucuc

SEQ ID NO: 3555979 - RNA, 12 nt, Pseudomonas putida KT2440
gcccaccagcgc

SEQ ID NO: 3555980 - RNA, 16 nt, Pseudomonas putida KT2440
gcccaccagcugcacc

SEQ ID NO: 3555981 - RNA, 21 nt, Pseudomonas putida KT2440
gcccaccagcugcaccaccug

SEQ ID NO: 3555982 - RNA, 12 nt, Pseudomonas putida KT2440
gcccaccaggau

SEQ ID NO: 3555983 - RNA, 12 nt, Pseudomonas putida KT2440
gcccaccagguc

SEQ ID NO: 3555984 - RNA, 15 nt, Pseudomonas putida KT2440
gcccaccagucugcu

SEQ ID NO: 3555985 - RNA, 21 nt, Pseudomonas putida KT2440
gcccacccaaccgcgccagcu

SEQ ID NO: 3555986 - RNA, 16 nt, Pseudomonas putida KT2440
gcccacccggcugaaa

SEQ ID NO: 3555987 - RNA, 15 nt, Pseudomonas putida KT2440
gcccaccgacagccc

SEQ ID NO: 3555988 - RNA, 16 nt, Pseudomonas putida KT2440
gcccaccgacagcccg

SEQ ID NO: 3555989 - RNA, 16 nt, Pseudomonas putida KT2440
gcccaccgagcuuggg

SEQ ID NO: 3555990 - RNA, 16 nt, Pseudomonas putida KT2440
gcccaccgaucacggg

SEQ ID NO: 3555991 - RNA, 15 nt, Pseudomonas putida KT2440
gccccgauacagcgc

SEQ ID NO: 3555992 - RNA, 19 nt, Pseudomonas putida KT2440
gccccgauacagcgcgccg

SEQ ID NO: 3555993 - RNA, 17 nt, Pseudomonas putida KT2440
gccccgcacaucacggc

SEQ ID NO: 3555994 - RNA, 19 nt, Pseudomonas putida KT2440
gccccgcacaucacggcgc

SEQ ID NO: 3555995 - RNA, 15 nt, Pseudomonas putida KT2440
gccccgcaccagacc

SEQ ID NO: 3555996 - RNA, 23 nt, Pseudomonas putida KT2440
gccccgcaccgcggaugcgccug

SEQ ID NO: 3555997 - RNA, 12 nt, Pseudomonas putida KT2440
gccccgcaggcc

SEQ ID NO: 3555998 - RNA, 14 nt, Pseudomonas putida KT2440
gccccgcaggccgc

SEQ ID NO: 3555999 - RNA, 16 nt, Pseudomonas putida KT2440
gccccgcaggccgccg

SEQ ID NO: 3556000 - RNA, 23 nt, Pseudomonas putida KT2440
gccccgcaugcucgcugcugccu

SEQ ID NO: 3556001 - RNA, 15 nt, Pseudomonas putida KT2440
gccccgccagcgccu

SEQ ID NO: 3556002 - RNA, 18 nt, Pseudomonas putida KT2440
gccccgcucgccuggcca

SEQ ID NO: 3556003 - RNA, 22 nt, Pseudomonas putida KT2440
gccccggauucacggaucagcc

SEQ ID NO: 3556004 - RNA, 23 nt, Pseudomonas putida KT2440
gccccggauucacggaucagccg

SEQ ID NO: 3556005 - RNA, 13 nt, Pseudomonas putida KT2440
gccccggcaauac

SEQ ID NO: 3556006 - RNA, 16 nt, Pseudomonas putida KT2440
gccccggcaauccugg

SEQ ID NO: 3556007 - RNA, 13 nt, Pseudomonas putida KT2440
gccccggccaggc

SEQ ID NO: 3556008 - RNA, 14 nt, Pseudomonas putida KT2440
gccccggccaggcc

SEQ ID NO: 3556009 - RNA, 17 nt, Pseudomonas putida KT2440
gccccggccaggccggc

SEQ ID NO: 3556010 - RNA, 12 nt, Pseudomonas putida KT2440
gccccggccagu

SEQ ID NO: 3556011 - RNA, 22 nt, Pseudomonas putida KT2440
gccccggccagugaagcucgau

SEQ ID NO: 3556012 - RNA, 14 nt, Pseudomonas putida KT2440
gccccggccugcac

SEQ ID NO: 3556013 - RNA, 15 nt, Pseudomonas putida KT2440
gccccggccugcaca

SEQ ID NO: 3556014 - RNA, 13 nt, Pseudomonas putida KT2440
gccccggcgccgc

SEQ ID NO: 3556015 - RNA, 17 nt, Pseudomonas putida KT2440
gccccggcgccgccagg

SEQ ID NO: 3556016 - RNA, 15 nt, Pseudomonas putida KT2440
gccccggcggcgcga

SEQ ID NO: 3556017 - RNA, 22 nt, Pseudomonas putida KT2440
gccccggcuaucucaggccagu

SEQ ID NO: 3556018 - RNA, 15 nt, Pseudomonas putida KT2440
gccccgggcaggcca

SEQ ID NO: 3556019 - RNA, 15 nt, Pseudomonas putida KT2440
gccccgggugcagcc

SEQ ID NO: 3556020 - RNA, 17 nt, Pseudomonas putida KT2440
gccccgggugcagccgc

SEQ ID NO: 3556021 - RNA, 14 nt, Pseudomonas putida KT2440
gccccgguccagca

SEQ ID NO: 3556022 - RNA, 15 nt, Pseudomonas putida KT2440
gccccgguccagcac

SEQ ID NO: 3556023 - RNA, 16 nt, Pseudomonas putida KT2440
gccccgguccagcaca

SEQ ID NO: 3556024 - RNA, 22 nt, Pseudomonas putida KT2440
gccccgguccagcacacugagc

SEQ ID NO: 3556025 - RNA, 14 nt, Pseudomonas putida KT2440
gccccggugcaucc

SEQ ID NO: 3556026 - RNA, 19 nt, Pseudomonas putida KT2440
gccccggugcauccaacgc

SEQ ID NO: 3556027 - RNA, 20 nt, Pseudomonas putida KT2440
gccccggugcauccaacgcu

SEQ ID NO: 3556028 - RNA, 22 nt, Pseudomonas putida KT2440
gccccgguucgcgagaaccggg

SEQ ID NO: 3556029 - RNA, 15 nt, Pseudomonas putida KT2440
gccccguauacccau

SEQ ID NO: 3556030 - RNA, 17 nt, Pseudomonas putida KT2440
gccccguauacccaucg

SEQ ID NO: 3556031 - RNA, 14 nt, Pseudomonas putida KT2440
gccccguccacagc

SEQ ID NO: 3556032 - RNA, 13 nt, Pseudomonas putida KT2440
gccccuaccgcca

SEQ ID NO: 3556033 - RNA, 14 nt, Pseudomonas putida KT2440
gccccuaccgccaa

SEQ ID NO: 3556034 - RNA, 15 nt, Pseudomonas putida KT2440
gccccuacgcugguu

SEQ ID NO: 3556035 - RNA, 21 nt, Pseudomonas putida KT2440
gccccucaaugcugccuccgc

SEQ ID NO: 3556036 - RNA, 23 nt, Pseudomonas putida KT2440
gccccucaaugcugccuccgcca

SEQ ID NO: 3556037 - RNA, 22 nt, Pseudomonas putida KT2440
gccccucauucaaagccugcuc

SEQ ID NO: 3556038 - RNA, 18 nt, Pseudomonas putida KT2440
gccccuccacccaccuug

SEQ ID NO: 3556039 - RNA, 22 nt, Pseudomonas putida KT2440
gccccuccacccaccuuggccc

SEQ ID NO: 3556040 - RNA, 18 nt, Pseudomonas putida KT2440
gccccucgaacagcgccg

SEQ ID NO: 3556041 - RNA, 20 nt, Pseudomonas putida KT2440
gccccucgaacagcgccggc

SEQ ID NO: 3556042 - RNA, 21 nt, Pseudomonas putida KT2440
gccccucgaccacgcacagcu

SEQ ID NO: 3556043 - RNA, 16 nt, Pseudomonas putida KT2440
gccccucgaucaacgu

SEQ ID NO: 3556044 - RNA, 16 nt, Pseudomonas putida KT2440
gccccugcaacagggc

SEQ ID NO: 3556045 - RNA, 15 nt, Pseudomonas putida KT2440
gccccugcaauuucu

SEQ ID NO: 3556046 - RNA, 14 nt, Pseudomonas putida KT2440
gccccugcacauca

SEQ ID NO: 3556047 - RNA, 12 nt, Pseudomonas putida KT2440
gccccugcaucc

SEQ ID NO: 3556048 - RNA, 13 nt, Pseudomonas putida KT2440
gccccugcauccg

SEQ ID NO: 3556049 - RNA, 13 nt, Pseudomonas putida KT2440
gccccugccagca

SEQ ID NO: 3556050 - RNA, 14 nt, Pseudomonas putida KT2440
gccccugccagcac

SEQ ID NO: 3556051 - RNA, 15 nt, Pseudomonas putida KT2440
gccccugccagcacc

SEQ ID NO: 3556052 - RNA, 21 nt, Pseudomonas putida KT2440
gccccugccagcaccagcgcg

SEQ ID NO: 3556053 - RNA, 15 nt, Pseudomonas putida KT2440
gccccugcgccgcca

SEQ ID NO: 3556054 - RNA, 18 nt, Pseudomonas putida KT2440
gccccugcgccgccaccu

SEQ ID NO: 3556055 - RNA, 13 nt, Pseudomonas putida KT2440
gccccugcggcug

SEQ ID NO: 3556056 - RNA, 20 nt, Pseudomonas putida KT2440
gccccugcggcugccccaac

SEQ ID NO: 3556057 - RNA, 22 nt, Pseudomonas putida KT2440
gccccugcuugaccauggcgau

SEQ ID NO: 3556058 - RNA, 16 nt, Pseudomonas putida KT2440
gccccuggcuguccca

SEQ ID NO: 3556059 - RNA, 19 nt, Pseudomonas putida KT2440
gccccuguaggaucggguu

SEQ ID NO: 3556060 - RNA, 15 nt, Pseudomonas putida KT2440
gccccugugggagcg

SEQ ID NO: 3556061 - RNA, 13 nt, Pseudomonas putida KT2440
gccccuguggggg

SEQ ID NO: 3556062 - RNA, 16 nt, Pseudomonas putida KT2440
gccccuucaaggggcc

SEQ ID NO: 3556063 - RNA, 16 nt, Pseudomonas putida KT2440
gccccuuccccaggcc

SEQ ID NO: 3556064 - RNA, 22 nt, Pseudomonas putida KT2440
gccccuuccgaccggucauaca

SEQ ID NO: 3556065 - RNA, 13 nt, Pseudomonas putida KT2440
gccccuuggcacg

SEQ ID NO: 3556066 - RNA, 17 nt, Pseudomonas putida KT2440
gccccuuggcacggcca

SEQ ID NO: 3556067 - RNA, 12 nt, Pseudomonas putida KT2440
gccccuuggcca

SEQ ID NO: 3556068 - RNA, 14 nt, Pseudomonas putida KT2440
gccccuuuagcagg

SEQ ID NO: 3556069 - RNA, 23 nt, Pseudomonas putida KT2440
gccccuuuagcaggcaagcccgc

SEQ ID NO: 3556070 - RNA, 18 nt, Pseudomonas putida KT2440
gcccgaaaccaugcaggu

SEQ ID NO: 3556071 - RNA, 16 nt, Pseudomonas putida KT2440
gcccgaaaccgccagc

SEQ ID NO: 3556072 - RNA, 22 nt, Pseudomonas putida KT2440
gcccgaaacugcgcucaaccag

SEQ ID NO: 3556073 - RNA, 12 nt, Pseudomonas putida KT2440
gcccgaacaaca

SEQ ID NO: 3556074 - RNA, 15 nt, Pseudomonas putida KT2440
gcccgaacagacaac

SEQ ID NO: 3556075 - RNA, 17 nt, Pseudomonas putida KT2440
gcccgaacgacacggca

SEQ ID NO: 3556076 - RNA, 21 nt, Pseudomonas putida KT2440
gcccgaagguguuugaccacc

SEQ ID NO: 3556077 - RNA, 17 nt, Pseudomonas putida KT2440
gcccgaccucacgcagg

SEQ ID NO: 3556078 - RNA, 13 nt, Pseudomonas putida KT2440
gcccgaccuuggc

SEQ ID NO: 3556079 - RNA, 15 nt, Pseudomonas putida KT2440
gcccgaccuuggcga

SEQ ID NO: 3556080 - RNA, 18 nt, Pseudomonas putida KT2440
gcccgacgcauauccgca

SEQ ID NO: 3556081 - RNA, 14 nt, Pseudomonas putida KT2440
gcccgagcaaggcg

SEQ ID NO: 3556082 - RNA, 19 nt, Pseudomonas putida KT2440
gcccgagcaaggcgcagcc

SEQ ID NO: 3556083 - RNA, 21 nt, Pseudomonas putida KT2440
gcccgagcccccgcugcucga

SEQ ID NO: 3556084 - RNA, 21 nt, Pseudomonas putida KT2440
gcccgaggaacggcuggcugc

SEQ ID NO: 3556085 - RNA, 23 nt, Pseudomonas putida KT2440
gcccgaggaacggcuggcugccg

SEQ ID NO: 3556086 - RNA, 18 nt, Pseudomonas putida KT2440
gcccgaucaccgacgugu

SEQ ID NO: 3556087 - RNA, 13 nt, Pseudomonas putida KT2440
gcccgaucagcca

SEQ ID NO: 3556088 - RNA, 12 nt, Pseudomonas putida KT2440
gcccgaucgccu

SEQ ID NO: 3556089 - RNA, 15 nt, Pseudomonas putida KT2440
gcccgauggccuuga

SEQ ID NO: 3556090 - RNA, 15 nt, Pseudomonas putida KT2440
gcccgaugggcgucg

SEQ ID NO: 3556091 - RNA, 18 nt, Pseudomonas putida KT2440
gcccgaugggcgucgccu

SEQ ID NO: 3556092 - RNA, 15 nt, Pseudomonas putida KT2440
gcccgcaacaaccug

SEQ ID NO: 3556093 - RNA, 13 nt, Pseudomonas putida KT2440
gcccgcaacagau

SEQ ID NO: 3556094 - RNA, 18 nt, Pseudomonas putida KT2440
gcccgcaacagaucccgc

SEQ ID NO: 3556095 - RNA, 23 nt, Pseudomonas putida KT2440
gcccgcaaccgaugaacccgcga

SEQ ID NO: 3556096 - RNA, 18 nt, Pseudomonas putida KT2440
gcccgcaaccucggccgc

SEQ ID NO: 3556097 - RNA, 21 nt, Pseudomonas putida KT2440
gcccgcucccacagguccagc

SEQ ID NO: 3556098 - RNA, 21 nt, Pseudomonas putida KT2440
gcccgcuccuacaggggaugc

SEQ ID NO: 3556099 - RNA, 19 nt, Pseudomonas putida KT2440
gcccgcuccuacagguucu

SEQ ID NO: 3556100 - RNA, 20 nt, Pseudomonas putida KT2440
gcccgcuccuacagguucug

SEQ ID NO: 3556101 - RNA, 12 nt, Pseudomonas putida KT2440
gcccgcucgcca

SEQ ID NO: 3556102 - RNA, 19 nt, Pseudomonas putida KT2440
gcccgcucggucagggcgg

SEQ ID NO: 3556103 - RNA, 16 nt, Pseudomonas putida KT2440
gcccgcucucacaggg

SEQ ID NO: 3556104 - RNA, 19 nt, Pseudomonas putida KT2440
gcccgcucucacagggacc

SEQ ID NO: 3556105 - RNA, 22 nt, Pseudomonas putida KT2440
gcccgcugcagucaaagccuuu

SEQ ID NO: 3556106 - RNA, 15 nt, Pseudomonas putida KT2440
gcccgcugcgccgag

SEQ ID NO: 3556107 - RNA, 20 nt, Pseudomonas putida KT2440
gcccgcuguugagcagcagc

SEQ ID NO: 3556108 - RNA, 16 nt, Pseudomonas putida KT2440
gcccgcuucaacagcu

SEQ ID NO: 3556109 - RNA, 18 nt, Pseudomonas putida KT2440
gcccgcuucaacagcuuc

SEQ ID NO: 3556110 - RNA, 17 nt, Pseudomonas putida KT2440
gcccgcuugcccgagga

SEQ ID NO: 3556111 - RNA, 22 nt, Pseudomonas putida KT2440
gcccgcuuuuggcugugcaccc

SEQ ID NO: 3556112 - RNA, 20 nt, Pseudomonas putida KT2440
gcccggacaacuuggcaccg

SEQ ID NO: 3556113 - RNA, 21 nt, Pseudomonas putida KT2440
gcccggacaggggaugcgcga

SEQ ID NO: 3556114 - RNA, 21 nt, Pseudomonas putida KT2440
gcccggacugcaccaggucca

SEQ ID NO: 3556115 - RNA, 19 nt, Pseudomonas putida KT2440
gcccggauggcggugaugc

SEQ ID NO: 3556116 - RNA, 13 nt, Pseudomonas putida KT2440
gcccggauggggc

SEQ ID NO: 3556117 - RNA, 15 nt, Pseudomonas putida KT2440
gcccggcaaucgcca

SEQ ID NO: 3556118 - RNA, 21 nt, Pseudomonas putida KT2440
gcccggcaaucgccaggcgca

SEQ ID NO: 3556119 - RNA, 22 nt, Pseudomonas putida KT2440
gcccggcaaucgccaggcgcac

SEQ ID NO: 3556120 - RNA, 23 nt, Pseudomonas putida KT2440
gcccggcaaucgggauggcaccg

SEQ ID NO: 3556121 - RNA, 22 nt, Pseudomonas putida KT2440
gcccggcacgguugcgcccggc

SEQ ID NO: 3556122 - RNA, 17 nt, Pseudomonas putida KT2440
gcccggcagaucgagcg

SEQ ID NO: 3556123 - RNA, 23 nt, Pseudomonas putida KT2440
gcccggcagaucgagcgccgccc

SEQ ID NO: 3556124 - RNA, 17 nt, Pseudomonas putida KT2440
gcccggcagguugcugg

SEQ ID NO: 3556125 - RNA, 22 nt, Pseudomonas putida KT2440
gcccggcagguugcuggccuug

SEQ ID NO: 3556126 - RNA, 22 nt, Pseudomonas putida KT2440
gcccggcauacuugggcgcagu

SEQ ID NO: 3556127 - RNA, 13 nt, Pseudomonas putida KT2440
gcccggcauccgc

SEQ ID NO: 3556128 - RNA, 14 nt, Pseudomonas putida KT2440
gcccggcaucgcuc

SEQ ID NO: 3556129 - RNA, 20 nt, Pseudomonas putida KT2440
gcccggccacgucgguggcg

SEQ ID NO: 3556130 - RNA, 12 nt, Pseudomonas putida KT2440
gcccggccagca

SEQ ID NO: 3556131 - RNA, 17 nt, Pseudomonas putida KT2440
gcccggccagcaggacg

SEQ ID NO: 3556132 - RNA, 11 nt, Pseudomonas putida KT2440
gcccggccagg

SEQ ID NO: 3556133 - RNA, 12 nt, Pseudomonas putida KT2440
gcccggccaggu

SEQ ID NO: 3556134 - RNA, 14 nt, Pseudomonas putida KT2440
gcccggccagguca

SEQ ID NO: 3556135 - RNA, 16 nt, Pseudomonas putida KT2440
gcccggcccauaccgu

SEQ ID NO: 3556136 - RNA, 19 nt, Pseudomonas putida KT2440
gcccggccgcgccaccggg

SEQ ID NO: 3556137 - RNA, 15 nt, Pseudomonas putida KT2440
gcccggcgagcgcag

SEQ ID NO: 3556138 - RNA, 12 nt, Pseudomonas putida KT2440
gcccggcgcaau

SEQ ID NO: 3556139 - RNA, 12 nt, Pseudomonas putida KT2440
gcccggcgcagc

SEQ ID NO: 3556140 - RNA, 13 nt, Pseudomonas putida KT2440
gcccggcgcagca

SEQ ID NO: 3556141 - RNA, 22 nt, Pseudomonas putida KT2440
gcccggcgcagcauaugcuggu

SEQ ID NO: 3556142 - RNA, 13 nt, Pseudomonas putida KT2440
gcccggcguucga

SEQ ID NO: 3556143 - RNA, 16 nt, Pseudomonas putida KT2440
gcccggcucaccgcag

SEQ ID NO: 3556144 - RNA, 17 nt, Pseudomonas putida KT2440
gcccggcucaccgcagc

SEQ ID NO: 3556145 - RNA, 18 nt, Pseudomonas putida KT2440
gcccggcucaccgcagcc

SEQ ID NO: 3556146 - RNA, 22 nt, Pseudomonas putida KT2440
gcccggcucaccgcagcccagc

SEQ ID NO: 3556147 - RNA, 15 nt, Pseudomonas putida KT2440
gcccggcuccgcgca

SEQ ID NO: 3556148 - RNA, 16 nt, Pseudomonas putida KT2440
gcccggcuccgcgcaa

SEQ ID NO: 3556149 - RNA, 23 nt, Pseudomonas putida KT2440
gcccggcuccgcgcaagcgguug

SEQ ID NO: 3556150 - RNA, 15 nt, Pseudomonas putida KT2440
gcccggcugaaaccg

SEQ ID NO: 3556151 - RNA, 17 nt, Pseudomonas putida KT2440
gcccggcuggauggcgc

SEQ ID NO: 3556152 - RNA, 14 nt, Pseudomonas putida KT2440
gcccgggaacggcu

SEQ ID NO: 3556153 - RNA, 17 nt, Pseudomonas putida KT2440
gcccgggcaaagcacca

SEQ ID NO: 3556154 - RNA, 19 nt, Pseudomonas putida KT2440
gcccgggcaaagcaccaug

SEQ ID NO: 3556155 - RNA, 21 nt, Pseudomonas putida KT2440
gcccgggcacgggccagcgcg

SEQ ID NO: 3556156 - RNA, 18 nt, Pseudomonas putida KT2440
gcccgggccaggccccuu

SEQ ID NO: 3556157 - RNA, 12 nt, Pseudomonas putida KT2440
gcccgggcgcag

SEQ ID NO: 3556158 - RNA, 14 nt, Pseudomonas putida KT2440
gcccgggcgcaggc

SEQ ID NO: 3556159 - RNA, 15 nt, Pseudomonas putida KT2440
gcccggucauacagc

SEQ ID NO: 3556160 - RNA, 17 nt, Pseudomonas putida KT2440
gcccggucauacagccc

SEQ ID NO: 3556161 - RNA, 14 nt, Pseudomonas putida KT2440
gcccggucccgcug

SEQ ID NO: 3556162 - RNA, 18 nt, Pseudomonas putida KT2440
gcccggugaagucaccga

SEQ ID NO: 3556163 - RNA, 15 nt, Pseudomonas putida KT2440
gcccggugcaagcca

SEQ ID NO: 3556164 - RNA, 14 nt, Pseudomonas putida KT2440
gcccggugcaaggu

SEQ ID NO: 3556165 - RNA, 10 nt, Pseudomonas putida KT2440
gcccggugcc

SEQ ID NO: 3556166 - RNA, 14 nt, Pseudomonas putida KT2440
gcccggugccgcgc

SEQ ID NO: 3556167 - RNA, 16 nt, Pseudomonas putida KT2440
gcccgguggcgcggcc

SEQ ID NO: 3556168 - RNA, 17 nt, Pseudomonas putida KT2440
gcccgguggcgcggccg

SEQ ID NO: 3556169 - RNA, 14 nt, Pseudomonas putida KT2440
gcccgguuccagcg

SEQ ID NO: 3556170 - RNA, 22 nt, Pseudomonas putida KT2440
gcccguagcggauaaucuguuu

SEQ ID NO: 3556171 - RNA, 18 nt, Pseudomonas putida KT2440
gcccguaugcauccgcca

SEQ ID NO: 3556172 - RNA, 20 nt, Pseudomonas putida KT2440
gcccgucaccuugccaucga

SEQ ID NO: 3556173 - RNA, 18 nt, Pseudomonas putida KT2440
gcccgucacgugccuuca

SEQ ID NO: 3556174 - RNA, 22 nt, Pseudomonas putida KT2440
gcccgucacgugccuucaccag

SEQ ID NO: 3556175 - RNA, 15 nt, Pseudomonas putida KT2440
gcccgucagcuugcc

SEQ ID NO: 3556176 - RNA, 19 nt, Pseudomonas putida KT2440
gcccguccgccuugagguu

SEQ ID NO: 3556177 - RNA, 14 nt, Pseudomonas putida KT2440
gcccguccggcaug

SEQ ID NO: 3556178 - RNA, 15 nt, Pseudomonas putida KT2440
gcccgucugcgugca

SEQ ID NO: 3556179 - RNA, 16 nt, Pseudomonas putida KT2440
gcccgucuggcugcaa

SEQ ID NO: 3556180 - RNA, 23 nt, Pseudomonas putida KT2440
gcccgugacuaguggccacuucg

SEQ ID NO: 3556181 - RNA, 17 nt, Pseudomonas putida KT2440
gcccgugccauccaccg

SEQ ID NO: 3556182 - RNA, 17 nt, Pseudomonas putida KT2440
gcccgugccgcaucagc

SEQ ID NO: 3556183 - RNA, 18 nt, Pseudomonas putida KT2440
gcccgugccgcaucagcc

SEQ ID NO: 3556184 - RNA, 16 nt, Pseudomonas putida KT2440
gcccgugccucgcgca

SEQ ID NO: 3556185 - RNA, 18 nt, Pseudomonas putida KT2440
gcccgugcucacgcacga

SEQ ID NO: 3556186 - RNA, 14 nt, Pseudomonas putida KT2440
gcccgugcugucgg

SEQ ID NO: 3556187 - RNA, 17 nt, Pseudomonas putida KT2440
gcccguggcccucagcc

SEQ ID NO: 3556188 - RNA, 16 nt, Pseudomonas putida KT2440
gcccgugguuggagcg

SEQ ID NO: 3556189 - RNA, 16 nt, Pseudomonas putida KT2440
gcccguguucgcgggc

SEQ ID NO: 3556190 - RNA, 17 nt, Pseudomonas putida KT2440
gcccguguucgcgggca

SEQ ID NO: 3556191 - RNA, 18 nt, Pseudomonas putida KT2440
gcccguguucgcgggcaa

SEQ ID NO: 3556192 - RNA, 19 nt, Pseudomonas putida KT2440
gcccguguucgcgggcaag

SEQ ID NO: 3556193 - RNA, 23 nt, Pseudomonas putida KT2440
gcccguuacguaagucaggccga

SEQ ID NO: 3556194 - RNA, 13 nt, Pseudomonas putida KT2440
gcccguucuggcc

SEQ ID NO: 3556195 - RNA, 19 nt, Pseudomonas putida KT2440
gcccguugaaagcggccuu

SEQ ID NO: 3556196 - RNA, 17 nt, Pseudomonas putida KT2440
gcccuagaacaggcggc

SEQ ID NO: 3556197 - RNA, 21 nt, Pseudomonas putida KT2440
gcccuauggggugagcggcuu

SEQ ID NO: 3556198 - RNA, 19 nt, Pseudomonas putida KT2440
gcccucaagggcgcugauc

SEQ ID NO: 3556199 - RNA, 14 nt, Pseudomonas putida KT2440
gcccucagcccagu

SEQ ID NO: 3556200 - RNA, 17 nt, Pseudomonas putida KT2440
gcccucauucgcccgca

SEQ ID NO: 3556201 - RNA, 11 nt, Pseudomonas putida KT2440
gcccuccagcc

SEQ ID NO: 3556202 - RNA, 13 nt, Pseudomonas putida KT2440
gcccuccagcccu

SEQ ID NO: 3556203 - RNA, 15 nt, Pseudomonas putida KT2440
gcccuuugguacugc

SEQ ID NO: 3556204 - RNA, 23 nt, Pseudomonas putida KT2440
gcccuuugguacugcgccggcca

SEQ ID NO: 3556205 - RNA, 15 nt, Pseudomonas putida KT2440
gcccuuuuucaccag

SEQ ID NO: 3556206 - RNA, 19 nt, Pseudomonas putida KT2440
gcccuuuuucaccaggcgg

SEQ ID NO: 3556207 - RNA, 17 nt, Pseudomonas putida KT2440
gccgaaaccagccccuu

SEQ ID NO: 3556208 - RNA, 16 nt, Pseudomonas putida KT2440
gccgaaaccgcccggg

SEQ ID NO: 3556209 - RNA, 19 nt, Pseudomonas putida KT2440
gccgaaacguagucgacca

SEQ ID NO: 3556210 - RNA, 15 nt, Pseudomonas putida KT2440
gccgaaauaugcagu

SEQ ID NO: 3556211 - RNA, 19 nt, Pseudomonas putida KT2440
gccgaacaccgccagcccg

SEQ ID NO: 3556212 - RNA, 15 nt, Pseudomonas putida KT2440
gccgaacagcaggca

SEQ ID NO: 3556213 - RNA, 16 nt, Pseudomonas putida KT2440
gccgaacagcaggcaa

SEQ ID NO: 3556214 - RNA, 20 nt, Pseudomonas putida KT2440
gccgaacaggccggcugcag

SEQ ID NO: 3556215 - RNA, 21 nt, Pseudomonas putida KT2440
gccgaaccccaccagcacugc

SEQ ID NO: 3556216 - RNA, 21 nt, Pseudomonas putida KT2440
gccgaacgcaagaaggcugcc

SEQ ID NO: 3556217 - RNA, 16 nt, Pseudomonas putida KT2440
gccgaacgggccacca

SEQ ID NO: 3556218 - RNA, 21 nt, Pseudomonas putida KT2440
gccgaacucgauucgccgggc

SEQ ID NO: 3556219 - RNA, 20 nt, Pseudomonas putida KT2440
gccgaacuugccgaugaacg

SEQ ID NO: 3556220 - RNA, 19 nt, Pseudomonas putida KT2440
gccgaagccaugagcgagc

SEQ ID NO: 3556221 - RNA, 12 nt, Pseudomonas putida KT2440
gccgaaggccgu

SEQ ID NO: 3556222 - RNA, 16 nt, Pseudomonas putida KT2440
gccgaaggccguggca

SEQ ID NO: 3556223 - RNA, 15 nt, Pseudomonas putida KT2440
gccgaaggcgcuggc

SEQ ID NO: 3556224 - RNA, 18 nt, Pseudomonas putida KT2440
gccgaagucauccauggc

SEQ ID NO: 3556225 - RNA, 15 nt, Pseudomonas putida KT2440
gccgaaguggcggcu

SEQ ID NO: 3556226 - RNA, 21 nt, Pseudomonas putida KT2440
gccgacaaaacugagcaagaa

SEQ ID NO: 3556227 - RNA, 16 nt, Pseudomonas putida KT2440
gccgacaaacguacca

SEQ ID NO: 3556228 - RNA, 14 nt, Pseudomonas putida KT2440
gccgacaacagcau

SEQ ID NO: 3556229 - RNA, 20 nt, Pseudomonas putida KT2440
gccgacacaccaauggccau

SEQ ID NO: 3556230 - RNA, 19 nt, Pseudomonas putida KT2440
gccgacagccaccgcgagc

SEQ ID NO: 3556231 - RNA, 13 nt, Pseudomonas putida KT2440
gccgacagccuca

SEQ ID NO: 3556232 - RNA, 17 nt, Pseudomonas putida KT2440
gccgacagccucaaggc

SEQ ID NO: 3556233 - RNA, 20 nt, Pseudomonas putida KT2440
gccgacagccucaaggccgg

SEQ ID NO: 3556234 - RNA, 12 nt, Pseudomonas putida KT2440
gccgacagcggc

SEQ ID NO: 3556235 - RNA, 16 nt, Pseudomonas putida KT2440
gccgacagcggcgaag

SEQ ID NO: 3556236 - RNA, 17 nt, Pseudomonas putida KT2440
gccgaccaagcgcccca

SEQ ID NO: 3556237 - RNA, 23 nt, Pseudomonas putida KT2440
gccgaccaagcgccccacaagcc

SEQ ID NO: 3556238 - RNA, 12 nt, Pseudomonas putida KT2440
gccgaccaggug

SEQ ID NO: 3556239 - RNA, 16 nt, Pseudomonas putida KT2440
gccgacccgccuggug

SEQ ID NO: 3556240 - RNA, 19 nt, Pseudomonas putida KT2440
gccgacccgggccagccac

SEQ ID NO: 3556241 - RNA, 22 nt, Pseudomonas putida KT2440
gccgaccgaaccggcgcuggcc

SEQ ID NO: 3556242 - RNA, 13 nt, Pseudomonas putida KT2440
gccgaccgcgcgc

SEQ ID NO: 3556243 - RNA, 14 nt, Pseudomonas putida KT2440
gccgaccgcgcgca

SEQ ID NO: 3556244 - RNA, 13 nt, Pseudomonas putida KT2440
gccgaccuugggc

SEQ ID NO: 3556245 - RNA, 21 nt, Pseudomonas putida KT2440
gccgaccuugggccggcgcag

SEQ ID NO: 3556246 - RNA, 13 nt, Pseudomonas putida KT2440
gccgacgaugccc

SEQ ID NO: 3556247 - RNA, 20 nt, Pseudomonas putida KT2440
gccgacgauuucugccguug

SEQ ID NO: 3556248 - RNA, 14 nt, Pseudomonas putida KT2440
gccgacuccaacgc

SEQ ID NO: 3556249 - RNA, 16 nt, Pseudomonas putida KT2440
gccgacucuucaccag

SEQ ID NO: 3556250 - RNA, 22 nt, Pseudomonas putida KT2440
gccgacuggcgcaccagcggcu

SEQ ID NO: 3556251 - RNA, 13 nt, Pseudomonas putida KT2440
gccgagcaggagc

SEQ ID NO: 3556252 - RNA, 21 nt, Pseudomonas putida KT2440
gccgagcaggagcugaacugc

SEQ ID NO: 3556253 - RNA, 19 nt, Pseudomonas putida KT2440
gccgagcauccgcgccacu

SEQ ID NO: 3556254 - RNA, 18 nt, Pseudomonas putida KT2440
gccgagcaucuuccagcc

SEQ ID NO: 3556255 - RNA, 18 nt, Pseudomonas putida KT2440
gccgagcauuacaggcag

SEQ ID NO: 3556256 - RNA, 13 nt, Pseudomonas putida KT2440
gccgagccaaccg

SEQ ID NO: 3556257 - RNA, 19 nt, Pseudomonas putida KT2440
gccgagccaagcgacgugc

SEQ ID NO: 3556258 - RNA, 22 nt, Pseudomonas putida KT2440
gccgagccgauaugcggggucg

SEQ ID NO: 3556259 - RNA, 19 nt, Pseudomonas putida KT2440
gccgagcgagugaccuugg

SEQ ID NO: 3556260 - RNA, 23 nt, Pseudomonas putida KT2440
gccgagcgcggcgcccagcaaca

SEQ ID NO: 3556261 - RNA, 17 nt, Pseudomonas putida KT2440
gccgagcugaugccgga

SEQ ID NO: 3556262 - RNA, 15 nt, Pseudomonas putida KT2440
gccgaggaauugcgc

SEQ ID NO: 3556263 - RNA, 19 nt, Pseudomonas putida KT2440
gccgaggaauugcgccagg

SEQ ID NO: 3556264 - RNA, 18 nt, Pseudomonas putida KT2440
gccgaggacaacaaggac

SEQ ID NO: 3556265 - RNA, 12 nt, Pseudomonas putida KT2440
gccgaggcaccg

SEQ ID NO: 3556266 - RNA, 15 nt, Pseudomonas putida KT2440
gccgaggccaugugc

SEQ ID NO: 3556267 - RNA, 17 nt, Pseudomonas putida KT2440
gccgaggccggguuuuu

SEQ ID NO: 3556268 - RNA, 14 nt, Pseudomonas putida KT2440
gccgaggcguuggc

SEQ ID NO: 3556269 - RNA, 12 nt, Pseudomonas putida KT2440
gccgagggcaug

SEQ ID NO: 3556270 - RNA, 14 nt, Pseudomonas putida KT2440
gccgagggcauggg

SEQ ID NO: 3556271 - RNA, 20 nt, Pseudomonas putida KT2440
gccgagggcaugggccacuu

SEQ ID NO: 3556272 - RNA, 20 nt, Pseudomonas putida KT2440
gccgagggugaggugcugca

SEQ ID NO: 3556273 - RNA, 18 nt, Pseudomonas putida KT2440
gccgaggucggcucgucg

SEQ ID NO: 3556274 - RNA, 16 nt, Pseudomonas putida KT2440
gccgaggucugguacu

SEQ ID NO: 3556275 - RNA, 15 nt, Pseudomonas putida KT2440
gccgagguucuucca

SEQ ID NO: 3556276 - RNA, 17 nt, Pseudomonas putida KT2440
gccgaguaaccggcggc

SEQ ID NO: 3556277 - RNA, 19 nt, Pseudomonas putida KT2440
gccgaguccuugcgugccu

SEQ ID NO: 3556278 - RNA, 18 nt, Pseudomonas putida KT2440
gccgagucgguggcgaag

SEQ ID NO: 3556279 - RNA, 14 nt, Pseudomonas putida KT2440
gccgagugccaaca

SEQ ID NO: 3556280 - RNA, 15 nt, Pseudomonas putida KT2440
gccgagugcgcggaa

SEQ ID NO: 3556281 - RNA, 14 nt, Pseudomonas putida KT2440
gccgaguuggcuuc

SEQ ID NO: 3556282 - RNA, 20 nt, Pseudomonas putida KT2440
gccgaguuggcuucuugacg

SEQ ID NO: 3556283 - RNA, 20 nt, Pseudomonas putida KT2440
gccgauaaagguugcccggc

SEQ ID NO: 3556284 - RNA, 20 nt, Pseudomonas putida KT2440
gccgauaccgcccacuucug

SEQ ID NO: 3556285 - RNA, 18 nt, Pseudomonas putida KT2440
gccgauacggugccaaua

SEQ ID NO: 3556286 - RNA, 22 nt, Pseudomonas putida KT2440
gccgauagcagcaccgaucagc

SEQ ID NO: 3556287 - RNA, 14 nt, Pseudomonas putida KT2440
gccgaucaaugucg

SEQ ID NO: 3556288 - RNA, 18 nt, Pseudomonas putida KT2440
gccgaucacaccggcaau

SEQ ID NO: 3556289 - RNA, 15 nt, Pseudomonas putida KT2440
gccgaucaccagcac

SEQ ID NO: 3556290 - RNA, 18 nt, Pseudomonas putida KT2440
gccgaucagcacgccgcc

SEQ ID NO: 3556291 - RNA, 12 nt, Pseudomonas putida KT2440
gccgaucagcga

SEQ ID NO: 3556292 - RNA, 13 nt, Pseudomonas putida KT2440
gccgaucagcgag

SEQ ID NO: 3556293 - RNA, 14 nt, Pseudomonas putida KT2440
gccgaucagcgagu

SEQ ID NO: 3556294 - RNA, 19 nt, Pseudomonas putida KT2440
gccgaucaggaagccccgc

SEQ ID NO: 3556295 - RNA, 21 nt, Pseudomonas putida KT2440
gccgaucaggaagccccgcgc

SEQ ID NO: 3556296 - RNA, 18 nt, Pseudomonas putida KT2440
gccgaucagguugcccag

SEQ ID NO: 3556297 - RNA, 23 nt, Pseudomonas putida KT2440
gccgaucagguugcccagcaugc

SEQ ID NO: 3556298 - RNA, 23 nt, Pseudomonas putida KT2440
gccgaucaucuuggugugggcga

SEQ ID NO: 3556299 - RNA, 18 nt, Pseudomonas putida KT2440
gccgaucauugcugcggu

SEQ ID NO: 3556300 - RNA, 16 nt, Pseudomonas putida KT2440
gccgaucgaagcagca

SEQ ID NO: 3556301 - RNA, 17 nt, Pseudomonas putida KT2440
gccgaucgaagcagcag

SEQ ID NO: 3556302 - RNA, 19 nt, Pseudomonas putida KT2440
gccgaucgaagcagcagcu

SEQ ID NO: 3556303 - RNA, 19 nt, Pseudomonas putida KT2440
gccgaugaagcaggccgag

SEQ ID NO: 3556304 - RNA, 18 nt, Pseudomonas putida KT2440
gccgaugaccugcgucag

SEQ ID NO: 3556305 - RNA, 21 nt, Pseudomonas putida KT2440
gccgaugaccugcgucaggac

SEQ ID NO: 3556306 - RNA, 22 nt, Pseudomonas putida KT2440
gccgaugaugcgggcaaagaac

SEQ ID NO: 3556307 - RNA, 14 nt, Pseudomonas putida KT2440
gccgaugccaagca

SEQ ID NO: 3556308 - RNA, 15 nt, Pseudomonas putida KT2440
gccgccccuccaccc

SEQ ID NO: 3556309 - RNA, 23 nt, Pseudomonas putida KT2440
gccgcccggucauacagcccuac

SEQ ID NO: 3556310 - RNA, 21 nt, Pseudomonas putida KT2440
gccgcccucuucgcgggcacg

SEQ ID NO: 3556311 - RNA, 22 nt, Pseudomonas putida KT2440
gccgcccucuugcugcaacagc

SEQ ID NO: 3556312 - RNA, 13 nt, Pseudomonas putida KT2440
gccgcccuggucc

SEQ ID NO: 3556313 - RNA, 22 nt, Pseudomonas putida KT2440
gccgcccuugagcuucagcgcg

SEQ ID NO: 3556314 - RNA, 20 nt, Pseudomonas putida KT2440
gccgcccuugaggggcggcg

SEQ ID NO: 3556315 - RNA, 18 nt, Pseudomonas putida KT2440
gccgcccuuggugcacca

SEQ ID NO: 3556316 - RNA, 21 nt, Pseudomonas putida KT2440
gccgcccuuggugcaccagcu

SEQ ID NO: 3556317 - RNA, 23 nt, Pseudomonas putida KT2440
gccgcccuuggugcaccagcuug

SEQ ID NO: 3556318 - RNA, 18 nt, Pseudomonas putida KT2440
gccgcccuuucgcgggug

SEQ ID NO: 3556319 - RNA, 22 nt, Pseudomonas putida KT2440
gccgccgaacaggccggcugca

SEQ ID NO: 3556320 - RNA, 22 nt, Pseudomonas putida KT2440
gccgccgaacucuggcaacagc

SEQ ID NO: 3556321 - RNA, 23 nt, Pseudomonas putida KT2440
gccgccgaacucuggcaacagcu

SEQ ID NO: 3556322 - RNA, 14 nt, Pseudomonas putida KT2440
gccgccgaccaggu

SEQ ID NO: 3556323 - RNA, 15 nt, Pseudomonas putida KT2440
gccgccgacgaucag

SEQ ID NO: 3556324 - RNA, 22 nt, Pseudomonas putida KT2440
gccgccgacgaucaguaccggc

SEQ ID NO: 3556325 - RNA, 18 nt, Pseudomonas putida KT2440
gccgccgagugcgcggaa

SEQ ID NO: 3556326 - RNA, 13 nt, Pseudomonas putida KT2440
gccgccgauaccg

SEQ ID NO: 3556327 - RNA, 15 nt, Pseudomonas putida KT2440
gccgccgaugcgcuu

SEQ ID NO: 3556328 - RNA, 23 nt, Pseudomonas putida KT2440
gccgccgauguagucguccugcc

SEQ ID NO: 3556329 - RNA, 19 nt, Pseudomonas putida KT2440
gccgccgauguuggucacc

SEQ ID NO: 3556330 - RNA, 13 nt, Pseudomonas putida KT2440
gccgccgcagcaa

SEQ ID NO: 3556331 - RNA, 15 nt, Pseudomonas putida KT2440
gccgccgcagcaauc

SEQ ID NO: 3556332 - RNA, 15 nt, Pseudomonas putida KT2440
gccgccgccagacca

SEQ ID NO: 3556333 - RNA, 14 nt, Pseudomonas putida KT2440
gccgccgcugacca

SEQ ID NO: 3556334 - RNA, 14 nt, Pseudomonas putida KT2440
gccgccgcugcgag

SEQ ID NO: 3556335 - RNA, 18 nt, Pseudomonas putida KT2440
gccgccgcugcugcgccu

SEQ ID NO: 3556336 - RNA, 23 nt, Pseudomonas putida KT2440
gccgccgggguaauggcgcugga

SEQ ID NO: 3556337 - RNA, 21 nt, Pseudomonas putida KT2440
gccgccgguguaccauccagu

SEQ ID NO: 3556338 - RNA, 21 nt, Pseudomonas putida KT2440
gccgccgucagguucaagccu

SEQ ID NO: 3556339 - RNA, 18 nt, Pseudomonas putida KT2440
gccgccguggugccgguu

SEQ ID NO: 3556340 - RNA, 19 nt, Pseudomonas putida KT2440
gccgccguucaggcgccug

SEQ ID NO: 3556341 - RNA, 21 nt, Pseudomonas putida KT2440
gccgccguucaggcgccugcc

SEQ ID NO: 3556342 - RNA, 19 nt, Pseudomonas putida KT2440
gccgccuccaccgggaugg

SEQ ID NO: 3556343 - RNA, 22 nt, Pseudomonas putida KT2440
gccgccuccaccgggauggcgg

SEQ ID NO: 3556344 - RNA, 17 nt, Pseudomonas putida KT2440
gccgccuccugcugcug

SEQ ID NO: 3556345 - RNA, 20 nt, Pseudomonas putida KT2440
gccgccuccugcugcugcau

SEQ ID NO: 3556346 - RNA, 15 nt, Pseudomonas putida KT2440
gccgccugcccgccc

SEQ ID NO: 3556347 - RNA, 15 nt, Pseudomonas putida KT2440
gccgccuggcucacc

SEQ ID NO: 3556348 - RNA, 20 nt, Pseudomonas putida KT2440
gccgccugggucaaccccag

SEQ ID NO: 3556349 - RNA, 22 nt, Pseudomonas putida KT2440
gccgccugggucaaccccaggu

SEQ ID NO: 3556350 - RNA, 23 nt, Pseudomonas putida KT2440
gccgccugguugcguucgucgau

SEQ ID NO: 3556351 - RNA, 17 nt, Pseudomonas putida KT2440
gccgccuucgccaaggu

SEQ ID NO: 3556352 - RNA, 15 nt, Pseudomonas putida KT2440
gccgccuucuccagc

SEQ ID NO: 3556353 - RNA, 21 nt, Pseudomonas putida KT2440
gccgccuucuccagcucgcca

SEQ ID NO: 3556354 - RNA, 15 nt, Pseudomonas putida KT2440
gccgccuugcagaaa

SEQ ID NO: 3556355 - RNA, 15 nt, Pseudomonas putida KT2440
gccgccuugcggccc

SEQ ID NO: 3556356 - RNA, 15 nt, Pseudomonas putida KT2440
gccgcgaagcggccc

SEQ ID NO: 3556357 - RNA, 20 nt, Pseudomonas putida KT2440
gccgcgacuggaacgauacc

SEQ ID NO: 3556358 - RNA, 12 nt, Pseudomonas putida KT2440
gccgcgcagccc

SEQ ID NO: 3556359 - RNA, 13 nt, Pseudomonas putida KT2440
gccgcgcagccca

SEQ ID NO: 3556360 - RNA, 20 nt, Pseudomonas putida KT2440
gccgcgcaugcugugcccug

SEQ ID NO: 3556361 - RNA, 16 nt, Pseudomonas putida KT2440
gccgcgccaccgggcg

SEQ ID NO: 3556362 - RNA, 20 nt, Pseudomonas putida KT2440
gccgcgccaccgggcgcgau

SEQ ID NO: 3556363 - RNA, 20 nt, Pseudomonas putida KT2440
gccgcgcccagugcgcgcaa

SEQ ID NO: 3556364 - RNA, 18 nt, Pseudomonas putida KT2440
gccgcgccucgcggugca

SEQ ID NO: 3556365 - RNA, 20 nt, Pseudomonas putida KT2440
gccgcgcgcccgcugaccgg

SEQ ID NO: 3556366 - RNA, 22 nt, Pseudomonas putida KT2440
gccgcgcggcuugcucgcggcg

SEQ ID NO: 3556367 - RNA, 15 nt, Pseudomonas putida KT2440
gccgcgcgggcggcg

SEQ ID NO: 3556368 - RNA, 19 nt, Pseudomonas putida KT2440
gccgcgcugauaucgauac

SEQ ID NO: 3556369 - RNA, 12 nt, Pseudomonas putida KT2440
gccgcgcuggcg

SEQ ID NO: 3556370 - RNA, 15 nt, Pseudomonas putida KT2440
gccgcgcuggcgcgc

SEQ ID NO: 3556371 - RNA, 13 nt, Pseudomonas putida KT2440
gccgcgcuguggc

SEQ ID NO: 3556372 - RNA, 20 nt, Pseudomonas putida KT2440
gccgcgcuguggcgcccggc

SEQ ID NO: 3556373 - RNA, 21 nt, Pseudomonas putida KT2440
gccgcggaaauaccagacgca

SEQ ID NO: 3556374 - RNA, 23 nt, Pseudomonas putida KT2440
gccgcggaaauaccagacgcagg

SEQ ID NO: 3556375 - RNA, 22 nt, Pseudomonas putida KT2440
gccgcggaugugguggaacagg

SEQ ID NO: 3556376 - RNA, 17 nt, Pseudomonas putida KT2440
gccgcggccaacauuca

SEQ ID NO: 3556377 - RNA, 17 nt, Pseudomonas putida KT2440
gccgcggcuccagguga

SEQ ID NO: 3556378 - RNA, 19 nt, Pseudomonas putida KT2440
gccgcgggcgucgcgauca

SEQ ID NO: 3556379 - RNA, 16 nt, Pseudomonas putida KT2440
gccgcggguaccaccu

SEQ ID NO: 3556380 - RNA, 17 nt, Pseudomonas putida KT2440
gccgcggguaccaccug

SEQ ID NO: 3556381 - RNA, 23 nt, Pseudomonas putida KT2440
gccgcgguagugcggccgggucg

SEQ ID NO: 3556382 - RNA, 20 nt, Pseudomonas putida KT2440
gccgcguaccagcagggcca

SEQ ID NO: 3556383 - RNA, 18 nt, Pseudomonas putida KT2440
gccgcguccuugaucagg

SEQ ID NO: 3556384 - RNA, 15 nt, Pseudomonas putida KT2440
gccgcgucgcggccc

SEQ ID NO: 3556385 - RNA, 19 nt, Pseudomonas putida KT2440
gccgcgucgcggccccagg

SEQ ID NO: 3556386 - RNA, 15 nt, Pseudomonas putida KT2440
gccgcguucgcccag

SEQ ID NO: 3556387 - RNA, 19 nt, Pseudomonas putida KT2440
gccgcguucgcccaggcgc

SEQ ID NO: 3556388 - RNA, 16 nt, Pseudomonas putida KT2440
gccgcguugcggcccu

SEQ ID NO: 3556389 - RNA, 14 nt, Pseudomonas putida KT2440
gccgcguugucagg

SEQ ID NO: 3556390 - RNA, 15 nt, Pseudomonas putida KT2440
gccgcuaggcggccc

SEQ ID NO: 3556391 - RNA, 17 nt, Pseudomonas putida KT2440
gccgcucaccaccaucu

SEQ ID NO: 3556392 - RNA, 15 nt, Pseudomonas putida KT2440
gccgcucccacaggu

SEQ ID NO: 3556393 - RNA, 16 nt, Pseudomonas putida KT2440
gccgcucccacaggua

SEQ ID NO: 3556394 - RNA, 20 nt, Pseudomonas putida KT2440
gccgcucccacagguaauac

SEQ ID NO: 3556395 - RNA, 23 nt, Pseudomonas putida KT2440
gccgcuccugcggucagccugcg

SEQ ID NO: 3556396 - RNA, 21 nt, Pseudomonas putida KT2440
gccgcucgagaaacgccagcu

SEQ ID NO: 3556397 - RNA, 15 nt, Pseudomonas putida KT2440
gccgcucgcccagca

SEQ ID NO: 3556398 - RNA, 18 nt, Pseudomonas putida KT2440
gccgcucugcggcccauu

SEQ ID NO: 3556399 - RNA, 23 nt, Pseudomonas putida KT2440
gccgcugaacaacuccgggugcu

SEQ ID NO: 3556400 - RNA, 17 nt, Pseudomonas putida KT2440
gccgcugaccacgccga

SEQ ID NO: 3556401 - RNA, 13 nt, Pseudomonas putida KT2440
gccgcugccaacc

SEQ ID NO: 3556402 - RNA, 19 nt, Pseudomonas putida KT2440
gccgcugccacagguacug

SEQ ID NO: 3556403 - RNA, 15 nt, Pseudomonas putida KT2440
gccgcugccagcagg

SEQ ID NO: 3556404 - RNA, 17 nt, Pseudomonas putida KT2440
gccgcugccagcagggc

SEQ ID NO: 3556405 - RNA, 13 nt, Pseudomonas putida KT2440
gccgcugcgcccg

SEQ ID NO: 3556406 - RNA, 15 nt, Pseudomonas putida KT2440
gccgcugcgcccgcc

SEQ ID NO: 3556407 - RNA, 13 nt, Pseudomonas putida KT2440
gccgcugcgccug

SEQ ID NO: 3556408 - RNA, 15 nt, Pseudomonas putida KT2440
gccgcugcgccugcc

SEQ ID NO: 3556409 - RNA, 17 nt, Pseudomonas putida KT2440
gccgcugcgccugccgg

SEQ ID NO: 3556410 - RNA, 17 nt, Pseudomonas putida KT2440
gccgcugcgcgguaaac

SEQ ID NO: 3556411 - RNA, 12 nt, Pseudomonas putida KT2440
gccgcugcggcu

SEQ ID NO: 3556412 - RNA, 20 nt, Pseudomonas putida KT2440
gccgcugcugcgccucgcag

SEQ ID NO: 3556413 - RNA, 20 nt, Pseudomonas putida KT2440
gccggccucuucgcgggcaa

SEQ ID NO: 3556414 - RNA, 18 nt, Pseudomonas putida KT2440
gccggccucuucgcgggu

SEQ ID NO: 3556415 - RNA, 16 nt, Pseudomonas putida KT2440
gccggccuguugcgca

SEQ ID NO: 3556416 - RNA, 18 nt, Pseudomonas putida KT2440
gccggccuguugcgcacu

SEQ ID NO: 3556417 - RNA, 13 nt, Pseudomonas putida KT2440
gccggccuugacc

SEQ ID NO: 3556418 - RNA, 17 nt, Pseudomonas putida KT2440
gccggccuuggcgcggc

SEQ ID NO: 3556419 - RNA, 23 nt, Pseudomonas putida KT2440
gccggccuuggcgcggcggauaa

SEQ ID NO: 3556420 - RNA, 15 nt, Pseudomonas putida KT2440
gccggcgaacagcac

SEQ ID NO: 3556421 - RNA, 21 nt, Pseudomonas putida KT2440
gccggcgaacagcacugccag

SEQ ID NO: 3556422 - RNA, 19 nt, Pseudomonas putida KT2440
gccggcgaauccagccggc

SEQ ID NO: 3556423 - RNA, 14 nt, Pseudomonas putida KT2440
gccggcgcaggucg

SEQ ID NO: 3556424 - RNA, 14 nt, Pseudomonas putida KT2440
gccggcgcccugca

SEQ ID NO: 3556425 - RNA, 15 nt, Pseudomonas putida KT2440
gccggcgcugagcga

SEQ ID NO: 3556426 - RNA, 13 nt, Pseudomonas putida KT2440
gccggcggauagc

SEQ ID NO: 3556427 - RNA, 14 nt, Pseudomonas putida KT2440
gccggcggccaucg

SEQ ID NO: 3556428 - RNA, 23 nt, Pseudomonas putida KT2440
gccggcgucgaucugcagguggu

SEQ ID NO: 3556429 - RNA, 16 nt, Pseudomonas putida KT2440
gccggcgucggcgcgc

SEQ ID NO: 3556430 - RNA, 17 nt, Pseudomonas putida KT2440
gccggcgucggcgcgca

SEQ ID NO: 3556431 - RNA, 18 nt, Pseudomonas putida KT2440
gccggcgucggcgcgcaa

SEQ ID NO: 3556432 - RNA, 23 nt, Pseudomonas putida KT2440
gccggcgucggcgcgcaacagca

SEQ ID NO: 3556433 - RNA, 21 nt, Pseudomonas putida KT2440
gccggcguuggcuuccacggc

SEQ ID NO: 3556434 - RNA, 14 nt, Pseudomonas putida KT2440
gccggcuaucggcc

SEQ ID NO: 3556435 - RNA, 21 nt, Pseudomonas putida KT2440
gccggcugaacuucaaccgca

SEQ ID NO: 3556436 - RNA, 18 nt, Pseudomonas putida KT2440
gccggcugaugaacuucc

SEQ ID NO: 3556437 - RNA, 15 nt, Pseudomonas putida KT2440
gccggcuggacaccu

SEQ ID NO: 3556438 - RNA, 13 nt, Pseudomonas putida KT2440
gccggcugugcag

SEQ ID NO: 3556439 - RNA, 14 nt, Pseudomonas putida KT2440
gccggcuucacuag

SEQ ID NO: 3556440 - RNA, 20 nt, Pseudomonas putida KT2440
gccggcuuccagcgauggcg

SEQ ID NO: 3556441 - RNA, 13 nt, Pseudomonas putida KT2440
gccggcuugccuu

SEQ ID NO: 3556442 - RNA, 21 nt, Pseudomonas putida KT2440
gccggcuugccuucaagggca

SEQ ID NO: 3556443 - RNA, 16 nt, Pseudomonas putida KT2440
gccgggaagcgcccgc

SEQ ID NO: 3556444 - RNA, 16 nt, Pseudomonas putida KT2440
gccgggacagcaccau

SEQ ID NO: 3556445 - RNA, 20 nt, Pseudomonas putida KT2440
gccgggaugguaacgggcaa

SEQ ID NO: 3556446 - RNA, 17 nt, Pseudomonas putida KT2440
gccgggcacaucaccag

SEQ ID NO: 3556447 - RNA, 18 nt, Pseudomonas putida KT2440
gccgggcacaucaccagc

SEQ ID NO: 3556448 - RNA, 22 nt, Pseudomonas putida KT2440
gccgggcacaucaccagcagcu

SEQ ID NO: 3556449 - RNA, 18 nt, Pseudomonas putida KT2440
gccgggcacgacacuccg

SEQ ID NO: 3556450 - RNA, 13 nt, Pseudomonas putida KT2440
gccgggcagccgu

SEQ ID NO: 3556451 - RNA, 17 nt, Pseudomonas putida KT2440
gccgggccgccguggug

SEQ ID NO: 3556452 - RNA, 18 nt, Pseudomonas putida KT2440
gccgggccuugaccagca

SEQ ID NO: 3556453 - RNA, 21 nt, Pseudomonas putida KT2440
gccgggcugcaaagcgggcaa

SEQ ID NO: 3556454 - RNA, 15 nt, Pseudomonas putida KT2440
gccggggccaggcgc

SEQ ID NO: 3556455 - RNA, 13 nt, Pseudomonas putida KT2440
gccggggcugcuu

SEQ ID NO: 3556456 - RNA, 13 nt, Pseudomonas putida KT2440
gccggggcuguuu

SEQ ID NO: 3556457 - RNA, 21 nt, Pseudomonas putida KT2440
gccgggguaauggcgcuggau

SEQ ID NO: 3556458 - RNA, 20 nt, Pseudomonas putida KT2440
gccgggucaaggccagcgcc

SEQ ID NO: 3556459 - RNA, 12 nt, Pseudomonas putida KT2440
gccgggucagcu

SEQ ID NO: 3556460 - RNA, 17 nt, Pseudomonas putida KT2440
gccggguccccggccgu

SEQ ID NO: 3556461 - RNA, 15 nt, Pseudomonas putida KT2440
gccgggucgaaggca

SEQ ID NO: 3556462 - RNA, 21 nt, Pseudomonas putida KT2440
gccgggucgauagccagcccg

SEQ ID NO: 3556463 - RNA, 13 nt, Pseudomonas putida KT2440
gccgggugcaucg

SEQ ID NO: 3556464 - RNA, 19 nt, Pseudomonas putida KT2440
gccggguuacccaucugcu

SEQ ID NO: 3556465 - RNA, 17 nt, Pseudomonas putida KT2440
gccggguuguggcuggc

SEQ ID NO: 3556466 - RNA, 22 nt, Pseudomonas putida KT2440
gccggguuguggcuggcgucga

SEQ ID NO: 3556467 - RNA, 18 nt, Pseudomonas putida KT2440
gccggguuuuucaugaag

SEQ ID NO: 3556468 - RNA, 19 nt, Pseudomonas putida KT2440
gccggguuuuucaugaagc

SEQ ID NO: 3556469 - RNA, 16 nt, Pseudomonas putida KT2440
gccgguacagccuacc

SEQ ID NO: 3556470 - RNA, 21 nt, Pseudomonas putida KT2440
gccgguacagccuaccaacgc

SEQ ID NO: 3556471 - RNA, 16 nt, Pseudomonas putida KT2440
gccgguaccgccacca

SEQ ID NO: 3556472 - RNA, 14 nt, Pseudomonas putida KT2440
gccgguacggccaa

SEQ ID NO: 3556473 - RNA, 14 nt, Pseudomonas putida KT2440
gccgguagcggcug

SEQ ID NO: 3556474 - RNA, 21 nt, Pseudomonas putida KT2440
gccgguagugaugcaucagcu

SEQ ID NO: 3556475 - RNA, 23 nt, Pseudomonas putida KT2440
gccggucacccccaucagcgggc

SEQ ID NO: 3556476 - RNA, 20 nt, Pseudomonas putida KT2440
gccggucaccgaccaucggc

SEQ ID NO: 3556477 - RNA, 21 nt, Pseudomonas putida KT2440
gccggucaccgaccaucggca

SEQ ID NO: 3556478 - RNA, 22 nt, Pseudomonas putida KT2440
gccggucacgauccccaccagc

SEQ ID NO: 3556479 - RNA, 14 nt, Pseudomonas putida KT2440
gccggucacuggca

SEQ ID NO: 3556480 - RNA, 14 nt, Pseudomonas putida KT2440
gccggucagcagca

SEQ ID NO: 3556481 - RNA, 15 nt, Pseudomonas putida KT2440
gccggucaucacgcu

SEQ ID NO: 3556482 - RNA, 21 nt, Pseudomonas putida KT2440
gccggucggggugcugcgcac

SEQ ID NO: 3556483 - RNA, 14 nt, Pseudomonas putida KT2440
gccggucguuaccc

SEQ ID NO: 3556484 - RNA, 21 nt, Pseudomonas putida KT2440
gccggucguuacccaccagcu

SEQ ID NO: 3556485 - RNA, 23 nt, Pseudomonas putida KT2440
gccggucguuacccaccagcucc

SEQ ID NO: 3556486 - RNA, 18 nt, Pseudomonas putida KT2440
gccggucuguucggcaag

SEQ ID NO: 3556487 - RNA, 19 nt, Pseudomonas putida KT2440
gccggucuguucggcaagg

SEQ ID NO: 3556488 - RNA, 20 nt, Pseudomonas putida KT2440
gccggucuguucggcaaggu

SEQ ID NO: 3556489 - RNA, 20 nt, Pseudomonas putida KT2440
gccggucuugucugacagca

SEQ ID NO: 3556490 - RNA, 21 nt, Pseudomonas putida KT2440
gccggucuugucugacagcag

SEQ ID NO: 3556491 - RNA, 23 nt, Pseudomonas putida KT2440
gccggucuugucugacagcagga

SEQ ID NO: 3556492 - RNA, 11 nt, Pseudomonas putida KT2440
gccggugaccc

SEQ ID NO: 3556493 - RNA, 14 nt, Pseudomonas putida KT2440
gccggugccaucca

SEQ ID NO: 3556494 - RNA, 15 nt, Pseudomonas putida KT2440
gccggugccauccac

SEQ ID NO: 3556495 - RNA, 13 nt, Pseudomonas putida KT2440
gccggugccgaag

SEQ ID NO: 3556496 - RNA, 18 nt, Pseudomonas putida KT2440
gccgguggcggccgcagc

SEQ ID NO: 3556497 - RNA, 23 nt, Pseudomonas putida KT2440
gccgguggcuucguggugcuggc

SEQ ID NO: 3556498 - RNA, 22 nt, Pseudomonas putida KT2440
gccggugggcaacagcugcgcg

SEQ ID NO: 3556499 - RNA, 23 nt, Pseudomonas putida KT2440
gccggugggcaacagcugcgcga

SEQ ID NO: 3556500 - RNA, 17 nt, Pseudomonas putida KT2440
gccgguguaccauccag

SEQ ID NO: 3556501 - RNA, 17 nt, Pseudomonas putida KT2440
gccgguguucgcgggug

SEQ ID NO: 3556502 - RNA, 20 nt, Pseudomonas putida KT2440
gccgguguucuucaggcaaa

SEQ ID NO: 3556503 - RNA, 12 nt, Pseudomonas putida KT2440
gccgguugcgca

SEQ ID NO: 3556504 - RNA, 13 nt, Pseudomonas putida KT2440
gccgguugcgcag

SEQ ID NO: 3556505 - RNA, 14 nt, Pseudomonas putida KT2440
gccgguugcgcagc

SEQ ID NO: 3556506 - RNA, 19 nt, Pseudomonas putida KT2440
gccgguugcgcagccggcc

SEQ ID NO: 3556507 - RNA, 21 nt, Pseudomonas putida KT2440
gccgguuggcguaaggaccau

SEQ ID NO: 3556508 - RNA, 22 nt, Pseudomonas putida KT2440
gccgguuucguaagcgcugcgc

SEQ ID NO: 3556509 - RNA, 15 nt, Pseudomonas putida KT2440
gccgguuucgucagg

SEQ ID NO: 3556510 - RNA, 20 nt, Pseudomonas putida KT2440
gccgguuucucgcagcagca

SEQ ID NO: 3556511 - RNA, 16 nt, Pseudomonas putida KT2440
gccgguuugcgcucgc

SEQ ID NO: 3556512 - RNA, 14 nt, Pseudomonas putida KT2440
gccgguuuuuucau

SEQ ID NO: 3556513 - RNA, 19 nt, Pseudomonas putida KT2440
gccguacggcccaugucga

SEQ ID NO: 3556514 - RNA, 21 nt, Pseudomonas putida KT2440
gccguacugcugggucagcac

SEQ ID NO: 3556515 - RNA, 22 nt, Pseudomonas putida KT2440
gccguagccaaccgagucaaca

SEQ ID NO: 3556516 - RNA, 19 nt, Pseudomonas putida KT2440
gccguagccaggcauugcc

SEQ ID NO: 3556517 - RNA, 14 nt, Pseudomonas putida KT2440
gccguaggacagug

SEQ ID NO: 3556518 - RNA, 18 nt, Pseudomonas putida KT2440
gccucaaggccggcagcc

SEQ ID NO: 3556519 - RNA, 13 nt, Pseudomonas putida KT2440
gccucaauacccc

SEQ ID NO: 3556520 - RNA, 20 nt, Pseudomonas putida KT2440
gccucaaugggcuuccccag

SEQ ID NO: 3556521 - RNA, 16 nt, Pseudomonas putida KT2440
gccucacaucgcgcag

SEQ ID NO: 3556522 - RNA, 13 nt, Pseudomonas putida KT2440
gccucacauucac

SEQ ID NO: 3556523 - RNA, 14 nt, Pseudomonas putida KT2440
gccucacauucacc

SEQ ID NO: 3556524 - RNA, 20 nt, Pseudomonas putida KT2440
gccucaccgacccacaggca

SEQ ID NO: 3556525 - RNA, 21 nt, Pseudomonas putida KT2440
gccucaccgacccacaggcac

SEQ ID NO: 3556526 - RNA, 16 nt, Pseudomonas putida KT2440
gccucaccuccaccga

SEQ ID NO: 3556527 - RNA, 17 nt, Pseudomonas putida KT2440
gccucaccuccaccgau

SEQ ID NO: 3556528 - RNA, 13 nt, Pseudomonas putida KT2440
gccucagccggcu

SEQ ID NO: 3556529 - RNA, 12 nt, Pseudomonas putida KT2440
gccucagcgcca

SEQ ID NO: 3556530 - RNA, 15 nt, Pseudomonas putida KT2440
gccucagcgccaaua

SEQ ID NO: 3556531 - RNA, 21 nt, Pseudomonas putida KT2440
gccucagcgccaauaccgcgc

SEQ ID NO: 3556532 - RNA, 14 nt, Pseudomonas putida KT2440
gccucagcgcccgc

SEQ ID NO: 3556533 - RNA, 20 nt, Pseudomonas putida KT2440
gccucagcgcccgcugcgcc

SEQ ID NO: 3556534 - RNA, 21 nt, Pseudomonas putida KT2440
gccucagcgcccgcugcgccg

SEQ ID NO: 3556535 - RNA, 12 nt, Pseudomonas putida KT2440
gccucaggcccc

SEQ ID NO: 3556536 - RNA, 15 nt, Pseudomonas putida KT2440
gccucaggccccagg

SEQ ID NO: 3556537 - RNA, 18 nt, Pseudomonas putida KT2440
gccucaggccccaggcca

SEQ ID NO: 3556538 - RNA, 18 nt, Pseudomonas putida KT2440
gccucaggugcacagggc

SEQ ID NO: 3556539 - RNA, 20 nt, Pseudomonas putida KT2440
gccucauagcuuucaggcgc

SEQ ID NO: 3556540 - RNA, 22 nt, Pseudomonas putida KT2440
gccucauagcuuucaggcgcag

SEQ ID NO: 3556541 - RNA, 22 nt, Pseudomonas putida KT2440
gccucaucaggccgaaggccag

SEQ ID NO: 3556542 - RNA, 19 nt, Pseudomonas putida KT2440
gccucauccucgcccacca

SEQ ID NO: 3556543 - RNA, 23 nt, Pseudomonas putida KT2440
gccucauccucgcccaccagcug

SEQ ID NO: 3556544 - RNA, 14 nt, Pseudomonas putida KT2440
gccucaugaucugc

SEQ ID NO: 3556545 - RNA, 16 nt, Pseudomonas putida KT2440
gccucaugcagcaccu

SEQ ID NO: 3556546 - RNA, 21 nt, Pseudomonas putida KT2440
gccucaugcagcaccuccugc

SEQ ID NO: 3556547 - RNA, 20 nt, Pseudomonas putida KT2440
gccuccagagaaccgcacac

SEQ ID NO: 3556548 - RNA, 13 nt, Pseudomonas putida KT2440
gccuccagcagcg

SEQ ID NO: 3556549 - RNA, 16 nt, Pseudomonas putida KT2440
gccuccagcagcgaca

SEQ ID NO: 3556550 - RNA, 21 nt, Pseudomonas putida KT2440
gccuccagcagcgacaccagc

SEQ ID NO: 3556551 - RNA, 13 nt, Pseudomonas putida KT2440
gccuccagcuggc

SEQ ID NO: 3556552 - RNA, 15 nt, Pseudomonas putida KT2440
gccuccagcuggcca

SEQ ID NO: 3556553 - RNA, 21 nt, Pseudomonas putida KT2440
gccuccagcuggccaucgacc

SEQ ID NO: 3556554 - RNA, 18 nt, Pseudomonas putida KT2440
gccuccaggcguugcggg

SEQ ID NO: 3556555 - RNA, 20 nt, Pseudomonas putida KT2440
gccuccagggcggccuuggc

SEQ ID NO: 3556556 - RNA, 19 nt, Pseudomonas putida KT2440
gccuccagguaauccagcu

SEQ ID NO: 3556557 - RNA, 19 nt, Pseudomonas putida KT2440
gccuccauacgcuggugca

SEQ ID NO: 3556558 - RNA, 22 nt, Pseudomonas putida KT2440
gccucccaggacuucagcaguu

SEQ ID NO: 3556559 - RNA, 13 nt, Pseudomonas putida KT2440
gccucccccaccc

SEQ ID NO: 3556560 - RNA, 14 nt, Pseudomonas putida KT2440
gccucccccacccc

SEQ ID NO: 3556561 - RNA, 21 nt, Pseudomonas putida KT2440
gccucccccacccccgcccca

SEQ ID NO: 3556562 - RNA, 23 nt, Pseudomonas putida KT2440
gccucccccacccccgccccacg

SEQ ID NO: 3556563 - RNA, 15 nt, Pseudomonas putida KT2440
gccucccccagcgcg

SEQ ID NO: 3556564 - RNA, 15 nt, Pseudomonas putida KT2440
gccuccggcccaucc

SEQ ID NO: 3556565 - RNA, 13 nt, Pseudomonas putida KT2440
gccucgaacaccu

SEQ ID NO: 3556566 - RNA, 16 nt, Pseudomonas putida KT2440
gccucgaacagcaguu

SEQ ID NO: 3556567 - RNA, 18 nt, Pseudomonas putida KT2440
gccucgaaguaggcaaac

SEQ ID NO: 3556568 - RNA, 18 nt, Pseudomonas putida KT2440
gccucgaccacgaucuug

SEQ ID NO: 3556569 - RNA, 22 nt, Pseudomonas putida KT2440
gccucgaccacgaucuuggcca

SEQ ID NO: 3556570 - RNA, 17 nt, Pseudomonas putida KT2440
gccucgacccgcuggcg

SEQ ID NO: 3556571 - RNA, 15 nt, Pseudomonas putida KT2440
gccucgaccuggccc

SEQ ID NO: 3556572 - RNA, 21 nt, Pseudomonas putida KT2440
gccucgagcgcuuucagccgu

SEQ ID NO: 3556573 - RNA, 15 nt, Pseudomonas putida KT2440
gccucgauagcagcg

SEQ ID NO: 3556574 - RNA, 16 nt, Pseudomonas putida KT2440
gccucgaucccgccgc

SEQ ID NO: 3556575 - RNA, 18 nt, Pseudomonas putida KT2440
gccucgaucccgccgcca

SEQ ID NO: 3556576 - RNA, 16 nt, Pseudomonas putida KT2440
gccucgauuucuucau

SEQ ID NO: 3556577 - RNA, 21 nt, Pseudomonas putida KT2440
gccucgauuucuucaucgcca

SEQ ID NO: 3556578 - RNA, 22 nt, Pseudomonas putida KT2440
gccucgcaaaccugcgcuugca

SEQ ID NO: 3556579 - RNA, 14 nt, Pseudomonas putida KT2440
gccucgcagguaau

SEQ ID NO: 3556580 - RNA, 15 nt, Pseudomonas putida KT2440
gccucgcagguaauc

SEQ ID NO: 3556581 - RNA, 14 nt, Pseudomonas putida KT2440
gccucgccauaagc

SEQ ID NO: 3556582 - RNA, 16 nt, Pseudomonas putida KT2440
gccucgccauaagcug

SEQ ID NO: 3556583 - RNA, 22 nt, Pseudomonas putida KT2440
gccucgccauaagcugucagca

SEQ ID NO: 3556584 - RNA, 16 nt, Pseudomonas putida KT2440
gccucgcccaggccgc

SEQ ID NO: 3556585 - RNA, 15 nt, Pseudomonas putida KT2440
gccucgcccagguca

SEQ ID NO: 3556586 - RNA, 16 nt, Pseudomonas putida KT2440
gccucgcccaggucaa

SEQ ID NO: 3556587 - RNA, 14 nt, Pseudomonas putida KT2440
gccucgccguacuc

SEQ ID NO: 3556588 - RNA, 21 nt, Pseudomonas putida KT2440
gccucgccguacucggucugg

SEQ ID NO: 3556589 - RNA, 15 nt, Pseudomonas putida KT2440
gccucgcgcaacacc

SEQ ID NO: 3556590 - RNA, 19 nt, Pseudomonas putida KT2440
gccucgcgcaacaccgcca

SEQ ID NO: 3556591 - RNA, 21 nt, Pseudomonas putida KT2440
gccucgcgcaacaccgccagc

SEQ ID NO: 3556592 - RNA, 15 nt, Pseudomonas putida KT2440
gccucgcgcauggcc

SEQ ID NO: 3556593 - RNA, 15 nt, Pseudomonas putida KT2440
gccucgcugaccagu

SEQ ID NO: 3556594 - RNA, 22 nt, Pseudomonas putida KT2440
gccucgcugccuuuggccgcca

SEQ ID NO: 3556595 - RNA, 12 nt, Pseudomonas putida KT2440
gccucgcuggcg

SEQ ID NO: 3556596 - RNA, 18 nt, Pseudomonas putida KT2440
gccucggcaaagcggcug

SEQ ID NO: 3556597 - RNA, 17 nt, Pseudomonas putida KT2440
gccucggccggguuuuu

SEQ ID NO: 3556598 - RNA, 14 nt, Pseudomonas putida KT2440
gccucgguacccgc

SEQ ID NO: 3556599 - RNA, 18 nt, Pseudomonas putida KT2440
gccucgguacccgccagc

SEQ ID NO: 3556600 - RNA, 11 nt, Pseudomonas putida KT2440
gccucgucgau

SEQ ID NO: 3556601 - RNA, 16 nt, Pseudomonas putida KT2440
gccucgucgcgguccu

SEQ ID NO: 3556602 - RNA, 16 nt, Pseudomonas putida KT2440
gccucgucggcgcggu

SEQ ID NO: 3556603 - RNA, 14 nt, Pseudomonas putida KT2440
gccucgugucgcga

SEQ ID NO: 3556604 - RNA, 20 nt, Pseudomonas putida KT2440
gccucguugaaguagcgggu

SEQ ID NO: 3556605 - RNA, 15 nt, Pseudomonas putida KT2440
gccucuacccgccgc

SEQ ID NO: 3556606 - RNA, 23 nt, Pseudomonas putida KT2440
gccucugcugcggauacagcgcc

SEQ ID NO: 3556607 - RNA, 14 nt, Pseudomonas putida KT2440
gccucuggcuuggc

SEQ ID NO: 3556608 - RNA, 12 nt, Pseudomonas putida KT2440
gccucuucgcgg

SEQ ID NO: 3556609 - RNA, 19 nt, Pseudomonas putida KT2440
gccucuucgcgggcaagcc

SEQ ID NO: 3556610 - RNA, 20 nt, Pseudomonas putida KT2440
gccucuucgcgggcaagccc

SEQ ID NO: 3556611 - RNA, 16 nt, Pseudomonas putida KT2440
gccucuucgcggguaa

SEQ ID NO: 3556612 - RNA, 23 nt, Pseudomonas putida KT2440
gccucuucgcggguaagcccgcu

SEQ ID NO: 3556613 - RNA, 19 nt, Pseudomonas putida KT2440
gccucuucgcgggugaacc

SEQ ID NO: 3556614 - RNA, 15 nt, Pseudomonas putida KT2440
gccucuucggccagc

SEQ ID NO: 3556615 - RNA, 16 nt, Pseudomonas putida KT2440
gccucuucuucaaggc

SEQ ID NO: 3556616 - RNA, 13 nt, Pseudomonas putida KT2440
gccugaaacccau

SEQ ID NO: 3556617 - RNA, 19 nt, Pseudomonas putida KT2440
gccugaaucuugcgcgcca

SEQ ID NO: 3556618 - RNA, 20 nt, Pseudomonas putida KT2440
gccugaccggucagcccggc

SEQ ID NO: 3556619 - RNA, 14 nt, Pseudomonas putida KT2440
gccugaccugugcu

SEQ ID NO: 3556620 - RNA, 19 nt, Pseudomonas putida KT2440
gccugacgcagugcagccg

SEQ ID NO: 3556621 - RNA, 14 nt, Pseudomonas putida KT2440
gccugacgccgcca

SEQ ID NO: 3556622 - RNA, 19 nt, Pseudomonas putida KT2440
gccugacgccgccagcgcu

SEQ ID NO: 3556623 - RNA, 16 nt, Pseudomonas putida KT2440
gccugacgcgccgcca

SEQ ID NO: 3556624 - RNA, 13 nt, Pseudomonas putida KT2440
gccuggccugcag

SEQ ID NO: 3556625 - RNA, 14 nt, Pseudomonas putida KT2440
gccuggccugcaga

SEQ ID NO: 3556626 - RNA, 15 nt, Pseudomonas putida KT2440
gccuggccugcaugc

SEQ ID NO: 3556627 - RNA, 16 nt, Pseudomonas putida KT2440
gccuggccugcaugcu

SEQ ID NO: 3556628 - RNA, 17 nt, Pseudomonas putida KT2440
gccuggcgccugcgcca

SEQ ID NO: 3556629 - RNA, 19 nt, Pseudomonas putida KT2440
gccuggcgcuugaucagcc

SEQ ID NO: 3556630 - RNA, 23 nt, Pseudomonas putida KT2440
gccuggcgcuuggaaauguucaa

SEQ ID NO: 3556631 - RNA, 22 nt, Pseudomonas putida KT2440
gccuggcucaccuuaucggccg

SEQ ID NO: 3556632 - RNA, 20 nt, Pseudomonas putida KT2440
gccuggcucaggcgcuggcg

SEQ ID NO: 3556633 - RNA, 22 nt, Pseudomonas putida KT2440
gccuggcuuuccagguccuugc

SEQ ID NO: 3556634 - RNA, 16 nt, Pseudomonas putida KT2440
gccugggcgguccuuc

SEQ ID NO: 3556635 - RNA, 20 nt, Pseudomonas putida KT2440
gccugggcgguccuucaugc

SEQ ID NO: 3556636 - RNA, 20 nt, Pseudomonas putida KT2440
gccugggcgugaaagcagga

SEQ ID NO: 3556637 - RNA, 11 nt, Pseudomonas putida KT2440
gccugggcucg

SEQ ID NO: 3556638 - RNA, 22 nt, Pseudomonas putida KT2440
gccugggcugucgccuacagga

SEQ ID NO: 3556639 - RNA, 19 nt, Pseudomonas putida KT2440
gccuggggcaggcccggca

SEQ ID NO: 3556640 - RNA, 17 nt, Pseudomonas putida KT2440
gccugggggucgcccgc

SEQ ID NO: 3556641 - RNA, 20 nt, Pseudomonas putida KT2440
gccuggguacgccgaaauua

SEQ ID NO: 3556642 - RNA, 20 nt, Pseudomonas putida KT2440
gccugggucaaccccaggug

SEQ ID NO: 3556643 - RNA, 23 nt, Pseudomonas putida KT2440
gccugggucaaccccaggugcug

SEQ ID NO: 3556644 - RNA, 21 nt, Pseudomonas putida KT2440
gccuggguuuuaaccggcccu

SEQ ID NO: 3556645 - RNA, 23 nt, Pseudomonas putida KT2440
gccuggguuuuaaccggcccuga

SEQ ID NO: 3556646 - RNA, 15 nt, Pseudomonas putida KT2440
gccuggucgccgcca

SEQ ID NO: 3556647 - RNA, 13 nt, Pseudomonas putida KT2440
gccuggugccagc

SEQ ID NO: 3556648 - RNA, 22 nt, Pseudomonas putida KT2440
gccugguugcguucgucgaugu

SEQ ID NO: 3556649 - RNA, 16 nt, Pseudomonas putida KT2440
gccugguuuucgcucg

SEQ ID NO: 3556650 - RNA, 16 nt, Pseudomonas putida KT2440
gccuguacacagccca

SEQ ID NO: 3556651 - RNA, 20 nt, Pseudomonas putida KT2440
gccuguaggaauuucggcgu

SEQ ID NO: 3556652 - RNA, 13 nt, Pseudomonas putida KT2440
gccuguaggcgcg

SEQ ID NO: 3556653 - RNA, 13 nt, Pseudomonas putida KT2440
gccugucacgccu

SEQ ID NO: 3556654 - RNA, 13 nt, Pseudomonas putida KT2440
gccuguccgggcu

SEQ ID NO: 3556655 - RNA, 20 nt, Pseudomonas putida KT2440
gccugucgcgacgggcugcu

SEQ ID NO: 3556656 - RNA, 21 nt, Pseudomonas putida KT2440
gccugucgucagcucaggccu

SEQ ID NO: 3556657 - RNA, 19 nt, Pseudomonas putida KT2440
gccugucuagccgccugcc

SEQ ID NO: 3556658 - RNA, 21 nt, Pseudomonas putida KT2440
gccugugagaucgagcgccgc

SEQ ID NO: 3556659 - RNA, 16 nt, Pseudomonas putida KT2440
gccugugcauguccag

SEQ ID NO: 3556660 - RNA, 14 nt, Pseudomonas putida KT2440
gccugugccggccu

SEQ ID NO: 3556661 - RNA, 21 nt, Pseudomonas putida KT2440
gccugugccggccucuucgcg

SEQ ID NO: 3556662 - RNA, 15 nt, Pseudomonas putida KT2440
gccugugccgggcca

SEQ ID NO: 3556663 - RNA, 18 nt, Pseudomonas putida KT2440
gccugugccgguggggug

SEQ ID NO: 3556664 - RNA, 18 nt, Pseudomonas putida KT2440
gccugugcuggccucuuc

SEQ ID NO: 3556665 - RNA, 15 nt, Pseudomonas putida KT2440
gccuguggggcaacu

SEQ ID NO: 3556666 - RNA, 19 nt, Pseudomonas putida KT2440
gccuguggggcaacugcgc

SEQ ID NO: 3556667 - RNA, 18 nt, Pseudomonas putida KT2440
gccuguggguaacccugc

SEQ ID NO: 3556668 - RNA, 18 nt, Pseudomonas putida KT2440
gccuguguccaacacccg

SEQ ID NO: 3556669 - RNA, 13 nt, Pseudomonas putida KT2440
gccugugucgaac

SEQ ID NO: 3556670 - RNA, 17 nt, Pseudomonas putida KT2440
gccugugucgaaccccu

SEQ ID NO: 3556671 - RNA, 23 nt, Pseudomonas putida KT2440
gccuguguuuucccaauccucag

SEQ ID NO: 3556672 - RNA, 21 nt, Pseudomonas putida KT2440
gccuguuccggcccuuucgcg

SEQ ID NO: 3556673 - RNA, 22 nt, Pseudomonas putida KT2440
gccuguuccggcccuuucgcgg

SEQ ID NO: 3556674 - RNA, 13 nt, Pseudomonas putida KT2440
gccuuacaugugu

SEQ ID NO: 3556675 - RNA, 23 nt, Pseudomonas putida KT2440
gccuucaaacacuucaucucgcu

SEQ ID NO: 3556676 - RNA, 12 nt, Pseudomonas putida KT2440
gccuucaaccuc

SEQ ID NO: 3556677 - RNA, 16 nt, Pseudomonas putida KT2440
gccuucaaccucacug

SEQ ID NO: 3556678 - RNA, 17 nt, Pseudomonas putida KT2440
gccuucacacaggcugu

SEQ ID NO: 3556679 - RNA, 23 nt, Pseudomonas putida KT2440
gccuucagauaguccuuauccag

SEQ ID NO: 3556680 - RNA, 16 nt, Pseudomonas putida KT2440
gccuucagcagccggu

SEQ ID NO: 3556681 - RNA, 20 nt, Pseudomonas putida KT2440
gccuucagcaggcgcggcgu

SEQ ID NO: 3556682 - RNA, 23 nt, Pseudomonas putida KT2440
gccuucagcaggcgcggcguggc

SEQ ID NO: 3556683 - RNA, 17 nt, Pseudomonas putida KT2440
gccuucaggcgcugguu

SEQ ID NO: 3556684 - RNA, 19 nt, Pseudomonas putida KT2440
gccuucaggcgcugguuga

SEQ ID NO: 3556685 - RNA, 15 nt, Pseudomonas putida KT2440
gccuucagggccggu

SEQ ID NO: 3556686 - RNA, 18 nt, Pseudomonas putida KT2440
gccuucagugcuucacag

SEQ ID NO: 3556687 - RNA, 22 nt, Pseudomonas putida KT2440
gccuucauaggcggccacggcc

SEQ ID NO: 3556688 - RNA, 17 nt, Pseudomonas putida KT2440
gccuucaucgcugcgau

SEQ ID NO: 3556689 - RNA, 14 nt, Pseudomonas putida KT2440
gccuuccaaccagc

SEQ ID NO: 3556690 - RNA, 17 nt, Pseudomonas putida KT2440
gccuuccacccgccugc

SEQ ID NO: 3556691 - RNA, 20 nt, Pseudomonas putida KT2440
gccuuccagcuccuucuuca

SEQ ID NO: 3556692 - RNA, 15 nt, Pseudomonas putida KT2440
gccuucccgccuggc

SEQ ID NO: 3556693 - RNA, 20 nt, Pseudomonas putida KT2440
gccuucccgccuggcgccug

SEQ ID NO: 3556694 - RNA, 16 nt, Pseudomonas putida KT2440
gccuucccgucgagcc

SEQ ID NO: 3556695 - RNA, 21 nt, Pseudomonas putida KT2440
gccuucccucuguaacugcgc

SEQ ID NO: 3556696 - RNA, 16 nt, Pseudomonas putida KT2440
gccuuccggcccggca

SEQ ID NO: 3556697 - RNA, 13 nt, Pseudomonas putida KT2440
gccuuccgggaag

SEQ ID NO: 3556698 - RNA, 17 nt, Pseudomonas putida KT2440
gccuuccgggcacuggc

SEQ ID NO: 3556699 - RNA, 14 nt, Pseudomonas putida KT2440
gccuuccugcaccu

SEQ ID NO: 3556700 - RNA, 17 nt, Pseudomonas putida KT2440
gccuuccuucuuugaaa

SEQ ID NO: 3556701 - RNA, 20 nt, Pseudomonas putida KT2440
gccuucgaacaauucuucca

SEQ ID NO: 3556702 - RNA, 22 nt, Pseudomonas putida KT2440
gccuucgccaagguccagccac

SEQ ID NO: 3556703 - RNA, 16 nt, Pseudomonas putida KT2440
gccuucgccacugcca

SEQ ID NO: 3556704 - RNA, 18 nt, Pseudomonas putida KT2440
gccuucgcgaccgccauu

SEQ ID NO: 3556705 - RNA, 13 nt, Pseudomonas putida KT2440
gccuucgcgggcu

SEQ ID NO: 3556706 - RNA, 19 nt, Pseudomonas putida KT2440
gccuucgcgggcucgcccg

SEQ ID NO: 3556707 - RNA, 15 nt, Pseudomonas putida KT2440
gccuucgcgggcuuu

SEQ ID NO: 3556708 - RNA, 17 nt, Pseudomonas putida KT2440
gccuucggacucgacgu

SEQ ID NO: 3556709 - RNA, 13 nt, Pseudomonas putida KT2440
gccuucggugcug

SEQ ID NO: 3556710 - RNA, 22 nt, Pseudomonas putida KT2440
gccuucggugcuggcgcucaau

SEQ ID NO: 3556711 - RNA, 14 nt, Pseudomonas putida KT2440
gccuucgucgcugg

SEQ ID NO: 3556712 - RNA, 15 nt, Pseudomonas putida KT2440
gccuucgucgcuggc

SEQ ID NO: 3556713 - RNA, 16 nt, Pseudomonas putida KT2440
gccuucgucgcuggcc

SEQ ID NO: 3556714 - RNA, 14 nt, Pseudomonas putida KT2440
gccuucucuuccgc

SEQ ID NO: 3556715 - RNA, 19 nt, Pseudomonas putida KT2440
gccuucucuuccgccagcc

SEQ ID NO: 3556716 - RNA, 20 nt, Pseudomonas putida KT2440
gccuucugugauuuccagcg

SEQ ID NO: 3556717 - RNA, 12 nt, Pseudomonas putida KT2440
gccuucuucacg

SEQ ID NO: 3556718 - RNA, 22 nt, Pseudomonas putida KT2440
gccuucuucggucagcugguga

SEQ ID NO: 3556719 - RNA, 15 nt, Pseudomonas putida KT2440
gccuugaagcgcggc

SEQ ID NO: 3556720 - RNA, 17 nt, Pseudomonas putida KT2440
gccuugaagcuggccgu

SEQ ID NO: 3556721 - RNA, 18 nt, Pseudomonas putida KT2440
gccuugaagcuggccgug

SEQ ID NO: 3556722 - RNA, 20 nt, Pseudomonas putida KT2440
gccuugaagcuggccguggu

SEQ ID NO: 3556723 - RNA, 19 nt, Pseudomonas putida KT2440
gccuugaccagcuugugca

SEQ ID NO: 3556724 - RNA, 18 nt, Pseudomonas putida KT2440
gccuugauacgcccaucc

SEQ ID NO: 3556725 - RNA, 16 nt, Pseudomonas putida KT2440
gccuugaucaaugccc

SEQ ID NO: 3556726 - RNA, 19 nt, Pseudomonas putida KT2440
gccuugaucgucauggugg

SEQ ID NO: 3556727 - RNA, 15 nt, Pseudomonas putida KT2440
gccuugaucugcgcg

SEQ ID NO: 3556728 - RNA, 18 nt, Pseudomonas putida KT2440
gccuugauuaccagcgcc

SEQ ID NO: 3556729 - RNA, 23 nt, Pseudomonas putida KT2440
gcgaauacgauauccgcagcccc

SEQ ID NO: 3556730 - RNA, 14 nt, Pseudomonas putida KT2440
gcgaauacgcucag

SEQ ID NO: 3556731 - RNA, 16 nt, Pseudomonas putida KT2440
gcgaauacgguagcgg

SEQ ID NO: 3556732 - RNA, 20 nt, Pseudomonas putida KT2440
gcgaauacgguagcggcgga

SEQ ID NO: 3556733 - RNA, 20 nt, Pseudomonas putida KT2440
gcgaauacggucgcggcggc

SEQ ID NO: 3556734 - RNA, 15 nt, Pseudomonas putida KT2440
gcgaauagcaacaca

SEQ ID NO: 3556735 - RNA, 17 nt, Pseudomonas putida KT2440
gcgaaucagcaugccca

SEQ ID NO: 3556736 - RNA, 15 nt, Pseudomonas putida KT2440
gcgaaucagcgccuc

SEQ ID NO: 3556737 - RNA, 16 nt, Pseudomonas putida KT2440
gcgaauccagccggcc

SEQ ID NO: 3556738 - RNA, 19 nt, Pseudomonas putida KT2440
gcgaauccagccggcccgg

SEQ ID NO: 3556739 - RNA, 20 nt, Pseudomonas putida KT2440
gcgaauccagccggcccggc

SEQ ID NO: 3556740 - RNA, 11 nt, Pseudomonas putida KT2440
gcgaaucccgc

SEQ ID NO: 3556741 - RNA, 12 nt, Pseudomonas putida KT2440
gcgaaucugcau

SEQ ID NO: 3556742 - RNA, 19 nt, Pseudomonas putida KT2440
gcgaaugagaggcggguca

SEQ ID NO: 3556743 - RNA, 23 nt, Pseudomonas putida KT2440
gcgaaugaugaauaaugcuccag

SEQ ID NO: 3556744 - RNA, 15 nt, Pseudomonas putida KT2440
gcgaaugcgcucauc

SEQ ID NO: 3556745 - RNA, 12 nt, Pseudomonas putida KT2440
gcgaaugggccg

SEQ ID NO: 3556746 - RNA, 12 nt, Pseudomonas putida KT2440
gcgaaugggcug

SEQ ID NO: 3556747 - RNA, 16 nt, Pseudomonas putida KT2440
gcgaaugggcugcaaa

SEQ ID NO: 3556748 - RNA, 17 nt, Pseudomonas putida KT2440
gcgaauggguggcggca

SEQ ID NO: 3556749 - RNA, 15 nt, Pseudomonas putida KT2440
gcgacaaaggcgucg

SEQ ID NO: 3556750 - RNA, 12 nt, Pseudomonas putida KT2440
gcgacaaccgaa

SEQ ID NO: 3556751 - RNA, 20 nt, Pseudomonas putida KT2440
gcgacaaccgaaaaggccaa

SEQ ID NO: 3556752 - RNA, 12 nt, Pseudomonas putida KT2440
gcgacaccagcg

SEQ ID NO: 3556753 - RNA, 16 nt, Pseudomonas putida KT2440
gcgacacccuggucau

SEQ ID NO: 3556754 - RNA, 19 nt, Pseudomonas putida KT2440
gcgacacgcgaaucgccag

SEQ ID NO: 3556755 - RNA, 23 nt, Pseudomonas putida KT2440
gcgacacgcgaaucgccagggcu

SEQ ID NO: 3556756 - RNA, 16 nt, Pseudomonas putida KT2440
gcgacagacagggccu

SEQ ID NO: 3556757 - RNA, 21 nt, Pseudomonas putida KT2440
gcgacagcaucaucaggccga

SEQ ID NO: 3556758 - RNA, 20 nt, Pseudomonas putida KT2440
gcgacagcaucggcagguca

SEQ ID NO: 3556759 - RNA, 13 nt, Pseudomonas putida KT2440
gcgacagcucaag

SEQ ID NO: 3556760 - RNA, 15 nt, Pseudomonas putida KT2440
gcgacagcucaagcc

SEQ ID NO: 3556761 - RNA, 17 nt, Pseudomonas putida KT2440
gcgacagcucaagcccu

SEQ ID NO: 3556762 - RNA, 13 nt, Pseudomonas putida KT2440
gcgacaggcgucg

SEQ ID NO: 3556763 - RNA, 14 nt, Pseudomonas putida KT2440
gcgacaggcgucgg

SEQ ID NO: 3556764 - RNA, 17 nt, Pseudomonas putida KT2440
gcgacaggcgucggggc

SEQ ID NO: 3556765 - RNA, 23 nt, Pseudomonas putida KT2440
gcgacagguaguuggccgggccu

SEQ ID NO: 3556766 - RNA, 16 nt, Pseudomonas putida KT2440
gcgacaguucgccacc

SEQ ID NO: 3556767 - RNA, 15 nt, Pseudomonas putida KT2440
gcgacaugaucagcg

SEQ ID NO: 3556768 - RNA, 19 nt, Pseudomonas putida KT2440
gcgacaugaucagcggggu

SEQ ID NO: 3556769 - RNA, 16 nt, Pseudomonas putida KT2440
gcgaccaaguuuucgc

SEQ ID NO: 3556770 - RNA, 16 nt, Pseudomonas putida KT2440
gcgaccacacugcucg

SEQ ID NO: 3556771 - RNA, 15 nt, Pseudomonas putida KT2440
gcgaccaucaccgcc

SEQ ID NO: 3556772 - RNA, 19 nt, Pseudomonas putida KT2440
gcgacccauuugcagcaca

SEQ ID NO: 3556773 - RNA, 17 nt, Pseudomonas putida KT2440
gcgacccguccaguucc

SEQ ID NO: 3556774 - RNA, 17 nt, Pseudomonas putida KT2440
gcgaccgacacgcggca

SEQ ID NO: 3556775 - RNA, 12 nt, Pseudomonas putida KT2440
gcgaccgccauu

SEQ ID NO: 3556776 - RNA, 14 nt, Pseudomonas putida KT2440
gcgaccgccauuga

SEQ ID NO: 3556777 - RNA, 20 nt, Pseudomonas putida KT2440
gcgaccggcguguugccgcu

SEQ ID NO: 3556778 - RNA, 20 nt, Pseudomonas putida KT2440
gcgaccuucacgccagccgu

SEQ ID NO: 3556779 - RNA, 23 nt, Pseudomonas putida KT2440
gcgaccuucacgccagccguuga

SEQ ID NO: 3556780 - RNA, 18 nt, Pseudomonas putida KT2440
gcgaccuucgggucgccu

SEQ ID NO: 3556781 - RNA, 14 nt, Pseudomonas putida KT2440
gcgacgaaacccag

SEQ ID NO: 3556782 - RNA, 21 nt, Pseudomonas putida KT2440
gcgacgaagcugcuggcguca

SEQ ID NO: 3556783 - RNA, 16 nt, Pseudomonas putida KT2440
gcgacgaccugcacaa

SEQ ID NO: 3556784 - RNA, 16 nt, Pseudomonas putida KT2440
gcgacgaggccgagcg

SEQ ID NO: 3556785 - RNA, 23 nt, Pseudomonas putida KT2440
gcgacgaguuuaccuccaucacc

SEQ ID NO: 3556786 - RNA, 16 nt, Pseudomonas putida KT2440
gcgacgauaccggcgc

SEQ ID NO: 3556787 - RNA, 16 nt, Pseudomonas putida KT2440
gcgacgaugaucaggu

SEQ ID NO: 3556788 - RNA, 15 nt, Pseudomonas putida KT2440
gcgacgcaaggccgc

SEQ ID NO: 3556789 - RNA, 16 nt, Pseudomonas putida KT2440
gcgacgcaaggccgcu

SEQ ID NO: 3556790 - RNA, 14 nt, Pseudomonas putida KT2440
gcgacgcagcagcg

SEQ ID NO: 3556791 - RNA, 23 nt, Pseudomonas putida KT2440
gcgacgcgcuaccugugggagcg

SEQ ID NO: 3556792 - RNA, 12 nt, Pseudomonas putida KT2440
gcgacgcggcau

SEQ ID NO: 3556793 - RNA, 21 nt, Pseudomonas putida KT2440
gcgacgcgguggagggcaccg

SEQ ID NO: 3556794 - RNA, 15 nt, Pseudomonas putida KT2440
gcgacgcugcccagc

SEQ ID NO: 3556795 - RNA, 14 nt, Pseudomonas putida KT2440
gcgacgcugccgca

SEQ ID NO: 3556796 - RNA, 20 nt, Pseudomonas putida KT2440
gcgacgcugccgcaccugcc

SEQ ID NO: 3556797 - RNA, 22 nt, Pseudomonas putida KT2440
gcgacgcugccgcaccugccug

SEQ ID NO: 3556798 - RNA, 14 nt, Pseudomonas putida KT2440
gcgacggcgaauga

SEQ ID NO: 3556799 - RNA, 12 nt, Pseudomonas putida KT2440
gcgacgggaagu

SEQ ID NO: 3556800 - RNA, 20 nt, Pseudomonas putida KT2440
gcgacgggaagugcacugcc

SEQ ID NO: 3556801 - RNA, 14 nt, Pseudomonas putida KT2440
gcgacgggcugcuc

SEQ ID NO: 3556802 - RNA, 18 nt, Pseudomonas putida KT2440
gcgacgggcugcucccgc

SEQ ID NO: 3556803 - RNA, 18 nt, Pseudomonas putida KT2440
gcgacgugcccagaucac

SEQ ID NO: 3556804 - RNA, 16 nt, Pseudomonas putida KT2440
gcgacugaagcgcggg

SEQ ID NO: 3556805 - RNA, 17 nt, Pseudomonas putida KT2440
gcgacugaauacagcca

SEQ ID NO: 3556806 - RNA, 14 nt, Pseudomonas putida KT2440
gcgacugccaaugc

SEQ ID NO: 3556807 - RNA, 19 nt, Pseudomonas putida KT2440
gcgacugccaaugcucagu

SEQ ID NO: 3556808 - RNA, 16 nt, Pseudomonas putida KT2440
gcgacuucgaccacgg

SEQ ID NO: 3556809 - RNA, 13 nt, Pseudomonas putida KT2440
gcgacuucggcga

SEQ ID NO: 3556810 - RNA, 15 nt, Pseudomonas putida KT2440
gcgacuucggcgaua

SEQ ID NO: 3556811 - RNA, 22 nt, Pseudomonas putida KT2440
gcgacuugugcauccugcacug

SEQ ID NO: 3556812 - RNA, 16 nt, Pseudomonas putida KT2440
gcgagaaggcguggug

SEQ ID NO: 3556813 - RNA, 19 nt, Pseudomonas putida KT2440
gcgagaaugcugcgcagcu

SEQ ID NO: 3556814 - RNA, 15 nt, Pseudomonas putida KT2440
gcgagagcgacgcgc

SEQ ID NO: 3556815 - RNA, 16 nt, Pseudomonas putida KT2440
gcgagagcuucagacc

SEQ ID NO: 3556816 - RNA, 19 nt, Pseudomonas putida KT2440
gcgagagcuucagaccuga

SEQ ID NO: 3556817 - RNA, 22 nt, Pseudomonas putida KT2440
gcgagaggcgcuuuucaccucc

SEQ ID NO: 3556818 - RNA, 17 nt, Pseudomonas putida KT2440
gcgagaucgacaggggu

SEQ ID NO: 3556819 - RNA, 20 nt, Pseudomonas putida KT2440
gcgagcaagcucgcuccuac

SEQ ID NO: 3556820 - RNA, 13 nt, Pseudomonas putida KT2440
gcgagcaccggca

SEQ ID NO: 3556821 - RNA, 15 nt, Pseudomonas putida KT2440
gcgagcaggugaccc

SEQ ID NO: 3556822 - RNA, 16 nt, Pseudomonas putida KT2440
gcgagccacucggcaa

SEQ ID NO: 3556823 - RNA, 18 nt, Pseudomonas putida KT2440
gcgagccagaucauggcg

SEQ ID NO: 3556824 - RNA, 12 nt, Pseudomonas putida KT2440
gcgagcccgcgc

SEQ ID NO: 3556825 - RNA, 17 nt, Pseudomonas putida KT2440
gcgagcccgcgcgcgau

SEQ ID NO: 3556826 - RNA, 15 nt, Pseudomonas putida KT2440
gcgagcccggcgcca

SEQ ID NO: 3556827 - RNA, 18 nt, Pseudomonas putida KT2440
gcgagcccuuguccaggu

SEQ ID NO: 3556828 - RNA, 23 nt, Pseudomonas putida KT2440
gcgagccgcauuggccgggucga

SEQ ID NO: 3556829 - RNA, 13 nt, Pseudomonas putida KT2440
gcgagccgccaga

SEQ ID NO: 3556830 - RNA, 23 nt, Pseudomonas putida KT2440
gcgagccucuguuugcuggucag

SEQ ID NO: 3556831 - RNA, 21 nt, Pseudomonas putida KT2440
gcgagccuugccaacggcacu

SEQ ID NO: 3556832 - RNA, 13 nt, Pseudomonas putida KT2440
gcgagcgaacagc

SEQ ID NO: 3556833 - RNA, 14 nt, Pseudomonas putida KT2440
gcgagcgcgggcag

SEQ ID NO: 3556834 - RNA, 19 nt, Pseudomonas putida KT2440
gcgagcgguucagcgcacu

SEQ ID NO: 3556835 - RNA, 14 nt, Pseudomonas putida KT2440
gcgcaagccgcugu

SEQ ID NO: 3556836 - RNA, 18 nt, Pseudomonas putida KT2440
gcgcaagccgcugucggu

SEQ ID NO: 3556837 - RNA, 14 nt, Pseudomonas putida KT2440
gcgcaaggccgcgg

SEQ ID NO: 3556838 - RNA, 16 nt, Pseudomonas putida KT2440
gcgcaaggccgcggcu

SEQ ID NO: 3556839 - RNA, 14 nt, Pseudomonas putida KT2440
gcgcaaggcgaggu

SEQ ID NO: 3556840 - RNA, 13 nt, Pseudomonas putida KT2440
gcgcaaggggucg

SEQ ID NO: 3556841 - RNA, 16 nt, Pseudomonas putida KT2440
gcgcaaggggucgcgg

SEQ ID NO: 3556842 - RNA, 19 nt, Pseudomonas putida KT2440
gcgcaaugaaaaagccccu

SEQ ID NO: 3556843 - RNA, 18 nt, Pseudomonas putida KT2440
gcgcaaugcccagcgcgc

SEQ ID NO: 3556844 - RNA, 20 nt, Pseudomonas putida KT2440
gcgcaaugcccagcgcgccg

SEQ ID NO: 3556845 - RNA, 14 nt, Pseudomonas putida KT2440
gcgcaaugcgcccc

SEQ ID NO: 3556846 - RNA, 19 nt, Pseudomonas putida KT2440
gcgcaauugccggucgggc

SEQ ID NO: 3556847 - RNA, 13 nt, Pseudomonas putida KT2440
gcgcacaccgcug

SEQ ID NO: 3556848 - RNA, 16 nt, Pseudomonas putida KT2440
gcgcacaccgcuggug

SEQ ID NO: 3556849 - RNA, 22 nt, Pseudomonas putida KT2440
gcgcacaccgcugguggcgugg

SEQ ID NO: 3556850 - RNA, 17 nt, Pseudomonas putida KT2440
gcgcacacuucgccggu

SEQ ID NO: 3556851 - RNA, 17 nt, Pseudomonas putida KT2440
gcgcaccaaggcggcau

SEQ ID NO: 3556852 - RNA, 23 nt, Pseudomonas putida KT2440
gcgcaccacaucauccaugaagc

SEQ ID NO: 3556853 - RNA, 14 nt, Pseudomonas putida KT2440
gcgcaccaucggcu

SEQ ID NO: 3556854 - RNA, 20 nt, Pseudomonas putida KT2440
gcgcaccaucggcuccagcg

SEQ ID NO: 3556855 - RNA, 22 nt, Pseudomonas putida KT2440
gcgcaccgccggguugcucauc

SEQ ID NO: 3556856 - RNA, 14 nt, Pseudomonas putida KT2440
gcgcaccgcugacc

SEQ ID NO: 3556857 - RNA, 16 nt, Pseudomonas putida KT2440
gcgcaccgcugaccac

SEQ ID NO: 3556858 - RNA, 15 nt, Pseudomonas putida KT2440
gcgcaccucgaccgc

SEQ ID NO: 3556859 - RNA, 17 nt, Pseudomonas putida KT2440
gcgcaccuuggcgucca

SEQ ID NO: 3556860 - RNA, 20 nt, Pseudomonas putida KT2440
gcgcaccuuguauucgagcu

SEQ ID NO: 3556861 - RNA, 18 nt, Pseudomonas putida KT2440
gcgcacgaauacgcucga

SEQ ID NO: 3556862 - RNA, 20 nt, Pseudomonas putida KT2440
gcgcacgacccguacuuuuc

SEQ ID NO: 3556863 - RNA, 14 nt, Pseudomonas putida KT2440
gcgcacgcaucugc

SEQ ID NO: 3556864 - RNA, 16 nt, Pseudomonas putida KT2440
gcgcacgcgcucugca

SEQ ID NO: 3556865 - RNA, 21 nt, Pseudomonas putida KT2440
gcgcacgcgcuuuuccagcaa

SEQ ID NO: 3556866 - RNA, 23 nt, Pseudomonas putida KT2440
gcgcacgcgcuuuuccagcaaag

SEQ ID NO: 3556867 - RNA, 14 nt, Pseudomonas putida KT2440
gcgcacgcugccca

SEQ ID NO: 3556868 - RNA, 15 nt, Pseudomonas putida KT2440
gcgcacgcugcccag

SEQ ID NO: 3556869 - RNA, 18 nt, Pseudomonas putida KT2440
gcgcacggaaggcaucga

SEQ ID NO: 3556870 - RNA, 21 nt, Pseudomonas putida KT2440
gcgcacggcaucggccgagcc

SEQ ID NO: 3556871 - RNA, 14 nt, Pseudomonas putida KT2440
gcgcacggccucca

SEQ ID NO: 3556872 - RNA, 17 nt, Pseudomonas putida KT2440
gcgcacgucucgggaau

SEQ ID NO: 3556873 - RNA, 17 nt, Pseudomonas putida KT2440
gcgcacucucccgcagc

SEQ ID NO: 3556874 - RNA, 18 nt, Pseudomonas putida KT2440
gcgcacucucccgcagcc

SEQ ID NO: 3556875 - RNA, 15 nt, Pseudomonas putida KT2440
gcgcacugagcaacg

SEQ ID NO: 3556876 - RNA, 18 nt, Pseudomonas putida KT2440
gcgcacugccgccggugu

SEQ ID NO: 3556877 - RNA, 18 nt, Pseudomonas putida KT2440
gcgcacuuccacacccag

SEQ ID NO: 3556878 - RNA, 15 nt, Pseudomonas putida KT2440
gcgcacuugccagcc

SEQ ID NO: 3556879 - RNA, 19 nt, Pseudomonas putida KT2440
gcgcacuugccagccgccc

SEQ ID NO: 3556880 - RNA, 18 nt, Pseudomonas putida KT2440
gcgcacuuguuccagccg

SEQ ID NO: 3556881 - RNA, 20 nt, Pseudomonas putida KT2440
gcgcacuuguuccagccgcg

SEQ ID NO: 3556882 - RNA, 13 nt, Pseudomonas putida KT2440
gcgcagagcgccc

SEQ ID NO: 3556883 - RNA, 15 nt, Pseudomonas putida KT2440
gcgcagagcgccccg

SEQ ID NO: 3556884 - RNA, 12 nt, Pseudomonas putida KT2440
gcgcagauggug

SEQ ID NO: 3556885 - RNA, 19 nt, Pseudomonas putida KT2440
gcgcagcaauacgcacagg

SEQ ID NO: 3556886 - RNA, 18 nt, Pseudomonas putida KT2440
gcgcagcacaaggcugcg

SEQ ID NO: 3556887 - RNA, 23 nt, Pseudomonas putida KT2440
gcgcagcacaucacacagcggca

SEQ ID NO: 3556888 - RNA, 18 nt, Pseudomonas putida KT2440
gcgcagcaccgugggcgc

SEQ ID NO: 3556889 - RNA, 13 nt, Pseudomonas putida KT2440
gcgcagcacuucc

SEQ ID NO: 3556890 - RNA, 15 nt, Pseudomonas putida KT2440
gcgcagcagcucccg

SEQ ID NO: 3556891 - RNA, 14 nt, Pseudomonas putida KT2440
gcgcagcaggucca

SEQ ID NO: 3556892 - RNA, 22 nt, Pseudomonas putida KT2440
gcgcagcagguccagcuccggu

SEQ ID NO: 3556893 - RNA, 22 nt, Pseudomonas putida KT2440
gcgcagcaucuuccugccacuc

SEQ ID NO: 3556894 - RNA, 18 nt, Pseudomonas putida KT2440
gcgcagccaaucggcgcc

SEQ ID NO: 3556895 - RNA, 15 nt, Pseudomonas putida KT2440
gcgcagccaccagcu

SEQ ID NO: 3556896 - RNA, 18 nt, Pseudomonas putida KT2440
gcgcagcccaaacagcau

SEQ ID NO: 3556897 - RNA, 12 nt, Pseudomonas putida KT2440
gcgcagcccugu

SEQ ID NO: 3556898 - RNA, 20 nt, Pseudomonas putida KT2440
gcgcagcccugucacgacag

SEQ ID NO: 3556899 - RNA, 14 nt, Pseudomonas putida KT2440
gcgcagccggccuu

SEQ ID NO: 3556900 - RNA, 22 nt, Pseudomonas putida KT2440
gcgcagccggccuugcuccagu

SEQ ID NO: 3556901 - RNA, 11 nt, Pseudomonas putida KT2440
gcgcagcgaac

SEQ ID NO: 3556902 - RNA, 11 nt, Pseudomonas putida KT2440
gcgcagcgcag

SEQ ID NO: 3556903 - RNA, 17 nt, Pseudomonas putida KT2440
gcgcagcgcaugcucgc

SEQ ID NO: 3556904 - RNA, 13 nt, Pseudomonas putida KT2440
gcgcagcggcccc

SEQ ID NO: 3556905 - RNA, 20 nt, Pseudomonas putida KT2440
gcgcagcggccccuuucacg

SEQ ID NO: 3556906 - RNA, 20 nt, Pseudomonas putida KT2440
gcgcagcggcgucaccuucc

SEQ ID NO: 3556907 - RNA, 15 nt, Pseudomonas putida KT2440
gcgcaggaacaggcu

SEQ ID NO: 3556908 - RNA, 19 nt, Pseudomonas putida KT2440
gcgcaggaacaggcugaug

SEQ ID NO: 3556909 - RNA, 14 nt, Pseudomonas putida KT2440
gcgcaggaagaagg

SEQ ID NO: 3556910 - RNA, 16 nt, Pseudomonas putida KT2440
gcgcaggaagucuucc

SEQ ID NO: 3556911 - RNA, 18 nt, Pseudomonas putida KT2440
gcgcaggauauccacacc

SEQ ID NO: 3556912 - RNA, 13 nt, Pseudomonas putida KT2440
gcgcaggcagcga

SEQ ID NO: 3556913 - RNA, 13 nt, Pseudomonas putida KT2440
gcgcaggcagcuc

SEQ ID NO: 3556914 - RNA, 18 nt, Pseudomonas putida KT2440
gcgcaggccgacaacagc

SEQ ID NO: 3556915 - RNA, 18 nt, Pseudomonas putida KT2440
gcgcaggcgccgccagcu

SEQ ID NO: 3556916 - RNA, 12 nt, Pseudomonas putida KT2440
gcgcaggcggcu

SEQ ID NO: 3556917 - RNA, 20 nt, Pseudomonas putida KT2440
gcgcaggcgguucaaaucuu

SEQ ID NO: 3556918 - RNA, 19 nt, Pseudomonas putida KT2440
gcgcaggcugucgaacagg

SEQ ID NO: 3556919 - RNA, 19 nt, Pseudomonas putida KT2440
gcgcaggcuuucggccacc

SEQ ID NO: 3556920 - RNA, 12 nt, Pseudomonas putida KT2440
gcgcaggggucu

SEQ ID NO: 3556921 - RNA, 18 nt, Pseudomonas putida KT2440
gcgcagggugccggccag

SEQ ID NO: 3556922 - RNA, 20 nt, Pseudomonas putida KT2440
gcgcagggugccggccagcg

SEQ ID NO: 3556923 - RNA, 17 nt, Pseudomonas putida KT2440
gcgcaggguggcgcuga

SEQ ID NO: 3556924 - RNA, 20 nt, Pseudomonas putida KT2440
gcgcaggguggcgcugacca

SEQ ID NO: 3556925 - RNA, 15 nt, Pseudomonas putida KT2440
gcgcagggugucggu

SEQ ID NO: 3556926 - RNA, 23 nt, Pseudomonas putida KT2440
gcgcagggugucgguggcggcca

SEQ ID NO: 3556927 - RNA, 23 nt, Pseudomonas putida KT2440
gcgcagguacgccaugugcgccc

SEQ ID NO: 3556928 - RNA, 15 nt, Pseudomonas putida KT2440
gcgcagguccaggcg

SEQ ID NO: 3556929 - RNA, 16 nt, Pseudomonas putida KT2440
gcgcagguccaggcgc

SEQ ID NO: 3556930 - RNA, 18 nt, Pseudomonas putida KT2440
gcgcagguccaggcgcaa

SEQ ID NO: 3556931 - RNA, 17 nt, Pseudomonas putida KT2440
gcgcaggucgacaugca

SEQ ID NO: 3556932 - RNA, 15 nt, Pseudomonas putida KT2440
gcgcaggugcagcca

SEQ ID NO: 3556933 - RNA, 17 nt, Pseudomonas putida KT2440
gcgcaggugcagccagc

SEQ ID NO: 3556934 - RNA, 21 nt, Pseudomonas putida KT2440
gcgcaggugcagccagcccca

SEQ ID NO: 3556935 - RNA, 19 nt, Pseudomonas putida KT2440
gcgcagguuguucggcagg

SEQ ID NO: 3556936 - RNA, 15 nt, Pseudomonas putida KT2440
gcgcaguaacaggcg

SEQ ID NO: 3556937 - RNA, 17 nt, Pseudomonas putida KT2440
gcgcaguacaggcugcc

SEQ ID NO: 3556938 - RNA, 22 nt, Pseudomonas putida KT2440
gcgcagucaccacacggcagcc

SEQ ID NO: 3556939 - RNA, 15 nt, Pseudomonas putida KT2440
gcgcaguucguccag

SEQ ID NO: 3556940 - RNA, 18 nt, Pseudomonas putida KT2440
gcgcaguucguccaggcu

SEQ ID NO: 3556941 - RNA, 23 nt, Pseudomonas putida KT2440
gcgccaucggcacgccagcagcg

SEQ ID NO: 3556942 - RNA, 17 nt, Pseudomonas putida KT2440
gcgccaucuucacggca

SEQ ID NO: 3556943 - RNA, 18 nt, Pseudomonas putida KT2440
gcgccaugagugcaggca

SEQ ID NO: 3556944 - RNA, 15 nt, Pseudomonas putida KT2440
gcgccauggccuggc

SEQ ID NO: 3556945 - RNA, 15 nt, Pseudomonas putida KT2440
gcgccauuggccgcg

SEQ ID NO: 3556946 - RNA, 20 nt, Pseudomonas putida KT2440
gcgccauuggccgcgcgccc

SEQ ID NO: 3556947 - RNA, 18 nt, Pseudomonas putida KT2440
gcgcccaaggucagccag

SEQ ID NO: 3556948 - RNA, 19 nt, Pseudomonas putida KT2440
gcgcccaaucggguaaaac

SEQ ID NO: 3556949 - RNA, 14 nt, Pseudomonas putida KT2440
gcgcccaaugcagc

SEQ ID NO: 3556950 - RNA, 17 nt, Pseudomonas putida KT2440
gcgcccaaugcagccgc

SEQ ID NO: 3556951 - RNA, 21 nt, Pseudomonas putida KT2440
gcgcccaccgguuugaagcca

SEQ ID NO: 3556952 - RNA, 15 nt, Pseudomonas putida KT2440
gcgcccacgcggguc

SEQ ID NO: 3556953 - RNA, 22 nt, Pseudomonas putida KT2440
gcgcccacgcggguccagcgcg

SEQ ID NO: 3556954 - RNA, 12 nt, Pseudomonas putida KT2440
gcgcccagaaca

SEQ ID NO: 3556955 - RNA, 20 nt, Pseudomonas putida KT2440
gcgcccagaacacggugaca

SEQ ID NO: 3556956 - RNA, 10 nt, Pseudomonas putida KT2440
gcgcccagau

SEQ ID NO: 3556957 - RNA, 15 nt, Pseudomonas putida KT2440
gcgcccagaucagca

SEQ ID NO: 3556958 - RNA, 13 nt, Pseudomonas putida KT2440
gcgcccagcaaca

SEQ ID NO: 3556959 - RNA, 13 nt, Pseudomonas putida KT2440
gcgcccaggccca

SEQ ID NO: 3556960 - RNA, 22 nt, Pseudomonas putida KT2440
gcgccccaagcgggccaagguc

SEQ ID NO: 3556961 - RNA, 15 nt, Pseudomonas putida KT2440
gcgccccagguugca

SEQ ID NO: 3556962 - RNA, 16 nt, Pseudomonas putida KT2440
gcgccccccaggcggu

SEQ ID NO: 3556963 - RNA, 22 nt, Pseudomonas putida KT2440
gcgcccccugggcgucaaaguu

SEQ ID NO: 3556964 - RNA, 23 nt, Pseudomonas putida KT2440
gcgccccgccgcauccuggucac

SEQ ID NO: 3556965 - RNA, 14 nt, Pseudomonas putida KT2440
gcgccccggcgaua

SEQ ID NO: 3556966 - RNA, 17 nt, Pseudomonas putida KT2440
gcgcccgcaacagaucc

SEQ ID NO: 3556967 - RNA, 22 nt, Pseudomonas putida KT2440
gcgcccgcaaccucggccgcau

SEQ ID NO: 3556968 - RNA, 13 nt, Pseudomonas putida KT2440
gcgcccgcacagc

SEQ ID NO: 3556969 - RNA, 14 nt, Pseudomonas putida KT2440
gcgcccgcacagca

SEQ ID NO: 3556970 - RNA, 19 nt, Pseudomonas putida KT2440
gcgcccgcccaccaccagc

SEQ ID NO: 3556971 - RNA, 20 nt, Pseudomonas putida KT2440
gcgcccgcccaccaccagcc

SEQ ID NO: 3556972 - RNA, 21 nt, Pseudomonas putida KT2440
gcgcccgccccucgucacuga

SEQ ID NO: 3556973 - RNA, 13 nt, Pseudomonas putida KT2440
gcgcccgcggccc

SEQ ID NO: 3556974 - RNA, 18 nt, Pseudomonas putida KT2440
gcgcccgcggcccacagu

SEQ ID NO: 3556975 - RNA, 21 nt, Pseudomonas putida KT2440
gcgcccgcugcgccgcucugc

SEQ ID NO: 3556976 - RNA, 21 nt, Pseudomonas putida KT2440
gcgcccggcaaacacauccac

SEQ ID NO: 3556977 - RNA, 16 nt, Pseudomonas putida KT2440
gcgcccggccagguca

SEQ ID NO: 3556978 - RNA, 13 nt, Pseudomonas putida KT2440
gcgcccggcgcag

SEQ ID NO: 3556979 - RNA, 15 nt, Pseudomonas putida KT2440
gcgcccggcgcagca

SEQ ID NO: 3556980 - RNA, 18 nt, Pseudomonas putida KT2440
gcgcccggcgcuggugca

SEQ ID NO: 3556981 - RNA, 19 nt, Pseudomonas putida KT2440
gcgcccggcuugcccgggc

SEQ ID NO: 3556982 - RNA, 16 nt, Pseudomonas putida KT2440
gcgcccgggccaugcu

SEQ ID NO: 3556983 - RNA, 22 nt, Pseudomonas putida KT2440
gcgcccgguggcgcggccgggc

SEQ ID NO: 3556984 - RNA, 21 nt, Pseudomonas putida KT2440
gcgcccguuacguaagucagg

SEQ ID NO: 3556985 - RNA, 22 nt, Pseudomonas putida KT2440
gcgcccuccaucaaucgcucga

SEQ ID NO: 3556986 - RNA, 13 nt, Pseudomonas putida KT2440
gcgcccugcgcca

SEQ ID NO: 3556987 - RNA, 12 nt, Pseudomonas putida KT2440
gcgcccugcuca

SEQ ID NO: 3556988 - RNA, 20 nt, Pseudomonas putida KT2440
gcgcccugcugccgcaccuc

SEQ ID NO: 3556989 - RNA, 17 nt, Pseudomonas putida KT2440
gcgcccuggcaugcuga

SEQ ID NO: 3556990 - RNA, 15 nt, Pseudomonas putida KT2440
gcgcccuggcggcca

SEQ ID NO: 3556991 - RNA, 19 nt, Pseudomonas putida KT2440
gcgcccuggcggccacggc

SEQ ID NO: 3556992 - RNA, 15 nt, Pseudomonas putida KT2440
gcgcccugggcgccg

SEQ ID NO: 3556993 - RNA, 18 nt, Pseudomonas putida KT2440
gcgcccugggcgccgguu

SEQ ID NO: 3556994 - RNA, 12 nt, Pseudomonas putida KT2440
gcgcccuguggg

SEQ ID NO: 3556995 - RNA, 20 nt, Pseudomonas putida KT2440
gcgcccugugggagcggccu

SEQ ID NO: 3556996 - RNA, 21 nt, Pseudomonas putida KT2440
gcgcccugugggagcggccuu

SEQ ID NO: 3556997 - RNA, 15 nt, Pseudomonas putida KT2440
gcgcccuucgcggaa

SEQ ID NO: 3556998 - RNA, 20 nt, Pseudomonas putida KT2440
gcgcccuugcggaccaccug

SEQ ID NO: 3556999 - RNA, 18 nt, Pseudomonas putida KT2440
gcgccgaacgaauagccg

SEQ ID NO: 3557000 - RNA, 18 nt, Pseudomonas putida KT2440
gcgccgaccaagcgcccc

SEQ ID NO: 3557001 - RNA, 13 nt, Pseudomonas putida KT2440
gcgccgaccagua

SEQ ID NO: 3557002 - RNA, 19 nt, Pseudomonas putida KT2440
gcgccgaccaguaccacag

SEQ ID NO: 3557003 - RNA, 20 nt, Pseudomonas putida KT2440
gcgccgaccaguaccacagc

SEQ ID NO: 3557004 - RNA, 15 nt, Pseudomonas putida KT2440
gcgccgacccugugg

SEQ ID NO: 3557005 - RNA, 23 nt, Pseudomonas putida KT2440
gcgccgaccgaaccggcgcuggc

SEQ ID NO: 3557006 - RNA, 14 nt, Pseudomonas putida KT2440
gcgccgagaggcgc

SEQ ID NO: 3557007 - RNA, 17 nt, Pseudomonas putida KT2440
gcgccgagaggcgcugc

SEQ ID NO: 3557008 - RNA, 23 nt, Pseudomonas putida KT2440
gcgccgagcgagugaccuuggcu

SEQ ID NO: 3557009 - RNA, 14 nt, Pseudomonas putida KT2440
gcgccgagcgcggc

SEQ ID NO: 3557010 - RNA, 15 nt, Pseudomonas putida KT2440
gcgccgagcgcggcg

SEQ ID NO: 3557011 - RNA, 22 nt, Pseudomonas putida KT2440
gcgccgaugaagcaggccgagu

SEQ ID NO: 3557012 - RNA, 20 nt, Pseudomonas putida KT2440
gcgccgaugaguugucugcc

SEQ ID NO: 3557013 - RNA, 19 nt, Pseudomonas putida KT2440
gcgccgaugcucgucagcc

SEQ ID NO: 3557014 - RNA, 18 nt, Pseudomonas putida KT2440
gcgccgauugcugccgac

SEQ ID NO: 3557015 - RNA, 20 nt, Pseudomonas putida KT2440
gcgccgauugcugccgaccu

SEQ ID NO: 3557016 - RNA, 12 nt, Pseudomonas putida KT2440
gcgccgcaucca

SEQ ID NO: 3557017 - RNA, 15 nt, Pseudomonas putida KT2440
gcgccgcauccagca

SEQ ID NO: 3557018 - RNA, 16 nt, Pseudomonas putida KT2440
gcgccgcauccagcac

SEQ ID NO: 3557019 - RNA, 23 nt, Pseudomonas putida KT2440
gcgccgcaucgccacgggcguga

SEQ ID NO: 3557020 - RNA, 21 nt, Pseudomonas putida KT2440
gcgccgccaacucgccauuca

SEQ ID NO: 3557021 - RNA, 13 nt, Pseudomonas putida KT2440
gcgccgccacauc

SEQ ID NO: 3557022 - RNA, 16 nt, Pseudomonas putida KT2440
gcgccgccacauccag

SEQ ID NO: 3557023 - RNA, 21 nt, Pseudomonas putida KT2440
gcgccgccacauccagcgccu

SEQ ID NO: 3557024 - RNA, 21 nt, Pseudomonas putida KT2440
gcgccgccaccugcggcaggu

SEQ ID NO: 3557025 - RNA, 14 nt, Pseudomonas putida KT2440
gcgccgccagcugc

SEQ ID NO: 3557026 - RNA, 13 nt, Pseudomonas putida KT2440
gcgccgccaggca

SEQ ID NO: 3557027 - RNA, 14 nt, Pseudomonas putida KT2440
gcgccgccaggcag

SEQ ID NO: 3557028 - RNA, 15 nt, Pseudomonas putida KT2440
gcgccgccaggcagc

SEQ ID NO: 3557029 - RNA, 13 nt, Pseudomonas putida KT2440
gcgccgccaggcg

SEQ ID NO: 3557030 - RNA, 14 nt, Pseudomonas putida KT2440
gcgccgccaggcgg

SEQ ID NO: 3557031 - RNA, 11 nt, Pseudomonas putida KT2440
gcgccgccaug

SEQ ID NO: 3557032 - RNA, 18 nt, Pseudomonas putida KT2440
gcgccgccaugcagcccg

SEQ ID NO: 3557033 - RNA, 22 nt, Pseudomonas putida KT2440
gcgccgcccaauacgcaccgcu

SEQ ID NO: 3557034 - RNA, 14 nt, Pseudomonas putida KT2440
gcgccgcccagcuc

SEQ ID NO: 3557035 - RNA, 17 nt, Pseudomonas putida KT2440
gcgccgcccagcucuuu

SEQ ID NO: 3557036 - RNA, 19 nt, Pseudomonas putida KT2440
gcgccgcccaguaccgggg

SEQ ID NO: 3557037 - RNA, 17 nt, Pseudomonas putida KT2440
gcgccgcccgcgcggcg

SEQ ID NO: 3557038 - RNA, 13 nt, Pseudomonas putida KT2440
gcgccgccgcauc

SEQ ID NO: 3557039 - RNA, 18 nt, Pseudomonas putida KT2440
gcgccgccgcauccucgu

SEQ ID NO: 3557040 - RNA, 13 nt, Pseudomonas putida KT2440
gcgccgccgcugc

SEQ ID NO: 3557041 - RNA, 16 nt, Pseudomonas putida KT2440
gcgccgcgcgggcggc

SEQ ID NO: 3557042 - RNA, 17 nt, Pseudomonas putida KT2440
gcgccgcucgcccagca

SEQ ID NO: 3557043 - RNA, 21 nt, Pseudomonas putida KT2440
gcgccgcucugcccgcgccac

SEQ ID NO: 3557044 - RNA, 12 nt, Pseudomonas putida KT2440
gcgccgcugcuc

SEQ ID NO: 3557045 - RNA, 22 nt, Pseudomonas putida KT2440
gcgccggacuucuucaacgcgg

SEQ ID NO: 3557046 - RNA, 21 nt, Pseudomonas putida KT2440
gcgccggauuucuuccauggc

SEQ ID NO: 3557047 - RNA, 20 nt, Pseudomonas putida KT2440
gcgcgcccgcucccacaggu

SEQ ID NO: 3557048 - RNA, 15 nt, Pseudomonas putida KT2440
gcgcgccgccaggcg

SEQ ID NO: 3557049 - RNA, 14 nt, Pseudomonas putida KT2440
gcgcgccgccuucg

SEQ ID NO: 3557050 - RNA, 15 nt, Pseudomonas putida KT2440
gcgcgccuccagcug

SEQ ID NO: 3557051 - RNA, 17 nt, Pseudomonas putida KT2440
gcgcgccugcaccugac

SEQ ID NO: 3557052 - RNA, 20 nt, Pseudomonas putida KT2440
gcgcgccuggguggcgcggu

SEQ ID NO: 3557053 - RNA, 15 nt, Pseudomonas putida KT2440
gcgcgcgaaggcccg

SEQ ID NO: 3557054 - RNA, 13 nt, Pseudomonas putida KT2440
gcgcgcgggcucu

SEQ ID NO: 3557055 - RNA, 20 nt, Pseudomonas putida KT2440
gcgcgcugaaguagcgcaga

SEQ ID NO: 3557056 - RNA, 14 nt, Pseudomonas putida KT2440
gcgcgcugcugggc

SEQ ID NO: 3557057 - RNA, 17 nt, Pseudomonas putida KT2440
gcgcgcugugcucagca

SEQ ID NO: 3557058 - RNA, 17 nt, Pseudomonas putida KT2440
gcgcgcuucagggucgg

SEQ ID NO: 3557059 - RNA, 19 nt, Pseudomonas putida KT2440
gcgcggaacacacgcuccg

SEQ ID NO: 3557060 - RNA, 17 nt, Pseudomonas putida KT2440
gcgcggaacgucguugc

SEQ ID NO: 3557061 - RNA, 22 nt, Pseudomonas putida KT2440
gcgcggcaaagguggcaccgcc

SEQ ID NO: 3557062 - RNA, 22 nt, Pseudomonas putida KT2440
gcgcggcaaccugcucgcucag

SEQ ID NO: 3557063 - RNA, 13 nt, Pseudomonas putida KT2440
gcgcggcaaggug

SEQ ID NO: 3557064 - RNA, 18 nt, Pseudomonas putida KT2440
gcgcggcacaacgcgcca

SEQ ID NO: 3557065 - RNA, 13 nt, Pseudomonas putida KT2440
gcgcggcagcccu

SEQ ID NO: 3557066 - RNA, 21 nt, Pseudomonas putida KT2440
gcgcggcagcccuucgcgggc

SEQ ID NO: 3557067 - RNA, 23 nt, Pseudomonas putida KT2440
gcgcggcauguagccacgcugcc

SEQ ID NO: 3557068 - RNA, 21 nt, Pseudomonas putida KT2440
gcgcggccgccuccugcugcu

SEQ ID NO: 3557069 - RNA, 16 nt, Pseudomonas putida KT2440
gcgcggccugcuccac

SEQ ID NO: 3557070 - RNA, 22 nt, Pseudomonas putida KT2440
gcgcggcgaucaacgcaggcuc

SEQ ID NO: 3557071 - RNA, 14 nt, Pseudomonas putida KT2440
gcgcggcgcccagc

SEQ ID NO: 3557072 - RNA, 22 nt, Pseudomonas putida KT2440
gcgcggcucgcugcgcuggcca

SEQ ID NO: 3557073 - RNA, 19 nt, Pseudomonas putida KT2440
gcgcggcuugcucgcggcg

SEQ ID NO: 3557074 - RNA, 23 nt, Pseudomonas putida KT2440
gcgcggcuugcucgcggcgcagg

SEQ ID NO: 3557075 - RNA, 19 nt, Pseudomonas putida KT2440
gcgcgggcacccuggcggu

SEQ ID NO: 3557076 - RNA, 14 nt, Pseudomonas putida KT2440
gcgcgggcggcgcu

SEQ ID NO: 3557077 - RNA, 22 nt, Pseudomonas putida KT2440
gcgcggguaaauguucucgccg

SEQ ID NO: 3557078 - RNA, 17 nt, Pseudomonas putida KT2440
gcgcgggucuuccacca

SEQ ID NO: 3557079 - RNA, 18 nt, Pseudomonas putida KT2440
gcgcgggugcgagaggcg

SEQ ID NO: 3557080 - RNA, 19 nt, Pseudomonas putida KT2440
gcgcgggugcgagaggcgc

SEQ ID NO: 3557081 - RNA, 20 nt, Pseudomonas putida KT2440
gcgcggguuuacccgcgaag

SEQ ID NO: 3557082 - RNA, 15 nt, Pseudomonas putida KT2440
gcgcggguuugcccg

SEQ ID NO: 3557083 - RNA, 19 nt, Pseudomonas putida KT2440
gcgcggguuugcccgcgaa

SEQ ID NO: 3557084 - RNA, 20 nt, Pseudomonas putida KT2440
gcgcggguuugcccgcgaag

SEQ ID NO: 3557085 - RNA, 19 nt, Pseudomonas putida KT2440
gcgcggugcggcguagacc

SEQ ID NO: 3557086 - RNA, 19 nt, Pseudomonas putida KT2440
gcgcgguuaagcgccacca

SEQ ID NO: 3557087 - RNA, 22 nt, Pseudomonas putida KT2440
gcgcgguuaagcgccaccaccg

SEQ ID NO: 3557088 - RNA, 18 nt, Pseudomonas putida KT2440
gcgcguaaaucccgcagg

SEQ ID NO: 3557089 - RNA, 15 nt, Pseudomonas putida KT2440
gcgcguacagcgaca

SEQ ID NO: 3557090 - RNA, 18 nt, Pseudomonas putida KT2440
gcgcguaguacuccagca
